United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 68

SEQ ID NO: 3095457 - RNA, 14 nt, Molluscum contagiosum virus
gcggcaggcgcugc

SEQ ID NO: 3095458 - RNA, 19 nt, Molluscum contagiosum virus
gcccgaggagagcggcgcc

SEQ ID NO: 3095459 - RNA, 17 nt, Molluscum contagiosum virus
cgcgcugcucuggagca

SEQ ID NO: 3095460 - RNA, 16 nt, Molluscum contagiosum virus
gcacagaaagccaacg

SEQ ID NO: 3095461 - RNA, 19 nt, Molluscum contagiosum virus
cggagcuggccacucucgc

SEQ ID NO: 3095462 - RNA, 12 nt, Molluscum contagiosum virus
acgccggcaagc

SEQ ID NO: 3095463 - RNA, 21 nt, Molluscum contagiosum virus
acugaaaacuuaucccagaaa

SEQ ID NO: 3095464 - RNA, 16 nt, Molluscum contagiosum virus
uggucucgcugcuggg

SEQ ID NO: 3095465 - RNA, 13 nt, Molluscum contagiosum virus
ugcuggcgggcgc

SEQ ID NO: 3095466 - RNA, 15 nt, Molluscum contagiosum virus
gcagacuaagaacgu

SEQ ID NO: 3095467 - RNA, 19 nt, Molluscum contagiosum virus
augccuuucaggggucugu

SEQ ID NO: 3095468 - RNA, 17 nt, Molluscum contagiosum virus
gcugcggcugcugccug

SEQ ID NO: 3095469 - RNA, 19 nt, Molluscum contagiosum virus
cgcgcaagaacaaccagac

SEQ ID NO: 3095470 - RNA, 16 nt, Molluscum contagiosum virus
acaugccgcgcugcuc

SEQ ID NO: 3095471 - RNA, 12 nt, Molluscum contagiosum virus
cgcgcugcucuc

SEQ ID NO: 3095472 - RNA, 20 nt, Molluscum contagiosum virus
ggugcaaccgcugcucgaca

SEQ ID NO: 3095473 - RNA, 17 nt, Molluscum contagiosum virus
ugcuggcggggcuggca

SEQ ID NO: 3095474 - RNA, 15 nt, Molluscum contagiosum virus
gucgcgcgcugugga

SEQ ID NO: 3095475 - RNA, 14 nt, Molluscum contagiosum virus
gcagugccagcagc

SEQ ID NO: 3095476 - RNA, 20 nt, Molluscum contagiosum virus
cugcaggaccugcugguggu

SEQ ID NO: 3095477 - RNA, 18 nt, Molluscum contagiosum virus
gcacaguccaacccgcgg

SEQ ID NO: 3095478 - RNA, 16 nt, Molluscum contagiosum virus
uggacacgcacuggcg

SEQ ID NO: 3095479 - RNA, 17 nt, Molluscum contagiosum virus
ggcuggaccugcgccag

SEQ ID NO: 3095480 - RNA, 19 nt, Molluscum contagiosum virus
cacugucguaacaauggac

SEQ ID NO: 3095481 - RNA, 17 nt, Molluscum contagiosum virus
ccgcgcgcgccagcuau

SEQ ID NO: 3095482 - RNA, 15 nt, Molluscum contagiosum virus
gaugcucgcuugccg

SEQ ID NO: 3095483 - RNA, 18 nt, Molluscum contagiosum virus
ggugccuggcguccgcac

SEQ ID NO: 3095484 - RNA, 18 nt, Molluscum contagiosum virus
caacauggugcuggccau

SEQ ID NO: 3095485 - RNA, 18 nt, Molluscum contagiosum virus
cuucaaguuccuggagcc

SEQ ID NO: 3095486 - RNA, 17 nt, Molluscum contagiosum virus
gcuuguugucgagcaga

SEQ ID NO: 3095487 - RNA, 13 nt, Molluscum contagiosum virus
gcgugagagccau

SEQ ID NO: 3095488 - RNA, 22 nt, Molluscum contagiosum virus
aguacuucuacgggaagcugca

SEQ ID NO: 3095489 - RNA, 18 nt, Molluscum contagiosum virus
gaucaggcagcugcugcg

SEQ ID NO: 3095490 - RNA, 14 nt, Molluscum contagiosum virus
caagcccagcagcg

SEQ ID NO: 3095491 - RNA, 16 nt, Molluscum contagiosum virus
cgcagugcggccagca

SEQ ID NO: 3095492 - RNA, 14 nt, Molluscum contagiosum virus
uugggcacuuccug

SEQ ID NO: 3095493 - RNA, 20 nt, Molluscum contagiosum virus
uguccacgaugaacggcucc

SEQ ID NO: 3095494 - RNA, 24 nt, Molluscum contagiosum virus
guugcgcagcacaaacucgcagaa

SEQ ID NO: 3095495 - RNA, 20 nt, Molluscum contagiosum virus
guggaucgcgcgcaccugca

SEQ ID NO: 3095496 - RNA, 14 nt, Molluscum contagiosum virus
ccgccugcugcagc

SEQ ID NO: 3095497 - RNA, 16 nt, Molluscum contagiosum virus
gauggacgccagcuug

SEQ ID NO: 3095498 - RNA, 13 nt, Molluscum contagiosum virus
ugcacuacugcuc

SEQ ID NO: 3095499 - RNA, 16 nt, Molluscum contagiosum virus
gcagcguuccaggaac

SEQ ID NO: 3095500 - RNA, 16 nt, Molluscum contagiosum virus
gcccuacgcgcgcgug

SEQ ID NO: 3095501 - RNA, 15 nt, Molluscum contagiosum virus
ccucuuuugggcacg

SEQ ID NO: 3095502 - RNA, 15 nt, Molluscum contagiosum virus
ccagcgcgcagaagc

SEQ ID NO: 3095503 - RNA, 22 nt, Molluscum contagiosum virus
guguuuuaauuuuccaaccugu

SEQ ID NO: 3095504 - RNA, 19 nt, Molluscum contagiosum virus
uccccguccuugcucuggc

SEQ ID NO: 3095505 - RNA, 14 nt, Molluscum contagiosum virus
gccccgcgccagca

SEQ ID NO: 3095506 - RNA, 20 nt, Molluscum contagiosum virus
cgacgugaucgcgcaggcgc

SEQ ID NO: 3095507 - RNA, 16 nt, Molluscum contagiosum virus
cagaaaacgcacuguc

SEQ ID NO: 3095508 - RNA, 18 nt, Molluscum contagiosum virus
ccacgagagaggcuuugc

SEQ ID NO: 3095509 - RNA, 21 nt, Molluscum contagiosum virus
gcaauggcggccugcccugcu

SEQ ID NO: 3095510 - RNA, 20 nt, Molluscum contagiosum virus
acucgagcacguagugcucg

SEQ ID NO: 3095511 - RNA, 13 nt, Molluscum contagiosum virus
cagcaccagguag

SEQ ID NO: 3095512 - RNA, 18 nt, Molluscum contagiosum virus
ggcaaaagggcucugcca

SEQ ID NO: 3095513 - RNA, 12 nt, Molluscum contagiosum virus
cacgcagagcca

SEQ ID NO: 3095514 - RNA, 15 nt, Molluscum contagiosum virus
guccccggcgccggc

SEQ ID NO: 3095515 - RNA, 21 nt, Molluscum contagiosum virus
cggcgcggcuagcaccgcaug

SEQ ID NO: 3095516 - RNA, 17 nt, Molluscum contagiosum virus
caauggacacgcacugg

SEQ ID NO: 3095517 - RNA, 20 nt, Molluscum contagiosum virus
gagcacaaagagacgcggcc

SEQ ID NO: 3095518 - RNA, 19 nt, Molluscum contagiosum virus
ggcgccagcuaagccggag

SEQ ID NO: 3095519 - RNA, 14 nt, Molluscum contagiosum virus
acgcagcaggcacg

SEQ ID NO: 3095520 - RNA, 16 nt, Molluscum contagiosum virus
uguccuacacgccgcu

SEQ ID NO: 3095521 - RNA, 16 nt, Molluscum contagiosum virus
ccgacucgcagcucac

SEQ ID NO: 3095522 - RNA, 16 nt, Molluscum contagiosum virus
ccgcugcuccugcucu

SEQ ID NO: 3095523 - RNA, 15 nt, Molluscum contagiosum virus
gaccgcgggcacggg

SEQ ID NO: 3095524 - RNA, 16 nt, Molluscum contagiosum virus
cgugcauggcacgcga

SEQ ID NO: 3095525 - RNA, 15 nt, Molluscum contagiosum virus
uguugccuggagggc

SEQ ID NO: 3095526 - RNA, 12 nt, Molluscum contagiosum virus
ggcacagucugg

SEQ ID NO: 3095527 - RNA, 14 nt, Molluscum contagiosum virus
gcugaugcccaggc

SEQ ID NO: 3095528 - RNA, 22 nt, Molluscum contagiosum virus
caccagcuggacggugcuggug

SEQ ID NO: 3095529 - RNA, 13 nt, Molluscum contagiosum virus
agauggacacagc

SEQ ID NO: 3095530 - RNA, 18 nt, Molluscum contagiosum virus
gcccaagaagaagcagca

SEQ ID NO: 3095531 - RNA, 13 nt, Molluscum contagiosum virus
gcccccgccgcgg

SEQ ID NO: 3095532 - RNA, 19 nt, Molluscum contagiosum virus
cuacgacaugcucgcgcuc

SEQ ID NO: 3095533 - RNA, 22 nt, Molluscum contagiosum virus
gugcgccgcgccgaaguacuuu

SEQ ID NO: 3095534 - RNA, 22 nt, Molluscum contagiosum virus
cacggcgacaacgacagagccc

SEQ ID NO: 3095535 - RNA, 20 nt, Molluscum contagiosum virus
gccgucgucaacaacacgau

SEQ ID NO: 3095536 - RNA, 16 nt, Molluscum contagiosum virus
cgcgcgugugcauggc

SEQ ID NO: 3095537 - RNA, 11 nt, Molluscum contagiosum virus
cggaggcugcu

SEQ ID NO: 3095538 - RNA, 13 nt, Molluscum contagiosum virus
cggagaggggacg

SEQ ID NO: 3095539 - RNA, 23 nt, Molluscum contagiosum virus
caaccccgcgcguacgcugcucg

SEQ ID NO: 3095540 - RNA, 17 nt, Molluscum contagiosum virus
ccgcggcgcgcagcucg

SEQ ID NO: 3095541 - RNA, 22 nt, Molluscum contagiosum virus
ugcaaccgcugcucgacauuaa

SEQ ID NO: 3095542 - RNA, 20 nt, Molluscum contagiosum virus
cacagccccugcugcucgcg

SEQ ID NO: 3095543 - RNA, 16 nt, Molluscum contagiosum virus
agcugugcgagccagu

SEQ ID NO: 3095544 - RNA, 15 nt, Molluscum contagiosum virus
gcgcguucggaacgc

SEQ ID NO: 3095545 - RNA, 12 nt, Molluscum contagiosum virus
ccacgugccaag

SEQ ID NO: 3095546 - RNA, 20 nt, Molluscum contagiosum virus
gcagcgcgugcgcaggagca

SEQ ID NO: 3095547 - RNA, 13 nt, Molluscum contagiosum virus
cgccgccaugcug

SEQ ID NO: 3095548 - RNA, 23 nt, Molluscum contagiosum virus
gcagccgcggcgcccggugccag

SEQ ID NO: 3095549 - RNA, 13 nt, Molluscum contagiosum virus
gccgugccuggca

SEQ ID NO: 3095550 - RNA, 15 nt, Molluscum contagiosum virus
ucgagcuuccucaag

SEQ ID NO: 3095551 - RNA, 14 nt, Molluscum contagiosum virus
cggccagcgugcag

SEQ ID NO: 3095552 - RNA, 18 nt, Molluscum contagiosum virus
guggccgagccgcuggcc

SEQ ID NO: 3095553 - RNA, 14 nt, Molluscum contagiosum virus
cauccucaccuucc

SEQ ID NO: 3095554 - RNA, 17 nt, Molluscum contagiosum virus
gacuggcacgcgccgcg

SEQ ID NO: 3095555 - RNA, 15 nt, Molluscum contagiosum virus
ccgagggcgugcgcu

SEQ ID NO: 3095556 - RNA, 21 nt, Molluscum contagiosum virus
cagcgcgcgcagcaccgcggc

SEQ ID NO: 3095557 - RNA, 20 nt, Molluscum contagiosum virus
cgagguggcacccuggcugc

SEQ ID NO: 3095558 - RNA, 14 nt, Molluscum contagiosum virus
cacgggccugcgcg

SEQ ID NO: 3095559 - RNA, 23 nt, Molluscum contagiosum virus
ccagcucggguuccagcuccggc

SEQ ID NO: 3095560 - RNA, 21 nt, Molluscum contagiosum virus
gcagagguaaucccgagcuuc

SEQ ID NO: 3095561 - RNA, 16 nt, Molluscum contagiosum virus
uuuuccggggacggag

SEQ ID NO: 3095562 - RNA, 20 nt, Molluscum contagiosum virus
ccgaggagagcggcgccccu

SEQ ID NO: 3095563 - RNA, 21 nt, Molluscum contagiosum virus
gcgugaggaggcggcacugcu

SEQ ID NO: 3095564 - RNA, 16 nt, Molluscum contagiosum virus
ugccgcgcgcgccgca

SEQ ID NO: 3095565 - RNA, 20 nt, Molluscum contagiosum virus
ggaccucuuucucgcgccgu

SEQ ID NO: 3095566 - RNA, 19 nt, Molluscum contagiosum virus
gcugggaaagggcugcuug

SEQ ID NO: 3095567 - RNA, 18 nt, Molluscum contagiosum virus
gccguccaugugcccgcg

SEQ ID NO: 3095568 - RNA, 20 nt, Molluscum contagiosum virus
gccccacugugccagcagca

SEQ ID NO: 3095569 - RNA, 13 nt, Molluscum contagiosum virus
gacgaagcugugc

SEQ ID NO: 3095570 - RNA, 18 nt, Molluscum contagiosum virus
gcacgcgcacgcucucgc

SEQ ID NO: 3095571 - RNA, 22 nt, Molluscum contagiosum virus
ugugcacaugcccgugcaccuc

SEQ ID NO: 3095572 - RNA, 18 nt, Molluscum contagiosum virus
cgaaguuccugcauuuca

SEQ ID NO: 3095573 - RNA, 14 nt, Molluscum contagiosum virus
ugcgcggggcaggc

SEQ ID NO: 3095574 - RNA, 18 nt, Molluscum contagiosum virus
acgcaggaugcuggggcu

SEQ ID NO: 3095575 - RNA, 13 nt, Molluscum contagiosum virus
cgaggagaaagua

SEQ ID NO: 3095576 - RNA, 15 nt, Molluscum contagiosum virus
aguaccggccaaggc

SEQ ID NO: 3095577 - RNA, 13 nt, Molluscum contagiosum virus
cuuggcgagcgcu

SEQ ID NO: 3095578 - RNA, 16 nt, Molluscum contagiosum virus
gaggcccugcuugccc

SEQ ID NO: 3095579 - RNA, 17 nt, Molluscum contagiosum virus
cugugcccuggaagcuu

SEQ ID NO: 3095580 - RNA, 21 nt, Molluscum contagiosum virus
acguaguacugcagcagcucc

SEQ ID NO: 3095581 - RNA, 13 nt, Molluscum contagiosum virus
cgccgaugcagug

SEQ ID NO: 3095582 - RNA, 21 nt, Molluscum contagiosum virus
aggcucgagcgcgcgccugcu

SEQ ID NO: 3095583 - RNA, 19 nt, Molluscum contagiosum virus
guuuucacgcaaggaagca

SEQ ID NO: 3095584 - RNA, 21 nt, Molluscum contagiosum virus
gggcgcgcggcaagccuggcu

SEQ ID NO: 3095585 - RNA, 14 nt, Molluscum contagiosum virus
gcuggcggcgcacg

SEQ ID NO: 3095586 - RNA, 14 nt, Molluscum contagiosum virus
cgccggcucugccu

SEQ ID NO: 3095587 - RNA, 22 nt, Molluscum contagiosum virus
cucgaggcgcuugggcacugcu

SEQ ID NO: 3095588 - RNA, 21 nt, Molluscum contagiosum virus
augcugguucugcgcugccag

SEQ ID NO: 3095589 - RNA, 16 nt, Molluscum contagiosum virus
gcgccgcgcggcuccu

SEQ ID NO: 3095590 - RNA, 20 nt, Molluscum contagiosum virus
cgucgggcgccaacacgagc

SEQ ID NO: 3095591 - RNA, 15 nt, Molluscum contagiosum virus
cacccgcaacaagga

SEQ ID NO: 3095592 - RNA, 21 nt, Molluscum contagiosum virus
gccgcggacgccggcgcccgc

SEQ ID NO: 3095593 - RNA, 18 nt, Molluscum contagiosum virus
ggucgugugcguacuggg

SEQ ID NO: 3095594 - RNA, 14 nt, Molluscum contagiosum virus
guguugcugaugcc

SEQ ID NO: 3095595 - RNA, 19 nt, Molluscum contagiosum virus
guucuucgcagaggacagc

SEQ ID NO: 3095596 - RNA, 15 nt, Molluscum contagiosum virus
cuccgcacagaggga

SEQ ID NO: 3095597 - RNA, 15 nt, Molluscum contagiosum virus
cuggacgccucggga

SEQ ID NO: 3095598 - RNA, 17 nt, Molluscum contagiosum virus
cggacacguacacgcug

SEQ ID NO: 3095599 - RNA, 15 nt, Molluscum contagiosum virus
ucuuccccgagagcu

SEQ ID NO: 3095600 - RNA, 19 nt, Molluscum contagiosum virus
cagcgugccgcggcacugg

SEQ ID NO: 3095601 - RNA, 20 nt, Molluscum contagiosum virus
ccgcgcgcugcucuggagca

SEQ ID NO: 3095602 - RNA, 22 nt, Molluscum contagiosum virus
cagauccgggcgcugcaccgcu

SEQ ID NO: 3095603 - RNA, 20 nt, Molluscum contagiosum virus
cagccucugugcggcgccgu

SEQ ID NO: 3095604 - RNA, 19 nt, Molluscum contagiosum virus
gcgccagggcggagccccg

SEQ ID NO: 3095605 - RNA, 16 nt, Molluscum contagiosum virus
uggagacggcaguguc

SEQ ID NO: 3095606 - RNA, 14 nt, Molluscum contagiosum virus
acguccuagagcag

SEQ ID NO: 3095607 - RNA, 14 nt, Molluscum contagiosum virus
uccgucgcgcucga

SEQ ID NO: 3095608 - RNA, 23 nt, Molluscum contagiosum virus
ggagacaccagcuccgccgggaa

SEQ ID NO: 3095609 - RNA, 21 nt, Molluscum contagiosum virus
cuggccaaggacgacaacacu

SEQ ID NO: 3095610 - RNA, 13 nt, Molluscum contagiosum virus
cgggcgccagcua

SEQ ID NO: 3095611 - RNA, 16 nt, Molluscum contagiosum virus
gcuggcgcucggcgug

SEQ ID NO: 3095612 - RNA, 18 nt, Molluscum contagiosum virus
acgcgcacgcgcacacgc

SEQ ID NO: 3095613 - RNA, 11 nt, Molluscum contagiosum virus
cgcgcagcgcc

SEQ ID NO: 3095614 - RNA, 22 nt, Molluscum contagiosum virus
cccaagcgcaccguugacgagc

SEQ ID NO: 3095615 - RNA, 19 nt, Molluscum contagiosum virus
gcaggucaucgggcugcag

SEQ ID NO: 3095616 - RNA, 18 nt, Molluscum contagiosum virus
ccgcacguggagucacga

SEQ ID NO: 3095617 - RNA, 16 nt, Molluscum contagiosum virus
uccuggggcuggacag

SEQ ID NO: 3095618 - RNA, 13 nt, Molluscum contagiosum virus
gcgcaccuggagu

SEQ ID NO: 3095619 - RNA, 20 nt, Molluscum contagiosum virus
gacggugugccgcugguggg

SEQ ID NO: 3095620 - RNA, 18 nt, Molluscum contagiosum virus
ccggcguuggcuuucugu

SEQ ID NO: 3095621 - RNA, 21 nt, Molluscum contagiosum virus
ccuggcucgcgagugugcaug

SEQ ID NO: 3095622 - RNA, 9 nt, Molluscum contagiosum virus
ccagcagcg

SEQ ID NO: 3095623 - RNA, 21 nt, Molluscum contagiosum virus
gguccaccagcugccgcuuga

SEQ ID NO: 3095624 - RNA, 13 nt, Molluscum contagiosum virus
cguagccuagcca

SEQ ID NO: 3095625 - RNA, 15 nt, Molluscum contagiosum virus
cgcucgccuuucccc

SEQ ID NO: 3095626 - RNA, 16 nt, Molluscum contagiosum virus
gcaggcacgacgccga

SEQ ID NO: 3095627 - RNA, 22 nt, Molluscum contagiosum virus
uggcgcagcaggaugcuggugu

SEQ ID NO: 3095628 - RNA, 23 nt, Molluscum contagiosum virus
agugcgggagcaagucugcgcag

SEQ ID NO: 3095629 - RNA, 21 nt, Molluscum contagiosum virus
ucccggcgcgcgcggcgcgcc

SEQ ID NO: 3095630 - RNA, 16 nt, Molluscum contagiosum virus
caacgcuuggcaagcu

SEQ ID NO: 3095631 - RNA, 15 nt, Molluscum contagiosum virus
ggcugcucgcugccu

SEQ ID NO: 3095632 - RNA, 14 nt, Molluscum contagiosum virus
cugugcucgcgccu

SEQ ID NO: 3095633 - RNA, 22 nt, Molluscum contagiosum virus
cgagcgcguccaugagcaucuc

SEQ ID NO: 3095634 - RNA, 15 nt, Molluscum contagiosum virus
caagaggggagccag

SEQ ID NO: 3095635 - RNA, 16 nt, Molluscum contagiosum virus
cgcccucgcgccugac

SEQ ID NO: 3095636 - RNA, 18 nt, Molluscum contagiosum virus
gcgggagggcgcaacucc

SEQ ID NO: 3095637 - RNA, 15 nt, Molluscum contagiosum virus
gacggaacgagccug

SEQ ID NO: 3095638 - RNA, 21 nt, Molluscum contagiosum virus
gucucugcgcgagcagcugcu

SEQ ID NO: 3095639 - RNA, 19 nt, Molluscum contagiosum virus
aguacugcagcagcuccuc

SEQ ID NO: 3095640 - RNA, 14 nt, Molluscum contagiosum virus
uguuuucauuucgc

SEQ ID NO: 3095641 - RNA, 13 nt, Molluscum contagiosum virus
cagcuaugcgccc

SEQ ID NO: 3095642 - RNA, 15 nt, Molluscum contagiosum virus
cccgacucgcagcuc

SEQ ID NO: 3095643 - RNA, 22 nt, Molluscum contagiosum virus
gccugccgcgcaugcuggagac

SEQ ID NO: 3095644 - RNA, 18 nt, Molluscum contagiosum virus
ccaagaggacgagcugcu

SEQ ID NO: 3095645 - RNA, 22 nt, Molluscum contagiosum virus
ucgcggucgacgagugcgccgc

SEQ ID NO: 3095646 - RNA, 15 nt, Molluscum contagiosum virus
gccacgagcgccgcg

SEQ ID NO: 3095647 - RNA, 16 nt, Molluscum contagiosum virus
gcugcacaugugcgug

SEQ ID NO: 3095648 - RNA, 15 nt, Molluscum contagiosum virus
caggaacaucugcaa

SEQ ID NO: 3095649 - RNA, 21 nt, Molluscum contagiosum virus
cagcggaagaaacagccaugu

SEQ ID NO: 3095650 - RNA, 11 nt, Molluscum contagiosum virus
ugacagcaucg

SEQ ID NO: 3095651 - RNA, 13 nt, Molluscum contagiosum virus
cgugacagucagc

SEQ ID NO: 3095652 - RNA, 17 nt, Molluscum contagiosum virus
ggccucgccuccgggcg

SEQ ID NO: 3095653 - RNA, 18 nt, Molluscum contagiosum virus
gaaucgagaugcgccgca

SEQ ID NO: 3095654 - RNA, 14 nt, Molluscum contagiosum virus
cgggggcgcuuccc

SEQ ID NO: 3095655 - RNA, 15 nt, Molluscum contagiosum virus
ggaggcggcacugcu

SEQ ID NO: 3095656 - RNA, 21 nt, Molluscum contagiosum virus
cugcacgaccgcggacuccuu

SEQ ID NO: 3095657 - RNA, 18 nt, Molluscum contagiosum virus
ggcugucgcccggcagcg

SEQ ID NO: 3095658 - RNA, 14 nt, Molluscum contagiosum virus
gcacgcggcucugg

SEQ ID NO: 3095659 - RNA, 17 nt, Molluscum contagiosum virus
gcgcgccuuccgcgcgg

SEQ ID NO: 3095660 - RNA, 22 nt, Molluscum contagiosum virus
gcuggagaacggcgugcgagug

SEQ ID NO: 3095661 - RNA, 20 nt, Molluscum contagiosum virus
gcaucuagucagcggcgguc

SEQ ID NO: 3095662 - RNA, 21 nt, Molluscum contagiosum virus
gcgggcggcacacacuugcac

SEQ ID NO: 3095663 - RNA, 17 nt, Molluscum contagiosum virus
gggcucagcaaggaggg

SEQ ID NO: 3095664 - RNA, 15 nt, Molluscum contagiosum virus
acgcuugccuuggcg

SEQ ID NO: 3095665 - RNA, 14 nt, Molluscum contagiosum virus
caugcgugcuucac

SEQ ID NO: 3095666 - RNA, 22 nt, Molluscum contagiosum virus
agcgacgagcagcugcuucucu

SEQ ID NO: 3095667 - RNA, 20 nt, Molluscum contagiosum virus
gcugcaguguguacggcgug

SEQ ID NO: 3095668 - RNA, 18 nt, Molluscum contagiosum virus
cugucccuugauccaggc

SEQ ID NO: 3095669 - RNA, 17 nt, Molluscum contagiosum virus
cgcgugcgagcggcgcg

SEQ ID NO: 3095670 - RNA, 16 nt, Molluscum contagiosum virus
uguagaacgccaggaa

SEQ ID NO: 3095671 - RNA, 23 nt, Molluscum contagiosum virus
aaagcgccgcgcgcggcuaagcu

SEQ ID NO: 3095672 - RNA, 15 nt, Molluscum contagiosum virus
ggccaaccuccugca

SEQ ID NO: 3095673 - RNA, 16 nt, Molluscum contagiosum virus
gcuccucgcacgggcg

SEQ ID NO: 3095674 - RNA, 19 nt, Molluscum contagiosum virus
gcgcgcggaagcccgccuc

SEQ ID NO: 3095675 - RNA, 14 nt, Molluscum contagiosum virus
cugcaggaaaggca

SEQ ID NO: 3095676 - RNA, 22 nt, Molluscum contagiosum virus
gacgcgggccuguccgcgggcg

SEQ ID NO: 3095677 - RNA, 21 nt, Molluscum contagiosum virus
acuuaacggccaauaaaugau

SEQ ID NO: 3095678 - RNA, 15 nt, Molluscum contagiosum virus
caccgcaugggcccu

SEQ ID NO: 3095679 - RNA, 21 nt, Molluscum contagiosum virus
gcacccuccgcacagagggac

SEQ ID NO: 3095680 - RNA, 20 nt, Molluscum contagiosum virus
caagcuucgggccgcugccg

SEQ ID NO: 3095681 - RNA, 20 nt, Molluscum contagiosum virus
cucgccuccuugcccgagga

SEQ ID NO: 3095682 - RNA, 17 nt, Molluscum contagiosum virus
ugggaaagggcugcuug

SEQ ID NO: 3095683 - RNA, 22 nt, Molluscum contagiosum virus
ugcguagagcaaaggaagagcc

SEQ ID NO: 3095684 - RNA, 19 nt, Molluscum contagiosum virus
cgcgccgggccgcgguggc

SEQ ID NO: 3095685 - RNA, 13 nt, Molluscum contagiosum virus
ccacgcagcuggc

SEQ ID NO: 3095686 - RNA, 14 nt, Molluscum contagiosum virus
cugccgcgcaauac

SEQ ID NO: 3095687 - RNA, 13 nt, Molluscum contagiosum virus
agcaaccucggga

SEQ ID NO: 3095688 - RNA, 15 nt, Molluscum contagiosum virus
cgccagcucugggcg

SEQ ID NO: 3095689 - RNA, 18 nt, Molluscum contagiosum virus
cucgcugcuccccgccag

SEQ ID NO: 3095690 - RNA, 17 nt, Molluscum contagiosum virus
cgcgagacgggcacgcg

SEQ ID NO: 3095691 - RNA, 17 nt, Molluscum contagiosum virus
accgacaaggagggaga

SEQ ID NO: 3095692 - RNA, 12 nt, Molluscum contagiosum virus
uccugcugguuc

SEQ ID NO: 3095693 - RNA, 23 nt, Molluscum contagiosum virus
aggcaggccccgcaccagugccg

SEQ ID NO: 3095694 - RNA, 21 nt, Molluscum contagiosum virus
gcagacgccgagcgggcaaug

SEQ ID NO: 3095695 - RNA, 13 nt, Molluscum contagiosum virus
cgccgcgccgcac

SEQ ID NO: 3095696 - RNA, 19 nt, Molluscum contagiosum virus
cacaguccaacccgcggcg

SEQ ID NO: 3095697 - RNA, 13 nt, Molluscum contagiosum virus
cgagcacgccucc

SEQ ID NO: 3095698 - RNA, 17 nt, Molluscum contagiosum virus
gcucaagacgcugcugg

SEQ ID NO: 3095699 - RNA, 20 nt, Molluscum contagiosum virus
acuaccuggcggcgcuggag

SEQ ID NO: 3095700 - RNA, 16 nt, Molluscum contagiosum virus
acggacaugagcuugc

SEQ ID NO: 3095701 - RNA, 15 nt, Molluscum contagiosum virus
cgguccagccgcacc

SEQ ID NO: 3095702 - RNA, 20 nt, Molluscum contagiosum virus
cuucucgcagcguuccagga

SEQ ID NO: 3095703 - RNA, 13 nt, Molluscum contagiosum virus
cgcgcgagcugga

SEQ ID NO: 3095704 - RNA, 13 nt, Molluscum contagiosum virus
uugaccagcucca

SEQ ID NO: 3095705 - RNA, 13 nt, Molluscum contagiosum virus
caccgagcccgcc

SEQ ID NO: 3095706 - RNA, 21 nt, Molluscum contagiosum virus
ccgcgggcgcagacgccgagc

SEQ ID NO: 3095707 - RNA, 20 nt, Molluscum contagiosum virus
ggcgcgccuaguucgagaag

SEQ ID NO: 3095708 - RNA, 12 nt, Molluscum contagiosum virus
uaaccaugaaga

SEQ ID NO: 3095709 - RNA, 15 nt, Molluscum contagiosum virus
ccgcagcaagcagcc

SEQ ID NO: 3095710 - RNA, 13 nt, Molluscum contagiosum virus
cgcgcggcagcag

SEQ ID NO: 3095711 - RNA, 15 nt, Molluscum contagiosum virus
acccuggcugcugcg

SEQ ID NO: 3095712 - RNA, 17 nt, Molluscum contagiosum virus
agugcagaugaggcugc

SEQ ID NO: 3095713 - RNA, 15 nt, Molluscum contagiosum virus
gcgcgcugcgcgccg

SEQ ID NO: 3095714 - RNA, 18 nt, Molluscum contagiosum virus
cgacauuucgcgccuguc

SEQ ID NO: 3095715 - RNA, 15 nt, Molluscum contagiosum virus
uggccgcgcgcgcac

SEQ ID NO: 3095716 - RNA, 19 nt, Molluscum contagiosum virus
gugacgcugcaagacggaa

SEQ ID NO: 3095717 - RNA, 21 nt, Molluscum contagiosum virus
guggcguccgcacgaggagcc

SEQ ID NO: 3095718 - RNA, 15 nt, Molluscum contagiosum virus
uccccgcgggccgcc

SEQ ID NO: 3095719 - RNA, 15 nt, Molluscum contagiosum virus
gcuggcugggcacuc

SEQ ID NO: 3095720 - RNA, 19 nt, Molluscum contagiosum virus
uccuguagcaaggggucug

SEQ ID NO: 3095721 - RNA, 18 nt, Molluscum contagiosum virus
gucgcgcgagaagucggg

SEQ ID NO: 3095722 - RNA, 13 nt, Molluscum contagiosum virus
ugaagcucucgcg

SEQ ID NO: 3095723 - RNA, 12 nt, Molluscum contagiosum virus
caccagcaccag

SEQ ID NO: 3095724 - RNA, 22 nt, Molluscum contagiosum virus
aggacgccggcaagccgagcca

SEQ ID NO: 3095725 - RNA, 20 nt, Molluscum contagiosum virus
gagagccgccuuugcgcugu

SEQ ID NO: 3095726 - RNA, 20 nt, Molluscum contagiosum virus
cagugccgccgcgcaaaagc

SEQ ID NO: 3095727 - RNA, 18 nt, Molluscum contagiosum virus
ucacaagcaccgccugcu

SEQ ID NO: 3095728 - RNA, 15 nt, Molluscum contagiosum virus
gcgcgccggcccgag

SEQ ID NO: 3095729 - RNA, 17 nt, Molluscum contagiosum virus
uuggacagcaagcagcg

SEQ ID NO: 3095730 - RNA, 17 nt, Molluscum contagiosum virus
caccgggcgccgcggcu

SEQ ID NO: 3095731 - RNA, 13 nt, Molluscum contagiosum virus
ugccguccccgcg

SEQ ID NO: 3095732 - RNA, 15 nt, Molluscum contagiosum virus
cgccgccgcgccgcu

SEQ ID NO: 3095733 - RNA, 15 nt, Molluscum contagiosum virus
cacuucgucaagcag

SEQ ID NO: 3095734 - RNA, 23 nt, Molluscum contagiosum virus
gauggcaagucucgcuuccggga

SEQ ID NO: 3095735 - RNA, 16 nt, Molluscum contagiosum virus
gggcggccgcagcaag

SEQ ID NO: 3095736 - RNA, 12 nt, Molluscum contagiosum virus
ggaagcugcacg

SEQ ID NO: 3095737 - RNA, 18 nt, Molluscum contagiosum virus
gcauaccugugccagcgc

SEQ ID NO: 3095738 - RNA, 17 nt, Molluscum contagiosum virus
cgacgccgagcccgagc

SEQ ID NO: 3095739 - RNA, 13 nt, Molluscum contagiosum virus
cugcuguuggccu

SEQ ID NO: 3095740 - RNA, 22 nt, Molluscum contagiosum virus
gccacucgcauugcguuggcaa

SEQ ID NO: 3095741 - RNA, 18 nt, Molluscum contagiosum virus
caucgcgcugcuggugcu

SEQ ID NO: 3095742 - RNA, 12 nt, Molluscum contagiosum virus
ccagcagcuccu

SEQ ID NO: 3095743 - RNA, 19 nt, Molluscum contagiosum virus
ccaugaggacagcuugcug

SEQ ID NO: 3095744 - RNA, 18 nt, Molluscum contagiosum virus
gacggcgugcgccgcucc

SEQ ID NO: 3095745 - RNA, 14 nt, Molluscum contagiosum virus
uguccgcaagcacg

SEQ ID NO: 3095746 - RNA, 22 nt, Molluscum contagiosum virus
gcccgagggcgggcacgugcug

SEQ ID NO: 3095747 - RNA, 15 nt, Molluscum contagiosum virus
ccggugucagccccg

SEQ ID NO: 3095748 - RNA, 16 nt, Molluscum contagiosum virus
acagcgggcgcugcuc

SEQ ID NO: 3095749 - RNA, 18 nt, Molluscum contagiosum virus
gggcacggcacccgccag

SEQ ID NO: 3095750 - RNA, 17 nt, Molluscum contagiosum virus
gugccagcagcauuuug

SEQ ID NO: 3095751 - RNA, 21 nt, Molluscum contagiosum virus
gagugucucgaaccgaggccg

SEQ ID NO: 3095752 - RNA, 19 nt, Molluscum contagiosum virus
uggagggcuccucuucaga

SEQ ID NO: 3095753 - RNA, 16 nt, Molluscum contagiosum virus
cuuguccgcggacgcg

SEQ ID NO: 3095754 - RNA, 14 nt, Molluscum contagiosum virus
guguuuugugccug

SEQ ID NO: 3095755 - RNA, 20 nt, Molluscum contagiosum virus
cgagcgggcaaugggcacgc

SEQ ID NO: 3095756 - RNA, 14 nt, Molluscum contagiosum virus
uggccaaggucucg

SEQ ID NO: 3095757 - RNA, 16 nt, Molluscum contagiosum virus
cgagcugugcgagcca

SEQ ID NO: 3095758 - RNA, 17 nt, Molluscum contagiosum virus
aauagcuggggcaaaga

SEQ ID NO: 3095759 - RNA, 15 nt, Molluscum contagiosum virus
cgcgcagcugcgccu

SEQ ID NO: 3095760 - RNA, 15 nt, Molluscum contagiosum virus
gcccgugccgccggc

SEQ ID NO: 3095761 - RNA, 19 nt, Molluscum contagiosum virus
caaggacaucuacagccgc

SEQ ID NO: 3095762 - RNA, 13 nt, Molluscum contagiosum virus
cguacccuggcag

SEQ ID NO: 3095763 - RNA, 19 nt, Molluscum contagiosum virus
ggccgcccacgcucaacca

SEQ ID NO: 3095764 - RNA, 14 nt, Molluscum contagiosum virus
cuuucucagagaaa

SEQ ID NO: 3095765 - RNA, 21 nt, Molluscum contagiosum virus
ggcaucuucggcguguucaug

SEQ ID NO: 3095766 - RNA, 12 nt, Molluscum contagiosum virus
augcacacacuc

SEQ ID NO: 3095767 - RNA, 12 nt, Molluscum contagiosum virus
ccaugcugaucu

SEQ ID NO: 3095768 - RNA, 13 nt, Molluscum contagiosum virus
gcgugcugggccc

SEQ ID NO: 3095769 - RNA, 17 nt, Molluscum contagiosum virus
gcuccucgagcgccgcc

SEQ ID NO: 3095770 - RNA, 12 nt, Molluscum contagiosum virus
cgagagcggcgu

SEQ ID NO: 3095771 - RNA, 14 nt, Molluscum contagiosum virus
guaccgcgcgcacg

SEQ ID NO: 3095772 - RNA, 16 nt, Molluscum contagiosum virus
ucgaagcccagcuuca

SEQ ID NO: 3095773 - RNA, 17 nt, Molluscum contagiosum virus
gcgucgacguggagccu

SEQ ID NO: 3095774 - RNA, 14 nt, Molluscum contagiosum virus
aagcccagcuucag

SEQ ID NO: 3095775 - RNA, 18 nt, Molluscum contagiosum virus
aaggcaaagccugcugcg

SEQ ID NO: 3095776 - RNA, 23 nt, Molluscum contagiosum virus
aagcucgcgcugcugacacgcuc

SEQ ID NO: 3095777 - RNA, 18 nt, Molluscum contagiosum virus
cuguaccugcgacagcug

SEQ ID NO: 3095778 - RNA, 15 nt, Molluscum contagiosum virus
aagcugucgcgcagc

SEQ ID NO: 3095779 - RNA, 18 nt, Molluscum contagiosum virus
aacaucuaugcacggcac

SEQ ID NO: 3095780 - RNA, 22 nt, Molluscum contagiosum virus
gcgggcacgugcugcugcggcu

SEQ ID NO: 3095781 - RNA, 15 nt, Molluscum contagiosum virus
caucucgugcaugac

SEQ ID NO: 3095782 - RNA, 12 nt, Molluscum contagiosum virus
cgcgcucuuccc

SEQ ID NO: 3095783 - RNA, 15 nt, Molluscum contagiosum virus
gaacgaggcugcugc

SEQ ID NO: 3095784 - RNA, 18 nt, Molluscum contagiosum virus
gcuggggcucgcgcaaua

SEQ ID NO: 3095785 - RNA, 20 nt, Molluscum contagiosum virus
ucgugcucguguugugccug

SEQ ID NO: 3095786 - RNA, 22 nt, Molluscum contagiosum virus
auggacauccucaccuuccugg

SEQ ID NO: 3095787 - RNA, 21 nt, Molluscum contagiosum virus
aacaccagcgugcccuucucc

SEQ ID NO: 3095788 - RNA, 15 nt, Molluscum contagiosum virus
gcaagccuggcuccu

SEQ ID NO: 3095789 - RNA, 17 nt, Molluscum contagiosum virus
gcgucaucgcugcacgc

SEQ ID NO: 3095790 - RNA, 14 nt, Molluscum contagiosum virus
cucgcccgcgcgcg

SEQ ID NO: 3095791 - RNA, 19 nt, Molluscum contagiosum virus
gcaggucggccagcagcuc

SEQ ID NO: 3095792 - RNA, 23 nt, Molluscum contagiosum virus
acuuuggcuacgacggcgacgag

SEQ ID NO: 3095793 - RNA, 16 nt, Molluscum contagiosum virus
cacucuuucacgcugc

SEQ ID NO: 3095794 - RNA, 17 nt, Molluscum contagiosum virus
ugccggcgcgugagcgc

SEQ ID NO: 3095795 - RNA, 16 nt, Molluscum contagiosum virus
guacgagcaggcgcag

SEQ ID NO: 3095796 - RNA, 21 nt, Molluscum contagiosum virus
cgagcggcuuuucgccggagg

SEQ ID NO: 3095797 - RNA, 21 nt, Molluscum contagiosum virus
cgcagagccugcugcucuucg

SEQ ID NO: 3095798 - RNA, 16 nt, Molluscum contagiosum virus
gcugcgcgcucuggag

SEQ ID NO: 3095799 - RNA, 18 nt, Molluscum contagiosum virus
gacggacgaagagacgcc

SEQ ID NO: 3095800 - RNA, 15 nt, Molluscum contagiosum virus
cgcgauggcgccugc

SEQ ID NO: 3095801 - RNA, 20 nt, Molluscum contagiosum virus
ucgacugcgccuucugccug

SEQ ID NO: 3095802 - RNA, 16 nt, Molluscum contagiosum virus
guccacgacgagccug

SEQ ID NO: 3095803 - RNA, 21 nt, Molluscum contagiosum virus
cgccgcgcgcgauguacaagc

SEQ ID NO: 3095804 - RNA, 12 nt, Molluscum contagiosum virus
cacugcagcagc

SEQ ID NO: 3095805 - RNA, 13 nt, Molluscum contagiosum virus
gacuacgcacggc

SEQ ID NO: 3095806 - RNA, 18 nt, Molluscum contagiosum virus
uggcggggaucuugcgug

SEQ ID NO: 3095807 - RNA, 19 nt, Molluscum contagiosum virus
uaccggagacaccagcucc

SEQ ID NO: 3095808 - RNA, 21 nt, Molluscum contagiosum virus
aucccagaaaacgcacugucg

SEQ ID NO: 3095809 - RNA, 18 nt, Molluscum contagiosum virus
cgcggaacugacugcugc

SEQ ID NO: 3095810 - RNA, 19 nt, Molluscum contagiosum virus
ggggcucuccuacacauuc

SEQ ID NO: 3095811 - RNA, 18 nt, Molluscum contagiosum virus
aaaacgcgcggcagcagc

SEQ ID NO: 3095812 - RNA, 16 nt, Molluscum contagiosum virus
aagaggugcgugcccc

SEQ ID NO: 3095813 - RNA, 17 nt, Molluscum contagiosum virus
cccagcagcgagaccau

SEQ ID NO: 3095814 - RNA, 17 nt, Molluscum contagiosum virus
cguacagcgggcgcugc

SEQ ID NO: 3095815 - RNA, 13 nt, Molluscum contagiosum virus
gcucuacggcgug

SEQ ID NO: 3095816 - RNA, 18 nt, Molluscum contagiosum virus
ggcgagacgugcggcacg

SEQ ID NO: 3095817 - RNA, 21 nt, Molluscum contagiosum virus
gcgcagcauucccggcgcgcg

SEQ ID NO: 3095818 - RNA, 21 nt, Molluscum contagiosum virus
gcagccgcguagcuagcucug

SEQ ID NO: 3095819 - RNA, 12 nt, Molluscum contagiosum virus
gaaggagcccuu

SEQ ID NO: 3095820 - RNA, 18 nt, Molluscum contagiosum virus
agggcggcgccugcgccu

SEQ ID NO: 3095821 - RNA, 13 nt, Molluscum contagiosum virus
acuaccugcugcu

SEQ ID NO: 3095822 - RNA, 13 nt, Molluscum contagiosum virus
cacugugcuggcg

SEQ ID NO: 3095823 - RNA, 14 nt, Molluscum contagiosum virus
cugcacgagcugcu

SEQ ID NO: 3095824 - RNA, 15 nt, Molluscum contagiosum virus
gccucgcgagggcuc

SEQ ID NO: 3095825 - RNA, 11 nt, Molluscum contagiosum virus
caccaggaacg

SEQ ID NO: 3095826 - RNA, 19 nt, Molluscum contagiosum virus
guggaguuuagcaagguca

SEQ ID NO: 3095827 - RNA, 21 nt, Molluscum contagiosum virus
gcgccugcacuacugcuccau

SEQ ID NO: 3095828 - RNA, 15 nt, Molluscum contagiosum virus
acuguugguuaauuu

SEQ ID NO: 3095829 - RNA, 18 nt, Molluscum contagiosum virus
gccgcuucgggcucagca

SEQ ID NO: 3095830 - RNA, 23 nt, Molluscum contagiosum virus
aucgacugcgccuucugccugcc

SEQ ID NO: 3095831 - RNA, 22 nt, Molluscum contagiosum virus
cgccagcuaagccggagcagcc

SEQ ID NO: 3095832 - RNA, 11 nt, Molluscum contagiosum virus
aaguuccugca

SEQ ID NO: 3095833 - RNA, 12 nt, Molluscum contagiosum virus
cgccgccaugcu

SEQ ID NO: 3095834 - RNA, 23 nt, Molluscum contagiosum virus
caggccggucgcggaagacgugc

SEQ ID NO: 3095835 - RNA, 13 nt, Molluscum contagiosum virus
gcgcugcucgccg

SEQ ID NO: 3095836 - RNA, 22 nt, Molluscum contagiosum virus
aaacgcacagccccugcugcuc

SEQ ID NO: 3095837 - RNA, 15 nt, Molluscum contagiosum virus
ucuuucauggcuccc

SEQ ID NO: 3095838 - RNA, 19 nt, Molluscum contagiosum virus
gcaugggcccuggcggcuu

SEQ ID NO: 3095839 - RNA, 13 nt, Molluscum contagiosum virus
gagcacuggcugg

SEQ ID NO: 3095840 - RNA, 18 nt, Molluscum contagiosum virus
cagcucgucaacggugcg

SEQ ID NO: 3095841 - RNA, 20 nt, Molluscum contagiosum virus
accggcaagcuucgggccgc

SEQ ID NO: 3095842 - RNA, 13 nt, Molluscum contagiosum virus
ccgcagcccgagc

SEQ ID NO: 3095843 - RNA, 10 nt, Molluscum contagiosum virus
gcggcagcag

SEQ ID NO: 3095844 - RNA, 18 nt, Molluscum contagiosum virus
gagaacucgcgugccuug

SEQ ID NO: 3095845 - RNA, 19 nt, Molluscum contagiosum virus
ccgcgcgcucucacgcuuc

SEQ ID NO: 3095846 - RNA, 13 nt, Molluscum contagiosum virus
gcggcgccuugcu

SEQ ID NO: 3095847 - RNA, 14 nt, Molluscum contagiosum virus
ugcucuucggggac

SEQ ID NO: 3095848 - RNA, 13 nt, Molluscum contagiosum virus
gcagcccaccagc

SEQ ID NO: 3095849 - RNA, 20 nt, Molluscum contagiosum virus
gagaucuuugaccgcuucga

SEQ ID NO: 3095850 - RNA, 13 nt, Molluscum contagiosum virus
gcccgccagcaug

SEQ ID NO: 3095851 - RNA, 18 nt, Molluscum contagiosum virus
gcaugugcgagcgcagcu

SEQ ID NO: 3095852 - RNA, 14 nt, Molluscum contagiosum virus
gcacgauguacucc

SEQ ID NO: 3095853 - RNA, 14 nt, Molluscum contagiosum virus
caagguggggcgca

SEQ ID NO: 3095854 - RNA, 17 nt, Molluscum contagiosum virus
gcgucucugcgcagagc

SEQ ID NO: 3095855 - RNA, 15 nt, Molluscum contagiosum virus
ccgcgcgcgcuccga

SEQ ID NO: 3095856 - RNA, 14 nt, Molluscum contagiosum virus
cgagcugugcauug

SEQ ID NO: 3095857 - RNA, 17 nt, Molluscum contagiosum virus
cucggcguggugcuggc

SEQ ID NO: 3095858 - RNA, 17 nt, Molluscum contagiosum virus
gccgccaaugcugccgu

SEQ ID NO: 3095859 - RNA, 23 nt, Molluscum contagiosum virus
gacgggcucaucccgggacacga

SEQ ID NO: 3095860 - RNA, 16 nt, Molluscum contagiosum virus
cuccacaugccuucag

SEQ ID NO: 3095861 - RNA, 13 nt, Molluscum contagiosum virus
cgcugcagcaccu

SEQ ID NO: 3095862 - RNA, 15 nt, Molluscum contagiosum virus
ggacggcgcgcagcg

SEQ ID NO: 3095863 - RNA, 17 nt, Molluscum contagiosum virus
ccugcacuacugcucca

SEQ ID NO: 3095864 - RNA, 19 nt, Molluscum contagiosum virus
agugcgggagcaagucugc

SEQ ID NO: 3095865 - RNA, 16 nt, Molluscum contagiosum virus
aggucuacgaggagca

SEQ ID NO: 3095866 - RNA, 23 nt, Molluscum contagiosum virus
uguguucccggcugccgcugccu

SEQ ID NO: 3095867 - RNA, 18 nt, Molluscum contagiosum virus
aagaacaugugcuccgcc

SEQ ID NO: 3095868 - RNA, 17 nt, Molluscum contagiosum virus
cacgagauggcugcucu

SEQ ID NO: 3095869 - RNA, 14 nt, Molluscum contagiosum virus
ccucgcgcacagac

SEQ ID NO: 3095870 - RNA, 22 nt, Molluscum contagiosum virus
ccgcgucgcgcacgcgcgcuua

SEQ ID NO: 3095871 - RNA, 15 nt, Molluscum contagiosum virus
agucgcuagaggaga

SEQ ID NO: 3095872 - RNA, 17 nt, Molluscum contagiosum virus
ccgcgugcaugcccagc

SEQ ID NO: 3095873 - RNA, 14 nt, Molluscum contagiosum virus
acuagugcugcugg

SEQ ID NO: 3095874 - RNA, 19 nt, Molluscum contagiosum virus
acgcuggacuuccugcugc

SEQ ID NO: 3095875 - RNA, 16 nt, Molluscum contagiosum virus
cgagcacagcgcgcgg

SEQ ID NO: 3095876 - RNA, 23 nt, Molluscum contagiosum virus
aacacagugcguuugccagaagc

SEQ ID NO: 3095877 - RNA, 20 nt, Molluscum contagiosum virus
cacgcgaauguccggcgcug

SEQ ID NO: 3095878 - RNA, 20 nt, Molluscum contagiosum virus
cuauuaccugaccgacggcg

SEQ ID NO: 3095879 - RNA, 22 nt, Molluscum contagiosum virus
cgcgccgaggacgcgcccggga

SEQ ID NO: 3095880 - RNA, 18 nt, Molluscum contagiosum virus
gcuguccuucugguuccu

SEQ ID NO: 3095881 - RNA, 12 nt, Molluscum contagiosum virus
gcuggcggggac

SEQ ID NO: 3095882 - RNA, 17 nt, Molluscum contagiosum virus
caagcccggcaugggca

SEQ ID NO: 3095883 - RNA, 20 nt, Molluscum contagiosum virus
ggcucguccucgggcgccaa

SEQ ID NO: 3095884 - RNA, 19 nt, Molluscum contagiosum virus
caggagcauggccgcgucc

SEQ ID NO: 3095885 - RNA, 15 nt, Molluscum contagiosum virus
uuugcgcgagagcua

SEQ ID NO: 3095886 - RNA, 18 nt, Molluscum contagiosum virus
ucccugccacaugcagua

SEQ ID NO: 3095887 - RNA, 15 nt, Molluscum contagiosum virus
guccucggccagagc

SEQ ID NO: 3095888 - RNA, 13 nt, Molluscum contagiosum virus
ggcugcccgcgga

SEQ ID NO: 3095889 - RNA, 15 nt, Molluscum contagiosum virus
ugcugcgcagcaucc

SEQ ID NO: 3095890 - RNA, 13 nt, Molluscum contagiosum virus
ggcguugcugcug

SEQ ID NO: 3095891 - RNA, 22 nt, Molluscum contagiosum virus
acgacucgcgucugcaaggccu

SEQ ID NO: 3095892 - RNA, 19 nt, Molluscum contagiosum virus
ccugucaagacgggcacgc

SEQ ID NO: 3095893 - RNA, 20 nt, Molluscum contagiosum virus
gcuacgucgcggcgcacggu

SEQ ID NO: 3095894 - RNA, 20 nt, Molluscum contagiosum virus
aucagguccacguggugguu

SEQ ID NO: 3095895 - RNA, 23 nt, Molluscum contagiosum virus
agcgcguucgcgcgugcuggacg

SEQ ID NO: 3095896 - RNA, 19 nt, Molluscum contagiosum virus
gugaacgaggcugcugccg

SEQ ID NO: 3095897 - RNA, 14 nt, Molluscum contagiosum virus
cgccuucugccugc

SEQ ID NO: 3095898 - RNA, 17 nt, Molluscum contagiosum virus
ccgcauguccacggaca

SEQ ID NO: 3095899 - RNA, 23 nt, Molluscum contagiosum virus
ccugugcugugcagaacuucucg

SEQ ID NO: 3095900 - RNA, 20 nt, Molluscum contagiosum virus
ugacacaccgcguggacaac

SEQ ID NO: 3095901 - RNA, 14 nt, Molluscum contagiosum virus
gccgcuuccuggca

SEQ ID NO: 3095902 - RNA, 18 nt, Molluscum contagiosum virus
aggaucggagcgcagcug

SEQ ID NO: 3095903 - RNA, 22 nt, Molluscum contagiosum virus
accugggcgucgugcaccugga

SEQ ID NO: 3095904 - RNA, 18 nt, Molluscum contagiosum virus
cuaagcuaaaagagcugc

SEQ ID NO: 3095905 - RNA, 15 nt, Molluscum contagiosum virus
ucgggaagcccucag

SEQ ID NO: 3095906 - RNA, 15 nt, Molluscum contagiosum virus
gcagcggcaaaggcc

SEQ ID NO: 3095907 - RNA, 15 nt, Molluscum contagiosum virus
aaguguacuauuaca

SEQ ID NO: 3095908 - RNA, 18 nt, Molluscum contagiosum virus
gcgcgaccuacuccuggc

SEQ ID NO: 3095909 - RNA, 14 nt, Molluscum contagiosum virus
acggcgcgcaccua

SEQ ID NO: 3095910 - RNA, 20 nt, Molluscum contagiosum virus
aggcgcgcucuacgagacuc

SEQ ID NO: 3095911 - RNA, 22 nt, Molluscum contagiosum virus
gacuccgaggcagguuccggug

SEQ ID NO: 3095912 - RNA, 15 nt, Molluscum contagiosum virus
gcugguucugcgcug

SEQ ID NO: 3095913 - RNA, 20 nt, Molluscum contagiosum virus
gcagcaggugcacgugcugc

SEQ ID NO: 3095914 - RNA, 17 nt, Molluscum contagiosum virus
uggacgcgcaagugugc

SEQ ID NO: 3095915 - RNA, 16 nt, Molluscum contagiosum virus
ccggcgugagcucguc

SEQ ID NO: 3095916 - RNA, 14 nt, Molluscum contagiosum virus
cccucgugcugggc

SEQ ID NO: 3095917 - RNA, 14 nt, Molluscum contagiosum virus
guguccucuucaca

SEQ ID NO: 3095918 - RNA, 19 nt, Molluscum contagiosum virus
cugaccgcgggcacgggca

SEQ ID NO: 3095919 - RNA, 21 nt, Molluscum contagiosum virus
gcaggaaaggcacccgcagga

SEQ ID NO: 3095920 - RNA, 15 nt, Molluscum contagiosum virus
gccagcgauugcccg

SEQ ID NO: 3095921 - RNA, 17 nt, Molluscum contagiosum virus
gcaaggcaugcgcgcag

SEQ ID NO: 3095922 - RNA, 14 nt, Molluscum contagiosum virus
cgggugcauacgca

SEQ ID NO: 3095923 - RNA, 17 nt, Molluscum contagiosum virus
gccgcgggcgcagagcc

SEQ ID NO: 3095924 - RNA, 13 nt, Molluscum contagiosum virus
ggucgaggagggc

SEQ ID NO: 3095925 - RNA, 19 nt, Molluscum contagiosum virus
cuccacuaccaacucugug

SEQ ID NO: 3095926 - RNA, 22 nt, Molluscum contagiosum virus
gauccuccggaugaacagcuuc

SEQ ID NO: 3095927 - RNA, 21 nt, Molluscum contagiosum virus
cacgcaagcuuugugcucgcu

SEQ ID NO: 3095928 - RNA, 19 nt, Molluscum contagiosum virus
cuccgaccgugcccuggac

SEQ ID NO: 3095929 - RNA, 12 nt, Molluscum contagiosum virus
gcgcucuucccg

SEQ ID NO: 3095930 - RNA, 17 nt, Molluscum contagiosum virus
cugcaggaccugcuggu

SEQ ID NO: 3095931 - RNA, 17 nt, Molluscum contagiosum virus
cgcacgaccacgugcag

SEQ ID NO: 3095932 - RNA, 15 nt, Molluscum contagiosum virus
gccugcugcagcucc

SEQ ID NO: 3095933 - RNA, 23 nt, Molluscum contagiosum virus
cacagucuccacgcgugcgcgcc

SEQ ID NO: 3095934 - RNA, 18 nt, Molluscum contagiosum virus
gcacgccgcucggcacug

SEQ ID NO: 3095935 - RNA, 16 nt, Molluscum contagiosum virus
cacgcuacgcagcgcg

SEQ ID NO: 3095936 - RNA, 16 nt, Molluscum contagiosum virus
acgcgucgcgcgccgc

SEQ ID NO: 3095937 - RNA, 18 nt, Molluscum contagiosum virus
ugccugagaagcuguacc

SEQ ID NO: 3095938 - RNA, 17 nt, Molluscum contagiosum virus
gagagcgcgcggcgccg

SEQ ID NO: 3095939 - RNA, 14 nt, Molluscum contagiosum virus
cgaacugcccggcg

SEQ ID NO: 3095940 - RNA, 11 nt, Molluscum contagiosum virus
cgaccagcugg

SEQ ID NO: 3095941 - RNA, 22 nt, Molluscum contagiosum virus
uccgagcgaaccgcggcagccu

SEQ ID NO: 3095942 - RNA, 20 nt, Molluscum contagiosum virus
gcgcgcugcucuggagcaag

SEQ ID NO: 3095943 - RNA, 18 nt, Molluscum contagiosum virus
gacccagcaaggcccacu

SEQ ID NO: 3095944 - RNA, 14 nt, Molluscum contagiosum virus
gugugagucgcccu

SEQ ID NO: 3095945 - RNA, 18 nt, Molluscum contagiosum virus
cacaagccguugucuugg

SEQ ID NO: 3095946 - RNA, 14 nt, Molluscum contagiosum virus
aaaggcaccugcgg

SEQ ID NO: 3095947 - RNA, 17 nt, Molluscum contagiosum virus
acugcccggcggcaagc

SEQ ID NO: 3095948 - RNA, 20 nt, Molluscum contagiosum virus
guuuucuuucauggcucccg

SEQ ID NO: 3095949 - RNA, 16 nt, Molluscum contagiosum virus
cgcgccgcgcugcugg

SEQ ID NO: 3095950 - RNA, 22 nt, Molluscum contagiosum virus
cucgagcaggucaucgggcugc

SEQ ID NO: 3095951 - RNA, 14 nt, Molluscum contagiosum virus
cugccgcagagccg

SEQ ID NO: 3095952 - RNA, 16 nt, Molluscum contagiosum virus
guuucgcaugcacagc

SEQ ID NO: 3095953 - RNA, 17 nt, Molluscum contagiosum virus
gcuaccugaagcuggac

SEQ ID NO: 3095954 - RNA, 17 nt, Molluscum contagiosum virus
gcuagcucuggcagccc

SEQ ID NO: 3095955 - RNA, 23 nt, Molluscum contagiosum virus
aagcuggcgggugccgugccccu

SEQ ID NO: 3095956 - RNA, 22 nt, Molluscum contagiosum virus
ucccugcauacacuuccugcua

SEQ ID NO: 3095957 - RNA, 19 nt, Molluscum contagiosum virus
acacgagugcccgcgcgcu

SEQ ID NO: 3095958 - RNA, 13 nt, Molluscum contagiosum virus
ucaagauccaagc

SEQ ID NO: 3095959 - RNA, 19 nt, Molluscum contagiosum virus
ugcgcgcguugccugagaa

SEQ ID NO: 3095960 - RNA, 18 nt, Molluscum contagiosum virus
cgagauucguggcgagca

SEQ ID NO: 3095961 - RNA, 10 nt, Molluscum contagiosum virus
gcccagcgcc

SEQ ID NO: 3095962 - RNA, 17 nt, Molluscum contagiosum virus
acgcgcgcgugcugcua

SEQ ID NO: 3095963 - RNA, 19 nt, Molluscum contagiosum virus
gcuacagcagccgcagccc

SEQ ID NO: 3095964 - RNA, 21 nt, Molluscum contagiosum virus
ugcugcccccgccgcggcgcc

SEQ ID NO: 3095965 - RNA, 14 nt, Molluscum contagiosum virus
gagcggccuccgga

SEQ ID NO: 3095966 - RNA, 14 nt, Molluscum contagiosum virus
aguugcgagccagc

SEQ ID NO: 3095967 - RNA, 18 nt, Molluscum contagiosum virus
uaguagcagcuucuugga

SEQ ID NO: 3095968 - RNA, 21 nt, Molluscum contagiosum virus
cgcggaccuaaagcugcuggc

SEQ ID NO: 3095969 - RNA, 19 nt, Molluscum contagiosum virus
acugcguugucuccuccug

SEQ ID NO: 3095970 - RNA, 18 nt, Molluscum contagiosum virus
uguucaccauccagccgu

SEQ ID NO: 3095971 - RNA, 22 nt, Molluscum contagiosum virus
gacacggagcggaucgugcugg

SEQ ID NO: 3095972 - RNA, 20 nt, Molluscum contagiosum virus
agacuucuugcacgcucggc

SEQ ID NO: 3095973 - RNA, 20 nt, Molluscum contagiosum virus
ccuggcgagcgcucugcauu

SEQ ID NO: 3095974 - RNA, 20 nt, Molluscum contagiosum virus
ucuuccagaagguacugaac

SEQ ID NO: 3095975 - RNA, 18 nt, Molluscum contagiosum virus
ugcaacgcaggacacugu

SEQ ID NO: 3095976 - RNA, 16 nt, Molluscum contagiosum virus
ccaaggacgacaacac

SEQ ID NO: 3095977 - RNA, 15 nt, Molluscum contagiosum virus
cgacgacggcacgcu

SEQ ID NO: 3095978 - RNA, 15 nt, Molluscum contagiosum virus
ggcgccggcucugcc

SEQ ID NO: 3095979 - RNA, 21 nt, Molluscum contagiosum virus
gugccgggcgccggcucugcc

SEQ ID NO: 3095980 - RNA, 19 nt, Molluscum contagiosum virus
gcgcagguagcggcucgcg

SEQ ID NO: 3095981 - RNA, 24 nt, Molluscum contagiosum virus
cgagcacguuccaaaagacagagg

SEQ ID NO: 3095982 - RNA, 13 nt, Molluscum contagiosum virus
caaggaucucugc

SEQ ID NO: 3095983 - RNA, 12 nt, Molluscum contagiosum virus
uccagcgcauca

SEQ ID NO: 3095984 - RNA, 15 nt, Molluscum contagiosum virus
ugaccagcuccacgu

SEQ ID NO: 3095985 - RNA, 19 nt, Molluscum contagiosum virus
cauccggccgaggcacgcg

SEQ ID NO: 3095986 - RNA, 20 nt, Molluscum contagiosum virus
auccagcccugugcccgagu

SEQ ID NO: 3095987 - RNA, 18 nt, Molluscum contagiosum virus
acgcagcgcgagcugugc

SEQ ID NO: 3095988 - RNA, 16 nt, Molluscum contagiosum virus
gagcccgaccccaaga

SEQ ID NO: 3095989 - RNA, 21 nt, Molluscum contagiosum virus
ccagaggguggcuugcugcag

SEQ ID NO: 3095990 - RNA, 16 nt, Molluscum contagiosum virus
cgggcgcgccaacgac

SEQ ID NO: 3095991 - RNA, 22 nt, Molluscum contagiosum virus
cugcgcacacgucagccgcacg

SEQ ID NO: 3095992 - RNA, 23 nt, Molluscum contagiosum virus
gagacuucuccgaccgugcccug

SEQ ID NO: 3095993 - RNA, 14 nt, Molluscum contagiosum virus
ccagcggcugcccg

SEQ ID NO: 3095994 - RNA, 13 nt, Molluscum contagiosum virus
ccucggccagagc

SEQ ID NO: 3095995 - RNA, 18 nt, Molluscum contagiosum virus
accuuggcgcugcacagu

SEQ ID NO: 3095996 - RNA, 19 nt, Molluscum contagiosum virus
ggcacccaccaggaacagg

SEQ ID NO: 3095997 - RNA, 23 nt, Molluscum contagiosum virus
ugaucuccacaugccuucaggaa

SEQ ID NO: 3095998 - RNA, 13 nt, Molluscum contagiosum virus
gacuugcugcgga

SEQ ID NO: 3095999 - RNA, 12 nt, Molluscum contagiosum virus
aaguccagcgcg

SEQ ID NO: 3096000 - RNA, 15 nt, Molluscum contagiosum virus
cugggaaagggcugc

SEQ ID NO: 3096001 - RNA, 19 nt, Molluscum contagiosum virus
cacugugcugacccccucc

SEQ ID NO: 3096002 - RNA, 21 nt, Molluscum contagiosum virus
gcgcggggcacugcgcacgga

SEQ ID NO: 3096003 - RNA, 15 nt, Molluscum contagiosum virus
uccggcgcuggagaa

SEQ ID NO: 3096004 - RNA, 19 nt, Molluscum contagiosum virus
uguaccugcgacagcugcu

SEQ ID NO: 3096005 - RNA, 14 nt, Molluscum contagiosum virus
cgagcgcgcgcugc

SEQ ID NO: 3096006 - RNA, 20 nt, Molluscum contagiosum virus
gaggcuccugccgucgcccg

SEQ ID NO: 3096007 - RNA, 16 nt, Molluscum contagiosum virus
cgccuuccugcuggcg

SEQ ID NO: 3096008 - RNA, 22 nt, Molluscum contagiosum virus
ugaaaagcuauccgcugucuga

SEQ ID NO: 3096009 - RNA, 15 nt, Molluscum contagiosum virus
gacagcgugcgcggg

SEQ ID NO: 3096010 - RNA, 21 nt, Molluscum contagiosum virus
cugccggcgcgugagcgccua

SEQ ID NO: 3096011 - RNA, 22 nt, Molluscum contagiosum virus
ccgagguggcacccuggcugcu

SEQ ID NO: 3096012 - RNA, 17 nt, Molluscum contagiosum virus
ugaaguccucucucccc

SEQ ID NO: 3096013 - RNA, 22 nt, Molluscum contagiosum virus
ggcgcaggugcgggcuagcacg

SEQ ID NO: 3096014 - RNA, 17 nt, Molluscum contagiosum virus
gcagacguacgagcagg

SEQ ID NO: 3096015 - RNA, 13 nt, Molluscum contagiosum virus
cgaacaccuccug

SEQ ID NO: 3096016 - RNA, 21 nt, Molluscum contagiosum virus
aagagcacgaugcccagcagc

SEQ ID NO: 3096017 - RNA, 22 nt, Molluscum contagiosum virus
ugcugcucgacgggcgcagcca

SEQ ID NO: 3096018 - RNA, 18 nt, Molluscum contagiosum virus
uagcaccgcaugggcccu

SEQ ID NO: 3096019 - RNA, 16 nt, Molluscum contagiosum virus
cugcgcucggcgcgcg

SEQ ID NO: 3096020 - RNA, 20 nt, Molluscum contagiosum virus
ggccugcguggacagcaucc

SEQ ID NO: 3096021 - RNA, 15 nt, Molluscum contagiosum virus
cgcuggcacggccgg

SEQ ID NO: 3096022 - RNA, 17 nt, Molluscum contagiosum virus
agcgucgaacuucuccu

SEQ ID NO: 3096023 - RNA, 15 nt, Molluscum contagiosum virus
cugcacgggcacgcc

SEQ ID NO: 3096024 - RNA, 19 nt, Molluscum contagiosum virus
gacgugcugcugcagaacu

SEQ ID NO: 3096025 - RNA, 16 nt, Molluscum contagiosum virus
cggcuuguagucgccc

SEQ ID NO: 3096026 - RNA, 15 nt, Molluscum contagiosum virus
cgcaggaccgcgacc

SEQ ID NO: 3096027 - RNA, 15 nt, Molluscum contagiosum virus
ccaugcuccugaucu

SEQ ID NO: 3096028 - RNA, 19 nt, Molluscum contagiosum virus
cgugcgcgacggcgagcuc

SEQ ID NO: 3096029 - RNA, 21 nt, Molluscum contagiosum virus
ugccagcgggaaacugcugcc

SEQ ID NO: 3096030 - RNA, 12 nt, Molluscum contagiosum virus
gcucgccagcag

SEQ ID NO: 3096031 - RNA, 16 nt, Molluscum contagiosum virus
ccgcggagcugugcca

SEQ ID NO: 3096032 - RNA, 14 nt, Molluscum contagiosum virus
ccuuuguggacgcg

SEQ ID NO: 3096033 - RNA, 18 nt, Molluscum contagiosum virus
cgcugcuccccgccagca

SEQ ID NO: 3096034 - RNA, 20 nt, Molluscum contagiosum virus
caccucaagaagacgcagag

SEQ ID NO: 3096035 - RNA, 19 nt, Molluscum contagiosum virus
cucgaggcgcuugggcacu

SEQ ID NO: 3096036 - RNA, 21 nt, Molluscum contagiosum virus
uuguuuuucgggaagcacagu

SEQ ID NO: 3096037 - RNA, 22 nt, Molluscum contagiosum virus
gcuccgcgcggcgcucugccac

SEQ ID NO: 3096038 - RNA, 14 nt, Molluscum contagiosum virus
aggaucccugcccg

SEQ ID NO: 3096039 - RNA, 12 nt, Molluscum contagiosum virus
cagcucgcgccg

SEQ ID NO: 3096040 - RNA, 16 nt, Molluscum contagiosum virus
gcgccuagcuccagcg

SEQ ID NO: 3096041 - RNA, 14 nt, Molluscum contagiosum virus
gcagauuggaggag

SEQ ID NO: 3096042 - RNA, 16 nt, Molluscum contagiosum virus
caggucuucaacgagg

SEQ ID NO: 3096043 - RNA, 12 nt, Molluscum contagiosum virus
cucgcugcugcc

SEQ ID NO: 3096044 - RNA, 18 nt, Molluscum contagiosum virus
aacaagaucaccccgcag

SEQ ID NO: 3096045 - RNA, 13 nt, Molluscum contagiosum virus
gcgggcugggaaa

SEQ ID NO: 3096046 - RNA, 13 nt, Molluscum contagiosum virus
ccagcgugcagac

SEQ ID NO: 3096047 - RNA, 16 nt, Molluscum contagiosum virus
cugcguuuccagggca

SEQ ID NO: 3096048 - RNA, 16 nt, Molluscum contagiosum virus
cggccucgccuccggg

SEQ ID NO: 3096049 - RNA, 23 nt, Molluscum contagiosum virus
ccaggaaaggcaggagccucugu

SEQ ID NO: 3096050 - RNA, 16 nt, Molluscum contagiosum virus
caagcacgagcugcug

SEQ ID NO: 3096051 - RNA, 20 nt, Molluscum contagiosum virus
gcgggcguggggagcuggag

SEQ ID NO: 3096052 - RNA, 19 nt, Molluscum contagiosum virus
ggacgcaggaugcuggggc

SEQ ID NO: 3096053 - RNA, 21 nt, Molluscum contagiosum virus
gagcgcuucuuccggcagcug

SEQ ID NO: 3096054 - RNA, 11 nt, Molluscum contagiosum virus
gagguggccaa

SEQ ID NO: 3096055 - RNA, 15 nt, Molluscum contagiosum virus
ggcgagauugagcuc

SEQ ID NO: 3096056 - RNA, 14 nt, Molluscum contagiosum virus
aggagacguagagc

SEQ ID NO: 3096057 - RNA, 20 nt, Molluscum contagiosum virus
gcugcucgcgcgcgcacgcc

SEQ ID NO: 3096058 - RNA, 14 nt, Molluscum contagiosum virus
agcugcugcgcucc

SEQ ID NO: 3096059 - RNA, 14 nt, Molluscum contagiosum virus
agcgguuccugcuu

SEQ ID NO: 3096060 - RNA, 14 nt, Molluscum contagiosum virus
agccgcuccugguc

SEQ ID NO: 3096061 - RNA, 15 nt, Molluscum contagiosum virus
agcugguccagggcu

SEQ ID NO: 3096062 - RNA, 16 nt, Molluscum contagiosum virus
gaaccauuuuuugccc

SEQ ID NO: 3096063 - RNA, 15 nt, Molluscum contagiosum virus
gcucguccagcugcg

SEQ ID NO: 3096064 - RNA, 16 nt, Molluscum contagiosum virus
acugcaagaucuauca

SEQ ID NO: 3096065 - RNA, 15 nt, Molluscum contagiosum virus
gcccugcacgaccgc

SEQ ID NO: 3096066 - RNA, 19 nt, Molluscum contagiosum virus
gguccgcguuggcagcggc

SEQ ID NO: 3096067 - RNA, 18 nt, Molluscum contagiosum virus
gagcaggacgugcacgug

SEQ ID NO: 3096068 - RNA, 13 nt, Molluscum contagiosum virus
gugcccgagcccg

SEQ ID NO: 3096069 - RNA, 21 nt, Molluscum contagiosum virus
ccacgcaggacuggcaccugc

SEQ ID NO: 3096070 - RNA, 18 nt, Molluscum contagiosum virus
accguggaggagccgccc

SEQ ID NO: 3096071 - RNA, 17 nt, Molluscum contagiosum virus
cggcugccgcugccugu

SEQ ID NO: 3096072 - RNA, 16 nt, Molluscum contagiosum virus
gcgagcgacggcaggc

SEQ ID NO: 3096073 - RNA, 18 nt, Molluscum contagiosum virus
cagucgcaguacccgagc

SEQ ID NO: 3096074 - RNA, 20 nt, Molluscum contagiosum virus
gcagagguaaucccgagcuu

SEQ ID NO: 3096075 - RNA, 23 nt, Molluscum contagiosum virus
agcucgcgcaguuagaaaugcuu

SEQ ID NO: 3096076 - RNA, 15 nt, Molluscum contagiosum virus
gccacucuccuucag

SEQ ID NO: 3096077 - RNA, 14 nt, Molluscum contagiosum virus
ggacgagcugcuuc

SEQ ID NO: 3096078 - RNA, 12 nt, Molluscum contagiosum virus
guccacguggug

SEQ ID NO: 3096079 - RNA, 19 nt, Molluscum contagiosum virus
ccccgcugggccgcaugca

SEQ ID NO: 3096080 - RNA, 14 nt, Molluscum contagiosum virus
accgcaaccagcug

SEQ ID NO: 3096081 - RNA, 11 nt, Molluscum contagiosum virus
ggaaaggcacc

SEQ ID NO: 3096082 - RNA, 23 nt, Molluscum contagiosum virus
gcagcgucgcggagcgcgcacgg

SEQ ID NO: 3096083 - RNA, 19 nt, Molluscum contagiosum virus
ccugcggacccgccggugc

SEQ ID NO: 3096084 - RNA, 13 nt, Molluscum contagiosum virus
cacgcgcccgccg

SEQ ID NO: 3096085 - RNA, 16 nt, Molluscum contagiosum virus
cugcgcuucgagcugc

SEQ ID NO: 3096086 - RNA, 14 nt, Molluscum contagiosum virus
cuacgagcagcgcu

SEQ ID NO: 3096087 - RNA, 19 nt, Molluscum contagiosum virus
cgcagugcggccagcaccg

SEQ ID NO: 3096088 - RNA, 21 nt, Molluscum contagiosum virus
cgauguagguacccgcaaccc

SEQ ID NO: 3096089 - RNA, 14 nt, Molluscum contagiosum virus
cccgcugcgcgcuc

SEQ ID NO: 3096090 - RNA, 21 nt, Molluscum contagiosum virus
ccuaccugcaggaggaccgcg

SEQ ID NO: 3096091 - RNA, 16 nt, Molluscum contagiosum virus
gcaagaggggagccag

SEQ ID NO: 3096092 - RNA, 19 nt, Molluscum contagiosum virus
cucgcguccgcgcagcucg

SEQ ID NO: 3096093 - RNA, 15 nt, Molluscum contagiosum virus
cacgagggccuuggc

SEQ ID NO: 3096094 - RNA, 22 nt, Molluscum contagiosum virus
ucaaccccucggaggaaaagca

SEQ ID NO: 3096095 - RNA, 15 nt, Molluscum contagiosum virus
gucuugcgcagcgcc

SEQ ID NO: 3096096 - RNA, 18 nt, Molluscum contagiosum virus
cgcgcaaaaggcacgagg

SEQ ID NO: 3096097 - RNA, 17 nt, Molluscum contagiosum virus
ggcagcuggagcugccg

SEQ ID NO: 3096098 - RNA, 17 nt, Molluscum contagiosum virus
gcgccuuuccucucccg

SEQ ID NO: 3096099 - RNA, 17 nt, Molluscum contagiosum virus
cuggagcuggcugggca

SEQ ID NO: 3096100 - RNA, 17 nt, Molluscum contagiosum virus
gauggucucgcugcugg

SEQ ID NO: 3096101 - RNA, 21 nt, Molluscum contagiosum virus
acucaauucaaguuugacaag

SEQ ID NO: 3096102 - RNA, 16 nt, Molluscum contagiosum virus
agcacguuguucuugc

SEQ ID NO: 3096103 - RNA, 21 nt, Molluscum contagiosum virus
ggugcacgugcugcagcugcg

SEQ ID NO: 3096104 - RNA, 21 nt, Molluscum contagiosum virus
gguacccgcaggaaaggcacc

SEQ ID NO: 3096105 - RNA, 14 nt, Molluscum contagiosum virus
gaccuacuccuggc

SEQ ID NO: 3096106 - RNA, 18 nt, Molluscum contagiosum virus
caacaggagcauuccuug

SEQ ID NO: 3096107 - RNA, 16 nt, Molluscum contagiosum virus
gaacugcagcagcugg

SEQ ID NO: 3096108 - RNA, 12 nt, Molluscum contagiosum virus
cccgcgccgccc

SEQ ID NO: 3096109 - RNA, 21 nt, Molluscum contagiosum virus
ccucuccggucgcccuccgcc

SEQ ID NO: 3096110 - RNA, 23 nt, Molluscum contagiosum virus
cauggagagcguacucgggccgc

SEQ ID NO: 3096111 - RNA, 18 nt, Molluscum contagiosum virus
cgccuucugcaagcugcc

SEQ ID NO: 3096112 - RNA, 14 nt, Molluscum contagiosum virus
aacgcccaauucug

SEQ ID NO: 3096113 - RNA, 18 nt, Molluscum contagiosum virus
cgugaugugcgcacagac

SEQ ID NO: 3096114 - RNA, 15 nt, Molluscum contagiosum virus
cacacgcaccgccug

SEQ ID NO: 3096115 - RNA, 13 nt, Molluscum contagiosum virus
ucuucagaggaca

SEQ ID NO: 3096116 - RNA, 12 nt, Molluscum contagiosum virus
ggcaggcucccg

SEQ ID NO: 3096117 - RNA, 21 nt, Molluscum contagiosum virus
ucccgcgccacgagcgccgcg

SEQ ID NO: 3096118 - RNA, 16 nt, Molluscum contagiosum virus
gcgcacgcccucgccg

SEQ ID NO: 3096119 - RNA, 22 nt, Molluscum contagiosum virus
cccggcagcgacuacgcgcugc

SEQ ID NO: 3096120 - RNA, 13 nt, Molluscum contagiosum virus
ccgcaacgagguc

SEQ ID NO: 3096121 - RNA, 14 nt, Molluscum contagiosum virus
ggagcuggagcgag

SEQ ID NO: 3096122 - RNA, 17 nt, Molluscum contagiosum virus
cgugucaagcggcacgu

SEQ ID NO: 3096123 - RNA, 16 nt, Molluscum contagiosum virus
cgcuggaugcugcucg

SEQ ID NO: 3096124 - RNA, 21 nt, Molluscum contagiosum virus
ugcucaccgccgagauggagc

SEQ ID NO: 3096125 - RNA, 21 nt, Molluscum contagiosum virus
cacuugcgcguucgcaaagac

SEQ ID NO: 3096126 - RNA, 13 nt, Molluscum contagiosum virus
uggacgcuccgag

SEQ ID NO: 3096127 - RNA, 22 nt, Molluscum contagiosum virus
cagcaggcacgacgccgacacc

SEQ ID NO: 3096128 - RNA, 16 nt, Molluscum contagiosum virus
gugccgaggcgcugcc

SEQ ID NO: 3096129 - RNA, 17 nt, Molluscum contagiosum virus
acggcgugcugugccug

SEQ ID NO: 3096130 - RNA, 23 nt, Molluscum contagiosum virus
cgcggacacguuccagagcacug

SEQ ID NO: 3096131 - RNA, 15 nt, Molluscum contagiosum virus
gugcgcgugcgccug

SEQ ID NO: 3096132 - RNA, 23 nt, Molluscum contagiosum virus
gaccagauccgggcgcugcaccg

SEQ ID NO: 3096133 - RNA, 22 nt, Molluscum contagiosum virus
acugcggugacgguccugcgcg

SEQ ID NO: 3096134 - RNA, 23 nt, Molluscum contagiosum virus
ugcggcgcgggcaagcagggccu

SEQ ID NO: 3096135 - RNA, 13 nt, Molluscum contagiosum virus
gcaccaccagugc

SEQ ID NO: 3096136 - RNA, 15 nt, Molluscum contagiosum virus
cuagcgcuggcugca

SEQ ID NO: 3096137 - RNA, 13 nt, Molluscum contagiosum virus
uacgcgccagugc

SEQ ID NO: 3096138 - RNA, 15 nt, Molluscum contagiosum virus
gcguggccaggccgc

SEQ ID NO: 3096139 - RNA, 16 nt, Molluscum contagiosum virus
cucggcuucugcugca

SEQ ID NO: 3096140 - RNA, 16 nt, Molluscum contagiosum virus
ucgacgcgcugcucuc

SEQ ID NO: 3096141 - RNA, 17 nt, Molluscum contagiosum virus
ccggcagcuggagcugc

SEQ ID NO: 3096142 - RNA, 16 nt, Molluscum contagiosum virus
gcaccagguagagcaa

SEQ ID NO: 3096143 - RNA, 18 nt, Molluscum contagiosum virus
acgcgcccuggagcgcag

SEQ ID NO: 3096144 - RNA, 18 nt, Molluscum contagiosum virus
acacgucagccgcacggc

SEQ ID NO: 3096145 - RNA, 16 nt, Molluscum contagiosum virus
cuccaagaagaggcca

SEQ ID NO: 3096146 - RNA, 15 nt, Molluscum contagiosum virus
cgagugcuggagcag

SEQ ID NO: 3096147 - RNA, 23 nt, Molluscum contagiosum virus
agcuugacgcguacauccgcgag

SEQ ID NO: 3096148 - RNA, 21 nt, Molluscum contagiosum virus
gcgccgcgugcaugcccagca

SEQ ID NO: 3096149 - RNA, 12 nt, Molluscum contagiosum virus
agugcaccagca

SEQ ID NO: 3096150 - RNA, 21 nt, Molluscum contagiosum virus
cgccugaaccugggcgcgcac

SEQ ID NO: 3096151 - RNA, 13 nt, Molluscum contagiosum virus
ccacggcgcgccg

SEQ ID NO: 3096152 - RNA, 15 nt, Molluscum contagiosum virus
cucgugcugcucugc

SEQ ID NO: 3096153 - RNA, 20 nt, Molluscum contagiosum virus
ugcgggucucggggcuccgc

SEQ ID NO: 3096154 - RNA, 12 nt, Molluscum contagiosum virus
cgcgcugcugcu

SEQ ID NO: 3096155 - RNA, 12 nt, Molluscum contagiosum virus
cgaggcugcugc

SEQ ID NO: 3096156 - RNA, 21 nt, Molluscum contagiosum virus
agcuggacggugcuggugcug

SEQ ID NO: 3096157 - RNA, 22 nt, Molluscum contagiosum virus
ccgggaacgaggaaaggcaccc

SEQ ID NO: 3096158 - RNA, 12 nt, Molluscum contagiosum virus
cgcccagcaccu

SEQ ID NO: 3096159 - RNA, 16 nt, Molluscum contagiosum virus
gccgagguggcacccu

SEQ ID NO: 3096160 - RNA, 16 nt, Molluscum contagiosum virus
gcgcgcaucgcgggca

SEQ ID NO: 3096161 - RNA, 21 nt, Molluscum contagiosum virus
gagcaccaagaagcggcccug

SEQ ID NO: 3096162 - RNA, 22 nt, Molluscum contagiosum virus
caccgcggcgcggagcgcuucu

SEQ ID NO: 3096163 - RNA, 23 nt, Molluscum contagiosum virus
gccugcggguaguugcgagccag

SEQ ID NO: 3096164 - RNA, 20 nt, Molluscum contagiosum virus
agccucaucgugagccuggu

SEQ ID NO: 3096165 - RNA, 14 nt, Molluscum contagiosum virus
cucgcuuagccaac

SEQ ID NO: 3096166 - RNA, 14 nt, Molluscum contagiosum virus
cgcacgccagccug

SEQ ID NO: 3096167 - RNA, 14 nt, Molluscum contagiosum virus
cgcccgccagcaug

SEQ ID NO: 3096168 - RNA, 14 nt, Molluscum contagiosum virus
gaaucacggccagu

SEQ ID NO: 3096169 - RNA, 21 nt, Molluscum contagiosum virus
ggcguccggcgcuugccccuc

SEQ ID NO: 3096170 - RNA, 21 nt, Molluscum contagiosum virus
gcacagacauggcccgcgcgg

SEQ ID NO: 3096171 - RNA, 22 nt, Molluscum contagiosum virus
cgcgugcggugacuugccgugu

SEQ ID NO: 3096172 - RNA, 14 nt, Molluscum contagiosum virus
uacagcgcgcugca

SEQ ID NO: 3096173 - RNA, 15 nt, Molluscum contagiosum virus
guguuuugugccugc

SEQ ID NO: 3096174 - RNA, 19 nt, Molluscum contagiosum virus
accacccgaaagucccgcu

SEQ ID NO: 3096175 - RNA, 15 nt, Molluscum contagiosum virus
gcaaggcccacuucc

SEQ ID NO: 3096176 - RNA, 19 nt, Molluscum contagiosum virus
gagcaguucgcgcgccugc

SEQ ID NO: 3096177 - RNA, 17 nt, Molluscum contagiosum virus
cgccaagagcuggucgc

SEQ ID NO: 3096178 - RNA, 17 nt, Molluscum contagiosum virus
gugcacuagcacgggcg

SEQ ID NO: 3096179 - RNA, 15 nt, Molluscum contagiosum virus
gaugugacaacaugu

SEQ ID NO: 3096180 - RNA, 17 nt, Molluscum contagiosum virus
ucgcugcuccccgccag

SEQ ID NO: 3096181 - RNA, 13 nt, Molluscum contagiosum virus
gcaagacccagca

SEQ ID NO: 3096182 - RNA, 15 nt, Molluscum contagiosum virus
uggcgccgaugcagu

SEQ ID NO: 3096183 - RNA, 16 nt, Molluscum contagiosum virus
augcgcaagcagcucg

SEQ ID NO: 3096184 - RNA, 16 nt, Molluscum contagiosum virus
ugggcuucggaacgcu

SEQ ID NO: 3096185 - RNA, 14 nt, Molluscum contagiosum virus
gcuugggcacugcu

SEQ ID NO: 3096186 - RNA, 14 nt, Molluscum contagiosum virus
acguacagcgggcg

SEQ ID NO: 3096187 - RNA, 13 nt, Molluscum contagiosum virus
uucgucauggagc

SEQ ID NO: 3096188 - RNA, 13 nt, Molluscum contagiosum virus
gcucagcgccgcg

SEQ ID NO: 3096189 - RNA, 14 nt, Molluscum contagiosum virus
guggccaggccgcg

SEQ ID NO: 3096190 - RNA, 17 nt, Molluscum contagiosum virus
cgagucucuguaacaag

SEQ ID NO: 3096191 - RNA, 15 nt, Molluscum contagiosum virus
gacaaugagcacuug

SEQ ID NO: 3096192 - RNA, 21 nt, Molluscum contagiosum virus
agagaccgucaaccugcugcc

SEQ ID NO: 3096193 - RNA, 14 nt, Molluscum contagiosum virus
agucucuguaacaa

SEQ ID NO: 3096194 - RNA, 14 nt, Molluscum contagiosum virus
cgcgccgcccggga

SEQ ID NO: 3096195 - RNA, 13 nt, Molluscum contagiosum virus
cacgagcugcugu

SEQ ID NO: 3096196 - RNA, 13 nt, Molluscum contagiosum virus
gggcgcuccgagc

SEQ ID NO: 3096197 - RNA, 13 nt, Molluscum contagiosum virus
cgugcgcagcagc

SEQ ID NO: 3096198 - RNA, 22 nt, Molluscum contagiosum virus
cgccuucguggagcccgugcug

SEQ ID NO: 3096199 - RNA, 15 nt, Molluscum contagiosum virus
gcugcuccugcucug

SEQ ID NO: 3096200 - RNA, 20 nt, Molluscum contagiosum virus
gccgagccaaggaugccugc

SEQ ID NO: 3096201 - RNA, 20 nt, Molluscum contagiosum virus
gcggaccuaaagcugcuggc

SEQ ID NO: 3096202 - RNA, 21 nt, Molluscum contagiosum virus
cgcggcaagccuggcuccugu

SEQ ID NO: 3096203 - RNA, 17 nt, Molluscum contagiosum virus
aacacugacgcucgggc

SEQ ID NO: 3096204 - RNA, 16 nt, Molluscum contagiosum virus
uuuccuugccuucucg

SEQ ID NO: 3096205 - RNA, 15 nt, Molluscum contagiosum virus
ucugccggaguaaau

SEQ ID NO: 3096206 - RNA, 19 nt, Molluscum contagiosum virus
ugugguucaugacggcgug

SEQ ID NO: 3096207 - RNA, 16 nt, Molluscum contagiosum virus
uacaggcgcggcagcc

SEQ ID NO: 3096208 - RNA, 14 nt, Molluscum contagiosum virus
acgcugcugcacag

SEQ ID NO: 3096209 - RNA, 19 nt, Molluscum contagiosum virus
gcgagaugcgcggacagag

SEQ ID NO: 3096210 - RNA, 20 nt, Molluscum contagiosum virus
uguuccaagaagacuaccac

SEQ ID NO: 3096211 - RNA, 19 nt, Molluscum contagiosum virus
aggagagagagacaugcac

SEQ ID NO: 3096212 - RNA, 19 nt, Molluscum contagiosum virus
gacugcccgcgcccugcac

SEQ ID NO: 3096213 - RNA, 21 nt, Molluscum contagiosum virus
gcgcgagugugugcaucccuc

SEQ ID NO: 3096214 - RNA, 22 nt, Molluscum contagiosum virus
uguccgaggacuuccgcgcgcu

SEQ ID NO: 3096215 - RNA, 13 nt, Molluscum contagiosum virus
cuugcgcagcgcc

SEQ ID NO: 3096216 - RNA, 15 nt, Molluscum contagiosum virus
cucggcuucugcugc

SEQ ID NO: 3096217 - RNA, 17 nt, Molluscum contagiosum virus
ugcggcgcgggcaagca

SEQ ID NO: 3096218 - RNA, 14 nt, Molluscum contagiosum virus
cuucguggcgcugg

SEQ ID NO: 3096219 - RNA, 22 nt, Molluscum contagiosum virus
gucuagccgugaacgaggcugc

SEQ ID NO: 3096220 - RNA, 24 nt, Molluscum contagiosum virus
cgcaagugugcgcaucccucgucu

SEQ ID NO: 3096221 - RNA, 15 nt, Molluscum contagiosum virus
gacccaucggagaag

SEQ ID NO: 3096222 - RNA, 18 nt, Molluscum contagiosum virus
acucgcgcgcgccgggcc

SEQ ID NO: 3096223 - RNA, 23 nt, Molluscum contagiosum virus
cccgagcuaaauggacgcggacc

SEQ ID NO: 3096224 - RNA, 18 nt, Molluscum contagiosum virus
aauccaugucgagcccug

SEQ ID NO: 3096225 - RNA, 18 nt, Molluscum contagiosum virus
ucagccccgggcccgcau

SEQ ID NO: 3096226 - RNA, 15 nt, Molluscum contagiosum virus
caccagcaccagcac

SEQ ID NO: 3096227 - RNA, 16 nt, Molluscum contagiosum virus
cggcacaugcagcugc

SEQ ID NO: 3096228 - RNA, 20 nt, Molluscum contagiosum virus
guacuucaagcacgagcugc

SEQ ID NO: 3096229 - RNA, 12 nt, Molluscum contagiosum virus
ccaggcacuggc

SEQ ID NO: 3096230 - RNA, 17 nt, Molluscum contagiosum virus
gcaccugcaucgcgccg

SEQ ID NO: 3096231 - RNA, 22 nt, Molluscum contagiosum virus
gcgcuuccgcgagucugccagc

SEQ ID NO: 3096232 - RNA, 20 nt, Molluscum contagiosum virus
cuucguggccuaccugcagg

SEQ ID NO: 3096233 - RNA, 16 nt, Molluscum contagiosum virus
gaggaggcaagcgggc

SEQ ID NO: 3096234 - RNA, 14 nt, Molluscum contagiosum virus
ggccagccucaucg

SEQ ID NO: 3096235 - RNA, 13 nt, Molluscum contagiosum virus
gcgugcucgacuc

SEQ ID NO: 3096236 - RNA, 18 nt, Molluscum contagiosum virus
augcagauuggaggagga

SEQ ID NO: 3096237 - RNA, 14 nt, Molluscum contagiosum virus
gcauggcggcggcc

SEQ ID NO: 3096238 - RNA, 16 nt, Molluscum contagiosum virus
gagugcuggagcagac

SEQ ID NO: 3096239 - RNA, 21 nt, Molluscum contagiosum virus
cugcggcuccaacagcagcug

SEQ ID NO: 3096240 - RNA, 21 nt, Molluscum contagiosum virus
accuuccuccagggcacgauc

SEQ ID NO: 3096241 - RNA, 13 nt, Molluscum contagiosum virus
guggcaagggcuc

SEQ ID NO: 3096242 - RNA, 20 nt, Molluscum contagiosum virus
caagugcgcgugucuggagc

SEQ ID NO: 3096243 - RNA, 15 nt, Molluscum contagiosum virus
accgagugcuggccg

SEQ ID NO: 3096244 - RNA, 14 nt, Molluscum contagiosum virus
guccacgcgcccga

SEQ ID NO: 3096245 - RNA, 22 nt, Molluscum contagiosum virus
ggcacccgcaacaaggaaaggc

SEQ ID NO: 3096246 - RNA, 17 nt, Molluscum contagiosum virus
cucgccuccgggcgcac

SEQ ID NO: 3096247 - RNA, 16 nt, Molluscum contagiosum virus
cgugcgcuggcgcgcg

SEQ ID NO: 3096248 - RNA, 21 nt, Molluscum contagiosum virus
ugagcaggucggccagcagcu

SEQ ID NO: 3096249 - RNA, 23 nt, Molluscum contagiosum virus
gcacuugcaggccuccuucccug

SEQ ID NO: 3096250 - RNA, 21 nt, Molluscum contagiosum virus
cugccgguggaagagcccgca

SEQ ID NO: 3096251 - RNA, 20 nt, Molluscum contagiosum virus
gccugcugcucuucgugcug

SEQ ID NO: 3096252 - RNA, 22 nt, Molluscum contagiosum virus
acgcgccgcgcgcuuacuaagc

SEQ ID NO: 3096253 - RNA, 15 nt, Molluscum contagiosum virus
ggagcuccgugcugc

SEQ ID NO: 3096254 - RNA, 17 nt, Molluscum contagiosum virus
gccggcaaggggccagc

SEQ ID NO: 3096255 - RNA, 14 nt, Molluscum contagiosum virus
ggccuaccugcagg

SEQ ID NO: 3096256 - RNA, 15 nt, Molluscum contagiosum virus
cagaaucgcuuugcc

SEQ ID NO: 3096257 - RNA, 11 nt, Molluscum contagiosum virus
cuugggcacug

SEQ ID NO: 3096258 - RNA, 19 nt, Molluscum contagiosum virus
gcgcgacgucgucaaggau

SEQ ID NO: 3096259 - RNA, 21 nt, Molluscum contagiosum virus
cccggcaggcucccgcugucg

SEQ ID NO: 3096260 - RNA, 20 nt, Molluscum contagiosum virus
cguuacggagaccuggucac

SEQ ID NO: 3096261 - RNA, 16 nt, Molluscum contagiosum virus
cuacagcgcgcugcac

SEQ ID NO: 3096262 - RNA, 13 nt, Molluscum contagiosum virus
cggcgcggagcgc

SEQ ID NO: 3096263 - RNA, 22 nt, Molluscum contagiosum virus
acacgagggccuuggcggcgcg

SEQ ID NO: 3096264 - RNA, 16 nt, Molluscum contagiosum virus
ucggaugcgcugccgg

SEQ ID NO: 3096265 - RNA, 17 nt, Molluscum contagiosum virus
aucacggccgggauuug

SEQ ID NO: 3096266 - RNA, 15 nt, Molluscum contagiosum virus
gccgagcgcacgccg

SEQ ID NO: 3096267 - RNA, 20 nt, Molluscum contagiosum virus
uugccccgcgcguugcugcc

SEQ ID NO: 3096268 - RNA, 23 nt, Molluscum contagiosum virus
ccugcgaaaaagcccgcggguac

SEQ ID NO: 3096269 - RNA, 14 nt, Molluscum contagiosum virus
cgucuucuaccgcc

SEQ ID NO: 3096270 - RNA, 22 nt, Molluscum contagiosum virus
cggacgcccuccucgaccugca

SEQ ID NO: 3096271 - RNA, 13 nt, Molluscum contagiosum virus
gcuguuucugccg

SEQ ID NO: 3096272 - RNA, 12 nt, Molluscum contagiosum virus
agcucagcaggc

SEQ ID NO: 3096273 - RNA, 19 nt, Molluscum contagiosum virus
ggcguguccgcgggcgcgc

SEQ ID NO: 3096274 - RNA, 18 nt, Molluscum contagiosum virus
ugcgagccagccaggcgc

SEQ ID NO: 3096275 - RNA, 19 nt, Molluscum contagiosum virus
acgcacgcuugccuuggcg

SEQ ID NO: 3096276 - RNA, 19 nt, Molluscum contagiosum virus
uugaucgacauggagcgca

SEQ ID NO: 3096277 - RNA, 17 nt, Molluscum contagiosum virus
ggagaacaugcucgcca

SEQ ID NO: 3096278 - RNA, 13 nt, Molluscum contagiosum virus
cccggcgcgcgcg

SEQ ID NO: 3096279 - RNA, 16 nt, Molluscum contagiosum virus
uaacgugauccgagac

SEQ ID NO: 3096280 - RNA, 19 nt, Molluscum contagiosum virus
ucugucguggaggaaacac

SEQ ID NO: 3096281 - RNA, 17 nt, Molluscum contagiosum virus
cccgccgacugccgccg

SEQ ID NO: 3096282 - RNA, 14 nt, Molluscum contagiosum virus
uccaguaccagcuc

SEQ ID NO: 3096283 - RNA, 20 nt, Molluscum contagiosum virus
ccuugccgaggaggugcucu

SEQ ID NO: 3096284 - RNA, 22 nt, Molluscum contagiosum virus
acugucucugcgcgagcagcug

SEQ ID NO: 3096285 - RNA, 22 nt, Molluscum contagiosum virus
cgugcagggcgugcuugccugg

SEQ ID NO: 3096286 - RNA, 16 nt, Molluscum contagiosum virus
caucggcggcagcgcc

SEQ ID NO: 3096287 - RNA, 15 nt, Molluscum contagiosum virus
cggcaguagcagcgc

SEQ ID NO: 3096288 - RNA, 23 nt, Molluscum contagiosum virus
gcuuccucuacaccagcuggacg

SEQ ID NO: 3096289 - RNA, 16 nt, Molluscum contagiosum virus
cgcacucgcuggccuc

SEQ ID NO: 3096290 - RNA, 16 nt, Molluscum contagiosum virus
acagagaaaggcaccc

SEQ ID NO: 3096291 - RNA, 19 nt, Molluscum contagiosum virus
guggcaaaccacgagcgug

SEQ ID NO: 3096292 - RNA, 11 nt, Molluscum contagiosum virus
guauuuccagc

SEQ ID NO: 3096293 - RNA, 18 nt, Molluscum contagiosum virus
cccgccuucgacggcuuc

SEQ ID NO: 3096294 - RNA, 13 nt, Molluscum contagiosum virus
gcguccgcaggcg

SEQ ID NO: 3096295 - RNA, 14 nt, Molluscum contagiosum virus
agugccgagcucgc

SEQ ID NO: 3096296 - RNA, 20 nt, Molluscum contagiosum virus
cgcgugcgcgugccucugcc

SEQ ID NO: 3096297 - RNA, 18 nt, Molluscum contagiosum virus
gcccgcgaaggagagaga

SEQ ID NO: 3096298 - RNA, 18 nt, Molluscum contagiosum virus
gcugguuaccaagggcau

SEQ ID NO: 3096299 - RNA, 19 nt, Molluscum contagiosum virus
caaggccgcgcccaagaag

SEQ ID NO: 3096300 - RNA, 12 nt, Molluscum contagiosum virus
cguacugcugca

SEQ ID NO: 3096301 - RNA, 17 nt, Molluscum contagiosum virus
gcugcucgacgggcgca

SEQ ID NO: 3096302 - RNA, 16 nt, Molluscum contagiosum virus
uccugaacaagcugca

SEQ ID NO: 3096303 - RNA, 17 nt, Molluscum contagiosum virus
gcgugggugaggagcuc

SEQ ID NO: 3096304 - RNA, 15 nt, Molluscum contagiosum virus
gccugugccugcaag

SEQ ID NO: 3096305 - RNA, 14 nt, Molluscum contagiosum virus
agcgcuggcuucuu

SEQ ID NO: 3096306 - RNA, 14 nt, Molluscum contagiosum virus
cgugcagggcgugc

SEQ ID NO: 3096307 - RNA, 23 nt, Molluscum contagiosum virus
uagagcacgaagcuacgcuccgu

SEQ ID NO: 3096308 - RNA, 15 nt, Molluscum contagiosum virus
cugaaaauagagagu

SEQ ID NO: 3096309 - RNA, 23 nt, Molluscum contagiosum virus
caugcgugcuucacgugcuugcc

SEQ ID NO: 3096310 - RNA, 21 nt, Molluscum contagiosum virus
cagccuguuuuuaucgagccg

SEQ ID NO: 3096311 - RNA, 13 nt, Molluscum contagiosum virus
uccaggcgccgca

SEQ ID NO: 3096312 - RNA, 15 nt, Molluscum contagiosum virus
ggcuguggacaugau

SEQ ID NO: 3096313 - RNA, 17 nt, Molluscum contagiosum virus
ggugcauacgcagaggc

SEQ ID NO: 3096314 - RNA, 13 nt, Molluscum contagiosum virus
cuuccagcacugc

SEQ ID NO: 3096315 - RNA, 19 nt, Molluscum contagiosum virus
ucgcgggcccgccuuugug

SEQ ID NO: 3096316 - RNA, 20 nt, Molluscum contagiosum virus
guagugguccaccagcugcc

SEQ ID NO: 3096317 - RNA, 22 nt, Molluscum contagiosum virus
acugccuggucacagacacgcu

SEQ ID NO: 3096318 - RNA, 17 nt, Molluscum contagiosum virus
ggaugccuuucaggggu

SEQ ID NO: 3096319 - RNA, 22 nt, Molluscum contagiosum virus
cuuguccgcggacgcgggccug

SEQ ID NO: 3096320 - RNA, 21 nt, Molluscum contagiosum virus
ggccacucucccgggcucugu

SEQ ID NO: 3096321 - RNA, 13 nt, Molluscum contagiosum virus
ucucuucaugaaa

SEQ ID NO: 3096322 - RNA, 22 nt, Molluscum contagiosum virus
gcaaagaaugcaugcggagcug

SEQ ID NO: 3096323 - RNA, 14 nt, Molluscum contagiosum virus
ucgucaaugcgcac

SEQ ID NO: 3096324 - RNA, 15 nt, Molluscum contagiosum virus
gcacggcgcccagga

SEQ ID NO: 3096325 - RNA, 15 nt, Molluscum contagiosum virus
ccacugugccagcag

SEQ ID NO: 3096326 - RNA, 16 nt, Molluscum contagiosum virus
ccguaagucgaagagg

SEQ ID NO: 3096327 - RNA, 15 nt, Molluscum contagiosum virus
cagugccgcugagag

SEQ ID NO: 3096328 - RNA, 15 nt, Molluscum contagiosum virus
cgccggcugcgccac

SEQ ID NO: 3096329 - RNA, 21 nt, Molluscum contagiosum virus
cagaaggggggguaaugcaga

SEQ ID NO: 3096330 - RNA, 17 nt, Molluscum contagiosum virus
gcgcucacugcgaucgc

SEQ ID NO: 3096331 - RNA, 23 nt, Molluscum contagiosum virus
aacaacuugggagcaaggccugg

SEQ ID NO: 3096332 - RNA, 17 nt, Molluscum contagiosum virus
ucugccaccaugcgcac

SEQ ID NO: 3096333 - RNA, 21 nt, Molluscum contagiosum virus
gagggcagccucaaccugaac

SEQ ID NO: 3096334 - RNA, 18 nt, Molluscum contagiosum virus
ccaacacuaccacagcca

SEQ ID NO: 3096335 - RNA, 14 nt, Molluscum contagiosum virus
acaagccguccgcc

SEQ ID NO: 3096336 - RNA, 18 nt, Molluscum contagiosum virus
gcgcggaagcccgagcgc

SEQ ID NO: 3096337 - RNA, 13 nt, Molluscum contagiosum virus
acaaaaacugaaa

SEQ ID NO: 3096338 - RNA, 16 nt, Molluscum contagiosum virus
cgccugugccugcaag

SEQ ID NO: 3096339 - RNA, 13 nt, Molluscum contagiosum virus
cgcggccugggcc

SEQ ID NO: 3096340 - RNA, 18 nt, Molluscum contagiosum virus
cgcggauauggcgcgccg

SEQ ID NO: 3096341 - RNA, 14 nt, Molluscum contagiosum virus
gacgugcugcugca

SEQ ID NO: 3096342 - RNA, 18 nt, Molluscum contagiosum virus
gcgugcggaucggcacug

SEQ ID NO: 3096343 - RNA, 17 nt, Molluscum contagiosum virus
gcacacgcgucgcgcag

SEQ ID NO: 3096344 - RNA, 13 nt, Molluscum contagiosum virus
cgcaagcgugugu

SEQ ID NO: 3096345 - RNA, 21 nt, Molluscum contagiosum virus
cagccgcugcgccgccagcgu

SEQ ID NO: 3096346 - RNA, 18 nt, Molluscum contagiosum virus
caagacccagcaaggccc

SEQ ID NO: 3096347 - RNA, 17 nt, Molluscum contagiosum virus
ggagacuugagcccaga

SEQ ID NO: 3096348 - RNA, 17 nt, Molluscum contagiosum virus
caguucgagcugcugcg

SEQ ID NO: 3096349 - RNA, 18 nt, Molluscum contagiosum virus
uagaagagcgguuccugc

SEQ ID NO: 3096350 - RNA, 21 nt, Molluscum contagiosum virus
cgccgggaaacgcacagcccc

SEQ ID NO: 3096351 - RNA, 18 nt, Molluscum contagiosum virus
ggagggcacgcugcacau

SEQ ID NO: 3096352 - RNA, 16 nt, Molluscum contagiosum virus
auuguagagacgcugc

SEQ ID NO: 3096353 - RNA, 20 nt, Molluscum contagiosum virus
gcgcaagucaccgcuccgca

SEQ ID NO: 3096354 - RNA, 19 nt, Molluscum contagiosum virus
gcuccgccgggaauaccgg

SEQ ID NO: 3096355 - RNA, 15 nt, Molluscum contagiosum virus
ugccggcucagcgug

SEQ ID NO: 3096356 - RNA, 14 nt, Molluscum contagiosum virus
gcugccgcugcgcg

SEQ ID NO: 3096357 - RNA, 20 nt, Molluscum contagiosum virus
gcaaaugcgucccagcagcu

SEQ ID NO: 3096358 - RNA, 11 nt, Molluscum contagiosum virus
accggagaggg

SEQ ID NO: 3096359 - RNA, 23 nt, Molluscum contagiosum virus
gauucgugcucguguugugccug

SEQ ID NO: 3096360 - RNA, 12 nt, Molluscum contagiosum virus
ggaggacggcgc

SEQ ID NO: 3096361 - RNA, 13 nt, Molluscum contagiosum virus
gaaucuugccugu

SEQ ID NO: 3096362 - RNA, 15 nt, Molluscum contagiosum virus
acgcgggccaggcac

SEQ ID NO: 3096363 - RNA, 15 nt, Molluscum contagiosum virus
gcugcuccccgccag

SEQ ID NO: 3096364 - RNA, 16 nt, Molluscum contagiosum virus
gaacgaggagggcagc

SEQ ID NO: 3096365 - RNA, 23 nt, Molluscum contagiosum virus
acgcacacgacgacggcugcucg

SEQ ID NO: 3096366 - RNA, 14 nt, Molluscum contagiosum virus
ccuuggacacgugc

SEQ ID NO: 3096367 - RNA, 18 nt, Molluscum contagiosum virus
gcgcacgccgcucucgug

SEQ ID NO: 3096368 - RNA, 21 nt, Molluscum contagiosum virus
ggcgcccgugccgccggcgcc

SEQ ID NO: 3096369 - RNA, 14 nt, Molluscum contagiosum virus
gcgacuacaccugg

SEQ ID NO: 3096370 - RNA, 18 nt, Molluscum contagiosum virus
cgccagguguuccugccg

SEQ ID NO: 3096371 - RNA, 15 nt, Molluscum contagiosum virus
uggcgcugggcgcgc

SEQ ID NO: 3096372 - RNA, 19 nt, Molluscum contagiosum virus
cugcccgaguuucggaaga

SEQ ID NO: 3096373 - RNA, 19 nt, Molluscum contagiosum virus
ccguccuugcucuggcucu

SEQ ID NO: 3096374 - RNA, 17 nt, Molluscum contagiosum virus
ucggaacccagaaagaa

SEQ ID NO: 3096375 - RNA, 16 nt, Molluscum contagiosum virus
cgugggcggcauccug

SEQ ID NO: 3096376 - RNA, 17 nt, Molluscum contagiosum virus
caagaaggcgcuggugg

SEQ ID NO: 3096377 - RNA, 13 nt, Molluscum contagiosum virus
ggacgugcugcug

SEQ ID NO: 3096378 - RNA, 16 nt, Molluscum contagiosum virus
gcucggcacugcuggc

SEQ ID NO: 3096379 - RNA, 16 nt, Molluscum contagiosum virus
gggcaugcacagcugc

SEQ ID NO: 3096380 - RNA, 13 nt, Molluscum contagiosum virus
ugguggagcacuu

SEQ ID NO: 3096381 - RNA, 23 nt, Molluscum contagiosum virus
aguggcggcaaaagggcucugcc

SEQ ID NO: 3096382 - RNA, 21 nt, Molluscum contagiosum virus
accgacguuuucuuugcgcuc

SEQ ID NO: 3096383 - RNA, 15 nt, Molluscum contagiosum virus
gcgcagucccagcac

SEQ ID NO: 3096384 - RNA, 23 nt, Molluscum contagiosum virus
ucgccggaggaaggacagugucu

SEQ ID NO: 3096385 - RNA, 18 nt, Molluscum contagiosum virus
cuagcgggccuguaccug

SEQ ID NO: 3096386 - RNA, 18 nt, Molluscum contagiosum virus
ccacgaccgcaagugcac

SEQ ID NO: 3096387 - RNA, 19 nt, Molluscum contagiosum virus
gcaggucaacuccgagcgc

SEQ ID NO: 3096388 - RNA, 17 nt, Molluscum contagiosum virus
gagaagcuguaccuggu

SEQ ID NO: 3096389 - RNA, 14 nt, Molluscum contagiosum virus
aggcaggggccgcc

SEQ ID NO: 3096390 - RNA, 22 nt, Molluscum contagiosum virus
cagcgcuuuguugccucaguac

SEQ ID NO: 3096391 - RNA, 16 nt, Molluscum contagiosum virus
accgucgcguggugcu

SEQ ID NO: 3096392 - RNA, 23 nt, Molluscum contagiosum virus
gacucgcugccagagauccgccc

SEQ ID NO: 3096393 - RNA, 16 nt, Molluscum contagiosum virus
gcggcguacgcgcagg

SEQ ID NO: 3096394 - RNA, 16 nt, Molluscum contagiosum virus
cacaagggcagcucaa

SEQ ID NO: 3096395 - RNA, 14 nt, Molluscum contagiosum virus
caguucgagcugcu

SEQ ID NO: 3096396 - RNA, 13 nt, Molluscum contagiosum virus
cgcgugcgccugc

SEQ ID NO: 3096397 - RNA, 12 nt, Molluscum contagiosum virus
aucgacgagguc

SEQ ID NO: 3096398 - RNA, 17 nt, Molluscum contagiosum virus
augguguacgaaaguac

SEQ ID NO: 3096399 - RNA, 17 nt, Molluscum contagiosum virus
ccgacacguugcacugc

SEQ ID NO: 3096400 - RNA, 19 nt, Molluscum contagiosum virus
guaugcgaggccugcgugg

SEQ ID NO: 3096401 - RNA, 15 nt, Molluscum contagiosum virus
gccgcggccgcgaga

SEQ ID NO: 3096402 - RNA, 16 nt, Molluscum contagiosum virus
gcauacacuuccugcu

SEQ ID NO: 3096403 - RNA, 19 nt, Molluscum contagiosum virus
gagguaguuugcggagcag

SEQ ID NO: 3096404 - RNA, 16 nt, Molluscum contagiosum virus
ccugaacaagcugcac

SEQ ID NO: 3096405 - RNA, 21 nt, Molluscum contagiosum virus
ggcaugcgcgcagugccgcug

SEQ ID NO: 3096406 - RNA, 16 nt, Molluscum contagiosum virus
gccagcguacggcccg

SEQ ID NO: 3096407 - RNA, 23 nt, Molluscum contagiosum virus
guaguccaggugguagcggaggc

SEQ ID NO: 3096408 - RNA, 20 nt, Molluscum contagiosum virus
cggcccgaguacgcucucca

SEQ ID NO: 3096409 - RNA, 21 nt, Molluscum contagiosum virus
ggucacgcgcaaggccgcgcc

SEQ ID NO: 3096410 - RNA, 19 nt, Molluscum contagiosum virus
uggccuaccugcaggagga

SEQ ID NO: 3096411 - RNA, 16 nt, Molluscum contagiosum virus
uccagcccugugcccg

SEQ ID NO: 3096412 - RNA, 16 nt, Molluscum contagiosum virus
gcauuccuuguccugg

SEQ ID NO: 3096413 - RNA, 19 nt, Molluscum contagiosum virus
gcgugcucgacucggaugc

SEQ ID NO: 3096414 - RNA, 15 nt, Molluscum contagiosum virus
ccugaacaagcugca

SEQ ID NO: 3096415 - RNA, 20 nt, Molluscum contagiosum virus
gcaucugcgcgugcugucag

SEQ ID NO: 3096416 - RNA, 18 nt, Molluscum contagiosum virus
gugacggcccaccuucuu

SEQ ID NO: 3096417 - RNA, 12 nt, Molluscum contagiosum virus
cgcggcgcacaa

SEQ ID NO: 3096418 - RNA, 16 nt, Molluscum contagiosum virus
cuuggcgggcagcggc

SEQ ID NO: 3096419 - RNA, 21 nt, Molluscum contagiosum virus
cucuacgccgcgcaccuggag

SEQ ID NO: 3096420 - RNA, 21 nt, Molluscum contagiosum virus
uaccugaagcuggacgugggc

SEQ ID NO: 3096421 - RNA, 12 nt, Molluscum contagiosum virus
ccagcagcugcu

SEQ ID NO: 3096422 - RNA, 19 nt, Molluscum contagiosum virus
cgcgugcucacgcccuuca

SEQ ID NO: 3096423 - RNA, 21 nt, Molluscum contagiosum virus
cggagcgcgcacggcagcggc

SEQ ID NO: 3096424 - RNA, 22 nt, Molluscum contagiosum virus
caagcguuuucgucauggagca

SEQ ID NO: 3096425 - RNA, 12 nt, Molluscum contagiosum virus
ggcacguccgcc

SEQ ID NO: 3096426 - RNA, 16 nt, Molluscum contagiosum virus
uccggcagcuggagcu

SEQ ID NO: 3096427 - RNA, 22 nt, Molluscum contagiosum virus
gcacgcguaaacgcggugagug

SEQ ID NO: 3096428 - RNA, 15 nt, Molluscum contagiosum virus
ccuggcggcagcacg

SEQ ID NO: 3096429 - RNA, 13 nt, Molluscum contagiosum virus
ucaaccugcugcc

SEQ ID NO: 3096430 - RNA, 18 nt, Molluscum contagiosum virus
gcugcacaugugcgugca

SEQ ID NO: 3096431 - RNA, 19 nt, Molluscum contagiosum virus
agcucguggacagccugca

SEQ ID NO: 3096432 - RNA, 21 nt, Molluscum contagiosum virus
gucguccggaggcacgggcuc

SEQ ID NO: 3096433 - RNA, 21 nt, Molluscum contagiosum virus
acccaucggagaagugcuccg

SEQ ID NO: 3096434 - RNA, 22 nt, Molluscum contagiosum virus
gccaucgugcgcgacuuggggc

SEQ ID NO: 3096435 - RNA, 15 nt, Molluscum contagiosum virus
ucggcaugcagcgca

SEQ ID NO: 3096436 - RNA, 20 nt, Molluscum contagiosum virus
gcugcuccgugcccacgagc

SEQ ID NO: 3096437 - RNA, 17 nt, Molluscum contagiosum virus
ccgcgcgcucgcgcuuc

SEQ ID NO: 3096438 - RNA, 14 nt, Molluscum contagiosum virus
cucgagcuccaggg

SEQ ID NO: 3096439 - RNA, 15 nt, Molluscum contagiosum virus
gugacaaucucugcg

SEQ ID NO: 3096440 - RNA, 18 nt, Molluscum contagiosum virus
gaggaaaggcacaccccu

SEQ ID NO: 3096441 - RNA, 19 nt, Molluscum contagiosum virus
cagugcggcgcggcugcuc

SEQ ID NO: 3096442 - RNA, 23 nt, Molluscum contagiosum virus
cucuguugcguuggcgccagccu

SEQ ID NO: 3096443 - RNA, 14 nt, Molluscum contagiosum virus
accugcggcugcgg

SEQ ID NO: 3096444 - RNA, 14 nt, Molluscum contagiosum virus
uaagaguccacugc

SEQ ID NO: 3096445 - RNA, 13 nt, Molluscum contagiosum virus
cacaucaugggcu

SEQ ID NO: 3096446 - RNA, 17 nt, Molluscum contagiosum virus
ugcacgcuguccaggcg

SEQ ID NO: 3096447 - RNA, 15 nt, Molluscum contagiosum virus
caaagcccuccugag

SEQ ID NO: 3096448 - RNA, 19 nt, Molluscum contagiosum virus
gccgggccugcggcggcgc

SEQ ID NO: 3096449 - RNA, 17 nt, Molluscum contagiosum virus
cggcccgagcaggacgu

SEQ ID NO: 3096450 - RNA, 13 nt, Molluscum contagiosum virus
ugcgugcuagccc

SEQ ID NO: 3096451 - RNA, 14 nt, Molluscum contagiosum virus
gccugcgcgcaccc

SEQ ID NO: 3096452 - RNA, 13 nt, Molluscum contagiosum virus
cucccagcagcgu

SEQ ID NO: 3096453 - RNA, 13 nt, Molluscum contagiosum virus
cgcaggaaaggua

SEQ ID NO: 3096454 - RNA, 19 nt, Molluscum contagiosum virus
gcgugccgggcuugcuccc

SEQ ID NO: 3096455 - RNA, 13 nt, Molluscum contagiosum virus
ccgcggccugggc

SEQ ID NO: 3096456 - RNA, 20 nt, Molluscum contagiosum virus
gccuaggaggagaacuccaa

SEQ ID NO: 3096457 - RNA, 16 nt, Molluscum contagiosum virus
gcagugcaccagcacc

SEQ ID NO: 3096458 - RNA, 14 nt, Molluscum contagiosum virus
gcugguucugcucg

SEQ ID NO: 3096459 - RNA, 20 nt, Molluscum contagiosum virus
cgcgggccuuugccgcugcc

SEQ ID NO: 3096460 - RNA, 12 nt, Molluscum contagiosum virus
gcgguggugaaa

SEQ ID NO: 3096461 - RNA, 15 nt, Molluscum contagiosum virus
cugcccucgggagaa

SEQ ID NO: 3096462 - RNA, 12 nt, Molluscum contagiosum virus
gcgcgccuuccg

SEQ ID NO: 3096463 - RNA, 14 nt, Molluscum contagiosum virus
gccgccgggccugc

SEQ ID NO: 3096464 - RNA, 20 nt, Molluscum contagiosum virus
gugcacucgagaagaggguc

SEQ ID NO: 3096465 - RNA, 16 nt, Molluscum contagiosum virus
caggcgucgcgcacag

SEQ ID NO: 3096466 - RNA, 14 nt, Molluscum contagiosum virus
guucugcucgcagg

SEQ ID NO: 3096467 - RNA, 15 nt, Molluscum contagiosum virus
gcacgcaacugcccg

SEQ ID NO: 3096468 - RNA, 15 nt, Molluscum contagiosum virus
acgggaagcuuucag

SEQ ID NO: 3096469 - RNA, 20 nt, Molluscum contagiosum virus
guaauccaugucgagcccug

SEQ ID NO: 3096470 - RNA, 19 nt, Molluscum contagiosum virus
acgggcccgcgaaggagag

SEQ ID NO: 3096471 - RNA, 19 nt, Molluscum contagiosum virus
gccggcaucgcgcugcugg

SEQ ID NO: 3096472 - RNA, 17 nt, Molluscum contagiosum virus
gcgauugccccugggcu

SEQ ID NO: 3096473 - RNA, 20 nt, Molluscum contagiosum virus
gccaaggaugccugccagca

SEQ ID NO: 3096474 - RNA, 17 nt, Molluscum contagiosum virus
ucuacgggaagcugcac

SEQ ID NO: 3096475 - RNA, 14 nt, Molluscum contagiosum virus
gccccugcugcucg

SEQ ID NO: 3096476 - RNA, 20 nt, Molluscum contagiosum virus
augggcgugcucacgcugcc

SEQ ID NO: 3096477 - RNA, 22 nt, Molluscum contagiosum virus
agggcuccuucuucagcaggcc

SEQ ID NO: 3096478 - RNA, 16 nt, Molluscum contagiosum virus
cgucgcacaguucacg

SEQ ID NO: 3096479 - RNA, 15 nt, Molluscum contagiosum virus
cgcggaaacaugugu

SEQ ID NO: 3096480 - RNA, 14 nt, Molluscum contagiosum virus
gccagugcaguggc

SEQ ID NO: 3096481 - RNA, 13 nt, Molluscum contagiosum virus
cccgcggagcugu

SEQ ID NO: 3096482 - RNA, 16 nt, Molluscum contagiosum virus
gcgcggcccgagcagg

SEQ ID NO: 3096483 - RNA, 14 nt, Molluscum contagiosum virus
gugcgccugugcug

SEQ ID NO: 3096484 - RNA, 14 nt, Molluscum contagiosum virus
gcgcuugggcacug

SEQ ID NO: 3096485 - RNA, 17 nt, Molluscum contagiosum virus
ggaacucgaggcucugu

SEQ ID NO: 3096486 - RNA, 20 nt, Molluscum contagiosum virus
cagcugcuucucuucaugaa

SEQ ID NO: 3096487 - RNA, 18 nt, Molluscum contagiosum virus
aaucucgccggcuguaaa

SEQ ID NO: 3096488 - RNA, 20 nt, Molluscum contagiosum virus
cagcgcuuguuucgcaugca

SEQ ID NO: 3096489 - RNA, 20 nt, Molluscum contagiosum virus
gcgcugcuauacgcgccagu

SEQ ID NO: 3096490 - RNA, 21 nt, Molluscum contagiosum virus
gcaagaugacgacgggagagg

SEQ ID NO: 3096491 - RNA, 14 nt, Molluscum contagiosum virus
gcaccgggcgccgc

SEQ ID NO: 3096492 - RNA, 16 nt, Molluscum contagiosum virus
gccagcagcuccuggu

SEQ ID NO: 3096493 - RNA, 15 nt, Molluscum contagiosum virus
ggcggcugugcccgc

SEQ ID NO: 3096494 - RNA, 13 nt, Molluscum contagiosum virus
ggcgugcugugcc

SEQ ID NO: 3096495 - RNA, 23 nt, Molluscum contagiosum virus
agcaaccucgggaagcccucagg

SEQ ID NO: 3096496 - RNA, 16 nt, Molluscum contagiosum virus
cgggcugucgcccggc

SEQ ID NO: 3096497 - RNA, 16 nt, Molluscum contagiosum virus
ccacgaccgcaagugc

SEQ ID NO: 3096498 - RNA, 19 nt, Molluscum contagiosum virus
cggcguccggcgcucgccc

SEQ ID NO: 3096499 - RNA, 23 nt, Molluscum contagiosum virus
caugugcgagaacuggcgcagca

SEQ ID NO: 3096500 - RNA, 18 nt, Molluscum contagiosum virus
uaguugcgagccagccag

SEQ ID NO: 3096501 - RNA, 23 nt, Molluscum contagiosum virus
agcgcuugcucuucgaccucugc

SEQ ID NO: 3096502 - RNA, 13 nt, Molluscum contagiosum virus
cgcacgugcugcg

SEQ ID NO: 3096503 - RNA, 13 nt, Molluscum contagiosum virus
gcgcaaaagcaca

SEQ ID NO: 3096504 - RNA, 23 nt, Molluscum contagiosum virus
cggacgcccuccucgaccugcac

SEQ ID NO: 3096505 - RNA, 14 nt, Molluscum contagiosum virus
cuaugcccagccug

SEQ ID NO: 3096506 - RNA, 17 nt, Molluscum contagiosum virus
gaagagggucgugcagg

SEQ ID NO: 3096507 - RNA, 13 nt, Molluscum contagiosum virus
cgagcguguccag

SEQ ID NO: 3096508 - RNA, 23 nt, Molluscum contagiosum virus
cacgcaaggcaugcgcgcagugc

SEQ ID NO: 3096509 - RNA, 15 nt, Molluscum contagiosum virus
ucuacgccagcgacg

SEQ ID NO: 3096510 - RNA, 23 nt, Molluscum contagiosum virus
caccuuggcgcugcacaguucac

SEQ ID NO: 3096511 - RNA, 15 nt, Molluscum contagiosum virus
cggcgcgcagcgcgu

SEQ ID NO: 3096512 - RNA, 21 nt, Molluscum contagiosum virus
ugcuguccuucaagaacgaca

SEQ ID NO: 3096513 - RNA, 16 nt, Molluscum contagiosum virus
aaacuggacugagccg

SEQ ID NO: 3096514 - RNA, 21 nt, Molluscum contagiosum virus
gcgccgcgcaugacagccaug

SEQ ID NO: 3096515 - RNA, 12 nt, Molluscum contagiosum virus
gaggcugcucuc

SEQ ID NO: 3096516 - RNA, 19 nt, Molluscum contagiosum virus
caaggaaaggcacccgcag

SEQ ID NO: 3096517 - RNA, 15 nt, Molluscum contagiosum virus
gcgcacgccagccug

SEQ ID NO: 3096518 - RNA, 12 nt, Molluscum contagiosum virus
acgaagcugugc

SEQ ID NO: 3096519 - RNA, 20 nt, Molluscum contagiosum virus
ucgugcucguguguccgcac

SEQ ID NO: 3096520 - RNA, 21 nt, Molluscum contagiosum virus
cacgccgcucucgugcaaagc

SEQ ID NO: 3096521 - RNA, 23 nt, Molluscum contagiosum virus
cgaacgagagacacgcacacucg

SEQ ID NO: 3096522 - RNA, 14 nt, Molluscum contagiosum virus
acgaggccuacagc

SEQ ID NO: 3096523 - RNA, 20 nt, Molluscum contagiosum virus
cagguucucgcacaguacca

SEQ ID NO: 3096524 - RNA, 15 nt, Molluscum contagiosum virus
acgugcgugcccaag

SEQ ID NO: 3096525 - RNA, 12 nt, Molluscum contagiosum virus
ccaccagcugcc

SEQ ID NO: 3096526 - RNA, 16 nt, Molluscum contagiosum virus
caggcgcagcgcggcc

SEQ ID NO: 3096527 - RNA, 17 nt, Molluscum contagiosum virus
gguagugguccaccagc

SEQ ID NO: 3096528 - RNA, 18 nt, Molluscum contagiosum virus
ggcaagcuucgggccgcu

SEQ ID NO: 3096529 - RNA, 16 nt, Molluscum contagiosum virus
guccgccucgagcacg

SEQ ID NO: 3096530 - RNA, 13 nt, Molluscum contagiosum virus
cuuguugugcuuu

SEQ ID NO: 3096531 - RNA, 23 nt, Molluscum contagiosum virus
cagcgugcgcgggcacgccgcag

SEQ ID NO: 3096532 - RNA, 14 nt, Molluscum contagiosum virus
cgcgagcgcgcccc

SEQ ID NO: 3096533 - RNA, 16 nt, Molluscum contagiosum virus
gcacaugcagcugcag

SEQ ID NO: 3096534 - RNA, 19 nt, Molluscum contagiosum virus
gcucgcacccgcgccgcgg

SEQ ID NO: 3096535 - RNA, 15 nt, Molluscum contagiosum virus
gacgcgccucgagca

SEQ ID NO: 3096536 - RNA, 12 nt, Molluscum contagiosum virus
cgccgcaaagcu

SEQ ID NO: 3096537 - RNA, 21 nt, Molluscum contagiosum virus
gaaccccucgugcugggccug

SEQ ID NO: 3096538 - RNA, 18 nt, Molluscum contagiosum virus
ggacgaugguggcgcugc

SEQ ID NO: 3096539 - RNA, 22 nt, Molluscum contagiosum virus
gaagacgugcugcgcgcccagg

SEQ ID NO: 3096540 - RNA, 18 nt, Molluscum contagiosum virus
ggacagugccuccgcgga

SEQ ID NO: 3096541 - RNA, 14 nt, Molluscum contagiosum virus
uggcguugcugcug

SEQ ID NO: 3096542 - RNA, 21 nt, Molluscum contagiosum virus
augugagcaagcugcaagcca

SEQ ID NO: 3096543 - RNA, 20 nt, Molluscum contagiosum virus
ucuucaccugcauugagcuc

SEQ ID NO: 3096544 - RNA, 22 nt, Molluscum contagiosum virus
uucuucgcagaggacagcuccu

SEQ ID NO: 3096545 - RNA, 16 nt, Molluscum contagiosum virus
gaacugacugcugccc

SEQ ID NO: 3096546 - RNA, 17 nt, Molluscum contagiosum virus
acugccgccgccgcgag

SEQ ID NO: 3096547 - RNA, 16 nt, Molluscum contagiosum virus
ucuccaugucgucaaa

SEQ ID NO: 3096548 - RNA, 14 nt, Molluscum contagiosum virus
agaggagauggcaa

SEQ ID NO: 3096549 - RNA, 17 nt, Molluscum contagiosum virus
agagcaucgagcuggug

SEQ ID NO: 3096550 - RNA, 14 nt, Molluscum contagiosum virus
cgcgcccugcacga

SEQ ID NO: 3096551 - RNA, 14 nt, Molluscum contagiosum virus
cgacgugcagacgc

SEQ ID NO: 3096552 - RNA, 18 nt, Molluscum contagiosum virus
cggcggcgcacgcggcuc

SEQ ID NO: 3096553 - RNA, 21 nt, Molluscum contagiosum virus
gugcuugcgcacggaccucaa

SEQ ID NO: 3096554 - RNA, 12 nt, Molluscum contagiosum virus
cggcggccacac

SEQ ID NO: 3096555 - RNA, 20 nt, Molluscum contagiosum virus
guccucgugggauaggcaca

SEQ ID NO: 3096556 - RNA, 21 nt, Molluscum contagiosum virus
cagcgggcuacucgagcacgg

SEQ ID NO: 3096557 - RNA, 24 nt, Molluscum contagiosum virus
gcggcaaaugcgucccagcagcug

SEQ ID NO: 3096558 - RNA, 23 nt, Molluscum contagiosum virus
gccgcgcuucacggagaucaggc

SEQ ID NO: 3096559 - RNA, 22 nt, Molluscum contagiosum virus
gugcgacucgucgagcacgaag

SEQ ID NO: 3096560 - RNA, 12 nt, Molluscum contagiosum virus
ccugccuguggg

SEQ ID NO: 3096561 - RNA, 12 nt, Molluscum contagiosum virus
gaaugcccgcaa

SEQ ID NO: 3096562 - RNA, 21 nt, Molluscum contagiosum virus
gcccgcgcucuuacugcagca

SEQ ID NO: 3096563 - RNA, 17 nt, Molluscum contagiosum virus
cucgcgcguccgcaaag

SEQ ID NO: 3096564 - RNA, 18 nt, Molluscum contagiosum virus
ggcgaccagcugguccug

SEQ ID NO: 3096565 - RNA, 16 nt, Molluscum contagiosum virus
cucgcugcugcucuuc

SEQ ID NO: 3096566 - RNA, 14 nt, Molluscum contagiosum virus
uuuguccugagccu

SEQ ID NO: 3096567 - RNA, 23 nt, Molluscum contagiosum virus
cggagcgccuucugcaagcugcc

SEQ ID NO: 3096568 - RNA, 15 nt, Molluscum contagiosum virus
ggcgaccagcucuug

SEQ ID NO: 3096569 - RNA, 17 nt, Molluscum contagiosum virus
ggcgcgcgcgcuagccg

SEQ ID NO: 3096570 - RNA, 12 nt, Molluscum contagiosum virus
acggcccaccuu

SEQ ID NO: 3096571 - RNA, 15 nt, Molluscum contagiosum virus
guaccagccgcugcg

SEQ ID NO: 3096572 - RNA, 13 nt, Molluscum contagiosum virus
ugcgcccacgagu

SEQ ID NO: 3096573 - RNA, 13 nt, Molluscum contagiosum virus
ccugcgcaacgcg

SEQ ID NO: 3096574 - RNA, 20 nt, Molluscum contagiosum virus
gcucaucggcgagcucuuuu

SEQ ID NO: 3096575 - RNA, 19 nt, Molluscum contagiosum virus
acacgcgcgcgugcugcug

SEQ ID NO: 3096576 - RNA, 18 nt, Molluscum contagiosum virus
gagcucgguagccaggcg

SEQ ID NO: 3096577 - RNA, 14 nt, Molluscum contagiosum virus
ccugguuugcgcuc

SEQ ID NO: 3096578 - RNA, 21 nt, Molluscum contagiosum virus
uagcgugagagcaaagaaugc

SEQ ID NO: 3096579 - RNA, 10 nt, Molluscum contagiosum virus
cuccagagcc

SEQ ID NO: 3096580 - RNA, 17 nt, Molluscum contagiosum virus
cucuucccguuccuggg

SEQ ID NO: 3096581 - RNA, 23 nt, Molluscum contagiosum virus
ccugucaucaccccgcugggccg

SEQ ID NO: 3096582 - RNA, 20 nt, Molluscum contagiosum virus
accgucaaccugcugccucc

SEQ ID NO: 3096583 - RNA, 17 nt, Molluscum contagiosum virus
agggcuacgaguucugc

SEQ ID NO: 3096584 - RNA, 18 nt, Molluscum contagiosum virus
cucggacggaggucugcu

SEQ ID NO: 3096585 - RNA, 17 nt, Molluscum contagiosum virus
ugcucgcggagggcagc

SEQ ID NO: 3096586 - RNA, 18 nt, Molluscum contagiosum virus
cuccuuugcgagcacugu

SEQ ID NO: 3096587 - RNA, 14 nt, Molluscum contagiosum virus
gacaggaugccugu

SEQ ID NO: 3096588 - RNA, 16 nt, Molluscum contagiosum virus
ugggaaaccucaccuc

SEQ ID NO: 3096589 - RNA, 18 nt, Molluscum contagiosum virus
ccgcaguaccggccaagg

SEQ ID NO: 3096590 - RNA, 20 nt, Molluscum contagiosum virus
gcucauccucccugcgggcg

SEQ ID NO: 3096591 - RNA, 17 nt, Molluscum contagiosum virus
cggcccgaaggccaccu

SEQ ID NO: 3096592 - RNA, 12 nt, Molluscum contagiosum virus
gguugccaggca

SEQ ID NO: 3096593 - RNA, 13 nt, Molluscum contagiosum virus
gcagcugccgcag

SEQ ID NO: 3096594 - RNA, 19 nt, Molluscum contagiosum virus
cgcccagcucgaugggcuc

SEQ ID NO: 3096595 - RNA, 13 nt, Molluscum contagiosum virus
gcaacgcgggcca

SEQ ID NO: 3096596 - RNA, 14 nt, Molluscum contagiosum virus
ugccuuucuuccag

SEQ ID NO: 3096597 - RNA, 20 nt, Molluscum contagiosum virus
gggcacccagcccugguuug

SEQ ID NO: 3096598 - RNA, 13 nt, Molluscum contagiosum virus
ucucgcccagcac

SEQ ID NO: 3096599 - RNA, 14 nt, Molluscum contagiosum virus
gagaccgucaaccu

SEQ ID NO: 3096600 - RNA, 23 nt, Molluscum contagiosum virus
cgaggaccggcgcaacgagcagc

SEQ ID NO: 3096601 - RNA, 12 nt, Molluscum contagiosum virus
aacagucgcgcg

SEQ ID NO: 3096602 - RNA, 18 nt, Molluscum contagiosum virus
aucccccgccaggaacga

SEQ ID NO: 3096603 - RNA, 17 nt, Molluscum contagiosum virus
ucaagaagcccaaggag

SEQ ID NO: 3096604 - RNA, 17 nt, Molluscum contagiosum virus
cgcgucacggauacugu

SEQ ID NO: 3096605 - RNA, 23 nt, Molluscum contagiosum virus
gaaagcgucgugcuccacgcgca

SEQ ID NO: 3096606 - RNA, 17 nt, Molluscum contagiosum virus
cggacacguugcagcag

SEQ ID NO: 3096607 - RNA, 17 nt, Molluscum contagiosum virus
ucgcgcacagaaagcca

SEQ ID NO: 3096608 - RNA, 21 nt, Molluscum contagiosum virus
auguccaugucgcgcaucacc

SEQ ID NO: 3096609 - RNA, 19 nt, Molluscum contagiosum virus
cgcgaacucgcggcagugc

SEQ ID NO: 3096610 - RNA, 16 nt, Molluscum contagiosum virus
ugcugaagaaggagcc

SEQ ID NO: 3096611 - RNA, 22 nt, Molluscum contagiosum virus
gcugcucgcugccuggugcaca

SEQ ID NO: 3096612 - RNA, 22 nt, Molluscum contagiosum virus
gacuccuuccggagacaccagc

SEQ ID NO: 3096613 - RNA, 14 nt, Molluscum contagiosum virus
aagucaugcucgcg

SEQ ID NO: 3096614 - RNA, 17 nt, Molluscum contagiosum virus
agcaguaccugcuaacu

SEQ ID NO: 3096615 - RNA, 21 nt, Molluscum contagiosum virus
gcuggagcgagugcgcgugcg

SEQ ID NO: 3096616 - RNA, 23 nt, Molluscum contagiosum virus
cgcagcgcuggagcuggcugggc

SEQ ID NO: 3096617 - RNA, 17 nt, Molluscum contagiosum virus
cugcacuucggacaccu

SEQ ID NO: 3096618 - RNA, 14 nt, Molluscum contagiosum virus
cacccgugcccgcu

SEQ ID NO: 3096619 - RNA, 12 nt, Molluscum contagiosum virus
cucuaggagcuc

SEQ ID NO: 3096620 - RNA, 11 nt, Molluscum contagiosum virus
uucugccugcu

SEQ ID NO: 3096621 - RNA, 14 nt, Molluscum contagiosum virus
gcuacuugcuggcg

SEQ ID NO: 3096622 - RNA, 17 nt, Molluscum contagiosum virus
ugccggcucagcgugga

SEQ ID NO: 3096623 - RNA, 15 nt, Molluscum contagiosum virus
ucgacguggagccug

SEQ ID NO: 3096624 - RNA, 20 nt, Molluscum contagiosum virus
aaugagcacuugccgcgccu

SEQ ID NO: 3096625 - RNA, 19 nt, Molluscum contagiosum virus
ggagcgcagucccagcacc

SEQ ID NO: 3096626 - RNA, 16 nt, Molluscum contagiosum virus
gcuggagacggcagug

SEQ ID NO: 3096627 - RNA, 20 nt, Molluscum contagiosum virus
cagaucgcgagaggagacgg

SEQ ID NO: 3096628 - RNA, 18 nt, Molluscum contagiosum virus
ggcugcuggcggugcucu

SEQ ID NO: 3096629 - RNA, 16 nt, Molluscum contagiosum virus
uagcguugguaacaag

SEQ ID NO: 3096630 - RNA, 18 nt, Molluscum contagiosum virus
aaugcaugcggagcuggc

SEQ ID NO: 3096631 - RNA, 16 nt, Molluscum contagiosum virus
cugccuggugcacaca

SEQ ID NO: 3096632 - RNA, 20 nt, Molluscum contagiosum virus
cgcgccgaggacuaccuggc

SEQ ID NO: 3096633 - RNA, 22 nt, Molluscum contagiosum virus
acgacaaggaaaggcacccacc

SEQ ID NO: 3096634 - RNA, 17 nt, Molluscum contagiosum virus
uccccaagaccugcuuc

SEQ ID NO: 3096635 - RNA, 22 nt, Molluscum contagiosum virus
acguccaggccgcggcagcucu

SEQ ID NO: 3096636 - RNA, 18 nt, Molluscum contagiosum virus
gcagccgcugcugcugca

SEQ ID NO: 3096637 - RNA, 18 nt, Molluscum contagiosum virus
ccggcugccgcugccugu

SEQ ID NO: 3096638 - RNA, 19 nt, Molluscum contagiosum virus
gcagccccgacgccagcgc

SEQ ID NO: 3096639 - RNA, 17 nt, Molluscum contagiosum virus
cgccgagcccgagcccg

SEQ ID NO: 3096640 - RNA, 17 nt, Molluscum contagiosum virus
gcuagcgcuggagauga

SEQ ID NO: 3096641 - RNA, 11 nt, Molluscum contagiosum virus
cccgcccgugc

SEQ ID NO: 3096642 - RNA, 18 nt, Molluscum contagiosum virus
gcugcacgugcagcggcg

SEQ ID NO: 3096643 - RNA, 15 nt, Molluscum contagiosum virus
guacggcgguucgca

SEQ ID NO: 3096644 - RNA, 17 nt, Molluscum contagiosum virus
gccagcgucgcgcgccg

SEQ ID NO: 3096645 - RNA, 15 nt, Molluscum contagiosum virus
uguggccuacguggc

SEQ ID NO: 3096646 - RNA, 17 nt, Molluscum contagiosum virus
aaggcaccugcaggaaa

SEQ ID NO: 3096647 - RNA, 15 nt, Molluscum contagiosum virus
gcgcgcccaccagca

SEQ ID NO: 3096648 - RNA, 18 nt, Molluscum contagiosum virus
gaagugacuagcgcuggc

SEQ ID NO: 3096649 - RNA, 19 nt, Molluscum contagiosum virus
cguaguacugcagcagcuc

SEQ ID NO: 3096650 - RNA, 22 nt, Molluscum contagiosum virus
cggacgccuuuugugcagcgcg

SEQ ID NO: 3096651 - RNA, 22 nt, Molluscum contagiosum virus
cggccguggcaaacaggcacac

SEQ ID NO: 3096652 - RNA, 21 nt, Molluscum contagiosum virus
ccaccucggcguuggccacga

SEQ ID NO: 3096653 - RNA, 13 nt, Molluscum contagiosum virus
gccgagcucgccu

SEQ ID NO: 3096654 - RNA, 21 nt, Molluscum contagiosum virus
gcaucagagaagugcuccgca

SEQ ID NO: 3096655 - RNA, 17 nt, Molluscum contagiosum virus
cgcgucugcaaggccug

SEQ ID NO: 3096656 - RNA, 23 nt, Molluscum contagiosum virus
cucugcucgugcccgcacacgca

SEQ ID NO: 3096657 - RNA, 22 nt, Molluscum contagiosum virus
ccacagguuucucaacaugaau

SEQ ID NO: 3096658 - RNA, 12 nt, Molluscum contagiosum virus
agaggggcaaca

SEQ ID NO: 3096659 - RNA, 17 nt, Molluscum contagiosum virus
gcggcagugcuggugaa

SEQ ID NO: 3096660 - RNA, 17 nt, Molluscum contagiosum virus
ugcagccgcugcugcug

SEQ ID NO: 3096661 - RNA, 20 nt, Molluscum contagiosum virus
cccggcugccgcugccugug

SEQ ID NO: 3096662 - RNA, 14 nt, Molluscum contagiosum virus
ccacgugccagagu

SEQ ID NO: 3096663 - RNA, 14 nt, Molluscum contagiosum virus
gccgcgcugcuccg

SEQ ID NO: 3096664 - RNA, 16 nt, Molluscum contagiosum virus
cgggagcucacggcug

SEQ ID NO: 3096665 - RNA, 13 nt, Molluscum contagiosum virus
cgcgcaagugcgu

SEQ ID NO: 3096666 - RNA, 19 nt, Molluscum contagiosum virus
acgggcacgcgcgcgccuu

SEQ ID NO: 3096667 - RNA, 20 nt, Molluscum contagiosum virus
aucuucgaaguggccgucgc

SEQ ID NO: 3096668 - RNA, 18 nt, Molluscum contagiosum virus
ggacgaagcugugcaaga

SEQ ID NO: 3096669 - RNA, 14 nt, Molluscum contagiosum virus
cgacgggccccugu

SEQ ID NO: 3096670 - RNA, 15 nt, Molluscum contagiosum virus
uugacgcccauuaaa

SEQ ID NO: 3096671 - RNA, 23 nt, Molluscum contagiosum virus
ucgcgcuuuuccagguggccaac

SEQ ID NO: 3096672 - RNA, 14 nt, Molluscum contagiosum virus
agcggcgagcuuug

SEQ ID NO: 3096673 - RNA, 13 nt, Molluscum contagiosum virus
cuugggcucuggc

SEQ ID NO: 3096674 - RNA, 22 nt, Molluscum contagiosum virus
gaaggaucccugcccgcgugag

SEQ ID NO: 3096675 - RNA, 15 nt, Molluscum contagiosum virus
ucaggcagcugcugc

SEQ ID NO: 3096676 - RNA, 20 nt, Molluscum contagiosum virus
cagcucauagcccaugcgca

SEQ ID NO: 3096677 - RNA, 12 nt, Molluscum contagiosum virus
gcgccuugcagc

SEQ ID NO: 3096678 - RNA, 18 nt, Molluscum contagiosum virus
ccugcugguggugcugga

SEQ ID NO: 3096679 - RNA, 11 nt, Molluscum contagiosum virus
agcaggcacuc

SEQ ID NO: 3096680 - RNA, 15 nt, Molluscum contagiosum virus
gaacugacugcugcc

SEQ ID NO: 3096681 - RNA, 18 nt, Molluscum contagiosum virus
gcugcuucccgcugagcg

SEQ ID NO: 3096682 - RNA, 19 nt, Molluscum contagiosum virus
acgcucgcgacgugcgcgc

SEQ ID NO: 3096683 - RNA, 18 nt, Molluscum contagiosum virus
ccgaggcagguuccggug

SEQ ID NO: 3096684 - RNA, 21 nt, Molluscum contagiosum virus
cgugcgccaguccgcggcgcg

SEQ ID NO: 3096685 - RNA, 23 nt, Molluscum contagiosum virus
cugcuucccgcugagcgcagcac

SEQ ID NO: 3096686 - RNA, 21 nt, Molluscum contagiosum virus
uacuucggacgcgaacugccc

SEQ ID NO: 3096687 - RNA, 15 nt, Molluscum contagiosum virus
cgucuuacugcugca

SEQ ID NO: 3096688 - RNA, 17 nt, Molluscum contagiosum virus
cgcacaacuugggcccg

SEQ ID NO: 3096689 - RNA, 17 nt, Molluscum contagiosum virus
gaaggcauaccugugcc

SEQ ID NO: 3096690 - RNA, 16 nt, Molluscum contagiosum virus
ucuugugaggaaacac

SEQ ID NO: 3096691 - RNA, 12 nt, Molluscum contagiosum virus
gagccgcccgcg

SEQ ID NO: 3096692 - RNA, 23 nt, Molluscum contagiosum virus
cgagcgcauucgcgcgcccccgc

SEQ ID NO: 3096693 - RNA, 16 nt, Molluscum contagiosum virus
cggcgugcuggccagc

SEQ ID NO: 3096694 - RNA, 22 nt, Molluscum contagiosum virus
ccgccgcgaggacccgcgcuuu

SEQ ID NO: 3096695 - RNA, 19 nt, Molluscum contagiosum virus
gcugcgagaacucgcgugc

SEQ ID NO: 3096696 - RNA, 24 nt, Molluscum contagiosum virus
augcuugcuuccggugccggccgc

SEQ ID NO: 3096697 - RNA, 15 nt, Molluscum contagiosum virus
cggcguuucucaggu

SEQ ID NO: 3096698 - RNA, 23 nt, Molluscum contagiosum virus
caggucggccagcagcuccuggu

SEQ ID NO: 3096699 - RNA, 14 nt, Molluscum contagiosum virus
gcgccggacuacua

SEQ ID NO: 3096700 - RNA, 18 nt, Molluscum contagiosum virus
cccgcgcgcggacagccu

SEQ ID NO: 3096701 - RNA, 19 nt, Molluscum contagiosum virus
cucagccucuacuccacua

SEQ ID NO: 3096702 - RNA, 20 nt, Molluscum contagiosum virus
cgggaauaccggagacacca

SEQ ID NO: 3096703 - RNA, 17 nt, Molluscum contagiosum virus
caccagcaccagcacaa

SEQ ID NO: 3096704 - RNA, 20 nt, Molluscum contagiosum virus
gccagcguacggcccgaagg

SEQ ID NO: 3096705 - RNA, 17 nt, Molluscum contagiosum virus
gcccgagcgucaguguu

SEQ ID NO: 3096706 - RNA, 15 nt, Molluscum contagiosum virus
cccucggcgcgccgu

SEQ ID NO: 3096707 - RNA, 12 nt, Molluscum contagiosum virus
gggccgcgaggc

SEQ ID NO: 3096708 - RNA, 14 nt, Molluscum contagiosum virus
aggcagcugcugcg

SEQ ID NO: 3096709 - RNA, 13 nt, Molluscum contagiosum virus
uggccauggugga

SEQ ID NO: 3096710 - RNA, 14 nt, Molluscum contagiosum virus
ucggaacgcuaucc

SEQ ID NO: 3096711 - RNA, 13 nt, Molluscum contagiosum virus
cacaugccuucag

SEQ ID NO: 3096712 - RNA, 20 nt, Molluscum contagiosum virus
cugcgggcgccgggcgcgcc

SEQ ID NO: 3096713 - RNA, 19 nt, Molluscum contagiosum virus
agcgcguccaugcugaucu

SEQ ID NO: 3096714 - RNA, 22 nt, Molluscum contagiosum virus
cgcggacacauugcgaggcacc

SEQ ID NO: 3096715 - RNA, 20 nt, Molluscum contagiosum virus
gggcacggcacccgccagcu

SEQ ID NO: 3096716 - RNA, 21 nt, Molluscum contagiosum virus
agcucgacugcguugucuccu

SEQ ID NO: 3096717 - RNA, 17 nt, Molluscum contagiosum virus
cacgcccgcaaugcagu

SEQ ID NO: 3096718 - RNA, 12 nt, Molluscum contagiosum virus
ucuccacaaaga

SEQ ID NO: 3096719 - RNA, 18 nt, Molluscum contagiosum virus
cguggaguccaugcccac

SEQ ID NO: 3096720 - RNA, 14 nt, Molluscum contagiosum virus
ccacgcccgggccc

SEQ ID NO: 3096721 - RNA, 16 nt, Molluscum contagiosum virus
ugacgcgcggcggcgc

SEQ ID NO: 3096722 - RNA, 17 nt, Molluscum contagiosum virus
gcgcugcgcgcgcucgc

SEQ ID NO: 3096723 - RNA, 19 nt, Molluscum contagiosum virus
cgacgcaaaagaggccugc

SEQ ID NO: 3096724 - RNA, 14 nt, Molluscum contagiosum virus
aggagagagagaca

SEQ ID NO: 3096725 - RNA, 14 nt, Molluscum contagiosum virus
gcgcgggccugucc

SEQ ID NO: 3096726 - RNA, 23 nt, Molluscum contagiosum virus
ggaccgcgcgaacgaggagggca

SEQ ID NO: 3096727 - RNA, 20 nt, Molluscum contagiosum virus
gcuucuccaccuucaggacg

SEQ ID NO: 3096728 - RNA, 19 nt, Molluscum contagiosum virus
ugccuggagggcagugcca

SEQ ID NO: 3096729 - RNA, 19 nt, Molluscum contagiosum virus
gcccuccucgaccugcacg

SEQ ID NO: 3096730 - RNA, 14 nt, Molluscum contagiosum virus
ggcggccguguccu

SEQ ID NO: 3096731 - RNA, 15 nt, Molluscum contagiosum virus
agcaaugcgcaaggc

SEQ ID NO: 3096732 - RNA, 15 nt, Molluscum contagiosum virus
aguaccuagugcaca

SEQ ID NO: 3096733 - RNA, 20 nt, Molluscum contagiosum virus
gcacagcacaggccccagca

SEQ ID NO: 3096734 - RNA, 22 nt, Molluscum contagiosum virus
acugcugcccgcgcagcgccac

SEQ ID NO: 3096735 - RNA, 22 nt, Molluscum contagiosum virus
cgaugacaucuggaggcaaucu

SEQ ID NO: 3096736 - RNA, 22 nt, Molluscum contagiosum virus
gcugccgguggaagagcccgca

SEQ ID NO: 3096737 - RNA, 16 nt, Molluscum contagiosum virus
gcgggcuacucgagca

SEQ ID NO: 3096738 - RNA, 15 nt, Molluscum contagiosum virus
cgcgugcgcagcacg

SEQ ID NO: 3096739 - RNA, 23 nt, Molluscum contagiosum virus
ucgacugcguugucuccuccuga

SEQ ID NO: 3096740 - RNA, 13 nt, Molluscum contagiosum virus
ccgcuuccuggca

SEQ ID NO: 3096741 - RNA, 22 nt, Molluscum contagiosum virus
acgcgccgaggacuaccuggcg

SEQ ID NO: 3096742 - RNA, 19 nt, Molluscum contagiosum virus
gccgggaauaccggagaca

SEQ ID NO: 3096743 - RNA, 13 nt, Molluscum contagiosum virus
cuguggcgcacac

SEQ ID NO: 3096744 - RNA, 17 nt, Molluscum contagiosum virus
gcugcccgcgcagcgcc

SEQ ID NO: 3096745 - RNA, 17 nt, Molluscum contagiosum virus
ggcccgcgcggagacgc

SEQ ID NO: 3096746 - RNA, 22 nt, Molluscum contagiosum virus
uccucgagagggagcagccucc

SEQ ID NO: 3096747 - RNA, 22 nt, Molluscum contagiosum virus
cggaagcuugcucagcagcuuc

SEQ ID NO: 3096748 - RNA, 16 nt, Molluscum contagiosum virus
cguaagccaccgcgca

SEQ ID NO: 3096749 - RNA, 21 nt, Molluscum contagiosum virus
ugggcaacgcgcgcgcgcugg

SEQ ID NO: 3096750 - RNA, 21 nt, Molluscum contagiosum virus
aaauagccaugcuggucacgc

SEQ ID NO: 3096751 - RNA, 17 nt, Molluscum contagiosum virus
cgucgccggacagcuca

SEQ ID NO: 3096752 - RNA, 21 nt, Molluscum contagiosum virus
aggaucggagcgcagcugccg

SEQ ID NO: 3096753 - RNA, 20 nt, Molluscum contagiosum virus
cguccacaaagcccuccuga

SEQ ID NO: 3096754 - RNA, 21 nt, Molluscum contagiosum virus
gcagcuggcgcgcgccgagcc

SEQ ID NO: 3096755 - RNA, 16 nt, Molluscum contagiosum virus
ccauguuuccugcggc

SEQ ID NO: 3096756 - RNA, 22 nt, Molluscum contagiosum virus
ucacggcaaacgccacuggguc

SEQ ID NO: 3096757 - RNA, 16 nt, Molluscum contagiosum virus
cggcgcucgccuuucc

SEQ ID NO: 3096758 - RNA, 15 nt, Molluscum contagiosum virus
cguccgcggcacgcg

SEQ ID NO: 3096759 - RNA, 15 nt, Molluscum contagiosum virus
cgauaucgaucacgc

SEQ ID NO: 3096760 - RNA, 13 nt, Molluscum contagiosum virus
cgagcugcugccc

SEQ ID NO: 3096761 - RNA, 23 nt, Molluscum contagiosum virus
auugcccgcgcgcggacagccua

SEQ ID NO: 3096762 - RNA, 15 nt, Molluscum contagiosum virus
gcgcaagagccgccg

SEQ ID NO: 3096763 - RNA, 23 nt, Molluscum contagiosum virus
accagcuccgccgggaauaccgg

SEQ ID NO: 3096764 - RNA, 15 nt, Molluscum contagiosum virus
ggcaucaugagccag

SEQ ID NO: 3096765 - RNA, 21 nt, Molluscum contagiosum virus
ccgcgcccggcgggcacaucc

SEQ ID NO: 3096766 - RNA, 15 nt, Molluscum contagiosum virus
cgucgaccuggaagc

SEQ ID NO: 3096767 - RNA, 19 nt, Molluscum contagiosum virus
uggccucugccugcaagga

SEQ ID NO: 3096768 - RNA, 14 nt, Molluscum contagiosum virus
gcucagccccagca

SEQ ID NO: 3096769 - RNA, 23 nt, Molluscum contagiosum virus
gccgcggugccgggcgucuccgc

SEQ ID NO: 3096770 - RNA, 20 nt, Molluscum contagiosum virus
guagcgaaugcagugcccgg

SEQ ID NO: 3096771 - RNA, 18 nt, Molluscum contagiosum virus
accuuggacacgugcgug

SEQ ID NO: 3096772 - RNA, 22 nt, Molluscum contagiosum virus
cgcagcccacgugccagcucau

SEQ ID NO: 3096773 - RNA, 14 nt, Molluscum contagiosum virus
accccucgugcugg

SEQ ID NO: 3096774 - RNA, 22 nt, Molluscum contagiosum virus
cugcucaugcgcaagcagcucg

SEQ ID NO: 3096775 - RNA, 20 nt, Molluscum contagiosum virus
guagggggguggggagacuu

SEQ ID NO: 3096776 - RNA, 16 nt, Molluscum contagiosum virus
cgcggcgcgugccagu

SEQ ID NO: 3096777 - RNA, 21 nt, Molluscum contagiosum virus
acaugcucaagcaccugcgcu

SEQ ID NO: 3096778 - RNA, 13 nt, Molluscum contagiosum virus
ucgagcgcgcugg

SEQ ID NO: 3096779 - RNA, 14 nt, Molluscum contagiosum virus
ccggcaguagcagc

SEQ ID NO: 3096780 - RNA, 15 nt, Molluscum contagiosum virus
acgacuuccgcggcg

SEQ ID NO: 3096781 - RNA, 21 nt, Molluscum contagiosum virus
cgaacgagggaugcacacacu

SEQ ID NO: 3096782 - RNA, 19 nt, Molluscum contagiosum virus
uaugccgcgugcucugcuc

SEQ ID NO: 3096783 - RNA, 20 nt, Molluscum contagiosum virus
gcacaucucucagggcagcg

SEQ ID NO: 3096784 - RNA, 18 nt, Molluscum contagiosum virus
cucgugggauaggcacac

SEQ ID NO: 3096785 - RNA, 15 nt, Molluscum contagiosum virus
ccagcagcugcuccg

SEQ ID NO: 3096786 - RNA, 14 nt, Molluscum contagiosum virus
cagugcgcgcacaa

SEQ ID NO: 3096787 - RNA, 22 nt, Molluscum contagiosum virus
ccuacgcgcgcguaacagcgcg

SEQ ID NO: 3096788 - RNA, 18 nt, Molluscum contagiosum virus
ucacggacucgagcccca

SEQ ID NO: 3096789 - RNA, 13 nt, Molluscum contagiosum virus
gcgaaagaacacg

SEQ ID NO: 3096790 - RNA, 13 nt, Molluscum contagiosum virus
cugguggccgcac

SEQ ID NO: 3096791 - RNA, 21 nt, Molluscum contagiosum virus
gagacugacgccgauguccug

SEQ ID NO: 3096792 - RNA, 16 nt, Molluscum contagiosum virus
cauacuccugcuggcg

SEQ ID NO: 3096793 - RNA, 12 nt, Molluscum contagiosum virus
acggacuucuug

SEQ ID NO: 3096794 - RNA, 22 nt, Molluscum contagiosum virus
acggcggcgcaagcgcaagccg

SEQ ID NO: 3096795 - RNA, 20 nt, Molluscum contagiosum virus
gaugucgucgaagcccagcu

SEQ ID NO: 3096796 - RNA, 24 nt, Molluscum contagiosum virus
cuacagcagccgcagcccacgugc

SEQ ID NO: 3096797 - RNA, 20 nt, Molluscum contagiosum virus
cugcgcaacgcgggccaggc

SEQ ID NO: 3096798 - RNA, 20 nt, Molluscum contagiosum virus
cgcaaaagaggccugcugaa

SEQ ID NO: 3096799 - RNA, 16 nt, Molluscum contagiosum virus
cgagacggaaauguug

SEQ ID NO: 3096800 - RNA, 21 nt, Molluscum contagiosum virus
cuagaaugcguguggugacuc

SEQ ID NO: 3096801 - RNA, 22 nt, Molluscum contagiosum virus
gcgcccgcgugcacccuccgca

SEQ ID NO: 3096802 - RNA, 21 nt, Molluscum contagiosum virus
acguccccgaacugcugggcg

SEQ ID NO: 3096803 - RNA, 16 nt, Molluscum contagiosum virus
ccagcuacgagccgcu

SEQ ID NO: 3096804 - RNA, 16 nt, Molluscum contagiosum virus
aguccaugcccacgcg

SEQ ID NO: 3096805 - RNA, 13 nt, Molluscum contagiosum virus
gacggggcgcacg

SEQ ID NO: 3096806 - RNA, 19 nt, Molluscum contagiosum virus
uggucuccgcgggcagccg

SEQ ID NO: 3096807 - RNA, 14 nt, Molluscum contagiosum virus
gcggcauccugaug

SEQ ID NO: 3096808 - RNA, 20 nt, Molluscum contagiosum virus
cgagcgcggcaacagcacga

SEQ ID NO: 3096809 - RNA, 18 nt, Molluscum contagiosum virus
ucuucaggaacaaggcca

SEQ ID NO: 3096810 - RNA, 20 nt, Molluscum contagiosum virus
cggucgacgagugcgccgcg

SEQ ID NO: 3096811 - RNA, 16 nt, Molluscum contagiosum virus
gcgccgccggugcgug

SEQ ID NO: 3096812 - RNA, 21 nt, Molluscum contagiosum virus
aggaaaggcacccgcaacaag

SEQ ID NO: 3096813 - RNA, 17 nt, Molluscum contagiosum virus
gcucggacacacgcacc

SEQ ID NO: 3096814 - RNA, 19 nt, Molluscum contagiosum virus
cacguggaaucacggccag

SEQ ID NO: 3096815 - RNA, 15 nt, Molluscum contagiosum virus
ggaaaggcacccacc

SEQ ID NO: 3096816 - RNA, 17 nt, Molluscum contagiosum virus
cauugcguguggggcau

SEQ ID NO: 3096817 - RNA, 15 nt, Molluscum contagiosum virus
gccgggggaacacgc

SEQ ID NO: 3096818 - RNA, 18 nt, Molluscum contagiosum virus
cucauccaccugcgcaac

SEQ ID NO: 3096819 - RNA, 14 nt, Molluscum contagiosum virus
gugugcacauugcu

SEQ ID NO: 3096820 - RNA, 15 nt, Molluscum contagiosum virus
ggcuccuucuucagc

SEQ ID NO: 3096821 - RNA, 16 nt, Molluscum contagiosum virus
ggcucuucucgcagcg

SEQ ID NO: 3096822 - RNA, 15 nt, Molluscum contagiosum virus
gacagcauccuggag

SEQ ID NO: 3096823 - RNA, 16 nt, Molluscum contagiosum virus
cggcugccgcugccug

SEQ ID NO: 3096824 - RNA, 12 nt, Molluscum contagiosum virus
cucuggcuccag

SEQ ID NO: 3096825 - RNA, 19 nt, Molluscum contagiosum virus
gagcccggaucagccccgc

SEQ ID NO: 3096826 - RNA, 18 nt, Molluscum contagiosum virus
guacagugcgcgcacaaa

SEQ ID NO: 3096827 - RNA, 21 nt, Molluscum contagiosum virus
ggauacagcgcggagagaaca

SEQ ID NO: 3096828 - RNA, 16 nt, Molluscum contagiosum virus
aagcagcaaacugugc

SEQ ID NO: 3096829 - RNA, 17 nt, Molluscum contagiosum virus
caccaggaacagggaaa

SEQ ID NO: 3096830 - RNA, 16 nt, Molluscum contagiosum virus
cacugugccagcagca

SEQ ID NO: 3096831 - RNA, 15 nt, Molluscum contagiosum virus
ucacgaccugguaga

SEQ ID NO: 3096832 - RNA, 22 nt, Molluscum contagiosum virus
cuaugagcggcacgggaaggcu

SEQ ID NO: 3096833 - RNA, 18 nt, Molluscum contagiosum virus
uggcgcgguccagccgca

SEQ ID NO: 3096834 - RNA, 17 nt, Molluscum contagiosum virus
ccgcaggccgggcaccc

SEQ ID NO: 3096835 - RNA, 16 nt, Molluscum contagiosum virus
ugguggacagccuuug

SEQ ID NO: 3096836 - RNA, 20 nt, Molluscum contagiosum virus
gcgugcauagugggcuugcg

SEQ ID NO: 3096837 - RNA, 18 nt, Molluscum contagiosum virus
aggcgcuugggcacugcu

SEQ ID NO: 3096838 - RNA, 23 nt, Molluscum contagiosum virus
cagcacaugcaggccgagaugag

SEQ ID NO: 3096839 - RNA, 13 nt, Molluscum contagiosum virus
cgagugugugcau

SEQ ID NO: 3096840 - RNA, 22 nt, Molluscum contagiosum virus
cgcggggcucguccucgggcgc

SEQ ID NO: 3096841 - RNA, 16 nt, Molluscum contagiosum virus
cuagccccagcaccag

SEQ ID NO: 3096842 - RNA, 14 nt, Molluscum contagiosum virus
caucgcugcacgcg

SEQ ID NO: 3096843 - RNA, 15 nt, Molluscum contagiosum virus
cgccgccaugcugcg

SEQ ID NO: 3096844 - RNA, 18 nt, Molluscum contagiosum virus
gcacccgcaggaaaggca

SEQ ID NO: 3096845 - RNA, 19 nt, Molluscum contagiosum virus
caugcacagccgcuuucug

SEQ ID NO: 3096846 - RNA, 13 nt, Molluscum contagiosum virus
ugcgagucucugu

SEQ ID NO: 3096847 - RNA, 14 nt, Molluscum contagiosum virus
guagcguggagcug

SEQ ID NO: 3096848 - RNA, 13 nt, Molluscum contagiosum virus
cggcgcgccgccc

SEQ ID NO: 3096849 - RNA, 22 nt, Molluscum contagiosum virus
ugcgcaguuuuuuuccgcaaga

SEQ ID NO: 3096850 - RNA, 22 nt, Molluscum contagiosum virus
ugaacucuucccguuccugggc

SEQ ID NO: 3096851 - RNA, 18 nt, Molluscum contagiosum virus
accacgagcacugccugc

SEQ ID NO: 3096852 - RNA, 22 nt, Molluscum contagiosum virus
gugcuggagggcacgcugcaca

SEQ ID NO: 3096853 - RNA, 14 nt, Molluscum contagiosum virus
ccaaaucgccgccc

SEQ ID NO: 3096854 - RNA, 13 nt, Molluscum contagiosum virus
ccugcugcagcuc

SEQ ID NO: 3096855 - RNA, 12 nt, Molluscum contagiosum virus
aggcacccgcaa

SEQ ID NO: 3096856 - RNA, 12 nt, Molluscum contagiosum virus
gcgcauggagag

SEQ ID NO: 3096857 - RNA, 11 nt, Molluscum contagiosum virus
cucggacagug

SEQ ID NO: 3096858 - RNA, 15 nt, Molluscum contagiosum virus
uguuuguugucccac

SEQ ID NO: 3096859 - RNA, 14 nt, Molluscum contagiosum virus
gaugcgccuuuucc

SEQ ID NO: 3096860 - RNA, 17 nt, Molluscum contagiosum virus
accuucggaacugcgga

SEQ ID NO: 3096861 - RNA, 17 nt, Molluscum contagiosum virus
ucggaggcggagcugcc

SEQ ID NO: 3096862 - RNA, 21 nt, Molluscum contagiosum virus
cgucgcggagcgcgcacggca

SEQ ID NO: 3096863 - RNA, 19 nt, Molluscum contagiosum virus
uucaccuuggcgcugcaca

SEQ ID NO: 3096864 - RNA, 13 nt, Molluscum contagiosum virus
ccggcugcccugu

SEQ ID NO: 3096865 - RNA, 20 nt, Molluscum contagiosum virus
aaaggcgggcccgcgaacga

SEQ ID NO: 3096866 - RNA, 20 nt, Molluscum contagiosum virus
cagcucgccgcgcgccgcug

SEQ ID NO: 3096867 - RNA, 17 nt, Molluscum contagiosum virus
ccgcacggcgcccagga

SEQ ID NO: 3096868 - RNA, 18 nt, Molluscum contagiosum virus
ggcgcauccucuccauca

SEQ ID NO: 3096869 - RNA, 19 nt, Molluscum contagiosum virus
gggcccgugcucaggccag

SEQ ID NO: 3096870 - RNA, 19 nt, Molluscum contagiosum virus
cgaagcaugucaggccggu

SEQ ID NO: 3096871 - RNA, 21 nt, Molluscum contagiosum virus
gccugcgggcggcacacacuu

SEQ ID NO: 3096872 - RNA, 17 nt, Molluscum contagiosum virus
gacaaagucgcgcgcgg

SEQ ID NO: 3096873 - RNA, 14 nt, Molluscum contagiosum virus
auggggauguggac

SEQ ID NO: 3096874 - RNA, 16 nt, Molluscum contagiosum virus
ccaacacuaccacagc

SEQ ID NO: 3096875 - RNA, 14 nt, Molluscum contagiosum virus
cagccaugaggaca

SEQ ID NO: 3096876 - RNA, 17 nt, Molluscum contagiosum virus
gcuugcucagcagcuuc

SEQ ID NO: 3096877 - RNA, 14 nt, Molluscum contagiosum virus
agacaccagcuccg

SEQ ID NO: 3096878 - RNA, 23 nt, Molluscum contagiosum virus
gaauaccggagacaccagcuccg

SEQ ID NO: 3096879 - RNA, 16 nt, Molluscum contagiosum virus
ugcauggcggcggcca

SEQ ID NO: 3096880 - RNA, 18 nt, Molluscum contagiosum virus
cacgaucaaggugcagaa

SEQ ID NO: 3096881 - RNA, 15 nt, Molluscum contagiosum virus
gaaaaaucccccgcc

SEQ ID NO: 3096882 - RNA, 14 nt, Molluscum contagiosum virus
caaagccugcugcg

SEQ ID NO: 3096883 - RNA, 20 nt, Molluscum contagiosum virus
cgcgggcucaagucgcccuu

SEQ ID NO: 3096884 - RNA, 15 nt, Molluscum contagiosum virus
uggcaaaccacgagc

SEQ ID NO: 3096885 - RNA, 13 nt, Molluscum contagiosum virus
gccuccaagaaga

SEQ ID NO: 3096886 - RNA, 15 nt, Molluscum contagiosum virus
gcccuuccuggaggg

SEQ ID NO: 3096887 - RNA, 19 nt, Molluscum contagiosum virus
gcaacaggaaagcuucugu

SEQ ID NO: 3096888 - RNA, 20 nt, Molluscum contagiosum virus
ccagauguucucgccagugg

SEQ ID NO: 3096889 - RNA, 16 nt, Molluscum contagiosum virus
ccgccagaagugaaau

SEQ ID NO: 3096890 - RNA, 20 nt, Molluscum contagiosum virus
cucgugccgccugcgcgcac

SEQ ID NO: 3096891 - RNA, 16 nt, Molluscum contagiosum virus
cagcgcgcgacugucu

SEQ ID NO: 3096892 - RNA, 23 nt, Molluscum contagiosum virus
cgagguggcacccuggcugcugc

SEQ ID NO: 3096893 - RNA, 22 nt, Molluscum contagiosum virus
augcucgucgccgggccccugu

SEQ ID NO: 3096894 - RNA, 18 nt, Molluscum contagiosum virus
aguugcgagccagccagg

SEQ ID NO: 3096895 - RNA, 18 nt, Molluscum contagiosum virus
accucaacuguugccugg

SEQ ID NO: 3096896 - RNA, 15 nt, Molluscum contagiosum virus
gcggccacucucccg

SEQ ID NO: 3096897 - RNA, 17 nt, Molluscum contagiosum virus
uugcgagccagccaggc

SEQ ID NO: 3096898 - RNA, 17 nt, Molluscum contagiosum virus
uacuuccgguguccccg

SEQ ID NO: 3096899 - RNA, 20 nt, Molluscum contagiosum virus
cugcuguacucgccguucca

SEQ ID NO: 3096900 - RNA, 15 nt, Molluscum contagiosum virus
acgcuagcuacgagu

SEQ ID NO: 3096901 - RNA, 14 nt, Molluscum contagiosum virus
cgugaacgaggcug

SEQ ID NO: 3096902 - RNA, 14 nt, Molluscum contagiosum virus
gaucgacgaggacc

SEQ ID NO: 3096903 - RNA, 15 nt, Molluscum contagiosum virus
cugagggcgcucgau

SEQ ID NO: 3096904 - RNA, 13 nt, Molluscum contagiosum virus
augaggcugcucu

SEQ ID NO: 3096905 - RNA, 16 nt, Molluscum contagiosum virus
gcggcgcgaagcaggc

SEQ ID NO: 3096906 - RNA, 20 nt, Molluscum contagiosum virus
cgacggugugccgcuggugg

SEQ ID NO: 3096907 - RNA, 14 nt, Molluscum contagiosum virus
ggccgcuagcaggc

SEQ ID NO: 3096908 - RNA, 23 nt, Molluscum contagiosum virus
uagcgucugggugcccaaacagc

SEQ ID NO: 3096909 - RNA, 18 nt, Molluscum contagiosum virus
ccgcaggaaaggcacccg

SEQ ID NO: 3096910 - RNA, 22 nt, Molluscum contagiosum virus
ccgcgcgaacaaaaaacaacuc

SEQ ID NO: 3096911 - RNA, 11 nt, Molluscum contagiosum virus
agagcccgcac

SEQ ID NO: 3096912 - RNA, 16 nt, Molluscum contagiosum virus
ugcugcgcuacaugua

SEQ ID NO: 3096913 - RNA, 19 nt, Molluscum contagiosum virus
cacgagcugacgcagacgc

SEQ ID NO: 3096914 - RNA, 17 nt, Molluscum contagiosum virus
ggaccugcgccagcgcc

SEQ ID NO: 3096915 - RNA, 15 nt, Molluscum contagiosum virus
ugccugugggauggc

SEQ ID NO: 3096916 - RNA, 16 nt, Molluscum contagiosum virus
gugcuugcgcacggac

SEQ ID NO: 3096917 - RNA, 16 nt, Molluscum contagiosum virus
ggcguggugcuggcca

SEQ ID NO: 3096918 - RNA, 21 nt, Molluscum contagiosum virus
cggucuuccagcacugcgcca

SEQ ID NO: 3096919 - RNA, 19 nt, Molluscum contagiosum virus
uggagggguguuuccuugc

SEQ ID NO: 3096920 - RNA, 23 nt, Molluscum contagiosum virus
agugccuccgcggacgcgcccug

SEQ ID NO: 3096921 - RNA, 16 nt, Molluscum contagiosum virus
ggccuuuagcagcggc

SEQ ID NO: 3096922 - RNA, 16 nt, Molluscum contagiosum virus
ugccgguggaagagcc

SEQ ID NO: 3096923 - RNA, 17 nt, Molluscum contagiosum virus
cgagcccgagcccgggc

SEQ ID NO: 3096924 - RNA, 21 nt, Molluscum contagiosum virus
gcaccccgaaaggcacccgca

SEQ ID NO: 3096925 - RNA, 19 nt, Molluscum contagiosum virus
uucugcguugccagcguaa

SEQ ID NO: 3096926 - RNA, 18 nt, Molluscum contagiosum virus
cggagauggacacagcaa

SEQ ID NO: 3096927 - RNA, 17 nt, Molluscum contagiosum virus
uucgagaccagccgcga

SEQ ID NO: 3096928 - RNA, 14 nt, Molluscum contagiosum virus
cgauggcgcagcuc

SEQ ID NO: 3096929 - RNA, 14 nt, Molluscum contagiosum virus
ggggaaccgcugcu

SEQ ID NO: 3096930 - RNA, 14 nt, Molluscum contagiosum virus
gcaacaaagaggaa

SEQ ID NO: 3096931 - RNA, 13 nt, Molluscum contagiosum virus
cauacgcagaggc

SEQ ID NO: 3096932 - RNA, 20 nt, Molluscum contagiosum virus
uggaagcuuccuuuuucacu

SEQ ID NO: 3096933 - RNA, 23 nt, Molluscum contagiosum virus
gcuucaggcaagaggggagccag

SEQ ID NO: 3096934 - RNA, 21 nt, Molluscum contagiosum virus
cguacaucgacuacgcgcugc

SEQ ID NO: 3096935 - RNA, 14 nt, Molluscum contagiosum virus
ugcgaccggcaaca

SEQ ID NO: 3096936 - RNA, 22 nt, Molluscum contagiosum virus
gcugcuggccaacccucgcaag

SEQ ID NO: 3096937 - RNA, 21 nt, Molluscum contagiosum virus
cgucagccucugugcggcgcc

SEQ ID NO: 3096938 - RNA, 22 nt, Molluscum contagiosum virus
caacgagcucuccgaagagcag

SEQ ID NO: 3096939 - RNA, 15 nt, Molluscum contagiosum virus
gacacgagggccuug

SEQ ID NO: 3096940 - RNA, 16 nt, Molluscum contagiosum virus
cauacacuuccugcua

SEQ ID NO: 3096941 - RNA, 18 nt, Molluscum contagiosum virus
gcgggcccgugcucaggc

SEQ ID NO: 3096942 - RNA, 19 nt, Molluscum contagiosum virus
gcaggaggaccgcgagcgc

SEQ ID NO: 3096943 - RNA, 18 nt, Molluscum contagiosum virus
gcaggcgugcucagcacc

SEQ ID NO: 3096944 - RNA, 18 nt, Molluscum contagiosum virus
ccgcgugcucugcuccgc

SEQ ID NO: 3096945 - RNA, 15 nt, Molluscum contagiosum virus
cgcaggaugcugggg

SEQ ID NO: 3096946 - RNA, 15 nt, Molluscum contagiosum virus
gaaacaugugucuga

SEQ ID NO: 3096947 - RNA, 18 nt, Molluscum contagiosum virus
gacgugcugcuggcccug

SEQ ID NO: 3096948 - RNA, 23 nt, Molluscum contagiosum virus
uccggcgcggccuggccacgccg

SEQ ID NO: 3096949 - RNA, 15 nt, Molluscum contagiosum virus
ugcgcaccagcugca

SEQ ID NO: 3096950 - RNA, 22 nt, Molluscum contagiosum virus
cagccgcucguccagcugcgcg

SEQ ID NO: 3096951 - RNA, 16 nt, Molluscum contagiosum virus
cagcagcuccugguag

SEQ ID NO: 3096952 - RNA, 15 nt, Molluscum contagiosum virus
gcgauaggacaugac

SEQ ID NO: 3096953 - RNA, 14 nt, Molluscum contagiosum virus
gcaccgagcccgcc

SEQ ID NO: 3096954 - RNA, 15 nt, Molluscum contagiosum virus
cgcuguugcugcugc

SEQ ID NO: 3096955 - RNA, 23 nt, Molluscum contagiosum virus
guggccgcgccgggcgccagaac

SEQ ID NO: 3096956 - RNA, 14 nt, Molluscum contagiosum virus
ugagcaagcucaag

SEQ ID NO: 3096957 - RNA, 13 nt, Molluscum contagiosum virus
ccgggcccgggcc

SEQ ID NO: 3096958 - RNA, 14 nt, Molluscum contagiosum virus
gccuuccugcuggc

SEQ ID NO: 3096959 - RNA, 15 nt, Molluscum contagiosum virus
cuuucccgggcacug

SEQ ID NO: 3096960 - RNA, 16 nt, Molluscum contagiosum virus
uagcgcucgugcacca

SEQ ID NO: 3096961 - RNA, 20 nt, Molluscum contagiosum virus
agagcaagcgagagaggagu

SEQ ID NO: 3096962 - RNA, 13 nt, Molluscum contagiosum virus
cggagcugugccg

SEQ ID NO: 3096963 - RNA, 12 nt, Molluscum contagiosum virus
cgcgucugcucu

SEQ ID NO: 3096964 - RNA, 16 nt, Molluscum contagiosum virus
uucucagguacguguc

SEQ ID NO: 3096965 - RNA, 23 nt, Molluscum contagiosum virus
gagaaaggcacccaccaggaaca

SEQ ID NO: 3096966 - RNA, 16 nt, Molluscum contagiosum virus
ccgcugcgccggcugc

SEQ ID NO: 3096967 - RNA, 21 nt, Molluscum contagiosum virus
acacucgcgcguccgcaaaga

SEQ ID NO: 3096968 - RNA, 21 nt, Molluscum contagiosum virus
acacucacgcguccacaaaga

SEQ ID NO: 3096969 - RNA, 17 nt, Molluscum contagiosum virus
ugcgccggcugcgccac

SEQ ID NO: 3096970 - RNA, 15 nt, Molluscum contagiosum virus
caacuucgcgcugua

SEQ ID NO: 3096971 - RNA, 24 nt, Molluscum contagiosum virus
agcacacgguagagcugcgagaac

SEQ ID NO: 3096972 - RNA, 18 nt, Molluscum contagiosum virus
aaagguacccgcaggaaa

SEQ ID NO: 3096973 - RNA, 19 nt, Molluscum contagiosum virus
cuauguucuucgcagagga

SEQ ID NO: 3096974 - RNA, 19 nt, Molluscum contagiosum virus
cacgcaccgcgacaugccu

SEQ ID NO: 3096975 - RNA, 16 nt, Molluscum contagiosum virus
cgcucacugcagcagc

SEQ ID NO: 3096976 - RNA, 23 nt, Molluscum contagiosum virus
guuguucguacucaacaagcugc

SEQ ID NO: 3096977 - RNA, 20 nt, Molluscum contagiosum virus
acuggacugagccgcaagca

SEQ ID NO: 3096978 - RNA, 22 nt, Molluscum contagiosum virus
acgacggcugcucgcugccugg

SEQ ID NO: 3096979 - RNA, 14 nt, Molluscum contagiosum virus
agcgggaaacugcu

SEQ ID NO: 3096980 - RNA, 19 nt, Molluscum contagiosum virus
ucgagcgcgcgccugcugg

SEQ ID NO: 3096981 - RNA, 12 nt, Molluscum contagiosum virus
caaucuguccag

SEQ ID NO: 3096982 - RNA, 17 nt, Molluscum contagiosum virus
uguccuuccgacccggc

SEQ ID NO: 3096983 - RNA, 14 nt, Molluscum contagiosum virus
uccggggcgcaagc

SEQ ID NO: 3096984 - RNA, 17 nt, Molluscum contagiosum virus
guuccaggaacgccgcc

SEQ ID NO: 3096985 - RNA, 21 nt, Molluscum contagiosum virus
caccuggcgagcgcucugcau

SEQ ID NO: 3096986 - RNA, 14 nt, Molluscum contagiosum virus
ccaccaccuccagg

SEQ ID NO: 3096987 - RNA, 22 nt, Molluscum contagiosum virus
cacguccuccaauccuccugcc

SEQ ID NO: 3096988 - RNA, 21 nt, Molluscum contagiosum virus
ucuccgcgcugcacuacaacc

SEQ ID NO: 3096989 - RNA, 18 nt, Molluscum contagiosum virus
cuuucacgcugcacgagc

SEQ ID NO: 3096990 - RNA, 13 nt, Molluscum contagiosum virus
cacgagacugagu

SEQ ID NO: 3096991 - RNA, 16 nt, Molluscum contagiosum virus
cacaaaggcgggcccg

SEQ ID NO: 3096992 - RNA, 15 nt, Molluscum contagiosum virus
gcacgggcucgagcu

SEQ ID NO: 3096993 - RNA, 20 nt, Molluscum contagiosum virus
acaacuacuucgaggccggc

SEQ ID NO: 3096994 - RNA, 14 nt, Molluscum contagiosum virus
cgcucgccaccgcg

SEQ ID NO: 3096995 - RNA, 19 nt, Molluscum contagiosum virus
cgcugccgcgcgcgccgca

SEQ ID NO: 3096996 - RNA, 14 nt, Molluscum contagiosum virus
cuuuccgugcuuga

SEQ ID NO: 3096997 - RNA, 13 nt, Molluscum contagiosum virus
acgagccgcugcu

SEQ ID NO: 3096998 - RNA, 18 nt, Molluscum contagiosum virus
ccgacgccuuccugcugg

SEQ ID NO: 3096999 - RNA, 14 nt, Molluscum contagiosum virus
gcagccucaaccug

SEQ ID NO: 3097000 - RNA, 17 nt, Molluscum contagiosum virus
ccaccggcagugcuugc

SEQ ID NO: 3097001 - RNA, 17 nt, Molluscum contagiosum virus
cgugccgccggcgccgc

SEQ ID NO: 3097002 - RNA, 13 nt, Molluscum contagiosum virus
gagcagcugcugc

SEQ ID NO: 3097003 - RNA, 13 nt, Molluscum contagiosum virus
aggaaagcgcaca

SEQ ID NO: 3097004 - RNA, 14 nt, Molluscum contagiosum virus
gcgcccgacgagcu

SEQ ID NO: 3097005 - RNA, 18 nt, Molluscum contagiosum virus
gcgaggccugcguggaca

SEQ ID NO: 3097006 - RNA, 18 nt, Molluscum contagiosum virus
gucuacaacgagcucucc

SEQ ID NO: 3097007 - RNA, 12 nt, Molluscum contagiosum virus
gacaacgugcug

SEQ ID NO: 3097008 - RNA, 14 nt, Molluscum contagiosum virus
caggcgcaggccgc

SEQ ID NO: 3097009 - RNA, 18 nt, Molluscum contagiosum virus
cuacacgcacgaccucac

SEQ ID NO: 3097010 - RNA, 18 nt, Molluscum contagiosum virus
ggcugggaaagggcugcu

SEQ ID NO: 3097011 - RNA, 22 nt, Molluscum contagiosum virus
aguacgcgcgugguacagauga

SEQ ID NO: 3097012 - RNA, 18 nt, Molluscum contagiosum virus
uuuccgcgaaguccuggg

SEQ ID NO: 3097013 - RNA, 13 nt, Molluscum contagiosum virus
gcccaggccaugg

SEQ ID NO: 3097014 - RNA, 18 nt, Molluscum contagiosum virus
gucccagcaccgcgccgc

SEQ ID NO: 3097015 - RNA, 20 nt, Molluscum contagiosum virus
cgcgccggggcgcgcgcugc

SEQ ID NO: 3097016 - RNA, 19 nt, Molluscum contagiosum virus
gcagauaguuuggacgagc

SEQ ID NO: 3097017 - RNA, 16 nt, Molluscum contagiosum virus
gcugcagaacugccug

SEQ ID NO: 3097018 - RNA, 17 nt, Molluscum contagiosum virus
cagcaggaugcuggugu

SEQ ID NO: 3097019 - RNA, 20 nt, Molluscum contagiosum virus
gacacgcugcgcgugcuggg

SEQ ID NO: 3097020 - RNA, 20 nt, Molluscum contagiosum virus
uugcccccgagguggccaag

SEQ ID NO: 3097021 - RNA, 14 nt, Molluscum contagiosum virus
gaugcgcagcgucc

SEQ ID NO: 3097022 - RNA, 12 nt, Molluscum contagiosum virus
cacuagcgcagg

SEQ ID NO: 3097023 - RNA, 21 nt, Molluscum contagiosum virus
uccugcuggcgcgcugcgugc

SEQ ID NO: 3097024 - RNA, 19 nt, Molluscum contagiosum virus
gaagaggccagcacaagcc

SEQ ID NO: 3097025 - RNA, 15 nt, Molluscum contagiosum virus
acgcuguugcugcug

SEQ ID NO: 3097026 - RNA, 13 nt, Molluscum contagiosum virus
gcgcuagugcaga

SEQ ID NO: 3097027 - RNA, 14 nt, Molluscum contagiosum virus
gcgcggcucgcgca

SEQ ID NO: 3097028 - RNA, 14 nt, Molluscum contagiosum virus
gcaggccgugcuca

SEQ ID NO: 3097029 - RNA, 14 nt, Molluscum contagiosum virus
aaacgcacuguguu

SEQ ID NO: 3097030 - RNA, 20 nt, Molluscum contagiosum virus
uccaccggcagcgcauccga

SEQ ID NO: 3097031 - RNA, 19 nt, Molluscum contagiosum virus
gcgggacgcgugccuggcu

SEQ ID NO: 3097032 - RNA, 19 nt, Molluscum contagiosum virus
acgcugcugcacagcuucc

SEQ ID NO: 3097033 - RNA, 19 nt, Molluscum contagiosum virus
cgcaggaaaggucgggccc

SEQ ID NO: 3097034 - RNA, 19 nt, Molluscum contagiosum virus
cucgcguaccuacucgccg

SEQ ID NO: 3097035 - RNA, 23 nt, Molluscum contagiosum virus
aagcugcucaucggcgagcucuu

SEQ ID NO: 3097036 - RNA, 18 nt, Molluscum contagiosum virus
ucgagacgcugccugacg

SEQ ID NO: 3097037 - RNA, 19 nt, Molluscum contagiosum virus
gccgugcgucucucugucu

SEQ ID NO: 3097038 - RNA, 20 nt, Molluscum contagiosum virus
gggugaggagcucgacucga

SEQ ID NO: 3097039 - RNA, 21 nt, Molluscum contagiosum virus
acgugcugcuggcccugcuag

SEQ ID NO: 3097040 - RNA, 17 nt, Molluscum contagiosum virus
gccaacuaccuggggcu

SEQ ID NO: 3097041 - RNA, 19 nt, Molluscum contagiosum virus
ugcaugcggagcuggccga

SEQ ID NO: 3097042 - RNA, 18 nt, Molluscum contagiosum virus
gacucggaugcgcugccg

SEQ ID NO: 3097043 - RNA, 15 nt, Molluscum contagiosum virus
caugaaaggcaccug

SEQ ID NO: 3097044 - RNA, 14 nt, Molluscum contagiosum virus
acuacgcgcugcgg

SEQ ID NO: 3097045 - RNA, 15 nt, Molluscum contagiosum virus
gcgcguggaggacac

SEQ ID NO: 3097046 - RNA, 16 nt, Molluscum contagiosum virus
gccgggcgccagaaca

SEQ ID NO: 3097047 - RNA, 18 nt, Molluscum contagiosum virus
ucaaagcacaacaagaag

SEQ ID NO: 3097048 - RNA, 13 nt, Molluscum contagiosum virus
gcuugcugcgcug

SEQ ID NO: 3097049 - RNA, 16 nt, Molluscum contagiosum virus
ggacuccgaggcaggu

SEQ ID NO: 3097050 - RNA, 21 nt, Molluscum contagiosum virus
cgacuuacggacgcccuccuc

SEQ ID NO: 3097051 - RNA, 16 nt, Molluscum contagiosum virus
cgagcgccgccagcuc

SEQ ID NO: 3097052 - RNA, 21 nt, Molluscum contagiosum virus
ccacguacgagcagcugcugc

SEQ ID NO: 3097053 - RNA, 16 nt, Molluscum contagiosum virus
uccgaaaaaggcccgg

SEQ ID NO: 3097054 - RNA, 18 nt, Molluscum contagiosum virus
ugaacaauacaugcugga

SEQ ID NO: 3097055 - RNA, 13 nt, Molluscum contagiosum virus
aaaucgcaaagca

SEQ ID NO: 3097056 - RNA, 20 nt, Molluscum contagiosum virus
gcugcagaacugccugguca

SEQ ID NO: 3097057 - RNA, 12 nt, Molluscum contagiosum virus
aguguugugaag

SEQ ID NO: 3097058 - RNA, 15 nt, Molluscum contagiosum virus
ccuuccgcgcgggca

SEQ ID NO: 3097059 - RNA, 17 nt, Molluscum contagiosum virus
ugcacggggaagcacgc

SEQ ID NO: 3097060 - RNA, 15 nt, Molluscum contagiosum virus
gcauuacccccccuu

SEQ ID NO: 3097061 - RNA, 16 nt, Molluscum contagiosum virus
acaugcagcugcagga

SEQ ID NO: 3097062 - RNA, 11 nt, Molluscum contagiosum virus
gcacccgcagg

SEQ ID NO: 3097063 - RNA, 21 nt, Molluscum contagiosum virus
gagaagcuuuaguccaugccg

SEQ ID NO: 3097064 - RNA, 17 nt, Molluscum contagiosum virus
gugcuccacgcgcagcu

SEQ ID NO: 3097065 - RNA, 23 nt, Molluscum contagiosum virus
acagccccugcugcucgcggagg

SEQ ID NO: 3097066 - RNA, 14 nt, Molluscum contagiosum virus
gccuccgacuaccu

SEQ ID NO: 3097067 - RNA, 20 nt, Molluscum contagiosum virus
gaagaggccggcacaagccg

SEQ ID NO: 3097068 - RNA, 13 nt, Molluscum contagiosum virus
ccuagcuccagcg

SEQ ID NO: 3097069 - RNA, 13 nt, Molluscum contagiosum virus
cugcacgccgcca

SEQ ID NO: 3097070 - RNA, 22 nt, Molluscum contagiosum virus
cggagaucaggcagcugcugcg

SEQ ID NO: 3097071 - RNA, 13 nt, Molluscum contagiosum virus
cagccccugcugc

SEQ ID NO: 3097072 - RNA, 19 nt, Molluscum contagiosum virus
ggcacagugcuggacacuc

SEQ ID NO: 3097073 - RNA, 16 nt, Molluscum contagiosum virus
cgcaaacaagcauggu

SEQ ID NO: 3097074 - RNA, 15 nt, Molluscum contagiosum virus
gaccugcacgacccu

SEQ ID NO: 3097075 - RNA, 13 nt, Molluscum contagiosum virus
cugcuuccuccuc

SEQ ID NO: 3097076 - RNA, 21 nt, Molluscum contagiosum virus
ugcgcgugcggcgcaaccuca

SEQ ID NO: 3097077 - RNA, 18 nt, Molluscum contagiosum virus
gacgcguucuagcagcgu

SEQ ID NO: 3097078 - RNA, 16 nt, Molluscum contagiosum virus
gagcuucgucuucacc

SEQ ID NO: 3097079 - RNA, 19 nt, Molluscum contagiosum virus
ugcugcuggcccugcuagu

SEQ ID NO: 3097080 - RNA, 16 nt, Molluscum contagiosum virus
cuuggcgcgccgcugc

SEQ ID NO: 3097081 - RNA, 18 nt, Molluscum contagiosum virus
acaugucguaccuggugg

SEQ ID NO: 3097082 - RNA, 15 nt, Molluscum contagiosum virus
guccggcgcucgccc

SEQ ID NO: 3097083 - RNA, 23 nt, Molluscum contagiosum virus
aaaggaguuggcgcgcaagcgcu

SEQ ID NO: 3097084 - RNA, 17 nt, Molluscum contagiosum virus
auccucccugcgggcgc

SEQ ID NO: 3097085 - RNA, 14 nt, Molluscum contagiosum virus
auccugaaguccau

SEQ ID NO: 3097086 - RNA, 16 nt, Molluscum contagiosum virus
cgaagucuaggcagcg

SEQ ID NO: 3097087 - RNA, 21 nt, Molluscum contagiosum virus
cgaaccgcggcagccuugcga

SEQ ID NO: 3097088 - RNA, 14 nt, Molluscum contagiosum virus
cuuccgcgacgagc

SEQ ID NO: 3097089 - RNA, 19 nt, Molluscum contagiosum virus
gacuaugcgucuuccugcu

SEQ ID NO: 3097090 - RNA, 18 nt, Molluscum contagiosum virus
gcacgugcugcagcugcg

SEQ ID NO: 3097091 - RNA, 15 nt, Molluscum contagiosum virus
ccggcggcgcaagca

SEQ ID NO: 3097092 - RNA, 12 nt, Molluscum contagiosum virus
cuccaaggaggu

SEQ ID NO: 3097093 - RNA, 22 nt, Molluscum contagiosum virus
guccgcuccuucucagggcuuc

SEQ ID NO: 3097094 - RNA, 23 nt, Molluscum contagiosum virus
gccaaggaugccugccagcagag

SEQ ID NO: 3097095 - RNA, 14 nt, Molluscum contagiosum virus
gcauagucaucaaa

SEQ ID NO: 3097096 - RNA, 14 nt, Molluscum contagiosum virus
acccagcaaggccc

SEQ ID NO: 3097097 - RNA, 22 nt, Molluscum contagiosum virus
gugcacgcgggcgccggcgucc

SEQ ID NO: 3097098 - RNA, 16 nt, Molluscum contagiosum virus
acgugcuccgaggagg

SEQ ID NO: 3097099 - RNA, 22 nt, Molluscum contagiosum virus
ugcaagagcucguggacagccu

SEQ ID NO: 3097100 - RNA, 13 nt, Molluscum contagiosum virus
cggcgcucugcca

SEQ ID NO: 3097101 - RNA, 14 nt, Molluscum contagiosum virus
ugccaggcaacgca

SEQ ID NO: 3097102 - RNA, 13 nt, Molluscum contagiosum virus
gcccgagcccggc

SEQ ID NO: 3097103 - RNA, 15 nt, Molluscum contagiosum virus
aaacacgagacugag

SEQ ID NO: 3097104 - RNA, 18 nt, Molluscum contagiosum virus
cgcucaacgugggcaccu

SEQ ID NO: 3097105 - RNA, 23 nt, Molluscum contagiosum virus
gacccgcgaacgagggaugcaca

SEQ ID NO: 3097106 - RNA, 12 nt, Molluscum contagiosum virus
ccggcgcuugcg

SEQ ID NO: 3097107 - RNA, 12 nt, Molluscum contagiosum virus
aggcaccugcag

SEQ ID NO: 3097108 - RNA, 14 nt, Molluscum contagiosum virus
aacaccuccugcuu

SEQ ID NO: 3097109 - RNA, 14 nt, Molluscum contagiosum virus
cuccaaggucgagc

SEQ ID NO: 3097110 - RNA, 22 nt, Molluscum contagiosum virus
gaacgcgugaugucugucccgc

SEQ ID NO: 3097111 - RNA, 13 nt, Molluscum contagiosum virus
cccgcugcucuac

SEQ ID NO: 3097112 - RNA, 20 nt, Molluscum contagiosum virus
cgcguccacaaagacggggc

SEQ ID NO: 3097113 - RNA, 21 nt, Molluscum contagiosum virus
caggccuccuucccugacagc

SEQ ID NO: 3097114 - RNA, 12 nt, Molluscum contagiosum virus
gcccgugcucag

SEQ ID NO: 3097115 - RNA, 18 nt, Molluscum contagiosum virus
cgucacaagcaccgccug

SEQ ID NO: 3097116 - RNA, 12 nt, Molluscum contagiosum virus
ucagaggauucu

SEQ ID NO: 3097117 - RNA, 18 nt, Molluscum contagiosum virus
ccucgcaagcugagcgcg

SEQ ID NO: 3097118 - RNA, 13 nt, Molluscum contagiosum virus
cuagucagcggcg

SEQ ID NO: 3097119 - RNA, 20 nt, Molluscum contagiosum virus
ugccccguccucgcucgugc

SEQ ID NO: 3097120 - RNA, 11 nt, Molluscum contagiosum virus
uguaacaagga

SEQ ID NO: 3097121 - RNA, 21 nt, Molluscum contagiosum virus
uccggcuuuauuuccggcucc

SEQ ID NO: 3097122 - RNA, 23 nt, Molluscum contagiosum virus
cagcuccgcgacuaccugcugcu

SEQ ID NO: 3097123 - RNA, 16 nt, Molluscum contagiosum virus
cuguaugaucugcagu

SEQ ID NO: 3097124 - RNA, 20 nt, Molluscum contagiosum virus
auacccuuggcagcaacugc

SEQ ID NO: 3097125 - RNA, 19 nt, Molluscum contagiosum virus
gugcgucgacguggagccu

SEQ ID NO: 3097126 - RNA, 18 nt, Molluscum contagiosum virus
ggcgcgagaugcucgccg

SEQ ID NO: 3097127 - RNA, 19 nt, Molluscum contagiosum virus
gcugggccccuacgugguc

SEQ ID NO: 3097128 - RNA, 14 nt, Molluscum contagiosum virus
ccgagcccgcggcg

SEQ ID NO: 3097129 - RNA, 14 nt, Molluscum contagiosum virus
aucaccagccugcu

SEQ ID NO: 3097130 - RNA, 15 nt, Molluscum contagiosum virus
cagcccgacuucucg

SEQ ID NO: 3097131 - RNA, 18 nt, Molluscum contagiosum virus
cacgcucgcgcgcaugcu

SEQ ID NO: 3097132 - RNA, 13 nt, Molluscum contagiosum virus
gacauggagcgca

SEQ ID NO: 3097133 - RNA, 14 nt, Molluscum contagiosum virus
gcacgggcucgagc

SEQ ID NO: 3097134 - RNA, 18 nt, Molluscum contagiosum virus
cucgccggcaccacggug

SEQ ID NO: 3097135 - RNA, 18 nt, Molluscum contagiosum virus
agacugagugcugagcca

SEQ ID NO: 3097136 - RNA, 23 nt, Molluscum contagiosum virus
gcacguuccaaaagacagaggcc

SEQ ID NO: 3097137 - RNA, 23 nt, Molluscum contagiosum virus
cccgcguggcaagggcuccuucu

SEQ ID NO: 3097138 - RNA, 23 nt, Molluscum contagiosum virus
ggcggcagcgccagcgagaucaa

SEQ ID NO: 3097139 - RNA, 21 nt, Molluscum contagiosum virus
cagugcgagaucgacugcgcc

SEQ ID NO: 3097140 - RNA, 14 nt, Molluscum contagiosum virus
cguggccgagccgc

SEQ ID NO: 3097141 - RNA, 14 nt, Molluscum contagiosum virus
gugcugagccacaa

SEQ ID NO: 3097142 - RNA, 14 nt, Molluscum contagiosum virus
gcguugucgagaau

SEQ ID NO: 3097143 - RNA, 18 nt, Molluscum contagiosum virus
ccaacucugugaccugcg

SEQ ID NO: 3097144 - RNA, 19 nt, Molluscum contagiosum virus
gcuagcgacgcggacacau

SEQ ID NO: 3097145 - RNA, 18 nt, Molluscum contagiosum virus
gcguaucggagucaggca

SEQ ID NO: 3097146 - RNA, 13 nt, Molluscum contagiosum virus
gccgcacgugcug

SEQ ID NO: 3097147 - RNA, 15 nt, Molluscum contagiosum virus
cggacgcaggaugcu

SEQ ID NO: 3097148 - RNA, 15 nt, Molluscum contagiosum virus
ggcugcacgacgguc

SEQ ID NO: 3097149 - RNA, 16 nt, Molluscum contagiosum virus
cugggaacccguggcc

SEQ ID NO: 3097150 - RNA, 14 nt, Molluscum contagiosum virus
cgcgccugcuggcg

SEQ ID NO: 3097151 - RNA, 19 nt, Molluscum contagiosum virus
ccgcacaagggcagcucaa

SEQ ID NO: 3097152 - RNA, 19 nt, Molluscum contagiosum virus
cggugggcgccgcggccug

SEQ ID NO: 3097153 - RNA, 14 nt, Molluscum contagiosum virus
guucccauggaugc

SEQ ID NO: 3097154 - RNA, 16 nt, Molluscum contagiosum virus
gcgcacggcagcggcg

SEQ ID NO: 3097155 - RNA, 15 nt, Molluscum contagiosum virus
gcgcagagcuccccg

SEQ ID NO: 3097156 - RNA, 19 nt, Molluscum contagiosum virus
uuccccuccuagcccagca

SEQ ID NO: 3097157 - RNA, 14 nt, Molluscum contagiosum virus
uacuucgucaagca

SEQ ID NO: 3097158 - RNA, 18 nt, Molluscum contagiosum virus
uggggagacuugagccca

SEQ ID NO: 3097159 - RNA, 19 nt, Molluscum contagiosum virus
cccgugucgggcugcaucu

SEQ ID NO: 3097160 - RNA, 22 nt, Molluscum contagiosum virus
acuggagaccugucgugcaaug

SEQ ID NO: 3097161 - RNA, 12 nt, Molluscum contagiosum virus
cagagcgccagc

SEQ ID NO: 3097162 - RNA, 15 nt, Molluscum contagiosum virus
gcgggccaggcacug

SEQ ID NO: 3097163 - RNA, 13 nt, Molluscum contagiosum virus
guugcugcugccg

SEQ ID NO: 3097164 - RNA, 22 nt, Molluscum contagiosum virus
agaacaugugcuccgccaacgc

SEQ ID NO: 3097165 - RNA, 17 nt, Molluscum contagiosum virus
gaagcccugagaaggag

SEQ ID NO: 3097166 - RNA, 21 nt, Molluscum contagiosum virus
cuggugggcgugcggcgcacc

SEQ ID NO: 3097167 - RNA, 12 nt, Molluscum contagiosum virus
cgcaagccacac

SEQ ID NO: 3097168 - RNA, 13 nt, Molluscum contagiosum virus
cacggcgagcugc

SEQ ID NO: 3097169 - RNA, 13 nt, Molluscum contagiosum virus
ccgcggcgcggcg

SEQ ID NO: 3097170 - RNA, 15 nt, Molluscum contagiosum virus
ugcgugccccucgug

SEQ ID NO: 3097171 - RNA, 17 nt, Molluscum contagiosum virus
gcccgcaccugcgccgc

SEQ ID NO: 3097172 - RNA, 21 nt, Molluscum contagiosum virus
ccggcggcuggaccugcgcca

SEQ ID NO: 3097173 - RNA, 17 nt, Molluscum contagiosum virus
cggaaauguuguuugaa

SEQ ID NO: 3097174 - RNA, 16 nt, Molluscum contagiosum virus
accugcgacagcugcu

SEQ ID NO: 3097175 - RNA, 19 nt, Molluscum contagiosum virus
agccguucucguggcaagc

SEQ ID NO: 3097176 - RNA, 24 nt, Molluscum contagiosum virus
accucugcuucacgcugcucgugc

SEQ ID NO: 3097177 - RNA, 20 nt, Molluscum contagiosum virus
cuggagaaagaagugugccu

SEQ ID NO: 3097178 - RNA, 18 nt, Molluscum contagiosum virus
gacgagcagagccgggac

SEQ ID NO: 3097179 - RNA, 12 nt, Molluscum contagiosum virus
cgcgcugcgccg

SEQ ID NO: 3097180 - RNA, 23 nt, Molluscum contagiosum virus
cgucguagcgcucgugcaccagc

SEQ ID NO: 3097181 - RNA, 17 nt, Molluscum contagiosum virus
ugcaaguucgcugcugg

SEQ ID NO: 3097182 - RNA, 17 nt, Molluscum contagiosum virus
cguggcguugcugcugc

SEQ ID NO: 3097183 - RNA, 24 nt, Molluscum contagiosum virus
ggcgcacggugugcuacugcacug

SEQ ID NO: 3097184 - RNA, 14 nt, Molluscum contagiosum virus
cuggagcugccgcu

SEQ ID NO: 3097185 - RNA, 15 nt, Molluscum contagiosum virus
cgggcugcagcccuu

SEQ ID NO: 3097186 - RNA, 15 nt, Molluscum contagiosum virus
gccgaggucuuccac

SEQ ID NO: 3097187 - RNA, 22 nt, Molluscum contagiosum virus
guaccugcgacagcugcugcuc

SEQ ID NO: 3097188 - RNA, 14 nt, Molluscum contagiosum virus
ggacuacgcacggc

SEQ ID NO: 3097189 - RNA, 17 nt, Molluscum contagiosum virus
gaacggaacacagugcg

SEQ ID NO: 3097190 - RNA, 17 nt, Molluscum contagiosum virus
ucacgcguccacaaaga

SEQ ID NO: 3097191 - RNA, 16 nt, Molluscum contagiosum virus
ucucccgggcucuguc

SEQ ID NO: 3097192 - RNA, 22 nt, Molluscum contagiosum virus
guucugaauaaucucgagcagg

SEQ ID NO: 3097193 - RNA, 21 nt, Molluscum contagiosum virus
gucucaugguggccggccgcc

SEQ ID NO: 3097194 - RNA, 15 nt, Molluscum contagiosum virus
gcgcgccgcucgucg

SEQ ID NO: 3097195 - RNA, 17 nt, Molluscum contagiosum virus
gacucggaugcgcugcc

SEQ ID NO: 3097196 - RNA, 14 nt, Molluscum contagiosum virus
cuguaaauggaccc

SEQ ID NO: 3097197 - RNA, 14 nt, Molluscum contagiosum virus
cgcucgccccuucc

SEQ ID NO: 3097198 - RNA, 15 nt, Molluscum contagiosum virus
caacaacgagagcgg

SEQ ID NO: 3097199 - RNA, 20 nt, Molluscum contagiosum virus
cugcagagcgugcuggucaa

SEQ ID NO: 3097200 - RNA, 14 nt, Molluscum contagiosum virus
gcgcgguccugucc

SEQ ID NO: 3097201 - RNA, 14 nt, Molluscum contagiosum virus
gagacuugugccca

SEQ ID NO: 3097202 - RNA, 13 nt, Molluscum contagiosum virus
cuauugcgcggcg

SEQ ID NO: 3097203 - RNA, 22 nt, Molluscum contagiosum virus
cggcguacgcgcagggagcugc

SEQ ID NO: 3097204 - RNA, 19 nt, Molluscum contagiosum virus
gacgccgccaaugcugccg

SEQ ID NO: 3097205 - RNA, 22 nt, Molluscum contagiosum virus
uugaccgcuucgagugcucccg

SEQ ID NO: 3097206 - RNA, 18 nt, Molluscum contagiosum virus
ugcccaagugcgcguguc

SEQ ID NO: 3097207 - RNA, 21 nt, Molluscum contagiosum virus
aguugcagcccaccagcaggu

SEQ ID NO: 3097208 - RNA, 18 nt, Molluscum contagiosum virus
acagccccugcugcucgc

SEQ ID NO: 3097209 - RNA, 16 nt, Molluscum contagiosum virus
cucuggaaggagcugg

SEQ ID NO: 3097210 - RNA, 18 nt, Molluscum contagiosum virus
cuuggugcucauccuccc

SEQ ID NO: 3097211 - RNA, 15 nt, Molluscum contagiosum virus
cgugcaugcccagca

SEQ ID NO: 3097212 - RNA, 16 nt, Molluscum contagiosum virus
cgcgcgcgcucacccu

SEQ ID NO: 3097213 - RNA, 12 nt, Molluscum contagiosum virus
acagcuuccugg

SEQ ID NO: 3097214 - RNA, 13 nt, Molluscum contagiosum virus
agagaaccugugc

SEQ ID NO: 3097215 - RNA, 13 nt, Molluscum contagiosum virus
ggcgggugccgcc

SEQ ID NO: 3097216 - RNA, 20 nt, Molluscum contagiosum virus
aaagccggccccgcgaacga

SEQ ID NO: 3097217 - RNA, 14 nt, Molluscum contagiosum virus
ccaucgacgagguc

SEQ ID NO: 3097218 - RNA, 15 nt, Molluscum contagiosum virus
cugcgaucgcgggca

SEQ ID NO: 3097219 - RNA, 11 nt, Molluscum contagiosum virus
cacugcuggcg

SEQ ID NO: 3097220 - RNA, 14 nt, Molluscum contagiosum virus
gugcgcgcacggcu

SEQ ID NO: 3097221 - RNA, 21 nt, Molluscum contagiosum virus
ugacgauuaucguggacgagc

SEQ ID NO: 3097222 - RNA, 21 nt, Molluscum contagiosum virus
aguugagagcagcggcuacuu

SEQ ID NO: 3097223 - RNA, 15 nt, Molluscum contagiosum virus
acccuggcagccgag

SEQ ID NO: 3097224 - RNA, 17 nt, Molluscum contagiosum virus
ugcccgcgcacgagcug

SEQ ID NO: 3097225 - RNA, 18 nt, Molluscum contagiosum virus
ugcgagaacuggcgcagc

SEQ ID NO: 3097226 - RNA, 22 nt, Molluscum contagiosum virus
cugcgcgcgcuacugcgcgcac

SEQ ID NO: 3097227 - RNA, 13 nt, Molluscum contagiosum virus
gacgcgcagcugu

SEQ ID NO: 3097228 - RNA, 15 nt, Molluscum contagiosum virus
gucacaagcaccgcc

SEQ ID NO: 3097229 - RNA, 20 nt, Molluscum contagiosum virus
ggaggcgugcguuccgggcc

SEQ ID NO: 3097230 - RNA, 15 nt, Molluscum contagiosum virus
uguucggcaugcagc

SEQ ID NO: 3097231 - RNA, 15 nt, Molluscum contagiosum virus
gccugcucacgcccg

SEQ ID NO: 3097232 - RNA, 19 nt, Molluscum contagiosum virus
uggcacggccggcgccgcg

SEQ ID NO: 3097233 - RNA, 22 nt, Molluscum contagiosum virus
cacgccgcucggcacugcuggc

SEQ ID NO: 3097234 - RNA, 17 nt, Molluscum contagiosum virus
cuccucucacgcccucu

SEQ ID NO: 3097235 - RNA, 19 nt, Molluscum contagiosum virus
gcuuugugcgaccugcugc

SEQ ID NO: 3097236 - RNA, 14 nt, Molluscum contagiosum virus
uagccuccuugucu

SEQ ID NO: 3097237 - RNA, 14 nt, Molluscum contagiosum virus
cgcaccucaccgcg

SEQ ID NO: 3097238 - RNA, 17 nt, Molluscum contagiosum virus
ccagugcgugcacuguc

SEQ ID NO: 3097239 - RNA, 20 nt, Molluscum contagiosum virus
agcccuuccacgacauggac

SEQ ID NO: 3097240 - RNA, 19 nt, Molluscum contagiosum virus
aguggccgcuccagagccg

SEQ ID NO: 3097241 - RNA, 18 nt, Molluscum contagiosum virus
cucgugcuggagcagggc

SEQ ID NO: 3097242 - RNA, 20 nt, Molluscum contagiosum virus
ggcgccguccaugugcccgc

SEQ ID NO: 3097243 - RNA, 11 nt, Molluscum contagiosum virus
gccgcgccgcg

SEQ ID NO: 3097244 - RNA, 22 nt, Molluscum contagiosum virus
cacgaagagucgcgccuggagc

SEQ ID NO: 3097245 - RNA, 22 nt, Molluscum contagiosum virus
agcucugauuacauccugcccu

SEQ ID NO: 3097246 - RNA, 14 nt, Molluscum contagiosum virus
cguccacaggcgcg

SEQ ID NO: 3097247 - RNA, 15 nt, Molluscum contagiosum virus
acuuuaucucucacu

SEQ ID NO: 3097248 - RNA, 17 nt, Molluscum contagiosum virus
cgggcgcagacgccgag

SEQ ID NO: 3097249 - RNA, 23 nt, Molluscum contagiosum virus
cacggccuucuccucgcucugcu

SEQ ID NO: 3097250 - RNA, 21 nt, Molluscum contagiosum virus
cgcgggcguguccgcgggcgc

SEQ ID NO: 3097251 - RNA, 13 nt, Molluscum contagiosum virus
uggccgagccgcu

SEQ ID NO: 3097252 - RNA, 19 nt, Molluscum contagiosum virus
ccggcggcauugugguguu

SEQ ID NO: 3097253 - RNA, 16 nt, Molluscum contagiosum virus
cgggcgccgcggcugc

SEQ ID NO: 3097254 - RNA, 21 nt, Molluscum contagiosum virus
augaguaccuguaugaucugc

SEQ ID NO: 3097255 - RNA, 16 nt, Molluscum contagiosum virus
gacggcacgggcacgc

SEQ ID NO: 3097256 - RNA, 20 nt, Molluscum contagiosum virus
gucugcuuugucugcaggca

SEQ ID NO: 3097257 - RNA, 14 nt, Molluscum contagiosum virus
gcaugcuugaggcg

SEQ ID NO: 3097258 - RNA, 23 nt, Molluscum contagiosum virus
cugagcuagugccgagcucgccu

SEQ ID NO: 3097259 - RNA, 19 nt, Molluscum contagiosum virus
gcucgguagccaggcgccg

SEQ ID NO: 3097260 - RNA, 13 nt, Molluscum contagiosum virus
ggcagacuaagaa

SEQ ID NO: 3097261 - RNA, 22 nt, Molluscum contagiosum virus
acguguacgcacggggccgcac

SEQ ID NO: 3097262 - RNA, 21 nt, Molluscum contagiosum virus
cacgcgaauguccggcgcugg

SEQ ID NO: 3097263 - RNA, 19 nt, Molluscum contagiosum virus
gaggcgcuagugcagauga

SEQ ID NO: 3097264 - RNA, 17 nt, Molluscum contagiosum virus
gccgggcgccggcucug

SEQ ID NO: 3097265 - RNA, 17 nt, Molluscum contagiosum virus
cacgcgagcggagcugg

SEQ ID NO: 3097266 - RNA, 18 nt, Molluscum contagiosum virus
agggcgggcacgugcugc

SEQ ID NO: 3097267 - RNA, 20 nt, Molluscum contagiosum virus
ccaaguccgagcaagcgggc

SEQ ID NO: 3097268 - RNA, 23 nt, Molluscum contagiosum virus
caaaugcgucccagcagcugcuc

SEQ ID NO: 3097269 - RNA, 16 nt, Molluscum contagiosum virus
guuuuguguuggccag

SEQ ID NO: 3097270 - RNA, 17 nt, Molluscum contagiosum virus
cgcaucccccgcguugu

SEQ ID NO: 3097271 - RNA, 17 nt, Molluscum contagiosum virus
gcacaagggcagcucaa

SEQ ID NO: 3097272 - RNA, 17 nt, Molluscum contagiosum virus
gcguccguucacgggca

SEQ ID NO: 3097273 - RNA, 16 nt, Molluscum contagiosum virus
gaccucccggcggcaa

SEQ ID NO: 3097274 - RNA, 15 nt, Molluscum contagiosum virus
gcgcggcagccgcag

SEQ ID NO: 3097275 - RNA, 22 nt, Molluscum contagiosum virus
cugcgcuuugcccccgaggugg

SEQ ID NO: 3097276 - RNA, 14 nt, Molluscum contagiosum virus
acuugugcgccccc

SEQ ID NO: 3097277 - RNA, 17 nt, Molluscum contagiosum virus
ugcugcgcuacauguau

SEQ ID NO: 3097278 - RNA, 12 nt, Molluscum contagiosum virus
ucgaucagcucc

SEQ ID NO: 3097279 - RNA, 22 nt, Molluscum contagiosum virus
ucgccguguuggaagucguggc

SEQ ID NO: 3097280 - RNA, 17 nt, Molluscum contagiosum virus
cgggcaugcacagcugc

SEQ ID NO: 3097281 - RNA, 17 nt, Molluscum contagiosum virus
ccgaggccgcgcucuuc

SEQ ID NO: 3097282 - RNA, 21 nt, Molluscum contagiosum virus
ugaggaggccaacgccagcug

SEQ ID NO: 3097283 - RNA, 17 nt, Molluscum contagiosum virus
ugggcagccgccuggcc

SEQ ID NO: 3097284 - RNA, 16 nt, Molluscum contagiosum virus
acgaggaaaggcaccc

SEQ ID NO: 3097285 - RNA, 14 nt, Molluscum contagiosum virus
gcaggccaggugca

SEQ ID NO: 3097286 - RNA, 17 nt, Molluscum contagiosum virus
cgcaucccugcgcaccu

SEQ ID NO: 3097287 - RNA, 12 nt, Molluscum contagiosum virus
aacgagcucucc

SEQ ID NO: 3097288 - RNA, 17 nt, Molluscum contagiosum virus
uugccgcuugagcagca

SEQ ID NO: 3097289 - RNA, 18 nt, Molluscum contagiosum virus
ccacgugguccaccagca

SEQ ID NO: 3097290 - RNA, 13 nt, Molluscum contagiosum virus
cacgagcccgcaa

SEQ ID NO: 3097291 - RNA, 13 nt, Molluscum contagiosum virus
gacaugcugugcg

SEQ ID NO: 3097292 - RNA, 18 nt, Molluscum contagiosum virus
gcccuccucgaccugcac

SEQ ID NO: 3097293 - RNA, 14 nt, Molluscum contagiosum virus
cugcugcucuucca

SEQ ID NO: 3097294 - RNA, 20 nt, Molluscum contagiosum virus
cgccgcgcaaaagcacagca

SEQ ID NO: 3097295 - RNA, 14 nt, Molluscum contagiosum virus
aaagcgcacacuug

SEQ ID NO: 3097296 - RNA, 15 nt, Molluscum contagiosum virus
cggacgcgcagcugu

SEQ ID NO: 3097297 - RNA, 17 nt, Molluscum contagiosum virus
guccggaggcacgggcu

SEQ ID NO: 3097298 - RNA, 22 nt, Molluscum contagiosum virus
cgggagaguggccgcuccagag

SEQ ID NO: 3097299 - RNA, 12 nt, Molluscum contagiosum virus
gucggagcagga

SEQ ID NO: 3097300 - RNA, 17 nt, Molluscum contagiosum virus
gaggcgcuugggcacug

SEQ ID NO: 3097301 - RNA, 14 nt, Molluscum contagiosum virus
cgaagcaggcgcca

SEQ ID NO: 3097302 - RNA, 15 nt, Molluscum contagiosum virus
ggcgcucgcgagaag

SEQ ID NO: 3097303 - RNA, 12 nt, Molluscum contagiosum virus
ucccggcugccg

SEQ ID NO: 3097304 - RNA, 19 nt, Molluscum contagiosum virus
guugugcacgcuguccagg

SEQ ID NO: 3097305 - RNA, 23 nt, Molluscum contagiosum virus
agaagacggcgcgcgcgcuagcc

SEQ ID NO: 3097306 - RNA, 13 nt, Molluscum contagiosum virus
agcgagcgcgggc

SEQ ID NO: 3097307 - RNA, 19 nt, Molluscum contagiosum virus
gcgcccuaagggcccgcug

SEQ ID NO: 3097308 - RNA, 13 nt, Molluscum contagiosum virus
gcucggcgagagc

SEQ ID NO: 3097309 - RNA, 14 nt, Molluscum contagiosum virus
cgugcaccuggagc

SEQ ID NO: 3097310 - RNA, 18 nt, Molluscum contagiosum virus
caacucugcucgugcccg

SEQ ID NO: 3097311 - RNA, 18 nt, Molluscum contagiosum virus
gagaauaaaugagcagca

SEQ ID NO: 3097312 - RNA, 17 nt, Molluscum contagiosum virus
guacgguguccucuuca

SEQ ID NO: 3097313 - RNA, 20 nt, Molluscum contagiosum virus
aaaguacuugccgucacggc

SEQ ID NO: 3097314 - RNA, 12 nt, Molluscum contagiosum virus
agcguggagcug

SEQ ID NO: 3097315 - RNA, 15 nt, Molluscum contagiosum virus
gccuuccugcuggcg

SEQ ID NO: 3097316 - RNA, 16 nt, Molluscum contagiosum virus
uggcacuagccuccuu

SEQ ID NO: 3097317 - RNA, 17 nt, Molluscum contagiosum virus
cuccaucaucgagcugc

SEQ ID NO: 3097318 - RNA, 19 nt, Molluscum contagiosum virus
cucaacgugggcaccugca

SEQ ID NO: 3097319 - RNA, 15 nt, Molluscum contagiosum virus
gccucugccugcaag

SEQ ID NO: 3097320 - RNA, 17 nt, Molluscum contagiosum virus
cgagacgugcggcacgc

SEQ ID NO: 3097321 - RNA, 19 nt, Molluscum contagiosum virus
gucgacgggaacgagguca

SEQ ID NO: 3097322 - RNA, 18 nt, Molluscum contagiosum virus
ggcuccuucuucagcagg

SEQ ID NO: 3097323 - RNA, 20 nt, Molluscum contagiosum virus
cgcugccgcgcgcgccgcag

SEQ ID NO: 3097324 - RNA, 19 nt, Molluscum contagiosum virus
gcacuaccgcaaccagcug

SEQ ID NO: 3097325 - RNA, 21 nt, Molluscum contagiosum virus
gacggcugguguuaccggguc

SEQ ID NO: 3097326 - RNA, 19 nt, Molluscum contagiosum virus
ggaguccgugacagagugc

SEQ ID NO: 3097327 - RNA, 22 nt, Molluscum contagiosum virus
caucugcaacucgcgcugcagc

SEQ ID NO: 3097328 - RNA, 22 nt, Molluscum contagiosum virus
uugagcucgcgcgcaagaacaa

SEQ ID NO: 3097329 - RNA, 16 nt, Molluscum contagiosum virus
acaccacacgcgcggc

SEQ ID NO: 3097330 - RNA, 22 nt, Molluscum contagiosum virus
gcaugcgcgccgcgcugcuggc

SEQ ID NO: 3097331 - RNA, 21 nt, Molluscum contagiosum virus
ggccgcggaggacucggaggc

SEQ ID NO: 3097332 - RNA, 16 nt, Molluscum contagiosum virus
acagcgugcgcgggca

SEQ ID NO: 3097333 - RNA, 17 nt, Molluscum contagiosum virus
aucgcgugcuugcugcg

SEQ ID NO: 3097334 - RNA, 22 nt, Molluscum contagiosum virus
cacacucgcgcguccacaaggg

SEQ ID NO: 3097335 - RNA, 19 nt, Molluscum contagiosum virus
caggcaagaggggagccag

SEQ ID NO: 3097336 - RNA, 16 nt, Molluscum contagiosum virus
cgagcgcaugcgcgcc

SEQ ID NO: 3097337 - RNA, 14 nt, Molluscum contagiosum virus
cuguucugcuugga

SEQ ID NO: 3097338 - RNA, 20 nt, Molluscum contagiosum virus
cuacugcgcacccgccacga

SEQ ID NO: 3097339 - RNA, 17 nt, Molluscum contagiosum virus
cgcagggagcugcggac

SEQ ID NO: 3097340 - RNA, 13 nt, Molluscum contagiosum virus
ggcgcgcgccagc

SEQ ID NO: 3097341 - RNA, 15 nt, Molluscum contagiosum virus
agugcgugccaggcg

SEQ ID NO: 3097342 - RNA, 17 nt, Molluscum contagiosum virus
ugcgacagcugcugcuc

SEQ ID NO: 3097343 - RNA, 21 nt, Molluscum contagiosum virus
cucgcgggcguggggagcugg

SEQ ID NO: 3097344 - RNA, 14 nt, Molluscum contagiosum virus
gcuccgaguccagc

SEQ ID NO: 3097345 - RNA, 15 nt, Molluscum contagiosum virus
cgccaauggagccgc

SEQ ID NO: 3097346 - RNA, 23 nt, Molluscum contagiosum virus
uggcaccgcgcgcgcuccgagac

SEQ ID NO: 3097347 - RNA, 23 nt, Molluscum contagiosum virus
cugcgugcgauugccccugggcu

SEQ ID NO: 3097348 - RNA, 23 nt, Molluscum contagiosum virus
agucgcccguguucgcggagcug

SEQ ID NO: 3097349 - RNA, 12 nt, Molluscum contagiosum virus
uccagcagcgcc

SEQ ID NO: 3097350 - RNA, 23 nt, Molluscum contagiosum virus
acgcaaagucaucugccucgugg

SEQ ID NO: 3097351 - RNA, 18 nt, Molluscum contagiosum virus
caggaaagguacccgcag

SEQ ID NO: 3097352 - RNA, 15 nt, Molluscum contagiosum virus
ggcaucgcgcugcug

SEQ ID NO: 3097353 - RNA, 14 nt, Molluscum contagiosum virus
cuggggcuagcgcu

SEQ ID NO: 3097354 - RNA, 16 nt, Molluscum contagiosum virus
cugccgcgcgcgccgc

SEQ ID NO: 3097355 - RNA, 17 nt, Molluscum contagiosum virus
cgagcuucgucuucacc

SEQ ID NO: 3097356 - RNA, 21 nt, Molluscum contagiosum virus
cucauggcgcgcaaccagcug

SEQ ID NO: 3097357 - RNA, 15 nt, Molluscum contagiosum virus
uaaacgcggugagug

SEQ ID NO: 3097358 - RNA, 21 nt, Molluscum contagiosum virus
ggcucucgcggaacuggacgc

SEQ ID NO: 3097359 - RNA, 13 nt, Molluscum contagiosum virus
gggcaagcucgcg

SEQ ID NO: 3097360 - RNA, 18 nt, Molluscum contagiosum virus
agaagcccgggucggcaa

SEQ ID NO: 3097361 - RNA, 17 nt, Molluscum contagiosum virus
caguguuucgacgccgg

SEQ ID NO: 3097362 - RNA, 16 nt, Molluscum contagiosum virus
caucaccccgcugggc

SEQ ID NO: 3097363 - RNA, 17 nt, Molluscum contagiosum virus
augaggacagcuugcug

SEQ ID NO: 3097364 - RNA, 14 nt, Molluscum contagiosum virus
ucgaagcgagaggu

SEQ ID NO: 3097365 - RNA, 17 nt, Molluscum contagiosum virus
cgccgccaugcugcgcg

SEQ ID NO: 3097366 - RNA, 16 nt, Molluscum contagiosum virus
cagcucagcaggcugu

SEQ ID NO: 3097367 - RNA, 18 nt, Molluscum contagiosum virus
cuugcgcacggaccucaa

SEQ ID NO: 3097368 - RNA, 17 nt, Molluscum contagiosum virus
cacggccuucgcgcugc

SEQ ID NO: 3097369 - RNA, 13 nt, Molluscum contagiosum virus
ccuguaccacccg

SEQ ID NO: 3097370 - RNA, 23 nt, Molluscum contagiosum virus
cucgccggcgagaugcgagcgcg

SEQ ID NO: 3097371 - RNA, 17 nt, Molluscum contagiosum virus
cagcuucuuggagcccu

SEQ ID NO: 3097372 - RNA, 15 nt, Molluscum contagiosum virus
gcgucacguacucgc

SEQ ID NO: 3097373 - RNA, 21 nt, Molluscum contagiosum virus
aagacggggccgcgaaagagg

SEQ ID NO: 3097374 - RNA, 14 nt, Molluscum contagiosum virus
cuucuugcgcggcg

SEQ ID NO: 3097375 - RNA, 22 nt, Molluscum contagiosum virus
ucgcgcgacuggcacgcgccgc

SEQ ID NO: 3097376 - RNA, 12 nt, Molluscum contagiosum virus
gccgcgcccgcg

SEQ ID NO: 3097377 - RNA, 14 nt, Molluscum contagiosum virus
cgcacgcgcucucc

SEQ ID NO: 3097378 - RNA, 16 nt, Molluscum contagiosum virus
gcaccccgcaggaaag

SEQ ID NO: 3097379 - RNA, 16 nt, Molluscum contagiosum virus
cgagcgcgcgcgcugc

SEQ ID NO: 3097380 - RNA, 16 nt, Molluscum contagiosum virus
ucgcacccgcgccgcg

SEQ ID NO: 3097381 - RNA, 19 nt, Molluscum contagiosum virus
ccugcaggaaaggcacccg

SEQ ID NO: 3097382 - RNA, 13 nt, Molluscum contagiosum virus
ggaccccgagcug

SEQ ID NO: 3097383 - RNA, 20 nt, Molluscum contagiosum virus
gaauuuuuauauggcaagcu

SEQ ID NO: 3097384 - RNA, 19 nt, Molluscum contagiosum virus
aggcguccagcggcugccc

SEQ ID NO: 3097385 - RNA, 20 nt, Molluscum contagiosum virus
cugcuggugcucgccugcau

SEQ ID NO: 3097386 - RNA, 17 nt, Molluscum contagiosum virus
augcaugcggagcuggc

SEQ ID NO: 3097387 - RNA, 20 nt, Molluscum contagiosum virus
cauccucaccuuccugggcg

SEQ ID NO: 3097388 - RNA, 14 nt, Molluscum contagiosum virus
uguugcucuaccug

SEQ ID NO: 3097389 - RNA, 19 nt, Molluscum contagiosum virus
uccuuccggagacaccagc

SEQ ID NO: 3097390 - RNA, 20 nt, Molluscum contagiosum virus
cagacguacgagcaggcgca

SEQ ID NO: 3097391 - RNA, 14 nt, Molluscum contagiosum virus
cgucucggagaaga

SEQ ID NO: 3097392 - RNA, 13 nt, Molluscum contagiosum virus
gagccagcgcgga

SEQ ID NO: 3097393 - RNA, 11 nt, Molluscum contagiosum virus
gcuugcugcug

SEQ ID NO: 3097394 - RNA, 20 nt, Molluscum contagiosum virus
uccggcgcucgccccuuccc

SEQ ID NO: 3097395 - RNA, 15 nt, Molluscum contagiosum virus
gcgcgguccuguccg

SEQ ID NO: 3097396 - RNA, 22 nt, Molluscum contagiosum virus
cugccgcccgcgcccgcgccgc

SEQ ID NO: 3097397 - RNA, 16 nt, Molluscum contagiosum virus
ucgagcuuccucaagg

SEQ ID NO: 3097398 - RNA, 17 nt, Molluscum contagiosum virus
aagaaacucaggaagcg

SEQ ID NO: 3097399 - RNA, 21 nt, Molluscum contagiosum virus
gcacacacuugcacgcgcacg

SEQ ID NO: 3097400 - RNA, 14 nt, Molluscum contagiosum virus
acggcgacgacagc

SEQ ID NO: 3097401 - RNA, 23 nt, Molluscum contagiosum virus
accucccugugaacgcaccgccg

SEQ ID NO: 3097402 - RNA, 12 nt, Molluscum contagiosum virus
gcggcauccuga

SEQ ID NO: 3097403 - RNA, 13 nt, Molluscum contagiosum virus
cgagggccuuggc

SEQ ID NO: 3097404 - RNA, 15 nt, Molluscum contagiosum virus
ggagaucaggcagcu

SEQ ID NO: 3097405 - RNA, 16 nt, Molluscum contagiosum virus
ggacacgggugagcuc

SEQ ID NO: 3097406 - RNA, 19 nt, Molluscum contagiosum virus
acccgcaggaaaggcaccc

SEQ ID NO: 3097407 - RNA, 18 nt, Molluscum contagiosum virus
gcgggaggcucucgagca

SEQ ID NO: 3097408 - RNA, 14 nt, Molluscum contagiosum virus
auacuccugcuggc

SEQ ID NO: 3097409 - RNA, 17 nt, Molluscum contagiosum virus
uggccgcuccagagccg

SEQ ID NO: 3097410 - RNA, 16 nt, Molluscum contagiosum virus
ugccgcggcaguggcc

SEQ ID NO: 3097411 - RNA, 18 nt, Molluscum contagiosum virus
ggcgggcgaaagcgccgc

SEQ ID NO: 3097412 - RNA, 19 nt, Molluscum contagiosum virus
cuugaucgacauggagcgc

SEQ ID NO: 3097413 - RNA, 13 nt, Molluscum contagiosum virus
aaagucuuccugg

SEQ ID NO: 3097414 - RNA, 13 nt, Molluscum contagiosum virus
cuguccgugggcg

SEQ ID NO: 3097415 - RNA, 13 nt, Molluscum contagiosum virus
ggugugugccugc

SEQ ID NO: 3097416 - RNA, 15 nt, Molluscum contagiosum virus
accccuugcuacagg

SEQ ID NO: 3097417 - RNA, 24 nt, Molluscum contagiosum virus
cacgcgugcugcgcggcgccgcag

SEQ ID NO: 3097418 - RNA, 19 nt, Molluscum contagiosum virus
guggcacccuggcugcugc

SEQ ID NO: 3097419 - RNA, 15 nt, Molluscum contagiosum virus
gcacgcagcucuucc

SEQ ID NO: 3097420 - RNA, 21 nt, Molluscum contagiosum virus
cuguccgcggacgcgggccug

SEQ ID NO: 3097421 - RNA, 21 nt, Molluscum contagiosum virus
caccuuucauucgcuggugcg

SEQ ID NO: 3097422 - RNA, 15 nt, Molluscum contagiosum virus
cgcgcgaucgcggcc

SEQ ID NO: 3097423 - RNA, 16 nt, Molluscum contagiosum virus
aacuagggagcggcau

SEQ ID NO: 3097424 - RNA, 23 nt, Molluscum contagiosum virus
uacauggacgugcugcuggcccu

SEQ ID NO: 3097425 - RNA, 20 nt, Molluscum contagiosum virus
gaacgauuuuacgcacacga

SEQ ID NO: 3097426 - RNA, 19 nt, Molluscum contagiosum virus
cuggccgaacugcucugcg

SEQ ID NO: 3097427 - RNA, 14 nt, Molluscum contagiosum virus
guugcacgugcgug

SEQ ID NO: 3097428 - RNA, 18 nt, Molluscum contagiosum virus
gguugcgcggggcaggca

SEQ ID NO: 3097429 - RNA, 20 nt, Molluscum contagiosum virus
cgagugcccgcgcgcuguau

SEQ ID NO: 3097430 - RNA, 21 nt, Molluscum contagiosum virus
cgaggcgccgaagagugcgca

SEQ ID NO: 3097431 - RNA, 12 nt, Molluscum contagiosum virus
aaggcacacccc

SEQ ID NO: 3097432 - RNA, 24 nt, Molluscum contagiosum virus
gacuaucaggcgauaggacaugac

SEQ ID NO: 3097433 - RNA, 22 nt, Molluscum contagiosum virus
cggaggcgcaaccgcgugcgug

SEQ ID NO: 3097434 - RNA, 18 nt, Molluscum contagiosum virus
gccucucucggagaagug

SEQ ID NO: 3097435 - RNA, 15 nt, Molluscum contagiosum virus
cgugacaaucucugc

SEQ ID NO: 3097436 - RNA, 19 nt, Molluscum contagiosum virus
gccgcgcgcugcucuggag

SEQ ID NO: 3097437 - RNA, 16 nt, Molluscum contagiosum virus
guacugccgccaggaa

SEQ ID NO: 3097438 - RNA, 17 nt, Molluscum contagiosum virus
gcgcagugcggccagca

SEQ ID NO: 3097439 - RNA, 16 nt, Molluscum contagiosum virus
cccaagggcguagagc

SEQ ID NO: 3097440 - RNA, 15 nt, Molluscum contagiosum virus
ggaaagauagggcau

SEQ ID NO: 3097441 - RNA, 15 nt, Molluscum contagiosum virus
ccaagaacagagaaa

SEQ ID NO: 3097442 - RNA, 14 nt, Molluscum contagiosum virus
cgcucgccucuggg

SEQ ID NO: 3097443 - RNA, 18 nt, Molluscum contagiosum virus
cggacacguugcagcagc

SEQ ID NO: 3097444 - RNA, 19 nt, Molluscum contagiosum virus
cgcacucgcuggccucugc

SEQ ID NO: 3097445 - RNA, 19 nt, Molluscum contagiosum virus
gcaagacccagcaaggccc

SEQ ID NO: 3097446 - RNA, 19 nt, Molluscum contagiosum virus
gcuucuuuacgggcgccag

SEQ ID NO: 3097447 - RNA, 18 nt, Molluscum contagiosum virus
cugcucgcgcaucugccg

SEQ ID NO: 3097448 - RNA, 22 nt, Molluscum contagiosum virus
gccgcggaacugacugcugccc

SEQ ID NO: 3097449 - RNA, 23 nt, Molluscum contagiosum virus
auucuuguacgggcgugcgcagc

SEQ ID NO: 3097450 - RNA, 22 nt, Molluscum contagiosum virus
gcuccagagccgcgugcgccgc

SEQ ID NO: 3097451 - RNA, 21 nt, Molluscum contagiosum virus
aagcaccgccugcugcagcuc

SEQ ID NO: 3097452 - RNA, 12 nt, Molluscum contagiosum virus
uacacuuccugc

SEQ ID NO: 3097453 - RNA, 19 nt, Molluscum contagiosum virus
gugcuggcggggcuggcag

SEQ ID NO: 3097454 - RNA, 18 nt, Molluscum contagiosum virus
aggaaagcgcacacuugc

SEQ ID NO: 3097455 - RNA, 23 nt, Molluscum contagiosum virus
cauccuugauaaaagcacagucc

SEQ ID NO: 3097456 - RNA, 15 nt, Molluscum contagiosum virus
uguuuguagccgcgc

SEQ ID NO: 3097457 - RNA, 18 nt, Molluscum contagiosum virus
aagugcuccgcacgugga

SEQ ID NO: 3097458 - RNA, 22 nt, Molluscum contagiosum virus
caagauuguagagacgcugccg

SEQ ID NO: 3097459 - RNA, 17 nt, Molluscum contagiosum virus
aggaacucgaggcucug

SEQ ID NO: 3097460 - RNA, 21 nt, Molluscum contagiosum virus
cgcugguuugcgcgagcugcg

SEQ ID NO: 3097461 - RNA, 19 nt, Molluscum contagiosum virus
cucggcguggugcuggcca

SEQ ID NO: 3097462 - RNA, 14 nt, Molluscum contagiosum virus
agcuccugcugguu

SEQ ID NO: 3097463 - RNA, 16 nt, Molluscum contagiosum virus
cgcggccaugcuccug

SEQ ID NO: 3097464 - RNA, 13 nt, Molluscum contagiosum virus
ggcuguguuccag

SEQ ID NO: 3097465 - RNA, 19 nt, Molluscum contagiosum virus
gcucgcgcgcacgcgcacg

SEQ ID NO: 3097466 - RNA, 13 nt, Molluscum contagiosum virus
gcucucagagcau

SEQ ID NO: 3097467 - RNA, 17 nt, Molluscum contagiosum virus
gcagacaaagacagucc

SEQ ID NO: 3097468 - RNA, 23 nt, Molluscum contagiosum virus
cugccucguggaacaaagaggca

SEQ ID NO: 3097469 - RNA, 23 nt, Molluscum contagiosum virus
cacgcucgcgacgugcgcgcugc

SEQ ID NO: 3097470 - RNA, 15 nt, Molluscum contagiosum virus
gccccugcgcgagca

SEQ ID NO: 3097471 - RNA, 22 nt, Molluscum contagiosum virus
caucagagaagugcuccgcacg

SEQ ID NO: 3097472 - RNA, 23 nt, Molluscum contagiosum virus
ggccaugaucauggcgccgcugc

SEQ ID NO: 3097473 - RNA, 16 nt, Molluscum contagiosum virus
gaacaaaaaacaacuc

SEQ ID NO: 3097474 - RNA, 12 nt, Molluscum contagiosum virus
ccgccaggaacg

SEQ ID NO: 3097475 - RNA, 15 nt, Molluscum contagiosum virus
ccuggcuugcgcgcg

SEQ ID NO: 3097476 - RNA, 13 nt, Molluscum contagiosum virus
cgccgccucgcgc

SEQ ID NO: 3097477 - RNA, 19 nt, Molluscum contagiosum virus
gcugagcgcggagcuggcg

SEQ ID NO: 3097478 - RNA, 18 nt, Molluscum contagiosum virus
cgagucguacacgcagag

SEQ ID NO: 3097479 - RNA, 23 nt, Molluscum contagiosum virus
gcucgagcgcgcgccugcuggcg

SEQ ID NO: 3097480 - RNA, 19 nt, Molluscum contagiosum virus
gcucaccgcgcagaagcca

SEQ ID NO: 3097481 - RNA, 18 nt, Molluscum contagiosum virus
cagcggcgccgcagcuuu

SEQ ID NO: 3097482 - RNA, 18 nt, Molluscum contagiosum virus
cagcgugcgcgggcacgc

SEQ ID NO: 3097483 - RNA, 22 nt, Molluscum contagiosum virus
caauggcgcgcgagcacagcgc

SEQ ID NO: 3097484 - RNA, 17 nt, Molluscum contagiosum virus
cgguuugcuaacaggaa

SEQ ID NO: 3097485 - RNA, 14 nt, Molluscum contagiosum virus
acuggacugagccg

SEQ ID NO: 3097486 - RNA, 22 nt, Molluscum contagiosum virus
cgaggccggccgugcagagcaa

SEQ ID NO: 3097487 - RNA, 21 nt, Molluscum contagiosum virus
ggcgcacaacuugggcccgcc

SEQ ID NO: 3097488 - RNA, 12 nt, Molluscum contagiosum virus
acccuuggcagc

SEQ ID NO: 3097489 - RNA, 22 nt, Molluscum contagiosum virus
cgcaagaacaaccagacgugcu

SEQ ID NO: 3097490 - RNA, 14 nt, Molluscum contagiosum virus
cggcgcgcccagcg

SEQ ID NO: 3097491 - RNA, 22 nt, Molluscum contagiosum virus
ugcccccaccgggguccgcucc

SEQ ID NO: 3097492 - RNA, 17 nt, Molluscum contagiosum virus
cggaggacucggaggcc

SEQ ID NO: 3097493 - RNA, 18 nt, Molluscum contagiosum virus
gcgugcagggcgugcuug

SEQ ID NO: 3097494 - RNA, 13 nt, Molluscum contagiosum virus
cgugcgagcagag

SEQ ID NO: 3097495 - RNA, 17 nt, Molluscum contagiosum virus
gccguucacgcacacga

SEQ ID NO: 3097496 - RNA, 15 nt, Molluscum contagiosum virus
gcucgcacacgugca

SEQ ID NO: 3097497 - RNA, 23 nt, Molluscum contagiosum virus
ugcccgcgggggcguggcagaua

SEQ ID NO: 3097498 - RNA, 15 nt, Molluscum contagiosum virus
ccgcgccagcgacag

SEQ ID NO: 3097499 - RNA, 19 nt, Molluscum contagiosum virus
ccaagcacauucucaacca

SEQ ID NO: 3097500 - RNA, 22 nt, Molluscum contagiosum virus
cucgcggucgggccccugcgcg

SEQ ID NO: 3097501 - RNA, 21 nt, Molluscum contagiosum virus
gcacgcgcacagucuugcgca

SEQ ID NO: 3097502 - RNA, 16 nt, Molluscum contagiosum virus
gcgagccagccaggcg

SEQ ID NO: 3097503 - RNA, 20 nt, Molluscum contagiosum virus
gcugcggcucuacccggagg

SEQ ID NO: 3097504 - RNA, 17 nt, Molluscum contagiosum virus
cgaggcgcgcacgcugc

SEQ ID NO: 3097505 - RNA, 14 nt, Molluscum contagiosum virus
gcgugacggugcug

SEQ ID NO: 3097506 - RNA, 21 nt, Molluscum contagiosum virus
caagggcagcucaagcugcuc

SEQ ID NO: 3097507 - RNA, 15 nt, Molluscum contagiosum virus
gacgccuuccugcug

SEQ ID NO: 3097508 - RNA, 18 nt, Molluscum contagiosum virus
gcucaagacgcugcuggc

SEQ ID NO: 3097509 - RNA, 19 nt, Molluscum contagiosum virus
cuugcgcggaagaagcugc

SEQ ID NO: 3097510 - RNA, 20 nt, Molluscum contagiosum virus
guugaagcucucgcagagga

SEQ ID NO: 3097511 - RNA, 17 nt, Molluscum contagiosum virus
cugccgucgcgcgcugu

SEQ ID NO: 3097512 - RNA, 19 nt, Molluscum contagiosum virus
aagcugcacgugcagcggc

SEQ ID NO: 3097513 - RNA, 19 nt, Molluscum contagiosum virus
cccugguuugcgcucucag

SEQ ID NO: 3097514 - RNA, 12 nt, Molluscum contagiosum virus
cucacgcccucu

SEQ ID NO: 3097515 - RNA, 15 nt, Molluscum contagiosum virus
uuucgggaagcacag

SEQ ID NO: 3097516 - RNA, 14 nt, Molluscum contagiosum virus
ccugcgacagcugc

SEQ ID NO: 3097517 - RNA, 16 nt, Molluscum contagiosum virus
agcguacucgggccgc

SEQ ID NO: 3097518 - RNA, 20 nt, Molluscum contagiosum virus
cugcguggacagcaucccug

SEQ ID NO: 3097519 - RNA, 16 nt, Molluscum contagiosum virus
caucaucgagcugcag

SEQ ID NO: 3097520 - RNA, 20 nt, Molluscum contagiosum virus
gugccagagucgccgcugcg

SEQ ID NO: 3097521 - RNA, 16 nt, Molluscum contagiosum virus
uccaagaagaggccgg

SEQ ID NO: 3097522 - RNA, 22 nt, Molluscum contagiosum virus
ucagcuccgacgugaccucgcu

SEQ ID NO: 3097523 - RNA, 15 nt, Molluscum contagiosum virus
acuggcgcagcagga

SEQ ID NO: 3097524 - RNA, 17 nt, Molluscum contagiosum virus
caagaucguuuugcacu

SEQ ID NO: 3097525 - RNA, 13 nt, Molluscum contagiosum virus
ugcgcgugccucu

SEQ ID NO: 3097526 - RNA, 21 nt, Molluscum contagiosum virus
gcguaguaguagcgcucgccc

SEQ ID NO: 3097527 - RNA, 21 nt, Molluscum contagiosum virus
gcaggaaagguacccgcagga

SEQ ID NO: 3097528 - RNA, 14 nt, Molluscum contagiosum virus
aagacgagcugugc

SEQ ID NO: 3097529 - RNA, 14 nt, Molluscum contagiosum virus
agacaggccggggc

SEQ ID NO: 3097530 - RNA, 15 nt, Molluscum contagiosum virus
cgcggacgcgcccug

SEQ ID NO: 3097531 - RNA, 20 nt, Molluscum contagiosum virus
acgugcgccagcucugggcg

SEQ ID NO: 3097532 - RNA, 13 nt, Molluscum contagiosum virus
cugcgcgcggacu

SEQ ID NO: 3097533 - RNA, 13 nt, Molluscum contagiosum virus
acgaggagccccg

SEQ ID NO: 3097534 - RNA, 19 nt, Molluscum contagiosum virus
cgcgacgugugcucugugc

SEQ ID NO: 3097535 - RNA, 16 nt, Molluscum contagiosum virus
cugcugguucugcucg

SEQ ID NO: 3097536 - RNA, 22 nt, Molluscum contagiosum virus
cggcaaaugcgucccagcagcu

SEQ ID NO: 3097537 - RNA, 13 nt, Molluscum contagiosum virus
ccugguggagcac

SEQ ID NO: 3097538 - RNA, 20 nt, Molluscum contagiosum virus
cgcgcgcacaucggcacugc

SEQ ID NO: 3097539 - RNA, 21 nt, Molluscum contagiosum virus
ucggcacaucucucagggcag

SEQ ID NO: 3097540 - RNA, 15 nt, Molluscum contagiosum virus
cguggcguugcugcu

SEQ ID NO: 3097541 - RNA, 18 nt, Molluscum contagiosum virus
acagccgccugccgcgcu

SEQ ID NO: 3097542 - RNA, 12 nt, Molluscum contagiosum virus
caaggauuuaaa

SEQ ID NO: 3097543 - RNA, 17 nt, Molluscum contagiosum virus
gcugcguuuccagggca

SEQ ID NO: 3097544 - RNA, 14 nt, Molluscum contagiosum virus
caguaccugcugcc

SEQ ID NO: 3097545 - RNA, 17 nt, Molluscum contagiosum virus
gacaaguacaugcacgu

SEQ ID NO: 3097546 - RNA, 15 nt, Molluscum contagiosum virus
cguacgagcagcugc

SEQ ID NO: 3097547 - RNA, 22 nt, Molluscum contagiosum virus
caaaauggcugcgaccaagaca

SEQ ID NO: 3097548 - RNA, 17 nt, Molluscum contagiosum virus
cagaugaggcugcucuc

SEQ ID NO: 3097549 - RNA, 20 nt, Molluscum contagiosum virus
ugccgccugcgcgcacccga

SEQ ID NO: 3097550 - RNA, 18 nt, Molluscum contagiosum virus
gcagugcucuuuaguaca

SEQ ID NO: 3097551 - RNA, 20 nt, Molluscum contagiosum virus
gcugcuggaacaggugcgca

SEQ ID NO: 3097552 - RNA, 18 nt, Molluscum contagiosum virus
ucguggcguugcugcugc

SEQ ID NO: 3097553 - RNA, 14 nt, Molluscum contagiosum virus
gccugccgcgagca

SEQ ID NO: 3097554 - RNA, 22 nt, Molluscum contagiosum virus
gccgcggcacugggugcccgag

SEQ ID NO: 3097555 - RNA, 22 nt, Molluscum contagiosum virus
agaacaagaagcgcuucuuugc

SEQ ID NO: 3097556 - RNA, 15 nt, Molluscum contagiosum virus
ucgacacugugcugg

SEQ ID NO: 3097557 - RNA, 16 nt, Molluscum contagiosum virus
gcucgguuggcggcgc

SEQ ID NO: 3097558 - RNA, 18 nt, Molluscum contagiosum virus
aggcucgagcugcaucuu

SEQ ID NO: 3097559 - RNA, 21 nt, Molluscum contagiosum virus
gcgguggucuccgcgggcagc

SEQ ID NO: 3097560 - RNA, 15 nt, Molluscum contagiosum virus
cuggacugagccgca

SEQ ID NO: 3097561 - RNA, 13 nt, Molluscum contagiosum virus
gcgccugaaccug

SEQ ID NO: 3097562 - RNA, 15 nt, Molluscum contagiosum virus
gcgcgcgcggcgcag

SEQ ID NO: 3097563 - RNA, 15 nt, Molluscum contagiosum virus
ggcggcacccgccgc

SEQ ID NO: 3097564 - RNA, 15 nt, Molluscum contagiosum virus
cgcgcugcgggcgcc

SEQ ID NO: 3097565 - RNA, 17 nt, Molluscum contagiosum virus
cccgcggagcugugcca

SEQ ID NO: 3097566 - RNA, 15 nt, Molluscum contagiosum virus
gcgugucuggagccc

SEQ ID NO: 3097567 - RNA, 16 nt, Molluscum contagiosum virus
cgcgcucacugcagca

SEQ ID NO: 3097568 - RNA, 14 nt, Molluscum contagiosum virus
gcgcaugcgcgccg

SEQ ID NO: 3097569 - RNA, 12 nt, Molluscum contagiosum virus
cagcagccaggc

SEQ ID NO: 3097570 - RNA, 21 nt, Molluscum contagiosum virus
gagccuucucgucgagagcgc

SEQ ID NO: 3097571 - RNA, 23 nt, Molluscum contagiosum virus
acaggagcauuccuuguccuggc

SEQ ID NO: 3097572 - RNA, 18 nt, Molluscum contagiosum virus
aggucggaagaaggcgcc

SEQ ID NO: 3097573 - RNA, 13 nt, Molluscum contagiosum virus
ucaugcugcucau

SEQ ID NO: 3097574 - RNA, 16 nt, Molluscum contagiosum virus
augacggcgggaaggg

SEQ ID NO: 3097575 - RNA, 18 nt, Molluscum contagiosum virus
caccugcgcuuccucuac

SEQ ID NO: 3097576 - RNA, 22 nt, Molluscum contagiosum virus
uaggucggaagaaggcgccuac

SEQ ID NO: 3097577 - RNA, 14 nt, Molluscum contagiosum virus
aggacuaccagcuc

SEQ ID NO: 3097578 - RNA, 19 nt, Molluscum contagiosum virus
gcgugcgcgugccucugcc

SEQ ID NO: 3097579 - RNA, 14 nt, Molluscum contagiosum virus
ugcacuacugcucc

SEQ ID NO: 3097580 - RNA, 20 nt, Molluscum contagiosum virus
ggagaaagaagugugccugc

SEQ ID NO: 3097581 - RNA, 23 nt, Molluscum contagiosum virus
cguggucgcgcgcgcucugccgc

SEQ ID NO: 3097582 - RNA, 15 nt, Molluscum contagiosum virus
caaguccagcgcgcu

SEQ ID NO: 3097583 - RNA, 16 nt, Molluscum contagiosum virus
gcugagcgcagcacac

SEQ ID NO: 3097584 - RNA, 19 nt, Molluscum contagiosum virus
caugcccggccucgccucc

SEQ ID NO: 3097585 - RNA, 14 nt, Molluscum contagiosum virus
ccgcgggcugcaag

SEQ ID NO: 3097586 - RNA, 21 nt, Molluscum contagiosum virus
ccugucggcacaucucucagg

SEQ ID NO: 3097587 - RNA, 13 nt, Molluscum contagiosum virus
uguacaaagagcu

SEQ ID NO: 3097588 - RNA, 16 nt, Molluscum contagiosum virus
gcgcagaagccaacac

SEQ ID NO: 3097589 - RNA, 17 nt, Molluscum contagiosum virus
ccauggacacgcugcgc

SEQ ID NO: 3097590 - RNA, 17 nt, Molluscum contagiosum virus
uugcgcguccacaaagg

SEQ ID NO: 3097591 - RNA, 18 nt, Molluscum contagiosum virus
gcuugcauguucucuuug

SEQ ID NO: 3097592 - RNA, 21 nt, Molluscum contagiosum virus
cagcagccgcguagcuagcuc

SEQ ID NO: 3097593 - RNA, 16 nt, Molluscum contagiosum virus
ucucagcggcacugcg

SEQ ID NO: 3097594 - RNA, 15 nt, Molluscum contagiosum virus
cgcgucugugcgcgc

SEQ ID NO: 3097595 - RNA, 16 nt, Molluscum contagiosum virus
gcgccgcaaaagcaag

SEQ ID NO: 3097596 - RNA, 14 nt, Molluscum contagiosum virus
ggcagccgccuggc

SEQ ID NO: 3097597 - RNA, 13 nt, Molluscum contagiosum virus
gggucgugcaggu

SEQ ID NO: 3097598 - RNA, 20 nt, Molluscum contagiosum virus
ccgcggcgcggcggaagugg

SEQ ID NO: 3097599 - RNA, 17 nt, Molluscum contagiosum virus
gcgccgaugcagugcgg

SEQ ID NO: 3097600 - RNA, 19 nt, Molluscum contagiosum virus
ugagccacaaacacucgcg

SEQ ID NO: 3097601 - RNA, 20 nt, Molluscum contagiosum virus
gcuucuacugcgcacccgcc

SEQ ID NO: 3097602 - RNA, 16 nt, Molluscum contagiosum virus
accuccugcuuugcac

SEQ ID NO: 3097603 - RNA, 21 nt, Molluscum contagiosum virus
caaaagaggccugcugaagaa

SEQ ID NO: 3097604 - RNA, 15 nt, Molluscum contagiosum virus
gggcgagcaguguga

SEQ ID NO: 3097605 - RNA, 22 nt, Molluscum contagiosum virus
cguggcgcuuggcgagcgcugc

SEQ ID NO: 3097606 - RNA, 16 nt, Molluscum contagiosum virus
cgagcgcuaucucugg

SEQ ID NO: 3097607 - RNA, 17 nt, Molluscum contagiosum virus
agcgccuguccgugggc

SEQ ID NO: 3097608 - RNA, 14 nt, Molluscum contagiosum virus
cgcaagcgcugcuc

SEQ ID NO: 3097609 - RNA, 18 nt, Molluscum contagiosum virus
gaauuaaacaaacgugca

SEQ ID NO: 3097610 - RNA, 22 nt, Molluscum contagiosum virus
cugucguaacaauggacacgca

SEQ ID NO: 3097611 - RNA, 20 nt, Molluscum contagiosum virus
agcgcuacgacgacaugcac

SEQ ID NO: 3097612 - RNA, 20 nt, Molluscum contagiosum virus
cuucuucgcaagugcacacc

SEQ ID NO: 3097613 - RNA, 21 nt, Molluscum contagiosum virus
gcuaccugcgcaagcucagcc

SEQ ID NO: 3097614 - RNA, 19 nt, Molluscum contagiosum virus
gacgcggucgcgcccuugc

SEQ ID NO: 3097615 - RNA, 15 nt, Molluscum contagiosum virus
cggggcuggcagaag

SEQ ID NO: 3097616 - RNA, 22 nt, Molluscum contagiosum virus
uaccagcucgucaacggugcgc

SEQ ID NO: 3097617 - RNA, 14 nt, Molluscum contagiosum virus
agcggcgacuugcu

SEQ ID NO: 3097618 - RNA, 19 nt, Molluscum contagiosum virus
cgcuggaccccgagcugcg

SEQ ID NO: 3097619 - RNA, 16 nt, Molluscum contagiosum virus
cacguacucgcugcuc

SEQ ID NO: 3097620 - RNA, 22 nt, Molluscum contagiosum virus
ccgcagcgcuggagcuggcugg

SEQ ID NO: 3097621 - RNA, 19 nt, Molluscum contagiosum virus
ccgcuggggcggagagcuc

SEQ ID NO: 3097622 - RNA, 22 nt, Molluscum contagiosum virus
gccggcaacgcugccgcuggcg

SEQ ID NO: 3097623 - RNA, 15 nt, Molluscum contagiosum virus
gcgcggagaucgccg

SEQ ID NO: 3097624 - RNA, 19 nt, Molluscum contagiosum virus
cucguggcguugcugcugc

SEQ ID NO: 3097625 - RNA, 20 nt, Molluscum contagiosum virus
gauguagguacccgcaaccc

SEQ ID NO: 3097626 - RNA, 13 nt, Molluscum contagiosum virus
cacgcgcccgaag

SEQ ID NO: 3097627 - RNA, 23 nt, Molluscum contagiosum virus
cggccagagccuucucgguguag

SEQ ID NO: 3097628 - RNA, 16 nt, Molluscum contagiosum virus
uccacaaagacgggcc

SEQ ID NO: 3097629 - RNA, 19 nt, Molluscum contagiosum virus
gcccgugcucaggccagca

SEQ ID NO: 3097630 - RNA, 16 nt, Molluscum contagiosum virus
uggucaacagcuacac

SEQ ID NO: 3097631 - RNA, 13 nt, Molluscum contagiosum virus
gaaagaagaagga

SEQ ID NO: 3097632 - RNA, 23 nt, Molluscum contagiosum virus
gaugcucaagcacugccucaugu

SEQ ID NO: 3097633 - RNA, 13 nt, Molluscum contagiosum virus
gggacggaauuug

SEQ ID NO: 3097634 - RNA, 17 nt, Molluscum contagiosum virus
uggaggugcgcgacucc

SEQ ID NO: 3097635 - RNA, 23 nt, Molluscum contagiosum virus
gcgaaccauuuuuugccccgcgc

SEQ ID NO: 3097636 - RNA, 13 nt, Molluscum contagiosum virus
caagaacagagaa

SEQ ID NO: 3097637 - RNA, 17 nt, Molluscum contagiosum virus
gggcagcucaagcugcu

SEQ ID NO: 3097638 - RNA, 18 nt, Molluscum contagiosum virus
cgcggcgcacggugugcu

SEQ ID NO: 3097639 - RNA, 18 nt, Molluscum contagiosum virus
guuggcgccagccuggcg

SEQ ID NO: 3097640 - RNA, 22 nt, Molluscum contagiosum virus
uuccgcgagcacguggacagca

SEQ ID NO: 3097641 - RNA, 15 nt, Molluscum contagiosum virus
cugcggcugcuggag

SEQ ID NO: 3097642 - RNA, 13 nt, Molluscum contagiosum virus
cgcggagggcagc

SEQ ID NO: 3097643 - RNA, 16 nt, Molluscum contagiosum virus
agugcucccgaggcgc

SEQ ID NO: 3097644 - RNA, 23 nt, Molluscum contagiosum virus
ccugcgcaacgcgggccaggcac

SEQ ID NO: 3097645 - RNA, 21 nt, Molluscum contagiosum virus
ccgcgcagcucguugcgcagc

SEQ ID NO: 3097646 - RNA, 15 nt, Molluscum contagiosum virus
cagagcugcccgcca

SEQ ID NO: 3097647 - RNA, 16 nt, Molluscum contagiosum virus
aggagccucuguccug

SEQ ID NO: 3097648 - RNA, 19 nt, Molluscum contagiosum virus
ggaacggcgacuuguagug

SEQ ID NO: 3097649 - RNA, 14 nt, Molluscum contagiosum virus
cucaagcuggcaac

SEQ ID NO: 3097650 - RNA, 20 nt, Molluscum contagiosum virus
augcucgucgccgggccccu

SEQ ID NO: 3097651 - RNA, 18 nt, Molluscum contagiosum virus
ggcacgccgcagcgcugg

SEQ ID NO: 3097652 - RNA, 14 nt, Molluscum contagiosum virus
cgugcgcuuugagg

SEQ ID NO: 3097653 - RNA, 15 nt, Molluscum contagiosum virus
cgcacuucacggcgu

SEQ ID NO: 3097654 - RNA, 22 nt, Molluscum contagiosum virus
cgcgagcgcgcccccgagcugc

SEQ ID NO: 3097655 - RNA, 22 nt, Molluscum contagiosum virus
guccgccucgagcacgccucca

SEQ ID NO: 3097656 - RNA, 20 nt, Molluscum contagiosum virus
cuuuuccgcgaaguccuggg

SEQ ID NO: 3097657 - RNA, 17 nt, Molluscum contagiosum virus
ccuuggcagcaacugca

SEQ ID NO: 3097658 - RNA, 22 nt, Molluscum contagiosum virus
gacguccacaaagcccuccuga

SEQ ID NO: 3097659 - RNA, 16 nt, Molluscum contagiosum virus
cggaaccguggugcgc

SEQ ID NO: 3097660 - RNA, 22 nt, Molluscum contagiosum virus
gcacuauggacgcuugcuagca

SEQ ID NO: 3097661 - RNA, 15 nt, Molluscum contagiosum virus
gcucucgcgcgccag

SEQ ID NO: 3097662 - RNA, 22 nt, Molluscum contagiosum virus
ggcugccgcugccugugcccag

SEQ ID NO: 3097663 - RNA, 20 nt, Molluscum contagiosum virus
ggaggcgcuagugcagauga

SEQ ID NO: 3097664 - RNA, 9 nt, Molluscum contagiosum virus
agcaaggag

SEQ ID NO: 3097665 - RNA, 16 nt, Molluscum contagiosum virus
cgcagucgcaguaccc

SEQ ID NO: 3097666 - RNA, 22 nt, Molluscum contagiosum virus
gaccucgcgcuuccggcggcuc

SEQ ID NO: 3097667 - RNA, 23 nt, Molluscum contagiosum virus
gcaaccucgggaagcccucaggg

SEQ ID NO: 3097668 - RNA, 22 nt, Molluscum contagiosum virus
gcuggcuucuuguugucugcgg

SEQ ID NO: 3097669 - RNA, 15 nt, Molluscum contagiosum virus
caagacgcugcuggc

SEQ ID NO: 3097670 - RNA, 22 nt, Molluscum contagiosum virus
gaggccugcugaagaaggagcc

SEQ ID NO: 3097671 - RNA, 16 nt, Molluscum contagiosum virus
gccugcgggcggcaca

SEQ ID NO: 3097672 - RNA, 16 nt, Molluscum contagiosum virus
gccugugccugcaaga

SEQ ID NO: 3097673 - RNA, 12 nt, Molluscum contagiosum virus
caucgcgcugcu

SEQ ID NO: 3097674 - RNA, 19 nt, Molluscum contagiosum virus
cgcugcggcaacugccugc

SEQ ID NO: 3097675 - RNA, 18 nt, Molluscum contagiosum virus
ggccgaagucuaggcagc

SEQ ID NO: 3097676 - RNA, 12 nt, Molluscum contagiosum virus
gccugaggccgc

SEQ ID NO: 3097677 - RNA, 16 nt, Molluscum contagiosum virus
cagccgucgccgcgcc

SEQ ID NO: 3097678 - RNA, 19 nt, Molluscum contagiosum virus
caagagggggcuguuauuu

SEQ ID NO: 3097679 - RNA, 17 nt, Molluscum contagiosum virus
ugcgcuucggcucccag

SEQ ID NO: 3097680 - RNA, 14 nt, Molluscum contagiosum virus
gguugccaggcaca

SEQ ID NO: 3097681 - RNA, 21 nt, Molluscum contagiosum virus
ccuggauaucgagcgcgagau

SEQ ID NO: 3097682 - RNA, 18 nt, Molluscum contagiosum virus
ugccgcugccugugccca

SEQ ID NO: 3097683 - RNA, 18 nt, Molluscum contagiosum virus
ggagagcacuucucgccg

SEQ ID NO: 3097684 - RNA, 18 nt, Molluscum contagiosum virus
gccguuuuacacagggcu

SEQ ID NO: 3097685 - RNA, 13 nt, Molluscum contagiosum virus
cgacaggaacgca

SEQ ID NO: 3097686 - RNA, 14 nt, Molluscum contagiosum virus
guucgagcugcugc

SEQ ID NO: 3097687 - RNA, 16 nt, Molluscum contagiosum virus
gcugcucucggcagcg

SEQ ID NO: 3097688 - RNA, 12 nt, Molluscum contagiosum virus
gcgcgugccugu

SEQ ID NO: 3097689 - RNA, 15 nt, Molluscum contagiosum virus
guccggcgcucgccu

SEQ ID NO: 3097690 - RNA, 15 nt, Molluscum contagiosum virus
cacgaccacgcuggc

SEQ ID NO: 3097691 - RNA, 15 nt, Molluscum contagiosum virus
ggaagccgccagcca

SEQ ID NO: 3097692 - RNA, 13 nt, Molluscum contagiosum virus
cgcagcagugcca

SEQ ID NO: 3097693 - RNA, 14 nt, Molluscum contagiosum virus
acgccgagcgggca

SEQ ID NO: 3097694 - RNA, 16 nt, Molluscum contagiosum virus
ugguccaccagcugcc

SEQ ID NO: 3097695 - RNA, 15 nt, Molluscum contagiosum virus
gcucgaggcgccguc

SEQ ID NO: 3097696 - RNA, 16 nt, Molluscum contagiosum virus
gcuacccguugcugcg

SEQ ID NO: 3097697 - RNA, 14 nt, Molluscum contagiosum virus
aagaacaccaagag

SEQ ID NO: 3097698 - RNA, 13 nt, Molluscum contagiosum virus
cgagcuagugcac

SEQ ID NO: 3097699 - RNA, 23 nt, Molluscum contagiosum virus
agaucaaccgcaaggaaaacugc

SEQ ID NO: 3097700 - RNA, 23 nt, Molluscum contagiosum virus
ccugaggaagcaagacccagcaa

SEQ ID NO: 3097701 - RNA, 17 nt, Molluscum contagiosum virus
gacgcgaacugcccgag

SEQ ID NO: 3097702 - RNA, 14 nt, Molluscum contagiosum virus
guggucaagacugg

SEQ ID NO: 3097703 - RNA, 18 nt, Molluscum contagiosum virus
cccagcaccgcgccgcga

SEQ ID NO: 3097704 - RNA, 16 nt, Molluscum contagiosum virus
gugaugugcgcacaga

SEQ ID NO: 3097705 - RNA, 20 nt, Molluscum contagiosum virus
ggcucaacucguaggacaac

SEQ ID NO: 3097706 - RNA, 16 nt, Molluscum contagiosum virus
ucagguacguguccac

SEQ ID NO: 3097707 - RNA, 16 nt, Molluscum contagiosum virus
acaugcgugcuagccc

SEQ ID NO: 3097708 - RNA, 22 nt, Molluscum contagiosum virus
acggcaaacgccacugggucug

SEQ ID NO: 3097709 - RNA, 21 nt, Molluscum contagiosum virus
guggacgcgcgagugugugca

SEQ ID NO: 3097710 - RNA, 16 nt, Molluscum contagiosum virus
gcucaugcgcaagcag

SEQ ID NO: 3097711 - RNA, 24 nt, Molluscum contagiosum virus
guucgagaagacggggcgcacgcc

SEQ ID NO: 3097712 - RNA, 17 nt, Molluscum contagiosum virus
gcgcggcgcgcccagcg

SEQ ID NO: 3097713 - RNA, 14 nt, Molluscum contagiosum virus
ucggcaugcagcgc

SEQ ID NO: 3097714 - RNA, 15 nt, Molluscum contagiosum virus
guucgcugcuggcag

SEQ ID NO: 3097715 - RNA, 17 nt, Molluscum contagiosum virus
acugcccgcgcccugca

SEQ ID NO: 3097716 - RNA, 16 nt, Molluscum contagiosum virus
ccuggauaucgagcgc

SEQ ID NO: 3097717 - RNA, 20 nt, Molluscum contagiosum virus
ggagaccggcgucggcaaga

SEQ ID NO: 3097718 - RNA, 23 nt, Molluscum contagiosum virus
cagccuguguugcgcgcgccugc

SEQ ID NO: 3097719 - RNA, 20 nt, Molluscum contagiosum virus
ccgugggcagcuucugcucg

SEQ ID NO: 3097720 - RNA, 20 nt, Molluscum contagiosum virus
gccucgcaggcgaggucaca

SEQ ID NO: 3097721 - RNA, 15 nt, Molluscum contagiosum virus
gccugcuggcgggga

SEQ ID NO: 3097722 - RNA, 15 nt, Molluscum contagiosum virus
cuguuacggacggcg

SEQ ID NO: 3097723 - RNA, 15 nt, Molluscum contagiosum virus
aaugcgagcaaggcg

SEQ ID NO: 3097724 - RNA, 13 nt, Molluscum contagiosum virus
gcucuucucgcag

SEQ ID NO: 3097725 - RNA, 14 nt, Molluscum contagiosum virus
gacgugcugcuggc

SEQ ID NO: 3097726 - RNA, 13 nt, Molluscum contagiosum virus
ucucugcccucag

SEQ ID NO: 3097727 - RNA, 17 nt, Molluscum contagiosum virus
agcacgccuccaagaag

SEQ ID NO: 3097728 - RNA, 18 nt, Molluscum contagiosum virus
cugcggcucuacccggag

SEQ ID NO: 3097729 - RNA, 14 nt, Molluscum contagiosum virus
agagccgccggggc

SEQ ID NO: 3097730 - RNA, 19 nt, Molluscum contagiosum virus
aggaucggagcgcagcugc

SEQ ID NO: 3097731 - RNA, 13 nt, Molluscum contagiosum virus
cgccggcgcggcg

SEQ ID NO: 3097732 - RNA, 23 nt, Molluscum contagiosum virus
ccgcugcgcgcucuggagccucc

SEQ ID NO: 3097733 - RNA, 18 nt, Molluscum contagiosum virus
ucagcaccaaggacgugu

SEQ ID NO: 3097734 - RNA, 15 nt, Molluscum contagiosum virus
gagugcugagccaca

SEQ ID NO: 3097735 - RNA, 15 nt, Molluscum contagiosum virus
ugcuuccuccuccaa

SEQ ID NO: 3097736 - RNA, 20 nt, Molluscum contagiosum virus
ggucuucccgcuggcggcac

SEQ ID NO: 3097737 - RNA, 20 nt, Molluscum contagiosum virus
gagaccuggucacacuggug

SEQ ID NO: 3097738 - RNA, 20 nt, Molluscum contagiosum virus
guccuacacgccgcuggagc

SEQ ID NO: 3097739 - RNA, 18 nt, Molluscum contagiosum virus
uggcguugccgagcgagc

SEQ ID NO: 3097740 - RNA, 16 nt, Molluscum contagiosum virus
uuggcgcgcaagcgcu

SEQ ID NO: 3097741 - RNA, 19 nt, Molluscum contagiosum virus
cuuggcguucgcagugccc

SEQ ID NO: 3097742 - RNA, 14 nt, Molluscum contagiosum virus
gcgagacugugccg

SEQ ID NO: 3097743 - RNA, 18 nt, Molluscum contagiosum virus
cggggcgcgcgcugcgca

SEQ ID NO: 3097744 - RNA, 12 nt, Molluscum contagiosum virus
ccgaggaggcgc

SEQ ID NO: 3097745 - RNA, 19 nt, Molluscum contagiosum virus
accugcgacagcugcugcu

SEQ ID NO: 3097746 - RNA, 16 nt, Molluscum contagiosum virus
gugcgccuuuccucuc

SEQ ID NO: 3097747 - RNA, 19 nt, Molluscum contagiosum virus
gcugcaggaccugcuggug

SEQ ID NO: 3097748 - RNA, 19 nt, Molluscum contagiosum virus
cuuccgcaccuggucgagc

SEQ ID NO: 3097749 - RNA, 15 nt, Molluscum contagiosum virus
cgaacugcaacguga

SEQ ID NO: 3097750 - RNA, 16 nt, Molluscum contagiosum virus
cgccacgagcgccgcg

SEQ ID NO: 3097751 - RNA, 17 nt, Molluscum contagiosum virus
gcuggcgcucgcgcgca

SEQ ID NO: 3097752 - RNA, 14 nt, Molluscum contagiosum virus
cgcugcgcgcucug

SEQ ID NO: 3097753 - RNA, 15 nt, Molluscum contagiosum virus
ucaagacgcugguga

SEQ ID NO: 3097754 - RNA, 15 nt, Molluscum contagiosum virus
caaugcgcaaggccg

SEQ ID NO: 3097755 - RNA, 17 nt, Molluscum contagiosum virus
cacgaccgcgcacgcag

SEQ ID NO: 3097756 - RNA, 17 nt, Molluscum contagiosum virus
gaggggcaguguuccug

SEQ ID NO: 3097757 - RNA, 16 nt, Molluscum contagiosum virus
agcaccaagaagcggc

SEQ ID NO: 3097758 - RNA, 16 nt, Molluscum contagiosum virus
acggcgugcuggccag

SEQ ID NO: 3097759 - RNA, 17 nt, Molluscum contagiosum virus
ccacgugcgcuggccca

SEQ ID NO: 3097760 - RNA, 15 nt, Molluscum contagiosum virus
agagccgccggggcc

SEQ ID NO: 3097761 - RNA, 22 nt, Molluscum contagiosum virus
cggcacacaugcuagcgggcaa

SEQ ID NO: 3097762 - RNA, 18 nt, Molluscum contagiosum virus
guggccuuuagcagcggc

SEQ ID NO: 3097763 - RNA, 14 nt, Molluscum contagiosum virus
gcgacagcugcugc

SEQ ID NO: 3097764 - RNA, 16 nt, Molluscum contagiosum virus
ccugcacgacccucuu

SEQ ID NO: 3097765 - RNA, 21 nt, Molluscum contagiosum virus
gugugcgcgcugcacgccgcc

SEQ ID NO: 3097766 - RNA, 15 nt, Molluscum contagiosum virus
ucgcacacugcagca

SEQ ID NO: 3097767 - RNA, 19 nt, Molluscum contagiosum virus
cgcgccgcgcgcgccggga

SEQ ID NO: 3097768 - RNA, 18 nt, Molluscum contagiosum virus
cugacgccgauguccugc

SEQ ID NO: 3097769 - RNA, 16 nt, Molluscum contagiosum virus
uucaggaacaaggcca

SEQ ID NO: 3097770 - RNA, 15 nt, Molluscum contagiosum virus
gcuggcaccgggcgc

SEQ ID NO: 3097771 - RNA, 14 nt, Molluscum contagiosum virus
auguccacggacau

SEQ ID NO: 3097772 - RNA, 12 nt, Molluscum contagiosum virus
gguucugcgcug

SEQ ID NO: 3097773 - RNA, 18 nt, Molluscum contagiosum virus
ucuuccggaggcagcgcu

SEQ ID NO: 3097774 - RNA, 14 nt, Molluscum contagiosum virus
aacuagugcugcug

SEQ ID NO: 3097775 - RNA, 23 nt, Molluscum contagiosum virus
gagggcgggcacgugcugcugcg

SEQ ID NO: 3097776 - RNA, 20 nt, Molluscum contagiosum virus
ggcuuggacuccgaggcagg

SEQ ID NO: 3097777 - RNA, 14 nt, Molluscum contagiosum virus
ucgcguccgcgcag

SEQ ID NO: 3097778 - RNA, 11 nt, Molluscum contagiosum virus
cacguuggagg

SEQ ID NO: 3097779 - RNA, 21 nt, Molluscum contagiosum virus
cgcaaacaagcagucucaugg

SEQ ID NO: 3097780 - RNA, 23 nt, Molluscum contagiosum virus
gcuaccacgagcacugccugccg

SEQ ID NO: 3097781 - RNA, 16 nt, Molluscum contagiosum virus
cggugcaaccgcugcu

SEQ ID NO: 3097782 - RNA, 15 nt, Molluscum contagiosum virus
gcgugcgcgggcacg

SEQ ID NO: 3097783 - RNA, 20 nt, Molluscum contagiosum virus
acggcgcucgccucugggcg

SEQ ID NO: 3097784 - RNA, 21 nt, Molluscum contagiosum virus
gcgauguuuugaacagacaac

SEQ ID NO: 3097785 - RNA, 19 nt, Molluscum contagiosum virus
cagcuaggauccugcucaa

SEQ ID NO: 3097786 - RNA, 15 nt, Molluscum contagiosum virus
cgugcuggagcaggg

SEQ ID NO: 3097787 - RNA, 19 nt, Molluscum contagiosum virus
acuaagccgcgugcuggcg

SEQ ID NO: 3097788 - RNA, 19 nt, Molluscum contagiosum virus
accugcacgacccucuucg

SEQ ID NO: 3097789 - RNA, 21 nt, Molluscum contagiosum virus
acgagccgcugcuccugcucu

SEQ ID NO: 3097790 - RNA, 17 nt, Molluscum contagiosum virus
ggcaaucgcgugcuugc

SEQ ID NO: 3097791 - RNA, 21 nt, Molluscum contagiosum virus
cagcucggcgagagcgcgcag

SEQ ID NO: 3097792 - RNA, 14 nt, Molluscum contagiosum virus
cgugcaccucaaga

SEQ ID NO: 3097793 - RNA, 18 nt, Molluscum contagiosum virus
cacugcggcaacgagcac

SEQ ID NO: 3097794 - RNA, 20 nt, Molluscum contagiosum virus
ccggcaccacgugcgcuggc

SEQ ID NO: 3097795 - RNA, 21 nt, Molluscum contagiosum virus
cccggccucgccuccgggcgc

SEQ ID NO: 3097796 - RNA, 16 nt, Molluscum contagiosum virus
ggcacauccgcuaccu

SEQ ID NO: 3097797 - RNA, 14 nt, Molluscum contagiosum virus
accgcgggcgcaga

SEQ ID NO: 3097798 - RNA, 13 nt, Molluscum contagiosum virus
uuuacugcaagau

SEQ ID NO: 3097799 - RNA, 14 nt, Molluscum contagiosum virus
cagcccugugcccg

SEQ ID NO: 3097800 - RNA, 15 nt, Molluscum contagiosum virus
acaugcggagacugu

SEQ ID NO: 3097801 - RNA, 16 nt, Molluscum contagiosum virus
gcccggaucugguccg

SEQ ID NO: 3097802 - RNA, 16 nt, Molluscum contagiosum virus
gcaacaaggaaaggca

SEQ ID NO: 3097803 - RNA, 20 nt, Molluscum contagiosum virus
ccugcucucgcgcgccagca

SEQ ID NO: 3097804 - RNA, 18 nt, Molluscum contagiosum virus
cuccaagaagaggccagc

SEQ ID NO: 3097805 - RNA, 18 nt, Molluscum contagiosum virus
ccgcugccugugcccagu

SEQ ID NO: 3097806 - RNA, 17 nt, Molluscum contagiosum virus
cgcgcggcaagccuggc

SEQ ID NO: 3097807 - RNA, 14 nt, Molluscum contagiosum virus
gcccgccgggcacc

SEQ ID NO: 3097808 - RNA, 11 nt, Molluscum contagiosum virus
agagccgccgg

SEQ ID NO: 3097809 - RNA, 13 nt, Molluscum contagiosum virus
ugcggagcuggcc

SEQ ID NO: 3097810 - RNA, 11 nt, Molluscum contagiosum virus
cgagcugcuag

SEQ ID NO: 3097811 - RNA, 13 nt, Molluscum contagiosum virus
uggcggggcuggc

SEQ ID NO: 3097812 - RNA, 21 nt, Molluscum contagiosum virus
cccagcgugacaaucucugcg

SEQ ID NO: 3097813 - RNA, 15 nt, Molluscum contagiosum virus
cacgcacucgcuggc

SEQ ID NO: 3097814 - RNA, 21 nt, Molluscum contagiosum virus
gccggcucagcguggagcacc

SEQ ID NO: 3097815 - RNA, 18 nt, Molluscum contagiosum virus
ucgcgcuuuuuucuucgc

SEQ ID NO: 3097816 - RNA, 16 nt, Molluscum contagiosum virus
cacgugcacgcgcacg

SEQ ID NO: 3097817 - RNA, 17 nt, Molluscum contagiosum virus
cucgacaaggaggcuuu

SEQ ID NO: 3097818 - RNA, 20 nt, Molluscum contagiosum virus
cgccgcaaacacugucucug

SEQ ID NO: 3097819 - RNA, 17 nt, Molluscum contagiosum virus
cgcggugugcacaugcc

SEQ ID NO: 3097820 - RNA, 15 nt, Molluscum contagiosum virus
gacaagacaacacuc

SEQ ID NO: 3097821 - RNA, 12 nt, Molluscum contagiosum virus
gagccugcugcu

SEQ ID NO: 3097822 - RNA, 16 nt, Molluscum contagiosum virus
ggcggagguggcggag

SEQ ID NO: 3097823 - RNA, 15 nt, Molluscum contagiosum virus
accagcucgcgccgc

SEQ ID NO: 3097824 - RNA, 17 nt, Molluscum contagiosum virus
gagaagaccuguucuuu

SEQ ID NO: 3097825 - RNA, 19 nt, Molluscum contagiosum virus
ccacgagcguguccaggug

SEQ ID NO: 3097826 - RNA, 12 nt, Molluscum contagiosum virus
guccccaagagc

SEQ ID NO: 3097827 - RNA, 15 nt, Molluscum contagiosum virus
cggacaagacaacac

SEQ ID NO: 3097828 - RNA, 19 nt, Molluscum contagiosum virus
accggagacaccagcuccg

SEQ ID NO: 3097829 - RNA, 17 nt, Molluscum contagiosum virus
cgcugcgcgugcugggc

SEQ ID NO: 3097830 - RNA, 21 nt, Molluscum contagiosum virus
uagcagcuucuuggagcccuu

SEQ ID NO: 3097831 - RNA, 21 nt, Molluscum contagiosum virus
gugcaauuccguccagugaaa

SEQ ID NO: 3097832 - RNA, 22 nt, Molluscum contagiosum virus
cggacaagacaacacucgugcu

SEQ ID NO: 3097833 - RNA, 22 nt, Molluscum contagiosum virus
gcaaggccguccccggaaagca

SEQ ID NO: 3097834 - RNA, 19 nt, Molluscum contagiosum virus
uccgcacagagggacagca

SEQ ID NO: 3097835 - RNA, 19 nt, Molluscum contagiosum virus
gcugcgcuccaugcugccg

SEQ ID NO: 3097836 - RNA, 15 nt, Molluscum contagiosum virus
ccacggccgcgcgcg

SEQ ID NO: 3097837 - RNA, 20 nt, Molluscum contagiosum virus
cgagcgcguccaugagcauc

SEQ ID NO: 3097838 - RNA, 14 nt, Molluscum contagiosum virus
gugacggcccaccu

SEQ ID NO: 3097839 - RNA, 15 nt, Molluscum contagiosum virus
ggccgaacugcucug

SEQ ID NO: 3097840 - RNA, 20 nt, Molluscum contagiosum virus
cguccacgcaggacuggcac

SEQ ID NO: 3097841 - RNA, 14 nt, Molluscum contagiosum virus
cgcccgcugcucua

SEQ ID NO: 3097842 - RNA, 20 nt, Molluscum contagiosum virus
gcaagaagaucgcggcgccg

SEQ ID NO: 3097843 - RNA, 16 nt, Molluscum contagiosum virus
uggacuccgaggcagg

SEQ ID NO: 3097844 - RNA, 23 nt, Molluscum contagiosum virus
gcucgcgacgugcgcgcugcgcg

SEQ ID NO: 3097845 - RNA, 14 nt, Molluscum contagiosum virus
guguccgcacgcac

SEQ ID NO: 3097846 - RNA, 18 nt, Molluscum contagiosum virus
gcacgugugcggagagcc

SEQ ID NO: 3097847 - RNA, 21 nt, Molluscum contagiosum virus
gucagccgcacggcgcccagg

SEQ ID NO: 3097848 - RNA, 18 nt, Molluscum contagiosum virus
ucguggacgagcagagcc

SEQ ID NO: 3097849 - RNA, 11 nt, Molluscum contagiosum virus
gcacgcacggc

SEQ ID NO: 3097850 - RNA, 21 nt, Molluscum contagiosum virus
cgaggccggccgugcagagca

SEQ ID NO: 3097851 - RNA, 18 nt, Molluscum contagiosum virus
cggagacagugacagacu

SEQ ID NO: 3097852 - RNA, 16 nt, Molluscum contagiosum virus
agguggcacccuggcu

SEQ ID NO: 3097853 - RNA, 15 nt, Molluscum contagiosum virus
acuacuuccugcagc

SEQ ID NO: 3097854 - RNA, 22 nt, Molluscum contagiosum virus
cuucccguuccugggcaacgcg

SEQ ID NO: 3097855 - RNA, 15 nt, Molluscum contagiosum virus
ccgcaguaccaguac

SEQ ID NO: 3097856 - RNA, 16 nt, Molluscum contagiosum virus
gcucgcgcucgggaag

SEQ ID NO: 3097857 - RNA, 19 nt, Molluscum contagiosum virus
gccgugaacgaggcugcug

SEQ ID NO: 3097858 - RNA, 17 nt, Molluscum contagiosum virus
uguagcgguugaccagc

SEQ ID NO: 3097859 - RNA, 16 nt, Molluscum contagiosum virus
gccgaacugcucugcg

SEQ ID NO: 3097860 - RNA, 21 nt, Molluscum contagiosum virus
ccugcgcaacgugcugcgccg

SEQ ID NO: 3097861 - RNA, 17 nt, Molluscum contagiosum virus
agggcagcucaagcugc

SEQ ID NO: 3097862 - RNA, 17 nt, Molluscum contagiosum virus
gcgcgccgcugcccgcg

SEQ ID NO: 3097863 - RNA, 18 nt, Molluscum contagiosum virus
gaucacgccgugacggcc

SEQ ID NO: 3097864 - RNA, 14 nt, Molluscum contagiosum virus
ggcggcggccacgc

SEQ ID NO: 3097865 - RNA, 11 nt, Molluscum contagiosum virus
gagcugcugcc

SEQ ID NO: 3097866 - RNA, 21 nt, Molluscum contagiosum virus
gcuggcgcucggcguggugcu

SEQ ID NO: 3097867 - RNA, 18 nt, Molluscum contagiosum virus
gcgagcugaggcaacauc

SEQ ID NO: 3097868 - RNA, 20 nt, Molluscum contagiosum virus
cgagcgcccgugcuugcgca

SEQ ID NO: 3097869 - RNA, 22 nt, Molluscum contagiosum virus
ccacgugcgcuggcccacgcug

SEQ ID NO: 3097870 - RNA, 13 nt, Molluscum contagiosum virus
agcggccuguucu

SEQ ID NO: 3097871 - RNA, 16 nt, Molluscum contagiosum virus
ucgcgguggcaggcgc

SEQ ID NO: 3097872 - RNA, 15 nt, Molluscum contagiosum virus
ugagugcgggucaca

SEQ ID NO: 3097873 - RNA, 16 nt, Molluscum contagiosum virus
gccguggcaaacaggc

SEQ ID NO: 3097874 - RNA, 18 nt, Molluscum contagiosum virus
cacuagcaaggcgccgcg

SEQ ID NO: 3097875 - RNA, 20 nt, Molluscum contagiosum virus
gccccagaaggucgugcgag

SEQ ID NO: 3097876 - RNA, 19 nt, Molluscum contagiosum virus
ucaccuucggaacugcgga

SEQ ID NO: 3097877 - RNA, 18 nt, Molluscum contagiosum virus
gcgcgaacucgcggcagu

SEQ ID NO: 3097878 - RNA, 15 nt, Molluscum contagiosum virus
aggagggagagcugc

SEQ ID NO: 3097879 - RNA, 15 nt, Molluscum contagiosum virus
gccacgcccgggccc

SEQ ID NO: 3097880 - RNA, 21 nt, Molluscum contagiosum virus
cuuuaacgcgugcggugacuu

SEQ ID NO: 3097881 - RNA, 19 nt, Molluscum contagiosum virus
gggcgcagccacgacucgc

SEQ ID NO: 3097882 - RNA, 14 nt, Molluscum contagiosum virus
caaccacagcucuc

SEQ ID NO: 3097883 - RNA, 21 nt, Molluscum contagiosum virus
cggcugguguuaccgggucgc

SEQ ID NO: 3097884 - RNA, 11 nt, Molluscum contagiosum virus
augagcggcac

SEQ ID NO: 3097885 - RNA, 20 nt, Molluscum contagiosum virus
ccugcugaagaaggagcccu

SEQ ID NO: 3097886 - RNA, 13 nt, Molluscum contagiosum virus
aggaaaaggcaca

SEQ ID NO: 3097887 - RNA, 15 nt, Molluscum contagiosum virus
cuggcaccgggcgcc

SEQ ID NO: 3097888 - RNA, 19 nt, Molluscum contagiosum virus
agcuccgcgacuaccugcu

SEQ ID NO: 3097889 - RNA, 20 nt, Molluscum contagiosum virus
gauacuuccgguguccccgg

SEQ ID NO: 3097890 - RNA, 17 nt, Molluscum contagiosum virus
cccgcgaacgagagaca

SEQ ID NO: 3097891 - RNA, 17 nt, Molluscum contagiosum virus
agacgcuccauucucuc

SEQ ID NO: 3097892 - RNA, 22 nt, Molluscum contagiosum virus
gucucucguucgcgggcccgcc

SEQ ID NO: 3097893 - RNA, 21 nt, Molluscum contagiosum virus
ccaggaacgcgccgcggaugu

SEQ ID NO: 3097894 - RNA, 14 nt, Molluscum contagiosum virus
uacgcgccggggcg

SEQ ID NO: 3097895 - RNA, 15 nt, Molluscum contagiosum virus
gccgcgcaccuggag

SEQ ID NO: 3097896 - RNA, 17 nt, Molluscum contagiosum virus
gacggaaccguggugcg

SEQ ID NO: 3097897 - RNA, 17 nt, Molluscum contagiosum virus
cguucgacggcuggugu

SEQ ID NO: 3097898 - RNA, 18 nt, Molluscum contagiosum virus
aaaucuguucgagcaaca

SEQ ID NO: 3097899 - RNA, 13 nt, Molluscum contagiosum virus
aacugcugggcgu

SEQ ID NO: 3097900 - RNA, 22 nt, Molluscum contagiosum virus
gacgacaugcacacgcaccgcc

SEQ ID NO: 3097901 - RNA, 16 nt, Molluscum contagiosum virus
gacgcccuccucgacc

SEQ ID NO: 3097902 - RNA, 12 nt, Molluscum contagiosum virus
gccgcggaggga

SEQ ID NO: 3097903 - RNA, 20 nt, Molluscum contagiosum virus
caggcggccgcguugcagca

SEQ ID NO: 3097904 - RNA, 15 nt, Molluscum contagiosum virus
uggcugugcgcccac

SEQ ID NO: 3097905 - RNA, 22 nt, Molluscum contagiosum virus
cacgcuggcacggccggcgccg

SEQ ID NO: 3097906 - RNA, 13 nt, Molluscum contagiosum virus
cgcccacgugcca

SEQ ID NO: 3097907 - RNA, 18 nt, Molluscum contagiosum virus
accaggcgcgugcccugc

SEQ ID NO: 3097908 - RNA, 19 nt, Molluscum contagiosum virus
ggccacucucccgggcucu

SEQ ID NO: 3097909 - RNA, 15 nt, Molluscum contagiosum virus
ccgcgcucacugcag

SEQ ID NO: 3097910 - RNA, 21 nt, Molluscum contagiosum virus
accugauuuucccgggcggcg

SEQ ID NO: 3097911 - RNA, 19 nt, Molluscum contagiosum virus
guaccgccgcggccgcgag

SEQ ID NO: 3097912 - RNA, 22 nt, Molluscum contagiosum virus
gaacgucuucuaccgcccgcug

SEQ ID NO: 3097913 - RNA, 16 nt, Molluscum contagiosum virus
cgagggcucguccucu

SEQ ID NO: 3097914 - RNA, 15 nt, Molluscum contagiosum virus
uuuucccgggcggcg

SEQ ID NO: 3097915 - RNA, 18 nt, Molluscum contagiosum virus
cgucgaagaccaccagca

SEQ ID NO: 3097916 - RNA, 23 nt, Molluscum contagiosum virus
gaauguagccuuuguucuuagca

SEQ ID NO: 3097917 - RNA, 13 nt, Molluscum contagiosum virus
gccuucgacggcu

SEQ ID NO: 3097918 - RNA, 21 nt, Molluscum contagiosum virus
gcgcggcuuggcgcccuuccu

SEQ ID NO: 3097919 - RNA, 20 nt, Molluscum contagiosum virus
agaucaggcagcugcugcgc

SEQ ID NO: 3097920 - RNA, 13 nt, Molluscum contagiosum virus
aguucggccgcac

SEQ ID NO: 3097921 - RNA, 16 nt, Molluscum contagiosum virus
guccgguacugcugca

SEQ ID NO: 3097922 - RNA, 17 nt, Molluscum contagiosum virus
auccugguuccucuccu

SEQ ID NO: 3097923 - RNA, 20 nt, Molluscum contagiosum virus
cgugcuggagggcacgcugc

SEQ ID NO: 3097924 - RNA, 22 nt, Molluscum contagiosum virus
ggaacucggcuucugcugcaca

SEQ ID NO: 3097925 - RNA, 23 nt, Molluscum contagiosum virus
ucgcccggcaggcucccgcuguc

SEQ ID NO: 3097926 - RNA, 15 nt, Molluscum contagiosum virus
acgacucgcugccag

SEQ ID NO: 3097927 - RNA, 20 nt, Molluscum contagiosum virus
gagcguacucgggccgcgag

SEQ ID NO: 3097928 - RNA, 19 nt, Molluscum contagiosum virus
gguacuuguugugcacgcu

SEQ ID NO: 3097929 - RNA, 12 nt, Molluscum contagiosum virus
acugcagcagcc

SEQ ID NO: 3097930 - RNA, 18 nt, Molluscum contagiosum virus
ugcgcaagcucagccucu

SEQ ID NO: 3097931 - RNA, 23 nt, Molluscum contagiosum virus
uggacgcgcucaagauccgagaa

SEQ ID NO: 3097932 - RNA, 20 nt, Molluscum contagiosum virus
cuggcuuccgacgucaagca

SEQ ID NO: 3097933 - RNA, 21 nt, Molluscum contagiosum virus
acagucuccacgcgugcgcgc

SEQ ID NO: 3097934 - RNA, 14 nt, Molluscum contagiosum virus
cugauuacauccug

SEQ ID NO: 3097935 - RNA, 13 nt, Molluscum contagiosum virus
auacuccugcugg

SEQ ID NO: 3097936 - RNA, 14 nt, Molluscum contagiosum virus
ugcugucccucugu

SEQ ID NO: 3097937 - RNA, 18 nt, Molluscum contagiosum virus
uccgaugugagcaagcug

SEQ ID NO: 3097938 - RNA, 14 nt, Molluscum contagiosum virus
cacgugcugcugcg

SEQ ID NO: 3097939 - RNA, 17 nt, Molluscum contagiosum virus
acucggcuucugcugca

SEQ ID NO: 3097940 - RNA, 22 nt, Molluscum contagiosum virus
gcugccgcgcguuuucccgagg

SEQ ID NO: 3097941 - RNA, 22 nt, Molluscum contagiosum virus
cacuugcacgcgcacgcgcccu

SEQ ID NO: 3097942 - RNA, 20 nt, Molluscum contagiosum virus
ucgcaaucugacggugcaac

SEQ ID NO: 3097943 - RNA, 16 nt, Molluscum contagiosum virus
gcgcaacgcgggccag

SEQ ID NO: 3097944 - RNA, 21 nt, Molluscum contagiosum virus
cuucucgcagcguuccaggaa

SEQ ID NO: 3097945 - RNA, 16 nt, Molluscum contagiosum virus
ucuuggcaugcgugcu

SEQ ID NO: 3097946 - RNA, 22 nt, Molluscum contagiosum virus
ccgcguaccaccguggaggagc

SEQ ID NO: 3097947 - RNA, 14 nt, Molluscum contagiosum virus
cggacgcgggccug

SEQ ID NO: 3097948 - RNA, 16 nt, Molluscum contagiosum virus
gcacggcgcccaggaa

SEQ ID NO: 3097949 - RNA, 17 nt, Molluscum contagiosum virus
cacgugcagcggcgcca

SEQ ID NO: 3097950 - RNA, 12 nt, Molluscum contagiosum virus
ucggcggccgga

SEQ ID NO: 3097951 - RNA, 23 nt, Molluscum contagiosum virus
cucguggaucgcgcgcaccugca

SEQ ID NO: 3097952 - RNA, 14 nt, Molluscum contagiosum virus
uuucguugccugca

SEQ ID NO: 3097953 - RNA, 20 nt, Molluscum contagiosum virus
cacggccuucuccucgcucu

SEQ ID NO: 3097954 - RNA, 21 nt, Molluscum contagiosum virus
gcacuagacugucgacagaga

SEQ ID NO: 3097955 - RNA, 18 nt, Molluscum contagiosum virus
cacauugcugcugcaggc

SEQ ID NO: 3097956 - RNA, 12 nt, Molluscum contagiosum virus
caagccugcuca

SEQ ID NO: 3097957 - RNA, 18 nt, Molluscum contagiosum virus
accgcggcgggugccgcc

SEQ ID NO: 3097958 - RNA, 23 nt, Molluscum contagiosum virus
aggaguccgugacagagugccug

SEQ ID NO: 3097959 - RNA, 21 nt, Molluscum contagiosum virus
ggaccuuggcgcgccgcugcc

SEQ ID NO: 3097960 - RNA, 18 nt, Molluscum contagiosum virus
cggaggucuacaacgagc

SEQ ID NO: 3097961 - RNA, 20 nt, Molluscum contagiosum virus
gcucuacgagacucuggaag

SEQ ID NO: 3097962 - RNA, 20 nt, Molluscum contagiosum virus
ccuucuucgugcugugccua

SEQ ID NO: 3097963 - RNA, 18 nt, Molluscum contagiosum virus
caccgcggcgcggagcgc

SEQ ID NO: 3097964 - RNA, 16 nt, Molluscum contagiosum virus
acuggcaccugcggcu

SEQ ID NO: 3097965 - RNA, 16 nt, Molluscum contagiosum virus
agacgacucgcugcca

SEQ ID NO: 3097966 - RNA, 14 nt, Molluscum contagiosum virus
gcggcggccccugc

SEQ ID NO: 3097967 - RNA, 13 nt, Molluscum contagiosum virus
ucgcgcugcagca

SEQ ID NO: 3097968 - RNA, 12 nt, Molluscum contagiosum virus
aggagcuguccg

SEQ ID NO: 3097969 - RNA, 13 nt, Molluscum contagiosum virus
guucgcugcuggc

SEQ ID NO: 3097970 - RNA, 19 nt, Molluscum contagiosum virus
agcagacguacgagcaggc

SEQ ID NO: 3097971 - RNA, 22 nt, Molluscum contagiosum virus
cagugcaguggcuacuggagga

SEQ ID NO: 3097972 - RNA, 19 nt, Molluscum contagiosum virus
gcuucgccgcgcgcgccag

SEQ ID NO: 3097973 - RNA, 19 nt, Molluscum contagiosum virus
gacgcagcgcgagcugugc

SEQ ID NO: 3097974 - RNA, 15 nt, Molluscum contagiosum virus
gcucgcgcgccagca

SEQ ID NO: 3097975 - RNA, 17 nt, Molluscum contagiosum virus
gaugaguaccgcgggcg

SEQ ID NO: 3097976 - RNA, 19 nt, Molluscum contagiosum virus
gcaccgccuggugcugcgc

SEQ ID NO: 3097977 - RNA, 20 nt, Molluscum contagiosum virus
gaacugacugcugcccccgc

SEQ ID NO: 3097978 - RNA, 16 nt, Molluscum contagiosum virus
aagaagugugccugcu

SEQ ID NO: 3097979 - RNA, 17 nt, Molluscum contagiosum virus
ccucgucguccacaggc

SEQ ID NO: 3097980 - RNA, 14 nt, Molluscum contagiosum virus
cgugcugcggcugc

SEQ ID NO: 3097981 - RNA, 18 nt, Molluscum contagiosum virus
ggcacccgcaggaaaggc

SEQ ID NO: 3097982 - RNA, 19 nt, Molluscum contagiosum virus
cguuagcguugguaacaag

SEQ ID NO: 3097983 - RNA, 20 nt, Molluscum contagiosum virus
gggcgccaaguccgagcaag

SEQ ID NO: 3097984 - RNA, 15 nt, Molluscum contagiosum virus
ccccgcgcgugcagu

SEQ ID NO: 3097985 - RNA, 18 nt, Molluscum contagiosum virus
caggaguccgugacagag

SEQ ID NO: 3097986 - RNA, 18 nt, Molluscum contagiosum virus
ggaggccaacgccagcug

SEQ ID NO: 3097987 - RNA, 13 nt, Molluscum contagiosum virus
guccugcgugcuu

SEQ ID NO: 3097988 - RNA, 20 nt, Molluscum contagiosum virus
gucccagcagcugcuccgcc

SEQ ID NO: 3097989 - RNA, 13 nt, Molluscum contagiosum virus
cugacggcagcaa

SEQ ID NO: 3097990 - RNA, 22 nt, Molluscum contagiosum virus
uucugcgcgccgcucgucgcug

SEQ ID NO: 3097991 - RNA, 21 nt, Molluscum contagiosum virus
cacucgcgcguccgcaaagac

SEQ ID NO: 3097992 - RNA, 22 nt, Molluscum contagiosum virus
gcgcgaaacgguaagcucgacg

SEQ ID NO: 3097993 - RNA, 13 nt, Molluscum contagiosum virus
ggcacgcugagca

SEQ ID NO: 3097994 - RNA, 13 nt, Molluscum contagiosum virus
aaaggcacacccc

SEQ ID NO: 3097995 - RNA, 14 nt, Molluscum contagiosum virus
cccgagcuggugau

SEQ ID NO: 3097996 - RNA, 19 nt, Molluscum contagiosum virus
ugcacgggcaugcacagcu

SEQ ID NO: 3097997 - RNA, 14 nt, Molluscum contagiosum virus
cgugcugaucacgc

SEQ ID NO: 3097998 - RNA, 16 nt, Molluscum contagiosum virus
cugggcgguugccugc

SEQ ID NO: 3097999 - RNA, 18 nt, Molluscum contagiosum virus
ggaacaggugcgcaagca

SEQ ID NO: 3098000 - RNA, 15 nt, Molluscum contagiosum virus
gcgcgcugcacgccg

SEQ ID NO: 3098001 - RNA, 20 nt, Molluscum contagiosum virus
gggcaagcucgcgcugcuga

SEQ ID NO: 3098002 - RNA, 11 nt, Molluscum contagiosum virus
aguccugggcg

SEQ ID NO: 3098003 - RNA, 13 nt, Molluscum contagiosum virus
gcgcccgccagca

SEQ ID NO: 3098004 - RNA, 20 nt, Molluscum contagiosum virus
cgccgggcaccggcgcucac

SEQ ID NO: 3098005 - RNA, 14 nt, Molluscum contagiosum virus
cgcgccgcgcgccg

SEQ ID NO: 3098006 - RNA, 15 nt, Molluscum contagiosum virus
cggccuagagcuggc

SEQ ID NO: 3098007 - RNA, 21 nt, Molluscum contagiosum virus
aagugcacaccagacaaaguc

SEQ ID NO: 3098008 - RNA, 21 nt, Molluscum contagiosum virus
aaggagcccgucuacauuuug

SEQ ID NO: 3098009 - RNA, 17 nt, Molluscum contagiosum virus
cgacguccuagagcaga

SEQ ID NO: 3098010 - RNA, 20 nt, Molluscum contagiosum virus
cugugcuacgcgagcacugc

SEQ ID NO: 3098011 - RNA, 10 nt, Molluscum contagiosum virus
uagcagagca

SEQ ID NO: 3098012 - RNA, 21 nt, Molluscum contagiosum virus
ccuguuaaauggacgugcucc

SEQ ID NO: 3098013 - RNA, 15 nt, Molluscum contagiosum virus
ggccuacgugcugcg

SEQ ID NO: 3098014 - RNA, 21 nt, Molluscum contagiosum virus
acuaugcgucuuccugcugcc

SEQ ID NO: 3098015 - RNA, 20 nt, Molluscum contagiosum virus
cgcgcacuaccgcaaccagc

SEQ ID NO: 3098016 - RNA, 23 nt, Molluscum contagiosum virus
ggagacggccguuuuugggacag

SEQ ID NO: 3098017 - RNA, 18 nt, Molluscum contagiosum virus
ccgcaggaaaggcacccc

SEQ ID NO: 3098018 - RNA, 22 nt, Molluscum contagiosum virus
ggacgugcuccgaguccagcuu

SEQ ID NO: 3098019 - RNA, 19 nt, Molluscum contagiosum virus
ggugccggccgccggcgcc

SEQ ID NO: 3098020 - RNA, 21 nt, Molluscum contagiosum virus
gccucgucguccacaggcgcg

SEQ ID NO: 3098021 - RNA, 19 nt, Molluscum contagiosum virus
gcggccaaccgccugcucu

SEQ ID NO: 3098022 - RNA, 18 nt, Molluscum contagiosum virus
ggucaucgggcugcagcc

SEQ ID NO: 3098023 - RNA, 16 nt, Molluscum contagiosum virus
gcagcacgcgaugagc

SEQ ID NO: 3098024 - RNA, 22 nt, Molluscum contagiosum virus
gcaccagucucgaugugacaac

SEQ ID NO: 3098025 - RNA, 20 nt, Molluscum contagiosum virus
ugcgccugccgcgcaugcug

SEQ ID NO: 3098026 - RNA, 22 nt, Molluscum contagiosum virus
cgguugccugcacaagcaggag

SEQ ID NO: 3098027 - RNA, 23 nt, Molluscum contagiosum virus
cgaggugcugcgccacgugcgca

SEQ ID NO: 3098028 - RNA, 13 nt, Molluscum contagiosum virus
gcuggccucugcc

SEQ ID NO: 3098029 - RNA, 21 nt, Molluscum contagiosum virus
agcgcuucuuccggcagcugg

SEQ ID NO: 3098030 - RNA, 15 nt, Molluscum contagiosum virus
augagcguggagaag

SEQ ID NO: 3098031 - RNA, 14 nt, Molluscum contagiosum virus
gucgaggccuucgc

SEQ ID NO: 3098032 - RNA, 20 nt, Molluscum contagiosum virus
cgcggucgacgagugcgccg

SEQ ID NO: 3098033 - RNA, 17 nt, Molluscum contagiosum virus
cuccagguccuccagcg

SEQ ID NO: 3098034 - RNA, 16 nt, Molluscum contagiosum virus
aacaagagcuuacuag

SEQ ID NO: 3098035 - RNA, 23 nt, Molluscum contagiosum virus
cgagcgggcaaugggcacgcucu

SEQ ID NO: 3098036 - RNA, 16 nt, Molluscum contagiosum virus
cguacugggagcuuuc

SEQ ID NO: 3098037 - RNA, 21 nt, Molluscum contagiosum virus
cggcggggcugcuggcggugc

SEQ ID NO: 3098038 - RNA, 18 nt, Molluscum contagiosum virus
ggucuucccgcuggcggc

SEQ ID NO: 3098039 - RNA, 22 nt, Molluscum contagiosum virus
cgggcacggguguacaaagagc

SEQ ID NO: 3098040 - RNA, 14 nt, Molluscum contagiosum virus
gcaagucucccucg

SEQ ID NO: 3098041 - RNA, 23 nt, Molluscum contagiosum virus
caugccggggaugaacgcgcugc

SEQ ID NO: 3098042 - RNA, 16 nt, Molluscum contagiosum virus
guacuccguggugcgc

SEQ ID NO: 3098043 - RNA, 21 nt, Molluscum contagiosum virus
guagucgcccccgugccggaa

SEQ ID NO: 3098044 - RNA, 17 nt, Molluscum contagiosum virus
cagcggcgccgcagcuu

SEQ ID NO: 3098045 - RNA, 20 nt, Molluscum contagiosum virus
aggaacucuacgacaugcuc

SEQ ID NO: 3098046 - RNA, 13 nt, Molluscum contagiosum virus
cuccauggagcgc

SEQ ID NO: 3098047 - RNA, 15 nt, Molluscum contagiosum virus
uugcucgcuugccgc

SEQ ID NO: 3098048 - RNA, 16 nt, Molluscum contagiosum virus
agcugcaagccagccc

SEQ ID NO: 3098049 - RNA, 12 nt, Molluscum contagiosum virus
agcuuucagagu

SEQ ID NO: 3098050 - RNA, 18 nt, Molluscum contagiosum virus
cguggcaaacaggcacac

SEQ ID NO: 3098051 - RNA, 21 nt, Molluscum contagiosum virus
cuccuuuccaucggaacuagc

SEQ ID NO: 3098052 - RNA, 18 nt, Molluscum contagiosum virus
caggccccgcaccagugc

SEQ ID NO: 3098053 - RNA, 19 nt, Molluscum contagiosum virus
cuaguggcaagggccugcg

SEQ ID NO: 3098054 - RNA, 17 nt, Molluscum contagiosum virus
ucagccccgcgccagca

SEQ ID NO: 3098055 - RNA, 18 nt, Molluscum contagiosum virus
gugcgaaggcucgagcug

SEQ ID NO: 3098056 - RNA, 16 nt, Molluscum contagiosum virus
ccggccuagagcuggc

SEQ ID NO: 3098057 - RNA, 20 nt, Molluscum contagiosum virus
uucaccuucggaacugcgga

SEQ ID NO: 3098058 - RNA, 16 nt, Molluscum contagiosum virus
ccagcagcgccagcuu

SEQ ID NO: 3098059 - RNA, 12 nt, Molluscum contagiosum virus
cugcccucggga

SEQ ID NO: 3098060 - RNA, 18 nt, Molluscum contagiosum virus
cagcguuacguacagcgg

SEQ ID NO: 3098061 - RNA, 22 nt, Molluscum contagiosum virus
acacgcugaguuacguggccgc

SEQ ID NO: 3098062 - RNA, 14 nt, Molluscum contagiosum virus
aucuugaugaccac

SEQ ID NO: 3098063 - RNA, 15 nt, Molluscum contagiosum virus
caguucggccgcacg

SEQ ID NO: 3098064 - RNA, 19 nt, Molluscum contagiosum virus
cuggcucgcgccugcgcuu

SEQ ID NO: 3098065 - RNA, 13 nt, Molluscum contagiosum virus
cugcucuggagca

SEQ ID NO: 3098066 - RNA, 15 nt, Molluscum contagiosum virus
gccuaccugcaggag

SEQ ID NO: 3098067 - RNA, 12 nt, Molluscum contagiosum virus
ccgagugcuggc

SEQ ID NO: 3098068 - RNA, 21 nt, Molluscum contagiosum virus
gccgccggugcgugcccagca

SEQ ID NO: 3098069 - RNA, 14 nt, Molluscum contagiosum virus
ugcccgaggagagc

SEQ ID NO: 3098070 - RNA, 19 nt, Molluscum contagiosum virus
gcacuacucgucuugcgcg

SEQ ID NO: 3098071 - RNA, 12 nt, Molluscum contagiosum virus
aacagcagcugg

SEQ ID NO: 3098072 - RNA, 22 nt, Molluscum contagiosum virus
cccgcaggaaaggcaccccgca

SEQ ID NO: 3098073 - RNA, 19 nt, Molluscum contagiosum virus
aaggaucucugcccucaga

SEQ ID NO: 3098074 - RNA, 17 nt, Molluscum contagiosum virus
gcagcugcgcgagccgc

SEQ ID NO: 3098075 - RNA, 21 nt, Molluscum contagiosum virus
caugcugucucugucccugca

SEQ ID NO: 3098076 - RNA, 15 nt, Molluscum contagiosum virus
uggacagcaagcagc

SEQ ID NO: 3098077 - RNA, 21 nt, Molluscum contagiosum virus
ugggcacugcuacgagccgcu

SEQ ID NO: 3098078 - RNA, 18 nt, Molluscum contagiosum virus
guggagccugaggccgcg

SEQ ID NO: 3098079 - RNA, 14 nt, Molluscum contagiosum virus
gcugucaacagugc

SEQ ID NO: 3098080 - RNA, 21 nt, Molluscum contagiosum virus
gaucuccacgucgaucagcuc

SEQ ID NO: 3098081 - RNA, 20 nt, Molluscum contagiosum virus
acgcaacgucgcacuggccu

SEQ ID NO: 3098082 - RNA, 18 nt, Molluscum contagiosum virus
cugcgcguggaguacagc

SEQ ID NO: 3098083 - RNA, 15 nt, Molluscum contagiosum virus
caucgagcugcagag

SEQ ID NO: 3098084 - RNA, 19 nt, Molluscum contagiosum virus
acuugcggcgcuagcgccc

SEQ ID NO: 3098085 - RNA, 17 nt, Molluscum contagiosum virus
cguccacaaaggcgggc

SEQ ID NO: 3098086 - RNA, 14 nt, Molluscum contagiosum virus
ccugccagcagagc

SEQ ID NO: 3098087 - RNA, 18 nt, Molluscum contagiosum virus
gcaagacccagcaaggcc

SEQ ID NO: 3098088 - RNA, 19 nt, Molluscum contagiosum virus
gcccagccugacggcagca

SEQ ID NO: 3098089 - RNA, 15 nt, Molluscum contagiosum virus
cgcgaaguccugggc

SEQ ID NO: 3098090 - RNA, 19 nt, Molluscum contagiosum virus
agugacuagcgcuggcugc

SEQ ID NO: 3098091 - RNA, 18 nt, Molluscum contagiosum virus
agaaaugcgcacacuugc

SEQ ID NO: 3098092 - RNA, 13 nt, Molluscum contagiosum virus
ggacggagagcgc

SEQ ID NO: 3098093 - RNA, 17 nt, Molluscum contagiosum virus
cacggagaucaggcagc

SEQ ID NO: 3098094 - RNA, 20 nt, Molluscum contagiosum virus
uccuccaauccuccugccgc

SEQ ID NO: 3098095 - RNA, 17 nt, Molluscum contagiosum virus
aagacggaguuggagac

SEQ ID NO: 3098096 - RNA, 21 nt, Molluscum contagiosum virus
ccuucgguuucuaugcccagc

SEQ ID NO: 3098097 - RNA, 18 nt, Molluscum contagiosum virus
agcacgggcgggacagac

SEQ ID NO: 3098098 - RNA, 19 nt, Molluscum contagiosum virus
cugcgcaauaaggcggugg

SEQ ID NO: 3098099 - RNA, 17 nt, Molluscum contagiosum virus
cuuccggggcgggcggc

SEQ ID NO: 3098100 - RNA, 23 nt, Molluscum contagiosum virus
gccggaaauagcgcgcuagcucc

SEQ ID NO: 3098101 - RNA, 21 nt, Molluscum contagiosum virus
gugcaagagcucguggacagc

SEQ ID NO: 3098102 - RNA, 21 nt, Molluscum contagiosum virus
aacccgcauugggccuugauu

SEQ ID NO: 3098103 - RNA, 14 nt, Molluscum contagiosum virus
cagcugcugcucgc

SEQ ID NO: 3098104 - RNA, 20 nt, Molluscum contagiosum virus
ccggugcgugcccagcaggu

SEQ ID NO: 3098105 - RNA, 12 nt, Molluscum contagiosum virus
cggcagcuggag

SEQ ID NO: 3098106 - RNA, 17 nt, Molluscum contagiosum virus
uggcuugcugcaguaug

SEQ ID NO: 3098107 - RNA, 20 nt, Molluscum contagiosum virus
uucuuuacgggcgccagcua

SEQ ID NO: 3098108 - RNA, 18 nt, Molluscum contagiosum virus
uccgcgggcgcacgcuug

SEQ ID NO: 3098109 - RNA, 13 nt, Molluscum contagiosum virus
gcgcggcugcucg

SEQ ID NO: 3098110 - RNA, 13 nt, Molluscum contagiosum virus
gcggggcugcugg

SEQ ID NO: 3098111 - RNA, 20 nt, Molluscum contagiosum virus
aucaagaucggacucagcau

SEQ ID NO: 3098112 - RNA, 18 nt, Molluscum contagiosum virus
cgcaagucucccucgcgc

SEQ ID NO: 3098113 - RNA, 16 nt, Molluscum contagiosum virus
uugcguaucggaguca

SEQ ID NO: 3098114 - RNA, 16 nt, Molluscum contagiosum virus
uaaugaagcgcugugc

SEQ ID NO: 3098115 - RNA, 15 nt, Molluscum contagiosum virus
agccucgcuggugug

SEQ ID NO: 3098116 - RNA, 21 nt, Molluscum contagiosum virus
cugcaggcaaagcggggcgcg

SEQ ID NO: 3098117 - RNA, 15 nt, Molluscum contagiosum virus
caaaggaagagcccg

SEQ ID NO: 3098118 - RNA, 21 nt, Molluscum contagiosum virus
accucacucacaugugcugcc

SEQ ID NO: 3098119 - RNA, 23 nt, Molluscum contagiosum virus
agcgcgugccgcucggaggcuug

SEQ ID NO: 3098120 - RNA, 17 nt, Molluscum contagiosum virus
ggucacgcaagcuuugu

SEQ ID NO: 3098121 - RNA, 13 nt, Molluscum contagiosum virus
cugugccugcaag

SEQ ID NO: 3098122 - RNA, 19 nt, Molluscum contagiosum virus
cugcggacgcaaaucuguu

SEQ ID NO: 3098123 - RNA, 22 nt, Molluscum contagiosum virus
agcacgccuccaagaagaggcc

SEQ ID NO: 3098124 - RNA, 22 nt, Molluscum contagiosum virus
cucgccugcgaaaaagcccgcg

SEQ ID NO: 3098125 - RNA, 17 nt, Molluscum contagiosum virus
cgaccuacuccuggcca

SEQ ID NO: 3098126 - RNA, 14 nt, Molluscum contagiosum virus
gagaaaggcaccca

SEQ ID NO: 3098127 - RNA, 14 nt, Molluscum contagiosum virus
caacgacagagccc

SEQ ID NO: 3098128 - RNA, 13 nt, Molluscum contagiosum virus
cgucgccugagcu

SEQ ID NO: 3098129 - RNA, 19 nt, Molluscum contagiosum virus
gcucuucgaccucugcuuc

SEQ ID NO: 3098130 - RNA, 19 nt, Molluscum contagiosum virus
acacgcuguugcugcugcc

SEQ ID NO: 3098131 - RNA, 17 nt, Molluscum contagiosum virus
aacgaggaaaggcaccc

SEQ ID NO: 3098132 - RNA, 14 nt, Molluscum contagiosum virus
gcgugugccggugc

SEQ ID NO: 3098133 - RNA, 21 nt, Molluscum contagiosum virus
gccuggagggcagugccaagg

SEQ ID NO: 3098134 - RNA, 19 nt, Molluscum contagiosum virus
gcacguuccaaaagacaga

SEQ ID NO: 3098135 - RNA, 12 nt, Molluscum contagiosum virus
agcuagcucugc

SEQ ID NO: 3098136 - RNA, 15 nt, Molluscum contagiosum virus
gaacauaugucuccc

SEQ ID NO: 3098137 - RNA, 22 nt, Molluscum contagiosum virus
agacggaguccucgacaaugag

SEQ ID NO: 3098138 - RNA, 18 nt, Molluscum contagiosum virus
cacguccucaagcgcccu

SEQ ID NO: 3098139 - RNA, 17 nt, Molluscum contagiosum virus
cggaucugcgcacacgu

SEQ ID NO: 3098140 - RNA, 23 nt, Molluscum contagiosum virus
ccagcguaaugaagcgcugugcg

SEQ ID NO: 3098141 - RNA, 16 nt, Molluscum contagiosum virus
cccgcacgugggcuac

SEQ ID NO: 3098142 - RNA, 14 nt, Molluscum contagiosum virus
ggcgcggccucuuu

SEQ ID NO: 3098143 - RNA, 22 nt, Molluscum contagiosum virus
caggucggccagcagcuccugg

SEQ ID NO: 3098144 - RNA, 19 nt, Molluscum contagiosum virus
cggcguccucuuuugggca

SEQ ID NO: 3098145 - RNA, 14 nt, Molluscum contagiosum virus
gagacauauguucu

SEQ ID NO: 3098146 - RNA, 22 nt, Molluscum contagiosum virus
cugccgccgccgcgaggacccg

SEQ ID NO: 3098147 - RNA, 20 nt, Molluscum contagiosum virus
aagcaagacccagcaaggcc

SEQ ID NO: 3098148 - RNA, 19 nt, Molluscum contagiosum virus
ucuggcucguacugcugca

SEQ ID NO: 3098149 - RNA, 18 nt, Molluscum contagiosum virus
gcuuggacagcaagcagc

SEQ ID NO: 3098150 - RNA, 20 nt, Molluscum contagiosum virus
cggcgcccgugagcauggag

SEQ ID NO: 3098151 - RNA, 18 nt, Molluscum contagiosum virus
agguguuccugccgggag

SEQ ID NO: 3098152 - RNA, 14 nt, Molluscum contagiosum virus
ggugccggccgccg

SEQ ID NO: 3098153 - RNA, 17 nt, Molluscum contagiosum virus
cgguguccucuucacau

SEQ ID NO: 3098154 - RNA, 19 nt, Molluscum contagiosum virus
cugcgagcgccugcgagca

SEQ ID NO: 3098155 - RNA, 14 nt, Molluscum contagiosum virus
cagcagcgccagcu

SEQ ID NO: 3098156 - RNA, 21 nt, Molluscum contagiosum virus
uucucauagcauauaaaucau

SEQ ID NO: 3098157 - RNA, 22 nt, Molluscum contagiosum virus
uguccaaggugaacgaccucaa

SEQ ID NO: 3098158 - RNA, 18 nt, Molluscum contagiosum virus
gacccccuccccagcgcc

SEQ ID NO: 3098159 - RNA, 18 nt, Molluscum contagiosum virus
cugcgccacugccacggc

SEQ ID NO: 3098160 - RNA, 15 nt, Molluscum contagiosum virus
agcaagcagccgcac

SEQ ID NO: 3098161 - RNA, 18 nt, Molluscum contagiosum virus
cugacacgcucuucggca

SEQ ID NO: 3098162 - RNA, 18 nt, Molluscum contagiosum virus
accuacgaggugcugcgc

SEQ ID NO: 3098163 - RNA, 15 nt, Molluscum contagiosum virus
cgccgcgugcccguc

SEQ ID NO: 3098164 - RNA, 16 nt, Molluscum contagiosum virus
cugcaggaccugcugg

SEQ ID NO: 3098165 - RNA, 17 nt, Molluscum contagiosum virus
gaugaacaccauccugc

SEQ ID NO: 3098166 - RNA, 22 nt, Molluscum contagiosum virus
cucaacauccaaaccaacguga

SEQ ID NO: 3098167 - RNA, 14 nt, Molluscum contagiosum virus
cgcucgcccagcuc

SEQ ID NO: 3098168 - RNA, 18 nt, Molluscum contagiosum virus
ggcggguccgcaggcucg

SEQ ID NO: 3098169 - RNA, 15 nt, Molluscum contagiosum virus
ccgcgugcgccgccg

SEQ ID NO: 3098170 - RNA, 22 nt, Molluscum contagiosum virus
cgcccgcgaaagaacacggaca

SEQ ID NO: 3098171 - RNA, 22 nt, Molluscum contagiosum virus
aaagacggacccgcgaacgagg

SEQ ID NO: 3098172 - RNA, 22 nt, Molluscum contagiosum virus
acaggggggagacgguggaggu

SEQ ID NO: 3098173 - RNA, 18 nt, Molluscum contagiosum virus
agcccaggaacaucugca

SEQ ID NO: 3098174 - RNA, 18 nt, Molluscum contagiosum virus
cgugaccuugugcgcgca

SEQ ID NO: 3098175 - RNA, 15 nt, Molluscum contagiosum virus
cacaucggcacugcu

SEQ ID NO: 3098176 - RNA, 16 nt, Molluscum contagiosum virus
cagcauguugcucuac

SEQ ID NO: 3098177 - RNA, 22 nt, Molluscum contagiosum virus
ccgacaaggagggagagcugcc

SEQ ID NO: 3098178 - RNA, 18 nt, Molluscum contagiosum virus
cagagcccgcggcgcacg

SEQ ID NO: 3098179 - RNA, 19 nt, Molluscum contagiosum virus
agugcgcgugucuggagcc

SEQ ID NO: 3098180 - RNA, 22 nt, Molluscum contagiosum virus
uccggccuguaaauggaccaca

SEQ ID NO: 3098181 - RNA, 14 nt, Molluscum contagiosum virus
uggagacggcagug

SEQ ID NO: 3098182 - RNA, 22 nt, Molluscum contagiosum virus
gcgcugcugguucugcucgcag

SEQ ID NO: 3098183 - RNA, 15 nt, Molluscum contagiosum virus
agagggucgugcagg

SEQ ID NO: 3098184 - RNA, 20 nt, Molluscum contagiosum virus
cacaguucacggcgcucgcc

SEQ ID NO: 3098185 - RNA, 20 nt, Molluscum contagiosum virus
cgccgggaauaccggagaca

SEQ ID NO: 3098186 - RNA, 17 nt, Molluscum contagiosum virus
gcggcgcgcgcugagcg

SEQ ID NO: 3098187 - RNA, 20 nt, Molluscum contagiosum virus
aaggcacccgcaggaaaggc

SEQ ID NO: 3098188 - RNA, 14 nt, Molluscum contagiosum virus
gacugugccgcucc

SEQ ID NO: 3098189 - RNA, 17 nt, Molluscum contagiosum virus
ggcgcuuucgcccgccg

SEQ ID NO: 3098190 - RNA, 18 nt, Molluscum contagiosum virus
cuguccgcgggcgcacgc

SEQ ID NO: 3098191 - RNA, 20 nt, Molluscum contagiosum virus
gcagcaaagggcggccgcag

SEQ ID NO: 3098192 - RNA, 17 nt, Molluscum contagiosum virus
gcgugcucggugucggu

SEQ ID NO: 3098193 - RNA, 20 nt, Molluscum contagiosum virus
uggcccuuuucuaggccuca

SEQ ID NO: 3098194 - RNA, 14 nt, Molluscum contagiosum virus
ugcgugguguccac

SEQ ID NO: 3098195 - RNA, 22 nt, Molluscum contagiosum virus
acggcccgaaggccaccucgca

SEQ ID NO: 3098196 - RNA, 17 nt, Molluscum contagiosum virus
uaaagaagcggugcagc

SEQ ID NO: 3098197 - RNA, 20 nt, Molluscum contagiosum virus
ccucggaggaaaagcacgcg

SEQ ID NO: 3098198 - RNA, 15 nt, Molluscum contagiosum virus
cuccgaggaggcaag

SEQ ID NO: 3098199 - RNA, 15 nt, Molluscum contagiosum virus
cucguguuguugcau

SEQ ID NO: 3098200 - RNA, 14 nt, Molluscum contagiosum virus
accgccugcgggag

SEQ ID NO: 3098201 - RNA, 17 nt, Molluscum contagiosum virus
guccagccgcagccgcg

SEQ ID NO: 3098202 - RNA, 14 nt, Molluscum contagiosum virus
gcccagcuucagca

SEQ ID NO: 3098203 - RNA, 14 nt, Molluscum contagiosum virus
ccggcggccucccu

SEQ ID NO: 3098204 - RNA, 16 nt, Molluscum contagiosum virus
gcgcugcucuggagca

SEQ ID NO: 3098205 - RNA, 14 nt, Molluscum contagiosum virus
agggcagcucaagc

SEQ ID NO: 3098206 - RNA, 18 nt, Molluscum contagiosum virus
ucgcgcguccgcaaagac

SEQ ID NO: 3098207 - RNA, 12 nt, Molluscum contagiosum virus
caccgcuccgca

SEQ ID NO: 3098208 - RNA, 19 nt, Molluscum contagiosum virus
caagaggacgagcugcuaa

SEQ ID NO: 3098209 - RNA, 20 nt, Molluscum contagiosum virus
guucuuuccggacgauaaau

SEQ ID NO: 3098210 - RNA, 21 nt, Molluscum contagiosum virus
cgggaccgcagacaaagacag

SEQ ID NO: 3098211 - RNA, 14 nt, Molluscum contagiosum virus
uguacaacucggug

SEQ ID NO: 3098212 - RNA, 18 nt, Molluscum contagiosum virus
agcuagcucuggcagccc

SEQ ID NO: 3098213 - RNA, 21 nt, Molluscum contagiosum virus
agcguacggcccgaaggccac

SEQ ID NO: 3098214 - RNA, 19 nt, Molluscum contagiosum virus
accagcgcggccguggcug

SEQ ID NO: 3098215 - RNA, 14 nt, Molluscum contagiosum virus
accugggcgccgcg

SEQ ID NO: 3098216 - RNA, 13 nt, Molluscum contagiosum virus
accacgugccaga

SEQ ID NO: 3098217 - RNA, 15 nt, Molluscum contagiosum virus
ccuggcugcugcgcg

SEQ ID NO: 3098218 - RNA, 21 nt, Molluscum contagiosum virus
gucuucgcguagucagggccu

SEQ ID NO: 3098219 - RNA, 16 nt, Molluscum contagiosum virus
gccccgcaccagugcc

SEQ ID NO: 3098220 - RNA, 19 nt, Molluscum contagiosum virus
gaaggacgcguucuccagg

SEQ ID NO: 3098221 - RNA, 17 nt, Molluscum contagiosum virus
ccgcggagaccaccgcu

SEQ ID NO: 3098222 - RNA, 15 nt, Molluscum contagiosum virus
caagagcuggucgcc

SEQ ID NO: 3098223 - RNA, 17 nt, Molluscum contagiosum virus
cguaguacugcagcagc

SEQ ID NO: 3098224 - RNA, 18 nt, Molluscum contagiosum virus
gaacaaugaggagaggaa

SEQ ID NO: 3098225 - RNA, 17 nt, Molluscum contagiosum virus
ccgggcggcgcgccgcg

SEQ ID NO: 3098226 - RNA, 17 nt, Molluscum contagiosum virus
ccgcgcucgugccgccu

SEQ ID NO: 3098227 - RNA, 11 nt, Molluscum contagiosum virus
cacgcagagcc

SEQ ID NO: 3098228 - RNA, 14 nt, Molluscum contagiosum virus
ucacggcucugcgu

SEQ ID NO: 3098229 - RNA, 21 nt, Molluscum contagiosum virus
cuugaauugagugcgggucac

SEQ ID NO: 3098230 - RNA, 18 nt, Molluscum contagiosum virus
ggcaagaggggagccagc

SEQ ID NO: 3098231 - RNA, 17 nt, Molluscum contagiosum virus
gaugguggcgcugcugc

SEQ ID NO: 3098232 - RNA, 20 nt, Molluscum contagiosum virus
cucggcaugugcgcaccgcg

SEQ ID NO: 3098233 - RNA, 17 nt, Molluscum contagiosum virus
agcugucgcgcagcagc

SEQ ID NO: 3098234 - RNA, 14 nt, Molluscum contagiosum virus
gagcuccggcugcu

SEQ ID NO: 3098235 - RNA, 16 nt, Molluscum contagiosum virus
caucagcaacaagcuc

SEQ ID NO: 3098236 - RNA, 21 nt, Molluscum contagiosum virus
cuuuguggucaagacuggccu

SEQ ID NO: 3098237 - RNA, 17 nt, Molluscum contagiosum virus
cacaagccguccgccuc

SEQ ID NO: 3098238 - RNA, 14 nt, Molluscum contagiosum virus
caggaaaggcaccc

SEQ ID NO: 3098239 - RNA, 13 nt, Molluscum contagiosum virus
ugcggccagcacc

SEQ ID NO: 3098240 - RNA, 17 nt, Molluscum contagiosum virus
uguucacaccaugcagc

SEQ ID NO: 3098241 - RNA, 17 nt, Molluscum contagiosum virus
acagagaaaggcaccca

SEQ ID NO: 3098242 - RNA, 18 nt, Molluscum contagiosum virus
ccgggcgccgcggcugcc

SEQ ID NO: 3098243 - RNA, 18 nt, Molluscum contagiosum virus
cuuuuuaaauggccgaga

SEQ ID NO: 3098244 - RNA, 19 nt, Molluscum contagiosum virus
agcuauccgcugucugaaa

SEQ ID NO: 3098245 - RNA, 18 nt, Molluscum contagiosum virus
ugcuccgcacguggaguc

SEQ ID NO: 3098246 - RNA, 22 nt, Molluscum contagiosum virus
agcgugcccuucuccgaggaaa

SEQ ID NO: 3098247 - RNA, 22 nt, Molluscum contagiosum virus
gugcuccacgcgcagcuucucu

SEQ ID NO: 3098248 - RNA, 20 nt, Molluscum contagiosum virus
cacaccgucgcguggugcuu

SEQ ID NO: 3098249 - RNA, 20 nt, Molluscum contagiosum virus
accccgcgcguacgcugcuc

SEQ ID NO: 3098250 - RNA, 14 nt, Molluscum contagiosum virus
cagcuaagccggag

SEQ ID NO: 3098251 - RNA, 22 nt, Molluscum contagiosum virus
ugccgcgccuugagcgcgccgc

SEQ ID NO: 3098252 - RNA, 19 nt, Molluscum contagiosum virus
cagcucaagacgcugcugg

SEQ ID NO: 3098253 - RNA, 16 nt, Molluscum contagiosum virus
cccgagagugacgccu

SEQ ID NO: 3098254 - RNA, 22 nt, Molluscum contagiosum virus
gcucgcaggcggugggcgccgc

SEQ ID NO: 3098255 - RNA, 16 nt, Molluscum contagiosum virus
gacacacuccuguccu

SEQ ID NO: 3098256 - RNA, 20 nt, Molluscum contagiosum virus
cuuguugucgagcagauuca

SEQ ID NO: 3098257 - RNA, 13 nt, Molluscum contagiosum virus
cgcgcgccgggcc

SEQ ID NO: 3098258 - RNA, 19 nt, Molluscum contagiosum virus
cucgcucggaaagagcgcg

SEQ ID NO: 3098259 - RNA, 15 nt, Molluscum contagiosum virus
cccucguguacgaga

SEQ ID NO: 3098260 - RNA, 16 nt, Molluscum contagiosum virus
uggaggcccaggccau

SEQ ID NO: 3098261 - RNA, 14 nt, Molluscum contagiosum virus
ucgccgcgggcugg

SEQ ID NO: 3098262 - RNA, 13 nt, Molluscum contagiosum virus
gcagcugcaggac

SEQ ID NO: 3098263 - RNA, 16 nt, Molluscum contagiosum virus
cacgugcagcggcgcc

SEQ ID NO: 3098264 - RNA, 22 nt, Molluscum contagiosum virus
ggcccuucuugacgcgagacug

SEQ ID NO: 3098265 - RNA, 17 nt, Molluscum contagiosum virus
cggcuucugcugcacac

SEQ ID NO: 3098266 - RNA, 18 nt, Molluscum contagiosum virus
caggcgcgcaagugcgug

SEQ ID NO: 3098267 - RNA, 23 nt, Molluscum contagiosum virus
ccggcaacgcugccgcuggcgcu

SEQ ID NO: 3098268 - RNA, 14 nt, Molluscum contagiosum virus
acgaggugcugcgc

SEQ ID NO: 3098269 - RNA, 16 nt, Molluscum contagiosum virus
cagcucugggcgcgcu

SEQ ID NO: 3098270 - RNA, 16 nt, Molluscum contagiosum virus
ggcgcgcagcuccgcg

SEQ ID NO: 3098271 - RNA, 19 nt, Molluscum contagiosum virus
gcuucggcucccagcagcg

SEQ ID NO: 3098272 - RNA, 14 nt, Molluscum contagiosum virus
ccgcugcgccgcca

SEQ ID NO: 3098273 - RNA, 19 nt, Molluscum contagiosum virus
aggcaccccgaaaggcacc

SEQ ID NO: 3098274 - RNA, 14 nt, Molluscum contagiosum virus
ccucugccugcaag

SEQ ID NO: 3098275 - RNA, 16 nt, Molluscum contagiosum virus
cugaagaaggagcccu

SEQ ID NO: 3098276 - RNA, 13 nt, Molluscum contagiosum virus
ggcggcugugccc

SEQ ID NO: 3098277 - RNA, 22 nt, Molluscum contagiosum virus
ggauagccccucgagcagcggu

SEQ ID NO: 3098278 - RNA, 11 nt, Molluscum contagiosum virus
uggaagaacag

SEQ ID NO: 3098279 - RNA, 13 nt, Molluscum contagiosum virus
ggagguuggaagc

SEQ ID NO: 3098280 - RNA, 16 nt, Molluscum contagiosum virus
ggcgucgcgcacagaa

SEQ ID NO: 3098281 - RNA, 17 nt, Molluscum contagiosum virus
gugcgcaaagcaacugc

SEQ ID NO: 3098282 - RNA, 18 nt, Molluscum contagiosum virus
gaagaaacagccaugugu

SEQ ID NO: 3098283 - RNA, 14 nt, Molluscum contagiosum virus
gagcugccauggca

SEQ ID NO: 3098284 - RNA, 18 nt, Molluscum contagiosum virus
aagaaacgggagucacuu

SEQ ID NO: 3098285 - RNA, 20 nt, Molluscum contagiosum virus
ccucacucacaugugcugcc

SEQ ID NO: 3098286 - RNA, 21 nt, Molluscum contagiosum virus
augccagacccgaaagcugcc

SEQ ID NO: 3098287 - RNA, 19 nt, Molluscum contagiosum virus
gauggucacgcgcaaggcc

SEQ ID NO: 3098288 - RNA, 20 nt, Molluscum contagiosum virus
gcggcaaucuucgugcgcuc

SEQ ID NO: 3098289 - RNA, 20 nt, Molluscum contagiosum virus
ggaggcagcgcuuguuucgc

SEQ ID NO: 3098290 - RNA, 23 nt, Molluscum contagiosum virus
cgcguugucgagaauagcugggg

SEQ ID NO: 3098291 - RNA, 16 nt, Molluscum contagiosum virus
ggaacgccgccacgcc

SEQ ID NO: 3098292 - RNA, 16 nt, Molluscum contagiosum virus
ccgaagucgcagcagc

SEQ ID NO: 3098293 - RNA, 23 nt, Molluscum contagiosum virus
gggcacgcucauacuccugcugg

SEQ ID NO: 3098294 - RNA, 18 nt, Molluscum contagiosum virus
cgcgcccggcgggcacau

SEQ ID NO: 3098295 - RNA, 15 nt, Molluscum contagiosum virus
gagcgcggcaacagc

SEQ ID NO: 3098296 - RNA, 16 nt, Molluscum contagiosum virus
cggaggcugcucccuc

SEQ ID NO: 3098297 - RNA, 18 nt, Molluscum contagiosum virus
agcgccgccaugcugcgc

SEQ ID NO: 3098298 - RNA, 15 nt, Molluscum contagiosum virus
gcgcgcugcucugga

SEQ ID NO: 3098299 - RNA, 16 nt, Molluscum contagiosum virus
gacgagacgugggcaa

SEQ ID NO: 3098300 - RNA, 21 nt, Molluscum contagiosum virus
gacagagcucggcaacacaaa

SEQ ID NO: 3098301 - RNA, 22 nt, Molluscum contagiosum virus
gcccgcgcacgagcugcugccc

SEQ ID NO: 3098302 - RNA, 15 nt, Molluscum contagiosum virus
cgcacgcacggagca

SEQ ID NO: 3098303 - RNA, 14 nt, Molluscum contagiosum virus
cuagccgccgcugc

SEQ ID NO: 3098304 - RNA, 16 nt, Molluscum contagiosum virus
gccagcuuucccuagc

SEQ ID NO: 3098305 - RNA, 16 nt, Molluscum contagiosum virus
gcgcccaacgcccgcg

SEQ ID NO: 3098306 - RNA, 14 nt, Molluscum contagiosum virus
agaggacgagcugc

SEQ ID NO: 3098307 - RNA, 23 nt, Molluscum contagiosum virus
agcaagcugcaagccagcccgcu

SEQ ID NO: 3098308 - RNA, 14 nt, Molluscum contagiosum virus
uaccugaagcugga

SEQ ID NO: 3098309 - RNA, 14 nt, Molluscum contagiosum virus
auggcgcgcagcuc

SEQ ID NO: 3098310 - RNA, 15 nt, Molluscum contagiosum virus
acgggcacgagcacg

SEQ ID NO: 3098311 - RNA, 16 nt, Molluscum contagiosum virus
cgacggugugccgcug

SEQ ID NO: 3098312 - RNA, 22 nt, Molluscum contagiosum virus
guacgagcagcugcugcgcacg

SEQ ID NO: 3098313 - RNA, 17 nt, Molluscum contagiosum virus
cuggcgagcgcucugca

SEQ ID NO: 3098314 - RNA, 15 nt, Molluscum contagiosum virus
ugccgccggcgccgc

SEQ ID NO: 3098315 - RNA, 19 nt, Molluscum contagiosum virus
agauccguaguagccgcaa

SEQ ID NO: 3098316 - RNA, 19 nt, Molluscum contagiosum virus
gcuuccgcgagucugccag

SEQ ID NO: 3098317 - RNA, 10 nt, Molluscum contagiosum virus
ggguguacaa

SEQ ID NO: 3098318 - RNA, 21 nt, Molluscum contagiosum virus
caaggaaaggcaccugcagga

SEQ ID NO: 3098319 - RNA, 15 nt, Molluscum contagiosum virus
cggaucggcacugug

SEQ ID NO: 3098320 - RNA, 22 nt, Molluscum contagiosum virus
aggcgccgcaccucaccgcgca

SEQ ID NO: 3098321 - RNA, 16 nt, Molluscum contagiosum virus
acgcaacgucgcacug

SEQ ID NO: 3098322 - RNA, 13 nt, Molluscum contagiosum virus
caucaccccgcug

SEQ ID NO: 3098323 - RNA, 17 nt, Molluscum contagiosum virus
caucaucgcggagcugc

SEQ ID NO: 3098324 - RNA, 17 nt, Molluscum contagiosum virus
gcugcugguucugcucg

SEQ ID NO: 3098325 - RNA, 16 nt, Molluscum contagiosum virus
gacggagacagugaca

SEQ ID NO: 3098326 - RNA, 16 nt, Molluscum contagiosum virus
cguggucgccgcggcc

SEQ ID NO: 3098327 - RNA, 23 nt, Molluscum contagiosum virus
ggcccuaaauaaugaaccugcac

SEQ ID NO: 3098328 - RNA, 15 nt, Molluscum contagiosum virus
accagguacuccuug

SEQ ID NO: 3098329 - RNA, 17 nt, Molluscum contagiosum virus
cgaacggaacacagugc

SEQ ID NO: 3098330 - RNA, 16 nt, Molluscum contagiosum virus
agcuggccggcucgcu

SEQ ID NO: 3098331 - RNA, 12 nt, Molluscum contagiosum virus
aggggagccagc

SEQ ID NO: 3098332 - RNA, 17 nt, Molluscum contagiosum virus
caccguugacgagcugg

SEQ ID NO: 3098333 - RNA, 13 nt, Molluscum contagiosum virus
guacgugcugccc

SEQ ID NO: 3098334 - RNA, 21 nt, Molluscum contagiosum virus
ugcagcagccccgacgccagc

SEQ ID NO: 3098335 - RNA, 21 nt, Molluscum contagiosum virus
gggcgaacugcccggcggcaa

SEQ ID NO: 3098336 - RNA, 16 nt, Molluscum contagiosum virus
cagugugugaucacgu

SEQ ID NO: 3098337 - RNA, 21 nt, Molluscum contagiosum virus
ccagccugcucacgcccgagg

SEQ ID NO: 3098338 - RNA, 13 nt, Molluscum contagiosum virus
cugccccucgggg

SEQ ID NO: 3098339 - RNA, 23 nt, Molluscum contagiosum virus
cuugcucuucgaccucugcuuca

SEQ ID NO: 3098340 - RNA, 17 nt, Molluscum contagiosum virus
ccgcgagcacuggcugg

SEQ ID NO: 3098341 - RNA, 13 nt, Molluscum contagiosum virus
gagcuggcugggc

SEQ ID NO: 3098342 - RNA, 19 nt, Molluscum contagiosum virus
gcacugcgcgcaugccuug

SEQ ID NO: 3098343 - RNA, 19 nt, Molluscum contagiosum virus
gguugcgcacguuggccac

SEQ ID NO: 3098344 - RNA, 16 nt, Molluscum contagiosum virus
cguccacgaugcgcuc

SEQ ID NO: 3098345 - RNA, 19 nt, Molluscum contagiosum virus
auggcugcucucggcagcg

SEQ ID NO: 3098346 - RNA, 14 nt, Molluscum contagiosum virus
ugcgcgcaugccuu

SEQ ID NO: 3098347 - RNA, 16 nt, Molluscum contagiosum virus
cagcagccgcagccca

SEQ ID NO: 3098348 - RNA, 20 nt, Molluscum contagiosum virus
gccuccaagaagaggccagc

SEQ ID NO: 3098349 - RNA, 18 nt, Molluscum contagiosum virus
cuccgacuaccuaggcac

SEQ ID NO: 3098350 - RNA, 18 nt, Molluscum contagiosum virus
cgcgagcagcugcugcgc

SEQ ID NO: 3098351 - RNA, 16 nt, Molluscum contagiosum virus
gcggccuggccacgcc

SEQ ID NO: 3098352 - RNA, 19 nt, Molluscum contagiosum virus
cacucgcucucucagggug

SEQ ID NO: 3098353 - RNA, 21 nt, Molluscum contagiosum virus
agcggccacucucccgggcuc

SEQ ID NO: 3098354 - RNA, 22 nt, Molluscum contagiosum virus
ccugcggacccgccggugcuug

SEQ ID NO: 3098355 - RNA, 20 nt, Molluscum contagiosum virus
ucugcgugcuugugcgccug

SEQ ID NO: 3098356 - RNA, 17 nt, Molluscum contagiosum virus
gcagaaggaagggcccg

SEQ ID NO: 3098357 - RNA, 23 nt, Molluscum contagiosum virus
gauagcuuuucaguuuuguccuc

SEQ ID NO: 3098358 - RNA, 22 nt, Molluscum contagiosum virus
cgcuucggcucgggaacaaagg

SEQ ID NO: 3098359 - RNA, 14 nt, Molluscum contagiosum virus
ggcgcgcgugccgc

SEQ ID NO: 3098360 - RNA, 16 nt, Molluscum contagiosum virus
cuccgagucgcgccuc

SEQ ID NO: 3098361 - RNA, 19 nt, Molluscum contagiosum virus
cgagcucgcgcgccagcac

SEQ ID NO: 3098362 - RNA, 21 nt, Molluscum contagiosum virus
cgcaggaugcuggggcucgcg

SEQ ID NO: 3098363 - RNA, 14 nt, Molluscum contagiosum virus
cugcacaguucacg

SEQ ID NO: 3098364 - RNA, 20 nt, Molluscum contagiosum virus
accuccugcaccugcuggaa

SEQ ID NO: 3098365 - RNA, 15 nt, Molluscum contagiosum virus
ccuggcguccgcacg

SEQ ID NO: 3098366 - RNA, 20 nt, Molluscum contagiosum virus
ucggacggaggucugcuuug

SEQ ID NO: 3098367 - RNA, 17 nt, Molluscum contagiosum virus
accgcgacaugccucgc

SEQ ID NO: 3098368 - RNA, 15 nt, Molluscum contagiosum virus
ucgcuggaggauucu

SEQ ID NO: 3098369 - RNA, 21 nt, Molluscum contagiosum virus
uggacguguccggagccaagc

SEQ ID NO: 3098370 - RNA, 11 nt, Molluscum contagiosum virus
cgacagagccc

SEQ ID NO: 3098371 - RNA, 16 nt, Molluscum contagiosum virus
gcgucuuacugcugca

SEQ ID NO: 3098372 - RNA, 16 nt, Molluscum contagiosum virus
ucacugcagcagcccc

SEQ ID NO: 3098373 - RNA, 13 nt, Molluscum contagiosum virus
acucggacacugg

SEQ ID NO: 3098374 - RNA, 14 nt, Molluscum contagiosum virus
cagcuccgccggga

SEQ ID NO: 3098375 - RNA, 14 nt, Molluscum contagiosum virus
uuguguuggccagg

SEQ ID NO: 3098376 - RNA, 13 nt, Molluscum contagiosum virus
gucgcgcagcugc

SEQ ID NO: 3098377 - RNA, 21 nt, Molluscum contagiosum virus
caucgggcugcagcccuucca

SEQ ID NO: 3098378 - RNA, 20 nt, Molluscum contagiosum virus
cuuccggcagcuggagcugc

SEQ ID NO: 3098379 - RNA, 18 nt, Molluscum contagiosum virus
guggcacccuggcugcug

SEQ ID NO: 3098380 - RNA, 15 nt, Molluscum contagiosum virus
ggcgcgguccagccg

SEQ ID NO: 3098381 - RNA, 11 nt, Molluscum contagiosum virus
cuggcuccugu

SEQ ID NO: 3098382 - RNA, 15 nt, Molluscum contagiosum virus
cgccagccugcuggc

SEQ ID NO: 3098383 - RNA, 18 nt, Molluscum contagiosum virus
uccacggguagcagcgcc

SEQ ID NO: 3098384 - RNA, 16 nt, Molluscum contagiosum virus
cccauuagugugccuc

SEQ ID NO: 3098385 - RNA, 20 nt, Molluscum contagiosum virus
gcaagugggcgucgaccugg

SEQ ID NO: 3098386 - RNA, 15 nt, Molluscum contagiosum virus
gcgcaaaccucugag

SEQ ID NO: 3098387 - RNA, 17 nt, Molluscum contagiosum virus
ugugacaacaugugauc

SEQ ID NO: 3098388 - RNA, 17 nt, Molluscum contagiosum virus
cgauaacaucugcuaua

SEQ ID NO: 3098389 - RNA, 13 nt, Molluscum contagiosum virus
aggucgaggaggg

SEQ ID NO: 3098390 - RNA, 22 nt, Molluscum contagiosum virus
agcucgugccugucggcacauc

SEQ ID NO: 3098391 - RNA, 18 nt, Molluscum contagiosum virus
gaagucguuaggcggcuc

SEQ ID NO: 3098392 - RNA, 17 nt, Molluscum contagiosum virus
cacaguucggccgcacg

SEQ ID NO: 3098393 - RNA, 15 nt, Molluscum contagiosum virus
ccucuacaccagcug

SEQ ID NO: 3098394 - RNA, 21 nt, Molluscum contagiosum virus
cagcagcggcgcgugcuccuc

SEQ ID NO: 3098395 - RNA, 13 nt, Molluscum contagiosum virus
cagacuaggcaau

SEQ ID NO: 3098396 - RNA, 15 nt, Molluscum contagiosum virus
ccggcagcuggagcu

SEQ ID NO: 3098397 - RNA, 21 nt, Molluscum contagiosum virus
acgcggcucuggagcggccac

SEQ ID NO: 3098398 - RNA, 18 nt, Molluscum contagiosum virus
gcccgaguuugcccgcgg

SEQ ID NO: 3098399 - RNA, 18 nt, Molluscum contagiosum virus
gccccaaaagugaagauc

SEQ ID NO: 3098400 - RNA, 17 nt, Molluscum contagiosum virus
gacgcgcagcucgacgc

SEQ ID NO: 3098401 - RNA, 20 nt, Molluscum contagiosum virus
cgugcuccacgcgcagcuuc

SEQ ID NO: 3098402 - RNA, 19 nt, Molluscum contagiosum virus
aaagcccuccugagaagca

SEQ ID NO: 3098403 - RNA, 14 nt, Molluscum contagiosum virus
cgccgguuugcuaa

SEQ ID NO: 3098404 - RNA, 17 nt, Molluscum contagiosum virus
aagcucgaggcgcuugg

SEQ ID NO: 3098405 - RNA, 21 nt, Molluscum contagiosum virus
gcgcgcacgaacgcaacucgc

SEQ ID NO: 3098406 - RNA, 23 nt, Molluscum contagiosum virus
aggaaaggcaccccgaaggaaag

SEQ ID NO: 3098407 - RNA, 14 nt, Molluscum contagiosum virus
cgaggccugcgugg

SEQ ID NO: 3098408 - RNA, 21 nt, Molluscum contagiosum virus
ccaaucccaguaguggcggca

SEQ ID NO: 3098409 - RNA, 17 nt, Molluscum contagiosum virus
gcacccaccaggaacag

SEQ ID NO: 3098410 - RNA, 18 nt, Molluscum contagiosum virus
ccagcgggaaacugcugc

SEQ ID NO: 3098411 - RNA, 13 nt, Molluscum contagiosum virus
caagccagagcuu

SEQ ID NO: 3098412 - RNA, 16 nt, Molluscum contagiosum virus
cugcaucuagccuccu

SEQ ID NO: 3098413 - RNA, 23 nt, Molluscum contagiosum virus
gcgccgaaacacggccuccagca

SEQ ID NO: 3098414 - RNA, 13 nt, Molluscum contagiosum virus
cgcggggcuccuc

SEQ ID NO: 3098415 - RNA, 16 nt, Molluscum contagiosum virus
cgaagcccagcuucag

SEQ ID NO: 3098416 - RNA, 19 nt, Molluscum contagiosum virus
agggcagcucaagcugcuc

SEQ ID NO: 3098417 - RNA, 16 nt, Molluscum contagiosum virus
gcuggcggggcuggca

SEQ ID NO: 3098418 - RNA, 18 nt, Molluscum contagiosum virus
ucaacuguugccuggagg

SEQ ID NO: 3098419 - RNA, 14 nt, Molluscum contagiosum virus
cgcggcgcucugcc

SEQ ID NO: 3098420 - RNA, 15 nt, Molluscum contagiosum virus
gcagcucuuccacga

SEQ ID NO: 3098421 - RNA, 21 nt, Molluscum contagiosum virus
uucccgaggcguccagcggcu

SEQ ID NO: 3098422 - RNA, 17 nt, Molluscum contagiosum virus
gcgcacgaccacgugca

SEQ ID NO: 3098423 - RNA, 13 nt, Molluscum contagiosum virus
aacacgagacuga

SEQ ID NO: 3098424 - RNA, 13 nt, Molluscum contagiosum virus
gauuucgcgcagc

SEQ ID NO: 3098425 - RNA, 16 nt, Molluscum contagiosum virus
ugcccgaguuugcccg

SEQ ID NO: 3098426 - RNA, 15 nt, Molluscum contagiosum virus
gcgucugggugccca

SEQ ID NO: 3098427 - RNA, 19 nt, Molluscum contagiosum virus
gcaggaucggagcgcagcu

SEQ ID NO: 3098428 - RNA, 21 nt, Molluscum contagiosum virus
gcgguguccuugcgccgccaa

SEQ ID NO: 3098429 - RNA, 16 nt, Molluscum contagiosum virus
ccucggcgcacacucc

SEQ ID NO: 3098430 - RNA, 15 nt, Molluscum contagiosum virus
ccggcagugcuugcu

SEQ ID NO: 3098431 - RNA, 18 nt, Molluscum contagiosum virus
cgcgcgucgagggcgccg

SEQ ID NO: 3098432 - RNA, 16 nt, Molluscum contagiosum virus
ccccgcgcgcagcgcg

SEQ ID NO: 3098433 - RNA, 16 nt, Molluscum contagiosum virus
uacacgcagagccagc

SEQ ID NO: 3098434 - RNA, 12 nt, Molluscum contagiosum virus
auaccugugcca

SEQ ID NO: 3098435 - RNA, 14 nt, Molluscum contagiosum virus
cccugcccgcguga

SEQ ID NO: 3098436 - RNA, 18 nt, Molluscum contagiosum virus
gcacgaagcuacgcuccg

SEQ ID NO: 3098437 - RNA, 16 nt, Molluscum contagiosum virus
ccgugaacgaggcugc

SEQ ID NO: 3098438 - RNA, 14 nt, Molluscum contagiosum virus
gcggcuggaccugc

SEQ ID NO: 3098439 - RNA, 12 nt, Molluscum contagiosum virus
ugcgaggccugc

SEQ ID NO: 3098440 - RNA, 15 nt, Molluscum contagiosum virus
gagcuuaauuuugca

SEQ ID NO: 3098441 - RNA, 14 nt, Molluscum contagiosum virus
guagcaaggggucu

SEQ ID NO: 3098442 - RNA, 16 nt, Molluscum contagiosum virus
gacccucuucgacuua

SEQ ID NO: 3098443 - RNA, 18 nt, Molluscum contagiosum virus
caagcugagcgcgcugcg

SEQ ID NO: 3098444 - RNA, 14 nt, Molluscum contagiosum virus
gaagugugccugcu

SEQ ID NO: 3098445 - RNA, 16 nt, Molluscum contagiosum virus
ccuuccgcgcgggcau

SEQ ID NO: 3098446 - RNA, 11 nt, Molluscum contagiosum virus
cuccugaugcc

SEQ ID NO: 3098447 - RNA, 23 nt, Molluscum contagiosum virus
aaggcauccucgccgaacggcag

SEQ ID NO: 3098448 - RNA, 16 nt, Molluscum contagiosum virus
cgcgcgcucagcgccg

SEQ ID NO: 3098449 - RNA, 14 nt, Molluscum contagiosum virus
uccggccuguaaau

SEQ ID NO: 3098450 - RNA, 19 nt, Molluscum contagiosum virus
gcacgagcgcgggcgcccg

SEQ ID NO: 3098451 - RNA, 18 nt, Molluscum contagiosum virus
cccuccagguccuccagc

SEQ ID NO: 3098452 - RNA, 14 nt, Molluscum contagiosum virus
gaggcucuguucug

SEQ ID NO: 3098453 - RNA, 14 nt, Molluscum contagiosum virus
gcagcgcgccacca

SEQ ID NO: 3098454 - RNA, 20 nt, Molluscum contagiosum virus
acaaggaaaggcacccacca

SEQ ID NO: 3098455 - RNA, 17 nt, Molluscum contagiosum virus
cacggcgagcugccaug

SEQ ID NO: 3098456 - RNA, 14 nt, Molluscum contagiosum virus
cgucgcggagcgcg

SEQ ID NO: 3098457 - RNA, 22 nt, Molluscum contagiosum virus
gugcugcgucacaagcaccgcc

SEQ ID NO: 3098458 - RNA, 12 nt, Molluscum contagiosum virus
gugcugugccua

SEQ ID NO: 3098459 - RNA, 22 nt, Molluscum contagiosum virus
ggcucuguucugcuuggacgac

SEQ ID NO: 3098460 - RNA, 22 nt, Molluscum contagiosum virus
cgcgcgcucugccgcccgcgcc

SEQ ID NO: 3098461 - RNA, 20 nt, Molluscum contagiosum virus
gcccgggcguagccuagcca

SEQ ID NO: 3098462 - RNA, 14 nt, Molluscum contagiosum virus
gugcguacccuggc

SEQ ID NO: 3098463 - RNA, 15 nt, Molluscum contagiosum virus
acggugcagccgcug

SEQ ID NO: 3098464 - RNA, 14 nt, Molluscum contagiosum virus
gguuccgugcgcuc

SEQ ID NO: 3098465 - RNA, 18 nt, Molluscum contagiosum virus
gcgcaagucaccgcuccg

SEQ ID NO: 3098466 - RNA, 23 nt, Molluscum contagiosum virus
cgggcacauccgcuaccuggugg

SEQ ID NO: 3098467 - RNA, 18 nt, Molluscum contagiosum virus
ccuccgcacacgcgcgcg

SEQ ID NO: 3098468 - RNA, 20 nt, Molluscum contagiosum virus
cacgcaacgucgcacuggcc

SEQ ID NO: 3098469 - RNA, 18 nt, Molluscum contagiosum virus
cggcgccaccggcagugc

SEQ ID NO: 3098470 - RNA, 22 nt, Molluscum contagiosum virus
caucaugggcucgggcaagacc

SEQ ID NO: 3098471 - RNA, 18 nt, Molluscum contagiosum virus
gcacagcacaggccccag

SEQ ID NO: 3098472 - RNA, 13 nt, Molluscum contagiosum virus
gccaucaauucaa

SEQ ID NO: 3098473 - RNA, 20 nt, Molluscum contagiosum virus
gcgcgugccuguggcgcaca

SEQ ID NO: 3098474 - RNA, 18 nt, Molluscum contagiosum virus
aucgagaugcucaagcac

SEQ ID NO: 3098475 - RNA, 15 nt, Molluscum contagiosum virus
gcucgaggugugccu

SEQ ID NO: 3098476 - RNA, 13 nt, Molluscum contagiosum virus
ccagcagcgccag

SEQ ID NO: 3098477 - RNA, 19 nt, Molluscum contagiosum virus
gaagcaacgacaaggaaag

SEQ ID NO: 3098478 - RNA, 14 nt, Molluscum contagiosum virus
ccggagacaccagc

SEQ ID NO: 3098479 - RNA, 21 nt, Molluscum contagiosum virus
gcgauccuugcguacuuggaa

SEQ ID NO: 3098480 - RNA, 17 nt, Molluscum contagiosum virus
accgccgcggccgcgag

SEQ ID NO: 3098481 - RNA, 21 nt, Molluscum contagiosum virus
gcgcacacgcgucgggaagug

SEQ ID NO: 3098482 - RNA, 23 nt, Molluscum contagiosum virus
ggaguacagccgcgcggcagaca

SEQ ID NO: 3098483 - RNA, 14 nt, Molluscum contagiosum virus
ccuaccgcgcggga

SEQ ID NO: 3098484 - RNA, 12 nt, Molluscum contagiosum virus
cgccuggagcgc

SEQ ID NO: 3098485 - RNA, 19 nt, Molluscum contagiosum virus
gaucauggcgccgcugcgg

SEQ ID NO: 3098486 - RNA, 15 nt, Molluscum contagiosum virus
ugcugguucugcucg

SEQ ID NO: 3098487 - RNA, 18 nt, Molluscum contagiosum virus
gccugccgcgcaugcugg

SEQ ID NO: 3098488 - RNA, 22 nt, Molluscum contagiosum virus
gacaugcugugcggcacgccug

SEQ ID NO: 3098489 - RNA, 13 nt, Molluscum contagiosum virus
cggcaggcucccg

SEQ ID NO: 3098490 - RNA, 13 nt, Molluscum contagiosum virus
cggugggcgccgc

SEQ ID NO: 3098491 - RNA, 15 nt, Molluscum contagiosum virus
ucgcggagggcagca

SEQ ID NO: 3098492 - RNA, 21 nt, Molluscum contagiosum virus
gacagcaagcagcgcgcgcag

SEQ ID NO: 3098493 - RNA, 15 nt, Molluscum contagiosum virus
gccaccgcgcccuuu

SEQ ID NO: 3098494 - RNA, 19 nt, Molluscum contagiosum virus
cagccgcguagcuagcucu

SEQ ID NO: 3098495 - RNA, 16 nt, Molluscum contagiosum virus
ccaguaccugcugccg

SEQ ID NO: 3098496 - RNA, 13 nt, Molluscum contagiosum virus
gccuuccugcugg

SEQ ID NO: 3098497 - RNA, 17 nt, Molluscum contagiosum virus
cuagugcacgcccuuau

SEQ ID NO: 3098498 - RNA, 22 nt, Molluscum contagiosum virus
cugcaacucgcgcugcagcacc

SEQ ID NO: 3098499 - RNA, 16 nt, Molluscum contagiosum virus
gugucuggagcccacg

SEQ ID NO: 3098500 - RNA, 15 nt, Molluscum contagiosum virus
accacguggaccuga

SEQ ID NO: 3098501 - RNA, 16 nt, Molluscum contagiosum virus
cguggcgagcaucugc

SEQ ID NO: 3098502 - RNA, 15 nt, Molluscum contagiosum virus
cgggcuucgccgccg

SEQ ID NO: 3098503 - RNA, 17 nt, Molluscum contagiosum virus
cgagaccuuccuccagg

SEQ ID NO: 3098504 - RNA, 21 nt, Molluscum contagiosum virus
agaagacauugccuuuugcac

SEQ ID NO: 3098505 - RNA, 21 nt, Molluscum contagiosum virus
ggcaacaacgucacgcucgag

SEQ ID NO: 3098506 - RNA, 12 nt, Molluscum contagiosum virus
cgcggccgcggc

SEQ ID NO: 3098507 - RNA, 12 nt, Molluscum contagiosum virus
aggagcccuugc

SEQ ID NO: 3098508 - RNA, 20 nt, Molluscum contagiosum virus
acgcugcgcgugcugggccc

SEQ ID NO: 3098509 - RNA, 18 nt, Molluscum contagiosum virus
cgcggcuaccacgggccc

SEQ ID NO: 3098510 - RNA, 19 nt, Molluscum contagiosum virus
acccuuaauaaaaaaucaa

SEQ ID NO: 3098511 - RNA, 20 nt, Molluscum contagiosum virus
gcgcccgcugcgcgcucugg

SEQ ID NO: 3098512 - RNA, 19 nt, Molluscum contagiosum virus
uguuggaagucguggccgu

SEQ ID NO: 3098513 - RNA, 15 nt, Molluscum contagiosum virus
gacgggcacgagcac

SEQ ID NO: 3098514 - RNA, 18 nt, Molluscum contagiosum virus
ccgcgcaaaagcacagca

SEQ ID NO: 3098515 - RNA, 14 nt, Molluscum contagiosum virus
caggaacaaggcca

SEQ ID NO: 3098516 - RNA, 23 nt, Molluscum contagiosum virus
caaccgcauguccacggacaugg

SEQ ID NO: 3098517 - RNA, 15 nt, Molluscum contagiosum virus
ccaggaacgccgcca

SEQ ID NO: 3098518 - RNA, 18 nt, Molluscum contagiosum virus
agguugcgcggggcaggc

SEQ ID NO: 3098519 - RNA, 17 nt, Molluscum contagiosum virus
gugcgcgacggcgagcu

SEQ ID NO: 3098520 - RNA, 15 nt, Molluscum contagiosum virus
uccgcccgcgcuucu

SEQ ID NO: 3098521 - RNA, 19 nt, Molluscum contagiosum virus
uagcgcgccgcaaagcuca

SEQ ID NO: 3098522 - RNA, 14 nt, Molluscum contagiosum virus
ucgcgcucuucccg

SEQ ID NO: 3098523 - RNA, 16 nt, Molluscum contagiosum virus
agucagaguccgaccc

SEQ ID NO: 3098524 - RNA, 14 nt, Molluscum contagiosum virus
gcuacucaggcgcg

SEQ ID NO: 3098525 - RNA, 22 nt, Molluscum contagiosum virus
cucgcgcaggucaucgacgagc

SEQ ID NO: 3098526 - RNA, 14 nt, Molluscum contagiosum virus
ggucucggcagcag

SEQ ID NO: 3098527 - RNA, 14 nt, Molluscum contagiosum virus
gcugcgcacgggcg

SEQ ID NO: 3098528 - RNA, 14 nt, Molluscum contagiosum virus
ggcgugcugugccu

SEQ ID NO: 3098529 - RNA, 14 nt, Molluscum contagiosum virus
caugcgcgcgcugc

SEQ ID NO: 3098530 - RNA, 21 nt, Molluscum contagiosum virus
ccuggcacuggcgcgcacgcg

SEQ ID NO: 3098531 - RNA, 13 nt, Molluscum contagiosum virus
uugcggcgccgcc

SEQ ID NO: 3098532 - RNA, 18 nt, Molluscum contagiosum virus
ccucccucgucgcgcuuc

SEQ ID NO: 3098533 - RNA, 17 nt, Molluscum contagiosum virus
uucaaguuugacaaggg

SEQ ID NO: 3098534 - RNA, 19 nt, Molluscum contagiosum virus
ucaacaagcugcuggcaca

SEQ ID NO: 3098535 - RNA, 12 nt, Molluscum contagiosum virus
augcccagccug

SEQ ID NO: 3098536 - RNA, 13 nt, Molluscum contagiosum virus
aucgcgcgcgggc

SEQ ID NO: 3098537 - RNA, 20 nt, Molluscum contagiosum virus
acaugcuucgcgcaaacaag

SEQ ID NO: 3098538 - RNA, 22 nt, Molluscum contagiosum virus
gccgucuccucucgcgaucugc

SEQ ID NO: 3098539 - RNA, 21 nt, Molluscum contagiosum virus
agugcgucgacguggagccug

SEQ ID NO: 3098540 - RNA, 15 nt, Molluscum contagiosum virus
cgccgccgcaggccc

SEQ ID NO: 3098541 - RNA, 21 nt, Molluscum contagiosum virus
cucgagcacgccuccaagaag

SEQ ID NO: 3098542 - RNA, 21 nt, Molluscum contagiosum virus
gccgacaacgcacccgcgcgg

SEQ ID NO: 3098543 - RNA, 17 nt, Molluscum contagiosum virus
cgcgcagaagcccgggu

SEQ ID NO: 3098544 - RNA, 15 nt, Molluscum contagiosum virus
ggaccugcugguggu

SEQ ID NO: 3098545 - RNA, 18 nt, Molluscum contagiosum virus
acgacaaggaaaggcacc

SEQ ID NO: 3098546 - RNA, 15 nt, Molluscum contagiosum virus
cacgcucgaggagga

SEQ ID NO: 3098547 - RNA, 17 nt, Molluscum contagiosum virus
ccugcggcugcggcgcg

SEQ ID NO: 3098548 - RNA, 20 nt, Molluscum contagiosum virus
caccaagaagcggcccugca

SEQ ID NO: 3098549 - RNA, 22 nt, Molluscum contagiosum virus
accagcgcggccguggcugcgg

SEQ ID NO: 3098550 - RNA, 18 nt, Molluscum contagiosum virus
gagcgcgcgccugcuggc

SEQ ID NO: 3098551 - RNA, 18 nt, Molluscum contagiosum virus
uagcagggcggcgccugc

SEQ ID NO: 3098552 - RNA, 18 nt, Molluscum contagiosum virus
cgcugccuggugcacaca

SEQ ID NO: 3098553 - RNA, 17 nt, Molluscum contagiosum virus
cguagcaaaugcgcugc

SEQ ID NO: 3098554 - RNA, 18 nt, Molluscum contagiosum virus
gccacgcagcuggcgggc

SEQ ID NO: 3098555 - RNA, 15 nt, Molluscum contagiosum virus
guaccuggugcgccc

SEQ ID NO: 3098556 - RNA, 23 nt, Molluscum contagiosum virus
cgcggcuagcaccgcaugggccc

SEQ ID NO: 3098557 - RNA, 11 nt, Molluscum contagiosum virus
uugugcugcug

SEQ ID NO: 3098558 - RNA, 13 nt, Molluscum contagiosum virus
cugccacaugcag

SEQ ID NO: 3098559 - RNA, 21 nt, Molluscum contagiosum virus
ugugcacgcuguccaggcgcu

SEQ ID NO: 3098560 - RNA, 14 nt, Molluscum contagiosum virus
ucaucgccagcauc

SEQ ID NO: 3098561 - RNA, 20 nt, Molluscum contagiosum virus
cugggaggacacgcgcacgc

SEQ ID NO: 3098562 - RNA, 22 nt, Molluscum contagiosum virus
ucucagagcuccgcgcaugcca

SEQ ID NO: 3098563 - RNA, 14 nt, Molluscum contagiosum virus
accaggaacaggga

SEQ ID NO: 3098564 - RNA, 19 nt, Molluscum contagiosum virus
cgcaugcggcaggcgcugc

SEQ ID NO: 3098565 - RNA, 23 nt, Molluscum contagiosum virus
cgggaacgaggaaaggcaccccg

SEQ ID NO: 3098566 - RNA, 18 nt, Molluscum contagiosum virus
gaccuuccuccagggcac

SEQ ID NO: 3098567 - RNA, 13 nt, Molluscum contagiosum virus
acaugcagcugca

SEQ ID NO: 3098568 - RNA, 19 nt, Molluscum contagiosum virus
cacuuccgugagcaguccc

SEQ ID NO: 3098569 - RNA, 17 nt, Molluscum contagiosum virus
uggcgcgcccggcgccc

SEQ ID NO: 3098570 - RNA, 21 nt, Molluscum contagiosum virus
cuugcuagcaacuugcucuac

SEQ ID NO: 3098571 - RNA, 17 nt, Molluscum contagiosum virus
cagcgcgcggagaucgc

SEQ ID NO: 3098572 - RNA, 16 nt, Molluscum contagiosum virus
gaggccagcacaagcc

SEQ ID NO: 3098573 - RNA, 22 nt, Molluscum contagiosum virus
gcacuggcuggcguucgacggc

SEQ ID NO: 3098574 - RNA, 14 nt, Molluscum contagiosum virus
ccccguccucgcuc

SEQ ID NO: 3098575 - RNA, 21 nt, Molluscum contagiosum virus
accgcggacuccuuucggugg

SEQ ID NO: 3098576 - RNA, 12 nt, Molluscum contagiosum virus
gcguccaugagc

SEQ ID NO: 3098577 - RNA, 15 nt, Molluscum contagiosum virus
acucgcgcugcagca

SEQ ID NO: 3098578 - RNA, 19 nt, Molluscum contagiosum virus
acuuccgcgcgcucuugca

SEQ ID NO: 3098579 - RNA, 19 nt, Molluscum contagiosum virus
ggcgguggcggcucugccg

SEQ ID NO: 3098580 - RNA, 20 nt, Molluscum contagiosum virus
cuacaccgagaucaugggcg

SEQ ID NO: 3098581 - RNA, 18 nt, Molluscum contagiosum virus
uggcggugcggcgcacgc

SEQ ID NO: 3098582 - RNA, 24 nt, Molluscum contagiosum virus
cagcaaaacugaauaaguauucgc

SEQ ID NO: 3098583 - RNA, 17 nt, Molluscum contagiosum virus
gcgcaaccgcgugcgug

SEQ ID NO: 3098584 - RNA, 17 nt, Molluscum contagiosum virus
ggcgcaccugcuagagc

SEQ ID NO: 3098585 - RNA, 23 nt, Molluscum contagiosum virus
cggcacgccgcucggcacugcug

SEQ ID NO: 3098586 - RNA, 13 nt, Molluscum contagiosum virus
cgagcagcugcug

SEQ ID NO: 3098587 - RNA, 20 nt, Molluscum contagiosum virus
cacgcugcucgugcugcucu

SEQ ID NO: 3098588 - RNA, 17 nt, Molluscum contagiosum virus
caucucgcagacgcagc

SEQ ID NO: 3098589 - RNA, 22 nt, Molluscum contagiosum virus
cuucccgacgucuuccccaaga

SEQ ID NO: 3098590 - RNA, 16 nt, Molluscum contagiosum virus
acgagcgcgugccgcu

SEQ ID NO: 3098591 - RNA, 14 nt, Molluscum contagiosum virus
gaguucaacacgca

SEQ ID NO: 3098592 - RNA, 12 nt, Molluscum contagiosum virus
ccgcgugcuggc

SEQ ID NO: 3098593 - RNA, 13 nt, Molluscum contagiosum virus
cgugucgagcugc

SEQ ID NO: 3098594 - RNA, 22 nt, Molluscum contagiosum virus
gaaacgcacagccccugcugcu

SEQ ID NO: 3098595 - RNA, 17 nt, Molluscum contagiosum virus
ggcguggccaggccgcg

SEQ ID NO: 3098596 - RNA, 19 nt, Molluscum contagiosum virus
cgccagcgcgcccaccagc

SEQ ID NO: 3098597 - RNA, 19 nt, Molluscum contagiosum virus
ucgccgaacggcagacccc

SEQ ID NO: 3098598 - RNA, 16 nt, Molluscum contagiosum virus
cggugaccggagcggc

SEQ ID NO: 3098599 - RNA, 17 nt, Molluscum contagiosum virus
ggcguccggugcucgcc

SEQ ID NO: 3098600 - RNA, 23 nt, Molluscum contagiosum virus
acaucuucgugcccacgcuggcg

SEQ ID NO: 3098601 - RNA, 16 nt, Molluscum contagiosum virus
cagcuacugcgugcga

SEQ ID NO: 3098602 - RNA, 13 nt, Molluscum contagiosum virus
gcgcgcgcgcagg

SEQ ID NO: 3098603 - RNA, 13 nt, Molluscum contagiosum virus
gcacccgcgcggc

SEQ ID NO: 3098604 - RNA, 18 nt, Molluscum contagiosum virus
augcucuacgugcugcag

SEQ ID NO: 3098605 - RNA, 21 nt, Molluscum contagiosum virus
cgucuggggauggccacggga

SEQ ID NO: 3098606 - RNA, 20 nt, Molluscum contagiosum virus
ggagcccuugaucgacaugg

SEQ ID NO: 3098607 - RNA, 19 nt, Molluscum contagiosum virus
gcgcgcacaagauggcgca

SEQ ID NO: 3098608 - RNA, 12 nt, Molluscum contagiosum virus
cuccgugcgcca

SEQ ID NO: 3098609 - RNA, 23 nt, Molluscum contagiosum virus
acuugagcaccaagaagcggccc

SEQ ID NO: 3098610 - RNA, 20 nt, Molluscum contagiosum virus
uuucgccggaggaaggacag

SEQ ID NO: 3098611 - RNA, 13 nt, Molluscum contagiosum virus
gccggcgaaccga

SEQ ID NO: 3098612 - RNA, 14 nt, Molluscum contagiosum virus
ugugccugcgcaac

SEQ ID NO: 3098613 - RNA, 16 nt, Molluscum contagiosum virus
ccgcgccuugagcgcg

SEQ ID NO: 3098614 - RNA, 16 nt, Molluscum contagiosum virus
cugcgcgagccgcugc

SEQ ID NO: 3098615 - RNA, 17 nt, Molluscum contagiosum virus
cucgugcugggccugcc

SEQ ID NO: 3098616 - RNA, 19 nt, Molluscum contagiosum virus
gaacucggcuucugcugca

SEQ ID NO: 3098617 - RNA, 20 nt, Molluscum contagiosum virus
gcucgggccggcgcgccgcg

SEQ ID NO: 3098618 - RNA, 13 nt, Molluscum contagiosum virus
cgcgccagcagcg

SEQ ID NO: 3098619 - RNA, 13 nt, Molluscum contagiosum virus
cgcggcagcagcc

SEQ ID NO: 3098620 - RNA, 23 nt, Molluscum contagiosum virus
uuccacgaccgcaagugcacgcg

SEQ ID NO: 3098621 - RNA, 19 nt, Molluscum contagiosum virus
agccucucucguggggagg

SEQ ID NO: 3098622 - RNA, 15 nt, Molluscum contagiosum virus
gcugccggcucaagc

SEQ ID NO: 3098623 - RNA, 13 nt, Molluscum contagiosum virus
uguccucuucaca

SEQ ID NO: 3098624 - RNA, 13 nt, Molluscum contagiosum virus
cagcggcgccgca

SEQ ID NO: 3098625 - RNA, 15 nt, Molluscum contagiosum virus
gauuguagagacgcu

SEQ ID NO: 3098626 - RNA, 15 nt, Molluscum contagiosum virus
caagcaguaccugcu

SEQ ID NO: 3098627 - RNA, 14 nt, Molluscum contagiosum virus
gcuggagcuggcug

SEQ ID NO: 3098628 - RNA, 23 nt, Molluscum contagiosum virus
ccaagaacagagaaaggcaccca

SEQ ID NO: 3098629 - RNA, 17 nt, Molluscum contagiosum virus
ggcaggccgcccacgcu

SEQ ID NO: 3098630 - RNA, 22 nt, Molluscum contagiosum virus
cucagcggcacugcgcgcaugc

SEQ ID NO: 3098631 - RNA, 17 nt, Molluscum contagiosum virus
caugugcgagaacuggc

SEQ ID NO: 3098632 - RNA, 18 nt, Molluscum contagiosum virus
cucugccaccgcggcgcg

SEQ ID NO: 3098633 - RNA, 21 nt, Molluscum contagiosum virus
ugcucccgguccuugcuccuc

SEQ ID NO: 3098634 - RNA, 19 nt, Molluscum contagiosum virus
augcuuuuguuacucucag

SEQ ID NO: 3098635 - RNA, 19 nt, Molluscum contagiosum virus
cugcgcaagcucagccucu

SEQ ID NO: 3098636 - RNA, 20 nt, Molluscum contagiosum virus
uggcguccgcacgaggagcc

SEQ ID NO: 3098637 - RNA, 23 nt, Molluscum contagiosum virus
cacgcugcucgugcugcucugcg

SEQ ID NO: 3098638 - RNA, 15 nt, Molluscum contagiosum virus
gccgcucggcccgcg

SEQ ID NO: 3098639 - RNA, 17 nt, Molluscum contagiosum virus
gugcugucccucugugc

SEQ ID NO: 3098640 - RNA, 21 nt, Molluscum contagiosum virus
agcgcaggcaguugccgcagc

SEQ ID NO: 3098641 - RNA, 20 nt, Molluscum contagiosum virus
cgccgaggacuaccuggcgg

SEQ ID NO: 3098642 - RNA, 14 nt, Molluscum contagiosum virus
cuggccgaugccua

SEQ ID NO: 3098643 - RNA, 16 nt, Molluscum contagiosum virus
cagccucgagcgccgu

SEQ ID NO: 3098644 - RNA, 18 nt, Molluscum contagiosum virus
cggcgcgccgcacgcugc

SEQ ID NO: 3098645 - RNA, 20 nt, Molluscum contagiosum virus
ccgcgcccgacucgcagcuc

SEQ ID NO: 3098646 - RNA, 13 nt, Molluscum contagiosum virus
gcgcugcuggugc

SEQ ID NO: 3098647 - RNA, 20 nt, Molluscum contagiosum virus
gcacgugcagcggcgccacg

SEQ ID NO: 3098648 - RNA, 23 nt, Molluscum contagiosum virus
guggccaaagucuuccuggggcu

SEQ ID NO: 3098649 - RNA, 22 nt, Molluscum contagiosum virus
cgccaaccaccacguggaccug

SEQ ID NO: 3098650 - RNA, 15 nt, Molluscum contagiosum virus
gcuugccccucgucc

SEQ ID NO: 3098651 - RNA, 20 nt, Molluscum contagiosum virus
cgccuggccgaacugcucug

SEQ ID NO: 3098652 - RNA, 15 nt, Molluscum contagiosum virus
gaagaguuggacagc

SEQ ID NO: 3098653 - RNA, 18 nt, Molluscum contagiosum virus
cggcucuggagcggccac

SEQ ID NO: 3098654 - RNA, 15 nt, Molluscum contagiosum virus
cgcacgaccacgcug

SEQ ID NO: 3098655 - RNA, 22 nt, Molluscum contagiosum virus
gacucucguucuuccggcagcg

SEQ ID NO: 3098656 - RNA, 13 nt, Molluscum contagiosum virus
ccccccuucuguc

SEQ ID NO: 3098657 - RNA, 22 nt, Molluscum contagiosum virus
ccgcgcgcgacuacgcacuggc

SEQ ID NO: 3098658 - RNA, 13 nt, Molluscum contagiosum virus
gccugcugcucuu

SEQ ID NO: 3098659 - RNA, 15 nt, Molluscum contagiosum virus
gcgagccagccaggc

SEQ ID NO: 3098660 - RNA, 17 nt, Molluscum contagiosum virus
aguacugcagcagcucc

SEQ ID NO: 3098661 - RNA, 18 nt, Molluscum contagiosum virus
gccgccuuugcgcugucu

SEQ ID NO: 3098662 - RNA, 19 nt, Molluscum contagiosum virus
cuccgggcacguccgccuc

SEQ ID NO: 3098663 - RNA, 13 nt, Molluscum contagiosum virus
caugaggcagugc

SEQ ID NO: 3098664 - RNA, 21 nt, Molluscum contagiosum virus
gaucucgcgcacgaccacgug

SEQ ID NO: 3098665 - RNA, 15 nt, Molluscum contagiosum virus
ccugcacuacugcuc

SEQ ID NO: 3098666 - RNA, 15 nt, Molluscum contagiosum virus
gcaccggcagcgcga

SEQ ID NO: 3098667 - RNA, 14 nt, Molluscum contagiosum virus
cuccuaucucaaag

SEQ ID NO: 3098668 - RNA, 21 nt, Molluscum contagiosum virus
gggcaagcgccgccaugcugc

SEQ ID NO: 3098669 - RNA, 22 nt, Molluscum contagiosum virus
uggagggcagugccaagguucu

SEQ ID NO: 3098670 - RNA, 23 nt, Molluscum contagiosum virus
agaaaggcacccaccaggaacag

SEQ ID NO: 3098671 - RNA, 20 nt, Molluscum contagiosum virus
cgagcugcuaacaacaugag

SEQ ID NO: 3098672 - RNA, 22 nt, Molluscum contagiosum virus
cucgcagcguuccaggaacgcc

SEQ ID NO: 3098673 - RNA, 16 nt, Molluscum contagiosum virus
gccugccagcgccagc

SEQ ID NO: 3098674 - RNA, 18 nt, Molluscum contagiosum virus
gcugggcgugggcagccg

SEQ ID NO: 3098675 - RNA, 14 nt, Molluscum contagiosum virus
acucaacaagcugc

SEQ ID NO: 3098676 - RNA, 13 nt, Molluscum contagiosum virus
cgcgucugcucuc

SEQ ID NO: 3098677 - RNA, 12 nt, Molluscum contagiosum virus
guaccuggugcg

SEQ ID NO: 3098678 - RNA, 16 nt, Molluscum contagiosum virus
caaaugcgcugcucgc

SEQ ID NO: 3098679 - RNA, 15 nt, Molluscum contagiosum virus
ccaacuaccuggggc

SEQ ID NO: 3098680 - RNA, 15 nt, Molluscum contagiosum virus
ugcgcgugcugggcc

SEQ ID NO: 3098681 - RNA, 20 nt, Molluscum contagiosum virus
cuuccucuacaccagcugga

SEQ ID NO: 3098682 - RNA, 21 nt, Molluscum contagiosum virus
uggagcagacguacgagcagg

SEQ ID NO: 3098683 - RNA, 13 nt, Molluscum contagiosum virus
gcacgugcugcgc

SEQ ID NO: 3098684 - RNA, 16 nt, Molluscum contagiosum virus
ucuuucccgggcacug

SEQ ID NO: 3098685 - RNA, 17 nt, Molluscum contagiosum virus
gaucaccccgcagcuca

SEQ ID NO: 3098686 - RNA, 14 nt, Molluscum contagiosum virus
cgcguucacaaagg

SEQ ID NO: 3098687 - RNA, 22 nt, Molluscum contagiosum virus
aagacguggacgaggccaaccu

SEQ ID NO: 3098688 - RNA, 22 nt, Molluscum contagiosum virus
aaagggcugcuugcgaccccag

SEQ ID NO: 3098689 - RNA, 18 nt, Molluscum contagiosum virus
cagcgggaaacugcugcc

SEQ ID NO: 3098690 - RNA, 18 nt, Molluscum contagiosum virus
caccugcaucgcgccgcc

SEQ ID NO: 3098691 - RNA, 22 nt, Molluscum contagiosum virus
uccgacggaacgagccugccgc

SEQ ID NO: 3098692 - RNA, 15 nt, Molluscum contagiosum virus
accaccaccagcacg

SEQ ID NO: 3098693 - RNA, 15 nt, Molluscum contagiosum virus
gaggagaaaguaaau

SEQ ID NO: 3098694 - RNA, 21 nt, Molluscum contagiosum virus
acacuugcgcguucgcaaaga

SEQ ID NO: 3098695 - RNA, 16 nt, Molluscum contagiosum virus
cugcucgcgcgcgcac

SEQ ID NO: 3098696 - RNA, 22 nt, Molluscum contagiosum virus
gacuccaaggaggucccuagcc

SEQ ID NO: 3098697 - RNA, 16 nt, Molluscum contagiosum virus
agcgcuggagcuggcu

SEQ ID NO: 3098698 - RNA, 15 nt, Molluscum contagiosum virus
cggcgggggcagcag

SEQ ID NO: 3098699 - RNA, 14 nt, Molluscum contagiosum virus
ggcgcggcugcucg

SEQ ID NO: 3098700 - RNA, 20 nt, Molluscum contagiosum virus
cugcgcacgcuugugcgcac

SEQ ID NO: 3098701 - RNA, 22 nt, Molluscum contagiosum virus
cagauucggaggcggagcugcc

SEQ ID NO: 3098702 - RNA, 18 nt, Molluscum contagiosum virus
ucuccaggaacgcgccgc

SEQ ID NO: 3098703 - RNA, 18 nt, Molluscum contagiosum virus
cccuugauccaggcccgu

SEQ ID NO: 3098704 - RNA, 19 nt, Molluscum contagiosum virus
gaaguccaucggugggcuc

SEQ ID NO: 3098705 - RNA, 13 nt, Molluscum contagiosum virus
guggcgcugugcg

SEQ ID NO: 3098706 - RNA, 23 nt, Molluscum contagiosum virus
gucuugccgaagccgcaggccag

SEQ ID NO: 3098707 - RNA, 15 nt, Molluscum contagiosum virus
ccagcuccgccggga

SEQ ID NO: 3098708 - RNA, 19 nt, Molluscum contagiosum virus
gguuguagcgguugaccag

SEQ ID NO: 3098709 - RNA, 14 nt, Molluscum contagiosum virus
ccaccaggaacagg

SEQ ID NO: 3098710 - RNA, 14 nt, Molluscum contagiosum virus
aagugacuagcgcu

SEQ ID NO: 3098711 - RNA, 16 nt, Molluscum contagiosum virus
gccgcgucguagcaaa

SEQ ID NO: 3098712 - RNA, 18 nt, Molluscum contagiosum virus
cgacuugcugcggagcgc

SEQ ID NO: 3098713 - RNA, 20 nt, Molluscum contagiosum virus
ucgagcgcgcgccugcuggc

SEQ ID NO: 3098714 - RNA, 16 nt, Molluscum contagiosum virus
acgcuguugcugcugc

SEQ ID NO: 3098715 - RNA, 15 nt, Molluscum contagiosum virus
caaacgcuguuuuca

SEQ ID NO: 3098716 - RNA, 15 nt, Molluscum contagiosum virus
cguccuguagcaagg

SEQ ID NO: 3098717 - RNA, 24 nt, Molluscum contagiosum virus
acucgcagcucacgagauggcugc

SEQ ID NO: 3098718 - RNA, 18 nt, Molluscum contagiosum virus
gcggcgcaagcaccggca

SEQ ID NO: 3098719 - RNA, 13 nt, Molluscum contagiosum virus
acugcaagaucua

SEQ ID NO: 3098720 - RNA, 21 nt, Molluscum contagiosum virus
cggccugcacggcuaccgcga

SEQ ID NO: 3098721 - RNA, 14 nt, Molluscum contagiosum virus
acgucguagcgcuc

SEQ ID NO: 3098722 - RNA, 16 nt, Molluscum contagiosum virus
gcaaagacgagggaug

SEQ ID NO: 3098723 - RNA, 14 nt, Molluscum contagiosum virus
cggugcucgccccu

SEQ ID NO: 3098724 - RNA, 20 nt, Molluscum contagiosum virus
cgucuucacuccgcacagcu

SEQ ID NO: 3098725 - RNA, 16 nt, Molluscum contagiosum virus
aaauaugaaccacuuc

SEQ ID NO: 3098726 - RNA, 24 nt, Molluscum contagiosum virus
cagccugcuggcaccgcgcgcgcu

SEQ ID NO: 3098727 - RNA, 20 nt, Molluscum contagiosum virus
gcgcuggaugcugcucgacg

SEQ ID NO: 3098728 - RNA, 18 nt, Molluscum contagiosum virus
cauuuucucuggagagcg

SEQ ID NO: 3098729 - RNA, 16 nt, Molluscum contagiosum virus
ccaagucgcgcucuuc

SEQ ID NO: 3098730 - RNA, 17 nt, Molluscum contagiosum virus
ccgaagcaaaagcgcuc

SEQ ID NO: 3098731 - RNA, 18 nt, Molluscum contagiosum virus
cuggcucgcgccugcgcu

SEQ ID NO: 3098732 - RNA, 22 nt, Molluscum contagiosum virus
cggacgaucuuacaggccaccg

SEQ ID NO: 3098733 - RNA, 21 nt, Molluscum contagiosum virus
cacgcgacggugugccgcugg

SEQ ID NO: 3098734 - RNA, 16 nt, Molluscum contagiosum virus
cggaugcaggcacugc

SEQ ID NO: 3098735 - RNA, 18 nt, Molluscum contagiosum virus
cgacggcgugcuggccag

SEQ ID NO: 3098736 - RNA, 13 nt, Molluscum contagiosum virus
cgcagccacgacu

SEQ ID NO: 3098737 - RNA, 21 nt, Molluscum contagiosum virus
gcacugccgcguccucagguu

SEQ ID NO: 3098738 - RNA, 17 nt, Molluscum contagiosum virus
ucaacucguaggacaac

SEQ ID NO: 3098739 - RNA, 19 nt, Molluscum contagiosum virus
cgcgcacgcucucgcuggc

SEQ ID NO: 3098740 - RNA, 14 nt, Molluscum contagiosum virus
agcagcuccagcau

SEQ ID NO: 3098741 - RNA, 22 nt, Molluscum contagiosum virus
gcccggcaggcucccgcugucg

SEQ ID NO: 3098742 - RNA, 18 nt, Molluscum contagiosum virus
guucucuuuguuccugcg

SEQ ID NO: 3098743 - RNA, 17 nt, Molluscum contagiosum virus
cgcgagcguuucugccg

SEQ ID NO: 3098744 - RNA, 22 nt, Molluscum contagiosum virus
gucacgcugaucuucuaccugg

SEQ ID NO: 3098745 - RNA, 17 nt, Molluscum contagiosum virus
cggcaacugccugcgcu

SEQ ID NO: 3098746 - RNA, 17 nt, Molluscum contagiosum virus
acgcgcggcagcagccu

SEQ ID NO: 3098747 - RNA, 14 nt, Molluscum contagiosum virus
cgcuggcuccgcug

SEQ ID NO: 3098748 - RNA, 13 nt, Molluscum contagiosum virus
aagacuggcucag

SEQ ID NO: 3098749 - RNA, 16 nt, Molluscum contagiosum virus
ucaggagcauggccgc

SEQ ID NO: 3098750 - RNA, 17 nt, Molluscum contagiosum virus
agcgcgcccaccagcag

SEQ ID NO: 3098751 - RNA, 21 nt, Molluscum contagiosum virus
acgcgugccuggcuugcgcgc

SEQ ID NO: 3098752 - RNA, 14 nt, Molluscum contagiosum virus
gcaaccagcugcug

SEQ ID NO: 3098753 - RNA, 15 nt, Molluscum contagiosum virus
aagcucaagcccggc

SEQ ID NO: 3098754 - RNA, 19 nt, Molluscum contagiosum virus
ggaugccacgcagcuggcg

SEQ ID NO: 3098755 - RNA, 13 nt, Molluscum contagiosum virus
ggcucgccaugcu

SEQ ID NO: 3098756 - RNA, 21 nt, Molluscum contagiosum virus
cgugcuuacggacaggaugcc

SEQ ID NO: 3098757 - RNA, 11 nt, Molluscum contagiosum virus
cacgagcugcu

SEQ ID NO: 3098758 - RNA, 16 nt, Molluscum contagiosum virus
cgagcacgagcauucc

SEQ ID NO: 3098759 - RNA, 17 nt, Molluscum contagiosum virus
gcaaggcgcgcgcuggc

SEQ ID NO: 3098760 - RNA, 15 nt, Molluscum contagiosum virus
ccgagcagcggggac

SEQ ID NO: 3098761 - RNA, 18 nt, Molluscum contagiosum virus
cuccuggucuucccgcug

SEQ ID NO: 3098762 - RNA, 17 nt, Molluscum contagiosum virus
gcccgugcuugcgcacg

SEQ ID NO: 3098763 - RNA, 13 nt, Molluscum contagiosum virus
ugcgacugccagc

SEQ ID NO: 3098764 - RNA, 20 nt, Molluscum contagiosum virus
auaaggcgguggcggcucug

SEQ ID NO: 3098765 - RNA, 18 nt, Molluscum contagiosum virus
ugcgcuuuuuuuguccug

SEQ ID NO: 3098766 - RNA, 19 nt, Molluscum contagiosum virus
ccacaugaccaagcacauu

SEQ ID NO: 3098767 - RNA, 14 nt, Molluscum contagiosum virus
agcccgcccccgag

SEQ ID NO: 3098768 - RNA, 16 nt, Molluscum contagiosum virus
gccgagccgcuggccg

SEQ ID NO: 3098769 - RNA, 20 nt, Molluscum contagiosum virus
cugcaacucgcgcugcagca

SEQ ID NO: 3098770 - RNA, 23 nt, Molluscum contagiosum virus
ucaccagcuacgagccgcugcuc

SEQ ID NO: 3098771 - RNA, 17 nt, Molluscum contagiosum virus
cggcuccuugagaauca

SEQ ID NO: 3098772 - RNA, 21 nt, Molluscum contagiosum virus
gccgcgugcaugcccagcaug

SEQ ID NO: 3098773 - RNA, 16 nt, Molluscum contagiosum virus
ccgcggcgugcccguc

SEQ ID NO: 3098774 - RNA, 16 nt, Molluscum contagiosum virus
cgagcgcgucugcucu

SEQ ID NO: 3098775 - RNA, 19 nt, Molluscum contagiosum virus
cguagcggacgaagcugug

SEQ ID NO: 3098776 - RNA, 13 nt, Molluscum contagiosum virus
ucggagaagaaca

SEQ ID NO: 3098777 - RNA, 22 nt, Molluscum contagiosum virus
cgcgcguguuugugcugucccu

SEQ ID NO: 3098778 - RNA, 15 nt, Molluscum contagiosum virus
cgagaacuggcgcag

SEQ ID NO: 3098779 - RNA, 22 nt, Molluscum contagiosum virus
ucggcggcaugcgcgcgcagca

SEQ ID NO: 3098780 - RNA, 13 nt, Molluscum contagiosum virus
gugcgaaggcucg

SEQ ID NO: 3098781 - RNA, 17 nt, Molluscum contagiosum virus
uagugaaccgcauuugu

SEQ ID NO: 3098782 - RNA, 14 nt, Molluscum contagiosum virus
cgccugugccugca

SEQ ID NO: 3098783 - RNA, 14 nt, Molluscum contagiosum virus
acgagcccgcaaga

SEQ ID NO: 3098784 - RNA, 20 nt, Molluscum contagiosum virus
ccaaggacuucgagaccuac

SEQ ID NO: 3098785 - RNA, 19 nt, Molluscum contagiosum virus
gcugcucgugcugcucugc

SEQ ID NO: 3098786 - RNA, 18 nt, Molluscum contagiosum virus
cacgcuggcacggccggc

SEQ ID NO: 3098787 - RNA, 22 nt, Molluscum contagiosum virus
gcgcguaugcgaacagccgccg

SEQ ID NO: 3098788 - RNA, 20 nt, Molluscum contagiosum virus
gucgcguuccaggugcuggg

SEQ ID NO: 3098789 - RNA, 13 nt, Molluscum contagiosum virus
agcuggagcugcc

SEQ ID NO: 3098790 - RNA, 18 nt, Molluscum contagiosum virus
gagaccugucgugcaaug

SEQ ID NO: 3098791 - RNA, 20 nt, Molluscum contagiosum virus
gccugcugaagaaggagccc

SEQ ID NO: 3098792 - RNA, 21 nt, Molluscum contagiosum virus
cugcagcagcuccagcauggc

SEQ ID NO: 3098793 - RNA, 17 nt, Molluscum contagiosum virus
cggacaaaauggcugcg

SEQ ID NO: 3098794 - RNA, 13 nt, Molluscum contagiosum virus
cucucguggggag

SEQ ID NO: 3098795 - RNA, 12 nt, Molluscum contagiosum virus
acaccugugccc

SEQ ID NO: 3098796 - RNA, 23 nt, Molluscum contagiosum virus
ccgcggagaccaccgcuggggcg

SEQ ID NO: 3098797 - RNA, 15 nt, Molluscum contagiosum virus
aagaggggagccagc

SEQ ID NO: 3098798 - RNA, 15 nt, Molluscum contagiosum virus
guccggcgcuugccc

SEQ ID NO: 3098799 - RNA, 19 nt, Molluscum contagiosum virus
ccgcagcgcuggagcuggc

SEQ ID NO: 3098800 - RNA, 12 nt, Molluscum contagiosum virus
gcagcgugccgc

SEQ ID NO: 3098801 - RNA, 14 nt, Molluscum contagiosum virus
cuucugcaagcugc

SEQ ID NO: 3098802 - RNA, 11 nt, Molluscum contagiosum virus
ugccuggcagu

SEQ ID NO: 3098803 - RNA, 17 nt, Molluscum contagiosum virus
gccgcgccgcugcgccg

SEQ ID NO: 3098804 - RNA, 12 nt, Molluscum contagiosum virus
gcaaggccuggc

SEQ ID NO: 3098805 - RNA, 19 nt, Molluscum contagiosum virus
acuugcgcguccgcaaagc

SEQ ID NO: 3098806 - RNA, 17 nt, Molluscum contagiosum virus
acgaagacgaagcgcuc

SEQ ID NO: 3098807 - RNA, 19 nt, Molluscum contagiosum virus
ccucgccgaacggcagacc

SEQ ID NO: 3098808 - RNA, 21 nt, Molluscum contagiosum virus
ucucagggcagcgaaaaguag

SEQ ID NO: 3098809 - RNA, 18 nt, Molluscum contagiosum virus
ugucuugaugcuguuacu

SEQ ID NO: 3098810 - RNA, 15 nt, Molluscum contagiosum virus
acacacacacacucg

SEQ ID NO: 3098811 - RNA, 17 nt, Molluscum contagiosum virus
gcgacuagccugugccc

SEQ ID NO: 3098812 - RNA, 22 nt, Molluscum contagiosum virus
cggugcucgccccuccccggcg

SEQ ID NO: 3098813 - RNA, 14 nt, Molluscum contagiosum virus
cgugagcgcgcucu

SEQ ID NO: 3098814 - RNA, 17 nt, Molluscum contagiosum virus
auccuggggaaccgcug

SEQ ID NO: 3098815 - RNA, 22 nt, Molluscum contagiosum virus
gcugccggcaacgcugccgcug

SEQ ID NO: 3098816 - RNA, 21 nt, Molluscum contagiosum virus
ccaucaucgcgcugcucuucg

SEQ ID NO: 3098817 - RNA, 15 nt, Molluscum contagiosum virus
ugcacuuccaguaug

SEQ ID NO: 3098818 - RNA, 14 nt, Molluscum contagiosum virus
gcaagcgcaccuuu

SEQ ID NO: 3098819 - RNA, 23 nt, Molluscum contagiosum virus
cagcuuagcuuccgucugcugcu

SEQ ID NO: 3098820 - RNA, 14 nt, Molluscum contagiosum virus
gcagucgccuuccu

SEQ ID NO: 3098821 - RNA, 22 nt, Molluscum contagiosum virus
cgucagggaugccagugcagug

SEQ ID NO: 3098822 - RNA, 18 nt, Molluscum contagiosum virus
uauuuccggcuccggcuu

SEQ ID NO: 3098823 - RNA, 13 nt, Molluscum contagiosum virus
ggcucacagccgu

SEQ ID NO: 3098824 - RNA, 13 nt, Molluscum contagiosum virus
gccagcggcgccg

SEQ ID NO: 3098825 - RNA, 22 nt, Molluscum contagiosum virus
cacacucacgcguccacaaaga

SEQ ID NO: 3098826 - RNA, 23 nt, Molluscum contagiosum virus
cgccgcuggagcacgacuacggc

SEQ ID NO: 3098827 - RNA, 13 nt, Molluscum contagiosum virus
gcuugccgcuuga

SEQ ID NO: 3098828 - RNA, 19 nt, Molluscum contagiosum virus
cggguaguugcgagccagc

SEQ ID NO: 3098829 - RNA, 23 nt, Molluscum contagiosum virus
gccagcuuggugcgcucgagcuc

SEQ ID NO: 3098830 - RNA, 16 nt, Molluscum contagiosum virus
aggcauaccugugcca

SEQ ID NO: 3098831 - RNA, 13 nt, Molluscum contagiosum virus
gcacgcggcgcuc

SEQ ID NO: 3098832 - RNA, 16 nt, Molluscum contagiosum virus
gcacgcugcguuucca

SEQ ID NO: 3098833 - RNA, 21 nt, Molluscum contagiosum virus
gccagcgcgcccaccagcagc

SEQ ID NO: 3098834 - RNA, 20 nt, Molluscum contagiosum virus
cacgccgcagcgcuggagcu

SEQ ID NO: 3098835 - RNA, 23 nt, Molluscum contagiosum virus
ccgcgagcacguggacagcaucc

SEQ ID NO: 3098836 - RNA, 16 nt, Molluscum contagiosum virus
gcgcagcuguuucugc

SEQ ID NO: 3098837 - RNA, 18 nt, Molluscum contagiosum virus
gcguggcgcgcgagcugc

SEQ ID NO: 3098838 - RNA, 17 nt, Molluscum contagiosum virus
cugcgacagcugcugcu

SEQ ID NO: 3098839 - RNA, 22 nt, Molluscum contagiosum virus
ggcaagcgccgccaugcugcgc

SEQ ID NO: 3098840 - RNA, 17 nt, Molluscum contagiosum virus
aacugcccggcggcaag

SEQ ID NO: 3098841 - RNA, 18 nt, Molluscum contagiosum virus
cguggaaaagcagggccc

SEQ ID NO: 3098842 - RNA, 20 nt, Molluscum contagiosum virus
uccuugcuccucgcacgggc

SEQ ID NO: 3098843 - RNA, 15 nt, Molluscum contagiosum virus
agucacgaccgaccc

SEQ ID NO: 3098844 - RNA, 18 nt, Molluscum contagiosum virus
cacgccuucguggagccc

SEQ ID NO: 3098845 - RNA, 15 nt, Molluscum contagiosum virus
gccgcguugcagcag

SEQ ID NO: 3098846 - RNA, 16 nt, Molluscum contagiosum virus
gcgcccgacgagcuug

SEQ ID NO: 3098847 - RNA, 14 nt, Molluscum contagiosum virus
ccccgcgcugcgcg

SEQ ID NO: 3098848 - RNA, 19 nt, Molluscum contagiosum virus
ugcuagagcauauccugau

SEQ ID NO: 3098849 - RNA, 21 nt, Molluscum contagiosum virus
cgcgccuugcagcgcagcagc

SEQ ID NO: 3098850 - RNA, 21 nt, Molluscum contagiosum virus
uggagagcguacucgggccgc

SEQ ID NO: 3098851 - RNA, 13 nt, Molluscum contagiosum virus
uuggaggaggaag

SEQ ID NO: 3098852 - RNA, 23 nt, Molluscum contagiosum virus
agcugcccgaguuucggaagagc

SEQ ID NO: 3098853 - RNA, 18 nt, Molluscum contagiosum virus
gcuccuggucuucccgcu

SEQ ID NO: 3098854 - RNA, 14 nt, Molluscum contagiosum virus
aaacugcauccugg

SEQ ID NO: 3098855 - RNA, 22 nt, Molluscum contagiosum virus
gggcucugucguugucgccgug

SEQ ID NO: 3098856 - RNA, 17 nt, Molluscum contagiosum virus
ugugcuacugcacugca

SEQ ID NO: 3098857 - RNA, 21 nt, Molluscum contagiosum virus
cuuugaggaacuagugcugcu

SEQ ID NO: 3098858 - RNA, 16 nt, Molluscum contagiosum virus
gccuucgcgcugcccg

SEQ ID NO: 3098859 - RNA, 17 nt, Molluscum contagiosum virus
gggcgcgcacuaccgca

SEQ ID NO: 3098860 - RNA, 19 nt, Molluscum contagiosum virus
agcgagucaucggcgaguu

SEQ ID NO: 3098861 - RNA, 12 nt, Molluscum contagiosum virus
gacggcgagcgc

SEQ ID NO: 3098862 - RNA, 16 nt, Molluscum contagiosum virus
acgcuguccaggcgcu

SEQ ID NO: 3098863 - RNA, 21 nt, Molluscum contagiosum virus
aagaagcagcagaccaagaag

SEQ ID NO: 3098864 - RNA, 15 nt, Molluscum contagiosum virus
cgccuagccugcagu

SEQ ID NO: 3098865 - RNA, 14 nt, Molluscum contagiosum virus
aaggaaaacugcau

SEQ ID NO: 3098866 - RNA, 14 nt, Molluscum contagiosum virus
gggugccuacucgc

SEQ ID NO: 3098867 - RNA, 14 nt, Molluscum contagiosum virus
cgccaccgcgcccu

SEQ ID NO: 3098868 - RNA, 22 nt, Molluscum contagiosum virus
gcccuucguguucgcggacggc

SEQ ID NO: 3098869 - RNA, 18 nt, Molluscum contagiosum virus
uccucgcuccgcagcagg

SEQ ID NO: 3098870 - RNA, 18 nt, Molluscum contagiosum virus
cuucaagcacgagcugcu

SEQ ID NO: 3098871 - RNA, 20 nt, Molluscum contagiosum virus
ccgccgcggcgcccacggcg

SEQ ID NO: 3098872 - RNA, 13 nt, Molluscum contagiosum virus
cgcgcgcgcgcag

SEQ ID NO: 3098873 - RNA, 23 nt, Molluscum contagiosum virus
agucauucucuucgaaggcagcg

SEQ ID NO: 3098874 - RNA, 17 nt, Molluscum contagiosum virus
caggcgcgcaagugcgu

SEQ ID NO: 3098875 - RNA, 11 nt, Molluscum contagiosum virus
cgcgcgcagua

SEQ ID NO: 3098876 - RNA, 23 nt, Molluscum contagiosum virus
ggcgcggccucuuuuugcgccgc

SEQ ID NO: 3098877 - RNA, 12 nt, Molluscum contagiosum virus
gaaggugcucag

SEQ ID NO: 3098878 - RNA, 16 nt, Molluscum contagiosum virus
cgcgucgcgcgccgcg

SEQ ID NO: 3098879 - RNA, 20 nt, Molluscum contagiosum virus
cugcagcagcuccagcaugg

SEQ ID NO: 3098880 - RNA, 16 nt, Molluscum contagiosum virus
cgucguccggaggcac

SEQ ID NO: 3098881 - RNA, 13 nt, Molluscum contagiosum virus
cgcgcugcgccac

SEQ ID NO: 3098882 - RNA, 23 nt, Molluscum contagiosum virus
gcuucacgcugcucgugcugcuc

SEQ ID NO: 3098883 - RNA, 17 nt, Molluscum contagiosum virus
gcguccgugcgcagggc

SEQ ID NO: 3098884 - RNA, 15 nt, Molluscum contagiosum virus
gucgugcaggucgag

SEQ ID NO: 3098885 - RNA, 16 nt, Molluscum contagiosum virus
ugcgcgacaugcugcc

SEQ ID NO: 3098886 - RNA, 23 nt, Molluscum contagiosum virus
ggcgcaaccgcgugcgugcacag

SEQ ID NO: 3098887 - RNA, 19 nt, Molluscum contagiosum virus
cuacgaggugcugcgccac

SEQ ID NO: 3098888 - RNA, 15 nt, Molluscum contagiosum virus
ccaaggacgacaaca

SEQ ID NO: 3098889 - RNA, 14 nt, Molluscum contagiosum virus
uacgacgacaugca

SEQ ID NO: 3098890 - RNA, 18 nt, Molluscum contagiosum virus
ggcgccgcuaccagcucg

SEQ ID NO: 3098891 - RNA, 13 nt, Molluscum contagiosum virus
gucagaggauucu

SEQ ID NO: 3098892 - RNA, 15 nt, Molluscum contagiosum virus
acaucggcacugcuc

SEQ ID NO: 3098893 - RNA, 18 nt, Molluscum contagiosum virus
ucggcguggccaggccgc

SEQ ID NO: 3098894 - RNA, 20 nt, Molluscum contagiosum virus
cgagcaauugcugggcacaa

SEQ ID NO: 3098895 - RNA, 14 nt, Molluscum contagiosum virus
agcugcggacgcgg

SEQ ID NO: 3098896 - RNA, 14 nt, Molluscum contagiosum virus
gcagcccuuccacg

SEQ ID NO: 3098897 - RNA, 17 nt, Molluscum contagiosum virus
cgccgcugcgcaucugc

SEQ ID NO: 3098898 - RNA, 16 nt, Molluscum contagiosum virus
gcagagccgcgaaagc

SEQ ID NO: 3098899 - RNA, 17 nt, Molluscum contagiosum virus
cgugcuugugcgccugu

SEQ ID NO: 3098900 - RNA, 15 nt, Molluscum contagiosum virus
acuugccguguucua

SEQ ID NO: 3098901 - RNA, 15 nt, Molluscum contagiosum virus
aacgucgcacuggcc

SEQ ID NO: 3098902 - RNA, 13 nt, Molluscum contagiosum virus
gugccgcugcgcg

SEQ ID NO: 3098903 - RNA, 17 nt, Molluscum contagiosum virus
ggccgccacuguugcuu

SEQ ID NO: 3098904 - RNA, 14 nt, Molluscum contagiosum virus
uagcagagcacgag

SEQ ID NO: 3098905 - RNA, 18 nt, Molluscum contagiosum virus
cagccaugaggacagcuu

SEQ ID NO: 3098906 - RNA, 14 nt, Molluscum contagiosum virus
gcgggcacggcuac

SEQ ID NO: 3098907 - RNA, 21 nt, Molluscum contagiosum virus
ggaggugcgcgacuccaucug

SEQ ID NO: 3098908 - RNA, 14 nt, Molluscum contagiosum virus
gcaugcccagcaug

SEQ ID NO: 3098909 - RNA, 20 nt, Molluscum contagiosum virus
uggaacugcagcagcuggcc

SEQ ID NO: 3098910 - RNA, 13 nt, Molluscum contagiosum virus
cgcggaggcgcaa

SEQ ID NO: 3098911 - RNA, 14 nt, Molluscum contagiosum virus
cgaggccggcaagc

SEQ ID NO: 3098912 - RNA, 14 nt, Molluscum contagiosum virus
gccgcgcgcgcacg

SEQ ID NO: 3098913 - RNA, 14 nt, Molluscum contagiosum virus
cucgacgcgcugcu

SEQ ID NO: 3098914 - RNA, 16 nt, Molluscum contagiosum virus
uucuggcgcgcgugcc

SEQ ID NO: 3098915 - RNA, 14 nt, Molluscum contagiosum virus
cgcgcgccugcgcg

SEQ ID NO: 3098916 - RNA, 13 nt, Molluscum contagiosum virus
ggcggggcugcug

SEQ ID NO: 3098917 - RNA, 16 nt, Molluscum contagiosum virus
ucgacgggcgcagcca

SEQ ID NO: 3098918 - RNA, 17 nt, Molluscum contagiosum virus
cguuagcguugguaaca

SEQ ID NO: 3098919 - RNA, 15 nt, Molluscum contagiosum virus
cggggcccaugcuca

SEQ ID NO: 3098920 - RNA, 20 nt, Molluscum contagiosum virus
cguggaucgcgcgcaccugc

SEQ ID NO: 3098921 - RNA, 17 nt, Molluscum contagiosum virus
uggagaucgacaagauc

SEQ ID NO: 3098922 - RNA, 16 nt, Molluscum contagiosum virus
ggaaggcgaccagcug

SEQ ID NO: 3098923 - RNA, 15 nt, Molluscum contagiosum virus
cggcgcgugagcgcc

SEQ ID NO: 3098924 - RNA, 17 nt, Molluscum contagiosum virus
ggccgucgcgagcuugg

SEQ ID NO: 3098925 - RNA, 17 nt, Molluscum contagiosum virus
ccgcguacgcgccgggg

SEQ ID NO: 3098926 - RNA, 19 nt, Molluscum contagiosum virus
cagcucgccgcgcgccgcu

SEQ ID NO: 3098927 - RNA, 13 nt, Molluscum contagiosum virus
ccagcagccaggc

SEQ ID NO: 3098928 - RNA, 19 nt, Molluscum contagiosum virus
gcugcguuuccagggcagu

SEQ ID NO: 3098929 - RNA, 17 nt, Molluscum contagiosum virus
gaagaagcagcagacca

SEQ ID NO: 3098930 - RNA, 21 nt, Molluscum contagiosum virus
gaugaaaagcgugauguugag

SEQ ID NO: 3098931 - RNA, 15 nt, Molluscum contagiosum virus
gcacagaaagccaac

SEQ ID NO: 3098932 - RNA, 17 nt, Molluscum contagiosum virus
agcccgcugcgcauggc

SEQ ID NO: 3098933 - RNA, 23 nt, Molluscum contagiosum virus
gcuaguuaccagaggguggcuug

SEQ ID NO: 3098934 - RNA, 16 nt, Molluscum contagiosum virus
cagcugcgcgagccgc

SEQ ID NO: 3098935 - RNA, 15 nt, Molluscum contagiosum virus
gccggcgcgccgcgg

SEQ ID NO: 3098936 - RNA, 14 nt, Molluscum contagiosum virus
gccugcccgugugc

SEQ ID NO: 3098937 - RNA, 23 nt, Molluscum contagiosum virus
cgcucggaauuccuugugcaauu

SEQ ID NO: 3098938 - RNA, 21 nt, Molluscum contagiosum virus
cugacggucguccuggagccu

SEQ ID NO: 3098939 - RNA, 23 nt, Molluscum contagiosum virus
gcaucuucuuguuguugugacac

SEQ ID NO: 3098940 - RNA, 13 nt, Molluscum contagiosum virus
cgcaugcuggaga

SEQ ID NO: 3098941 - RNA, 14 nt, Molluscum contagiosum virus
ggcgcgguccagcc

SEQ ID NO: 3098942 - RNA, 20 nt, Molluscum contagiosum virus
gcagcuucuuggagcccuug

SEQ ID NO: 3098943 - RNA, 16 nt, Molluscum contagiosum virus
acgccuucguggagcc

SEQ ID NO: 3098944 - RNA, 16 nt, Molluscum contagiosum virus
ccgggcgccggcucug

SEQ ID NO: 3098945 - RNA, 15 nt, Molluscum contagiosum virus
gagccgggacgcgga

SEQ ID NO: 3098946 - RNA, 15 nt, Molluscum contagiosum virus
accugucgugcaaug

SEQ ID NO: 3098947 - RNA, 22 nt, Molluscum contagiosum virus
gcggcgcguccucggccagagc

SEQ ID NO: 3098948 - RNA, 19 nt, Molluscum contagiosum virus
ggcgccgcggccugggcca

SEQ ID NO: 3098949 - RNA, 16 nt, Molluscum contagiosum virus
agacgcguaccagcgc

SEQ ID NO: 3098950 - RNA, 23 nt, Molluscum contagiosum virus
gcgcauguauauacuccccgcgc

SEQ ID NO: 3098951 - RNA, 18 nt, Molluscum contagiosum virus
gccgggcacccagcccug

SEQ ID NO: 3098952 - RNA, 16 nt, Molluscum contagiosum virus
ccgccgcugccgcgcg

SEQ ID NO: 3098953 - RNA, 17 nt, Molluscum contagiosum virus
ccagcguuugauacagu

SEQ ID NO: 3098954 - RNA, 15 nt, Molluscum contagiosum virus
cgcugcagcaccugc

SEQ ID NO: 3098955 - RNA, 16 nt, Molluscum contagiosum virus
gcacgccgugggcagc

SEQ ID NO: 3098956 - RNA, 18 nt, Molluscum contagiosum virus
ucuacagccgccugccgc

SEQ ID NO: 3098957 - RNA, 15 nt, Molluscum contagiosum virus
agugcgcgugcgccu

SEQ ID NO: 3098958 - RNA, 23 nt, Molluscum contagiosum virus
gcgccgacgugcgcgugacgauu

SEQ ID NO: 3098959 - RNA, 19 nt, Molluscum contagiosum virus
acgugccaagaccugggcg

SEQ ID NO: 3098960 - RNA, 14 nt, Molluscum contagiosum virus
cugcuuccuccucc

SEQ ID NO: 3098961 - RNA, 23 nt, Molluscum contagiosum virus
cguaacaauggacacgcacuggc

SEQ ID NO: 3098962 - RNA, 16 nt, Molluscum contagiosum virus
ucccaagacucugccg

SEQ ID NO: 3098963 - RNA, 17 nt, Molluscum contagiosum virus
agucggcguggccaggc

SEQ ID NO: 3098964 - RNA, 15 nt, Molluscum contagiosum virus
cauagcccaugcgca

SEQ ID NO: 3098965 - RNA, 21 nt, Molluscum contagiosum virus
cucgccgcgcgccgcugcucg

SEQ ID NO: 3098966 - RNA, 19 nt, Molluscum contagiosum virus
gccgcgcgcuacgcgccga

SEQ ID NO: 3098967 - RNA, 23 nt, Molluscum contagiosum virus
ggcgcgcgagcacagcgcgcgga

SEQ ID NO: 3098968 - RNA, 20 nt, Molluscum contagiosum virus
cugcgccuucugccugcccg

SEQ ID NO: 3098969 - RNA, 19 nt, Molluscum contagiosum virus
cguagacgauuuugccgca

SEQ ID NO: 3098970 - RNA, 15 nt, Molluscum contagiosum virus
auaccggagacacca

SEQ ID NO: 3098971 - RNA, 15 nt, Molluscum contagiosum virus
ccgucagccucugug

SEQ ID NO: 3098972 - RNA, 15 nt, Molluscum contagiosum virus
gcccucgcgcgcagc

SEQ ID NO: 3098973 - RNA, 13 nt, Molluscum contagiosum virus
agcgcgccucucg

SEQ ID NO: 3098974 - RNA, 16 nt, Molluscum contagiosum virus
ugggcgagagcuuuuc

SEQ ID NO: 3098975 - RNA, 16 nt, Molluscum contagiosum virus
cacgcgcucuccagag

SEQ ID NO: 3098976 - RNA, 14 nt, Molluscum contagiosum virus
gccgccgugggcgc

SEQ ID NO: 3098977 - RNA, 17 nt, Molluscum contagiosum virus
ugagcagcaaaacugaa

SEQ ID NO: 3098978 - RNA, 14 nt, Molluscum contagiosum virus
ggcacgugcugcug

SEQ ID NO: 3098979 - RNA, 19 nt, Molluscum contagiosum virus
gacguggaccuuggcgcgc

SEQ ID NO: 3098980 - RNA, 14 nt, Molluscum contagiosum virus
acuccaaggagggc

SEQ ID NO: 3098981 - RNA, 22 nt, Molluscum contagiosum virus
uuccggagacaccagcuccgcc

SEQ ID NO: 3098982 - RNA, 16 nt, Molluscum contagiosum virus
ggaaaggcacccacca

SEQ ID NO: 3098983 - RNA, 21 nt, Molluscum contagiosum virus
caccuaaauggacgcgccgcg

SEQ ID NO: 3098984 - RNA, 14 nt, Molluscum contagiosum virus
cggacggcgcgcag

SEQ ID NO: 3098985 - RNA, 23 nt, Molluscum contagiosum virus
cgcaugguggcgauccuguccau

SEQ ID NO: 3098986 - RNA, 19 nt, Molluscum contagiosum virus
gccguagucuucgugcgug

SEQ ID NO: 3098987 - RNA, 18 nt, Molluscum contagiosum virus
cacgcgcacgcucucgcu

SEQ ID NO: 3098988 - RNA, 14 nt, Molluscum contagiosum virus
ggcgagauugagcu

SEQ ID NO: 3098989 - RNA, 21 nt, Molluscum contagiosum virus
gcucaaaguguacuauuacac

SEQ ID NO: 3098990 - RNA, 13 nt, Molluscum contagiosum virus
gcacgaggagccc

SEQ ID NO: 3098991 - RNA, 11 nt, Molluscum contagiosum virus
ccacugggaac

SEQ ID NO: 3098992 - RNA, 14 nt, Molluscum contagiosum virus
gugccuuguucuga

SEQ ID NO: 3098993 - RNA, 21 nt, Molluscum contagiosum virus
ccgcgccgaaacacggccucc

SEQ ID NO: 3098994 - RNA, 18 nt, Molluscum contagiosum virus
cacgcgucgcgcaggcgc

SEQ ID NO: 3098995 - RNA, 20 nt, Molluscum contagiosum virus
agcugcagagcgugcugguc

SEQ ID NO: 3098996 - RNA, 16 nt, Molluscum contagiosum virus
acggaaacagcaccgu

SEQ ID NO: 3098997 - RNA, 19 nt, Molluscum contagiosum virus
ccaauggagccgcugcugc

SEQ ID NO: 3098998 - RNA, 20 nt, Molluscum contagiosum virus
accgccguacccggggagaa

SEQ ID NO: 3098999 - RNA, 18 nt, Molluscum contagiosum virus
acuaccacgucggcgaga

SEQ ID NO: 3099000 - RNA, 16 nt, Molluscum contagiosum virus
acucgcugcugcucuu

SEQ ID NO: 3099001 - RNA, 12 nt, Molluscum contagiosum virus
aggacaccgcgg

SEQ ID NO: 3099002 - RNA, 15 nt, Molluscum contagiosum virus
cgcgcgaacucucau

SEQ ID NO: 3099003 - RNA, 16 nt, Molluscum contagiosum virus
cagccugcuggcaccg

SEQ ID NO: 3099004 - RNA, 18 nt, Molluscum contagiosum virus
gcgucacaagcaccgccu

SEQ ID NO: 3099005 - RNA, 20 nt, Molluscum contagiosum virus
gaacucggcuucugcugcac

SEQ ID NO: 3099006 - RNA, 18 nt, Molluscum contagiosum virus
cguucucuaccagcucgu

SEQ ID NO: 3099007 - RNA, 18 nt, Molluscum contagiosum virus
augucgaacaccuccugc

SEQ ID NO: 3099008 - RNA, 19 nt, Molluscum contagiosum virus
ugcacuuucaacucucuac

SEQ ID NO: 3099009 - RNA, 23 nt, Molluscum contagiosum virus
gcucgcgcgcaagaacaaccaga

SEQ ID NO: 3099010 - RNA, 15 nt, Molluscum contagiosum virus
cgcgcaagcgcugcu

SEQ ID NO: 3099011 - RNA, 14 nt, Molluscum contagiosum virus
gacagcucagcagg

SEQ ID NO: 3099012 - RNA, 17 nt, Molluscum contagiosum virus
acuuugagcgagugccg

SEQ ID NO: 3099013 - RNA, 19 nt, Molluscum contagiosum virus
gcaccguaccgcgcccgcc

SEQ ID NO: 3099014 - RNA, 19 nt, Molluscum contagiosum virus
agcgcgccuagcuccagcg

SEQ ID NO: 3099015 - RNA, 19 nt, Molluscum contagiosum virus
cgcuuggcgagcgcugccg

SEQ ID NO: 3099016 - RNA, 13 nt, Molluscum contagiosum virus
ggcgcugcucgcg

SEQ ID NO: 3099017 - RNA, 20 nt, Molluscum contagiosum virus
cgcacguggaaucacggcca

SEQ ID NO: 3099018 - RNA, 18 nt, Molluscum contagiosum virus
cuggcucguacugcugca

SEQ ID NO: 3099019 - RNA, 21 nt, Molluscum contagiosum virus
gagcaggacgacgacacagcc

SEQ ID NO: 3099020 - RNA, 20 nt, Molluscum contagiosum virus
gcgagcacccccgcugcacg

SEQ ID NO: 3099021 - RNA, 23 nt, Molluscum contagiosum virus
gaaccugugcgcgguggugcugg

SEQ ID NO: 3099022 - RNA, 21 nt, Molluscum contagiosum virus
cgccggaccagauccgggcgc

SEQ ID NO: 3099023 - RNA, 18 nt, Molluscum contagiosum virus
cgcgggcgcgcggcaagc

SEQ ID NO: 3099024 - RNA, 14 nt, Molluscum contagiosum virus
ccuggcagccgagc

SEQ ID NO: 3099025 - RNA, 16 nt, Molluscum contagiosum virus
caagcgccgccaugcu

SEQ ID NO: 3099026 - RNA, 17 nt, Molluscum contagiosum virus
cgcguucgcguacggcg

SEQ ID NO: 3099027 - RNA, 13 nt, Molluscum contagiosum virus
gccaaugacggcg

SEQ ID NO: 3099028 - RNA, 23 nt, Molluscum contagiosum virus
cccgcaggaaagguaccccgcag

SEQ ID NO: 3099029 - RNA, 12 nt, Molluscum contagiosum virus
acaugugccugc

SEQ ID NO: 3099030 - RNA, 18 nt, Molluscum contagiosum virus
gcgaucgcagcagugcca

SEQ ID NO: 3099031 - RNA, 13 nt, Molluscum contagiosum virus
gcagcaaacugug

SEQ ID NO: 3099032 - RNA, 22 nt, Molluscum contagiosum virus
uccccgcgcucacugcagcagc

SEQ ID NO: 3099033 - RNA, 18 nt, Molluscum contagiosum virus
cgaaacacggccuccagc

SEQ ID NO: 3099034 - RNA, 19 nt, Molluscum contagiosum virus
cagcuguuucugccgcgcc

SEQ ID NO: 3099035 - RNA, 21 nt, Molluscum contagiosum virus
cgcugcuccccgccagcacca

SEQ ID NO: 3099036 - RNA, 21 nt, Molluscum contagiosum virus
agacuucuccgaccgugcccu

SEQ ID NO: 3099037 - RNA, 16 nt, Molluscum contagiosum virus
gcagacaaggagaugg

SEQ ID NO: 3099038 - RNA, 22 nt, Molluscum contagiosum virus
ugcggagggugcacgcgggcgc

SEQ ID NO: 3099039 - RNA, 16 nt, Molluscum contagiosum virus
accgcgggcacgggca

SEQ ID NO: 3099040 - RNA, 14 nt, Molluscum contagiosum virus
acgugcgcaucccu

SEQ ID NO: 3099041 - RNA, 13 nt, Molluscum contagiosum virus
cacgcuagcgggc

SEQ ID NO: 3099042 - RNA, 20 nt, Molluscum contagiosum virus
ggcgcgcugugagcgcgccg

SEQ ID NO: 3099043 - RNA, 20 nt, Molluscum contagiosum virus
guagcccaggaacaucugca

SEQ ID NO: 3099044 - RNA, 15 nt, Molluscum contagiosum virus
ccucgagaagaccug

SEQ ID NO: 3099045 - RNA, 14 nt, Molluscum contagiosum virus
gaacugcugggcgu

SEQ ID NO: 3099046 - RNA, 21 nt, Molluscum contagiosum virus
agacugcuacgucgcggcgca

SEQ ID NO: 3099047 - RNA, 15 nt, Molluscum contagiosum virus
cacucgagaagaggg

SEQ ID NO: 3099048 - RNA, 20 nt, Molluscum contagiosum virus
cgcguacauaaaauggacca

SEQ ID NO: 3099049 - RNA, 14 nt, Molluscum contagiosum virus
acggacggcgcacg

SEQ ID NO: 3099050 - RNA, 13 nt, Molluscum contagiosum virus
acgagaaugacuu

SEQ ID NO: 3099051 - RNA, 20 nt, Molluscum contagiosum virus
ugggcucgcgcuuuuccagg

SEQ ID NO: 3099052 - RNA, 19 nt, Molluscum contagiosum virus
acuccaagugaacuacagu

SEQ ID NO: 3099053 - RNA, 13 nt, Molluscum contagiosum virus
cccgcgcucgccg

SEQ ID NO: 3099054 - RNA, 19 nt, Molluscum contagiosum virus
agcacgaugcccagcagcg

SEQ ID NO: 3099055 - RNA, 21 nt, Molluscum contagiosum virus
cgacgugcugcugcagaacug

SEQ ID NO: 3099056 - RNA, 20 nt, Molluscum contagiosum virus
caucgacgugcagacgcuca

SEQ ID NO: 3099057 - RNA, 15 nt, Molluscum contagiosum virus
cgcugcccgcgccgc

SEQ ID NO: 3099058 - RNA, 17 nt, Molluscum contagiosum virus
gagcaaggccuggccuu

SEQ ID NO: 3099059 - RNA, 16 nt, Molluscum contagiosum virus
cgcuggccucugccug

SEQ ID NO: 3099060 - RNA, 22 nt, Molluscum contagiosum virus
acaucaucgcggagcugcgcgc

SEQ ID NO: 3099061 - RNA, 22 nt, Molluscum contagiosum virus
cgcuaggggugccgcugcgcug

SEQ ID NO: 3099062 - RNA, 21 nt, Molluscum contagiosum virus
guuugcggaugcucgcuugcc

SEQ ID NO: 3099063 - RNA, 20 nt, Molluscum contagiosum virus
cgaaggucaucaccagccug

SEQ ID NO: 3099064 - RNA, 17 nt, Molluscum contagiosum virus
aucuccaacuagacaag

SEQ ID NO: 3099065 - RNA, 14 nt, Molluscum contagiosum virus
cugcguuuccaggg

SEQ ID NO: 3099066 - RNA, 20 nt, Molluscum contagiosum virus
gcuccgaaccccucgugcug

SEQ ID NO: 3099067 - RNA, 20 nt, Molluscum contagiosum virus
cuggcaaugagggcgaggcc

SEQ ID NO: 3099068 - RNA, 15 nt, Molluscum contagiosum virus
cgccagcgcgcccac

SEQ ID NO: 3099069 - RNA, 12 nt, Molluscum contagiosum virus
gccggacagcuc

SEQ ID NO: 3099070 - RNA, 15 nt, Molluscum contagiosum virus
cgcacagccccugcu

SEQ ID NO: 3099071 - RNA, 24 nt, Molluscum contagiosum virus
auggaaggcgaccagcugguccug

SEQ ID NO: 3099072 - RNA, 15 nt, Molluscum contagiosum virus
ccgcucguguuuguc

SEQ ID NO: 3099073 - RNA, 19 nt, Molluscum contagiosum virus
gcacgcgcacuugccuggc

SEQ ID NO: 3099074 - RNA, 21 nt, Molluscum contagiosum virus
cccugguuugcgcucucagag

SEQ ID NO: 3099075 - RNA, 16 nt, Molluscum contagiosum virus
gcgaaguccugggcga

SEQ ID NO: 3099076 - RNA, 23 nt, Molluscum contagiosum virus
gacgugcugcgcgcccaggcgcg

SEQ ID NO: 3099077 - RNA, 19 nt, Molluscum contagiosum virus
aguaccagauuagcaacug

SEQ ID NO: 3099078 - RNA, 17 nt, Molluscum contagiosum virus
cuacgagacucuggaag

SEQ ID NO: 3099079 - RNA, 20 nt, Molluscum contagiosum virus
ccgcgcuuugucgaggccuu

SEQ ID NO: 3099080 - RNA, 15 nt, Molluscum contagiosum virus
cgcgccgcucgcgcu

SEQ ID NO: 3099081 - RNA, 17 nt, Molluscum contagiosum virus
cggcagcuggagcugcc

SEQ ID NO: 3099082 - RNA, 20 nt, Molluscum contagiosum virus
ggcaagcuucgggccgcugc

SEQ ID NO: 3099083 - RNA, 22 nt, Molluscum contagiosum virus
cggcugcucgcugccuggugca

SEQ ID NO: 3099084 - RNA, 14 nt, Molluscum contagiosum virus
guuacucucagagc

SEQ ID NO: 3099085 - RNA, 17 nt, Molluscum contagiosum virus
cacugcuacgagccgcu

SEQ ID NO: 3099086 - RNA, 15 nt, Molluscum contagiosum virus
ccgcgugcacccucc

SEQ ID NO: 3099087 - RNA, 18 nt, Molluscum contagiosum virus
uagcaagcacgccaggug

SEQ ID NO: 3099088 - RNA, 13 nt, Molluscum contagiosum virus
cugcggcugcugg

SEQ ID NO: 3099089 - RNA, 18 nt, Molluscum contagiosum virus
cggaccuaaagcugcugg

SEQ ID NO: 3099090 - RNA, 20 nt, Molluscum contagiosum virus
agcagcgcgagcuugccccu

SEQ ID NO: 3099091 - RNA, 22 nt, Molluscum contagiosum virus
agucgcaguacccgagcugugc

SEQ ID NO: 3099092 - RNA, 21 nt, Molluscum contagiosum virus
acguggagccugaggccgcgg

SEQ ID NO: 3099093 - RNA, 17 nt, Molluscum contagiosum virus
gcucuucgacagcgugc

SEQ ID NO: 3099094 - RNA, 18 nt, Molluscum contagiosum virus
auagccccucgagcagcg

SEQ ID NO: 3099095 - RNA, 15 nt, Molluscum contagiosum virus
cgacgggcgcgcuuc

SEQ ID NO: 3099096 - RNA, 19 nt, Molluscum contagiosum virus
cgcgggccuguccgcgggc

SEQ ID NO: 3099097 - RNA, 17 nt, Molluscum contagiosum virus
agagaaaggcacccacc

SEQ ID NO: 3099098 - RNA, 14 nt, Molluscum contagiosum virus
cagcucaagcugcu

SEQ ID NO: 3099099 - RNA, 18 nt, Molluscum contagiosum virus
ggcgcuuucgcccgccgc

SEQ ID NO: 3099100 - RNA, 14 nt, Molluscum contagiosum virus
cggccguggcugcg

SEQ ID NO: 3099101 - RNA, 22 nt, Molluscum contagiosum virus
cucauccacgcggaggacggcg

SEQ ID NO: 3099102 - RNA, 18 nt, Molluscum contagiosum virus
gcaccgcgccccacugug

SEQ ID NO: 3099103 - RNA, 18 nt, Molluscum contagiosum virus
cagcgacuacgcgcugcu

SEQ ID NO: 3099104 - RNA, 14 nt, Molluscum contagiosum virus
gagagcgugagcag

SEQ ID NO: 3099105 - RNA, 17 nt, Molluscum contagiosum virus
auccaaaccaacgugag

SEQ ID NO: 3099106 - RNA, 22 nt, Molluscum contagiosum virus
gcuccgugcccacgagcgccag

SEQ ID NO: 3099107 - RNA, 13 nt, Molluscum contagiosum virus
ucgcggugcagcu

SEQ ID NO: 3099108 - RNA, 18 nt, Molluscum contagiosum virus
ucgcuugcccggagccgg

SEQ ID NO: 3099109 - RNA, 18 nt, Molluscum contagiosum virus
gagaagcuguaccuggug

SEQ ID NO: 3099110 - RNA, 19 nt, Molluscum contagiosum virus
ccgcgcugguggccgcacu

SEQ ID NO: 3099111 - RNA, 18 nt, Molluscum contagiosum virus
gcgagucaaugacacgag

SEQ ID NO: 3099112 - RNA, 18 nt, Molluscum contagiosum virus
gcgggcccgcgaacgaga

SEQ ID NO: 3099113 - RNA, 16 nt, Molluscum contagiosum virus
gcaggaaaggcacccc

SEQ ID NO: 3099114 - RNA, 16 nt, Molluscum contagiosum virus
gcgcugcacaccgagc

SEQ ID NO: 3099115 - RNA, 17 nt, Molluscum contagiosum virus
cgacauuucgcgccugu

SEQ ID NO: 3099116 - RNA, 14 nt, Molluscum contagiosum virus
cacugucgcgcagc

SEQ ID NO: 3099117 - RNA, 19 nt, Molluscum contagiosum virus
acgagcugacgcagacgca

SEQ ID NO: 3099118 - RNA, 12 nt, Molluscum contagiosum virus
gcccgcgccgca

SEQ ID NO: 3099119 - RNA, 16 nt, Molluscum contagiosum virus
ugcugcgcacggaggg

SEQ ID NO: 3099120 - RNA, 17 nt, Molluscum contagiosum virus
cgcgccuuuccggccug

SEQ ID NO: 3099121 - RNA, 19 nt, Molluscum contagiosum virus
ugcuccgcacguggaauca

SEQ ID NO: 3099122 - RNA, 20 nt, Molluscum contagiosum virus
gcgacuuuguccugagccuu

SEQ ID NO: 3099123 - RNA, 18 nt, Molluscum contagiosum virus
ugcuugcccgaccuuggu

SEQ ID NO: 3099124 - RNA, 17 nt, Molluscum contagiosum virus
gcgcccgccaccaugcu

SEQ ID NO: 3099125 - RNA, 14 nt, Molluscum contagiosum virus
caggacuggcaccu

SEQ ID NO: 3099126 - RNA, 16 nt, Molluscum contagiosum virus
acagggauucgccgcg

SEQ ID NO: 3099127 - RNA, 14 nt, Molluscum contagiosum virus
gucuccguccccgg

SEQ ID NO: 3099128 - RNA, 14 nt, Molluscum contagiosum virus
gcagacggcaaguu

SEQ ID NO: 3099129 - RNA, 18 nt, Molluscum contagiosum virus
cuaccaacucugugaccu

SEQ ID NO: 3099130 - RNA, 19 nt, Molluscum contagiosum virus
gccgggcgccggcucugcc

SEQ ID NO: 3099131 - RNA, 13 nt, Molluscum contagiosum virus
uucugcgcugcca

SEQ ID NO: 3099132 - RNA, 15 nt, Molluscum contagiosum virus
cccgaaggccaccuc

SEQ ID NO: 3099133 - RNA, 22 nt, Molluscum contagiosum virus
ugaaggacgcguucuccaggaa

SEQ ID NO: 3099134 - RNA, 19 nt, Molluscum contagiosum virus
gcucgcggcucggcucuug

SEQ ID NO: 3099135 - RNA, 12 nt, Molluscum contagiosum virus
gaaaugacggcg

SEQ ID NO: 3099136 - RNA, 20 nt, Molluscum contagiosum virus
gcugcucuacuuccacgagc

SEQ ID NO: 3099137 - RNA, 22 nt, Molluscum contagiosum virus
acgaccgacccaucggagaagu

SEQ ID NO: 3099138 - RNA, 13 nt, Molluscum contagiosum virus
agcacgcaacugc

SEQ ID NO: 3099139 - RNA, 21 nt, Molluscum contagiosum virus
ccugcaaacgcgaaacuggac

SEQ ID NO: 3099140 - RNA, 13 nt, Molluscum contagiosum virus
gacacugugcugg

SEQ ID NO: 3099141 - RNA, 14 nt, Molluscum contagiosum virus
gguagcuagcucug

SEQ ID NO: 3099142 - RNA, 15 nt, Molluscum contagiosum virus
ccacgugcucaagug

SEQ ID NO: 3099143 - RNA, 23 nt, Molluscum contagiosum virus
aguggacaagcuagacuggagca

SEQ ID NO: 3099144 - RNA, 16 nt, Molluscum contagiosum virus
uggcgauagcgauggc

SEQ ID NO: 3099145 - RNA, 23 nt, Molluscum contagiosum virus
gcgcaccgcguugccgcccgccg

SEQ ID NO: 3099146 - RNA, 15 nt, Molluscum contagiosum virus
cugcucgacgggcgc

SEQ ID NO: 3099147 - RNA, 16 nt, Molluscum contagiosum virus
cgcgugucuggagccc

SEQ ID NO: 3099148 - RNA, 19 nt, Molluscum contagiosum virus
ccagacaaagucgacgaca

SEQ ID NO: 3099149 - RNA, 19 nt, Molluscum contagiosum virus
ggcgcgagcgacggcaggc

SEQ ID NO: 3099150 - RNA, 18 nt, Molluscum contagiosum virus
cuguccgacgucacgcug

SEQ ID NO: 3099151 - RNA, 16 nt, Molluscum contagiosum virus
cgucauggagcaggag

SEQ ID NO: 3099152 - RNA, 22 nt, Molluscum contagiosum virus
cgcaggaaagguacccgcagga

SEQ ID NO: 3099153 - RNA, 13 nt, Molluscum contagiosum virus
gccgccauccuga

SEQ ID NO: 3099154 - RNA, 23 nt, Molluscum contagiosum virus
caggaaagguacccgcaggaaag

SEQ ID NO: 3099155 - RNA, 14 nt, Molluscum contagiosum virus
caugcgacugccag

SEQ ID NO: 3099156 - RNA, 23 nt, Molluscum contagiosum virus
ugcuuccggugccggccgccggc

SEQ ID NO: 3099157 - RNA, 15 nt, Molluscum contagiosum virus
ggucccuagccuucc

SEQ ID NO: 3099158 - RNA, 15 nt, Molluscum contagiosum virus
cugccgcagagccgc

SEQ ID NO: 3099159 - RNA, 21 nt, Molluscum contagiosum virus
auuguucggaggcugcucccu

SEQ ID NO: 3099160 - RNA, 14 nt, Molluscum contagiosum virus
cgcgugcugggccc

SEQ ID NO: 3099161 - RNA, 23 nt, Molluscum contagiosum virus
gacuaccuggcggcgcuggagac

SEQ ID NO: 3099162 - RNA, 17 nt, Molluscum contagiosum virus
cgccagccugugcgcca

SEQ ID NO: 3099163 - RNA, 21 nt, Molluscum contagiosum virus
gcaccggaagcaacgacaagg

SEQ ID NO: 3099164 - RNA, 17 nt, Molluscum contagiosum virus
aggccuacgugcugcgc

SEQ ID NO: 3099165 - RNA, 21 nt, Molluscum contagiosum virus
cccgcaaacacgagacugagu

SEQ ID NO: 3099166 - RNA, 22 nt, Molluscum contagiosum virus
cucuccuacacauuccucggcg

SEQ ID NO: 3099167 - RNA, 18 nt, Molluscum contagiosum virus
cgaugagcgucucggugc

SEQ ID NO: 3099168 - RNA, 16 nt, Molluscum contagiosum virus
gcuggcgcgcugcgug

SEQ ID NO: 3099169 - RNA, 19 nt, Molluscum contagiosum virus
cggcguccggugcucgccc

SEQ ID NO: 3099170 - RNA, 19 nt, Molluscum contagiosum virus
cggcagccgcagaugcgca

SEQ ID NO: 3099171 - RNA, 16 nt, Molluscum contagiosum virus
cccgcggcgugcccgu

SEQ ID NO: 3099172 - RNA, 19 nt, Molluscum contagiosum virus
gcuuugugcgucucccagg

SEQ ID NO: 3099173 - RNA, 15 nt, Molluscum contagiosum virus
caacgccagcuguag

SEQ ID NO: 3099174 - RNA, 20 nt, Molluscum contagiosum virus
cacgaagcggcggacagcaa

SEQ ID NO: 3099175 - RNA, 17 nt, Molluscum contagiosum virus
cgcagcguccggcaugc

SEQ ID NO: 3099176 - RNA, 21 nt, Molluscum contagiosum virus
cugcgcuggaugcugcucgac

SEQ ID NO: 3099177 - RNA, 14 nt, Molluscum contagiosum virus
gccugcgagcagcc

SEQ ID NO: 3099178 - RNA, 22 nt, Molluscum contagiosum virus
cagcagcgcgacuagccugugc

SEQ ID NO: 3099179 - RNA, 17 nt, Molluscum contagiosum virus
cuuucccgggcacugua

SEQ ID NO: 3099180 - RNA, 18 nt, Molluscum contagiosum virus
ccgucggaagucggcgug

SEQ ID NO: 3099181 - RNA, 13 nt, Molluscum contagiosum virus
caggaacagggaa

SEQ ID NO: 3099182 - RNA, 17 nt, Molluscum contagiosum virus
guucuucgcagaggaca

SEQ ID NO: 3099183 - RNA, 12 nt, Molluscum contagiosum virus
gggcaauguuug

SEQ ID NO: 3099184 - RNA, 15 nt, Molluscum contagiosum virus
gugccgggcgccggc

SEQ ID NO: 3099185 - RNA, 14 nt, Molluscum contagiosum virus
cgagggcgaggcca

SEQ ID NO: 3099186 - RNA, 17 nt, Molluscum contagiosum virus
ggcgcucgccccuuccc

SEQ ID NO: 3099187 - RNA, 22 nt, Molluscum contagiosum virus
gagacugcuacgucgcggcgca

SEQ ID NO: 3099188 - RNA, 19 nt, Molluscum contagiosum virus
augaacaccauccugcgcu

SEQ ID NO: 3099189 - RNA, 15 nt, Molluscum contagiosum virus
cugccuggugcacac

SEQ ID NO: 3099190 - RNA, 21 nt, Molluscum contagiosum virus
agcauucccggcgcgcgcggc

SEQ ID NO: 3099191 - RNA, 17 nt, Molluscum contagiosum virus
ugcguugucuccuccug

SEQ ID NO: 3099192 - RNA, 18 nt, Molluscum contagiosum virus
auagucaucaaagcacaa

SEQ ID NO: 3099193 - RNA, 12 nt, Molluscum contagiosum virus
gacacugugcug

SEQ ID NO: 3099194 - RNA, 22 nt, Molluscum contagiosum virus
ucugcgcgcaagucaccgcucc

SEQ ID NO: 3099195 - RNA, 21 nt, Molluscum contagiosum virus
ucgaggcgcuugggcacugcu

SEQ ID NO: 3099196 - RNA, 15 nt, Molluscum contagiosum virus
cucagaaauacaccg

SEQ ID NO: 3099197 - RNA, 14 nt, Molluscum contagiosum virus
ucggugcucaugcg

SEQ ID NO: 3099198 - RNA, 21 nt, Molluscum contagiosum virus
accugcugcgagagcaugccu

SEQ ID NO: 3099199 - RNA, 23 nt, Molluscum contagiosum virus
caccccgaaaggcacccgcagga

SEQ ID NO: 3099200 - RNA, 20 nt, Molluscum contagiosum virus
aacgugggcaccugcaucgc

SEQ ID NO: 3099201 - RNA, 16 nt, Molluscum contagiosum virus
agcagcugcuccgccu

SEQ ID NO: 3099202 - RNA, 21 nt, Molluscum contagiosum virus
uccuacgaguugagccguucu

SEQ ID NO: 3099203 - RNA, 20 nt, Molluscum contagiosum virus
cucgcgcgcagcucgcacac

SEQ ID NO: 3099204 - RNA, 22 nt, Molluscum contagiosum virus
cugcgcacgcuugugcgcacgc

SEQ ID NO: 3099205 - RNA, 17 nt, Molluscum contagiosum virus
gcugcgcgcucuggagc

SEQ ID NO: 3099206 - RNA, 21 nt, Molluscum contagiosum virus
caggacgacgacacagcccug

SEQ ID NO: 3099207 - RNA, 20 nt, Molluscum contagiosum virus
gcugggauaacaggcgugcg

SEQ ID NO: 3099208 - RNA, 14 nt, Molluscum contagiosum virus
cgcugcuccugcuc

SEQ ID NO: 3099209 - RNA, 19 nt, Molluscum contagiosum virus
gcggcgcguacucgcgccg

SEQ ID NO: 3099210 - RNA, 17 nt, Molluscum contagiosum virus
cccuccccagcgccgcc

SEQ ID NO: 3099211 - RNA, 19 nt, Molluscum contagiosum virus
gcggccauggucacgcgca

SEQ ID NO: 3099212 - RNA, 14 nt, Molluscum contagiosum virus
gcacugagaaguga

SEQ ID NO: 3099213 - RNA, 20 nt, Molluscum contagiosum virus
cccgcggagaccaccgcugg

SEQ ID NO: 3099214 - RNA, 13 nt, Molluscum contagiosum virus
gacgcgggccugu

SEQ ID NO: 3099215 - RNA, 18 nt, Molluscum contagiosum virus
gagaacuacaaaacugaa

SEQ ID NO: 3099216 - RNA, 18 nt, Molluscum contagiosum virus
gguguacgaaaguacuuu

SEQ ID NO: 3099217 - RNA, 15 nt, Molluscum contagiosum virus
cccggccucgccucc

SEQ ID NO: 3099218 - RNA, 19 nt, Molluscum contagiosum virus
gcucgagccugccagcgcc

SEQ ID NO: 3099219 - RNA, 16 nt, Molluscum contagiosum virus
ccgcgggccgccgccc

SEQ ID NO: 3099220 - RNA, 18 nt, Molluscum contagiosum virus
acuguugcuuccggggcg

SEQ ID NO: 3099221 - RNA, 14 nt, Molluscum contagiosum virus
gcgugcggcgcacc

SEQ ID NO: 3099222 - RNA, 17 nt, Molluscum contagiosum virus
cuguaggggagggcggc

SEQ ID NO: 3099223 - RNA, 21 nt, Molluscum contagiosum virus
ggccacgggauguuggagcgc

SEQ ID NO: 3099224 - RNA, 19 nt, Molluscum contagiosum virus
gcugcucgacgggcgcagc

SEQ ID NO: 3099225 - RNA, 14 nt, Molluscum contagiosum virus
ccgcguacacgugc

SEQ ID NO: 3099226 - RNA, 17 nt, Molluscum contagiosum virus
caccccgaaaggcaccc

SEQ ID NO: 3099227 - RNA, 21 nt, Molluscum contagiosum virus
gccucgcauucuucuccgaug

SEQ ID NO: 3099228 - RNA, 14 nt, Molluscum contagiosum virus
cgagccagccaggc

SEQ ID NO: 3099229 - RNA, 16 nt, Molluscum contagiosum virus
gcgagacgcugcugca

SEQ ID NO: 3099230 - RNA, 19 nt, Molluscum contagiosum virus
agggcgcgcgucgagggcg

SEQ ID NO: 3099231 - RNA, 17 nt, Molluscum contagiosum virus
gcgcccucgcgcgcagc

SEQ ID NO: 3099232 - RNA, 15 nt, Molluscum contagiosum virus
uuccgacgggccgcc

SEQ ID NO: 3099233 - RNA, 13 nt, Molluscum contagiosum virus
cuagccugugccc

SEQ ID NO: 3099234 - RNA, 15 nt, Molluscum contagiosum virus
ccaggaacgaggaaa

SEQ ID NO: 3099235 - RNA, 16 nt, Molluscum contagiosum virus
cuggacgggcacgagc

SEQ ID NO: 3099236 - RNA, 18 nt, Molluscum contagiosum virus
ccuccugcuuugcacgcg

SEQ ID NO: 3099237 - RNA, 18 nt, Molluscum contagiosum virus
uuuuugcggcgccgccgc

SEQ ID NO: 3099238 - RNA, 22 nt, Molluscum contagiosum virus
cgggaaggcaggccccgcacca

SEQ ID NO: 3099239 - RNA, 11 nt, Molluscum contagiosum virus
cgcugcgccac

SEQ ID NO: 3099240 - RNA, 23 nt, Molluscum contagiosum virus
cgagcgcuucuuccggcagcugg

SEQ ID NO: 3099241 - RNA, 16 nt, Molluscum contagiosum virus
gcagccgcagcccacg

SEQ ID NO: 3099242 - RNA, 19 nt, Molluscum contagiosum virus
gcgacgugaagacgcuggc

SEQ ID NO: 3099243 - RNA, 16 nt, Molluscum contagiosum virus
cugcuuugucugcagg

SEQ ID NO: 3099244 - RNA, 21 nt, Molluscum contagiosum virus
cgaacugcccggcggcaagcc

SEQ ID NO: 3099245 - RNA, 21 nt, Molluscum contagiosum virus
agaaagaccuugucagugggc

SEQ ID NO: 3099246 - RNA, 19 nt, Molluscum contagiosum virus
gugaagacgcuggcggcgc

SEQ ID NO: 3099247 - RNA, 16 nt, Molluscum contagiosum virus
cgcagcaagcagccgc

SEQ ID NO: 3099248 - RNA, 11 nt, Molluscum contagiosum virus
cgcgcuuuguc

SEQ ID NO: 3099249 - RNA, 14 nt, Molluscum contagiosum virus
cgcgugccuggcuu

SEQ ID NO: 3099250 - RNA, 14 nt, Molluscum contagiosum virus
gccguccgccucga

SEQ ID NO: 3099251 - RNA, 21 nt, Molluscum contagiosum virus
gcgcggcgcuuucgcccgccg

SEQ ID NO: 3099252 - RNA, 20 nt, Molluscum contagiosum virus
gaggguggcuugcugcagua

SEQ ID NO: 3099253 - RNA, 12 nt, Molluscum contagiosum virus
ggaucaccacug

SEQ ID NO: 3099254 - RNA, 23 nt, Molluscum contagiosum virus
cguagacagugcggcgcggcugc

SEQ ID NO: 3099255 - RNA, 22 nt, Molluscum contagiosum virus
gcccuacgcgcgcgugcugcua

SEQ ID NO: 3099256 - RNA, 21 nt, Molluscum contagiosum virus
ccagguucucgcgguuguagc

SEQ ID NO: 3099257 - RNA, 18 nt, Molluscum contagiosum virus
cguacucaacaagcugcu

SEQ ID NO: 3099258 - RNA, 15 nt, Molluscum contagiosum virus
cugcgaguccuccuc

SEQ ID NO: 3099259 - RNA, 14 nt, Molluscum contagiosum virus
cgcgcccaccagca

SEQ ID NO: 3099260 - RNA, 21 nt, Molluscum contagiosum virus
caugaacaacauggugcuggc

SEQ ID NO: 3099261 - RNA, 16 nt, Molluscum contagiosum virus
acgguaaacucuugca

SEQ ID NO: 3099262 - RNA, 17 nt, Molluscum contagiosum virus
cuguaaauggacccgcu

SEQ ID NO: 3099263 - RNA, 14 nt, Molluscum contagiosum virus
agcguccagccgca

SEQ ID NO: 3099264 - RNA, 19 nt, Molluscum contagiosum virus
acuccuuucgacgcugccu

SEQ ID NO: 3099265 - RNA, 21 nt, Molluscum contagiosum virus
gggaagcccucaggggcucuc

SEQ ID NO: 3099266 - RNA, 16 nt, Molluscum contagiosum virus
agaccucgcgcuuccg

SEQ ID NO: 3099267 - RNA, 18 nt, Molluscum contagiosum virus
agcagcggggacucuccc

SEQ ID NO: 3099268 - RNA, 20 nt, Molluscum contagiosum virus
gggaaaacgcgcggcagcag

SEQ ID NO: 3099269 - RNA, 15 nt, Molluscum contagiosum virus
agaagaggccagcac

SEQ ID NO: 3099270 - RNA, 15 nt, Molluscum contagiosum virus
ggcaccugcaggaaa

SEQ ID NO: 3099271 - RNA, 19 nt, Molluscum contagiosum virus
cgucgaugaaggcgcggcu

SEQ ID NO: 3099272 - RNA, 24 nt, Molluscum contagiosum virus
gcgccgggaauaggucggaagaag

SEQ ID NO: 3099273 - RNA, 20 nt, Molluscum contagiosum virus
caugcgcgcagugccgcuga

SEQ ID NO: 3099274 - RNA, 20 nt, Molluscum contagiosum virus
ccacgcgugcgcgccaggug

SEQ ID NO: 3099275 - RNA, 11 nt, Molluscum contagiosum virus
cagucccagca

SEQ ID NO: 3099276 - RNA, 22 nt, Molluscum contagiosum virus
gaauaccggagacaccagcucc

SEQ ID NO: 3099277 - RNA, 16 nt, Molluscum contagiosum virus
cgcaacacggcggugc

SEQ ID NO: 3099278 - RNA, 21 nt, Molluscum contagiosum virus
gcagguuugcacccgcgcagc

SEQ ID NO: 3099279 - RNA, 11 nt, Molluscum contagiosum virus
gcguagagcaa

SEQ ID NO: 3099280 - RNA, 18 nt, Molluscum contagiosum virus
gucgguaugcgaggccug

SEQ ID NO: 3099281 - RNA, 15 nt, Molluscum contagiosum virus
agugcgcgccaagaa

SEQ ID NO: 3099282 - RNA, 12 nt, Molluscum contagiosum virus
ucgucagaggga

SEQ ID NO: 3099283 - RNA, 23 nt, Molluscum contagiosum virus
caugcagcugcaggaccugcugg

SEQ ID NO: 3099284 - RNA, 15 nt, Molluscum contagiosum virus
cgcuggccucugccu

SEQ ID NO: 3099285 - RNA, 12 nt, Molluscum contagiosum virus
cgcggcgcucug

SEQ ID NO: 3099286 - RNA, 19 nt, Molluscum contagiosum virus
gagaaaugcgcacacuugc

SEQ ID NO: 3099287 - RNA, 17 nt, Molluscum contagiosum virus
cgcacuugcgcgccugu

SEQ ID NO: 3099288 - RNA, 19 nt, Molluscum contagiosum virus
gcacacgugcacguccugc

SEQ ID NO: 3099289 - RNA, 20 nt, Molluscum contagiosum virus
cgccagugcgugcacugucu

SEQ ID NO: 3099290 - RNA, 17 nt, Molluscum contagiosum virus
cacgagcaguccgccuc

SEQ ID NO: 3099291 - RNA, 19 nt, Molluscum contagiosum virus
cgggcccgcaugcagucac

SEQ ID NO: 3099292 - RNA, 14 nt, Molluscum contagiosum virus
cccguggcgcgccg

SEQ ID NO: 3099293 - RNA, 17 nt, Molluscum contagiosum virus
gagggccuuggcggcgc

SEQ ID NO: 3099294 - RNA, 22 nt, Molluscum contagiosum virus
ucgaccugcacgacccucuucg

SEQ ID NO: 3099295 - RNA, 16 nt, Molluscum contagiosum virus
uagcaaaugcgcugcu

SEQ ID NO: 3099296 - RNA, 17 nt, Molluscum contagiosum virus
guuccgaacaguacuuu

SEQ ID NO: 3099297 - RNA, 21 nt, Molluscum contagiosum virus
cuggcgcgugcgagcagaggc

SEQ ID NO: 3099298 - RNA, 13 nt, Molluscum contagiosum virus
cgaggccuacagc

SEQ ID NO: 3099299 - RNA, 15 nt, Molluscum contagiosum virus
ggagagagagacaug

SEQ ID NO: 3099300 - RNA, 20 nt, Molluscum contagiosum virus
ccugcugguggugcuggagc

SEQ ID NO: 3099301 - RNA, 21 nt, Molluscum contagiosum virus
ucgugcaccagcgcgcagaag

SEQ ID NO: 3099302 - RNA, 13 nt, Molluscum contagiosum virus
ccucgagagggag

SEQ ID NO: 3099303 - RNA, 13 nt, Molluscum contagiosum virus
gcgcggcgcagug

SEQ ID NO: 3099304 - RNA, 11 nt, Molluscum contagiosum virus
cgagcgugcaa

SEQ ID NO: 3099305 - RNA, 19 nt, Molluscum contagiosum virus
gcccaccagcagccaggcu

SEQ ID NO: 3099306 - RNA, 17 nt, Molluscum contagiosum virus
gcuccaugagguacucc

SEQ ID NO: 3099307 - RNA, 18 nt, Molluscum contagiosum virus
caauacucuguagcaucu

SEQ ID NO: 3099308 - RNA, 13 nt, Molluscum contagiosum virus
ccaagccugcuca

SEQ ID NO: 3099309 - RNA, 20 nt, Molluscum contagiosum virus
accugcgacagcugcugcuc

SEQ ID NO: 3099310 - RNA, 13 nt, Molluscum contagiosum virus
cacagcaaaagcu

SEQ ID NO: 3099311 - RNA, 18 nt, Molluscum contagiosum virus
auggcauucucggacagu

SEQ ID NO: 3099312 - RNA, 22 nt, Molluscum contagiosum virus
gacuucccgacgucuuccccaa

SEQ ID NO: 3099313 - RNA, 19 nt, Molluscum contagiosum virus
ggcguacgcgcagggagcu

SEQ ID NO: 3099314 - RNA, 19 nt, Molluscum contagiosum virus
cgcacgaccacgcuggcac

SEQ ID NO: 3099315 - RNA, 22 nt, Molluscum contagiosum virus
cuggcugcugcgcgaccgcacc

SEQ ID NO: 3099316 - RNA, 21 nt, Molluscum contagiosum virus
cgcagaacacgggggcugccg

SEQ ID NO: 3099317 - RNA, 14 nt, Molluscum contagiosum virus
agccgagcgccgcc

SEQ ID NO: 3099318 - RNA, 18 nt, Molluscum contagiosum virus
gcgaacaucucggcuccg

SEQ ID NO: 3099319 - RNA, 15 nt, Molluscum contagiosum virus
gcugcugcacagcuu

SEQ ID NO: 3099320 - RNA, 19 nt, Molluscum contagiosum virus
aaaggcaaagccugcugcg

SEQ ID NO: 3099321 - RNA, 13 nt, Molluscum contagiosum virus
cgcugcagcuagg

SEQ ID NO: 3099322 - RNA, 23 nt, Molluscum contagiosum virus
gcgcgcuaguggcaagggccugc

SEQ ID NO: 3099323 - RNA, 16 nt, Molluscum contagiosum virus
gccgcucguccagcug

SEQ ID NO: 3099324 - RNA, 14 nt, Molluscum contagiosum virus
cugugcggcacgcc

SEQ ID NO: 3099325 - RNA, 14 nt, Molluscum contagiosum virus
gccgcugcgccgcc

SEQ ID NO: 3099326 - RNA, 23 nt, Molluscum contagiosum virus
uggcacccuucugaggggcagug

SEQ ID NO: 3099327 - RNA, 13 nt, Molluscum contagiosum virus
cucgagcacgccu

SEQ ID NO: 3099328 - RNA, 22 nt, Molluscum contagiosum virus
cgcugcggcgcucgcagcacau

SEQ ID NO: 3099329 - RNA, 16 nt, Molluscum contagiosum virus
gcgaacgugcgaacac

SEQ ID NO: 3099330 - RNA, 15 nt, Molluscum contagiosum virus
gcgcucgccccuucc

SEQ ID NO: 3099331 - RNA, 23 nt, Molluscum contagiosum virus
guggcgccauugcucgcggugcc

SEQ ID NO: 3099332 - RNA, 23 nt, Molluscum contagiosum virus
acgucuggcucguacugcugcag

SEQ ID NO: 3099333 - RNA, 13 nt, Molluscum contagiosum virus
caagcagucucau

SEQ ID NO: 3099334 - RNA, 17 nt, Molluscum contagiosum virus
cuccgguacguacagug

SEQ ID NO: 3099335 - RNA, 20 nt, Molluscum contagiosum virus
gcgucgugcaccuggagcag

SEQ ID NO: 3099336 - RNA, 13 nt, Molluscum contagiosum virus
gacucgcugccag

SEQ ID NO: 3099337 - RNA, 17 nt, Molluscum contagiosum virus
cucgcgggcguggggag

SEQ ID NO: 3099338 - RNA, 15 nt, Molluscum contagiosum virus
cggcgcgaagcaggc

SEQ ID NO: 3099339 - RNA, 15 nt, Molluscum contagiosum virus
cuuggcgcccuuccu

SEQ ID NO: 3099340 - RNA, 21 nt, Molluscum contagiosum virus
agcaugcugucucugucccug

SEQ ID NO: 3099341 - RNA, 21 nt, Molluscum contagiosum virus
cacgcgagcaauggcggccug

SEQ ID NO: 3099342 - RNA, 22 nt, Molluscum contagiosum virus
aaauggccuugcgagcgcugcc

SEQ ID NO: 3099343 - RNA, 16 nt, Molluscum contagiosum virus
ggcgcccgugccgccg

SEQ ID NO: 3099344 - RNA, 12 nt, Molluscum contagiosum virus
cagugcgugcac

SEQ ID NO: 3099345 - RNA, 18 nt, Molluscum contagiosum virus
ggaagcaacgacaaggaa

SEQ ID NO: 3099346 - RNA, 20 nt, Molluscum contagiosum virus
ugucgucaaaggcaaagccu

SEQ ID NO: 3099347 - RNA, 15 nt, Molluscum contagiosum virus
gggcgcgcaccccgu

SEQ ID NO: 3099348 - RNA, 23 nt, Molluscum contagiosum virus
uggcgugaccauggacacgcugc

SEQ ID NO: 3099349 - RNA, 16 nt, Molluscum contagiosum virus
agcaccgccugcugca

SEQ ID NO: 3099350 - RNA, 17 nt, Molluscum contagiosum virus
ccgcgcaagagccgccg

SEQ ID NO: 3099351 - RNA, 13 nt, Molluscum contagiosum virus
gcggagcugcccg

SEQ ID NO: 3099352 - RNA, 22 nt, Molluscum contagiosum virus
gaaguguugccgccggccuugu

SEQ ID NO: 3099353 - RNA, 19 nt, Molluscum contagiosum virus
gccagccgcucguccagcu

SEQ ID NO: 3099354 - RNA, 21 nt, Molluscum contagiosum virus
acaguaccagauuagcaacug

SEQ ID NO: 3099355 - RNA, 12 nt, Molluscum contagiosum virus
cacacacacucg

SEQ ID NO: 3099356 - RNA, 22 nt, Molluscum contagiosum virus
uccagcucggguuccagcuccg

SEQ ID NO: 3099357 - RNA, 14 nt, Molluscum contagiosum virus
ccggcgcgcgcgcg

SEQ ID NO: 3099358 - RNA, 15 nt, Molluscum contagiosum virus
gagcucgccuccuug

SEQ ID NO: 3099359 - RNA, 16 nt, Molluscum contagiosum virus
cgccaccaugcuuguu

SEQ ID NO: 3099360 - RNA, 12 nt, Molluscum contagiosum virus
uauacuccaaaa

SEQ ID NO: 3099361 - RNA, 13 nt, Molluscum contagiosum virus
cgccgccggugcg

SEQ ID NO: 3099362 - RNA, 12 nt, Molluscum contagiosum virus
cguggacagcau

SEQ ID NO: 3099363 - RNA, 14 nt, Molluscum contagiosum virus
gaacugcagcagcu

SEQ ID NO: 3099364 - RNA, 12 nt, Molluscum contagiosum virus
uggugcagaucu

SEQ ID NO: 3099365 - RNA, 14 nt, Molluscum contagiosum virus
cagcugcaggaccu

SEQ ID NO: 3099366 - RNA, 21 nt, Molluscum contagiosum virus
cgaggauacgcccgcgaaaga

SEQ ID NO: 3099367 - RNA, 19 nt, Molluscum contagiosum virus
acggugcaaccgcugcucg

SEQ ID NO: 3099368 - RNA, 13 nt, Molluscum contagiosum virus
cgcgguggcaggc

SEQ ID NO: 3099369 - RNA, 23 nt, Molluscum contagiosum virus
gacgugugcucugugcgcgcaga

SEQ ID NO: 3099370 - RNA, 14 nt, Molluscum contagiosum virus
cgagacgcugcugc

SEQ ID NO: 3099371 - RNA, 21 nt, Molluscum contagiosum virus
ucagccccgggcccgcaugca

SEQ ID NO: 3099372 - RNA, 14 nt, Molluscum contagiosum virus
caaagacgggcccg

SEQ ID NO: 3099373 - RNA, 22 nt, Molluscum contagiosum virus
caccuggcgagcgcucugcauu

SEQ ID NO: 3099374 - RNA, 22 nt, Molluscum contagiosum virus
cucgggugcccggacagagccc

SEQ ID NO: 3099375 - RNA, 14 nt, Molluscum contagiosum virus
cugucccucugugc

SEQ ID NO: 3099376 - RNA, 15 nt, Molluscum contagiosum virus
acacggccuccagca

SEQ ID NO: 3099377 - RNA, 16 nt, Molluscum contagiosum virus
cgaacaccgacaagga

SEQ ID NO: 3099378 - RNA, 22 nt, Molluscum contagiosum virus
ccgcgaggacccgcgcuuuguc

SEQ ID NO: 3099379 - RNA, 21 nt, Molluscum contagiosum virus
cgcgccaugguuuccgugucc

SEQ ID NO: 3099380 - RNA, 16 nt, Molluscum contagiosum virus
guggugcugggcgugg

SEQ ID NO: 3099381 - RNA, 16 nt, Molluscum contagiosum virus
ggcgccgaugcagugc

SEQ ID NO: 3099382 - RNA, 17 nt, Molluscum contagiosum virus
gccgcgcgagugccagc

SEQ ID NO: 3099383 - RNA, 12 nt, Molluscum contagiosum virus
cggcugcccugu

SEQ ID NO: 3099384 - RNA, 19 nt, Molluscum contagiosum virus
gacacgggugagcucgcca

SEQ ID NO: 3099385 - RNA, 13 nt, Molluscum contagiosum virus
ggucaagauccaa

SEQ ID NO: 3099386 - RNA, 21 nt, Molluscum contagiosum virus
agccgcgugcgccgccgcagg

SEQ ID NO: 3099387 - RNA, 13 nt, Molluscum contagiosum virus
acugcaacgugag

SEQ ID NO: 3099388 - RNA, 22 nt, Molluscum contagiosum virus
caccguaccgcgcccgccagca

SEQ ID NO: 3099389 - RNA, 21 nt, Molluscum contagiosum virus
cgcugcucuacuuccacgagc

SEQ ID NO: 3099390 - RNA, 18 nt, Molluscum contagiosum virus
cuggacggugcuggugcu

SEQ ID NO: 3099391 - RNA, 13 nt, Molluscum contagiosum virus
aggcaggagccuc

SEQ ID NO: 3099392 - RNA, 13 nt, Molluscum contagiosum virus
ucaucgcggagcu

SEQ ID NO: 3099393 - RNA, 19 nt, Molluscum contagiosum virus
gcccgcgggcugcaagauu

SEQ ID NO: 3099394 - RNA, 14 nt, Molluscum contagiosum virus
gcgugccgcccgag

SEQ ID NO: 3099395 - RNA, 21 nt, Molluscum contagiosum virus
ugcucgcggucgggccccugc

SEQ ID NO: 3099396 - RNA, 15 nt, Molluscum contagiosum virus
ccgcgcccgccagca

SEQ ID NO: 3099397 - RNA, 16 nt, Molluscum contagiosum virus
guccggggaggagcuc

SEQ ID NO: 3099398 - RNA, 15 nt, Molluscum contagiosum virus
ccagguccuccagcg

SEQ ID NO: 3099399 - RNA, 21 nt, Molluscum contagiosum virus
ugccgagcgugcaagaagucu

SEQ ID NO: 3099400 - RNA, 18 nt, Molluscum contagiosum virus
uguaauaguacacuuuga

SEQ ID NO: 3099401 - RNA, 19 nt, Molluscum contagiosum virus
acgugacgcgccucgagca

SEQ ID NO: 3099402 - RNA, 18 nt, Molluscum contagiosum virus
gaagcaaugcgcaaggcc

SEQ ID NO: 3099403 - RNA, 18 nt, Molluscum contagiosum virus
gcgcgcucgaggcgccgu

SEQ ID NO: 3099404 - RNA, 17 nt, Molluscum contagiosum virus
gcggcggcguaggccug

SEQ ID NO: 3099405 - RNA, 13 nt, Molluscum contagiosum virus
ccugcugcgcgcg

SEQ ID NO: 3099406 - RNA, 21 nt, Molluscum contagiosum virus
gccgcuuucugggcgcgugcg

SEQ ID NO: 3099407 - RNA, 16 nt, Molluscum contagiosum virus
gcacacuccucggcgc

SEQ ID NO: 3099408 - RNA, 23 nt, Molluscum contagiosum virus
caaggaaaggcacccaccaggaa

SEQ ID NO: 3099409 - RNA, 15 nt, Molluscum contagiosum virus
gcuggugggcgugcg

SEQ ID NO: 3099410 - RNA, 23 nt, Molluscum contagiosum virus
ggaaaacuguaggggagggcggc

SEQ ID NO: 3099411 - RNA, 22 nt, Molluscum contagiosum virus
gaaaauuuaaucaaggauuuaa

SEQ ID NO: 3099412 - RNA, 16 nt, Molluscum contagiosum virus
cgugccacugccgccg

SEQ ID NO: 3099413 - RNA, 16 nt, Molluscum contagiosum virus
cgcacgcucucgcugg

SEQ ID NO: 3099414 - RNA, 15 nt, Molluscum contagiosum virus
gcggagcgccuucug

SEQ ID NO: 3099415 - RNA, 13 nt, Molluscum contagiosum virus
aggucuuggggaa

SEQ ID NO: 3099416 - RNA, 18 nt, Molluscum contagiosum virus
ccugccgccugcaggcaa

SEQ ID NO: 3099417 - RNA, 16 nt, Molluscum contagiosum virus
ucgccggacagcucag

SEQ ID NO: 3099418 - RNA, 15 nt, Molluscum contagiosum virus
caaccccgcgcugcg

SEQ ID NO: 3099419 - RNA, 16 nt, Molluscum contagiosum virus
cgauggcgcagcuccu

SEQ ID NO: 3099420 - RNA, 21 nt, Molluscum contagiosum virus
gcgggaagaaggugcucagca

SEQ ID NO: 3099421 - RNA, 14 nt, Molluscum contagiosum virus
cagacgccgagcgg

SEQ ID NO: 3099422 - RNA, 14 nt, Molluscum contagiosum virus
uacacgcagagcca

SEQ ID NO: 3099423 - RNA, 14 nt, Molluscum contagiosum virus
ggcucaagcuggca

SEQ ID NO: 3099424 - RNA, 20 nt, Molluscum contagiosum virus
aagcacgccagguguuccug

SEQ ID NO: 3099425 - RNA, 17 nt, Molluscum contagiosum virus
cauggaggcgcuagugc

SEQ ID NO: 3099426 - RNA, 20 nt, Molluscum contagiosum virus
uggcagcggcaaaggcccgc

SEQ ID NO: 3099427 - RNA, 20 nt, Molluscum contagiosum virus
augcuuuuguuacucucaga

SEQ ID NO: 3099428 - RNA, 17 nt, Molluscum contagiosum virus
cugcuugcccgcgccgc

SEQ ID NO: 3099429 - RNA, 21 nt, Molluscum contagiosum virus
gcgcccgugcucgcgggccuu

SEQ ID NO: 3099430 - RNA, 13 nt, Molluscum contagiosum virus
gagcugcugcccg

SEQ ID NO: 3099431 - RNA, 21 nt, Molluscum contagiosum virus
caaggaaaggcacccaccagg

SEQ ID NO: 3099432 - RNA, 18 nt, Molluscum contagiosum virus
caaccucgagaagaccug

SEQ ID NO: 3099433 - RNA, 16 nt, Molluscum contagiosum virus
cccgcugucgcgcguc

SEQ ID NO: 3099434 - RNA, 18 nt, Molluscum contagiosum virus
ucggggcccucggcgcgc

SEQ ID NO: 3099435 - RNA, 17 nt, Molluscum contagiosum virus
gaagaucaagcacgcua

SEQ ID NO: 3099436 - RNA, 17 nt, Molluscum contagiosum virus
ugaacucgcugcugcuc

SEQ ID NO: 3099437 - RNA, 16 nt, Molluscum contagiosum virus
cucgaugggcuccagg

SEQ ID NO: 3099438 - RNA, 20 nt, Molluscum contagiosum virus
guccgcggacgcgggccugu

SEQ ID NO: 3099439 - RNA, 21 nt, Molluscum contagiosum virus
ccaggcggucuuccagcacug

SEQ ID NO: 3099440 - RNA, 13 nt, Molluscum contagiosum virus
cgcccaaggccgc

SEQ ID NO: 3099441 - RNA, 12 nt, Molluscum contagiosum virus
aucgugcuggag

SEQ ID NO: 3099442 - RNA, 14 nt, Molluscum contagiosum virus
gccagcgggaaacu

SEQ ID NO: 3099443 - RNA, 23 nt, Molluscum contagiosum virus
gcugcucccucucgaggaauuug

SEQ ID NO: 3099444 - RNA, 15 nt, Molluscum contagiosum virus
cggagaucaggcagc

SEQ ID NO: 3099445 - RNA, 22 nt, Molluscum contagiosum virus
cgccaggaaaggcaggagccuc

SEQ ID NO: 3099446 - RNA, 15 nt, Molluscum contagiosum virus
cacgagcacugccug

SEQ ID NO: 3099447 - RNA, 16 nt, Molluscum contagiosum virus
cgcgaaguuccugcau

SEQ ID NO: 3099448 - RNA, 14 nt, Molluscum contagiosum virus
cgcggcccgcgggc

SEQ ID NO: 3099449 - RNA, 18 nt, Molluscum contagiosum virus
cgcaggacuggcaccugc

SEQ ID NO: 3099450 - RNA, 12 nt, Molluscum contagiosum virus
caagcacgccag

SEQ ID NO: 3099451 - RNA, 13 nt, Molluscum contagiosum virus
ccggacagcucag

SEQ ID NO: 3099452 - RNA, 18 nt, Molluscum contagiosum virus
cgcucgcggugcagcugc

SEQ ID NO: 3099453 - RNA, 15 nt, Molluscum contagiosum virus
cccuaagggcccgcu

SEQ ID NO: 3099454 - RNA, 11 nt, Molluscum contagiosum virus
cgccugcuggc

SEQ ID NO: 3099455 - RNA, 23 nt, Molluscum contagiosum virus
uuccgucccccgcggagcugugc

SEQ ID NO: 3099456 - RNA, 13 nt, Molluscum contagiosum virus
ugcccgccagaag

SEQ ID NO: 3099457 - RNA, 21 nt, Molluscum contagiosum virus
cuucuggcaaacgcacugugu

SEQ ID NO: 3099458 - RNA, 22 nt, Molluscum contagiosum virus
aguccgcccccagguggagcug

SEQ ID NO: 3099459 - RNA, 16 nt, Molluscum contagiosum virus
gaugggcuccagguuc

SEQ ID NO: 3099460 - RNA, 15 nt, Molluscum contagiosum virus
caacagugcgugcca

SEQ ID NO: 3099461 - RNA, 15 nt, Molluscum contagiosum virus
gcgcaugacagccau

SEQ ID NO: 3099462 - RNA, 20 nt, Molluscum contagiosum virus
cgcuaccagcucgcgcaguu

SEQ ID NO: 3099463 - RNA, 13 nt, Molluscum contagiosum virus
gaucaccgaggag

SEQ ID NO: 3099464 - RNA, 15 nt, Molluscum contagiosum virus
cgcgcgcuggcgugc

SEQ ID NO: 3099465 - RNA, 13 nt, Molluscum contagiosum virus
ggcgcacuggggc

SEQ ID NO: 3099466 - RNA, 19 nt, Molluscum contagiosum virus
gagcugcagagcgugcugg

SEQ ID NO: 3099467 - RNA, 17 nt, Molluscum contagiosum virus
ccggaauguagccuuug

SEQ ID NO: 3099468 - RNA, 15 nt, Molluscum contagiosum virus
gcccgagcgcgcgug

SEQ ID NO: 3099469 - RNA, 15 nt, Molluscum contagiosum virus
uccucaccuuccugg

SEQ ID NO: 3099470 - RNA, 14 nt, Molluscum contagiosum virus
cauacuccugcugg

SEQ ID NO: 3099471 - RNA, 21 nt, Molluscum contagiosum virus
gcaggaaagguaccccgcagg

SEQ ID NO: 3099472 - RNA, 21 nt, Molluscum contagiosum virus
ccaggaaaacggaaacagcac

SEQ ID NO: 3099473 - RNA, 15 nt, Molluscum contagiosum virus
agcggucucggcagc

SEQ ID NO: 3099474 - RNA, 23 nt, Molluscum contagiosum virus
acguuuucuuugcgcucaucaag

SEQ ID NO: 3099475 - RNA, 15 nt, Molluscum contagiosum virus
uuccugcgucgccug

SEQ ID NO: 3099476 - RNA, 23 nt, Molluscum contagiosum virus
aaagacgagcugugcgagccagu

SEQ ID NO: 3099477 - RNA, 11 nt, Molluscum contagiosum virus
caagacuggca

SEQ ID NO: 3099478 - RNA, 12 nt, Molluscum contagiosum virus
ggcuuugacaug

SEQ ID NO: 3099479 - RNA, 16 nt, Molluscum contagiosum virus
auggccggcaacuggc

SEQ ID NO: 3099480 - RNA, 22 nt, Molluscum contagiosum virus
gagccucccccgcgcacugcca

SEQ ID NO: 3099481 - RNA, 13 nt, Molluscum contagiosum virus
agggcagccucaa

SEQ ID NO: 3099482 - RNA, 12 nt, Molluscum contagiosum virus
ggcuuggacagc

SEQ ID NO: 3099483 - RNA, 15 nt, Molluscum contagiosum virus
accugggcaggccgc

SEQ ID NO: 3099484 - RNA, 21 nt, Molluscum contagiosum virus
uucuacgggaagcugcacgug

SEQ ID NO: 3099485 - RNA, 21 nt, Molluscum contagiosum virus
acgcgcccacgugccaagacc

SEQ ID NO: 3099486 - RNA, 16 nt, Molluscum contagiosum virus
aggugcacgugcugca

SEQ ID NO: 3099487 - RNA, 17 nt, Molluscum contagiosum virus
uguccucuuggccccuc

SEQ ID NO: 3099488 - RNA, 17 nt, Molluscum contagiosum virus
gagacgcggccgcggag

SEQ ID NO: 3099489 - RNA, 22 nt, Molluscum contagiosum virus
gcccgcgcuucugccugcuccc

SEQ ID NO: 3099490 - RNA, 13 nt, Molluscum contagiosum virus
cucuuuguuccug

SEQ ID NO: 3099491 - RNA, 19 nt, Molluscum contagiosum virus
uggccaaagucuuccuggg

SEQ ID NO: 3099492 - RNA, 16 nt, Molluscum contagiosum virus
ccucgagcacgccucc

SEQ ID NO: 3099493 - RNA, 17 nt, Molluscum contagiosum virus
guacccgcaaccccgcg

SEQ ID NO: 3099494 - RNA, 17 nt, Molluscum contagiosum virus
agcuuacuagacuggcu

SEQ ID NO: 3099495 - RNA, 19 nt, Molluscum contagiosum virus
aacucggcuucugcugcac

SEQ ID NO: 3099496 - RNA, 20 nt, Molluscum contagiosum virus
cugcgcgcgcggcgcagugc

SEQ ID NO: 3099497 - RNA, 13 nt, Molluscum contagiosum virus
ugcccgcgccgca

SEQ ID NO: 3099498 - RNA, 16 nt, Molluscum contagiosum virus
gagcugcgugugccgg

SEQ ID NO: 3099499 - RNA, 13 nt, Molluscum contagiosum virus
ggacacgcgcacg

SEQ ID NO: 3099500 - RNA, 21 nt, Molluscum contagiosum virus
cuucgcacgcaaaugcgcgcg

SEQ ID NO: 3099501 - RNA, 14 nt, Molluscum contagiosum virus
cagaacugccuggu

SEQ ID NO: 3099502 - RNA, 22 nt, Molluscum contagiosum virus
gcgcccgcggcacaugcagcug

SEQ ID NO: 3099503 - RNA, 22 nt, Molluscum contagiosum virus
cgccgagcccgagcccgggccc

SEQ ID NO: 3099504 - RNA, 14 nt, Molluscum contagiosum virus
ccugcuugucugcc

SEQ ID NO: 3099505 - RNA, 14 nt, Molluscum contagiosum virus
cggagacaccagcu

SEQ ID NO: 3099506 - RNA, 14 nt, Molluscum contagiosum virus
gcugcgcuaccacg

SEQ ID NO: 3099507 - RNA, 18 nt, Molluscum contagiosum virus
cuaccaagaacagagaaa

SEQ ID NO: 3099508 - RNA, 15 nt, Molluscum contagiosum virus
ugccugcacugagaa

SEQ ID NO: 3099509 - RNA, 22 nt, Molluscum contagiosum virus
cucgcgagcguuucugccggag

SEQ ID NO: 3099510 - RNA, 18 nt, Molluscum contagiosum virus
gcugcaggaccugcuggu

SEQ ID NO: 3099511 - RNA, 20 nt, Molluscum contagiosum virus
ccggcgcaacgagcagcccg

SEQ ID NO: 3099512 - RNA, 14 nt, Molluscum contagiosum virus
gcucggaggcgcag

SEQ ID NO: 3099513 - RNA, 17 nt, Molluscum contagiosum virus
uacgaucgcgcucagga

SEQ ID NO: 3099514 - RNA, 18 nt, Molluscum contagiosum virus
cgcacucgggugcccgga

SEQ ID NO: 3099515 - RNA, 13 nt, Molluscum contagiosum virus
ccggcgcucgccu

SEQ ID NO: 3099516 - RNA, 22 nt, Molluscum contagiosum virus
gaccacgugccagagucgccgc

SEQ ID NO: 3099517 - RNA, 14 nt, Molluscum contagiosum virus
uggugcuggccaac

SEQ ID NO: 3099518 - RNA, 16 nt, Molluscum contagiosum virus
ggcgcucgccuuuccc

SEQ ID NO: 3099519 - RNA, 12 nt, Molluscum contagiosum virus
cauggcgccgcu

SEQ ID NO: 3099520 - RNA, 20 nt, Molluscum contagiosum virus
caguuagaaaugcuugcuuc

SEQ ID NO: 3099521 - RNA, 16 nt, Molluscum contagiosum virus
ccugcuggcgugcgua

SEQ ID NO: 3099522 - RNA, 14 nt, Molluscum contagiosum virus
gcccaccagcagcc

SEQ ID NO: 3099523 - RNA, 18 nt, Molluscum contagiosum virus
gcucauacuccugcuggc

SEQ ID NO: 3099524 - RNA, 23 nt, Molluscum contagiosum virus
cuuugaggaacuagugcugcugg

SEQ ID NO: 3099525 - RNA, 13 nt, Molluscum contagiosum virus
cgcuacagcagcc

SEQ ID NO: 3099526 - RNA, 19 nt, Molluscum contagiosum virus
cagcagccccgacgccagc

SEQ ID NO: 3099527 - RNA, 18 nt, Molluscum contagiosum virus
ccucgcgcgcgcgcggcg

SEQ ID NO: 3099528 - RNA, 16 nt, Molluscum contagiosum virus
cguucccaagcaaagc

SEQ ID NO: 3099529 - RNA, 18 nt, Molluscum contagiosum virus
ggaguagcgugcgccugc

SEQ ID NO: 3099530 - RNA, 22 nt, Molluscum contagiosum virus
caccucugcgcggcccgcgggc

SEQ ID NO: 3099531 - RNA, 14 nt, Molluscum contagiosum virus
caaccgccugcucu

SEQ ID NO: 3099532 - RNA, 15 nt, Molluscum contagiosum virus
cgccgucgcagaaga

SEQ ID NO: 3099533 - RNA, 21 nt, Molluscum contagiosum virus
cgugaggaggcggcacugcua

SEQ ID NO: 3099534 - RNA, 14 nt, Molluscum contagiosum virus
cccaccagcagcca

SEQ ID NO: 3099535 - RNA, 14 nt, Molluscum contagiosum virus
cccgggcccggguu

SEQ ID NO: 3099536 - RNA, 15 nt, Molluscum contagiosum virus
cacgguccugggcga

SEQ ID NO: 3099537 - RNA, 21 nt, Molluscum contagiosum virus
gccgcugccaacgcggaccgc

SEQ ID NO: 3099538 - RNA, 20 nt, Molluscum contagiosum virus
agcgugugccgccgcacuau

SEQ ID NO: 3099539 - RNA, 13 nt, Molluscum contagiosum virus
gccgcggccgccg

SEQ ID NO: 3099540 - RNA, 16 nt, Molluscum contagiosum virus
ccuguccgcggacgcg

SEQ ID NO: 3099541 - RNA, 16 nt, Molluscum contagiosum virus
aucaccccgcugggcc

SEQ ID NO: 3099542 - RNA, 21 nt, Molluscum contagiosum virus
acaugcaacgcaggacacugu

SEQ ID NO: 3099543 - RNA, 22 nt, Molluscum contagiosum virus
cgagcuucgucuucaccugcau

SEQ ID NO: 3099544 - RNA, 12 nt, Molluscum contagiosum virus
gccggcgccgcg

SEQ ID NO: 3099545 - RNA, 15 nt, Molluscum contagiosum virus
cugcuggugcucgcc

SEQ ID NO: 3099546 - RNA, 13 nt, Molluscum contagiosum virus
acgggccgccgcc

SEQ ID NO: 3099547 - RNA, 13 nt, Molluscum contagiosum virus
uguugagccuucu

SEQ ID NO: 3099548 - RNA, 20 nt, Molluscum contagiosum virus
ugagcaagcugcaagccagc

SEQ ID NO: 3099549 - RNA, 14 nt, Molluscum contagiosum virus
cggcaaaggcccgc

SEQ ID NO: 3099550 - RNA, 18 nt, Molluscum contagiosum virus
cacggcguucaccuuggc

SEQ ID NO: 3099551 - RNA, 14 nt, Molluscum contagiosum virus
gcucgugcucuugg

SEQ ID NO: 3099552 - RNA, 15 nt, Molluscum contagiosum virus
gcccgcggcgcgcag

SEQ ID NO: 3099553 - RNA, 12 nt, Molluscum contagiosum virus
caaagcgcggcc

SEQ ID NO: 3099554 - RNA, 11 nt, Molluscum contagiosum virus
gccccugcugc

SEQ ID NO: 3099555 - RNA, 16 nt, Molluscum contagiosum virus
ucaagacgcugcuggc

SEQ ID NO: 3099556 - RNA, 22 nt, Molluscum contagiosum virus
ugucccugcauacacuuccugc

SEQ ID NO: 3099557 - RNA, 21 nt, Molluscum contagiosum virus
ggagcaagucugcgcaggaca

SEQ ID NO: 3099558 - RNA, 12 nt, Molluscum contagiosum virus
cgcgagcagcug

SEQ ID NO: 3099559 - RNA, 14 nt, Molluscum contagiosum virus
acagcauccuggag

SEQ ID NO: 3099560 - RNA, 22 nt, Molluscum contagiosum virus
acugucgacagagaaguccccg

SEQ ID NO: 3099561 - RNA, 13 nt, Molluscum contagiosum virus
acggcacagucug

SEQ ID NO: 3099562 - RNA, 11 nt, Molluscum contagiosum virus
cacuggcccug

SEQ ID NO: 3099563 - RNA, 12 nt, Molluscum contagiosum virus
cgcucgggccgg

SEQ ID NO: 3099564 - RNA, 14 nt, Molluscum contagiosum virus
acgcgggccaggca

SEQ ID NO: 3099565 - RNA, 16 nt, Molluscum contagiosum virus
gcagcugccgcagagc

SEQ ID NO: 3099566 - RNA, 23 nt, Molluscum contagiosum virus
cucgagcucuucucgcagcggga

SEQ ID NO: 3099567 - RNA, 12 nt, Molluscum contagiosum virus
cccgacacacuc

SEQ ID NO: 3099568 - RNA, 22 nt, Molluscum contagiosum virus
cuucgcagagaccgucaaccug

SEQ ID NO: 3099569 - RNA, 16 nt, Molluscum contagiosum virus
ucgucgaagcccagcu

SEQ ID NO: 3099570 - RNA, 13 nt, Molluscum contagiosum virus
gcacccgagggcg

SEQ ID NO: 3099571 - RNA, 22 nt, Molluscum contagiosum virus
gaaccccucgugcugggccugc

SEQ ID NO: 3099572 - RNA, 15 nt, Molluscum contagiosum virus
aggagagagagacau

SEQ ID NO: 3099573 - RNA, 21 nt, Molluscum contagiosum virus
cgcgcucgucaaugcgcacgu

SEQ ID NO: 3099574 - RNA, 15 nt, Molluscum contagiosum virus
uuagccacugugcug

SEQ ID NO: 3099575 - RNA, 21 nt, Molluscum contagiosum virus
caggguuuucacgcaggaccu

SEQ ID NO: 3099576 - RNA, 13 nt, Molluscum contagiosum virus
gaggaggcaagcg

SEQ ID NO: 3099577 - RNA, 22 nt, Molluscum contagiosum virus
caccugcacgagccggcgccgu

SEQ ID NO: 3099578 - RNA, 22 nt, Molluscum contagiosum virus
ggcgcacggucuucucggugga

SEQ ID NO: 3099579 - RNA, 19 nt, Molluscum contagiosum virus
ugaaggacgcguucuccag

SEQ ID NO: 3099580 - RNA, 16 nt, Molluscum contagiosum virus
cgaagacgaagcgcuc

SEQ ID NO: 3099581 - RNA, 14 nt, Molluscum contagiosum virus
agggguccgcgucu

SEQ ID NO: 3099582 - RNA, 13 nt, Molluscum contagiosum virus
ucggaugcgcugc

SEQ ID NO: 3099583 - RNA, 16 nt, Molluscum contagiosum virus
gugcugcgucacaagc

SEQ ID NO: 3099584 - RNA, 15 nt, Molluscum contagiosum virus
cgugcccuggaccuc

SEQ ID NO: 3099585 - RNA, 20 nt, Molluscum contagiosum virus
cacguugccgcgcgcugcuc

SEQ ID NO: 3099586 - RNA, 20 nt, Molluscum contagiosum virus
guucgcaaagacgagggaug

SEQ ID NO: 3099587 - RNA, 12 nt, Molluscum contagiosum virus
acccgugcuugc

SEQ ID NO: 3099588 - RNA, 14 nt, Molluscum contagiosum virus
ggccugcugaagaa

SEQ ID NO: 3099589 - RNA, 19 nt, Molluscum contagiosum virus
gaagaggccggcacaagcc

SEQ ID NO: 3099590 - RNA, 13 nt, Molluscum contagiosum virus
gcuucgucuucac

SEQ ID NO: 3099591 - RNA, 16 nt, Molluscum contagiosum virus
gcgaccggcgugccuu

SEQ ID NO: 3099592 - RNA, 19 nt, Molluscum contagiosum virus
cuagugcagaugaggcugc

SEQ ID NO: 3099593 - RNA, 11 nt, Molluscum contagiosum virus
ccgcaccgagc

SEQ ID NO: 3099594 - RNA, 12 nt, Molluscum contagiosum virus
caccuccagguc

SEQ ID NO: 3099595 - RNA, 20 nt, Molluscum contagiosum virus
cuagacacgagcgcggcaac

SEQ ID NO: 3099596 - RNA, 22 nt, Molluscum contagiosum virus
uggcggccaaccgccugcucuc

SEQ ID NO: 3099597 - RNA, 21 nt, Molluscum contagiosum virus
gaggacuaccuggcggcgcug

SEQ ID NO: 3099598 - RNA, 13 nt, Molluscum contagiosum virus
ugcucccucgcgc

SEQ ID NO: 3099599 - RNA, 15 nt, Molluscum contagiosum virus
gccgcgcggcagaca

SEQ ID NO: 3099600 - RNA, 13 nt, Molluscum contagiosum virus
cacuggaggugag

SEQ ID NO: 3099601 - RNA, 21 nt, Molluscum contagiosum virus
uccgcaggcgucaugcgcgcg

SEQ ID NO: 3099602 - RNA, 15 nt, Molluscum contagiosum virus
cagcgccgccaccuc

SEQ ID NO: 3099603 - RNA, 15 nt, Molluscum contagiosum virus
cguccgcauccucaa

SEQ ID NO: 3099604 - RNA, 17 nt, Molluscum contagiosum virus
cggggccggcuuugcgg

SEQ ID NO: 3099605 - RNA, 22 nt, Molluscum contagiosum virus
cacaggugcguaaugcuggcgc

SEQ ID NO: 3099606 - RNA, 15 nt, Molluscum contagiosum virus
ucacgcuagcgggcc

SEQ ID NO: 3099607 - RNA, 18 nt, Molluscum contagiosum virus
cggcgcguuuucgcggcc

SEQ ID NO: 3099608 - RNA, 22 nt, Molluscum contagiosum virus
accccucgugcugggccugccg

SEQ ID NO: 3099609 - RNA, 17 nt, Molluscum contagiosum virus
aucaaccgcaaggaaaa

SEQ ID NO: 3099610 - RNA, 20 nt, Molluscum contagiosum virus
ccuggucgagcaccugucgc

SEQ ID NO: 3099611 - RNA, 17 nt, Molluscum contagiosum virus
gaagaccaccagcacca

SEQ ID NO: 3099612 - RNA, 14 nt, Molluscum contagiosum virus
ccugugcccugucc

SEQ ID NO: 3099613 - RNA, 13 nt, Molluscum contagiosum virus
ggcaaugggcacg

SEQ ID NO: 3099614 - RNA, 23 nt, Molluscum contagiosum virus
gcacaguccagcccgcggugcgc

SEQ ID NO: 3099615 - RNA, 15 nt, Molluscum contagiosum virus
ccuugcuggcacgcg

SEQ ID NO: 3099616 - RNA, 15 nt, Molluscum contagiosum virus
gcucgaugggcucca

SEQ ID NO: 3099617 - RNA, 15 nt, Molluscum contagiosum virus
ugcgcuccaugcugc

SEQ ID NO: 3099618 - RNA, 12 nt, Molluscum contagiosum virus
cgcgcugcucug

SEQ ID NO: 3099619 - RNA, 13 nt, Molluscum contagiosum virus
ccgcgggcgcacg

SEQ ID NO: 3099620 - RNA, 22 nt, Molluscum contagiosum virus
gggaauaccggagacaccagcu

SEQ ID NO: 3099621 - RNA, 24 nt, Molluscum contagiosum virus
aaucccacguacgagcagcugcug

SEQ ID NO: 3099622 - RNA, 21 nt, Molluscum contagiosum virus
gccgccgcguacgcgccgggg

SEQ ID NO: 3099623 - RNA, 19 nt, Molluscum contagiosum virus
uccccgcgcaagagccgcc

SEQ ID NO: 3099624 - RNA, 11 nt, Molluscum contagiosum virus
ucacgccgccc

SEQ ID NO: 3099625 - RNA, 17 nt, Molluscum contagiosum virus
ccaggccgcggcagcuc

SEQ ID NO: 3099626 - RNA, 22 nt, Molluscum contagiosum virus
guccuuuuuugugucuacggac

SEQ ID NO: 3099627 - RNA, 19 nt, Molluscum contagiosum virus
ggacgcguucuccaggaac

SEQ ID NO: 3099628 - RNA, 23 nt, Molluscum contagiosum virus
ggaauuugcggcgcgggcaagca

SEQ ID NO: 3099629 - RNA, 23 nt, Molluscum contagiosum virus
acggccuucuccucgcucugcuc

SEQ ID NO: 3099630 - RNA, 12 nt, Molluscum contagiosum virus
ccaggaucacga

SEQ ID NO: 3099631 - RNA, 20 nt, Molluscum contagiosum virus
aaguuguuccggugaaaauc

SEQ ID NO: 3099632 - RNA, 23 nt, Molluscum contagiosum virus
gagaucaggcagcugcugcgcuc

SEQ ID NO: 3099633 - RNA, 22 nt, Molluscum contagiosum virus
cuucgacagcgugcgcgggcac

SEQ ID NO: 3099634 - RNA, 14 nt, Molluscum contagiosum virus
ucaaccugcugccu

SEQ ID NO: 3099635 - RNA, 13 nt, Molluscum contagiosum virus
cgcgcgcagcucg

SEQ ID NO: 3099636 - RNA, 17 nt, Molluscum contagiosum virus
aggcacccaccaggaac

SEQ ID NO: 3099637 - RNA, 15 nt, Molluscum contagiosum virus
cgugccuggcagugc

SEQ ID NO: 3099638 - RNA, 15 nt, Molluscum contagiosum virus
caaaagaggccugcu

SEQ ID NO: 3099639 - RNA, 13 nt, Molluscum contagiosum virus
cgcgcgcucugcc

SEQ ID NO: 3099640 - RNA, 16 nt, Molluscum contagiosum virus
ugcaccuacgcgccga

SEQ ID NO: 3099641 - RNA, 19 nt, Molluscum contagiosum virus
ugcuuccgcaccuggucga

SEQ ID NO: 3099642 - RNA, 13 nt, Molluscum contagiosum virus
uaccuugaagaaa

SEQ ID NO: 3099643 - RNA, 20 nt, Molluscum contagiosum virus
gccugcgcccgcaaaccuug

SEQ ID NO: 3099644 - RNA, 12 nt, Molluscum contagiosum virus
cacggcucugcg

SEQ ID NO: 3099645 - RNA, 12 nt, Molluscum contagiosum virus
cuuuuugcugau

SEQ ID NO: 3099646 - RNA, 19 nt, Molluscum contagiosum virus
gccaugaucauggcgccgc

SEQ ID NO: 3099647 - RNA, 15 nt, Molluscum contagiosum virus
gcuugcucagcagcu

SEQ ID NO: 3099648 - RNA, 18 nt, Molluscum contagiosum virus
ccgcuucgagugcucccg

SEQ ID NO: 3099649 - RNA, 12 nt, Molluscum contagiosum virus
guuccagcuccg

SEQ ID NO: 3099650 - RNA, 23 nt, Molluscum contagiosum virus
gcaguuccgauauacgggcccug

SEQ ID NO: 3099651 - RNA, 17 nt, Molluscum contagiosum virus
accgucaaccugcugcc

SEQ ID NO: 3099652 - RNA, 17 nt, Molluscum contagiosum virus
cagauccgggcgcugca

SEQ ID NO: 3099653 - RNA, 14 nt, Molluscum contagiosum virus
cgcgcucuucccgu

SEQ ID NO: 3099654 - RNA, 20 nt, Molluscum contagiosum virus
acggacugggagcaccgcgu

SEQ ID NO: 3099655 - RNA, 17 nt, Molluscum contagiosum virus
ggcuuccgacaacucgc

SEQ ID NO: 3099656 - RNA, 15 nt, Molluscum contagiosum virus
cgcguguuugugcug

SEQ ID NO: 3099657 - RNA, 15 nt, Molluscum contagiosum virus
cccgcgcgugcaguu

SEQ ID NO: 3099658 - RNA, 23 nt, Molluscum contagiosum virus
cggucugauugagccggacuugu

SEQ ID NO: 3099659 - RNA, 22 nt, Molluscum contagiosum virus
cguggugcuuacugcgggcugc

SEQ ID NO: 3099660 - RNA, 18 nt, Molluscum contagiosum virus
cagcgcgugcgcaggagc

SEQ ID NO: 3099661 - RNA, 16 nt, Molluscum contagiosum virus
gguagcucgugccugu

SEQ ID NO: 3099662 - RNA, 17 nt, Molluscum contagiosum virus
gccagcgcgcccaccag

SEQ ID NO: 3099663 - RNA, 20 nt, Molluscum contagiosum virus
ucaggaacaaggccaaagcc

SEQ ID NO: 3099664 - RNA, 21 nt, Molluscum contagiosum virus
ucgcgcgccgcgcuggcgcgc

SEQ ID NO: 3099665 - RNA, 20 nt, Molluscum contagiosum virus
cgcucggaggcuugccccgc

SEQ ID NO: 3099666 - RNA, 15 nt, Molluscum contagiosum virus
gucugcaaggccugu

SEQ ID NO: 3099667 - RNA, 15 nt, Molluscum contagiosum virus
caugcagucacgacu

SEQ ID NO: 3099668 - RNA, 22 nt, Molluscum contagiosum virus
agcaacgcgacgauggccacgc

SEQ ID NO: 3099669 - RNA, 17 nt, Molluscum contagiosum virus
guucgagaccagccgcg

SEQ ID NO: 3099670 - RNA, 20 nt, Molluscum contagiosum virus
caucuucaagccgcaggcgc

SEQ ID NO: 3099671 - RNA, 15 nt, Molluscum contagiosum virus
cagugcuugagcauc

SEQ ID NO: 3099672 - RNA, 13 nt, Molluscum contagiosum virus
ggcaaucugucca

SEQ ID NO: 3099673 - RNA, 16 nt, Molluscum contagiosum virus
agcguccgcauccuca

SEQ ID NO: 3099674 - RNA, 20 nt, Molluscum contagiosum virus
ggcacaccccgggaacgagg

SEQ ID NO: 3099675 - RNA, 22 nt, Molluscum contagiosum virus
caacacgaucaaggugcagaac

SEQ ID NO: 3099676 - RNA, 18 nt, Molluscum contagiosum virus
cacgugcugcagcugcgc

SEQ ID NO: 3099677 - RNA, 12 nt, Molluscum contagiosum virus
ggaaaaggcaca

SEQ ID NO: 3099678 - RNA, 15 nt, Molluscum contagiosum virus
gcacgaccacgcugg

SEQ ID NO: 3099679 - RNA, 18 nt, Molluscum contagiosum virus
caacacuaccacagccau

SEQ ID NO: 3099680 - RNA, 20 nt, Molluscum contagiosum virus
ucccggcugccgcugccugu

SEQ ID NO: 3099681 - RNA, 20 nt, Molluscum contagiosum virus
gucgaagagggucgugcagg

SEQ ID NO: 3099682 - RNA, 12 nt, Molluscum contagiosum virus
cgcuccaugcug

SEQ ID NO: 3099683 - RNA, 23 nt, Molluscum contagiosum virus
acgccgugggcagcuucugcucg

SEQ ID NO: 3099684 - RNA, 12 nt, Molluscum contagiosum virus
acgucuucgccg

SEQ ID NO: 3099685 - RNA, 22 nt, Molluscum contagiosum virus
agugcguuugccagaagcccug

SEQ ID NO: 3099686 - RNA, 23 nt, Molluscum contagiosum virus
caacgagcucuccgaagagcaga

SEQ ID NO: 3099687 - RNA, 23 nt, Molluscum contagiosum virus
gcaacgcgacgauggccacgcag

SEQ ID NO: 3099688 - RNA, 16 nt, Molluscum contagiosum virus
ggaacucuacgacaug

SEQ ID NO: 3099689 - RNA, 18 nt, Molluscum contagiosum virus
ccucgugguugcgcagca

SEQ ID NO: 3099690 - RNA, 19 nt, Molluscum contagiosum virus
gaacaaugaggagaggaac

SEQ ID NO: 3099691 - RNA, 13 nt, Molluscum contagiosum virus
cgcgcgagcugcu

SEQ ID NO: 3099692 - RNA, 16 nt, Molluscum contagiosum virus
ucuucccgugcaaggu

SEQ ID NO: 3099693 - RNA, 21 nt, Molluscum contagiosum virus
gugacuagcgcuggcugcagg

SEQ ID NO: 3099694 - RNA, 14 nt, Molluscum contagiosum virus
cggcugcuggagcu

SEQ ID NO: 3099695 - RNA, 20 nt, Molluscum contagiosum virus
cgagcggcaagccgugcuuu

SEQ ID NO: 3099696 - RNA, 20 nt, Molluscum contagiosum virus
gagagccuucgucauccucg

SEQ ID NO: 3099697 - RNA, 21 nt, Molluscum contagiosum virus
gagcugugcgagccaguuucu

SEQ ID NO: 3099698 - RNA, 15 nt, Molluscum contagiosum virus
gagcgcagucccagc

SEQ ID NO: 3099699 - RNA, 19 nt, Molluscum contagiosum virus
ccgccgggaauaccggaga

SEQ ID NO: 3099700 - RNA, 17 nt, Molluscum contagiosum virus
cgugcuuacggacagga

SEQ ID NO: 3099701 - RNA, 15 nt, Molluscum contagiosum virus
caccacguggaccug

SEQ ID NO: 3099702 - RNA, 14 nt, Molluscum contagiosum virus
caccagcagccagg

SEQ ID NO: 3099703 - RNA, 22 nt, Molluscum contagiosum virus
auucucguggcguugcugcugc

SEQ ID NO: 3099704 - RNA, 21 nt, Molluscum contagiosum virus
ggcggcgcgaagcaggcgcca

SEQ ID NO: 3099705 - RNA, 14 nt, Molluscum contagiosum virus
gcuguggacaugau

SEQ ID NO: 3099706 - RNA, 19 nt, Molluscum contagiosum virus
caacacgaucaaggugcag

SEQ ID NO: 3099707 - RNA, 18 nt, Molluscum contagiosum virus
cgcaagcaccggcagcgc

SEQ ID NO: 3099708 - RNA, 16 nt, Molluscum contagiosum virus
ggucgagcgcgccgcg

SEQ ID NO: 3099709 - RNA, 17 nt, Molluscum contagiosum virus
agccugcaccgagugcu

SEQ ID NO: 3099710 - RNA, 19 nt, Molluscum contagiosum virus
cgcgguggccgcgccgggc

SEQ ID NO: 3099711 - RNA, 20 nt, Molluscum contagiosum virus
cccgcggacggacgaagaga

SEQ ID NO: 3099712 - RNA, 15 nt, Molluscum contagiosum virus
gcaauugcugggcac

SEQ ID NO: 3099713 - RNA, 20 nt, Molluscum contagiosum virus
gccugcugggagcuugcacg

SEQ ID NO: 3099714 - RNA, 22 nt, Molluscum contagiosum virus
acguacgagcagcugcugcgca

SEQ ID NO: 3099715 - RNA, 21 nt, Molluscum contagiosum virus
acgcuggcucgcgccugcgcu

SEQ ID NO: 3099716 - RNA, 15 nt, Molluscum contagiosum virus
gcugcucgcuugccc

SEQ ID NO: 3099717 - RNA, 18 nt, Molluscum contagiosum virus
ccuccgcggacgcgcccu

SEQ ID NO: 3099718 - RNA, 17 nt, Molluscum contagiosum virus
uaguugcagcccaccag

SEQ ID NO: 3099719 - RNA, 21 nt, Molluscum contagiosum virus
guuugacgcccggugccuggc

SEQ ID NO: 3099720 - RNA, 15 nt, Molluscum contagiosum virus
gcgcacgugcucgcg

SEQ ID NO: 3099721 - RNA, 12 nt, Molluscum contagiosum virus
caagggcuccuu

SEQ ID NO: 3099722 - RNA, 22 nt, Molluscum contagiosum virus
gccguggcacugacgguacuca

SEQ ID NO: 3099723 - RNA, 16 nt, Molluscum contagiosum virus
uuagccacugugcuga

SEQ ID NO: 3099724 - RNA, 19 nt, Molluscum contagiosum virus
acgcacagccccugcugcu

SEQ ID NO: 3099725 - RNA, 16 nt, Molluscum contagiosum virus
ugugaacacgacaugu

SEQ ID NO: 3099726 - RNA, 21 nt, Molluscum contagiosum virus
aaugacgcgcacgccagccug

SEQ ID NO: 3099727 - RNA, 12 nt, Molluscum contagiosum virus
uugcucucuuuc

SEQ ID NO: 3099728 - RNA, 13 nt, Molluscum contagiosum virus
uuggcgcgccgcu

SEQ ID NO: 3099729 - RNA, 17 nt, Molluscum contagiosum virus
gcugggcguggcgcacc

SEQ ID NO: 3099730 - RNA, 22 nt, Molluscum contagiosum virus
aucccacguacgagcagcugcu

SEQ ID NO: 3099731 - RNA, 17 nt, Molluscum contagiosum virus
ggcgcgcgagcugcugc

SEQ ID NO: 3099732 - RNA, 13 nt, Molluscum contagiosum virus
gcgccucgcaggc

SEQ ID NO: 3099733 - RNA, 14 nt, Molluscum contagiosum virus
acugacugcugccc

SEQ ID NO: 3099734 - RNA, 21 nt, Molluscum contagiosum virus
gauuagcaacugccccaugcc

SEQ ID NO: 3099735 - RNA, 13 nt, Molluscum contagiosum virus
guguugcuguucc

SEQ ID NO: 3099736 - RNA, 13 nt, Molluscum contagiosum virus
cacgugcugcgcu

SEQ ID NO: 3099737 - RNA, 23 nt, Molluscum contagiosum virus
gcccagcucgaugggcuccaggu

SEQ ID NO: 3099738 - RNA, 18 nt, Molluscum contagiosum virus
cgugaacgaggcugcugc

SEQ ID NO: 3099739 - RNA, 20 nt, Molluscum contagiosum virus
aggugcgaaggcucgagcug

SEQ ID NO: 3099740 - RNA, 14 nt, Molluscum contagiosum virus
ggcacgcagcucuu

SEQ ID NO: 3099741 - RNA, 13 nt, Molluscum contagiosum virus
gcgccaagaacaa

SEQ ID NO: 3099742 - RNA, 16 nt, Molluscum contagiosum virus
cuggcguugcgcggcg

SEQ ID NO: 3099743 - RNA, 16 nt, Molluscum contagiosum virus
ugcuccacgcgcagcu

SEQ ID NO: 3099744 - RNA, 20 nt, Molluscum contagiosum virus
ugcgcgguggugcugggcgu

SEQ ID NO: 3099745 - RNA, 13 nt, Molluscum contagiosum virus
uucgugcugugcc

SEQ ID NO: 3099746 - RNA, 15 nt, Molluscum contagiosum virus
agccacggccgcgcu

SEQ ID NO: 3099747 - RNA, 13 nt, Molluscum contagiosum virus
acagcccccucuu

SEQ ID NO: 3099748 - RNA, 21 nt, Molluscum contagiosum virus
cuuccaggcgccgcaccucac

SEQ ID NO: 3099749 - RNA, 19 nt, Molluscum contagiosum virus
cuugcgcguucgcaaagac

SEQ ID NO: 3099750 - RNA, 15 nt, Molluscum contagiosum virus
acugaaaagcuaucc

SEQ ID NO: 3099751 - RNA, 17 nt, Molluscum contagiosum virus
gugcuggagcagacgua

SEQ ID NO: 3099752 - RNA, 22 nt, Molluscum contagiosum virus
guuugcacccgcgcagcgugcc

SEQ ID NO: 3099753 - RNA, 20 nt, Molluscum contagiosum virus
cccagcucgaugggcuccag

SEQ ID NO: 3099754 - RNA, 13 nt, Molluscum contagiosum virus
gccuuccugcgcc

SEQ ID NO: 3099755 - RNA, 15 nt, Molluscum contagiosum virus
cggcaacacaaaugc

SEQ ID NO: 3099756 - RNA, 16 nt, Molluscum contagiosum virus
gcgugcgccgugcguc

SEQ ID NO: 3099757 - RNA, 20 nt, Molluscum contagiosum virus
caguaccgugucaaacugcu

SEQ ID NO: 3099758 - RNA, 20 nt, Molluscum contagiosum virus
gcacucguggcaacaacaug

SEQ ID NO: 3099759 - RNA, 19 nt, Molluscum contagiosum virus
acgcugcgcgugcugggcc

SEQ ID NO: 3099760 - RNA, 13 nt, Molluscum contagiosum virus
cgaugggaggcgg

SEQ ID NO: 3099761 - RNA, 14 nt, Molluscum contagiosum virus
ugcccgccugccgc

SEQ ID NO: 3099762 - RNA, 17 nt, Molluscum contagiosum virus
aggucgagcgcgccgcg

SEQ ID NO: 3099763 - RNA, 13 nt, Molluscum contagiosum virus
agcacagcaggag

SEQ ID NO: 3099764 - RNA, 16 nt, Molluscum contagiosum virus
ugacagacuaggcaau

SEQ ID NO: 3099765 - RNA, 17 nt, Molluscum contagiosum virus
cgaucgcgggcacgagc

SEQ ID NO: 3099766 - RNA, 22 nt, Molluscum contagiosum virus
gugcuggucaagaacaugugcu

SEQ ID NO: 3099767 - RNA, 14 nt, Molluscum contagiosum virus
cagagcaaggcgag

SEQ ID NO: 3099768 - RNA, 15 nt, Molluscum contagiosum virus
ugagugcugagccac

SEQ ID NO: 3099769 - RNA, 17 nt, Molluscum contagiosum virus
gugcgucucucugucuc

SEQ ID NO: 3099770 - RNA, 17 nt, Molluscum contagiosum virus
gugcuccgaggaggcaa

SEQ ID NO: 3099771 - RNA, 17 nt, Molluscum contagiosum virus
ggcgccgcgcugaugcu

SEQ ID NO: 3099772 - RNA, 17 nt, Molluscum contagiosum virus
cgugcgccucgcaggcg

SEQ ID NO: 3099773 - RNA, 19 nt, Molluscum contagiosum virus
gcgcgcaggcucgcaccgu

SEQ ID NO: 3099774 - RNA, 20 nt, Molluscum contagiosum virus
gccuguuuuuaucgagccgc

SEQ ID NO: 3099775 - RNA, 21 nt, Molluscum contagiosum virus
ucaagcagcgcgccaccacca

SEQ ID NO: 3099776 - RNA, 14 nt, Molluscum contagiosum virus
gcacaaaacacaaa

SEQ ID NO: 3099777 - RNA, 21 nt, Molluscum contagiosum virus
gccgccgcugccgcgcgcgcc

SEQ ID NO: 3099778 - RNA, 16 nt, Molluscum contagiosum virus
cgcgccgcugcucgcu

SEQ ID NO: 3099779 - RNA, 23 nt, Molluscum contagiosum virus
aaggcaccccgcaggaaagguac

SEQ ID NO: 3099780 - RNA, 11 nt, Molluscum contagiosum virus
ucgccaaagag

SEQ ID NO: 3099781 - RNA, 22 nt, Molluscum contagiosum virus
guggacgagcgcuaccugaugc

SEQ ID NO: 3099782 - RNA, 18 nt, Molluscum contagiosum virus
acagacgugcacaaagcc

SEQ ID NO: 3099783 - RNA, 16 nt, Molluscum contagiosum virus
gcacugcucgcgcacg

SEQ ID NO: 3099784 - RNA, 20 nt, Molluscum contagiosum virus
gcaaccagcuggcgcccgcg

SEQ ID NO: 3099785 - RNA, 18 nt, Molluscum contagiosum virus
acaaggacggagaguugu

SEQ ID NO: 3099786 - RNA, 14 nt, Molluscum contagiosum virus
aguggccggcaagg

SEQ ID NO: 3099787 - RNA, 22 nt, Molluscum contagiosum virus
gcacgacccucuucgacuuacg

SEQ ID NO: 3099788 - RNA, 14 nt, Molluscum contagiosum virus
cgaggugcugcgcc

SEQ ID NO: 3099789 - RNA, 14 nt, Molluscum contagiosum virus
acaacgacagagcc

SEQ ID NO: 3099790 - RNA, 22 nt, Molluscum contagiosum virus
ugccagcgagcucaaggacauc

SEQ ID NO: 3099791 - RNA, 14 nt, Molluscum contagiosum virus
gcgcgugcccgcag

SEQ ID NO: 3099792 - RNA, 24 nt, Molluscum contagiosum virus
ugccuuggcgcccgugccgccggc

SEQ ID NO: 3099793 - RNA, 19 nt, Molluscum contagiosum virus
aacgcacaaaacacaaaaa

SEQ ID NO: 3099794 - RNA, 12 nt, Molluscum contagiosum virus
gcgugcuggacg

SEQ ID NO: 3099795 - RNA, 22 nt, Molluscum contagiosum virus
aggcgcgcaagugcgugucccu

SEQ ID NO: 3099796 - RNA, 14 nt, Molluscum contagiosum virus
ccugguaguccugc

SEQ ID NO: 3099797 - RNA, 14 nt, Molluscum contagiosum virus
ggaagugcgagccg

SEQ ID NO: 3099798 - RNA, 21 nt, Molluscum contagiosum virus
gcaguaugugaacacgacaug

SEQ ID NO: 3099799 - RNA, 22 nt, Molluscum contagiosum virus
ccucucgaggccggcacgagca

SEQ ID NO: 3099800 - RNA, 16 nt, Molluscum contagiosum virus
gcacggcgacucuggc

SEQ ID NO: 3099801 - RNA, 22 nt, Molluscum contagiosum virus
gcgaguaccugggcaggccgcc

SEQ ID NO: 3099802 - RNA, 13 nt, Molluscum contagiosum virus
uggacagccauga

SEQ ID NO: 3099803 - RNA, 23 nt, Molluscum contagiosum virus
acgccaaccaccacguggaccug

SEQ ID NO: 3099804 - RNA, 18 nt, Molluscum contagiosum virus
cgcugcugguucugcucg

SEQ ID NO: 3099805 - RNA, 19 nt, Molluscum contagiosum virus
cagccugcuggcaccgcgc

SEQ ID NO: 3099806 - RNA, 11 nt, Molluscum contagiosum virus
ggacggagguc

SEQ ID NO: 3099807 - RNA, 15 nt, Molluscum contagiosum virus
ccucgcucugcucuu

SEQ ID NO: 3099808 - RNA, 18 nt, Molluscum contagiosum virus
caacaaggaaaggcaccc

SEQ ID NO: 3099809 - RNA, 16 nt, Molluscum contagiosum virus
cacgcgugucugcgcu

SEQ ID NO: 3099810 - RNA, 18 nt, Molluscum contagiosum virus
gcuuccgcgagucugcca

SEQ ID NO: 3099811 - RNA, 20 nt, Molluscum contagiosum virus
ccagucucgaugugacaaca

SEQ ID NO: 3099812 - RNA, 16 nt, Molluscum contagiosum virus
uagcgugugccgccgc

SEQ ID NO: 3099813 - RNA, 14 nt, Molluscum contagiosum virus
ggccugcggcggcg

SEQ ID NO: 3099814 - RNA, 19 nt, Molluscum contagiosum virus
aaguacaacccaaacaugu

SEQ ID NO: 3099815 - RNA, 15 nt, Molluscum contagiosum virus
uuggcgugaccaugg

SEQ ID NO: 3099816 - RNA, 15 nt, Molluscum contagiosum virus
ccuguccgcgggcgc

SEQ ID NO: 3099817 - RNA, 16 nt, Molluscum contagiosum virus
gccccaugcccgacca

SEQ ID NO: 3099818 - RNA, 19 nt, Molluscum contagiosum virus
gucuccacgcgugcgcgcc

SEQ ID NO: 3099819 - RNA, 18 nt, Molluscum contagiosum virus
acugccccaugcccgacc

SEQ ID NO: 3099820 - RNA, 18 nt, Molluscum contagiosum virus
cgcaggccaggugcagcg

SEQ ID NO: 3099821 - RNA, 21 nt, Molluscum contagiosum virus
acuuauuuuuguguuuugugc

SEQ ID NO: 3099822 - RNA, 18 nt, Molluscum contagiosum virus
guggaggugcgcgacucc

SEQ ID NO: 3099823 - RNA, 13 nt, Molluscum contagiosum virus
gagccggcugccc

SEQ ID NO: 3099824 - RNA, 21 nt, Molluscum contagiosum virus
gcgugcuugugcgccugugcu

SEQ ID NO: 3099825 - RNA, 23 nt, Molluscum contagiosum virus
uguaaguggcuucgcaagcaugc

SEQ ID NO: 3099826 - RNA, 14 nt, Molluscum contagiosum virus
cgcgugccgcggac

SEQ ID NO: 3099827 - RNA, 19 nt, Molluscum contagiosum virus
ccuggcgagcgcucugcau

SEQ ID NO: 3099828 - RNA, 17 nt, Molluscum contagiosum virus
cacugccugccgccucg

SEQ ID NO: 3099829 - RNA, 15 nt, Molluscum contagiosum virus
gucgagcgcgccgcg

SEQ ID NO: 3099830 - RNA, 20 nt, Molluscum contagiosum virus
uggagaccugucgugcaaug

SEQ ID NO: 3099831 - RNA, 21 nt, Molluscum contagiosum virus
cugcuggcgcgcgcgcgccgg

SEQ ID NO: 3099832 - RNA, 18 nt, Molluscum contagiosum virus
gcgcgcuccgagacugcu

SEQ ID NO: 3099833 - RNA, 16 nt, Molluscum contagiosum virus
gcucggcugccgugcg

SEQ ID NO: 3099834 - RNA, 21 nt, Molluscum contagiosum virus
ugugcgagaacuggcgcagca

SEQ ID NO: 3099835 - RNA, 22 nt, Molluscum contagiosum virus
aaguccgcccccagguggagcu

SEQ ID NO: 3099836 - RNA, 17 nt, Molluscum contagiosum virus
cggagaacaugcucgcc

SEQ ID NO: 3099837 - RNA, 14 nt, Molluscum contagiosum virus
gaggaaaggcgcac

SEQ ID NO: 3099838 - RNA, 13 nt, Molluscum contagiosum virus
uucgcgccgccgc

SEQ ID NO: 3099839 - RNA, 16 nt, Molluscum contagiosum virus
ucaccccgcagcucaa

SEQ ID NO: 3099840 - RNA, 19 nt, Molluscum contagiosum virus
cugccgucgcgcgcugugg

SEQ ID NO: 3099841 - RNA, 20 nt, Molluscum contagiosum virus
acuggcaccugcggcugcgg

SEQ ID NO: 3099842 - RNA, 16 nt, Molluscum contagiosum virus
gguucugcgcugccag

SEQ ID NO: 3099843 - RNA, 13 nt, Molluscum contagiosum virus
cgcgguccagccg

SEQ ID NO: 3099844 - RNA, 15 nt, Molluscum contagiosum virus
agcugcuagcggcag

SEQ ID NO: 3099845 - RNA, 23 nt, Molluscum contagiosum virus
gcgucggucaccaccaccuccag

SEQ ID NO: 3099846 - RNA, 14 nt, Molluscum contagiosum virus
ucaggccagcaucu

SEQ ID NO: 3099847 - RNA, 18 nt, Molluscum contagiosum virus
gauguacgcgugcaggaa

SEQ ID NO: 3099848 - RNA, 15 nt, Molluscum contagiosum virus
ugcuggugcucgccu

SEQ ID NO: 3099849 - RNA, 17 nt, Molluscum contagiosum virus
cgcacaagggcagcuca

SEQ ID NO: 3099850 - RNA, 13 nt, Molluscum contagiosum virus
cacauugcugcug

SEQ ID NO: 3099851 - RNA, 17 nt, Molluscum contagiosum virus
cucaucgagcaccucaa

SEQ ID NO: 3099852 - RNA, 22 nt, Molluscum contagiosum virus
ccguguucgcggagcugugccg

SEQ ID NO: 3099853 - RNA, 14 nt, Molluscum contagiosum virus
gcgacuuggggcuc

SEQ ID NO: 3099854 - RNA, 21 nt, Molluscum contagiosum virus
caccgggauggucucgcugcu

SEQ ID NO: 3099855 - RNA, 17 nt, Molluscum contagiosum virus
ccgaaggaaaggccccc

SEQ ID NO: 3099856 - RNA, 20 nt, Molluscum contagiosum virus
cucguggacagccugcaccg

SEQ ID NO: 3099857 - RNA, 14 nt, Molluscum contagiosum virus
cgcgcgugcuggac

SEQ ID NO: 3099858 - RNA, 19 nt, Molluscum contagiosum virus
cuccuuugcgagcacugua

SEQ ID NO: 3099859 - RNA, 15 nt, Molluscum contagiosum virus
cgagcgcggcaacag

SEQ ID NO: 3099860 - RNA, 20 nt, Molluscum contagiosum virus
cgugguacacguagaggaag

SEQ ID NO: 3099861 - RNA, 15 nt, Molluscum contagiosum virus
ggccuccuucccuga

SEQ ID NO: 3099862 - RNA, 23 nt, Molluscum contagiosum virus
cgcgacggugugccgcugguggg

SEQ ID NO: 3099863 - RNA, 15 nt, Molluscum contagiosum virus
uccggcggcuggacc

SEQ ID NO: 3099864 - RNA, 13 nt, Molluscum contagiosum virus
gagggucgugcag

SEQ ID NO: 3099865 - RNA, 19 nt, Molluscum contagiosum virus
gccgcgcugguggccgcac

SEQ ID NO: 3099866 - RNA, 18 nt, Molluscum contagiosum virus
acgugcugcugcagaacu

SEQ ID NO: 3099867 - RNA, 21 nt, Molluscum contagiosum virus
aggagauggaacugcagcagc

SEQ ID NO: 3099868 - RNA, 20 nt, Molluscum contagiosum virus
cauucccggcgcgcgcggcg

SEQ ID NO: 3099869 - RNA, 12 nt, Molluscum contagiosum virus
aacugcugggcg

SEQ ID NO: 3099870 - RNA, 18 nt, Molluscum contagiosum virus
augcgucuuccugcugcc

SEQ ID NO: 3099871 - RNA, 13 nt, Molluscum contagiosum virus
gcccugcucaugc

SEQ ID NO: 3099872 - RNA, 11 nt, Molluscum contagiosum virus
ugagaagcugu

SEQ ID NO: 3099873 - RNA, 15 nt, Molluscum contagiosum virus
gccugagaagcugua

SEQ ID NO: 3099874 - RNA, 14 nt, Molluscum contagiosum virus
gccgcaaccucuuc

SEQ ID NO: 3099875 - RNA, 21 nt, Molluscum contagiosum virus
uuggggcggcggggcugcugg

SEQ ID NO: 3099876 - RNA, 19 nt, Molluscum contagiosum virus
gcuccaacagcagcuggcg

SEQ ID NO: 3099877 - RNA, 20 nt, Molluscum contagiosum virus
gcgcgaccuacuccuggcca

SEQ ID NO: 3099878 - RNA, 20 nt, Molluscum contagiosum virus
agcagguucucgcacaguac

SEQ ID NO: 3099879 - RNA, 15 nt, Molluscum contagiosum virus
gcgcgccgcgcgccg

SEQ ID NO: 3099880 - RNA, 22 nt, Molluscum contagiosum virus
uggagcagacguacgagcaggc

SEQ ID NO: 3099881 - RNA, 24 nt, Molluscum contagiosum virus
ccacgcccgggcccgacacguugc

SEQ ID NO: 3099882 - RNA, 22 nt, Molluscum contagiosum virus
auugcugggcacaagcuuucuc

SEQ ID NO: 3099883 - RNA, 19 nt, Molluscum contagiosum virus
cuccggcuuagcuggcgcc

SEQ ID NO: 3099884 - RNA, 16 nt, Molluscum contagiosum virus
uccucaccuuccuggg

SEQ ID NO: 3099885 - RNA, 21 nt, Molluscum contagiosum virus
gccacgagcgccgcgugcgcg

SEQ ID NO: 3099886 - RNA, 20 nt, Molluscum contagiosum virus
ggccacucucccgggcucug

SEQ ID NO: 3099887 - RNA, 23 nt, Molluscum contagiosum virus
cacggcuguaaugugcuggucaa

SEQ ID NO: 3099888 - RNA, 14 nt, Molluscum contagiosum virus
gguggacguggacg

SEQ ID NO: 3099889 - RNA, 20 nt, Molluscum contagiosum virus
ccuucaggacgcaggacgcg

SEQ ID NO: 3099890 - RNA, 14 nt, Molluscum contagiosum virus
uucccguuccuggg

SEQ ID NO: 3099891 - RNA, 17 nt, Molluscum contagiosum virus
uggcaacgcgggggcca

SEQ ID NO: 3099892 - RNA, 11 nt, Molluscum contagiosum virus
cuuccugcagc

SEQ ID NO: 3099893 - RNA, 22 nt, Molluscum contagiosum virus
aguggcgcgcauuuaccggcgc

SEQ ID NO: 3099894 - RNA, 13 nt, Molluscum contagiosum virus
cucgcugccuggu

SEQ ID NO: 3099895 - RNA, 17 nt, Molluscum contagiosum virus
cggacgaagcugugcaa

SEQ ID NO: 3099896 - RNA, 15 nt, Molluscum contagiosum virus
aaagaggccugcuga

SEQ ID NO: 3099897 - RNA, 13 nt, Molluscum contagiosum virus
cuuucgacgcugc

SEQ ID NO: 3099898 - RNA, 21 nt, Molluscum contagiosum virus
cggacacguugcagcagcaca

SEQ ID NO: 3099899 - RNA, 13 nt, Molluscum contagiosum virus
ugcgcauggccac

SEQ ID NO: 3099900 - RNA, 16 nt, Molluscum contagiosum virus
cucaccuuccugggcg

SEQ ID NO: 3099901 - RNA, 21 nt, Molluscum contagiosum virus
ugggaacaccacacgcgcggc

SEQ ID NO: 3099902 - RNA, 12 nt, Molluscum contagiosum virus
cggcgcgccggc

SEQ ID NO: 3099903 - RNA, 12 nt, Molluscum contagiosum virus
cgcugcgccgcu

SEQ ID NO: 3099904 - RNA, 15 nt, Molluscum contagiosum virus
gcaggucggccagca

SEQ ID NO: 3099905 - RNA, 24 nt, Molluscum contagiosum virus
ggcgcgugccagucgcgcgagaag

SEQ ID NO: 3099906 - RNA, 17 nt, Molluscum contagiosum virus
cuagccugugcccugga

SEQ ID NO: 3099907 - RNA, 15 nt, Molluscum contagiosum virus
cugguaguccugcua

SEQ ID NO: 3099908 - RNA, 20 nt, Molluscum contagiosum virus
cuccacgucgaucagcuccg

SEQ ID NO: 3099909 - RNA, 12 nt, Molluscum contagiosum virus
ccgugggcggca

SEQ ID NO: 3099910 - RNA, 13 nt, Molluscum contagiosum virus
ccacggcugcaag

SEQ ID NO: 3099911 - RNA, 15 nt, Molluscum contagiosum virus
ggcuguguuccagcu

SEQ ID NO: 3099912 - RNA, 11 nt, Molluscum contagiosum virus
uuccugcuggc

SEQ ID NO: 3099913 - RNA, 18 nt, Molluscum contagiosum virus
gacaaggaaaggcaccca

SEQ ID NO: 3099914 - RNA, 15 nt, Molluscum contagiosum virus
ccuugucgagacagg

SEQ ID NO: 3099915 - RNA, 14 nt, Molluscum contagiosum virus
cgucccgacagcag

SEQ ID NO: 3099916 - RNA, 16 nt, Molluscum contagiosum virus
uugccugcacugagaa

SEQ ID NO: 3099917 - RNA, 14 nt, Molluscum contagiosum virus
caccaugcgcacag

SEQ ID NO: 3099918 - RNA, 12 nt, Molluscum contagiosum virus
cagcaguccgcc

SEQ ID NO: 3099919 - RNA, 22 nt, Molluscum contagiosum virus
cgaacgagaaaugcgcacacuu

SEQ ID NO: 3099920 - RNA, 13 nt, Molluscum contagiosum virus
cgagacgcugcug

SEQ ID NO: 3099921 - RNA, 13 nt, Molluscum contagiosum virus
agaagaacagcac

SEQ ID NO: 3099922 - RNA, 18 nt, Molluscum contagiosum virus
cuugcacgggcaugcaca

SEQ ID NO: 3099923 - RNA, 20 nt, Molluscum contagiosum virus
acgggaagcugcacgugcag

SEQ ID NO: 3099924 - RNA, 11 nt, Molluscum contagiosum virus
cagcagccagg

SEQ ID NO: 3099925 - RNA, 15 nt, Molluscum contagiosum virus
cagggaaagagcacg

SEQ ID NO: 3099926 - RNA, 18 nt, Molluscum contagiosum virus
gccgagcgccgccagcuc

SEQ ID NO: 3099927 - RNA, 13 nt, Molluscum contagiosum virus
cacacacacacuc

SEQ ID NO: 3099928 - RNA, 16 nt, Molluscum contagiosum virus
agcucauagcccaugc

SEQ ID NO: 3099929 - RNA, 20 nt, Molluscum contagiosum virus
cgauuuggacgcggcaccug

SEQ ID NO: 3099930 - RNA, 14 nt, Molluscum contagiosum virus
cggcggcugugccc

SEQ ID NO: 3099931 - RNA, 19 nt, Molluscum contagiosum virus
uagugccgagcucgccucc

SEQ ID NO: 3099932 - RNA, 15 nt, Molluscum contagiosum virus
uccaugagcaucucc

SEQ ID NO: 3099933 - RNA, 20 nt, Molluscum contagiosum virus
uggcuucuccaccuucagga

SEQ ID NO: 3099934 - RNA, 14 nt, Molluscum contagiosum virus
gugcucgcacacgu

SEQ ID NO: 3099935 - RNA, 15 nt, Molluscum contagiosum virus
acggcgugcuggcca

SEQ ID NO: 3099936 - RNA, 20 nt, Molluscum contagiosum virus
uccgucacggacagcagcuc

SEQ ID NO: 3099937 - RNA, 12 nt, Molluscum contagiosum virus
cgacuuuguccu

SEQ ID NO: 3099938 - RNA, 20 nt, Molluscum contagiosum virus
cggcacuguguccccugagc

SEQ ID NO: 3099939 - RNA, 22 nt, Molluscum contagiosum virus
acggcaaguuccuggugugcca

SEQ ID NO: 3099940 - RNA, 15 nt, Molluscum contagiosum virus
guaccccgcaggaaa

SEQ ID NO: 3099941 - RNA, 19 nt, Molluscum contagiosum virus
aucugcgugacccucuucg

SEQ ID NO: 3099942 - RNA, 21 nt, Molluscum contagiosum virus
ugccaggcggucuuccagcac

SEQ ID NO: 3099943 - RNA, 23 nt, Molluscum contagiosum virus
gugccgcuccuucgaagaggucu

SEQ ID NO: 3099944 - RNA, 17 nt, Molluscum contagiosum virus
cgccucgcgcgcacugc

SEQ ID NO: 3099945 - RNA, 17 nt, Molluscum contagiosum virus
ugacgucuuccagacgc

SEQ ID NO: 3099946 - RNA, 13 nt, Molluscum contagiosum virus
cacgcgcgcgcag

SEQ ID NO: 3099947 - RNA, 12 nt, Molluscum contagiosum virus
cacgugcugcug

SEQ ID NO: 3099948 - RNA, 13 nt, Molluscum contagiosum virus
gcacgagcgcggg

SEQ ID NO: 3099949 - RNA, 12 nt, Molluscum contagiosum virus
gccgcgaggacc

SEQ ID NO: 3099950 - RNA, 14 nt, Molluscum contagiosum virus
ugcgcuccaugcug

SEQ ID NO: 3099951 - RNA, 14 nt, Molluscum contagiosum virus
ugcgccacugccac

SEQ ID NO: 3099952 - RNA, 20 nt, Molluscum contagiosum virus
aagaggaaagcgcacacuug

SEQ ID NO: 3099953 - RNA, 12 nt, Molluscum contagiosum virus
cgugcgcgcugc

SEQ ID NO: 3099954 - RNA, 21 nt, Molluscum contagiosum virus
gugcagaugaggcugcucucc

SEQ ID NO: 3099955 - RNA, 20 nt, Molluscum contagiosum virus
aauguguacgacgcgcccac

SEQ ID NO: 3099956 - RNA, 23 nt, Molluscum contagiosum virus
gagggcagugccaagguucugga

SEQ ID NO: 3099957 - RNA, 18 nt, Molluscum contagiosum virus
gggcaggcagugccgccg

SEQ ID NO: 3099958 - RNA, 23 nt, Molluscum contagiosum virus
uacugcgcgcguugccugagaag

SEQ ID NO: 3099959 - RNA, 23 nt, Molluscum contagiosum virus
acaacguaguacugcagcagcuc

SEQ ID NO: 3099960 - RNA, 13 nt, Molluscum contagiosum virus
cgccggcucugcc

SEQ ID NO: 3099961 - RNA, 22 nt, Molluscum contagiosum virus
aaggcacccgcaggaaagguac

SEQ ID NO: 3099962 - RNA, 16 nt, Molluscum contagiosum virus
gcaacggcggcgcaag

SEQ ID NO: 3099963 - RNA, 18 nt, Molluscum contagiosum virus
caguuccaccucgagcuc

SEQ ID NO: 3099964 - RNA, 18 nt, Molluscum contagiosum virus
ccacgaacgacagcgccg

SEQ ID NO: 3099965 - RNA, 13 nt, Molluscum contagiosum virus
gccgaggcgcugc

SEQ ID NO: 3099966 - RNA, 15 nt, Molluscum contagiosum virus
cgugcucacgcugcc

SEQ ID NO: 3099967 - RNA, 13 nt, Molluscum contagiosum virus
uuccggcgcggcc

SEQ ID NO: 3099968 - RNA, 22 nt, Molluscum contagiosum virus
cgggaauaccggagacaccagc

SEQ ID NO: 3099969 - RNA, 17 nt, Molluscum contagiosum virus
gcugcagaacugccugg

SEQ ID NO: 3099970 - RNA, 17 nt, Molluscum contagiosum virus
guaccaccguggaggag

SEQ ID NO: 3099971 - RNA, 13 nt, Molluscum contagiosum virus
cuugcggcacgca

SEQ ID NO: 3099972 - RNA, 18 nt, Molluscum contagiosum virus
gcgcugcucgcgcucgcg

SEQ ID NO: 3099973 - RNA, 22 nt, Molluscum contagiosum virus
cggcgucgcgcgcgaccuccgc

SEQ ID NO: 3099974 - RNA, 22 nt, Molluscum contagiosum virus
acgcccuccucgaccugcacga

SEQ ID NO: 3099975 - RNA, 22 nt, Molluscum contagiosum virus
cacgcgguugcaauagacacgg

SEQ ID NO: 3099976 - RNA, 17 nt, Molluscum contagiosum virus
caccagcuccgccggga

SEQ ID NO: 3099977 - RNA, 18 nt, Molluscum contagiosum virus
gcugcgcgacgaggaggc

SEQ ID NO: 3099978 - RNA, 14 nt, Molluscum contagiosum virus
ccggccgaggcacg

SEQ ID NO: 3099979 - RNA, 22 nt, Molluscum contagiosum virus
cugcugcgcgccgccgacgccu

SEQ ID NO: 3099980 - RNA, 11 nt, Molluscum contagiosum virus
ugcggacaugc

SEQ ID NO: 3099981 - RNA, 14 nt, Molluscum contagiosum virus
gcacgccuccaaga

SEQ ID NO: 3099982 - RNA, 18 nt, Molluscum contagiosum virus
cgagcaugucacgcucac

SEQ ID NO: 3099983 - RNA, 15 nt, Molluscum contagiosum virus
ucccgggcggcgcgc

SEQ ID NO: 3099984 - RNA, 17 nt, Molluscum contagiosum virus
gggcaucaugagccagu

SEQ ID NO: 3099985 - RNA, 13 nt, Molluscum contagiosum virus
acaccggcgcgcu

SEQ ID NO: 3099986 - RNA, 14 nt, Molluscum contagiosum virus
gcgagcggcgcgcg

SEQ ID NO: 3099987 - RNA, 11 nt, Molluscum contagiosum virus
ucugcaagcug

SEQ ID NO: 3099988 - RNA, 17 nt, Molluscum contagiosum virus
caggaccgucaccgcag

SEQ ID NO: 3099989 - RNA, 22 nt, Molluscum contagiosum virus
cacgccgaccauuuccugcgag

SEQ ID NO: 3099990 - RNA, 14 nt, Molluscum contagiosum virus
gcccgccuccgggc

SEQ ID NO: 3099991 - RNA, 16 nt, Molluscum contagiosum virus
gccugcucucgaagca

SEQ ID NO: 3099992 - RNA, 21 nt, Molluscum contagiosum virus
ccgggcgcuccgagcggcugc

SEQ ID NO: 3099993 - RNA, 18 nt, Molluscum contagiosum virus
cuaagcgcaagccagagc

SEQ ID NO: 3099994 - RNA, 22 nt, Molluscum contagiosum virus
cacgccuggcggcagcacgggc

SEQ ID NO: 3099995 - RNA, 22 nt, Molluscum contagiosum virus
gcucuacggcgugcugugccug

SEQ ID NO: 3099996 - RNA, 20 nt, Molluscum contagiosum virus
gccgcgagcacuggcuggcg

SEQ ID NO: 3099997 - RNA, 18 nt, Molluscum contagiosum virus
agggccugcgggcggcac

SEQ ID NO: 3099998 - RNA, 20 nt, Molluscum contagiosum virus
gcgcggauauggcgcgccga

SEQ ID NO: 3099999 - RNA, 19 nt, Molluscum contagiosum virus
gggcgugacucggccgcgg

SEQ ID NO: 3100000 - RNA, 20 nt, Molluscum contagiosum virus
cgccagcgcgcccaccagca

SEQ ID NO: 3100001 - RNA, 21 nt, Molluscum contagiosum virus
uggagcccgugcuggagggca

SEQ ID NO: 3100002 - RNA, 22 nt, Molluscum contagiosum virus
gagucacgaccgacccaucgga

SEQ ID NO: 3100003 - RNA, 15 nt, Molluscum contagiosum virus
cgauguacuccacca

SEQ ID NO: 3100004 - RNA, 22 nt, Molluscum contagiosum virus
cucgcccgcgcgcgcgcgaacg

SEQ ID NO: 3100005 - RNA, 17 nt, Molluscum contagiosum virus
guccgcauccucaaccg

SEQ ID NO: 3100006 - RNA, 15 nt, Molluscum contagiosum virus
cgagcgcgcgccugc

SEQ ID NO: 3100007 - RNA, 21 nt, Molluscum contagiosum virus
gaggcgcguccgcggccggga

SEQ ID NO: 3100008 - RNA, 13 nt, Molluscum contagiosum virus
acugacugcugcc

SEQ ID NO: 3100009 - RNA, 19 nt, Molluscum contagiosum virus
gacucuggcuucuccaccu

SEQ ID NO: 3100010 - RNA, 18 nt, Molluscum contagiosum virus
cgggaugcuggacgggca

SEQ ID NO: 3100011 - RNA, 16 nt, Molluscum contagiosum virus
cuacgagcagcgcuug

SEQ ID NO: 3100012 - RNA, 22 nt, Molluscum contagiosum virus
acuccuuccggagacaccagcu

SEQ ID NO: 3100013 - RNA, 21 nt, Molluscum contagiosum virus
caagagcuuacuagacuggcu

SEQ ID NO: 3100014 - RNA, 15 nt, Molluscum contagiosum virus
gccugccgcgagcac

SEQ ID NO: 3100015 - RNA, 14 nt, Molluscum contagiosum virus
gccgccgcaggccc

SEQ ID NO: 3100016 - RNA, 21 nt, Molluscum contagiosum virus
augcccggccucgccuccggg

SEQ ID NO: 3100017 - RNA, 20 nt, Molluscum contagiosum virus
gccgcccgggaaaaucaggu

SEQ ID NO: 3100018 - RNA, 16 nt, Molluscum contagiosum virus
gccugccagcagagcu

SEQ ID NO: 3100019 - RNA, 20 nt, Molluscum contagiosum virus
aaagaccgugucugguguau

SEQ ID NO: 3100020 - RNA, 20 nt, Molluscum contagiosum virus
cagggaaaugcgggaggcuc

SEQ ID NO: 3100021 - RNA, 19 nt, Molluscum contagiosum virus
acugcugcaaucugcgcuc

SEQ ID NO: 3100022 - RNA, 21 nt, Molluscum contagiosum virus
guccacaaagcccuccugaga

SEQ ID NO: 3100023 - RNA, 21 nt, Molluscum contagiosum virus
cugccagccaucgugcgcgac

SEQ ID NO: 3100024 - RNA, 17 nt, Molluscum contagiosum virus
cagccacgaagagucgc

SEQ ID NO: 3100025 - RNA, 14 nt, Molluscum contagiosum virus
ucgcacacugcagc

SEQ ID NO: 3100026 - RNA, 13 nt, Molluscum contagiosum virus
ugguucaugcugg

SEQ ID NO: 3100027 - RNA, 19 nt, Molluscum contagiosum virus
cgcgguccuguccgcggac

SEQ ID NO: 3100028 - RNA, 16 nt, Molluscum contagiosum virus
acugagugcugagcca

SEQ ID NO: 3100029 - RNA, 15 nt, Molluscum contagiosum virus
ggccagcgugcagac

SEQ ID NO: 3100030 - RNA, 17 nt, Molluscum contagiosum virus
ccgcgugcucugcuccg

SEQ ID NO: 3100031 - RNA, 22 nt, Molluscum contagiosum virus
caggucaucgggcugcagcccu

SEQ ID NO: 3100032 - RNA, 10 nt, Molluscum contagiosum virus
augccgccgc

SEQ ID NO: 3100033 - RNA, 18 nt, Molluscum contagiosum virus
aucguuccuggccaagga

SEQ ID NO: 3100034 - RNA, 17 nt, Molluscum contagiosum virus
ggcacccuggcugcugc

SEQ ID NO: 3100035 - RNA, 16 nt, Molluscum contagiosum virus
uccucgaccugcacga

SEQ ID NO: 3100036 - RNA, 14 nt, Molluscum contagiosum virus
gaaggguguggccu

SEQ ID NO: 3100037 - RNA, 15 nt, Molluscum contagiosum virus
cucgcgcgcagggcg

SEQ ID NO: 3100038 - RNA, 21 nt, Molluscum contagiosum virus
gccagugcuuugucgcaaccc

SEQ ID NO: 3100039 - RNA, 14 nt, Molluscum contagiosum virus
cgugcgcagcacgg

SEQ ID NO: 3100040 - RNA, 19 nt, Molluscum contagiosum virus
cgcugccaacgcggaccgc

SEQ ID NO: 3100041 - RNA, 19 nt, Molluscum contagiosum virus
cggcgcgugucgcggagca

SEQ ID NO: 3100042 - RNA, 17 nt, Molluscum contagiosum virus
ugccccgcgcgugcagu

SEQ ID NO: 3100043 - RNA, 17 nt, Molluscum contagiosum virus
cgccugcacgcgcacuu

SEQ ID NO: 3100044 - RNA, 15 nt, Molluscum contagiosum virus
ccucgcggcucuggu

SEQ ID NO: 3100045 - RNA, 18 nt, Molluscum contagiosum virus
ccacgugcgcuggcccac

SEQ ID NO: 3100046 - RNA, 21 nt, Molluscum contagiosum virus
ugcagcugcaggaccugcugg

SEQ ID NO: 3100047 - RNA, 16 nt, Molluscum contagiosum virus
ggagcccuugaucgac

SEQ ID NO: 3100048 - RNA, 17 nt, Molluscum contagiosum virus
guccacgugguccacca

SEQ ID NO: 3100049 - RNA, 23 nt, Molluscum contagiosum virus
gggugaggagcucgacucgagcg

SEQ ID NO: 3100050 - RNA, 19 nt, Molluscum contagiosum virus
caagugggcgucgaccugg

SEQ ID NO: 3100051 - RNA, 15 nt, Molluscum contagiosum virus
gccggugcgugccca

SEQ ID NO: 3100052 - RNA, 18 nt, Molluscum contagiosum virus
cacggcccgggugcgcgc

SEQ ID NO: 3100053 - RNA, 15 nt, Molluscum contagiosum virus
agggcacgcugcaca

SEQ ID NO: 3100054 - RNA, 14 nt, Molluscum contagiosum virus
aggccggcacaagc

SEQ ID NO: 3100055 - RNA, 13 nt, Molluscum contagiosum virus
cgcgugccgcugc

SEQ ID NO: 3100056 - RNA, 15 nt, Molluscum contagiosum virus
cucgcgagugugcau

SEQ ID NO: 3100057 - RNA, 18 nt, Molluscum contagiosum virus
cgcuggagcuggcugggc

SEQ ID NO: 3100058 - RNA, 14 nt, Molluscum contagiosum virus
ucgaggugugccug

SEQ ID NO: 3100059 - RNA, 22 nt, Molluscum contagiosum virus
gcagugccgccgcgcaaaagca

SEQ ID NO: 3100060 - RNA, 13 nt, Molluscum contagiosum virus
uucguaaagcugg

SEQ ID NO: 3100061 - RNA, 20 nt, Molluscum contagiosum virus
gccgcgccuugagcgcgccg

SEQ ID NO: 3100062 - RNA, 14 nt, Molluscum contagiosum virus
augcucgagccugc

SEQ ID NO: 3100063 - RNA, 16 nt, Molluscum contagiosum virus
gaccuacuccuggcca

SEQ ID NO: 3100064 - RNA, 15 nt, Molluscum contagiosum virus
uccucuuggccccuc

SEQ ID NO: 3100065 - RNA, 17 nt, Molluscum contagiosum virus
cgaugcccagcagcgag

SEQ ID NO: 3100066 - RNA, 13 nt, Molluscum contagiosum virus
cuggccucugcca

SEQ ID NO: 3100067 - RNA, 14 nt, Molluscum contagiosum virus
cgcgugcaggaacg

SEQ ID NO: 3100068 - RNA, 13 nt, Molluscum contagiosum virus
guugccugcacug

SEQ ID NO: 3100069 - RNA, 12 nt, Molluscum contagiosum virus
agacaccagcuc

SEQ ID NO: 3100070 - RNA, 14 nt, Molluscum contagiosum virus
ggcaagaggggagc

SEQ ID NO: 3100071 - RNA, 16 nt, Molluscum contagiosum virus
gcugcgcggcgccgca

SEQ ID NO: 3100072 - RNA, 15 nt, Molluscum contagiosum virus
cgaaaucgcaaagca

SEQ ID NO: 3100073 - RNA, 14 nt, Molluscum contagiosum virus
agaggccagcacaa

SEQ ID NO: 3100074 - RNA, 19 nt, Molluscum contagiosum virus
gcugcuccccgccagcacc

SEQ ID NO: 3100075 - RNA, 16 nt, Molluscum contagiosum virus
gcaucagcaacaagcu

SEQ ID NO: 3100076 - RNA, 19 nt, Molluscum contagiosum virus
ccuuugcgcugucucuccg

SEQ ID NO: 3100077 - RNA, 16 nt, Molluscum contagiosum virus
cacgcgucgcgcgccg

SEQ ID NO: 3100078 - RNA, 13 nt, Molluscum contagiosum virus
gcucgcugccugg

SEQ ID NO: 3100079 - RNA, 12 nt, Molluscum contagiosum virus
acagcugcugcu

SEQ ID NO: 3100080 - RNA, 23 nt, Molluscum contagiosum virus
augucgcgacggagauggacaca

SEQ ID NO: 3100081 - RNA, 17 nt, Molluscum contagiosum virus
gggccgcgaggcauguc

SEQ ID NO: 3100082 - RNA, 17 nt, Molluscum contagiosum virus
uuccggugccggccgcc

SEQ ID NO: 3100083 - RNA, 14 nt, Molluscum contagiosum virus
gaccaaggagggag

SEQ ID NO: 3100084 - RNA, 18 nt, Molluscum contagiosum virus
gaucccugcccgcgugag

SEQ ID NO: 3100085 - RNA, 16 nt, Molluscum contagiosum virus
gcgcgcugcacaccga

SEQ ID NO: 3100086 - RNA, 18 nt, Molluscum contagiosum virus
ggcacccgcaacaaggaa

SEQ ID NO: 3100087 - RNA, 14 nt, Molluscum contagiosum virus
gggcccgccuccgg

SEQ ID NO: 3100088 - RNA, 11 nt, Molluscum contagiosum virus
aacgaccucaa

SEQ ID NO: 3100089 - RNA, 23 nt, Molluscum contagiosum virus
guccaugucgcgcaucaccgagc

SEQ ID NO: 3100090 - RNA, 17 nt, Molluscum contagiosum virus
cgagcagcugcuucucu

SEQ ID NO: 3100091 - RNA, 14 nt, Molluscum contagiosum virus
cagcagcuccagca

SEQ ID NO: 3100092 - RNA, 18 nt, Molluscum contagiosum virus
gcugggcgguugccugca

SEQ ID NO: 3100093 - RNA, 13 nt, Molluscum contagiosum virus
cacccgcgcggcu

SEQ ID NO: 3100094 - RNA, 20 nt, Molluscum contagiosum virus
ugcacgcacgcgcucuccag

SEQ ID NO: 3100095 - RNA, 18 nt, Molluscum contagiosum virus
aggagacguagagcagcg

SEQ ID NO: 3100096 - RNA, 21 nt, Molluscum contagiosum virus
gugcugucccucugugcggag

SEQ ID NO: 3100097 - RNA, 22 nt, Molluscum contagiosum virus
cugcugcccauacucgaacgca

SEQ ID NO: 3100098 - RNA, 17 nt, Molluscum contagiosum virus
cagagcgugcuggucaa

SEQ ID NO: 3100099 - RNA, 18 nt, Molluscum contagiosum virus
cggagagcuccggcugcu

SEQ ID NO: 3100100 - RNA, 22 nt, Molluscum contagiosum virus
gcugcgcuacauguaugccagc

SEQ ID NO: 3100101 - RNA, 20 nt, Molluscum contagiosum virus
gugcgcucggaggggcuccg

SEQ ID NO: 3100102 - RNA, 13 nt, Molluscum contagiosum virus
gaguguuccccaa

SEQ ID NO: 3100103 - RNA, 15 nt, Molluscum contagiosum virus
ucaacgagcgcauca

SEQ ID NO: 3100104 - RNA, 18 nt, Molluscum contagiosum virus
gcccgcgcucgccgcacg

SEQ ID NO: 3100105 - RNA, 24 nt, Molluscum contagiosum virus
gccugcggguaguugcgagccagc

SEQ ID NO: 3100106 - RNA, 15 nt, Molluscum contagiosum virus
uucgggaagcacagu

SEQ ID NO: 3100107 - RNA, 21 nt, Molluscum contagiosum virus
ccgagccaaggaugccugcca

SEQ ID NO: 3100108 - RNA, 15 nt, Molluscum contagiosum virus
agugugugcaucccu

SEQ ID NO: 3100109 - RNA, 20 nt, Molluscum contagiosum virus
uccgaccgugcccuggaccu

SEQ ID NO: 3100110 - RNA, 18 nt, Molluscum contagiosum virus
gcaaacaagcagucucau

SEQ ID NO: 3100111 - RNA, 19 nt, Molluscum contagiosum virus
gcaucggcggcagcgccag

SEQ ID NO: 3100112 - RNA, 16 nt, Molluscum contagiosum virus
uccccgaacugcuggg

SEQ ID NO: 3100113 - RNA, 22 nt, Molluscum contagiosum virus
ggcgcuaugccgcgugcucugc

SEQ ID NO: 3100114 - RNA, 15 nt, Molluscum contagiosum virus
gcuccccgcgcgcag

SEQ ID NO: 3100115 - RNA, 15 nt, Molluscum contagiosum virus
caaccgccugcucuc

SEQ ID NO: 3100116 - RNA, 19 nt, Molluscum contagiosum virus
gacacgagcaccgaacaaa

SEQ ID NO: 3100117 - RNA, 13 nt, Molluscum contagiosum virus
gcgcggggcacug

SEQ ID NO: 3100118 - RNA, 14 nt, Molluscum contagiosum virus
uugcgcguccgcaa

SEQ ID NO: 3100119 - RNA, 21 nt, Molluscum contagiosum virus
uacugccgccaggaaaacgga

SEQ ID NO: 3100120 - RNA, 17 nt, Molluscum contagiosum virus
gcucguguugugccugc

SEQ ID NO: 3100121 - RNA, 15 nt, Molluscum contagiosum virus
aucgcgcgcaccugc

SEQ ID NO: 3100122 - RNA, 15 nt, Molluscum contagiosum virus
ugcgucccagcagcu

SEQ ID NO: 3100123 - RNA, 14 nt, Molluscum contagiosum virus
gcgccgggcgcgcc

SEQ ID NO: 3100124 - RNA, 21 nt, Molluscum contagiosum virus
ugccuuggcgcccgugccgcc

SEQ ID NO: 3100125 - RNA, 14 nt, Molluscum contagiosum virus
ccggaucagccccg

SEQ ID NO: 3100126 - RNA, 20 nt, Molluscum contagiosum virus
uccgacuccuuccggagaca

SEQ ID NO: 3100127 - RNA, 22 nt, Molluscum contagiosum virus
augcugcgcgagcgcgcgcugc

SEQ ID NO: 3100128 - RNA, 17 nt, Molluscum contagiosum virus
ugcgggcgcaggcccgc

SEQ ID NO: 3100129 - RNA, 22 nt, Molluscum contagiosum virus
caggcgcggcagccgcagaugc

SEQ ID NO: 3100130 - RNA, 11 nt, Molluscum contagiosum virus
ggggcuggaca

SEQ ID NO: 3100131 - RNA, 18 nt, Molluscum contagiosum virus
cuccuccacguccaggcc

SEQ ID NO: 3100132 - RNA, 20 nt, Molluscum contagiosum virus
cuagaguacuagguggcaug

SEQ ID NO: 3100133 - RNA, 16 nt, Molluscum contagiosum virus
caucucucagggcagc

SEQ ID NO: 3100134 - RNA, 23 nt, Molluscum contagiosum virus
ccucgacgcguucuagcagcgug

SEQ ID NO: 3100135 - RNA, 12 nt, Molluscum contagiosum virus
ccaagaccuggg

SEQ ID NO: 3100136 - RNA, 13 nt, Molluscum contagiosum virus
caccggcagcgcg

SEQ ID NO: 3100137 - RNA, 20 nt, Molluscum contagiosum virus
gccgaugcagugcggaugug

SEQ ID NO: 3100138 - RNA, 15 nt, Molluscum contagiosum virus
cucagcauguugcuc

SEQ ID NO: 3100139 - RNA, 14 nt, Molluscum contagiosum virus
ugcagcgcagcagc

SEQ ID NO: 3100140 - RNA, 16 nt, Molluscum contagiosum virus
ccgcuggacgccucgg

SEQ ID NO: 3100141 - RNA, 11 nt, Molluscum contagiosum virus
gccgcaggaac

SEQ ID NO: 3100142 - RNA, 14 nt, Molluscum contagiosum virus
cacgccuccaagaa

SEQ ID NO: 3100143 - RNA, 23 nt, Molluscum contagiosum virus
gucggcccgaguauacucgacgc

SEQ ID NO: 3100144 - RNA, 23 nt, Molluscum contagiosum virus
gguugcgcggggcaggcagugcc

SEQ ID NO: 3100145 - RNA, 22 nt, Molluscum contagiosum virus
uguuuccgcucgcgcugcuucc

SEQ ID NO: 3100146 - RNA, 15 nt, Molluscum contagiosum virus
gcacgacccucuucg

SEQ ID NO: 3100147 - RNA, 15 nt, Molluscum contagiosum virus
agaccuuccuccagg

SEQ ID NO: 3100148 - RNA, 23 nt, Molluscum contagiosum virus
caaagaccacuugugaaauguug

SEQ ID NO: 3100149 - RNA, 14 nt, Molluscum contagiosum virus
ccgcgccgaaacac

SEQ ID NO: 3100150 - RNA, 19 nt, Molluscum contagiosum virus
aagcuguaccuggugcgcc

SEQ ID NO: 3100151 - RNA, 20 nt, Molluscum contagiosum virus
cugcgccaagguggccaagc

SEQ ID NO: 3100152 - RNA, 20 nt, Molluscum contagiosum virus
gaggcgcuagugcagaugag

SEQ ID NO: 3100153 - RNA, 15 nt, Molluscum contagiosum virus
cuguacgugcugccc

SEQ ID NO: 3100154 - RNA, 13 nt, Molluscum contagiosum virus
agcaaggggucug

SEQ ID NO: 3100155 - RNA, 22 nt, Molluscum contagiosum virus
ccucgagcacgccuccaagaag

SEQ ID NO: 3100156 - RNA, 23 nt, Molluscum contagiosum virus
aggaaagguaccccgcaggaaag

SEQ ID NO: 3100157 - RNA, 14 nt, Molluscum contagiosum virus
gccaugcgcuugcg

SEQ ID NO: 3100158 - RNA, 18 nt, Molluscum contagiosum virus
gugcgcgacuuggggcuc

SEQ ID NO: 3100159 - RNA, 13 nt, Molluscum contagiosum virus
uccuggugugcca

SEQ ID NO: 3100160 - RNA, 22 nt, Molluscum contagiosum virus
cggacgccggcgcccgcgugca

SEQ ID NO: 3100161 - RNA, 11 nt, Molluscum contagiosum virus
cggaggcagcg

SEQ ID NO: 3100162 - RNA, 13 nt, Molluscum contagiosum virus
aggaacgaaaguc

SEQ ID NO: 3100163 - RNA, 18 nt, Molluscum contagiosum virus
ugcuccugaucugcgugg

SEQ ID NO: 3100164 - RNA, 22 nt, Molluscum contagiosum virus
aggaaaggcacccgcaggaaag

SEQ ID NO: 3100165 - RNA, 15 nt, Molluscum contagiosum virus
aggcgcagcgcggcc

SEQ ID NO: 3100166 - RNA, 17 nt, Molluscum contagiosum virus
gcgcugcucgcgcucgc

SEQ ID NO: 3100167 - RNA, 12 nt, Molluscum contagiosum virus
cucucagcggca

SEQ ID NO: 3100168 - RNA, 13 nt, Molluscum contagiosum virus
aagcuccugcugg

SEQ ID NO: 3100169 - RNA, 22 nt, Molluscum contagiosum virus
cgcgagcacccccgcugcacgc

SEQ ID NO: 3100170 - RNA, 22 nt, Molluscum contagiosum virus
cgggccuguccgcgggcgcacg

SEQ ID NO: 3100171 - RNA, 22 nt, Molluscum contagiosum virus
ccucgcaggcgaggucacacuc

SEQ ID NO: 3100172 - RNA, 23 nt, Molluscum contagiosum virus
gcgccgcagaacacgggggcugc

SEQ ID NO: 3100173 - RNA, 14 nt, Molluscum contagiosum virus
acucgcggcaagua

SEQ ID NO: 3100174 - RNA, 17 nt, Molluscum contagiosum virus
cuccaagaagaggccag

SEQ ID NO: 3100175 - RNA, 13 nt, Molluscum contagiosum virus
gggcgagcagugu

SEQ ID NO: 3100176 - RNA, 19 nt, Molluscum contagiosum virus
cauuguaaaacgacagacc

SEQ ID NO: 3100177 - RNA, 22 nt, Molluscum contagiosum virus
gcucgaaaaaguucuuggugga

SEQ ID NO: 3100178 - RNA, 21 nt, Molluscum contagiosum virus
gcagacgacucgcugccagag

SEQ ID NO: 3100179 - RNA, 20 nt, Molluscum contagiosum virus
gccaugaacaacauggugcu

SEQ ID NO: 3100180 - RNA, 13 nt, Molluscum contagiosum virus
gguuccugcgcuc

SEQ ID NO: 3100181 - RNA, 14 nt, Molluscum contagiosum virus
gcccggcaccgcgg

SEQ ID NO: 3100182 - RNA, 13 nt, Molluscum contagiosum virus
guacacgcagagc

SEQ ID NO: 3100183 - RNA, 22 nt, Molluscum contagiosum virus
agcaggcuguguuccagcucgg

SEQ ID NO: 3100184 - RNA, 14 nt, Molluscum contagiosum virus
cggcgcgcagcgcg

SEQ ID NO: 3100185 - RNA, 20 nt, Molluscum contagiosum virus
cgaccacgugccagagucgc

SEQ ID NO: 3100186 - RNA, 20 nt, Molluscum contagiosum virus
cuagaagaccacauccuuga

SEQ ID NO: 3100187 - RNA, 14 nt, Molluscum contagiosum virus
ccuucgcgcgcgcg

SEQ ID NO: 3100188 - RNA, 22 nt, Molluscum contagiosum virus
cccguccuugcucuggcucucg

SEQ ID NO: 3100189 - RNA, 24 nt, Molluscum contagiosum virus
gugcggagggugcacgcgggcgcc

SEQ ID NO: 3100190 - RNA, 15 nt, Molluscum contagiosum virus
acaaccacagcucuc

SEQ ID NO: 3100191 - RNA, 12 nt, Molluscum contagiosum virus
gagagacagcac

SEQ ID NO: 3100192 - RNA, 18 nt, Molluscum contagiosum virus
gcuucacgugcuugcccg

SEQ ID NO: 3100193 - RNA, 18 nt, Molluscum contagiosum virus
ucccugguaguccugcua

SEQ ID NO: 3100194 - RNA, 19 nt, Molluscum contagiosum virus
aagaccugcuuccuccucc

SEQ ID NO: 3100195 - RNA, 14 nt, Molluscum contagiosum virus
ggccuguccgcgga

SEQ ID NO: 3100196 - RNA, 17 nt, Molluscum contagiosum virus
ggucuccgcgggcagcc

SEQ ID NO: 3100197 - RNA, 20 nt, Molluscum contagiosum virus
ccaaccuccugcaccugcug

SEQ ID NO: 3100198 - RNA, 13 nt, Molluscum contagiosum virus
ccuggucuucccg

SEQ ID NO: 3100199 - RNA, 15 nt, Molluscum contagiosum virus
caugccuucaggaac

SEQ ID NO: 3100200 - RNA, 16 nt, Molluscum contagiosum virus
aaauagcaugucacgc

SEQ ID NO: 3100201 - RNA, 22 nt, Molluscum contagiosum virus
cagcaaacugugcuccugagga

SEQ ID NO: 3100202 - RNA, 16 nt, Molluscum contagiosum virus
gcgcguggaguacagc

SEQ ID NO: 3100203 - RNA, 19 nt, Molluscum contagiosum virus
gccaucgaaacucugcacg

SEQ ID NO: 3100204 - RNA, 23 nt, Molluscum contagiosum virus
gcagcgccuguaccccgaacggc

SEQ ID NO: 3100205 - RNA, 23 nt, Molluscum contagiosum virus
uacgccaagaggacgagcugcua

SEQ ID NO: 3100206 - RNA, 17 nt, Molluscum contagiosum virus
caagucuucggaguggg

SEQ ID NO: 3100207 - RNA, 18 nt, Molluscum contagiosum virus
augcgguccgacucggug

SEQ ID NO: 3100208 - RNA, 19 nt, Molluscum contagiosum virus
guguaugcucgucgccggg

SEQ ID NO: 3100209 - RNA, 18 nt, Molluscum contagiosum virus
gccgcgccuagccgugcg

SEQ ID NO: 3100210 - RNA, 17 nt, Molluscum contagiosum virus
uggaacugcagcagcug

SEQ ID NO: 3100211 - RNA, 14 nt, Molluscum contagiosum virus
aucgacaagaucaa

SEQ ID NO: 3100212 - RNA, 17 nt, Molluscum contagiosum virus
gcagcagugccagcagc

SEQ ID NO: 3100213 - RNA, 18 nt, Molluscum contagiosum virus
ccauuuuuacgcuacuca

SEQ ID NO: 3100214 - RNA, 19 nt, Molluscum contagiosum virus
ugcgcucgagcuccgaggg

SEQ ID NO: 3100215 - RNA, 13 nt, Molluscum contagiosum virus
cgccagcaguccg

SEQ ID NO: 3100216 - RNA, 12 nt, Molluscum contagiosum virus
acacagggcuuc

SEQ ID NO: 3100217 - RNA, 16 nt, Molluscum contagiosum virus
gggcagcuucugcucg

SEQ ID NO: 3100218 - RNA, 21 nt, Molluscum contagiosum virus
guggccaaggucucgagcucc

SEQ ID NO: 3100219 - RNA, 16 nt, Molluscum contagiosum virus
cgugugcgggcacggc

SEQ ID NO: 3100220 - RNA, 18 nt, Molluscum contagiosum virus
ccuggcggcagcacgggc

SEQ ID NO: 3100221 - RNA, 18 nt, Molluscum contagiosum virus
gcgcgcgccugcucuccg

SEQ ID NO: 3100222 - RNA, 13 nt, Molluscum contagiosum virus
cggcacugggugc

SEQ ID NO: 3100223 - RNA, 17 nt, Molluscum contagiosum virus
ccuccagcagcggcgcg

SEQ ID NO: 3100224 - RNA, 22 nt, Molluscum contagiosum virus
cacaaacucgcagaacugcugc

SEQ ID NO: 3100225 - RNA, 16 nt, Molluscum contagiosum virus
gcgcccggcgcccgca

SEQ ID NO: 3100226 - RNA, 16 nt, Molluscum contagiosum virus
acgcgaaacuggacug

SEQ ID NO: 3100227 - RNA, 14 nt, Molluscum contagiosum virus
cgcagcuguuucug

SEQ ID NO: 3100228 - RNA, 20 nt, Molluscum contagiosum virus
gccucgccuccgggcgcaca

SEQ ID NO: 3100229 - RNA, 18 nt, Molluscum contagiosum virus
gcuucucgccagaaguca

SEQ ID NO: 3100230 - RNA, 20 nt, Molluscum contagiosum virus
acgucuggcucguacugcug

SEQ ID NO: 3100231 - RNA, 12 nt, Molluscum contagiosum virus
aguaccugggca

SEQ ID NO: 3100232 - RNA, 11 nt, Molluscum contagiosum virus
ggaggcagcgc

SEQ ID NO: 3100233 - RNA, 18 nt, Molluscum contagiosum virus
cauggacgugcugcuggc

SEQ ID NO: 3100234 - RNA, 20 nt, Molluscum contagiosum virus
cagccgagcgccgccagcuc

SEQ ID NO: 3100235 - RNA, 16 nt, Molluscum contagiosum virus
cccgggcggcgcgccg

SEQ ID NO: 3100236 - RNA, 16 nt, Molluscum contagiosum virus
ccgcaggcgcgcgcca

SEQ ID NO: 3100237 - RNA, 13 nt, Molluscum contagiosum virus
cgcgagcagcugc

SEQ ID NO: 3100238 - RNA, 22 nt, Molluscum contagiosum virus
cgccgcugcgccggcugcgcca

SEQ ID NO: 3100239 - RNA, 14 nt, Molluscum contagiosum virus
agcacgggcggaag

SEQ ID NO: 3100240 - RNA, 14 nt, Molluscum contagiosum virus
aaaaggcacacccc

SEQ ID NO: 3100241 - RNA, 16 nt, Molluscum contagiosum virus
ggucgccuacgaggug

SEQ ID NO: 3100242 - RNA, 16 nt, Molluscum contagiosum virus
gacggugugccgcugg

SEQ ID NO: 3100243 - RNA, 14 nt, Molluscum contagiosum virus
accagauguucucg

SEQ ID NO: 3100244 - RNA, 22 nt, Molluscum contagiosum virus
cuagacuucuugguggacagcc

SEQ ID NO: 3100245 - RNA, 17 nt, Molluscum contagiosum virus
caugccuuuccgagcuc

SEQ ID NO: 3100246 - RNA, 13 nt, Molluscum contagiosum virus
cggggaggagcuc

SEQ ID NO: 3100247 - RNA, 16 nt, Molluscum contagiosum virus
gcagcgcuagccccag

SEQ ID NO: 3100248 - RNA, 19 nt, Molluscum contagiosum virus
cgcucauacuccugcuggc

SEQ ID NO: 3100249 - RNA, 12 nt, Molluscum contagiosum virus
gucuacgugucc

SEQ ID NO: 3100250 - RNA, 14 nt, Molluscum contagiosum virus
agugcgugccaggc

SEQ ID NO: 3100251 - RNA, 19 nt, Molluscum contagiosum virus
gcgcuggagaaagaagugu

SEQ ID NO: 3100252 - RNA, 17 nt, Molluscum contagiosum virus
ccgacaacgugcugcuc

SEQ ID NO: 3100253 - RNA, 24 nt, Molluscum contagiosum virus
gcguccggcaugcgcgcgcugcca

SEQ ID NO: 3100254 - RNA, 17 nt, Molluscum contagiosum virus
ccagaggguggcuugcu

SEQ ID NO: 3100255 - RNA, 12 nt, Molluscum contagiosum virus
cuacgucuccuc

SEQ ID NO: 3100256 - RNA, 20 nt, Molluscum contagiosum virus
gcuccgcgcggcgcucugcc

SEQ ID NO: 3100257 - RNA, 16 nt, Molluscum contagiosum virus
cgcgcgcuacugcgcg

SEQ ID NO: 3100258 - RNA, 17 nt, Molluscum contagiosum virus
gagagacagcacggcac

SEQ ID NO: 3100259 - RNA, 15 nt, Molluscum contagiosum virus
caagaucaaccgcaa

SEQ ID NO: 3100260 - RNA, 13 nt, Molluscum contagiosum virus
gggcacgagcacg

SEQ ID NO: 3100261 - RNA, 21 nt, Molluscum contagiosum virus
gcucacguacgacugcuuuga

SEQ ID NO: 3100262 - RNA, 15 nt, Molluscum contagiosum virus
gcacgccagccugga

SEQ ID NO: 3100263 - RNA, 16 nt, Molluscum contagiosum virus
cuucaggaacaaggcc

SEQ ID NO: 3100264 - RNA, 17 nt, Molluscum contagiosum virus
cuucauccgcgcgcucu

SEQ ID NO: 3100265 - RNA, 20 nt, Molluscum contagiosum virus
cuuccuuuccgugcuugaca

SEQ ID NO: 3100266 - RNA, 19 nt, Molluscum contagiosum virus
cuucgaaggcagcgaaggc

SEQ ID NO: 3100267 - RNA, 20 nt, Molluscum contagiosum virus
cuucgacggcuucauccgcg

SEQ ID NO: 3100268 - RNA, 21 nt, Molluscum contagiosum virus
cuucgacguugacgagcgcgu

SEQ ID NO: 3100269 - RNA, 16 nt, Molluscum contagiosum virus
cuucgacuucuccgcg

SEQ ID NO: 3100270 - RNA, 19 nt, Molluscum contagiosum virus
cuucgaggaacuugcacgc

SEQ ID NO: 3100271 - RNA, 21 nt, Molluscum contagiosum virus
cuucgaggugcgcgagucgcg

SEQ ID NO: 3100272 - RNA, 23 nt, Molluscum contagiosum virus
gaccgucagccucugugcggcgc

SEQ ID NO: 3100273 - RNA, 19 nt, Molluscum contagiosum virus
cuucgcgggauacgggcgc

SEQ ID NO: 3100274 - RNA, 20 nt, Molluscum contagiosum virus
cuucgcgaaggcaaccgcga

SEQ ID NO: 3100275 - RNA, 22 nt, Molluscum contagiosum virus
cuucgcgaaggcaaccgcgacg

SEQ ID NO: 3100276 - RNA, 17 nt, Molluscum contagiosum virus
cuucgcgaugugcaccu

SEQ ID NO: 3100277 - RNA, 20 nt, Molluscum contagiosum virus
cuucaagaacgacacggagc

SEQ ID NO: 3100278 - RNA, 20 nt, Molluscum contagiosum virus
cuuagcuuccgucugcugcu

SEQ ID NO: 3100279 - RNA, 12 nt, Molluscum contagiosum virus
cuuacugcugca

SEQ ID NO: 3100280 - RNA, 16 nt, Molluscum contagiosum virus
cugugcgcgacgccug

SEQ ID NO: 3100281 - RNA, 21 nt, Molluscum contagiosum virus
cugugcgcgacgccugcuagc

SEQ ID NO: 3100282 - RNA, 21 nt, Molluscum contagiosum virus
cugugcgcgaggagacguaga

SEQ ID NO: 3100283 - RNA, 21 nt, Molluscum contagiosum virus
cuguguggaacggcucaccgc

SEQ ID NO: 3100284 - RNA, 18 nt, Molluscum contagiosum virus
cuguucggcaugcagcgc

SEQ ID NO: 3100285 - RNA, 14 nt, Molluscum contagiosum virus
cuguugcugcugcc

SEQ ID NO: 3100286 - RNA, 19 nt, Molluscum contagiosum virus
gaccucgcugcugagcccu

SEQ ID NO: 3100287 - RNA, 14 nt, Molluscum contagiosum virus
gaccugcacgaccc

SEQ ID NO: 3100288 - RNA, 17 nt, Molluscum contagiosum virus
gaccgcuagagugcgcg

SEQ ID NO: 3100289 - RNA, 15 nt, Molluscum contagiosum virus
gaccuuggugcucau

SEQ ID NO: 3100290 - RNA, 18 nt, Molluscum contagiosum virus
gacgaagagacgccaagc

SEQ ID NO: 3100291 - RNA, 13 nt, Molluscum contagiosum virus
gacgaagcugugc

SEQ ID NO: 3100292 - RNA, 19 nt, Molluscum contagiosum virus
gaccuacgaggugcugcgc

SEQ ID NO: 3100293 - RNA, 15 nt, Molluscum contagiosum virus
gaccucacagcgccg

SEQ ID NO: 3100294 - RNA, 20 nt, Molluscum contagiosum virus
gaccgcgaacugcaacguga

SEQ ID NO: 3100295 - RNA, 13 nt, Molluscum contagiosum virus
gacgacucgcugc

SEQ ID NO: 3100296 - RNA, 18 nt, Molluscum contagiosum virus
gacgagauggucacgcgc

SEQ ID NO: 3100297 - RNA, 20 nt, Molluscum contagiosum virus
gacgagcagagccgggacgc

SEQ ID NO: 3100298 - RNA, 13 nt, Molluscum contagiosum virus
gacgacggcacgc

SEQ ID NO: 3100299 - RNA, 18 nt, Molluscum contagiosum virus
gacgacggcugcucgcug

SEQ ID NO: 3100300 - RNA, 20 nt, Molluscum contagiosum virus
gacgacggcugcucgcugcc

SEQ ID NO: 3100301 - RNA, 22 nt, Molluscum contagiosum virus
gacgacaauacggugcagccgc

SEQ ID NO: 3100302 - RNA, 16 nt, Molluscum contagiosum virus
gacgacaugcacacgc

SEQ ID NO: 3100303 - RNA, 22 nt, Molluscum contagiosum virus
gacgacaugcugugcggcacgc

SEQ ID NO: 3100304 - RNA, 20 nt, Molluscum contagiosum virus
gcacgacguacgagugcugg

SEQ ID NO: 3100305 - RNA, 23 nt, Molluscum contagiosum virus
gcacgagaugggcccgcgcgcgc

SEQ ID NO: 3100306 - RNA, 13 nt, Molluscum contagiosum virus
gcacgaaggacgc

SEQ ID NO: 3100307 - RNA, 19 nt, Molluscum contagiosum virus
gcacgaaggacgcgcuugc

SEQ ID NO: 3100308 - RNA, 18 nt, Molluscum contagiosum virus
gcacgaccacgcuggcac

SEQ ID NO: 3100309 - RNA, 21 nt, Molluscum contagiosum virus
gcacgaccucacagcgccgga

SEQ ID NO: 3100310 - RNA, 20 nt, Molluscum contagiosum virus
gcacgagcaguccgccucga

SEQ ID NO: 3100311 - RNA, 17 nt, Molluscum contagiosum virus
gcacgagcugcugcccg

SEQ ID NO: 3100312 - RNA, 15 nt, Molluscum contagiosum virus
gcacgagcugcugcg

SEQ ID NO: 3100313 - RNA, 17 nt, Molluscum contagiosum virus
gcacgagcugcugcgcg

SEQ ID NO: 3100314 - RNA, 14 nt, Molluscum contagiosum virus
gcacgaggagcccc

SEQ ID NO: 3100315 - RNA, 22 nt, Molluscum contagiosum virus
gcacgaggcagccgcggcgccc

SEQ ID NO: 3100316 - RNA, 23 nt, Molluscum contagiosum virus
gcacgagggcacaggguuccgcg

SEQ ID NO: 3100317 - RNA, 14 nt, Molluscum contagiosum virus
gacgagugcgccgc

SEQ ID NO: 3100318 - RNA, 16 nt, Molluscum contagiosum virus
gacgagugcgccgcgc

SEQ ID NO: 3100319 - RNA, 14 nt, Molluscum contagiosum virus
gacgaggagcuguc

SEQ ID NO: 3100320 - RNA, 19 nt, Molluscum contagiosum virus
gacgaggccuacagcgcgc

SEQ ID NO: 3100321 - RNA, 16 nt, Molluscum contagiosum virus
gacgagcgcgugcccg

SEQ ID NO: 3100322 - RNA, 24 nt, Molluscum contagiosum virus
gacgcacagucuccacgcgugcgc

SEQ ID NO: 3100323 - RNA, 15 nt, Molluscum contagiosum virus
gacgcacuagacugu

SEQ ID NO: 3100324 - RNA, 20 nt, Molluscum contagiosum virus
gacgcagacgacgcccaagc

SEQ ID NO: 3100325 - RNA, 17 nt, Molluscum contagiosum virus
gacgcagagccaugccc

SEQ ID NO: 3100326 - RNA, 19 nt, Molluscum contagiosum virus
gacgcagcgcgagcugugc

SEQ ID NO: 3100327 - RNA, 21 nt, Molluscum contagiosum virus
gcacugccacgcggagcucgc

SEQ ID NO: 3100328 - RNA, 21 nt, Molluscum contagiosum virus
gcacuacauggacgugcugcu

SEQ ID NO: 3100329 - RNA, 20 nt, Molluscum contagiosum virus
gcacuccagcgcgcccucgc

SEQ ID NO: 3100330 - RNA, 14 nt, Molluscum contagiosum virus
gcacucgcgcucgc

SEQ ID NO: 3100331 - RNA, 17 nt, Molluscum contagiosum virus
gcacugauguuuucauu

SEQ ID NO: 3100332 - RNA, 18 nt, Molluscum contagiosum virus
gcacugcagcgagcucgc

SEQ ID NO: 3100333 - RNA, 21 nt, Molluscum contagiosum virus
gcacguuguucuugcgcgugg

SEQ ID NO: 3100334 - RNA, 17 nt, Molluscum contagiosum virus
gcacguuugcgucugcg

SEQ ID NO: 3100335 - RNA, 14 nt, Molluscum contagiosum virus
gcacggugugcuac

SEQ ID NO: 3100336 - RNA, 23 nt, Molluscum contagiosum virus
gcacgcgcgagcaugccgccgcg

SEQ ID NO: 3100337 - RNA, 14 nt, Molluscum contagiosum virus
gcacguagugcucg

SEQ ID NO: 3100338 - RNA, 20 nt, Molluscum contagiosum virus
gcacgucuucgccgugugcg

SEQ ID NO: 3100339 - RNA, 19 nt, Molluscum contagiosum virus
gcacgugccccgcgcgugc

SEQ ID NO: 3100340 - RNA, 12 nt, Molluscum contagiosum virus
gcacgugcugcu

SEQ ID NO: 3100341 - RNA, 19 nt, Molluscum contagiosum virus
gcacguggaaucacggcca

SEQ ID NO: 3100342 - RNA, 22 nt, Molluscum contagiosum virus
gcacguggagucacgaccgacc

SEQ ID NO: 3100343 - RNA, 14 nt, Molluscum contagiosum virus
gcacguggcgcugc

SEQ ID NO: 3100344 - RNA, 24 nt, Molluscum contagiosum virus
gcacgugggcuacaagugcauccg

SEQ ID NO: 3100345 - RNA, 17 nt, Molluscum contagiosum virus
gcacgugugcggagagc

SEQ ID NO: 3100346 - RNA, 19 nt, Molluscum contagiosum virus
gcacggacccgggcgcggc

SEQ ID NO: 3100347 - RNA, 22 nt, Molluscum contagiosum virus
gcacggcacgugcguacgcggc

SEQ ID NO: 3100348 - RNA, 18 nt, Molluscum contagiosum virus
gcacggcccgggugcgcg

SEQ ID NO: 3100349 - RNA, 16 nt, Molluscum contagiosum virus
gcacggccggcgccgc

SEQ ID NO: 3100350 - RNA, 17 nt, Molluscum contagiosum virus
gcacggccggcgccgcg

SEQ ID NO: 3100351 - RNA, 18 nt, Molluscum contagiosum virus
gcacggccggcgccgcgc

SEQ ID NO: 3100352 - RNA, 17 nt, Molluscum contagiosum virus
gcacggcuaggcgcggc

SEQ ID NO: 3100353 - RNA, 18 nt, Molluscum contagiosum virus
gcacggcuuccggcacca

SEQ ID NO: 3100354 - RNA, 13 nt, Molluscum contagiosum virus
gcacgggcacgcc

SEQ ID NO: 3100355 - RNA, 18 nt, Molluscum contagiosum virus
gcacgggcacgcgcgcgc

SEQ ID NO: 3100356 - RNA, 19 nt, Molluscum contagiosum virus
gcacgggccggggccucgc

SEQ ID NO: 3100357 - RNA, 18 nt, Molluscum contagiosum virus
gcacgggcucgagcucuu

SEQ ID NO: 3100358 - RNA, 20 nt, Molluscum contagiosum virus
gcacgggcucgaucugcgcc

SEQ ID NO: 3100359 - RNA, 18 nt, Molluscum contagiosum virus
gcacgcuacggcugccgg

SEQ ID NO: 3100360 - RNA, 18 nt, Molluscum contagiosum virus
gcacgcuagcgagcgccc

SEQ ID NO: 3100361 - RNA, 21 nt, Molluscum contagiosum virus
gcacgcuagcgagcgcccgug

SEQ ID NO: 3100362 - RNA, 20 nt, Molluscum contagiosum virus
gcacgcucauacuccugcug

SEQ ID NO: 3100363 - RNA, 17 nt, Molluscum contagiosum virus
gcacgcucggcacucgc

SEQ ID NO: 3100364 - RNA, 22 nt, Molluscum contagiosum virus
gcacgcucuacggcgugcugug

SEQ ID NO: 3100365 - RNA, 18 nt, Molluscum contagiosum virus
gcacgcugagcaagcuca

SEQ ID NO: 3100366 - RNA, 19 nt, Molluscum contagiosum virus
gcacgcugcugcgugcgcg

SEQ ID NO: 3100367 - RNA, 15 nt, Molluscum contagiosum virus
gcacgcuuguccgcg

SEQ ID NO: 3100368 - RNA, 17 nt, Molluscum contagiosum virus
gcacgcuuguccgcgga

SEQ ID NO: 3100369 - RNA, 18 nt, Molluscum contagiosum virus
gcacgcuugugcgcacgc

SEQ ID NO: 3100370 - RNA, 20 nt, Molluscum contagiosum virus
gcacgcuugugcgcacgcug

SEQ ID NO: 3100371 - RNA, 15 nt, Molluscum contagiosum virus
gcacgcgcgcagacg

SEQ ID NO: 3100372 - RNA, 12 nt, Molluscum contagiosum virus
gcacgcgcucgc

SEQ ID NO: 3100373 - RNA, 20 nt, Molluscum contagiosum virus
gcacgcgcucguccgccgcg

SEQ ID NO: 3100374 - RNA, 17 nt, Molluscum contagiosum virus
gcacgcauguacgcggc

SEQ ID NO: 3100375 - RNA, 22 nt, Molluscum contagiosum virus
gcacgccagguguuccugccgg

SEQ ID NO: 3100376 - RNA, 18 nt, Molluscum contagiosum virus
gacgcaggacgcggucgc

SEQ ID NO: 3100377 - RNA, 20 nt, Molluscum contagiosum virus
gacgcauagucaucaaagca

SEQ ID NO: 3100378 - RNA, 18 nt, Molluscum contagiosum virus
gcacgauggggcgcucgg

SEQ ID NO: 3100379 - RNA, 18 nt, Molluscum contagiosum virus
gcacgaugucggaaccca

SEQ ID NO: 3100380 - RNA, 13 nt, Molluscum contagiosum virus
gcacgcacgcgcu

SEQ ID NO: 3100381 - RNA, 22 nt, Molluscum contagiosum virus
gcacgcacggcccgggugcgcg

SEQ ID NO: 3100382 - RNA, 15 nt, Molluscum contagiosum virus
gcacgcacguggcgc

SEQ ID NO: 3100383 - RNA, 21 nt, Molluscum contagiosum virus
gcacgccgcucggcacugcug

SEQ ID NO: 3100384 - RNA, 18 nt, Molluscum contagiosum virus
gcacgcgaacgccuacgc

SEQ ID NO: 3100385 - RNA, 16 nt, Molluscum contagiosum virus
gcacgcgcacacgcug

SEQ ID NO: 3100386 - RNA, 17 nt, Molluscum contagiosum virus
gcacgcgcacacgcuga

SEQ ID NO: 3100387 - RNA, 16 nt, Molluscum contagiosum virus
gcacgcgcacgcgcac

SEQ ID NO: 3100388 - RNA, 15 nt, Molluscum contagiosum virus
gcacgcgcacgcgcc

SEQ ID NO: 3100389 - RNA, 18 nt, Molluscum contagiosum virus
gcacgcgcacgcucucgc

SEQ ID NO: 3100390 - RNA, 21 nt, Molluscum contagiosum virus
gcacgcgcacgggccugcgcg

SEQ ID NO: 3100391 - RNA, 12 nt, Molluscum contagiosum virus
gcagagcacgag

SEQ ID NO: 3100392 - RNA, 15 nt, Molluscum contagiosum virus
gcagagccgggacgc

SEQ ID NO: 3100393 - RNA, 15 nt, Molluscum contagiosum virus
gcagaggauacccgu

SEQ ID NO: 3100394 - RNA, 22 nt, Molluscum contagiosum virus
gcagcacaccgucgcguggugc

SEQ ID NO: 3100395 - RNA, 17 nt, Molluscum contagiosum virus
gcagaggcgcguccgcg

SEQ ID NO: 3100396 - RNA, 23 nt, Molluscum contagiosum virus
gcagacggucgacgacgcgcgca

SEQ ID NO: 3100397 - RNA, 21 nt, Molluscum contagiosum virus
gcagacguacgagcaggcgca

SEQ ID NO: 3100398 - RNA, 17 nt, Molluscum contagiosum virus
gcagaacugcugcgcgc

SEQ ID NO: 3100399 - RNA, 20 nt, Molluscum contagiosum virus
gcagaagacggaguccucga

SEQ ID NO: 3100400 - RNA, 14 nt, Molluscum contagiosum virus
gcagacaacaccag

SEQ ID NO: 3100401 - RNA, 13 nt, Molluscum contagiosum virus
gcagacacagacg

SEQ ID NO: 3100402 - RNA, 14 nt, Molluscum contagiosum virus
gcacuuccgcgcgc

SEQ ID NO: 3100403 - RNA, 15 nt, Molluscum contagiosum virus
gcacuuuggccucgc

SEQ ID NO: 3100404 - RNA, 15 nt, Molluscum contagiosum virus
gcacugccugccgcc

SEQ ID NO: 3100405 - RNA, 14 nt, Molluscum contagiosum virus
gcacugcgccaagg

SEQ ID NO: 3100406 - RNA, 13 nt, Molluscum contagiosum virus
gcacugcgcgcgc

SEQ ID NO: 3100407 - RNA, 20 nt, Molluscum contagiosum virus
gcacugcgcgucugugcgcg

SEQ ID NO: 3100408 - RNA, 17 nt, Molluscum contagiosum virus
gcacugcucgcgcacgc

SEQ ID NO: 3100409 - RNA, 17 nt, Molluscum contagiosum virus
gcacugcuggcgcgcgc

SEQ ID NO: 3100410 - RNA, 14 nt, Molluscum contagiosum virus
gcacuggcgcgcac

SEQ ID NO: 3100411 - RNA, 16 nt, Molluscum contagiosum virus
gcacuggcgcgcacgc

SEQ ID NO: 3100412 - RNA, 16 nt, Molluscum contagiosum virus
gcacuggggcgaucgc

SEQ ID NO: 3100413 - RNA, 20 nt, Molluscum contagiosum virus
gcagcauucccggcgcgcgc

SEQ ID NO: 3100414 - RNA, 21 nt, Molluscum contagiosum virus
gcagcauucccggcgcgcgcg

SEQ ID NO: 3100415 - RNA, 21 nt, Molluscum contagiosum virus
gcagcaggaugcuggugucga

SEQ ID NO: 3100416 - RNA, 19 nt, Molluscum contagiosum virus
gcagcaggugcacgugcug

SEQ ID NO: 3100417 - RNA, 21 nt, Molluscum contagiosum virus
gcagcaggugcacgugcugca

SEQ ID NO: 3100418 - RNA, 22 nt, Molluscum contagiosum virus
gcagcagaccaagaagcccgag

SEQ ID NO: 3100419 - RNA, 20 nt, Molluscum contagiosum virus
gcagcagaggaguagcgugc

SEQ ID NO: 3100420 - RNA, 14 nt, Molluscum contagiosum virus
gcagcagcgugcau

SEQ ID NO: 3100421 - RNA, 20 nt, Molluscum contagiosum virus
gcagcagcuggccggcucgc

SEQ ID NO: 3100422 - RNA, 15 nt, Molluscum contagiosum virus
gcagccacggccgcg

SEQ ID NO: 3100423 - RNA, 20 nt, Molluscum contagiosum virus
gcagccccgacgccagcgcg

SEQ ID NO: 3100424 - RNA, 19 nt, Molluscum contagiosum virus
gcagcccgugcgccugccg

SEQ ID NO: 3100425 - RNA, 18 nt, Molluscum contagiosum virus
gcagcccgacgcgggcgc

SEQ ID NO: 3100426 - RNA, 17 nt, Molluscum contagiosum virus
gcagcccgagcgcgcgu

SEQ ID NO: 3100427 - RNA, 14 nt, Molluscum contagiosum virus
gcagccgcgcucgu

SEQ ID NO: 3100428 - RNA, 20 nt, Molluscum contagiosum virus
gcagccuccgguuuucgcgg

SEQ ID NO: 3100429 - RNA, 22 nt, Molluscum contagiosum virus
gcagccuccgguuuucgcggga

SEQ ID NO: 3100430 - RNA, 13 nt, Molluscum contagiosum virus
gcagccgcugcug

SEQ ID NO: 3100431 - RNA, 15 nt, Molluscum contagiosum virus
gcagccgcuggacgc

SEQ ID NO: 3100432 - RNA, 18 nt, Molluscum contagiosum virus
cucggaggcuugccccgc

SEQ ID NO: 3100433 - RNA, 21 nt, Molluscum contagiosum virus
cucggagaagaacagcacgaa

SEQ ID NO: 3100434 - RNA, 13 nt, Molluscum contagiosum virus
cucuacgagacuc

SEQ ID NO: 3100435 - RNA, 18 nt, Molluscum contagiosum virus
cucuacgccguguaccgc

SEQ ID NO: 3100436 - RNA, 14 nt, Molluscum contagiosum virus
cucuacuuccacga

SEQ ID NO: 3100437 - RNA, 21 nt, Molluscum contagiosum virus
cucguggacagccugcaccga

SEQ ID NO: 3100438 - RNA, 15 nt, Molluscum contagiosum virus
cucgugccgccugcg

SEQ ID NO: 3100439 - RNA, 19 nt, Molluscum contagiosum virus
cucgugccuuuugcgcgcu

SEQ ID NO: 3100440 - RNA, 15 nt, Molluscum contagiosum virus
cucguggucgccgcg

SEQ ID NO: 3100441 - RNA, 17 nt, Molluscum contagiosum virus
cucgugguugcgcacgu

SEQ ID NO: 3100442 - RNA, 18 nt, Molluscum contagiosum virus
cucguguacgagaaguuc

SEQ ID NO: 3100443 - RNA, 23 nt, Molluscum contagiosum virus
cucgguuggcggcgccgcgaucu

SEQ ID NO: 3100444 - RNA, 20 nt, Molluscum contagiosum virus
cucguaaaagacgcgcucgc

SEQ ID NO: 3100445 - RNA, 16 nt, Molluscum contagiosum virus
cucggcgcgcgccgcg

SEQ ID NO: 3100446 - RNA, 23 nt, Molluscum contagiosum virus
cucggcguuggccacgaacacgg

SEQ ID NO: 3100447 - RNA, 19 nt, Molluscum contagiosum virus
cucggcugccgugcgggcg

SEQ ID NO: 3100448 - RNA, 16 nt, Molluscum contagiosum virus
cucguccggcgcucgc

SEQ ID NO: 3100449 - RNA, 22 nt, Molluscum contagiosum virus
cucgugcaugacggcgcgagcc

SEQ ID NO: 3100450 - RNA, 12 nt, Molluscum contagiosum virus
cucucgagcacu

SEQ ID NO: 3100451 - RNA, 12 nt, Molluscum contagiosum virus
cucugccgcccg

SEQ ID NO: 3100452 - RNA, 19 nt, Molluscum contagiosum virus
cucugccugcaaggagguc

SEQ ID NO: 3100453 - RNA, 16 nt, Molluscum contagiosum virus
cucucggcagcgucgc

SEQ ID NO: 3100454 - RNA, 21 nt, Molluscum contagiosum virus
cucucggcagcgucgcggagc

SEQ ID NO: 3100455 - RNA, 22 nt, Molluscum contagiosum virus
cucucggcguccgcagcggcgc

SEQ ID NO: 3100456 - RNA, 17 nt, Molluscum contagiosum virus
cucuccgagacacgcga

SEQ ID NO: 3100457 - RNA, 16 nt, Molluscum contagiosum virus
cucguucgcgggcccg

SEQ ID NO: 3100458 - RNA, 13 nt, Molluscum contagiosum virus
cucugcgcgagca

SEQ ID NO: 3100459 - RNA, 20 nt, Molluscum contagiosum virus
cucugcgcgcaagucaccgc

SEQ ID NO: 3100460 - RNA, 21 nt, Molluscum contagiosum virus
cucugcgcgcaagucaccgcu

SEQ ID NO: 3100461 - RNA, 24 nt, Molluscum contagiosum virus
cucugcguaagcgccugcacacgc

SEQ ID NO: 3100462 - RNA, 16 nt, Molluscum contagiosum virus
cucugcuccgcggagg

SEQ ID NO: 3100463 - RNA, 17 nt, Molluscum contagiosum virus
cucuggagccucccccg

SEQ ID NO: 3100464 - RNA, 19 nt, Molluscum contagiosum virus
cucuggcuugcgcuuagac

SEQ ID NO: 3100465 - RNA, 13 nt, Molluscum contagiosum virus
cugcccgcgcgag

SEQ ID NO: 3100466 - RNA, 15 nt, Molluscum contagiosum virus
cugcccgcgcgcgac

SEQ ID NO: 3100467 - RNA, 13 nt, Molluscum contagiosum virus
cugcccgcggaga

SEQ ID NO: 3100468 - RNA, 15 nt, Molluscum contagiosum virus
cugccaccgcggcgc

SEQ ID NO: 3100469 - RNA, 17 nt, Molluscum contagiosum virus
cugccagccgcucgucc

SEQ ID NO: 3100470 - RNA, 17 nt, Molluscum contagiosum virus
cugccagcucgacacug

SEQ ID NO: 3100471 - RNA, 17 nt, Molluscum contagiosum virus
cugcgagaucguggacg

SEQ ID NO: 3100472 - RNA, 12 nt, Molluscum contagiosum virus
cugcgagcagcc

SEQ ID NO: 3100473 - RNA, 18 nt, Molluscum contagiosum virus
cugcgaggcgcgcacgcu

SEQ ID NO: 3100474 - RNA, 14 nt, Molluscum contagiosum virus
cugcgaguggcgcg

SEQ ID NO: 3100475 - RNA, 15 nt, Molluscum contagiosum virus
cugcgaucgcagcag

SEQ ID NO: 3100476 - RNA, 21 nt, Molluscum contagiosum virus
cugcgaucgcgggcacgagca

SEQ ID NO: 3100477 - RNA, 17 nt, Molluscum contagiosum virus
cugcgcaccugcacgac

SEQ ID NO: 3100478 - RNA, 22 nt, Molluscum contagiosum virus
cugcgcacgcuugugcgcacgc

SEQ ID NO: 3100479 - RNA, 13 nt, Molluscum contagiosum virus
cugcgcaggugca

SEQ ID NO: 3100480 - RNA, 20 nt, Molluscum contagiosum virus
cugcgccacugccacggcug

SEQ ID NO: 3100481 - RNA, 14 nt, Molluscum contagiosum virus
cugcgccagucgcg

SEQ ID NO: 3100482 - RNA, 14 nt, Molluscum contagiosum virus
cugcgcccgcggag

SEQ ID NO: 3100483 - RNA, 21 nt, Molluscum contagiosum virus
cugccgcgccuccgagcgcgc

SEQ ID NO: 3100484 - RNA, 17 nt, Molluscum contagiosum virus
cugcccgugugcgggca

SEQ ID NO: 3100485 - RNA, 19 nt, Molluscum contagiosum virus
cugcgacagcugcugcucg

SEQ ID NO: 3100486 - RNA, 14 nt, Molluscum contagiosum virus
cugccucguggaac

SEQ ID NO: 3100487 - RNA, 15 nt, Molluscum contagiosum virus
cugucaagacgggca

SEQ ID NO: 3100488 - RNA, 12 nt, Molluscum contagiosum virus
cuguccgaggac

SEQ ID NO: 3100489 - RNA, 12 nt, Molluscum contagiosum virus
cuguccgcggac

SEQ ID NO: 3100490 - RNA, 15 nt, Molluscum contagiosum virus
cugucgccgcgggcu

SEQ ID NO: 3100491 - RNA, 17 nt, Molluscum contagiosum virus
cugucgcgcagcugcgc

SEQ ID NO: 3100492 - RNA, 14 nt, Molluscum contagiosum virus
cuggugcgcccgcg

SEQ ID NO: 3100493 - RNA, 17 nt, Molluscum contagiosum virus
cuggugcugcgcgacau

SEQ ID NO: 3100494 - RNA, 22 nt, Molluscum contagiosum virus
cuggugucgagcucgcgcgcca

SEQ ID NO: 3100495 - RNA, 15 nt, Molluscum contagiosum virus
cuguacgugcugccc

SEQ ID NO: 3100496 - RNA, 16 nt, Molluscum contagiosum virus
cuguacgugcugcccg

SEQ ID NO: 3100497 - RNA, 20 nt, Molluscum contagiosum virus
cuggucgagcaccugucgcg

SEQ ID NO: 3100498 - RNA, 19 nt, Molluscum contagiosum virus
cugugcggagggugcacgc

SEQ ID NO: 3100499 - RNA, 18 nt, Molluscum contagiosum virus
cugugcuacgcgagcacu

SEQ ID NO: 3100500 - RNA, 21 nt, Molluscum contagiosum virus
cugugcuacgcgagcacugcg

SEQ ID NO: 3100501 - RNA, 23 nt, Molluscum contagiosum virus
cugugcagaacuucucgcgagcg

SEQ ID NO: 3100502 - RNA, 23 nt, Molluscum contagiosum virus
cugugcauugcgucuuacugcug

SEQ ID NO: 3100503 - RNA, 21 nt, Molluscum contagiosum virus
cugugccuaggaggagaacuc

SEQ ID NO: 3100504 - RNA, 14 nt, Molluscum contagiosum virus
cugugccugcaaga

SEQ ID NO: 3100505 - RNA, 12 nt, Molluscum contagiosum virus
cugugagcgcgc

SEQ ID NO: 3100506 - RNA, 14 nt, Molluscum contagiosum virus
cugugagcgcgccg

SEQ ID NO: 3100507 - RNA, 18 nt, Molluscum contagiosum virus
cugugagcgcgccgcucg

SEQ ID NO: 3100508 - RNA, 22 nt, Molluscum contagiosum virus
cugucguaacaauggacacgca

SEQ ID NO: 3100509 - RNA, 23 nt, Molluscum contagiosum virus
cugucuuuuccucacgucgcugg

SEQ ID NO: 3100510 - RNA, 15 nt, Molluscum contagiosum virus
cugggcgcgccgcgc

SEQ ID NO: 3100511 - RNA, 21 nt, Molluscum contagiosum virus
cugggcgcgugcgagcggcgc

SEQ ID NO: 3100512 - RNA, 17 nt, Molluscum contagiosum virus
cugggcgucgugcaccu

SEQ ID NO: 3100513 - RNA, 17 nt, Molluscum contagiosum virus
cugggcguggcgcaccu

SEQ ID NO: 3100514 - RNA, 17 nt, Molluscum contagiosum virus
cugggaggacacgcgca

SEQ ID NO: 3100515 - RNA, 17 nt, Molluscum contagiosum virus
cugggauaacaggcgug

SEQ ID NO: 3100516 - RNA, 21 nt, Molluscum contagiosum virus
cugggcaacgcgcgcgcgcug

SEQ ID NO: 3100517 - RNA, 18 nt, Molluscum contagiosum virus
cugggcacaagcuuucuc

SEQ ID NO: 3100518 - RNA, 14 nt, Molluscum contagiosum virus
cugcucgacgggcg

SEQ ID NO: 3100519 - RNA, 15 nt, Molluscum contagiosum virus
cugcucgcgcacgcg

SEQ ID NO: 3100520 - RNA, 21 nt, Molluscum contagiosum virus
cugcucgugcccgcacacgca

SEQ ID NO: 3100521 - RNA, 17 nt, Molluscum contagiosum virus
cugcucucgcgcgccag

SEQ ID NO: 3100522 - RNA, 18 nt, Molluscum contagiosum virus
cugcucuugaugcugaac

SEQ ID NO: 3100523 - RNA, 19 nt, Molluscum contagiosum virus
cugggaacaccacacgcgc

SEQ ID NO: 3100524 - RNA, 20 nt, Molluscum contagiosum virus
cugggaacaccacacgcgcg

SEQ ID NO: 3100525 - RNA, 16 nt, Molluscum contagiosum virus
cugcuagugcgcgcca

SEQ ID NO: 3100526 - RNA, 15 nt, Molluscum contagiosum virus
cugcucaugcgcaag

SEQ ID NO: 3100527 - RNA, 18 nt, Molluscum contagiosum virus
cugcucauggucgucucc

SEQ ID NO: 3100528 - RNA, 16 nt, Molluscum contagiosum virus
cugcuccccgccagca

SEQ ID NO: 3100529 - RNA, 18 nt, Molluscum contagiosum virus
cugcuccccgccagcacc

SEQ ID NO: 3100530 - RNA, 21 nt, Molluscum contagiosum virus
cugcucgaagccuucgcagag

SEQ ID NO: 3100531 - RNA, 18 nt, Molluscum contagiosum virus
cugcggcaaccgcgcccg

SEQ ID NO: 3100532 - RNA, 20 nt, Molluscum contagiosum virus
cugcggcaaccgcgcccgcg

SEQ ID NO: 3100533 - RNA, 15 nt, Molluscum contagiosum virus
cugcugcacacaccg

SEQ ID NO: 3100534 - RNA, 18 nt, Molluscum contagiosum virus
cugcugcacacaccgcga

SEQ ID NO: 3100535 - RNA, 21 nt, Molluscum contagiosum virus
cugcugcacacaccgcgagca

SEQ ID NO: 3100536 - RNA, 16 nt, Molluscum contagiosum virus
cugcugccgcgcggca

SEQ ID NO: 3100537 - RNA, 16 nt, Molluscum contagiosum virus
cugcugcgcagcaucc

SEQ ID NO: 3100538 - RNA, 13 nt, Molluscum contagiosum virus
cugcugcgcgccg

SEQ ID NO: 3100539 - RNA, 16 nt, Molluscum contagiosum virus
cugcugcgcgcgccau

SEQ ID NO: 3100540 - RNA, 20 nt, Molluscum contagiosum virus
cugcugcgguaucuacacuc

SEQ ID NO: 3100541 - RNA, 16 nt, Molluscum contagiosum virus
cuggcucguacugcug

SEQ ID NO: 3100542 - RNA, 16 nt, Molluscum contagiosum virus
cugcgguucacgcccg

SEQ ID NO: 3100543 - RNA, 22 nt, Molluscum contagiosum virus
cugcguaagcgccugcacacgc

SEQ ID NO: 3100544 - RNA, 23 nt, Molluscum contagiosum virus
cugcguaagcgccugcacacgcg

SEQ ID NO: 3100545 - RNA, 19 nt, Molluscum contagiosum virus
cugcguacacauggccgcg

SEQ ID NO: 3100546 - RNA, 18 nt, Molluscum contagiosum virus
cugcgucacaagcaccgc

SEQ ID NO: 3100547 - RNA, 16 nt, Molluscum contagiosum virus
cugcgucucgcggccg

SEQ ID NO: 3100548 - RNA, 22 nt, Molluscum contagiosum virus
cugcguguacgacgugcugcug

SEQ ID NO: 3100549 - RNA, 12 nt, Molluscum contagiosum virus
cugcguucgagc

SEQ ID NO: 3100550 - RNA, 14 nt, Molluscum contagiosum virus
cugcguugcgcguc

SEQ ID NO: 3100551 - RNA, 16 nt, Molluscum contagiosum virus
cugcguugcgcgucau

SEQ ID NO: 3100552 - RNA, 17 nt, Molluscum contagiosum virus
cugcguugcgcgucaug

SEQ ID NO: 3100553 - RNA, 18 nt, Molluscum contagiosum virus
cugcguuuugcgcggcac

SEQ ID NO: 3100554 - RNA, 20 nt, Molluscum contagiosum virus
cugcuacaugcacagacagc

SEQ ID NO: 3100555 - RNA, 12 nt, Molluscum contagiosum virus
cugcggcgcucg

SEQ ID NO: 3100556 - RNA, 13 nt, Molluscum contagiosum virus
cugcggcucgcac

SEQ ID NO: 3100557 - RNA, 12 nt, Molluscum contagiosum virus
cugcggcugcug

SEQ ID NO: 3100558 - RNA, 14 nt, Molluscum contagiosum virus
cugcggcugcugga

SEQ ID NO: 3100559 - RNA, 22 nt, Molluscum contagiosum virus
cugcggcugcuggagcuagcgc

SEQ ID NO: 3100560 - RNA, 13 nt, Molluscum contagiosum virus
cugcgggcgccgg

SEQ ID NO: 3100561 - RNA, 15 nt, Molluscum contagiosum virus
cugcgggcgcgaccu

SEQ ID NO: 3100562 - RNA, 13 nt, Molluscum contagiosum virus
cugcgggcugccg

SEQ ID NO: 3100563 - RNA, 17 nt, Molluscum contagiosum virus
cugcgcgucugugcgcg

SEQ ID NO: 3100564 - RNA, 19 nt, Molluscum contagiosum virus
cugcgcgucugugcgcgcu

SEQ ID NO: 3100565 - RNA, 23 nt, Molluscum contagiosum virus
cugcgcguggaguacagccgcgc

SEQ ID NO: 3100566 - RNA, 15 nt, Molluscum contagiosum virus
cugcgcuccaugcug

SEQ ID NO: 3100567 - RNA, 19 nt, Molluscum contagiosum virus
cugcgcuggaugcugcucg

SEQ ID NO: 3100568 - RNA, 14 nt, Molluscum contagiosum virus
cugcgcuucgagcu

SEQ ID NO: 3100569 - RNA, 17 nt, Molluscum contagiosum virus
cugcgcuugcgcgugag

SEQ ID NO: 3100570 - RNA, 14 nt, Molluscum contagiosum virus
cugcggaacgcgca

SEQ ID NO: 3100571 - RNA, 19 nt, Molluscum contagiosum virus
cugcgccgccucaugcgcg

SEQ ID NO: 3100572 - RNA, 18 nt, Molluscum contagiosum virus
cugcgccgccugcucucg

SEQ ID NO: 3100573 - RNA, 15 nt, Molluscum contagiosum virus
cugcgcggcggcagc

SEQ ID NO: 3100574 - RNA, 14 nt, Molluscum contagiosum virus
cugcgcggcgugcg

SEQ ID NO: 3100575 - RNA, 14 nt, Molluscum contagiosum virus
cugcgcgcgccaug

SEQ ID NO: 3100576 - RNA, 14 nt, Molluscum contagiosum virus
cugcgcgcgcggcg

SEQ ID NO: 3100577 - RNA, 17 nt, Molluscum contagiosum virus
cugcgcgcgcuacugcg

SEQ ID NO: 3100578 - RNA, 18 nt, Molluscum contagiosum virus
cugcgcgcgcucgcgcag

SEQ ID NO: 3100579 - RNA, 18 nt, Molluscum contagiosum virus
cugcgcgcguugccugag

SEQ ID NO: 3100580 - RNA, 17 nt, Molluscum contagiosum virus
cugcgcgcucuggagcc

SEQ ID NO: 3100581 - RNA, 11 nt, Molluscum contagiosum virus
cugcgcggagc

SEQ ID NO: 3100582 - RNA, 18 nt, Molluscum contagiosum virus
cugcgcggcccgcgggcu

SEQ ID NO: 3100583 - RNA, 20 nt, Molluscum contagiosum virus
cugcgcgacaugcugcccgc

SEQ ID NO: 3100584 - RNA, 18 nt, Molluscum contagiosum virus
cugcgcgagacgcugcug

SEQ ID NO: 3100585 - RNA, 18 nt, Molluscum contagiosum virus
cugcgcgagcagcugcug

SEQ ID NO: 3100586 - RNA, 20 nt, Molluscum contagiosum virus
cugcgcgagccgcugcacgc

SEQ ID NO: 3100587 - RNA, 16 nt, Molluscum contagiosum virus
cugcgcgcacugcucg

SEQ ID NO: 3100588 - RNA, 16 nt, Molluscum contagiosum virus
cugcgcgccgccgacg

SEQ ID NO: 3100589 - RNA, 14 nt, Molluscum contagiosum virus
cugcgcgccgcucg

SEQ ID NO: 3100590 - RNA, 12 nt, Molluscum contagiosum virus
gccaaagccgcg

SEQ ID NO: 3100591 - RNA, 23 nt, Molluscum contagiosum virus
gcaugcgcgguccuguccgcgga

SEQ ID NO: 3100592 - RNA, 15 nt, Molluscum contagiosum virus
gcauggcgagcccuu

SEQ ID NO: 3100593 - RNA, 15 nt, Molluscum contagiosum virus
gcauggcgcgcucgc

SEQ ID NO: 3100594 - RNA, 16 nt, Molluscum contagiosum virus
gcaugucacgcgucgc

SEQ ID NO: 3100595 - RNA, 19 nt, Molluscum contagiosum virus
gcauuaaacaacacgcgcg

SEQ ID NO: 3100596 - RNA, 21 nt, Molluscum contagiosum virus
gcaugcgcccucacgugcuga

SEQ ID NO: 3100597 - RNA, 14 nt, Molluscum contagiosum virus
gcaugcgccugcac

SEQ ID NO: 3100598 - RNA, 22 nt, Molluscum contagiosum virus
gcauauaaaucauggccgcgcc

SEQ ID NO: 3100599 - RNA, 22 nt, Molluscum contagiosum virus
gcaucagagaagugcuccgcac

SEQ ID NO: 3100600 - RNA, 17 nt, Molluscum contagiosum virus
gcagugccgccgcgcgc

SEQ ID NO: 3100601 - RNA, 19 nt, Molluscum contagiosum virus
gcagugccgccgcgcgcgc

SEQ ID NO: 3100602 - RNA, 14 nt, Molluscum contagiosum virus
gcagugccgcucgc

SEQ ID NO: 3100603 - RNA, 13 nt, Molluscum contagiosum virus
gcagugcucgcac

SEQ ID NO: 3100604 - RNA, 22 nt, Molluscum contagiosum virus
gcagugcucgcacacgugcacg

SEQ ID NO: 3100605 - RNA, 16 nt, Molluscum contagiosum virus
gcaguggccgucgggc

SEQ ID NO: 3100606 - RNA, 19 nt, Molluscum contagiosum virus
gcagucgccuuccugcgcc

SEQ ID NO: 3100607 - RNA, 22 nt, Molluscum contagiosum virus
gcaguucggcgacacgcccgcg

SEQ ID NO: 3100608 - RNA, 13 nt, Molluscum contagiosum virus
gcaucgagaacgc

SEQ ID NO: 3100609 - RNA, 13 nt, Molluscum contagiosum virus
gcaucgucucgcu

SEQ ID NO: 3100610 - RNA, 20 nt, Molluscum contagiosum virus
gcaucgugcucuucgcggga

SEQ ID NO: 3100611 - RNA, 16 nt, Molluscum contagiosum virus
gcaucuccacgucggc

SEQ ID NO: 3100612 - RNA, 14 nt, Molluscum contagiosum virus
gcaucccugcgcac

SEQ ID NO: 3100613 - RNA, 20 nt, Molluscum contagiosum virus
gcauccucuccaucaucgag

SEQ ID NO: 3100614 - RNA, 16 nt, Molluscum contagiosum virus
gcauccggcacgcaca

SEQ ID NO: 3100615 - RNA, 14 nt, Molluscum contagiosum virus
gcagcuaccgcgcg

SEQ ID NO: 3100616 - RNA, 14 nt, Molluscum contagiosum virus
gcagguucucgcac

SEQ ID NO: 3100617 - RNA, 18 nt, Molluscum contagiosum virus
gcagguugaagcucucgc

SEQ ID NO: 3100618 - RNA, 19 nt, Molluscum contagiosum virus
gcagguuugcacccgcgca

SEQ ID NO: 3100619 - RNA, 18 nt, Molluscum contagiosum virus
gcaguaccggccaaggca

SEQ ID NO: 3100620 - RNA, 18 nt, Molluscum contagiosum virus
gcaguagcagcgccggca

SEQ ID NO: 3100621 - RNA, 17 nt, Molluscum contagiosum virus
gcagucaguuccgcggc

SEQ ID NO: 3100622 - RNA, 21 nt, Molluscum contagiosum virus
gcagucccagcaccgcgccgc

SEQ ID NO: 3100623 - RNA, 19 nt, Molluscum contagiosum virus
gcaguccgccgucgcccgg

SEQ ID NO: 3100624 - RNA, 13 nt, Molluscum contagiosum virus
gcagcgugccgcg

SEQ ID NO: 3100625 - RNA, 13 nt, Molluscum contagiosum virus
gcagcgugcgcac

SEQ ID NO: 3100626 - RNA, 16 nt, Molluscum contagiosum virus
gcagcggcgccacgag

SEQ ID NO: 3100627 - RNA, 14 nt, Molluscum contagiosum virus
gcagcggcgcgugc

SEQ ID NO: 3100628 - RNA, 22 nt, Molluscum contagiosum virus
gcagcggcgcgugcuccucgcg

SEQ ID NO: 3100629 - RNA, 14 nt, Molluscum contagiosum virus
gcagcgcuugcgcg

SEQ ID NO: 3100630 - RNA, 21 nt, Molluscum contagiosum virus
gcagcgcgcaaaaggcacgag

SEQ ID NO: 3100631 - RNA, 13 nt, Molluscum contagiosum virus
gcagcgcgcgcag

SEQ ID NO: 3100632 - RNA, 15 nt, Molluscum contagiosum virus
gcagcgcgcgcguag

SEQ ID NO: 3100633 - RNA, 23 nt, Molluscum contagiosum virus
gcagcgcgugacgcucacggccu

SEQ ID NO: 3100634 - RNA, 17 nt, Molluscum contagiosum virus
gcagcgcccggugcggc

SEQ ID NO: 3100635 - RNA, 18 nt, Molluscum contagiosum virus
gcagcgcccggugcggcg

SEQ ID NO: 3100636 - RNA, 13 nt, Molluscum contagiosum virus
gcagcgccgcgcg

SEQ ID NO: 3100637 - RNA, 20 nt, Molluscum contagiosum virus
gcagcgccgcgcgcgcgcgu

SEQ ID NO: 3100638 - RNA, 16 nt, Molluscum contagiosum virus
gccuuucuugcggcac

SEQ ID NO: 3100639 - RNA, 22 nt, Molluscum contagiosum virus
gccuuuguucuuagcagcgccg

SEQ ID NO: 3100640 - RNA, 20 nt, Molluscum contagiosum virus
gcgaaaccugggcgccgcgc

SEQ ID NO: 3100641 - RNA, 17 nt, Molluscum contagiosum virus
gcgaaagcgccgcgcgc

SEQ ID NO: 3100642 - RNA, 18 nt, Molluscum contagiosum virus
gcgaacacggauacgcgc

SEQ ID NO: 3100643 - RNA, 12 nt, Molluscum contagiosum virus
gcgaaccgcggc

SEQ ID NO: 3100644 - RNA, 15 nt, Molluscum contagiosum virus
gcgaaccgcggcagc

SEQ ID NO: 3100645 - RNA, 13 nt, Molluscum contagiosum virus
gcgaacgccggcg

SEQ ID NO: 3100646 - RNA, 14 nt, Molluscum contagiosum virus
gcgaacgcgcaagu

SEQ ID NO: 3100647 - RNA, 20 nt, Molluscum contagiosum virus
gcgaacgcguccacggcgcg

SEQ ID NO: 3100648 - RNA, 19 nt, Molluscum contagiosum virus
gccuucucgucgagagcgc

SEQ ID NO: 3100649 - RNA, 20 nt, Molluscum contagiosum virus
gccuucuugcuggcgcucgc

SEQ ID NO: 3100650 - RNA, 16 nt, Molluscum contagiosum virus
gccuguuuccgcucgc

SEQ ID NO: 3100651 - RNA, 19 nt, Molluscum contagiosum virus
gccuguuuccgcucgcgcu

SEQ ID NO: 3100652 - RNA, 17 nt, Molluscum contagiosum virus
gccuggcguccgcacgc

SEQ ID NO: 3100653 - RNA, 15 nt, Molluscum contagiosum virus
gccugguacaaguca

SEQ ID NO: 3100654 - RNA, 20 nt, Molluscum contagiosum virus
gccuguccgcgggcgcacgc

SEQ ID NO: 3100655 - RNA, 18 nt, Molluscum contagiosum virus
gccugugggauggcucgc

SEQ ID NO: 3100656 - RNA, 14 nt, Molluscum contagiosum virus
gccgucgacgcuga

SEQ ID NO: 3100657 - RNA, 19 nt, Molluscum contagiosum virus
gccgucgcccggcaggcuc

SEQ ID NO: 3100658 - RNA, 17 nt, Molluscum contagiosum virus
gccgucgccgcgcccgc

SEQ ID NO: 3100659 - RNA, 16 nt, Molluscum contagiosum virus
gccgucucgcgcucgc

SEQ ID NO: 3100660 - RNA, 14 nt, Molluscum contagiosum virus
gccgugagcacgag

SEQ ID NO: 3100661 - RNA, 16 nt, Molluscum contagiosum virus
gccgugagcacgagau

SEQ ID NO: 3100662 - RNA, 15 nt, Molluscum contagiosum virus
gccgugcccgccgac

SEQ ID NO: 3100663 - RNA, 18 nt, Molluscum contagiosum virus
gccgugaccuucgugcuu

SEQ ID NO: 3100664 - RNA, 12 nt, Molluscum contagiosum virus
gccgugcgcgac

SEQ ID NO: 3100665 - RNA, 16 nt, Molluscum contagiosum virus
gccguccaugugcccg

SEQ ID NO: 3100666 - RNA, 22 nt, Molluscum contagiosum virus
gccguccaugugcccgcggcgc

SEQ ID NO: 3100667 - RNA, 17 nt, Molluscum contagiosum virus
gccguccccgcgcucac

SEQ ID NO: 3100668 - RNA, 20 nt, Molluscum contagiosum virus
gccguccccggaaagcagca

SEQ ID NO: 3100669 - RNA, 19 nt, Molluscum contagiosum virus
gccguccgccucgagcacg

SEQ ID NO: 3100670 - RNA, 13 nt, Molluscum contagiosum virus
gccgucacggccg

SEQ ID NO: 3100671 - RNA, 16 nt, Molluscum contagiosum virus
gccguacccggggaga

SEQ ID NO: 3100672 - RNA, 21 nt, Molluscum contagiosum virus
gccguacccggggagaagaug

SEQ ID NO: 3100673 - RNA, 14 nt, Molluscum contagiosum virus
gccguagugcucau

SEQ ID NO: 3100674 - RNA, 12 nt, Molluscum contagiosum virus
gccggugcugcg

SEQ ID NO: 3100675 - RNA, 14 nt, Molluscum contagiosum virus
gccgguggaagagc

SEQ ID NO: 3100676 - RNA, 17 nt, Molluscum contagiosum virus
gccgguggaagagcccg

SEQ ID NO: 3100677 - RNA, 15 nt, Molluscum contagiosum virus
gcgacaacgacagag

SEQ ID NO: 3100678 - RNA, 16 nt, Molluscum contagiosum virus
gcgaccagcucuuggc

SEQ ID NO: 3100679 - RNA, 18 nt, Molluscum contagiosum virus
gcgacaugccucgcggcc

SEQ ID NO: 3100680 - RNA, 18 nt, Molluscum contagiosum virus
gcgacaugcugcccgcgc

SEQ ID NO: 3100681 - RNA, 21 nt, Molluscum contagiosum virus
gcgaauguccggcgcuggaga

SEQ ID NO: 3100682 - RNA, 22 nt, Molluscum contagiosum virus
gcgaauuggccgcggaggacuc

SEQ ID NO: 3100683 - RNA, 18 nt, Molluscum contagiosum virus
gcgacacgcccgcguccc

SEQ ID NO: 3100684 - RNA, 20 nt, Molluscum contagiosum virus
gcgaccuacgaggugcugcg

SEQ ID NO: 3100685 - RNA, 19 nt, Molluscum contagiosum virus
gcgaccuacuccuggccaa

SEQ ID NO: 3100686 - RNA, 16 nt, Molluscum contagiosum virus
gcgaccugcugcgaga

SEQ ID NO: 3100687 - RNA, 19 nt, Molluscum contagiosum virus
gcgacgagcucacgccgga

SEQ ID NO: 3100688 - RNA, 16 nt, Molluscum contagiosum virus
gcgaccuuagcgaggu

SEQ ID NO: 3100689 - RNA, 15 nt, Molluscum contagiosum virus
gcgacgacagcgacg

SEQ ID NO: 3100690 - RNA, 23 nt, Molluscum contagiosum virus
gcgacgacgacuucggcgcaacg

SEQ ID NO: 3100691 - RNA, 15 nt, Molluscum contagiosum virus
gcgacgacgagcacu

SEQ ID NO: 3100692 - RNA, 16 nt, Molluscum contagiosum virus
gcgacgacgagcacua

SEQ ID NO: 3100693 - RNA, 20 nt, Molluscum contagiosum virus
gcgacgccauuuucgugcgc

SEQ ID NO: 3100694 - RNA, 21 nt, Molluscum contagiosum virus
gcgacgccauuuucgugcgcg

SEQ ID NO: 3100695 - RNA, 15 nt, Molluscum contagiosum virus
gcgacgccccggcgc

SEQ ID NO: 3100696 - RNA, 16 nt, Molluscum contagiosum virus
gcgacggugugccgcu

SEQ ID NO: 3100697 - RNA, 12 nt, Molluscum contagiosum virus
gcgacgugcgcg

SEQ ID NO: 3100698 - RNA, 20 nt, Molluscum contagiosum virus
gcgacgugcgcgcugcgcgc

SEQ ID NO: 3100699 - RNA, 15 nt, Molluscum contagiosum virus
gcgacgccguccgcg

SEQ ID NO: 3100700 - RNA, 19 nt, Molluscum contagiosum virus
gcgacgccguccgcgcagc

SEQ ID NO: 3100701 - RNA, 17 nt, Molluscum contagiosum virus
gcgacgcgaucgugcgc

SEQ ID NO: 3100702 - RNA, 19 nt, Molluscum contagiosum virus
gcgacggaaccguggugcg

SEQ ID NO: 3100703 - RNA, 21 nt, Molluscum contagiosum virus
gcgacggaaccguggugcgcg

SEQ ID NO: 3100704 - RNA, 21 nt, Molluscum contagiosum virus
gcgacggagauggacacagca

SEQ ID NO: 3100705 - RNA, 14 nt, Molluscum contagiosum virus
gcgacggcaggccc

SEQ ID NO: 3100706 - RNA, 19 nt, Molluscum contagiosum virus
gcgacgggaaccgugcugg

SEQ ID NO: 3100707 - RNA, 17 nt, Molluscum contagiosum virus
gcgagaccgcuagagug

SEQ ID NO: 3100708 - RNA, 20 nt, Molluscum contagiosum virus
gcgagaccgcuagagugcgc

SEQ ID NO: 3100709 - RNA, 22 nt, Molluscum contagiosum virus
gcgagaccgcuagagugcgcgg

SEQ ID NO: 3100710 - RNA, 15 nt, Molluscum contagiosum virus
gcgagacgggcacgc

SEQ ID NO: 3100711 - RNA, 16 nt, Molluscum contagiosum virus
gcgagacugugccgcu

SEQ ID NO: 3100712 - RNA, 14 nt, Molluscum contagiosum virus
gcgagagcgcgcgc

SEQ ID NO: 3100713 - RNA, 17 nt, Molluscum contagiosum virus
gcgagaucaacgcgcgc

SEQ ID NO: 3100714 - RNA, 17 nt, Molluscum contagiosum virus
gcgagaucccuccgaga

SEQ ID NO: 3100715 - RNA, 13 nt, Molluscum contagiosum virus
gcgagaugcgcgg

SEQ ID NO: 3100716 - RNA, 18 nt, Molluscum contagiosum virus
gcgagaugcucgccggca

SEQ ID NO: 3100717 - RNA, 17 nt, Molluscum contagiosum virus
gcgagauucuggcgcgc

SEQ ID NO: 3100718 - RNA, 20 nt, Molluscum contagiosum virus
gcgagcaagcgcccgcgagc

SEQ ID NO: 3100719 - RNA, 15 nt, Molluscum contagiosum virus
gcgagcacagcgcgc

SEQ ID NO: 3100720 - RNA, 14 nt, Molluscum contagiosum virus
gcgagcacgccugc

SEQ ID NO: 3100721 - RNA, 14 nt, Molluscum contagiosum virus
gcgagcacgggcgc

SEQ ID NO: 3100722 - RNA, 22 nt, Molluscum contagiosum virus
gcgagcacugcgcgcgcggcgc

SEQ ID NO: 3100723 - RNA, 15 nt, Molluscum contagiosum virus
gcgagcagcugcugc

SEQ ID NO: 3100724 - RNA, 20 nt, Molluscum contagiosum virus
gcgagcagugugaugccgcg

SEQ ID NO: 3100725 - RNA, 23 nt, Molluscum contagiosum virus
gcgagcagugugaugccgcgcgu

SEQ ID NO: 3100726 - RNA, 17 nt, Molluscum contagiosum virus
gcgagcaguucgcgcgc

SEQ ID NO: 3100727 - RNA, 19 nt, Molluscum contagiosum virus
gcgagcaguucgcgcgccu

SEQ ID NO: 3100728 - RNA, 16 nt, Molluscum contagiosum virus
gcgagcaucugcgcgu

SEQ ID NO: 3100729 - RNA, 13 nt, Molluscum contagiosum virus
gcgagcaugccgc

SEQ ID NO: 3100730 - RNA, 16 nt, Molluscum contagiosum virus
gcgagcaugccgccgc

SEQ ID NO: 3100731 - RNA, 15 nt, Molluscum contagiosum virus
gcgagccacgcgcau

SEQ ID NO: 3100732 - RNA, 16 nt, Molluscum contagiosum virus
gcgcguuugucgcggg

SEQ ID NO: 3100733 - RNA, 12 nt, Molluscum contagiosum virus
gcgcuaccugau

SEQ ID NO: 3100734 - RNA, 14 nt, Molluscum contagiosum virus
gcgcuacguggcgc

SEQ ID NO: 3100735 - RNA, 17 nt, Molluscum contagiosum virus
gcgcuacuugcuggcgc

SEQ ID NO: 3100736 - RNA, 17 nt, Molluscum contagiosum virus
gcgcuagagcgcggcgc

SEQ ID NO: 3100737 - RNA, 22 nt, Molluscum contagiosum virus
gcgcuagcuccacgugccgcuc

SEQ ID NO: 3100738 - RNA, 16 nt, Molluscum contagiosum virus
gcgcuagugaaccgca

SEQ ID NO: 3100739 - RNA, 19 nt, Molluscum contagiosum virus
gcgcucacugcagcagccc

SEQ ID NO: 3100740 - RNA, 16 nt, Molluscum contagiosum virus
gcgcuauugcgcggcg

SEQ ID NO: 3100741 - RNA, 19 nt, Molluscum contagiosum virus
gcgagcccggaucagcccc

SEQ ID NO: 3100742 - RNA, 23 nt, Molluscum contagiosum virus
gcgagcccuucuuuccggcgcgg

SEQ ID NO: 3100743 - RNA, 20 nt, Molluscum contagiosum virus
gcgagcgcaugcgcgccgcg

SEQ ID NO: 3100744 - RNA, 14 nt, Molluscum contagiosum virus
gcgcgugugcagca

SEQ ID NO: 3100745 - RNA, 19 nt, Molluscum contagiosum virus
gcgcgugugcagcagguag

SEQ ID NO: 3100746 - RNA, 15 nt, Molluscum contagiosum virus
gcgcguucagcgcac

SEQ ID NO: 3100747 - RNA, 17 nt, Molluscum contagiosum virus
gcgcguucagcgcacgc

SEQ ID NO: 3100748 - RNA, 19 nt, Molluscum contagiosum virus
gcgcguucauuugcgugag

SEQ ID NO: 3100749 - RNA, 20 nt, Molluscum contagiosum virus
gcgcguucuuugugcggcuc

SEQ ID NO: 3100750 - RNA, 23 nt, Molluscum contagiosum virus
gcgcguugcucccgucgagcacg

SEQ ID NO: 3100751 - RNA, 21 nt, Molluscum contagiosum virus
gcgacgugugcucugugcgcg

SEQ ID NO: 3100752 - RNA, 13 nt, Molluscum contagiosum virus
gcgacuacgcgcu

SEQ ID NO: 3100753 - RNA, 16 nt, Molluscum contagiosum virus
gcgacuccaucugcgc

SEQ ID NO: 3100754 - RNA, 21 nt, Molluscum contagiosum virus
gcgacuccaucugcgcgacgc

SEQ ID NO: 3100755 - RNA, 21 nt, Molluscum contagiosum virus
gcgacuccuuugcgagcacug

SEQ ID NO: 3100756 - RNA, 19 nt, Molluscum contagiosum virus
gcgacuggcacgcgccgcg

SEQ ID NO: 3100757 - RNA, 17 nt, Molluscum contagiosum virus
gcgacuugcugcggagc

SEQ ID NO: 3100758 - RNA, 17 nt, Molluscum contagiosum virus
gcgacuuguagugcccg

SEQ ID NO: 3100759 - RNA, 18 nt, Molluscum contagiosum virus
gcgagaacuggcgcagca

SEQ ID NO: 3100760 - RNA, 20 nt, Molluscum contagiosum virus
gcgcucgaacgcgcgugcgc

SEQ ID NO: 3100761 - RNA, 17 nt, Molluscum contagiosum virus
gcgcucgacgcgugcau

SEQ ID NO: 3100762 - RNA, 16 nt, Molluscum contagiosum virus
gcgcucgagcuccgag

SEQ ID NO: 3100763 - RNA, 24 nt, Molluscum contagiosum virus
gcgcucgauuuaacucuagcgaga

SEQ ID NO: 3100764 - RNA, 19 nt, Molluscum contagiosum virus
gcgcucgcgcgcacgcgca

SEQ ID NO: 3100765 - RNA, 15 nt, Molluscum contagiosum virus
gcgcucgcucgcgcu

SEQ ID NO: 3100766 - RNA, 23 nt, Molluscum contagiosum virus
gcgcucgucaaugcgcacgugcu

SEQ ID NO: 3100767 - RNA, 17 nt, Molluscum contagiosum virus
gcgcucucagagcauua

SEQ ID NO: 3100768 - RNA, 13 nt, Molluscum contagiosum virus
gcgcucugccgcc

SEQ ID NO: 3100769 - RNA, 21 nt, Molluscum contagiosum virus
gcgcucuucaagaacagucgc

SEQ ID NO: 3100770 - RNA, 20 nt, Molluscum contagiosum virus
gcgcucuucguggugcucac

SEQ ID NO: 3100771 - RNA, 22 nt, Molluscum contagiosum virus
gcgcugcacaguucacggcgcu

SEQ ID NO: 3100772 - RNA, 13 nt, Molluscum contagiosum virus
gcgcugcaccgcu

SEQ ID NO: 3100773 - RNA, 18 nt, Molluscum contagiosum virus
gcgcugcacgccgccagc

SEQ ID NO: 3100774 - RNA, 14 nt, Molluscum contagiosum virus
gcgcugcagcaccu

SEQ ID NO: 3100775 - RNA, 16 nt, Molluscum contagiosum virus
gcgcugccagcucgac

SEQ ID NO: 3100776 - RNA, 14 nt, Molluscum contagiosum virus
gcgcugcccgcgca

SEQ ID NO: 3100777 - RNA, 16 nt, Molluscum contagiosum virus
gcgcugcccgcgcaca

SEQ ID NO: 3100778 - RNA, 13 nt, Molluscum contagiosum virus
gcgcugcgcaagc

SEQ ID NO: 3100779 - RNA, 16 nt, Molluscum contagiosum virus
gcgcugcgcaagcgcu

SEQ ID NO: 3100780 - RNA, 13 nt, Molluscum contagiosum virus
gcgcugcgccacu

SEQ ID NO: 3100781 - RNA, 22 nt, Molluscum contagiosum virus
gcgcugcgccacugccacggcu

SEQ ID NO: 3100782 - RNA, 12 nt, Molluscum contagiosum virus
gcgcugcgccgc

SEQ ID NO: 3100783 - RNA, 14 nt, Molluscum contagiosum virus
gcgcugcgcgcgcu

SEQ ID NO: 3100784 - RNA, 11 nt, Molluscum contagiosum virus
gcgcugcgcgg

SEQ ID NO: 3100785 - RNA, 14 nt, Molluscum contagiosum virus
gcgcugcgcggcgg

SEQ ID NO: 3100786 - RNA, 19 nt, Molluscum contagiosum virus
gcgcugcuacaagcggugc

SEQ ID NO: 3100787 - RNA, 14 nt, Molluscum contagiosum virus
gcgcugcucgcgcu

SEQ ID NO: 3100788 - RNA, 17 nt, Molluscum contagiosum virus
gcgcugcucgcgcucgc

SEQ ID NO: 3100789 - RNA, 14 nt, Molluscum contagiosum virus
gcgcugcucuucgc

SEQ ID NO: 3100790 - RNA, 20 nt, Molluscum contagiosum virus
gcgcugcugguucugcucgc

SEQ ID NO: 3100791 - RNA, 22 nt, Molluscum contagiosum virus
gcgcuggagaaagaagugugcc

SEQ ID NO: 3100792 - RNA, 16 nt, Molluscum contagiosum virus
gcgcuggaugcugcuc

SEQ ID NO: 3100793 - RNA, 16 nt, Molluscum contagiosum virus
gcgcuggcccacgcug

SEQ ID NO: 3100794 - RNA, 17 nt, Molluscum contagiosum virus
gcggcaaaggcccgcga

SEQ ID NO: 3100795 - RNA, 19 nt, Molluscum contagiosum virus
gcggcaaaggcccgcgagc

SEQ ID NO: 3100796 - RNA, 15 nt, Molluscum contagiosum virus
gcggcaacagcacga

SEQ ID NO: 3100797 - RNA, 14 nt, Molluscum contagiosum virus
gcggcaaccgcgcc

SEQ ID NO: 3100798 - RNA, 15 nt, Molluscum contagiosum virus
gcggcaaccgcgccc

SEQ ID NO: 3100799 - RNA, 16 nt, Molluscum contagiosum virus
gcggcaaccgcgcccg

SEQ ID NO: 3100800 - RNA, 21 nt, Molluscum contagiosum virus
gcggcaaccgcgcccgcgcgc

SEQ ID NO: 3100801 - RNA, 16 nt, Molluscum contagiosum virus
gcggcaacgagcacgu

SEQ ID NO: 3100802 - RNA, 16 nt, Molluscum contagiosum virus
gcggcaagccgugcuu

SEQ ID NO: 3100803 - RNA, 14 nt, Molluscum contagiosum virus
gcggcaagcuuugc

SEQ ID NO: 3100804 - RNA, 16 nt, Molluscum contagiosum virus
gcggcagcuaccgcgc

SEQ ID NO: 3100805 - RNA, 18 nt, Molluscum contagiosum virus
gcggcagcuaccgcgcgc

SEQ ID NO: 3100806 - RNA, 23 nt, Molluscum contagiosum virus
gcggcagcucugcagcgccgcgc

SEQ ID NO: 3100807 - RNA, 16 nt, Molluscum contagiosum virus
gcggcaggcgcugcgc

SEQ ID NO: 3100808 - RNA, 23 nt, Molluscum contagiosum virus
gcggcaggcgcugcgcggcgcgc

SEQ ID NO: 3100809 - RNA, 21 nt, Molluscum contagiosum virus
gcggcagguuugcacccgcgc

SEQ ID NO: 3100810 - RNA, 15 nt, Molluscum contagiosum virus
gcggcaugcgcgcgc

SEQ ID NO: 3100811 - RNA, 22 nt, Molluscum contagiosum virus
gcggcacacacuugcacgcgca

SEQ ID NO: 3100812 - RNA, 21 nt, Molluscum contagiosum virus
gcggcacacaugcuagcgggc

SEQ ID NO: 3100813 - RNA, 18 nt, Molluscum contagiosum virus
gcggccaccagcgcggcc

SEQ ID NO: 3100814 - RNA, 22 nt, Molluscum contagiosum virus
gcggccacgcacucgcuggccu

SEQ ID NO: 3100815 - RNA, 18 nt, Molluscum contagiosum virus
gcggccacgcucgcgcgc

SEQ ID NO: 3100816 - RNA, 19 nt, Molluscum contagiosum virus
gcggccacgcucgcgcgca

SEQ ID NO: 3100817 - RNA, 14 nt, Molluscum contagiosum virus
gcggcacccgccgc

SEQ ID NO: 3100818 - RNA, 19 nt, Molluscum contagiosum virus
gcggcacccgccgcggugc

SEQ ID NO: 3100819 - RNA, 19 nt, Molluscum contagiosum virus
gcgcugguuaccaagggca

SEQ ID NO: 3100820 - RNA, 14 nt, Molluscum contagiosum virus
gcgcuggcgugcgc

SEQ ID NO: 3100821 - RNA, 16 nt, Molluscum contagiosum virus
gcgcugguggaggagc

SEQ ID NO: 3100822 - RNA, 16 nt, Molluscum contagiosum virus
gcggcaccugucgcgc

SEQ ID NO: 3100823 - RNA, 18 nt, Molluscum contagiosum virus
gcggcaccugucgcgcgc

SEQ ID NO: 3100824 - RNA, 18 nt, Molluscum contagiosum virus
gcggcacgcccuggcccu

SEQ ID NO: 3100825 - RNA, 18 nt, Molluscum contagiosum virus
gcggcacgccgcucggca

SEQ ID NO: 3100826 - RNA, 15 nt, Molluscum contagiosum virus
gcggcacgcgagcgc

SEQ ID NO: 3100827 - RNA, 15 nt, Molluscum contagiosum virus
gcggcacgucguccg

SEQ ID NO: 3100828 - RNA, 14 nt, Molluscum contagiosum virus
gcggcacugcgcgc

SEQ ID NO: 3100829 - RNA, 18 nt, Molluscum contagiosum virus
gcggcacugggugcccga

SEQ ID NO: 3100830 - RNA, 22 nt, Molluscum contagiosum virus
gcggcagacaacaccagcgugc

SEQ ID NO: 3100831 - RNA, 13 nt, Molluscum contagiosum virus
gcggcagcgccag

SEQ ID NO: 3100832 - RNA, 17 nt, Molluscum contagiosum virus
gcggucaggccgggcgc

SEQ ID NO: 3100833 - RNA, 19 nt, Molluscum contagiosum virus
gcggucaggccgggcgcgg

SEQ ID NO: 3100834 - RNA, 21 nt, Molluscum contagiosum virus
gcgguccgacucggugcucau

SEQ ID NO: 3100835 - RNA, 13 nt, Molluscum contagiosum virus
gcggugcagcgcc

SEQ ID NO: 3100836 - RNA, 14 nt, Molluscum contagiosum virus
gcggugcagcgccc

SEQ ID NO: 3100837 - RNA, 20 nt, Molluscum contagiosum virus
gcgguccuguccgcggacgc

SEQ ID NO: 3100838 - RNA, 19 nt, Molluscum contagiosum virus
gcggucgacgagugcgccg

SEQ ID NO: 3100839 - RNA, 20 nt, Molluscum contagiosum virus
gcggucgcgagccacgcgca

SEQ ID NO: 3100840 - RNA, 20 nt, Molluscum contagiosum virus
gcggucucggcagcagcgug

SEQ ID NO: 3100841 - RNA, 23 nt, Molluscum contagiosum virus
gcggucugaaacacggaggagcg

SEQ ID NO: 3100842 - RNA, 22 nt, Molluscum contagiosum virus
gcggucuuccagcacugcgcca

SEQ ID NO: 3100843 - RNA, 24 nt, Molluscum contagiosum virus
gcggucuuggcaugcgugcuucac

SEQ ID NO: 3100844 - RNA, 19 nt, Molluscum contagiosum virus
gcggccauggucacgcgca

SEQ ID NO: 3100845 - RNA, 15 nt, Molluscum contagiosum virus
gcggccgcgagacgc

SEQ ID NO: 3100846 - RNA, 18 nt, Molluscum contagiosum virus
gcggccgcgcucgucggc

SEQ ID NO: 3100847 - RNA, 23 nt, Molluscum contagiosum virus
gcggccgggaucggacgcagacg

SEQ ID NO: 3100848 - RNA, 14 nt, Molluscum contagiosum virus
gcggcccgcggcgc

SEQ ID NO: 3100849 - RNA, 13 nt, Molluscum contagiosum virus
gcggcccgcgggc

SEQ ID NO: 3100850 - RNA, 21 nt, Molluscum contagiosum virus
gcggcccuucguguucgcgga

SEQ ID NO: 3100851 - RNA, 17 nt, Molluscum contagiosum virus
gcggccgagucacgccc

SEQ ID NO: 3100852 - RNA, 17 nt, Molluscum contagiosum virus
gcccgccucgucgucca

SEQ ID NO: 3100853 - RNA, 14 nt, Molluscum contagiosum virus
gcccgccugccgcg

SEQ ID NO: 3100854 - RNA, 20 nt, Molluscum contagiosum virus
gcccgccuuuguggacgcgc

SEQ ID NO: 3100855 - RNA, 19 nt, Molluscum contagiosum virus
gcccgcgagauugagagcg

SEQ ID NO: 3100856 - RNA, 22 nt, Molluscum contagiosum virus
gcccgcgcgagacuugugccca

SEQ ID NO: 3100857 - RNA, 13 nt, Molluscum contagiosum virus
gcccgcgcgcgca

SEQ ID NO: 3100858 - RNA, 13 nt, Molluscum contagiosum virus
gcccgcgcggaga

SEQ ID NO: 3100859 - RNA, 22 nt, Molluscum contagiosum virus
gcccgcggacaucgacgccaac

SEQ ID NO: 3100860 - RNA, 16 nt, Molluscum contagiosum virus
gcccgcgucgcgcgcc

SEQ ID NO: 3100861 - RNA, 14 nt, Molluscum contagiosum virus
gcccgcgugcaccc

SEQ ID NO: 3100862 - RNA, 14 nt, Molluscum contagiosum virus
gcccggaagcuugc

SEQ ID NO: 3100863 - RNA, 13 nt, Molluscum contagiosum virus
gcccgcugcgcau

SEQ ID NO: 3100864 - RNA, 23 nt, Molluscum contagiosum virus
gcccgcuggcggcgcacgcgagc

SEQ ID NO: 3100865 - RNA, 15 nt, Molluscum contagiosum virus
gcccgcggacgcgca

SEQ ID NO: 3100866 - RNA, 19 nt, Molluscum contagiosum virus
gcccgcggacucgugcacc

SEQ ID NO: 3100867 - RNA, 20 nt, Molluscum contagiosum virus
gcccgcggacucgugcacca

SEQ ID NO: 3100868 - RNA, 19 nt, Molluscum contagiosum virus
gcccgcggagaccaccgcu

SEQ ID NO: 3100869 - RNA, 15 nt, Molluscum contagiosum virus
gcccgcggcgcgcag

SEQ ID NO: 3100870 - RNA, 23 nt, Molluscum contagiosum virus
gcccgcguacacgugcacgcgca

SEQ ID NO: 3100871 - RNA, 15 nt, Molluscum contagiosum virus
gcccgcgggggcgug

SEQ ID NO: 3100872 - RNA, 20 nt, Molluscum contagiosum virus
gcccgugccgccggcgccgc

SEQ ID NO: 3100873 - RNA, 15 nt, Molluscum contagiosum virus
gcccguggugggccg

SEQ ID NO: 3100874 - RNA, 22 nt, Molluscum contagiosum virus
gcccguguucgcggagcugugc

SEQ ID NO: 3100875 - RNA, 21 nt, Molluscum contagiosum virus
gcccggcagcgacuacgcgcu

SEQ ID NO: 3100876 - RNA, 14 nt, Molluscum contagiosum virus
gcccggcgggcucu

SEQ ID NO: 3100877 - RNA, 15 nt, Molluscum contagiosum virus
gcccgguacgcucgc

SEQ ID NO: 3100878 - RNA, 18 nt, Molluscum contagiosum virus
gcccgguacgcucgcgcu

SEQ ID NO: 3100879 - RNA, 12 nt, Molluscum contagiosum virus
gcccguccuccg

SEQ ID NO: 3100880 - RNA, 16 nt, Molluscum contagiosum virus
gcccugcuagugcgcg

SEQ ID NO: 3100881 - RNA, 23 nt, Molluscum contagiosum virus
gcccuuauacaaaguugaccacc

SEQ ID NO: 3100882 - RNA, 14 nt, Molluscum contagiosum virus
gccgcccacgcuca

SEQ ID NO: 3100883 - RNA, 18 nt, Molluscum contagiosum virus
gcccuggagcgcaguccc

SEQ ID NO: 3100884 - RNA, 15 nt, Molluscum contagiosum virus
gccgccgcugccgcg

SEQ ID NO: 3100885 - RNA, 13 nt, Molluscum contagiosum virus
gccgccgcaggcc

SEQ ID NO: 3100886 - RNA, 14 nt, Molluscum contagiosum virus
gccgccgcaggccc

SEQ ID NO: 3100887 - RNA, 15 nt, Molluscum contagiosum virus
gccgccucgcgcgca

SEQ ID NO: 3100888 - RNA, 16 nt, Molluscum contagiosum virus
gccgccucgcgcgcac

SEQ ID NO: 3100889 - RNA, 23 nt, Molluscum contagiosum virus
gccgccugcucucgaagcagugc

SEQ ID NO: 3100890 - RNA, 21 nt, Molluscum contagiosum virus
gccgcgaaagcgucgugcucc

SEQ ID NO: 3100891 - RNA, 21 nt, Molluscum contagiosum virus
gccgccggggcccaugcucac

SEQ ID NO: 3100892 - RNA, 19 nt, Molluscum contagiosum virus
gccgcgcccacgggcuucg

SEQ ID NO: 3100893 - RNA, 18 nt, Molluscum contagiosum virus
gccgcgcccgcggcgcac

SEQ ID NO: 3100894 - RNA, 20 nt, Molluscum contagiosum virus
gccgcgccgcacgugcugcg

SEQ ID NO: 3100895 - RNA, 19 nt, Molluscum contagiosum virus
gccgcgagacgcagacgac

SEQ ID NO: 3100896 - RNA, 12 nt, Molluscum contagiosum virus
gccgcgagcacu

SEQ ID NO: 3100897 - RNA, 13 nt, Molluscum contagiosum virus
gccgcgagcgcgu

SEQ ID NO: 3100898 - RNA, 18 nt, Molluscum contagiosum virus
gccgcgaggacccgcgcu

SEQ ID NO: 3100899 - RNA, 21 nt, Molluscum contagiosum virus
gccgcgcaagugggcgucgac

SEQ ID NO: 3100900 - RNA, 13 nt, Molluscum contagiosum virus
gccgcgcgcgcac

SEQ ID NO: 3100901 - RNA, 20 nt, Molluscum contagiosum virus
gccgcgcgcgccagcuaugc

SEQ ID NO: 3100902 - RNA, 18 nt, Molluscum contagiosum virus
gccgcgcgcggugcugcg

SEQ ID NO: 3100903 - RNA, 13 nt, Molluscum contagiosum virus
gccgcgcgcucgc

SEQ ID NO: 3100904 - RNA, 17 nt, Molluscum contagiosum virus
gccgcgccgcugcgccg

SEQ ID NO: 3100905 - RNA, 18 nt, Molluscum contagiosum virus
gccgcgccgggcgccaga

SEQ ID NO: 3100906 - RNA, 20 nt, Molluscum contagiosum virus
gccgcgccuagccgugcgcg

SEQ ID NO: 3100907 - RNA, 22 nt, Molluscum contagiosum virus
gccgcgccuugagcgcgccgcg

SEQ ID NO: 3100908 - RNA, 17 nt, Molluscum contagiosum virus
gccgcgcucgugccgcc

SEQ ID NO: 3100909 - RNA, 13 nt, Molluscum contagiosum virus
gccgcgcucgugu

SEQ ID NO: 3100910 - RNA, 20 nt, Molluscum contagiosum virus
gccgcgcugcuccgugccca

SEQ ID NO: 3100911 - RNA, 19 nt, Molluscum contagiosum virus
gccgcggacgccggcgccc

SEQ ID NO: 3100912 - RNA, 19 nt, Molluscum contagiosum virus
gccgcggagaagugcgcag

SEQ ID NO: 3100913 - RNA, 23 nt, Molluscum contagiosum virus
gccgcggaggacucggaggccgu

SEQ ID NO: 3100914 - RNA, 22 nt, Molluscum contagiosum virus
gccgcggcacugggugcccgag

SEQ ID NO: 3100915 - RNA, 16 nt, Molluscum contagiosum virus
gccgcgcggcacgccc

SEQ ID NO: 3100916 - RNA, 17 nt, Molluscum contagiosum virus
gccggcguucgcggagc

SEQ ID NO: 3100917 - RNA, 13 nt, Molluscum contagiosum virus
gccgcggugccgg

SEQ ID NO: 3100918 - RNA, 18 nt, Molluscum contagiosum virus
gccggcucagcguggagc

SEQ ID NO: 3100919 - RNA, 15 nt, Molluscum contagiosum virus
gccggcugcgccacc

SEQ ID NO: 3100920 - RNA, 15 nt, Molluscum contagiosum virus
gccggcguccgcggc

SEQ ID NO: 3100921 - RNA, 19 nt, Molluscum contagiosum virus
gccggcguccgcggcacgc

SEQ ID NO: 3100922 - RNA, 16 nt, Molluscum contagiosum virus
gccgcggccugggcca

SEQ ID NO: 3100923 - RNA, 19 nt, Molluscum contagiosum virus
gccgguacucgugcgucac

SEQ ID NO: 3100924 - RNA, 14 nt, Molluscum contagiosum virus
gccgguacugcgga

SEQ ID NO: 3100925 - RNA, 15 nt, Molluscum contagiosum virus
gccgguacugcggac

SEQ ID NO: 3100926 - RNA, 16 nt, Molluscum contagiosum virus
gccgguacugcggaca

SEQ ID NO: 3100927 - RNA, 18 nt, Molluscum contagiosum virus
gccggucuccacguggcc

SEQ ID NO: 3100928 - RNA, 18 nt, Molluscum contagiosum virus
gccgggaaugcugcgcac

SEQ ID NO: 3100929 - RNA, 13 nt, Molluscum contagiosum virus
gccgggagagccg

SEQ ID NO: 3100930 - RNA, 15 nt, Molluscum contagiosum virus
gccgggcaccggcgc

SEQ ID NO: 3100931 - RNA, 18 nt, Molluscum contagiosum virus
gccgggcacgcccgcggu

SEQ ID NO: 3100932 - RNA, 18 nt, Molluscum contagiosum virus
gccgggccccugucgcgc

SEQ ID NO: 3100933 - RNA, 19 nt, Molluscum contagiosum virus
gccgggccugcggcggcgc

SEQ ID NO: 3100934 - RNA, 16 nt, Molluscum contagiosum virus
gucgcgccgaggacgc

SEQ ID NO: 3100935 - RNA, 13 nt, Molluscum contagiosum virus
gucgcgcgccgca

SEQ ID NO: 3100936 - RNA, 20 nt, Molluscum contagiosum virus
gucgccuacgaggugcgcga

SEQ ID NO: 3100937 - RNA, 13 nt, Molluscum contagiosum virus
gucgcgacgcgcu

SEQ ID NO: 3100938 - RNA, 11 nt, Molluscum contagiosum virus
gucgcgcacgc

SEQ ID NO: 3100939 - RNA, 19 nt, Molluscum contagiosum virus
ggacgagagggcgcgcguc

SEQ ID NO: 3100940 - RNA, 15 nt, Molluscum contagiosum virus
gcucccgcacgcacc

SEQ ID NO: 3100941 - RNA, 12 nt, Molluscum contagiosum virus
ggacgcgcaagu

SEQ ID NO: 3100942 - RNA, 13 nt, Molluscum contagiosum virus
ggacgcgcggagc

SEQ ID NO: 3100943 - RNA, 21 nt, Molluscum contagiosum virus
ggacgcggaauuggcgucagg

SEQ ID NO: 3100944 - RNA, 19 nt, Molluscum contagiosum virus
ggacgcgggcguguccgcg

SEQ ID NO: 3100945 - RNA, 15 nt, Molluscum contagiosum virus
ggacgcuugcuagca

SEQ ID NO: 3100946 - RNA, 14 nt, Molluscum contagiosum virus
ggacggagagcgcg

SEQ ID NO: 3100947 - RNA, 20 nt, Molluscum contagiosum virus
ggacggcgcgcagcgcguga

SEQ ID NO: 3100948 - RNA, 14 nt, Molluscum contagiosum virus
ggacggcgugcgcc

SEQ ID NO: 3100949 - RNA, 23 nt, Molluscum contagiosum virus
ggacgugcccuacgcgcgcgugc

SEQ ID NO: 3100950 - RNA, 17 nt, Molluscum contagiosum virus
ggacguggucgcgcgcg

SEQ ID NO: 3100951 - RNA, 16 nt, Molluscum contagiosum virus
ggacucgccgcgcgcc

SEQ ID NO: 3100952 - RNA, 14 nt, Molluscum contagiosum virus
ggagagcgcgcggc

SEQ ID NO: 3100953 - RNA, 15 nt, Molluscum contagiosum virus
ggagaggacgcgugc

SEQ ID NO: 3100954 - RNA, 15 nt, Molluscum contagiosum virus
ggagaucgccgcgca

SEQ ID NO: 3100955 - RNA, 15 nt, Molluscum contagiosum virus
ggagaugacgggcac

SEQ ID NO: 3100956 - RNA, 19 nt, Molluscum contagiosum virus
ggagcaccgcguggcgcgc

SEQ ID NO: 3100957 - RNA, 21 nt, Molluscum contagiosum virus
ggagcaccgcguggcgcgcga

SEQ ID NO: 3100958 - RNA, 20 nt, Molluscum contagiosum virus
ggagcacgccuggcggcagc

SEQ ID NO: 3100959 - RNA, 18 nt, Molluscum contagiosum virus
ggagcacuuccgcgcgcu

SEQ ID NO: 3100960 - RNA, 18 nt, Molluscum contagiosum virus
ggagcagacguacgagca

SEQ ID NO: 3100961 - RNA, 20 nt, Molluscum contagiosum virus
ggagcagacguacgagcagg

SEQ ID NO: 3100962 - RNA, 17 nt, Molluscum contagiosum virus
ggagcagccccguaggc

SEQ ID NO: 3100963 - RNA, 14 nt, Molluscum contagiosum virus
ggacuuccgcgcgc

SEQ ID NO: 3100964 - RNA, 15 nt, Molluscum contagiosum virus
ggacuuccgcgcgcu

SEQ ID NO: 3100965 - RNA, 13 nt, Molluscum contagiosum virus
ggacuucuugcgc

SEQ ID NO: 3100966 - RNA, 19 nt, Molluscum contagiosum virus
gcuagagaaccugugcgcg

SEQ ID NO: 3100967 - RNA, 13 nt, Molluscum contagiosum virus
gcuagagugcgcg

SEQ ID NO: 3100968 - RNA, 18 nt, Molluscum contagiosum virus
gcuagcaggcgucgcgca

SEQ ID NO: 3100969 - RNA, 14 nt, Molluscum contagiosum virus
gcucaagaucucgc

SEQ ID NO: 3100970 - RNA, 18 nt, Molluscum contagiosum virus
gcucaaggacuaccagcu

SEQ ID NO: 3100971 - RNA, 14 nt, Molluscum contagiosum virus
gcucaagugcgucg

SEQ ID NO: 3100972 - RNA, 22 nt, Molluscum contagiosum virus
gcucacccugcacgcuacggcu

SEQ ID NO: 3100973 - RNA, 16 nt, Molluscum contagiosum virus
gcucaguugcgacgga

SEQ ID NO: 3100974 - RNA, 21 nt, Molluscum contagiosum virus
gcucauagcccaugcgcagug

SEQ ID NO: 3100975 - RNA, 23 nt, Molluscum contagiosum virus
gcucaucaccgacacgcgcccgc

SEQ ID NO: 3100976 - RNA, 17 nt, Molluscum contagiosum virus
gcucacgcugcccgcgc

SEQ ID NO: 3100977 - RNA, 21 nt, Molluscum contagiosum virus
gcucacggacucgccgcgcgc

SEQ ID NO: 3100978 - RNA, 17 nt, Molluscum contagiosum virus
gcuccagagccgcgugc

SEQ ID NO: 3100979 - RNA, 19 nt, Molluscum contagiosum virus
gcuccagcauggcgccaca

SEQ ID NO: 3100980 - RNA, 12 nt, Molluscum contagiosum virus
gcucaugcgcgg

SEQ ID NO: 3100981 - RNA, 18 nt, Molluscum contagiosum virus
gcucauggacaugcucga

SEQ ID NO: 3100982 - RNA, 14 nt, Molluscum contagiosum virus
gcuccccgccagca

SEQ ID NO: 3100983 - RNA, 14 nt, Molluscum contagiosum virus
gcuccccgcgcgca

SEQ ID NO: 3100984 - RNA, 17 nt, Molluscum contagiosum virus
gcucccgucgagcacga

SEQ ID NO: 3100985 - RNA, 18 nt, Molluscum contagiosum virus
ggaccucaaggaggcgug

SEQ ID NO: 3100986 - RNA, 20 nt, Molluscum contagiosum virus
ggaccucaaggaggcgugcg

SEQ ID NO: 3100987 - RNA, 14 nt, Molluscum contagiosum virus
ggaccucgcgcgcc

SEQ ID NO: 3100988 - RNA, 14 nt, Molluscum contagiosum virus
ggaccugcgccagc

SEQ ID NO: 3100989 - RNA, 19 nt, Molluscum contagiosum virus
ggaccugcugguggugcug

SEQ ID NO: 3100990 - RNA, 13 nt, Molluscum contagiosum virus
gcuacguggcgcg

SEQ ID NO: 3100991 - RNA, 13 nt, Molluscum contagiosum virus
gcuacguuccgcg

SEQ ID NO: 3100992 - RNA, 16 nt, Molluscum contagiosum virus
gcuacguuccgcgcgg

SEQ ID NO: 3100993 - RNA, 18 nt, Molluscum contagiosum virus
gcuacugcaacguggcgc

SEQ ID NO: 3100994 - RNA, 14 nt, Molluscum contagiosum virus
gcuacugcgcgcgu

SEQ ID NO: 3100995 - RNA, 13 nt, Molluscum contagiosum virus
gcuacuggccgcg

SEQ ID NO: 3100996 - RNA, 17 nt, Molluscum contagiosum virus
gcuacuuggacgcgauc

SEQ ID NO: 3100997 - RNA, 22 nt, Molluscum contagiosum virus
gcuagccgccgcugccgcgcgc

SEQ ID NO: 3100998 - RNA, 18 nt, Molluscum contagiosum virus
gcuagcgugugccgccgc

SEQ ID NO: 3100999 - RNA, 19 nt, Molluscum contagiosum virus
gcuagcuccacgugccgcu

SEQ ID NO: 3101000 - RNA, 15 nt, Molluscum contagiosum virus
gcuagcucugcgcgc

SEQ ID NO: 3101001 - RNA, 17 nt, Molluscum contagiosum virus
gcuagcucuggcagccc

SEQ ID NO: 3101002 - RNA, 19 nt, Molluscum contagiosum virus
gcuagcucuggcagcccgu

SEQ ID NO: 3101003 - RNA, 15 nt, Molluscum contagiosum virus
gcuaggggugccgcu

SEQ ID NO: 3101004 - RNA, 21 nt, Molluscum contagiosum virus
gcuaggggugccgcugcgcug

SEQ ID NO: 3101005 - RNA, 19 nt, Molluscum contagiosum virus
gcuaggguccaccugcgac

SEQ ID NO: 3101006 - RNA, 12 nt, Molluscum contagiosum virus
gcuaguccgcgu

SEQ ID NO: 3101007 - RNA, 23 nt, Molluscum contagiosum virus
gcuaguccgcguacagcgcgcgu

SEQ ID NO: 3101008 - RNA, 17 nt, Molluscum contagiosum virus
gcuagugccgagcucgc

SEQ ID NO: 3101009 - RNA, 15 nt, Molluscum contagiosum virus
gcuaguggcgcucgc

SEQ ID NO: 3101010 - RNA, 19 nt, Molluscum contagiosum virus
gcguaguaguagcgcucgc

SEQ ID NO: 3101011 - RNA, 22 nt, Molluscum contagiosum virus
gcgucaagacucgcccgcgcgc

SEQ ID NO: 3101012 - RNA, 21 nt, Molluscum contagiosum virus
gcgucaagaucaaccgcaagg

SEQ ID NO: 3101013 - RNA, 14 nt, Molluscum contagiosum virus
gcgucaccaccgcu

SEQ ID NO: 3101014 - RNA, 15 nt, Molluscum contagiosum virus
gcgucaugcgcgcgc

SEQ ID NO: 3101015 - RNA, 18 nt, Molluscum contagiosum virus
gcgucaugcgcgcgcgcu

SEQ ID NO: 3101016 - RNA, 15 nt, Molluscum contagiosum virus
gcguccacggcgcgc

SEQ ID NO: 3101017 - RNA, 14 nt, Molluscum contagiosum virus
gcuacgcgagcacu

SEQ ID NO: 3101018 - RNA, 15 nt, Molluscum contagiosum virus
gcuacgcgagcacug

SEQ ID NO: 3101019 - RNA, 17 nt, Molluscum contagiosum virus
gcuacgcgcucuacgcu

SEQ ID NO: 3101020 - RNA, 19 nt, Molluscum contagiosum virus
gcguacgugcacguggcgc

SEQ ID NO: 3101021 - RNA, 19 nt, Molluscum contagiosum virus
gcguaccaagccgugacgc

SEQ ID NO: 3101022 - RNA, 18 nt, Molluscum contagiosum virus
gcguacgcgccggggcgc

SEQ ID NO: 3101023 - RNA, 18 nt, Molluscum contagiosum virus
gcguacgcgucgcggagg

SEQ ID NO: 3101024 - RNA, 14 nt, Molluscum contagiosum virus
gcguacgcgugcgc

SEQ ID NO: 3101025 - RNA, 20 nt, Molluscum contagiosum virus
gcguacgcgugcgcuggcgc

SEQ ID NO: 3101026 - RNA, 21 nt, Molluscum contagiosum virus
gcguacucaacgcgauggcgc

SEQ ID NO: 3101027 - RNA, 16 nt, Molluscum contagiosum virus
gcguacuccguggugc

SEQ ID NO: 3101028 - RNA, 21 nt, Molluscum contagiosum virus
gcguagagcaauacguggcgc

SEQ ID NO: 3101029 - RNA, 15 nt, Molluscum contagiosum virus
gcguagcaugcucgu

SEQ ID NO: 3101030 - RNA, 13 nt, Molluscum contagiosum virus
gcguagccgccgc

SEQ ID NO: 3101031 - RNA, 21 nt, Molluscum contagiosum virus
gcguagcggacgaagcugugc

SEQ ID NO: 3101032 - RNA, 18 nt, Molluscum contagiosum virus
gcguagcuagcucugcgc

SEQ ID NO: 3101033 - RNA, 20 nt, Molluscum contagiosum virus
gcguagcuagcucugcgcgc

SEQ ID NO: 3101034 - RNA, 21 nt, Molluscum contagiosum virus
gcgguuguagcgguugaccag

SEQ ID NO: 3101035 - RNA, 14 nt, Molluscum contagiosum virus
gcguaacagcgcgc

SEQ ID NO: 3101036 - RNA, 20 nt, Molluscum contagiosum virus
gcguaaugcuggcgcguccg

SEQ ID NO: 3101037 - RNA, 20 nt, Molluscum contagiosum virus
gcguacacauggccgcgcgc

SEQ ID NO: 3101038 - RNA, 13 nt, Molluscum contagiosum virus
gcguacagcgcgc

SEQ ID NO: 3101039 - RNA, 20 nt, Molluscum contagiosum virus
gcguacagcgcgcgugccgc

SEQ ID NO: 3101040 - RNA, 21 nt, Molluscum contagiosum virus
gcguacaucccgcacgugggc

SEQ ID NO: 3101041 - RNA, 16 nt, Molluscum contagiosum virus
gcguacauccgcgagc

SEQ ID NO: 3101042 - RNA, 22 nt, Molluscum contagiosum virus
gcgguguaugcucgucgccggg

SEQ ID NO: 3101043 - RNA, 14 nt, Molluscum contagiosum virus
gcggccguggcugc

SEQ ID NO: 3101044 - RNA, 16 nt, Molluscum contagiosum virus
gcggugcgugcgggag

SEQ ID NO: 3101045 - RNA, 14 nt, Molluscum contagiosum virus
gcgguggcaggcgc

SEQ ID NO: 3101046 - RNA, 20 nt, Molluscum contagiosum virus
gcgguggccgcgccgggcgc

SEQ ID NO: 3101047 - RNA, 19 nt, Molluscum contagiosum virus
guacaauacaccuuucauu

SEQ ID NO: 3101048 - RNA, 23 nt, Molluscum contagiosum virus
guacaauacaccuuucauucgcu

SEQ ID NO: 3101049 - RNA, 22 nt, Molluscum contagiosum virus
guacaauacccgcuuccgcggc

SEQ ID NO: 3101050 - RNA, 19 nt, Molluscum contagiosum virus
guacacauggccgcgcgcu

SEQ ID NO: 3101051 - RNA, 14 nt, Molluscum contagiosum virus
guaacagcgcgcga

SEQ ID NO: 3101052 - RNA, 19 nt, Molluscum contagiosum virus
guaaccaugaagaugucgc

SEQ ID NO: 3101053 - RNA, 19 nt, Molluscum contagiosum virus
guaccaccguggaggagcc

SEQ ID NO: 3101054 - RNA, 22 nt, Molluscum contagiosum virus
guaccagcucgcgccgccgcgc

SEQ ID NO: 3101055 - RNA, 17 nt, Molluscum contagiosum virus
guacagcuccccgcgca

SEQ ID NO: 3101056 - RNA, 13 nt, Molluscum contagiosum virus
guacagugcgcgc

SEQ ID NO: 3101057 - RNA, 14 nt, Molluscum contagiosum virus
guacagugcgcgca

SEQ ID NO: 3101058 - RNA, 15 nt, Molluscum contagiosum virus
guacauccgcgagca

SEQ ID NO: 3101059 - RNA, 18 nt, Molluscum contagiosum virus
guacaucgacuacgcgcu

SEQ ID NO: 3101060 - RNA, 17 nt, Molluscum contagiosum virus
guaccgccgcggccgcg

SEQ ID NO: 3101061 - RNA, 12 nt, Molluscum contagiosum virus
guaccgcgcgca

SEQ ID NO: 3101062 - RNA, 14 nt, Molluscum contagiosum virus
guaccgugcgcgug

SEQ ID NO: 3101063 - RNA, 22 nt, Molluscum contagiosum virus
guaccugggcaggccgcccacg

SEQ ID NO: 3101064 - RNA, 16 nt, Molluscum contagiosum virus
guacgacgguuuccgc

SEQ ID NO: 3101065 - RNA, 15 nt, Molluscum contagiosum virus
guacgacgugcugcu

SEQ ID NO: 3101066 - RNA, 22 nt, Molluscum contagiosum virus
guacgagcagcugcugcgcacg

SEQ ID NO: 3101067 - RNA, 16 nt, Molluscum contagiosum virus
guacgcacgugccgug

SEQ ID NO: 3101068 - RNA, 20 nt, Molluscum contagiosum virus
gguugccaggcacacgcagu

SEQ ID NO: 3101069 - RNA, 22 nt, Molluscum contagiosum virus
gguugcccgccugccgcgagca

SEQ ID NO: 3101070 - RNA, 14 nt, Molluscum contagiosum virus
gguugccgcucgca

SEQ ID NO: 3101071 - RNA, 17 nt, Molluscum contagiosum virus
ggagcugcgcgagacgc

SEQ ID NO: 3101072 - RNA, 15 nt, Molluscum contagiosum virus
ggagcugcgcgcgcu

SEQ ID NO: 3101073 - RNA, 18 nt, Molluscum contagiosum virus
gguuccgagguagcucca

SEQ ID NO: 3101074 - RNA, 18 nt, Molluscum contagiosum virus
gguuccggugucagcccc

SEQ ID NO: 3101075 - RNA, 12 nt, Molluscum contagiosum virus
ggagccgcggca

SEQ ID NO: 3101076 - RNA, 17 nt, Molluscum contagiosum virus
ggagccucccccgcgca

SEQ ID NO: 3101077 - RNA, 22 nt, Molluscum contagiosum virus
ggagccaagcaacggcggcgca

SEQ ID NO: 3101078 - RNA, 22 nt, Molluscum contagiosum virus
ggagcccacguugccgcgcgcu

SEQ ID NO: 3101079 - RNA, 13 nt, Molluscum contagiosum virus
ggacuuuucgcgc

SEQ ID NO: 3101080 - RNA, 17 nt, Molluscum contagiosum virus
ggacuuuucgcgcgugc

SEQ ID NO: 3101081 - RNA, 15 nt, Molluscum contagiosum virus
ggagaacaugcucgc

SEQ ID NO: 3101082 - RNA, 20 nt, Molluscum contagiosum virus
ggagaacaugcucgccagca

SEQ ID NO: 3101083 - RNA, 13 nt, Molluscum contagiosum virus
ggagacguagagc

SEQ ID NO: 3101084 - RNA, 21 nt, Molluscum contagiosum virus
ggagcgcaaaugccgagcgca

SEQ ID NO: 3101085 - RNA, 13 nt, Molluscum contagiosum virus
ggagcgcgcacgg

SEQ ID NO: 3101086 - RNA, 14 nt, Molluscum contagiosum virus
ggagcgcgcgcagg

SEQ ID NO: 3101087 - RNA, 18 nt, Molluscum contagiosum virus
ggagcgcuucuagcucgc

SEQ ID NO: 3101088 - RNA, 23 nt, Molluscum contagiosum virus
ggagcgcuucuagcucgcgcgcg

SEQ ID NO: 3101089 - RNA, 13 nt, Molluscum contagiosum virus
ggagcuagcgcgc

SEQ ID NO: 3101090 - RNA, 12 nt, Molluscum contagiosum virus
gucgagagcgcg

SEQ ID NO: 3101091 - RNA, 18 nt, Molluscum contagiosum virus
gucgagcaccugucgcgc

SEQ ID NO: 3101092 - RNA, 15 nt, Molluscum contagiosum virus
gucgagcgcgccgcg

SEQ ID NO: 3101093 - RNA, 16 nt, Molluscum contagiosum virus
gucgagcgcgccgcgc

SEQ ID NO: 3101094 - RNA, 19 nt, Molluscum contagiosum virus
gucgaggagggcguccgua

SEQ ID NO: 3101095 - RNA, 19 nt, Molluscum contagiosum virus
gucgaggccuucgcgcccg

SEQ ID NO: 3101096 - RNA, 15 nt, Molluscum contagiosum virus
gucgaguucgcucgc

SEQ ID NO: 3101097 - RNA, 22 nt, Molluscum contagiosum virus
gucgcaaccccgcgcugcgcgg

SEQ ID NO: 3101098 - RNA, 12 nt, Molluscum contagiosum virus
gucgacggcgcc

SEQ ID NO: 3101099 - RNA, 21 nt, Molluscum contagiosum virus
gucgaccuggaagccgccagc

SEQ ID NO: 3101100 - RNA, 22 nt, Molluscum contagiosum virus
gucgcauccgaccucuuuccgc

SEQ ID NO: 3101101 - RNA, 19 nt, Molluscum contagiosum virus
gucgcacaguucacggcgc

SEQ ID NO: 3101102 - RNA, 20 nt, Molluscum contagiosum virus
gucgcacaguucacggcgcu

SEQ ID NO: 3101103 - RNA, 12 nt, Molluscum contagiosum virus
gucgccgucguc

SEQ ID NO: 3101104 - RNA, 14 nt, Molluscum contagiosum virus
gucgcccgccgagc

SEQ ID NO: 3101105 - RNA, 21 nt, Molluscum contagiosum virus
gucgcaguacccgagcugugc

SEQ ID NO: 3101106 - RNA, 18 nt, Molluscum contagiosum virus
guccuguccgcggacgcg

SEQ ID NO: 3101107 - RNA, 14 nt, Molluscum contagiosum virus
guccugcuagcgug

SEQ ID NO: 3101108 - RNA, 20 nt, Molluscum contagiosum virus
guccugcgcgguggcuuacg

SEQ ID NO: 3101109 - RNA, 21 nt, Molluscum contagiosum virus
guacgcgccggggcgcgcgcu

SEQ ID NO: 3101110 - RNA, 13 nt, Molluscum contagiosum virus
guacgcgugcagg

SEQ ID NO: 3101111 - RNA, 19 nt, Molluscum contagiosum virus
guacgcgugcgcuggcgcg

SEQ ID NO: 3101112 - RNA, 22 nt, Molluscum contagiosum virus
guacgcucuccaugcgcgcgcg

SEQ ID NO: 3101113 - RNA, 15 nt, Molluscum contagiosum virus
guccggcgcucgccc

SEQ ID NO: 3101114 - RNA, 15 nt, Molluscum contagiosum virus
guccggcgcuugccc

SEQ ID NO: 3101115 - RNA, 22 nt, Molluscum contagiosum virus
guccgcucgugccacugccgcc

SEQ ID NO: 3101116 - RNA, 16 nt, Molluscum contagiosum virus
agggcucgccaugcug

SEQ ID NO: 3101117 - RNA, 20 nt, Molluscum contagiosum virus
agggcuuccccccacggcag

SEQ ID NO: 3101118 - RNA, 16 nt, Molluscum contagiosum virus
aggggcaagcucgcgc

SEQ ID NO: 3101119 - RNA, 20 nt, Molluscum contagiosum virus
aggggccguucgcgcgccag

SEQ ID NO: 3101120 - RNA, 19 nt, Molluscum contagiosum virus
aggggugauggcggugagc

SEQ ID NO: 3101121 - RNA, 22 nt, Molluscum contagiosum virus
agggguguuuccuugccuucuc

SEQ ID NO: 3101122 - RNA, 15 nt, Molluscum contagiosum virus
agggucacgcgcaca

SEQ ID NO: 3101123 - RNA, 15 nt, Molluscum contagiosum virus
agggcgggcacgugc

SEQ ID NO: 3101124 - RNA, 15 nt, Molluscum contagiosum virus
aggucacgacgagcg

SEQ ID NO: 3101125 - RNA, 16 nt, Molluscum contagiosum virus
aggucacgacgagcga

SEQ ID NO: 3101126 - RNA, 22 nt, Molluscum contagiosum virus
aggucaucgacgagcacgagca

SEQ ID NO: 3101127 - RNA, 13 nt, Molluscum contagiosum virus
aggucgagcgcgc

SEQ ID NO: 3101128 - RNA, 18 nt, Molluscum contagiosum virus
aggucgagcgcgccgcgc

SEQ ID NO: 3101129 - RNA, 14 nt, Molluscum contagiosum virus
agcucuucgacagc

SEQ ID NO: 3101130 - RNA, 20 nt, Molluscum contagiosum virus
agcucuucgacagcgugcgc

SEQ ID NO: 3101131 - RNA, 16 nt, Molluscum contagiosum virus
agcucuucguggccaa

SEQ ID NO: 3101132 - RNA, 14 nt, Molluscum contagiosum virus
agcugcaccggcgc

SEQ ID NO: 3101133 - RNA, 17 nt, Molluscum contagiosum virus
agcugcaccggcgcgag

SEQ ID NO: 3101134 - RNA, 14 nt, Molluscum contagiosum virus
agcugcacgugcag

SEQ ID NO: 3101135 - RNA, 15 nt, Molluscum contagiosum virus
agcugcacgugcagc

SEQ ID NO: 3101136 - RNA, 21 nt, Molluscum contagiosum virus
agcugcccuuuagcguggcgc

SEQ ID NO: 3101137 - RNA, 15 nt, Molluscum contagiosum virus
agcugcagagcgugc

SEQ ID NO: 3101138 - RNA, 19 nt, Molluscum contagiosum virus
agcugccauggcagcucgg

SEQ ID NO: 3101139 - RNA, 17 nt, Molluscum contagiosum virus
agcugcgcuugcgcgug

SEQ ID NO: 3101140 - RNA, 15 nt, Molluscum contagiosum virus
agcugcuagcggcag

SEQ ID NO: 3101141 - RNA, 14 nt, Molluscum contagiosum virus
agcugcugcgcgag

SEQ ID NO: 3101142 - RNA, 22 nt, Molluscum contagiosum virus
agcucuccgagacacgcgagcg

SEQ ID NO: 3101143 - RNA, 15 nt, Molluscum contagiosum virus
agcucucgcgcgcag

SEQ ID NO: 3101144 - RNA, 12 nt, Molluscum contagiosum virus
agcucguggaca

SEQ ID NO: 3101145 - RNA, 23 nt, Molluscum contagiosum virus
agcucccgcgccacgagcgccgc

SEQ ID NO: 3101146 - RNA, 21 nt, Molluscum contagiosum virus
agcuccgcgacgaacucgaca

SEQ ID NO: 3101147 - RNA, 14 nt, Molluscum contagiosum virus
agcuccggcugcuc

SEQ ID NO: 3101148 - RNA, 14 nt, Molluscum contagiosum virus
agcuccuagcgcgc

SEQ ID NO: 3101149 - RNA, 23 nt, Molluscum contagiosum virus
agcucgcagccuccgugcgccag

SEQ ID NO: 3101150 - RNA, 17 nt, Molluscum contagiosum virus
agcucgccaaagcgcgc

SEQ ID NO: 3101151 - RNA, 22 nt, Molluscum contagiosum virus
agcucgccaaagcgcgccuucc

SEQ ID NO: 3101152 - RNA, 18 nt, Molluscum contagiosum virus
agcucgccaugugcgaag

SEQ ID NO: 3101153 - RNA, 22 nt, Molluscum contagiosum virus
agcucgccgcgcgccgcugcuc

SEQ ID NO: 3101154 - RNA, 20 nt, Molluscum contagiosum virus
agcucgccuccuugcccgag

SEQ ID NO: 3101155 - RNA, 16 nt, Molluscum contagiosum virus
agcucgcgcgcaagaa

SEQ ID NO: 3101156 - RNA, 14 nt, Molluscum contagiosum virus
agcucgcgcgcgag

SEQ ID NO: 3101157 - RNA, 23 nt, Molluscum contagiosum virus
agcucgcguccacgaugcgcucg

SEQ ID NO: 3101158 - RNA, 17 nt, Molluscum contagiosum virus
agcuagcucugcgcgcg

SEQ ID NO: 3101159 - RNA, 14 nt, Molluscum contagiosum virus
agcucaaucucgcc

SEQ ID NO: 3101160 - RNA, 17 nt, Molluscum contagiosum virus
agcucaaucucgcccag

SEQ ID NO: 3101161 - RNA, 18 nt, Molluscum contagiosum virus
agcuaaaagagcugcugc

SEQ ID NO: 3101162 - RNA, 16 nt, Molluscum contagiosum virus
agcuacgaucgcgcuc

SEQ ID NO: 3101163 - RNA, 14 nt, Molluscum contagiosum virus
agcgugcagacgac

SEQ ID NO: 3101164 - RNA, 20 nt, Molluscum contagiosum virus
agcgugguguucgccggcau

SEQ ID NO: 3101165 - RNA, 19 nt, Molluscum contagiosum virus
agcgugucagcagcgcgag

SEQ ID NO: 3101166 - RNA, 14 nt, Molluscum contagiosum virus
agcgugucgaagcg

SEQ ID NO: 3101167 - RNA, 19 nt, Molluscum contagiosum virus
agcgugucgaagcgcgcag

SEQ ID NO: 3101168 - RNA, 14 nt, Molluscum contagiosum virus
aggugcacgcgcug

SEQ ID NO: 3101169 - RNA, 18 nt, Molluscum contagiosum virus
agguucguccgcucgugc

SEQ ID NO: 3101170 - RNA, 13 nt, Molluscum contagiosum virus
aggugcugggcga

SEQ ID NO: 3101171 - RNA, 18 nt, Molluscum contagiosum virus
agucacuucucggaagcg

SEQ ID NO: 3101172 - RNA, 12 nt, Molluscum contagiosum virus
agucagcggcgg

SEQ ID NO: 3101173 - RNA, 13 nt, Molluscum contagiosum virus
agguugcgcagag

SEQ ID NO: 3101174 - RNA, 22 nt, Molluscum contagiosum virus
aguacgagcgcguaagaccaug

SEQ ID NO: 3101175 - RNA, 21 nt, Molluscum contagiosum virus
aguacgcucuccaugcgcgcg

SEQ ID NO: 3101176 - RNA, 13 nt, Molluscum contagiosum virus
aguccugggcgag

SEQ ID NO: 3101177 - RNA, 17 nt, Molluscum contagiosum virus
agucgagcacgcgcgag

SEQ ID NO: 3101178 - RNA, 22 nt, Molluscum contagiosum virus
agucgcaguacccgagcugugc

SEQ ID NO: 3101179 - RNA, 20 nt, Molluscum contagiosum virus
agucgcccugcccgcgcgag

SEQ ID NO: 3101180 - RNA, 23 nt, Molluscum contagiosum virus
aguccacggguaccgugcgcgug

SEQ ID NO: 3101181 - RNA, 23 nt, Molluscum contagiosum virus
aguccaucggugggcucgcgcuu

SEQ ID NO: 3101182 - RNA, 20 nt, Molluscum contagiosum virus
aguccgacccgugcugcuug

SEQ ID NO: 3101183 - RNA, 18 nt, Molluscum contagiosum virus
aguccgccucgagcacgc

SEQ ID NO: 3101184 - RNA, 22 nt, Molluscum contagiosum virus
agucguuugcucggggcugucg

SEQ ID NO: 3101185 - RNA, 12 nt, Molluscum contagiosum virus
agucugcgcagg

SEQ ID NO: 3101186 - RNA, 13 nt, Molluscum contagiosum virus
aucgcgcaggcgc

SEQ ID NO: 3101187 - RNA, 16 nt, Molluscum contagiosum virus
aucgcgcugcuggugc

SEQ ID NO: 3101188 - RNA, 18 nt, Molluscum contagiosum virus
aucgcggagcugcgcgcg

SEQ ID NO: 3101189 - RNA, 17 nt, Molluscum contagiosum virus
aucgugggcaucgaccc

SEQ ID NO: 3101190 - RNA, 16 nt, Molluscum contagiosum virus
aucggcacugcucacg

SEQ ID NO: 3101191 - RNA, 17 nt, Molluscum contagiosum virus
aucggagaagugcuccg

SEQ ID NO: 3101192 - RNA, 22 nt, Molluscum contagiosum virus
aucgcgucacguccucaagcgc

SEQ ID NO: 3101193 - RNA, 18 nt, Molluscum contagiosum virus
agccagucucgcgcuucc

SEQ ID NO: 3101194 - RNA, 24 nt, Molluscum contagiosum virus
agccucuggaaggagcugggcucg

SEQ ID NO: 3101195 - RNA, 17 nt, Molluscum contagiosum virus
agccugaggccgcggag

SEQ ID NO: 3101196 - RNA, 20 nt, Molluscum contagiosum virus
agccucgagcgccgugcagu

SEQ ID NO: 3101197 - RNA, 14 nt, Molluscum contagiosum virus
agccuagccauaca

SEQ ID NO: 3101198 - RNA, 21 nt, Molluscum contagiosum virus
agccguccgccucgagcacgc

SEQ ID NO: 3101199 - RNA, 21 nt, Molluscum contagiosum virus
agcgugacaaucucugcgccg

SEQ ID NO: 3101200 - RNA, 16 nt, Molluscum contagiosum virus
agcgucgcgcgccgug

SEQ ID NO: 3101201 - RNA, 18 nt, Molluscum contagiosum virus
agcgugcgcgggcacgcc

SEQ ID NO: 3101202 - RNA, 14 nt, Molluscum contagiosum virus
agcguggagcaccu

SEQ ID NO: 3101203 - RNA, 15 nt, Molluscum contagiosum virus
agcguggcgcgcgag

SEQ ID NO: 3101204 - RNA, 15 nt, Molluscum contagiosum virus
agcgagcgcccgugc

SEQ ID NO: 3101205 - RNA, 14 nt, Molluscum contagiosum virus
agcgagugcgcgug

SEQ ID NO: 3101206 - RNA, 15 nt, Molluscum contagiosum virus
agcgagugcgcgugc

SEQ ID NO: 3101207 - RNA, 16 nt, Molluscum contagiosum virus
agcgaguucgcacgcu

SEQ ID NO: 3101208 - RNA, 15 nt, Molluscum contagiosum virus
agcgcaaaugccgag

SEQ ID NO: 3101209 - RNA, 17 nt, Molluscum contagiosum virus
agcgcaugcgcgccgcg

SEQ ID NO: 3101210 - RNA, 23 nt, Molluscum contagiosum virus
agcgccacuagcaaggcgccgcg

SEQ ID NO: 3101211 - RNA, 22 nt, Molluscum contagiosum virus
agccgccgcuacuacggagcga

SEQ ID NO: 3101212 - RNA, 21 nt, Molluscum contagiosum virus
agccgccugccgcgcucgugc

SEQ ID NO: 3101213 - RNA, 13 nt, Molluscum contagiosum virus
agccgccuggccg

SEQ ID NO: 3101214 - RNA, 13 nt, Molluscum contagiosum virus
agccgcgaaagcg

SEQ ID NO: 3101215 - RNA, 23 nt, Molluscum contagiosum virus
agccgcucguccagcugcgcgag

SEQ ID NO: 3101216 - RNA, 18 nt, Molluscum contagiosum virus
agccgcugcgccgccagc

SEQ ID NO: 3101217 - RNA, 15 nt, Molluscum contagiosum virus
agccgcugcuccugc

SEQ ID NO: 3101218 - RNA, 18 nt, Molluscum contagiosum virus
agccgcuucgggcucagc

SEQ ID NO: 3101219 - RNA, 13 nt, Molluscum contagiosum virus
agccgcacggcgc

SEQ ID NO: 3101220 - RNA, 14 nt, Molluscum contagiosum virus
agccgcagccgcgc

SEQ ID NO: 3101221 - RNA, 20 nt, Molluscum contagiosum virus
agccgcccgcggacucgugc

SEQ ID NO: 3101222 - RNA, 18 nt, Molluscum contagiosum virus
agccccgcggacggacga

SEQ ID NO: 3101223 - RNA, 13 nt, Molluscum contagiosum virus
agccgagcgccgc

SEQ ID NO: 3101224 - RNA, 20 nt, Molluscum contagiosum virus
agcccauuaucgucacggcc

SEQ ID NO: 3101225 - RNA, 18 nt, Molluscum contagiosum virus
agccccagaaggucgugc

SEQ ID NO: 3101226 - RNA, 19 nt, Molluscum contagiosum virus
agcccgacgcgggcgcgca

SEQ ID NO: 3101227 - RNA, 13 nt, Molluscum contagiosum virus
agcccgagcgcgc

SEQ ID NO: 3101228 - RNA, 18 nt, Molluscum contagiosum virus
agcccgaguucgcggcgc

SEQ ID NO: 3101229 - RNA, 21 nt, Molluscum contagiosum virus
agcccgcaggccgggcaccca

SEQ ID NO: 3101230 - RNA, 14 nt, Molluscum contagiosum virus
agcccgcgcgcgag

SEQ ID NO: 3101231 - RNA, 17 nt, Molluscum contagiosum virus
agcccgcggcgcgcagc

SEQ ID NO: 3101232 - RNA, 14 nt, Molluscum contagiosum virus
agcccgcggugcgc

SEQ ID NO: 3101233 - RNA, 20 nt, Molluscum contagiosum virus
agcccggaagcuugcucagc

SEQ ID NO: 3101234 - RNA, 15 nt, Molluscum contagiosum virus
agcccgggcccgugc

SEQ ID NO: 3101235 - RNA, 22 nt, Molluscum contagiosum virus
agcccgugcuggagggcacgcu

SEQ ID NO: 3101236 - RNA, 22 nt, Molluscum contagiosum virus
cauggcucccgcacgcaccgcg

SEQ ID NO: 3101237 - RNA, 16 nt, Molluscum contagiosum virus
cauggaaagcuucucg

SEQ ID NO: 3101238 - RNA, 13 nt, Molluscum contagiosum virus
cauggccgcgucc

SEQ ID NO: 3101239 - RNA, 14 nt, Molluscum contagiosum virus
cauggccgcguccg

SEQ ID NO: 3101240 - RNA, 13 nt, Molluscum contagiosum virus
caugcccacgcgc

SEQ ID NO: 3101241 - RNA, 19 nt, Molluscum contagiosum virus
caugccgaguguugucguc

SEQ ID NO: 3101242 - RNA, 16 nt, Molluscum contagiosum virus
caugccgcgcugcucc

SEQ ID NO: 3101243 - RNA, 22 nt, Molluscum contagiosum virus
caugccggggaugaacgcgcug

SEQ ID NO: 3101244 - RNA, 22 nt, Molluscum contagiosum virus
caugccuccguuucccgcggcg

SEQ ID NO: 3101245 - RNA, 15 nt, Molluscum contagiosum virus
cauggagcgcccgcu

SEQ ID NO: 3101246 - RNA, 20 nt, Molluscum contagiosum virus
cauggagcgcccgcugcucu

SEQ ID NO: 3101247 - RNA, 22 nt, Molluscum contagiosum virus
cauggaggacggcgcgggcgcg

SEQ ID NO: 3101248 - RNA, 20 nt, Molluscum contagiosum virus
cauggccacgcccgggcccg

SEQ ID NO: 3101249 - RNA, 16 nt, Molluscum contagiosum virus
caucuacugcgacauc

SEQ ID NO: 3101250 - RNA, 19 nt, Molluscum contagiosum virus
cauacgcagaggcgcgucc

SEQ ID NO: 3101251 - RNA, 14 nt, Molluscum contagiosum virus
caguuccgaucgcg

SEQ ID NO: 3101252 - RNA, 15 nt, Molluscum contagiosum virus
caguucgagcugcug

SEQ ID NO: 3101253 - RNA, 16 nt, Molluscum contagiosum virus
caguucgagcugcugc

SEQ ID NO: 3101254 - RNA, 17 nt, Molluscum contagiosum virus
caguucggccgcacgug

SEQ ID NO: 3101255 - RNA, 14 nt, Molluscum contagiosum virus
cagugccagcagcc

SEQ ID NO: 3101256 - RNA, 22 nt, Molluscum contagiosum virus
cagugccgacgugugccgcucg

SEQ ID NO: 3101257 - RNA, 14 nt, Molluscum contagiosum virus
cagugccgccgcgc

SEQ ID NO: 3101258 - RNA, 14 nt, Molluscum contagiosum virus
cagugccgcucgcu

SEQ ID NO: 3101259 - RNA, 21 nt, Molluscum contagiosum virus
cagugcgagaucgacugcgcc

SEQ ID NO: 3101260 - RNA, 15 nt, Molluscum contagiosum virus
cagugcuugagcauc

SEQ ID NO: 3101261 - RNA, 20 nt, Molluscum contagiosum virus
cagugugccguucacgcaca

SEQ ID NO: 3101262 - RNA, 17 nt, Molluscum contagiosum virus
caugcugcccgcgcgcg

SEQ ID NO: 3101263 - RNA, 20 nt, Molluscum contagiosum virus
caugcugcccgcgcgcgacu

SEQ ID NO: 3101264 - RNA, 17 nt, Molluscum contagiosum virus
caugcugcgcgagcgcg

SEQ ID NO: 3101265 - RNA, 21 nt, Molluscum contagiosum virus
caugcugcgcgagcgcgcgcu

SEQ ID NO: 3101266 - RNA, 16 nt, Molluscum contagiosum virus
caugcuggcgggcgcg

SEQ ID NO: 3101267 - RNA, 20 nt, Molluscum contagiosum virus
caugcugugcggcacgccug

SEQ ID NO: 3101268 - RNA, 16 nt, Molluscum contagiosum virus
caugcgacugccagcc

SEQ ID NO: 3101269 - RNA, 18 nt, Molluscum contagiosum virus
caugcgcaagcagcucgg

SEQ ID NO: 3101270 - RNA, 19 nt, Molluscum contagiosum virus
caugcgcaagcagcucggc

SEQ ID NO: 3101271 - RNA, 14 nt, Molluscum contagiosum virus
caugcgcccucacg

SEQ ID NO: 3101272 - RNA, 14 nt, Molluscum contagiosum virus
caugcgcgccgcgc

SEQ ID NO: 3101273 - RNA, 18 nt, Molluscum contagiosum virus
caugcgcgccgcgcugcu

SEQ ID NO: 3101274 - RNA, 19 nt, Molluscum contagiosum virus
caugcgcgccgcgcugcug

SEQ ID NO: 3101275 - RNA, 16 nt, Molluscum contagiosum virus
caugcgcgcgcagcag

SEQ ID NO: 3101276 - RNA, 16 nt, Molluscum contagiosum virus
caugcgcgcgcgcucg

SEQ ID NO: 3101277 - RNA, 18 nt, Molluscum contagiosum virus
caugcgcuugcggucgcg

SEQ ID NO: 3101278 - RNA, 20 nt, Molluscum contagiosum virus
caugcggcaggcgcugcgcg

SEQ ID NO: 3101279 - RNA, 16 nt, Molluscum contagiosum virus
caugcucgcgcucucg

SEQ ID NO: 3101280 - RNA, 19 nt, Molluscum contagiosum virus
caugcacacucacgcgucc

SEQ ID NO: 3101281 - RNA, 16 nt, Molluscum contagiosum virus
caugcacagcugcucg

SEQ ID NO: 3101282 - RNA, 18 nt, Molluscum contagiosum virus
caugaagaugucgccgcg

SEQ ID NO: 3101283 - RNA, 17 nt, Molluscum contagiosum virus
caucugcgagcgcgaau

SEQ ID NO: 3101284 - RNA, 16 nt, Molluscum contagiosum virus
caucuccacgucggcc

SEQ ID NO: 3101285 - RNA, 17 nt, Molluscum contagiosum virus
caucucgauggcgccgu

SEQ ID NO: 3101286 - RNA, 15 nt, Molluscum contagiosum virus
caugacgacgccgga

SEQ ID NO: 3101287 - RNA, 19 nt, Molluscum contagiosum virus
aucugcgacacgcuggcga

SEQ ID NO: 3101288 - RNA, 19 nt, Molluscum contagiosum virus
aucugcgccuccgguacgu

SEQ ID NO: 3101289 - RNA, 20 nt, Molluscum contagiosum virus
aucucgcacacugcagcacg

SEQ ID NO: 3101290 - RNA, 12 nt, Molluscum contagiosum virus
aucucugcgccg

SEQ ID NO: 3101291 - RNA, 18 nt, Molluscum contagiosum virus
augaguaccgcgggcgca

SEQ ID NO: 3101292 - RNA, 17 nt, Molluscum contagiosum virus
augaagcucucgcgcgc

SEQ ID NO: 3101293 - RNA, 14 nt, Molluscum contagiosum virus
augaaggcgcggcu

SEQ ID NO: 3101294 - RNA, 17 nt, Molluscum contagiosum virus
aucugcaacucgcgcug

SEQ ID NO: 3101295 - RNA, 12 nt, Molluscum contagiosum virus
augagcagcacc

SEQ ID NO: 3101296 - RNA, 17 nt, Molluscum contagiosum virus
augagccagucucgcgc

SEQ ID NO: 3101297 - RNA, 21 nt, Molluscum contagiosum virus
augacacgcgugucugcgcuc

SEQ ID NO: 3101298 - RNA, 21 nt, Molluscum contagiosum virus
cagcggacguggucgcgcgcg

SEQ ID NO: 3101299 - RNA, 23 nt, Molluscum contagiosum virus
cagcggacguggucgcgcgcgcu

SEQ ID NO: 3101300 - RNA, 13 nt, Molluscum contagiosum virus
augccacgcagcu

SEQ ID NO: 3101301 - RNA, 20 nt, Molluscum contagiosum virus
cagcgccgccaccucggcgu

SEQ ID NO: 3101302 - RNA, 14 nt, Molluscum contagiosum virus
cagcgccgcgcggu

SEQ ID NO: 3101303 - RNA, 15 nt, Molluscum contagiosum virus
cagcgccugcuugcg

SEQ ID NO: 3101304 - RNA, 18 nt, Molluscum contagiosum virus
cagcgccugcuugcgcac

SEQ ID NO: 3101305 - RNA, 22 nt, Molluscum contagiosum virus
cagcgcgacuagccugugcccu

SEQ ID NO: 3101306 - RNA, 20 nt, Molluscum contagiosum virus
cagcgcgcccaccagcagcc

SEQ ID NO: 3101307 - RNA, 12 nt, Molluscum contagiosum virus
cagcgcgcgcac

SEQ ID NO: 3101308 - RNA, 22 nt, Molluscum contagiosum virus
cagcgcgcgcagcaccgcggcg

SEQ ID NO: 3101309 - RNA, 13 nt, Molluscum contagiosum virus
cagcgcgcggaag

SEQ ID NO: 3101310 - RNA, 21 nt, Molluscum contagiosum virus
cagcgcgcggagaucgccgcg

SEQ ID NO: 3101311 - RNA, 12 nt, Molluscum contagiosum virus
cagcgcgcggcg

SEQ ID NO: 3101312 - RNA, 20 nt, Molluscum contagiosum virus
cagcgcgcucgaggcgccgu

SEQ ID NO: 3101313 - RNA, 21 nt, Molluscum contagiosum virus
cagcgcccgcguacacgugca

SEQ ID NO: 3101314 - RNA, 16 nt, Molluscum contagiosum virus
cagcgccagccugcug

SEQ ID NO: 3101315 - RNA, 20 nt, Molluscum contagiosum virus
cagcgccagccugcuggcac

SEQ ID NO: 3101316 - RNA, 10 nt, Molluscum contagiosum virus
cagcgcagca

SEQ ID NO: 3101317 - RNA, 14 nt, Molluscum contagiosum virus
cagcgcagcagcgc

SEQ ID NO: 3101318 - RNA, 18 nt, Molluscum contagiosum virus
cagcgcagcagcgcgacu

SEQ ID NO: 3101319 - RNA, 23 nt, Molluscum contagiosum virus
augcacacacucgcgcguccaca

SEQ ID NO: 3101320 - RNA, 17 nt, Molluscum contagiosum virus
augccgccgcguacgcg

SEQ ID NO: 3101321 - RNA, 16 nt, Molluscum contagiosum virus
augccgcgugcucugc

SEQ ID NO: 3101322 - RNA, 19 nt, Molluscum contagiosum virus
cagcgauugcccgcgcgcg

SEQ ID NO: 3101323 - RNA, 24 nt, Molluscum contagiosum virus
cagcgauugcccgcgcgcggacag

SEQ ID NO: 3101324 - RNA, 13 nt, Molluscum contagiosum virus
cagucccagcacc

SEQ ID NO: 3101325 - RNA, 17 nt, Molluscum contagiosum virus
cagucccagcaccgcgc

SEQ ID NO: 3101326 - RNA, 21 nt, Molluscum contagiosum virus
cagucccagcaccgcgccgcg

SEQ ID NO: 3101327 - RNA, 14 nt, Molluscum contagiosum virus
cagucgucgccgau

SEQ ID NO: 3101328 - RNA, 14 nt, Molluscum contagiosum virus
cagucuccacgcgu

SEQ ID NO: 3101329 - RNA, 12 nt, Molluscum contagiosum virus
cagucucgcgcu

SEQ ID NO: 3101330 - RNA, 21 nt, Molluscum contagiosum virus
caguaggacauguccggcccg

SEQ ID NO: 3101331 - RNA, 15 nt, Molluscum contagiosum virus
caguaccugcugccg

SEQ ID NO: 3101332 - RNA, 16 nt, Molluscum contagiosum virus
caguaccaguaccugc

SEQ ID NO: 3101333 - RNA, 14 nt, Molluscum contagiosum virus
caggucggccagca

SEQ ID NO: 3101334 - RNA, 17 nt, Molluscum contagiosum virus
cagguggccgcgcgcgc

SEQ ID NO: 3101335 - RNA, 20 nt, Molluscum contagiosum virus
cagguggccgcgcgcgcacg

SEQ ID NO: 3101336 - RNA, 22 nt, Molluscum contagiosum virus
cagguagagcaacaugcugagu

SEQ ID NO: 3101337 - RNA, 20 nt, Molluscum contagiosum virus
cagguagugguccaccagcu

SEQ ID NO: 3101338 - RNA, 22 nt, Molluscum contagiosum virus
caggucaacuccgagcgcgcgc

SEQ ID NO: 3101339 - RNA, 23 nt, Molluscum contagiosum virus
caggucaacuccgagcgcgcgcg

SEQ ID NO: 3101340 - RNA, 17 nt, Molluscum contagiosum virus
caggucaucgacgagca

SEQ ID NO: 3101341 - RNA, 14 nt, Molluscum contagiosum virus
cagcggcgccgcag

SEQ ID NO: 3101342 - RNA, 13 nt, Molluscum contagiosum virus
cagcggcgcgugc

SEQ ID NO: 3101343 - RNA, 16 nt, Molluscum contagiosum virus
cagcggcgcgugcucc

SEQ ID NO: 3101344 - RNA, 19 nt, Molluscum contagiosum virus
cagcggcaaaggcccgcga

SEQ ID NO: 3101345 - RNA, 20 nt, Molluscum contagiosum virus
cagcggcaaaggcccgcgag

SEQ ID NO: 3101346 - RNA, 16 nt, Molluscum contagiosum virus
cagcggcacugcgcgc

SEQ ID NO: 3101347 - RNA, 22 nt, Molluscum contagiosum virus
cagcggcuuguagucgcccccg

SEQ ID NO: 3101348 - RNA, 18 nt, Molluscum contagiosum virus
cagcggcgugcugcagcc

SEQ ID NO: 3101349 - RNA, 18 nt, Molluscum contagiosum virus
cagcggcugcccgcggag

SEQ ID NO: 3101350 - RNA, 16 nt, Molluscum contagiosum virus
cagcgcguccaugcug

SEQ ID NO: 3101351 - RNA, 21 nt, Molluscum contagiosum virus
cagcgugacaaucucugcgcc

SEQ ID NO: 3101352 - RNA, 16 nt, Molluscum contagiosum virus
cagcgugccgcggcac

SEQ ID NO: 3101353 - RNA, 23 nt, Molluscum contagiosum virus
cagcgugcgcgggcacgccgcag

SEQ ID NO: 3101354 - RNA, 14 nt, Molluscum contagiosum virus
cagcguuccaggaa

SEQ ID NO: 3101355 - RNA, 22 nt, Molluscum contagiosum virus
cagcgguggucuccgcgggcag

SEQ ID NO: 3101356 - RNA, 20 nt, Molluscum contagiosum virus
cagcguacggcccgaaggcc

SEQ ID NO: 3101357 - RNA, 24 nt, Molluscum contagiosum virus
cagcguagcggacgaagcugugca

SEQ ID NO: 3101358 - RNA, 18 nt, Molluscum contagiosum virus
cagcgucgcgcgccgugc

SEQ ID NO: 3101359 - RNA, 13 nt, Molluscum contagiosum virus
cagcgucgcggag

SEQ ID NO: 3101360 - RNA, 17 nt, Molluscum contagiosum virus
cagcgucgcggagcgcg

SEQ ID NO: 3101361 - RNA, 17 nt, Molluscum contagiosum virus
cggcaggcgcugcgcgg

SEQ ID NO: 3101362 - RNA, 20 nt, Molluscum contagiosum virus
cggcaggcgcugcgcggcgc

SEQ ID NO: 3101363 - RNA, 21 nt, Molluscum contagiosum virus
cggcacacaugcuagcgggca

SEQ ID NO: 3101364 - RNA, 15 nt, Molluscum contagiosum virus
cggcaccacgugcgc

SEQ ID NO: 3101365 - RNA, 17 nt, Molluscum contagiosum virus
cggcagcgucgcggagc

SEQ ID NO: 3101366 - RNA, 22 nt, Molluscum contagiosum virus
cggcagcgucgcggagcgcgca

SEQ ID NO: 3101367 - RNA, 17 nt, Molluscum contagiosum virus
cggcagcuaccgcgcgc

SEQ ID NO: 3101368 - RNA, 18 nt, Molluscum contagiosum virus
cggcagcuaccgcgcgcg

SEQ ID NO: 3101369 - RNA, 17 nt, Molluscum contagiosum virus
cggcagcucugcagcgc

SEQ ID NO: 3101370 - RNA, 20 nt, Molluscum contagiosum virus
cggcagcucugcagcgccgc

SEQ ID NO: 3101371 - RNA, 21 nt, Molluscum contagiosum virus
cggcagcucugcagcgccgcg

SEQ ID NO: 3101372 - RNA, 19 nt, Molluscum contagiosum virus
cggcagcuggagcugccgc

SEQ ID NO: 3101373 - RNA, 16 nt, Molluscum contagiosum virus
cggcaggaagcuggcg

SEQ ID NO: 3101374 - RNA, 12 nt, Molluscum contagiosum virus
cggcacgcgagc

SEQ ID NO: 3101375 - RNA, 17 nt, Molluscum contagiosum virus
cggcacgcugagcaagc

SEQ ID NO: 3101376 - RNA, 17 nt, Molluscum contagiosum virus
cggcacgcugcguuucc

SEQ ID NO: 3101377 - RNA, 22 nt, Molluscum contagiosum virus
cggcacggacccgggcgcggca

SEQ ID NO: 3101378 - RNA, 16 nt, Molluscum contagiosum virus
cggcacgggcacgcgc

SEQ ID NO: 3101379 - RNA, 19 nt, Molluscum contagiosum virus
cggcacgggcacgcgcgcg

SEQ ID NO: 3101380 - RNA, 13 nt, Molluscum contagiosum virus
cggcacgucgucc

SEQ ID NO: 3101381 - RNA, 21 nt, Molluscum contagiosum virus
cggcacgugcguacgcggcgc

SEQ ID NO: 3101382 - RNA, 15 nt, Molluscum contagiosum virus
cggcacucgcguccg

SEQ ID NO: 3101383 - RNA, 13 nt, Molluscum contagiosum virus
cggcacugcgcgc

SEQ ID NO: 3101384 - RNA, 13 nt, Molluscum contagiosum virus
cggcacugcuagc

SEQ ID NO: 3101385 - RNA, 15 nt, Molluscum contagiosum virus
cggcacugcucacgg

SEQ ID NO: 3101386 - RNA, 14 nt, Molluscum contagiosum virus
cggcacugcuggcg

SEQ ID NO: 3101387 - RNA, 15 nt, Molluscum contagiosum virus
cggcacugcuggcgc

SEQ ID NO: 3101388 - RNA, 13 nt, Molluscum contagiosum virus
cggcacccgccag

SEQ ID NO: 3101389 - RNA, 13 nt, Molluscum contagiosum virus
cggcacccgccgc

SEQ ID NO: 3101390 - RNA, 18 nt, Molluscum contagiosum virus
cggcacccgccgcggugc

SEQ ID NO: 3101391 - RNA, 14 nt, Molluscum contagiosum virus
cggcacccgugcgc

SEQ ID NO: 3101392 - RNA, 16 nt, Molluscum contagiosum virus
cggcacccgugcgcgc

SEQ ID NO: 3101393 - RNA, 19 nt, Molluscum contagiosum virus
cggcacccgugcgcgcgcu

SEQ ID NO: 3101394 - RNA, 13 nt, Molluscum contagiosum virus
cggcaccgcgccg

SEQ ID NO: 3101395 - RNA, 19 nt, Molluscum contagiosum virus
cggcaccguaccgcgcccg

SEQ ID NO: 3101396 - RNA, 21 nt, Molluscum contagiosum virus
cggcaccguaccgcgcccgcc

SEQ ID NO: 3101397 - RNA, 15 nt, Molluscum contagiosum virus
cggcaccugucgcgc

SEQ ID NO: 3101398 - RNA, 17 nt, Molluscum contagiosum virus
cggcaacaacgucacgc

SEQ ID NO: 3101399 - RNA, 19 nt, Molluscum contagiosum virus
cggcacacacuugcacgcg

SEQ ID NO: 3101400 - RNA, 20 nt, Molluscum contagiosum virus
cggcacacacuugcacgcgc

SEQ ID NO: 3101401 - RNA, 22 nt, Molluscum contagiosum virus
cggcagacaacaccagcgugcc

SEQ ID NO: 3101402 - RNA, 14 nt, Molluscum contagiosum virus
cggcagacgccagc

SEQ ID NO: 3101403 - RNA, 16 nt, Molluscum contagiosum virus
cggcagacgccagcga

SEQ ID NO: 3101404 - RNA, 15 nt, Molluscum contagiosum virus
cggcagcagcgugca

SEQ ID NO: 3101405 - RNA, 17 nt, Molluscum contagiosum virus
cggcagcaugcucacgu

SEQ ID NO: 3101406 - RNA, 17 nt, Molluscum contagiosum virus
cggcagcgacuacgcgc

SEQ ID NO: 3101407 - RNA, 21 nt, Molluscum contagiosum virus
cggcagcgacuacgcgcugcu

SEQ ID NO: 3101408 - RNA, 23 nt, Molluscum contagiosum virus
cggcagcgcauccgagucgagca

SEQ ID NO: 3101409 - RNA, 13 nt, Molluscum contagiosum virus
cggcagcgccagc

SEQ ID NO: 3101410 - RNA, 17 nt, Molluscum contagiosum virus
cggcagcgccagcgaga

SEQ ID NO: 3101411 - RNA, 13 nt, Molluscum contagiosum virus
cggcagcgccgcg

SEQ ID NO: 3101412 - RNA, 16 nt, Molluscum contagiosum virus
cggcagcgccgcgcgc

SEQ ID NO: 3101413 - RNA, 17 nt, Molluscum contagiosum virus
cggcagcgccgcgcgcg

SEQ ID NO: 3101414 - RNA, 13 nt, Molluscum contagiosum virus
cggcagcgcgccu

SEQ ID NO: 3101415 - RNA, 16 nt, Molluscum contagiosum virus
cggcagcgcgccuagc

SEQ ID NO: 3101416 - RNA, 17 nt, Molluscum contagiosum virus
ccacgcgugcugcgcgg

SEQ ID NO: 3101417 - RNA, 13 nt, Molluscum contagiosum virus
ccacgcuggcacg

SEQ ID NO: 3101418 - RNA, 16 nt, Molluscum contagiosum virus
ccacgggcuucgcugc

SEQ ID NO: 3101419 - RNA, 18 nt, Molluscum contagiosum virus
ccacggguaccgugcgcg

SEQ ID NO: 3101420 - RNA, 20 nt, Molluscum contagiosum virus
ccacggguaccgugcgcgug

SEQ ID NO: 3101421 - RNA, 20 nt, Molluscum contagiosum virus
ccacguccgacucggacacg

SEQ ID NO: 3101422 - RNA, 15 nt, Molluscum contagiosum virus
ccacggccgcgcgcg

SEQ ID NO: 3101423 - RNA, 18 nt, Molluscum contagiosum virus
ccacgugccagagucgcc

SEQ ID NO: 3101424 - RNA, 12 nt, Molluscum contagiosum virus
ccacgugcgcug

SEQ ID NO: 3101425 - RNA, 13 nt, Molluscum contagiosum virus
ccacgugcgcugg

SEQ ID NO: 3101426 - RNA, 23 nt, Molluscum contagiosum virus
ccacgugguccaccagcacgaag

SEQ ID NO: 3101427 - RNA, 19 nt, Molluscum contagiosum virus
ccacguggugguuggcgug

SEQ ID NO: 3101428 - RNA, 20 nt, Molluscum contagiosum virus
ccacuccgucgcgcucgaag

SEQ ID NO: 3101429 - RNA, 15 nt, Molluscum contagiosum virus
ccagacgcagagcca

SEQ ID NO: 3101430 - RNA, 21 nt, Molluscum contagiosum virus
ccacugggaacaccacacgcg

SEQ ID NO: 3101431 - RNA, 21 nt, Molluscum contagiosum virus
ccagagccgcgugcgccgccg

SEQ ID NO: 3101432 - RNA, 17 nt, Molluscum contagiosum virus
ccagauguucucgccag

SEQ ID NO: 3101433 - RNA, 20 nt, Molluscum contagiosum virus
ccagauugccggcgcgcgcu

SEQ ID NO: 3101434 - RNA, 12 nt, Molluscum contagiosum virus
ccagcacgcgcg

SEQ ID NO: 3101435 - RNA, 20 nt, Molluscum contagiosum virus
ccagcagagcugcccgccag

SEQ ID NO: 3101436 - RNA, 12 nt, Molluscum contagiosum virus
ccagcagcgaga

SEQ ID NO: 3101437 - RNA, 23 nt, Molluscum contagiosum virus
ccagcagcgcccggugcggcgug

SEQ ID NO: 3101438 - RNA, 16 nt, Molluscum contagiosum virus
ccagcagcggcgcgug

SEQ ID NO: 3101439 - RNA, 14 nt, Molluscum contagiosum virus
ccagcgacgagcag

SEQ ID NO: 3101440 - RNA, 15 nt, Molluscum contagiosum virus
ccugaugacggcaga

SEQ ID NO: 3101441 - RNA, 17 nt, Molluscum contagiosum virus
ccugaugcccgcgagau

SEQ ID NO: 3101442 - RNA, 13 nt, Molluscum contagiosum virus
ccugcaaacgcga

SEQ ID NO: 3101443 - RNA, 21 nt, Molluscum contagiosum virus
ccugcacaagcaggaguccgu

SEQ ID NO: 3101444 - RNA, 15 nt, Molluscum contagiosum virus
ccugcaccaccagug

SEQ ID NO: 3101445 - RNA, 19 nt, Molluscum contagiosum virus
ccagccaggcgccggcgcg

SEQ ID NO: 3101446 - RNA, 16 nt, Molluscum contagiosum virus
ccagccaucgugcgcg

SEQ ID NO: 3101447 - RNA, 15 nt, Molluscum contagiosum virus
ccagcccgcggugcg

SEQ ID NO: 3101448 - RNA, 17 nt, Molluscum contagiosum virus
ccagcccgcugcgcaug

SEQ ID NO: 3101449 - RNA, 13 nt, Molluscum contagiosum virus
ccagccgcgagcg

SEQ ID NO: 3101450 - RNA, 23 nt, Molluscum contagiosum virus
ccagccgcucguccagcugcgcg

SEQ ID NO: 3101451 - RNA, 19 nt, Molluscum contagiosum virus
ccagccgcugcgccgccag

SEQ ID NO: 3101452 - RNA, 15 nt, Molluscum contagiosum virus
ccagccugacggcag

SEQ ID NO: 3101453 - RNA, 21 nt, Molluscum contagiosum virus
ccagccugcuggcaccgcgcg

SEQ ID NO: 3101454 - RNA, 17 nt, Molluscum contagiosum virus
ccagauccgggcgcugc

SEQ ID NO: 3101455 - RNA, 16 nt, Molluscum contagiosum virus
ccugcacgagccggcg

SEQ ID NO: 3101456 - RNA, 14 nt, Molluscum contagiosum virus
ccugcacgcacgcg

SEQ ID NO: 3101457 - RNA, 13 nt, Molluscum contagiosum virus
ccugcacgcgcac

SEQ ID NO: 3101458 - RNA, 22 nt, Molluscum contagiosum virus
ccugcaggaaaggcacccgcag

SEQ ID NO: 3101459 - RNA, 18 nt, Molluscum contagiosum virus
ccugcauuucaugcgcgg

SEQ ID NO: 3101460 - RNA, 15 nt, Molluscum contagiosum virus
ccugccacaccagcu

SEQ ID NO: 3101461 - RNA, 18 nt, Molluscum contagiosum virus
ccugcucuccgcgggaag

SEQ ID NO: 3101462 - RNA, 20 nt, Molluscum contagiosum virus
ccugcugaagaaggagcccu

SEQ ID NO: 3101463 - RNA, 16 nt, Molluscum contagiosum virus
ccugcugcagcuccgc

SEQ ID NO: 3101464 - RNA, 14 nt, Molluscum contagiosum virus
ccugcugccgagcu

SEQ ID NO: 3101465 - RNA, 21 nt, Molluscum contagiosum virus
ccugcugcgagagcaugccua

SEQ ID NO: 3101466 - RNA, 19 nt, Molluscum contagiosum virus
ccugcgcgagcaagcgccc

SEQ ID NO: 3101467 - RNA, 18 nt, Molluscum contagiosum virus
ccugcgcgcgagagcuuc

SEQ ID NO: 3101468 - RNA, 21 nt, Molluscum contagiosum virus
ccugcgcgcggcaguggcgug

SEQ ID NO: 3101469 - RNA, 20 nt, Molluscum contagiosum virus
ccugcgcuuccucuacacca

SEQ ID NO: 3101470 - RNA, 16 nt, Molluscum contagiosum virus
ccugcggaacgcgcau

SEQ ID NO: 3101471 - RNA, 13 nt, Molluscum contagiosum virus
ccugcggcucgca

SEQ ID NO: 3101472 - RNA, 12 nt, Molluscum contagiosum virus
ccugcgggcgcu

SEQ ID NO: 3101473 - RNA, 19 nt, Molluscum contagiosum virus
ccugcggguaguugcgagc

SEQ ID NO: 3101474 - RNA, 16 nt, Molluscum contagiosum virus
ccugcuagugcgcgcc

SEQ ID NO: 3101475 - RNA, 16 nt, Molluscum contagiosum virus
ccugcucaugcgcaag

SEQ ID NO: 3101476 - RNA, 14 nt, Molluscum contagiosum virus
ccugcuggcaccgc

SEQ ID NO: 3101477 - RNA, 15 nt, Molluscum contagiosum virus
ccugcuggcaccgcg

SEQ ID NO: 3101478 - RNA, 21 nt, Molluscum contagiosum virus
ccugcuggcaccgcgcgcgcu

SEQ ID NO: 3101479 - RNA, 15 nt, Molluscum contagiosum virus
ccugcuggcgcgcug

SEQ ID NO: 3101480 - RNA, 13 nt, Molluscum contagiosum virus
ccugcuugcccgc

SEQ ID NO: 3101481 - RNA, 20 nt, Molluscum contagiosum virus
ccuggaacgcgaccuucacu

SEQ ID NO: 3101482 - RNA, 18 nt, Molluscum contagiosum virus
ccuggaacucuacgccgc

SEQ ID NO: 3101483 - RNA, 19 nt, Molluscum contagiosum virus
ccuggagggucacgcgcac

SEQ ID NO: 3101484 - RNA, 21 nt, Molluscum contagiosum virus
ccuggagggucacgcgcacau

SEQ ID NO: 3101485 - RNA, 22 nt, Molluscum contagiosum virus
ccugcgcaacgugcugcgccgc

SEQ ID NO: 3101486 - RNA, 22 nt, Molluscum contagiosum virus
ccugcgccgccucaugcgcgug

SEQ ID NO: 3101487 - RNA, 18 nt, Molluscum contagiosum virus
ccuggcuugcgcgcgccc

SEQ ID NO: 3101488 - RNA, 14 nt, Molluscum contagiosum virus
ccuggcggcgcugg

SEQ ID NO: 3101489 - RNA, 19 nt, Molluscum contagiosum virus
cgaagacgcguaccagcgc

SEQ ID NO: 3101490 - RNA, 15 nt, Molluscum contagiosum virus
cgaagagcgagaaca

SEQ ID NO: 3101491 - RNA, 18 nt, Molluscum contagiosum virus
cgaagagcgagaacacgg

SEQ ID NO: 3101492 - RNA, 18 nt, Molluscum contagiosum virus
cgaagagggucgugcagg

SEQ ID NO: 3101493 - RNA, 16 nt, Molluscum contagiosum virus
cgaagagugcgcaaca

SEQ ID NO: 3101494 - RNA, 16 nt, Molluscum contagiosum virus
cgaagcaggcgccauc

SEQ ID NO: 3101495 - RNA, 23 nt, Molluscum contagiosum virus
ccuggugcuggggcuagcgcugc

SEQ ID NO: 3101496 - RNA, 15 nt, Molluscum contagiosum virus
ccugguggagcacuu

SEQ ID NO: 3101497 - RNA, 19 nt, Molluscum contagiosum virus
ccuggugugccagcggcgc

SEQ ID NO: 3101498 - RNA, 12 nt, Molluscum contagiosum virus
cgaacugcuggg

SEQ ID NO: 3101499 - RNA, 18 nt, Molluscum contagiosum virus
cgaagaaggggccgaagu

SEQ ID NO: 3101500 - RNA, 15 nt, Molluscum contagiosum virus
cgaagaccaccagca

SEQ ID NO: 3101501 - RNA, 23 nt, Molluscum contagiosum virus
cgaagaccaccagcaccagcaca

SEQ ID NO: 3101502 - RNA, 18 nt, Molluscum contagiosum virus
cgaagacgagcgcgugcc

SEQ ID NO: 3101503 - RNA, 19 nt, Molluscum contagiosum virus
cgaaggcaaccgcgacgag

SEQ ID NO: 3101504 - RNA, 14 nt, Molluscum contagiosum virus
cgaagcgcgcagcg

SEQ ID NO: 3101505 - RNA, 16 nt, Molluscum contagiosum virus
cgaagcugcgcuugcg

SEQ ID NO: 3101506 - RNA, 18 nt, Molluscum contagiosum virus
cgaagcugcgcuugcgcg

SEQ ID NO: 3101507 - RNA, 17 nt, Molluscum contagiosum virus
cgacacgcgcccgccgc

SEQ ID NO: 3101508 - RNA, 13 nt, Molluscum contagiosum virus
cgacaacucgcgc

SEQ ID NO: 3101509 - RNA, 19 nt, Molluscum contagiosum virus
cgacaacgcacccgcgcgg

SEQ ID NO: 3101510 - RNA, 18 nt, Molluscum contagiosum virus
cgacaugccucgcggccc

SEQ ID NO: 3101511 - RNA, 16 nt, Molluscum contagiosum virus
cgaccaaaugcgcgug

SEQ ID NO: 3101512 - RNA, 16 nt, Molluscum contagiosum virus
cgacagcgcgcgcacg

SEQ ID NO: 3101513 - RNA, 14 nt, Molluscum contagiosum virus
cgacagcgugcgcg

SEQ ID NO: 3101514 - RNA, 17 nt, Molluscum contagiosum virus
cgacacugugcuggcgc

SEQ ID NO: 3101515 - RNA, 13 nt, Molluscum contagiosum virus
cgacagcgacgag

SEQ ID NO: 3101516 - RNA, 20 nt, Molluscum contagiosum virus
cgacccaucggagaagugcu

SEQ ID NO: 3101517 - RNA, 23 nt, Molluscum contagiosum virus
cgacguuuucuuugcgcucauca

SEQ ID NO: 3101518 - RNA, 14 nt, Molluscum contagiosum virus
cgacuacgcgcugc

SEQ ID NO: 3101519 - RNA, 18 nt, Molluscum contagiosum virus
cgacuagcgugcgcagca

SEQ ID NO: 3101520 - RNA, 21 nt, Molluscum contagiosum virus
cgacuagcgugcgcagcauuc

SEQ ID NO: 3101521 - RNA, 17 nt, Molluscum contagiosum virus
cgacucggugcucaugc

SEQ ID NO: 3101522 - RNA, 19 nt, Molluscum contagiosum virus
cgacucggugcucaugcgc

SEQ ID NO: 3101523 - RNA, 16 nt, Molluscum contagiosum virus
cgacucucaacgagcg

SEQ ID NO: 3101524 - RNA, 15 nt, Molluscum contagiosum virus
cgacgugcgcgcugc

SEQ ID NO: 3101525 - RNA, 13 nt, Molluscum contagiosum virus
cgacgugcgcgug

SEQ ID NO: 3101526 - RNA, 22 nt, Molluscum contagiosum virus
cgacguggagccugaggccgcg

SEQ ID NO: 3101527 - RNA, 19 nt, Molluscum contagiosum virus
cgaccauuuccugcgagug

SEQ ID NO: 3101528 - RNA, 13 nt, Molluscum contagiosum virus
cgaccacgugcca

SEQ ID NO: 3101529 - RNA, 16 nt, Molluscum contagiosum virus
cgaccacgugccagag

SEQ ID NO: 3101530 - RNA, 14 nt, Molluscum contagiosum virus
cgagcaaggcgcgc

SEQ ID NO: 3101531 - RNA, 15 nt, Molluscum contagiosum virus
cgagcaaugcgagca

SEQ ID NO: 3101532 - RNA, 18 nt, Molluscum contagiosum virus
cgagagugacgccucgag

SEQ ID NO: 3101533 - RNA, 15 nt, Molluscum contagiosum virus
cgagauucguggcga

SEQ ID NO: 3101534 - RNA, 21 nt, Molluscum contagiosum virus
cgagauucguggcgagcaucu

SEQ ID NO: 3101535 - RNA, 17 nt, Molluscum contagiosum virus
cgagggcgccgggcgca

SEQ ID NO: 3101536 - RNA, 14 nt, Molluscum contagiosum virus
cgagggcgcgcugg

SEQ ID NO: 3101537 - RNA, 20 nt, Molluscum contagiosum virus
cgagggccuuggcggcgcgg

SEQ ID NO: 3101538 - RNA, 16 nt, Molluscum contagiosum virus
cgagggaugcgcacac

SEQ ID NO: 3101539 - RNA, 14 nt, Molluscum contagiosum virus
cgaguaccgcgcgc

SEQ ID NO: 3101540 - RNA, 22 nt, Molluscum contagiosum virus
cgaguacgcucuccaugcgcgc

SEQ ID NO: 3101541 - RNA, 16 nt, Molluscum contagiosum virus
cgaguacugcugcggc

SEQ ID NO: 3101542 - RNA, 18 nt, Molluscum contagiosum virus
cgaguacugcugcggcuc

SEQ ID NO: 3101543 - RNA, 20 nt, Molluscum contagiosum virus
cgaguauacucgacgcgcgc

SEQ ID NO: 3101544 - RNA, 17 nt, Molluscum contagiosum virus
cgagucaaugacacgag

SEQ ID NO: 3101545 - RNA, 20 nt, Molluscum contagiosum virus
cgaguccccagacuucucca

SEQ ID NO: 3101546 - RNA, 22 nt, Molluscum contagiosum virus
cgagggggacgugcccuacgcg

SEQ ID NO: 3101547 - RNA, 14 nt, Molluscum contagiosum virus
cgaggucgcgucca

SEQ ID NO: 3101548 - RNA, 13 nt, Molluscum contagiosum virus
cgagagcgcgcgc

SEQ ID NO: 3101549 - RNA, 22 nt, Molluscum contagiosum virus
cgagacugcuacgucgcggcgc

SEQ ID NO: 3101550 - RNA, 20 nt, Molluscum contagiosum virus
cgagaauuucgacagcaucc

SEQ ID NO: 3101551 - RNA, 14 nt, Molluscum contagiosum virus
cgagacacgcgagc

SEQ ID NO: 3101552 - RNA, 13 nt, Molluscum contagiosum virus
cgacuuuucgcgc

SEQ ID NO: 3101553 - RNA, 18 nt, Molluscum contagiosum virus
cgacuuuucgcgccgcgg

SEQ ID NO: 3101554 - RNA, 16 nt, Molluscum contagiosum virus
cgagaccagccgcgag

SEQ ID NO: 3101555 - RNA, 17 nt, Molluscum contagiosum virus
cgagaccagccgcgagc

SEQ ID NO: 3101556 - RNA, 17 nt, Molluscum contagiosum virus
cgagacgcagacgacgc

SEQ ID NO: 3101557 - RNA, 15 nt, Molluscum contagiosum virus
cgagacgcugcgcga

SEQ ID NO: 3101558 - RNA, 15 nt, Molluscum contagiosum virus
cgagacgcugcugca

SEQ ID NO: 3101559 - RNA, 19 nt, Molluscum contagiosum virus
cgacucgagcgagcuacgc

SEQ ID NO: 3101560 - RNA, 17 nt, Molluscum contagiosum virus
cgacucgcagcucacga

SEQ ID NO: 3101561 - RNA, 13 nt, Molluscum contagiosum virus
cgacucgcgcccg

SEQ ID NO: 3101562 - RNA, 16 nt, Molluscum contagiosum virus
cgacuucggcgcaacg

SEQ ID NO: 3101563 - RNA, 13 nt, Molluscum contagiosum virus
cgacuucucgcgc

SEQ ID NO: 3101564 - RNA, 20 nt, Molluscum contagiosum virus
cgacuugcugcggagcgccu

SEQ ID NO: 3101565 - RNA, 19 nt, Molluscum contagiosum virus
cgagaaaaagcugucgcgc

SEQ ID NO: 3101566 - RNA, 23 nt, Molluscum contagiosum virus
cgagaaaaagcugucgcgcagca

SEQ ID NO: 3101567 - RNA, 20 nt, Molluscum contagiosum virus
cgagaaagaccuugucagug

SEQ ID NO: 3101568 - RNA, 18 nt, Molluscum contagiosum virus
cgagaaagucaugcucgc

SEQ ID NO: 3101569 - RNA, 15 nt, Molluscum contagiosum virus
cgagaaaugcgcaca

SEQ ID NO: 3101570 - RNA, 13 nt, Molluscum contagiosum virus
cgagaacuggcgc

SEQ ID NO: 3101571 - RNA, 17 nt, Molluscum contagiosum virus
cgagaacuggcgcagca

SEQ ID NO: 3101572 - RNA, 15 nt, Molluscum contagiosum virus
cgagaagacggggcg

SEQ ID NO: 3101573 - RNA, 20 nt, Molluscum contagiosum virus
cgagaagacggggcgcacgc

SEQ ID NO: 3101574 - RNA, 15 nt, Molluscum contagiosum virus
cggaugccacgcagc

SEQ ID NO: 3101575 - RNA, 16 nt, Molluscum contagiosum virus
cggaugccacgcagcu

SEQ ID NO: 3101576 - RNA, 15 nt, Molluscum contagiosum virus
cggaugucacgcaga

SEQ ID NO: 3101577 - RNA, 14 nt, Molluscum contagiosum virus
cggcaaaggcccgc

SEQ ID NO: 3101578 - RNA, 18 nt, Molluscum contagiosum virus
cggcaaaggcccgcgagc

SEQ ID NO: 3101579 - RNA, 17 nt, Molluscum contagiosum virus
cggcaaccgcgcccgcg

SEQ ID NO: 3101580 - RNA, 15 nt, Molluscum contagiosum virus
cggcaacgcugccgc

SEQ ID NO: 3101581 - RNA, 17 nt, Molluscum contagiosum virus
cggaucugcgcacacgu

SEQ ID NO: 3101582 - RNA, 15 nt, Molluscum contagiosum virus
cggaguccgcgccca

SEQ ID NO: 3101583 - RNA, 14 nt, Molluscum contagiosum virus
cggauacgcgcaca

SEQ ID NO: 3101584 - RNA, 16 nt, Molluscum contagiosum virus
cggauauggcgcgccg

SEQ ID NO: 3101585 - RNA, 20 nt, Molluscum contagiosum virus
cggaucagccccgcgccagc

SEQ ID NO: 3101586 - RNA, 21 nt, Molluscum contagiosum virus
cggaucagccccgcgccagca

SEQ ID NO: 3101587 - RNA, 20 nt, Molluscum contagiosum virus
cggagguuggaagcacgcaa

SEQ ID NO: 3101588 - RNA, 18 nt, Molluscum contagiosum virus
cggaggucgagcgcgccg

SEQ ID NO: 3101589 - RNA, 22 nt, Molluscum contagiosum virus
cggagcucgccaaagcgcgccu

SEQ ID NO: 3101590 - RNA, 16 nt, Molluscum contagiosum virus
cggagcugcgcgcgcu

SEQ ID NO: 3101591 - RNA, 16 nt, Molluscum contagiosum virus
cggagcuggcguugcc

SEQ ID NO: 3101592 - RNA, 18 nt, Molluscum contagiosum virus
cggagcuggcguugccga

SEQ ID NO: 3101593 - RNA, 19 nt, Molluscum contagiosum virus
cggaggagcgauccacgag

SEQ ID NO: 3101594 - RNA, 18 nt, Molluscum contagiosum virus
cggaggcacgggcucgau

SEQ ID NO: 3101595 - RNA, 18 nt, Molluscum contagiosum virus
cggaggccgcucccgcga

SEQ ID NO: 3101596 - RNA, 14 nt, Molluscum contagiosum virus
cgcugccgcuggcg

SEQ ID NO: 3101597 - RNA, 23 nt, Molluscum contagiosum virus
cgcugccgcuucgugcgcggaga

SEQ ID NO: 3101598 - RNA, 15 nt, Molluscum contagiosum virus
cgcugccggcaacgc

SEQ ID NO: 3101599 - RNA, 22 nt, Molluscum contagiosum virus
cgcugagcaagcucaagaagcc

SEQ ID NO: 3101600 - RNA, 12 nt, Molluscum contagiosum virus
cgcugacggcgc

SEQ ID NO: 3101601 - RNA, 20 nt, Molluscum contagiosum virus
cgcugacggcgcugcgcgug

SEQ ID NO: 3101602 - RNA, 22 nt, Molluscum contagiosum virus
cgcugaucaccgaggagccgcg

SEQ ID NO: 3101603 - RNA, 16 nt, Molluscum contagiosum virus
cgcugcaaggcgcgcg

SEQ ID NO: 3101604 - RNA, 20 nt, Molluscum contagiosum virus
cgcugcacaguucacggcgc

SEQ ID NO: 3101605 - RNA, 23 nt, Molluscum contagiosum virus
cgcugcacaguucacggcgcucg

SEQ ID NO: 3101606 - RNA, 13 nt, Molluscum contagiosum virus
cgcugcacgcucu

SEQ ID NO: 3101607 - RNA, 22 nt, Molluscum contagiosum virus
cgcugcagaacuguagcguccg

SEQ ID NO: 3101608 - RNA, 16 nt, Molluscum contagiosum virus
cgcugccaacgcggac

SEQ ID NO: 3101609 - RNA, 15 nt, Molluscum contagiosum virus
cgcugcccgcgcaca

SEQ ID NO: 3101610 - RNA, 15 nt, Molluscum contagiosum virus
cgcugcccgcgcacg

SEQ ID NO: 3101611 - RNA, 17 nt, Molluscum contagiosum virus
cgcugcccgcgcacgag

SEQ ID NO: 3101612 - RNA, 17 nt, Molluscum contagiosum virus
cgcugccgcgcgcgccg

SEQ ID NO: 3101613 - RNA, 16 nt, Molluscum contagiosum virus
cggagaucgacacgag

SEQ ID NO: 3101614 - RNA, 14 nt, Molluscum contagiosum virus
cggagccgcggcag

SEQ ID NO: 3101615 - RNA, 16 nt, Molluscum contagiosum virus
cggagcgcagcugccg

SEQ ID NO: 3101616 - RNA, 16 nt, Molluscum contagiosum virus
cggacugggagcaccg

SEQ ID NO: 3101617 - RNA, 19 nt, Molluscum contagiosum virus
cggacuucgacgcgcggca

SEQ ID NO: 3101618 - RNA, 20 nt, Molluscum contagiosum virus
cggacuucgacgcgcggcag

SEQ ID NO: 3101619 - RNA, 18 nt, Molluscum contagiosum virus
cggacuucucgcucacgc

SEQ ID NO: 3101620 - RNA, 18 nt, Molluscum contagiosum virus
cggacuucuugcgcggcg

SEQ ID NO: 3101621 - RNA, 20 nt, Molluscum contagiosum virus
cggacuuuucgcgcgugcgc

SEQ ID NO: 3101622 - RNA, 20 nt, Molluscum contagiosum virus
cggagaacaugcucgccagc

SEQ ID NO: 3101623 - RNA, 16 nt, Molluscum contagiosum virus
cggagaagugcgcagc

SEQ ID NO: 3101624 - RNA, 23 nt, Molluscum contagiosum virus
cggagaagugcuccgcacgugga

SEQ ID NO: 3101625 - RNA, 18 nt, Molluscum contagiosum virus
cggagacaccagcuccgc

SEQ ID NO: 3101626 - RNA, 21 nt, Molluscum contagiosum virus
cggagagcagugccgcucgcu

SEQ ID NO: 3101627 - RNA, 14 nt, Molluscum contagiosum virus
cgccuccgggcgca

SEQ ID NO: 3101628 - RNA, 18 nt, Molluscum contagiosum virus
cgccuccgagcgcgcgug

SEQ ID NO: 3101629 - RNA, 20 nt, Molluscum contagiosum virus
cgccguuucgcaagucuccc

SEQ ID NO: 3101630 - RNA, 14 nt, Molluscum contagiosum virus
cgccuccaagaaga

SEQ ID NO: 3101631 - RNA, 18 nt, Molluscum contagiosum virus
cgccugacucccgucagc

SEQ ID NO: 3101632 - RNA, 14 nt, Molluscum contagiosum virus
cgccugcacuacug

SEQ ID NO: 3101633 - RNA, 20 nt, Molluscum contagiosum virus
cgcucgagcuccgagggcgc

SEQ ID NO: 3101634 - RNA, 22 nt, Molluscum contagiosum virus
cgcucgaggaccucgcgcgccg

SEQ ID NO: 3101635 - RNA, 18 nt, Molluscum contagiosum virus
cgcucgaggaggaccacg

SEQ ID NO: 3101636 - RNA, 13 nt, Molluscum contagiosum virus
cgcucgagggcgc

SEQ ID NO: 3101637 - RNA, 14 nt, Molluscum contagiosum virus
cgcucgagggcgcc

SEQ ID NO: 3101638 - RNA, 20 nt, Molluscum contagiosum virus
cgcucgcgacgugcgcgcug

SEQ ID NO: 3101639 - RNA, 14 nt, Molluscum contagiosum virus
cgcucgcgagaagu

SEQ ID NO: 3101640 - RNA, 22 nt, Molluscum contagiosum virus
cgcucgcgcaaguccagcgcgc

SEQ ID NO: 3101641 - RNA, 23 nt, Molluscum contagiosum virus
cgcucgcgcaaguccagcgcgcu

SEQ ID NO: 3101642 - RNA, 22 nt, Molluscum contagiosum virus
cgcucgcgcgcaugcucgcgcu

SEQ ID NO: 3101643 - RNA, 12 nt, Molluscum contagiosum virus
cgcucgcgcucc

SEQ ID NO: 3101644 - RNA, 13 nt, Molluscum contagiosum virus
cgcucgcgcuucc

SEQ ID NO: 3101645 - RNA, 18 nt, Molluscum contagiosum virus
cgcucgcgugccgcggac

SEQ ID NO: 3101646 - RNA, 21 nt, Molluscum contagiosum virus
cgcucgcgugccgcggacgcc

SEQ ID NO: 3101647 - RNA, 11 nt, Molluscum contagiosum virus
cgcucgcuaga

SEQ ID NO: 3101648 - RNA, 18 nt, Molluscum contagiosum virus
cgcucgcuagaggacgcc

SEQ ID NO: 3101649 - RNA, 12 nt, Molluscum contagiosum virus
cgcucgcucagc

SEQ ID NO: 3101650 - RNA, 16 nt, Molluscum contagiosum virus
cgcucgcucgcucagc

SEQ ID NO: 3101651 - RNA, 12 nt, Molluscum contagiosum virus
cgcucgcugucc

SEQ ID NO: 3101652 - RNA, 22 nt, Molluscum contagiosum virus
cgcucguggaucgcgcgcaccu

SEQ ID NO: 3101653 - RNA, 16 nt, Molluscum contagiosum virus
cgcucuacgccagcga

SEQ ID NO: 3101654 - RNA, 17 nt, Molluscum contagiosum virus
cgcucuccaugcgcgcg

SEQ ID NO: 3101655 - RNA, 16 nt, Molluscum contagiosum virus
cgcucucgcuggcucc

SEQ ID NO: 3101656 - RNA, 17 nt, Molluscum contagiosum virus
cgcucguccagcugcgc

SEQ ID NO: 3101657 - RNA, 20 nt, Molluscum contagiosum virus
cgcucguccagcugcgcgag

SEQ ID NO: 3101658 - RNA, 23 nt, Molluscum contagiosum virus
cgcucgucggcggcaugcgcgcg

SEQ ID NO: 3101659 - RNA, 19 nt, Molluscum contagiosum virus
cgcucugccaccgcggcgc

SEQ ID NO: 3101660 - RNA, 21 nt, Molluscum contagiosum virus
cgcucuuacugcagcagcucc

SEQ ID NO: 3101661 - RNA, 21 nt, Molluscum contagiosum virus
cgcucuucguggugcucacgc

SEQ ID NO: 3101662 - RNA, 21 nt, Molluscum contagiosum virus
cgcucuuuugcaagcgcgaaa

SEQ ID NO: 3101663 - RNA, 15 nt, Molluscum contagiosum virus
cgccucgagcacgcc

SEQ ID NO: 3101664 - RNA, 17 nt, Molluscum contagiosum virus
cgccucgagcacgccuc

SEQ ID NO: 3101665 - RNA, 20 nt, Molluscum contagiosum virus
cgccucggacuucgacgcgc

SEQ ID NO: 3101666 - RNA, 21 nt, Molluscum contagiosum virus
cgccucggacuucgacgcgcg

SEQ ID NO: 3101667 - RNA, 23 nt, Molluscum contagiosum virus
cgccucgggaaaacgcgcggcag

SEQ ID NO: 3101668 - RNA, 24 nt, Molluscum contagiosum virus
cgccucgggaaaacgcgcggcagc

SEQ ID NO: 3101669 - RNA, 18 nt, Molluscum contagiosum virus
cgcucggaaagagcgcgc

SEQ ID NO: 3101670 - RNA, 15 nt, Molluscum contagiosum virus
cgcucggcacucgcu

SEQ ID NO: 3101671 - RNA, 18 nt, Molluscum contagiosum virus
cgcucggcguggugcugg

SEQ ID NO: 3101672 - RNA, 15 nt, Molluscum contagiosum virus
cgcucggcugccgug

SEQ ID NO: 3101673 - RNA, 16 nt, Molluscum contagiosum virus
cgcucggcccgcggac

SEQ ID NO: 3101674 - RNA, 14 nt, Molluscum contagiosum virus
cgaguucacggcga

SEQ ID NO: 3101675 - RNA, 14 nt, Molluscum contagiosum virus
cgagucgcgccgag

SEQ ID NO: 3101676 - RNA, 15 nt, Molluscum contagiosum virus
cgagucgcgggcgcg

SEQ ID NO: 3101677 - RNA, 17 nt, Molluscum contagiosum virus
cgagucguacacgcaga

SEQ ID NO: 3101678 - RNA, 17 nt, Molluscum contagiosum virus
cgagugcgccgcgcccg

SEQ ID NO: 3101679 - RNA, 12 nt, Molluscum contagiosum virus
cgagugcgcgug

SEQ ID NO: 3101680 - RNA, 12 nt, Molluscum contagiosum virus
cgagugugcaug

SEQ ID NO: 3101681 - RNA, 16 nt, Molluscum contagiosum virus
cgagugugcgcgcccc

SEQ ID NO: 3101682 - RNA, 14 nt, Molluscum contagiosum virus
cgagugugugcauc

SEQ ID NO: 3101683 - RNA, 19 nt, Molluscum contagiosum virus
cgaucuuccgcgacgagcu

SEQ ID NO: 3101684 - RNA, 21 nt, Molluscum contagiosum virus
cgaucuucuucuugcgcaccu

SEQ ID NO: 3101685 - RNA, 17 nt, Molluscum contagiosum virus
cgaugagaacaacagcg

SEQ ID NO: 3101686 - RNA, 17 nt, Molluscum contagiosum virus
cgaugccaacagacuug

SEQ ID NO: 3101687 - RNA, 14 nt, Molluscum contagiosum virus
cgauggggcgcucg

SEQ ID NO: 3101688 - RNA, 15 nt, Molluscum contagiosum virus
cgauccuguccaucu

SEQ ID NO: 3101689 - RNA, 15 nt, Molluscum contagiosum virus
cgaucgcagcagugc

SEQ ID NO: 3101690 - RNA, 14 nt, Molluscum contagiosum virus
cgaucaagacauuu

SEQ ID NO: 3101691 - RNA, 20 nt, Molluscum contagiosum virus
cgaucaagacauuucuccuc

SEQ ID NO: 3101692 - RNA, 18 nt, Molluscum contagiosum virus
cgccaccucggcguuggc

SEQ ID NO: 3101693 - RNA, 22 nt, Molluscum contagiosum virus
cgccaccucggcguuggccacg

SEQ ID NO: 3101694 - RNA, 19 nt, Molluscum contagiosum virus
cgccacgaagaacgcggcg

SEQ ID NO: 3101695 - RNA, 14 nt, Molluscum contagiosum virus
cgccacgagcgccg

SEQ ID NO: 3101696 - RNA, 21 nt, Molluscum contagiosum virus
cgccacgagcgccgcgacgcc

SEQ ID NO: 3101697 - RNA, 20 nt, Molluscum contagiosum virus
cgccacgagcgccgcgugcg

SEQ ID NO: 3101698 - RNA, 17 nt, Molluscum contagiosum virus
cgccacuagcaaggcgc

SEQ ID NO: 3101699 - RNA, 19 nt, Molluscum contagiosum virus
cgauguacgcgugcaggaa

SEQ ID NO: 3101700 - RNA, 14 nt, Molluscum contagiosum virus
cgccacugccacgg

SEQ ID NO: 3101701 - RNA, 18 nt, Molluscum contagiosum virus
cgccacugccacggcugc

SEQ ID NO: 3101702 - RNA, 18 nt, Molluscum contagiosum virus
cgccacugcggcaacgag

SEQ ID NO: 3101703 - RNA, 16 nt, Molluscum contagiosum virus
cgccacuggaagaaca

SEQ ID NO: 3101704 - RNA, 13 nt, Molluscum contagiosum virus
cgccagcacgcgc

SEQ ID NO: 3101705 - RNA, 15 nt, Molluscum contagiosum virus
cgccagcagcgcccg

SEQ ID NO: 3101706 - RNA, 18 nt, Molluscum contagiosum virus
cgccagcaguccgccguc

SEQ ID NO: 3101707 - RNA, 18 nt, Molluscum contagiosum virus
cgccagcgucgcgcgccg

SEQ ID NO: 3101708 - RNA, 18 nt, Molluscum contagiosum virus
cgccagcuaagccggagc

SEQ ID NO: 3101709 - RNA, 18 nt, Molluscum contagiosum virus
cgccagcuccgcgcggcg

SEQ ID NO: 3101710 - RNA, 19 nt, Molluscum contagiosum virus
cgccagcuccgcgcggcgc

SEQ ID NO: 3101711 - RNA, 16 nt, Molluscum contagiosum virus
cgccaccggcagugcu

SEQ ID NO: 3101712 - RNA, 13 nt, Molluscum contagiosum virus
cgccgugcgcgug

SEQ ID NO: 3101713 - RNA, 19 nt, Molluscum contagiosum virus
cgccgucgucgccgccguc

SEQ ID NO: 3101714 - RNA, 23 nt, Molluscum contagiosum virus
cgccguccaugugcccgcggcgc

SEQ ID NO: 3101715 - RNA, 21 nt, Molluscum contagiosum virus
cgccguuccacuacaagcagc

SEQ ID NO: 3101716 - RNA, 15 nt, Molluscum contagiosum virus
cgccguucguugucc

SEQ ID NO: 3101717 - RNA, 14 nt, Molluscum contagiosum virus
cgccguugcgcgug

SEQ ID NO: 3101718 - RNA, 21 nt, Molluscum contagiosum virus
cgccguguaccgccgcggccg

SEQ ID NO: 3101719 - RNA, 13 nt, Molluscum contagiosum virus
cgccguccgcgca

SEQ ID NO: 3101720 - RNA, 16 nt, Molluscum contagiosum virus
cgccguccgcgcagcc

SEQ ID NO: 3101721 - RNA, 20 nt, Molluscum contagiosum virus
cgccgggccugcggcggcgc

SEQ ID NO: 3101722 - RNA, 19 nt, Molluscum contagiosum virus
cgccggccuuguucgcgcu

SEQ ID NO: 3101723 - RNA, 14 nt, Molluscum contagiosum virus
cgccggcgcgcgcg

SEQ ID NO: 3101724 - RNA, 13 nt, Molluscum contagiosum virus
cgccggcgcggcg

SEQ ID NO: 3101725 - RNA, 13 nt, Molluscum contagiosum virus
cgcccacgugcca

SEQ ID NO: 3101726 - RNA, 17 nt, Molluscum contagiosum virus
cgcccagcaccuggaac

SEQ ID NO: 3101727 - RNA, 14 nt, Molluscum contagiosum virus
cgcccagcgccacg

SEQ ID NO: 3101728 - RNA, 19 nt, Molluscum contagiosum virus
cgcccaacgcccgcgcccg

SEQ ID NO: 3101729 - RNA, 18 nt, Molluscum contagiosum virus
cgccaucgugguggagga

SEQ ID NO: 3101730 - RNA, 23 nt, Molluscum contagiosum virus
cgccggccagcgagucucgcgcg

SEQ ID NO: 3101731 - RNA, 15 nt, Molluscum contagiosum virus
cgccgcugucacgcg

SEQ ID NO: 3101732 - RNA, 16 nt, Molluscum contagiosum virus
cgccgcugucacgcga

SEQ ID NO: 3101733 - RNA, 16 nt, Molluscum contagiosum virus
cgccggacagcucagc

SEQ ID NO: 3101734 - RNA, 16 nt, Molluscum contagiosum virus
cgccaugccaacgcac

SEQ ID NO: 3101735 - RNA, 15 nt, Molluscum contagiosum virus
cgccaugcugcgcga

SEQ ID NO: 3101736 - RNA, 21 nt, Molluscum contagiosum virus
cgccauuuccgagcgcgcacg

SEQ ID NO: 3101737 - RNA, 23 nt, Molluscum contagiosum virus
cgccauuuccgagcgcgcacgag

SEQ ID NO: 3101738 - RNA, 19 nt, Molluscum contagiosum virus
cgccauuuucgugcgcguc

SEQ ID NO: 3101739 - RNA, 17 nt, Molluscum contagiosum virus
cgccauccagcgcauca

SEQ ID NO: 3101740 - RNA, 14 nt, Molluscum contagiosum virus
cgccauccgcgagc

SEQ ID NO: 3101741 - RNA, 20 nt, Molluscum contagiosum virus
cgccauccgcgagcuaauca

SEQ ID NO: 3101742 - RNA, 22 nt, Molluscum contagiosum virus
cgccaguggccagcgcgcggcg

SEQ ID NO: 3101743 - RNA, 23 nt, Molluscum contagiosum virus
cgccaguggccagcgcgcggcgc

SEQ ID NO: 3101744 - RNA, 23 nt, Molluscum contagiosum virus
cgccagccuggaguacucgaagu

SEQ ID NO: 3101745 - RNA, 15 nt, Molluscum contagiosum virus
cgccagcgacgcgac

SEQ ID NO: 3101746 - RNA, 20 nt, Molluscum contagiosum virus
cgccagggcggagccccgag

SEQ ID NO: 3101747 - RNA, 17 nt, Molluscum contagiosum virus
cgccaggugcgaaggcu

SEQ ID NO: 3101748 - RNA, 16 nt, Molluscum contagiosum virus
cgccaguccgcggcgc

SEQ ID NO: 3101749 - RNA, 17 nt, Molluscum contagiosum virus
aagccaccgcgcaggac

SEQ ID NO: 3101750 - RNA, 18 nt, Molluscum contagiosum virus
aagcgcccucguguacga

SEQ ID NO: 3101751 - RNA, 14 nt, Molluscum contagiosum virus
aagcgccgcgcgcg

SEQ ID NO: 3101752 - RNA, 21 nt, Molluscum contagiosum virus
aagcgccgcucgguacaacuu

SEQ ID NO: 3101753 - RNA, 14 nt, Molluscum contagiosum virus
aagcgcgcucgggc

SEQ ID NO: 3101754 - RNA, 13 nt, Molluscum contagiosum virus
aagcgcggccgcg

SEQ ID NO: 3101755 - RNA, 18 nt, Molluscum contagiosum virus
aagcagguggccgcgcgc

SEQ ID NO: 3101756 - RNA, 17 nt, Molluscum contagiosum virus
aagcauggucuucgcgc

SEQ ID NO: 3101757 - RNA, 22 nt, Molluscum contagiosum virus
aagagccauguuuccugcggcg

SEQ ID NO: 3101758 - RNA, 20 nt, Molluscum contagiosum virus
aagagcccgcacacgccgcg

SEQ ID NO: 3101759 - RNA, 15 nt, Molluscum contagiosum virus
aagagcgcgccucuc

SEQ ID NO: 3101760 - RNA, 16 nt, Molluscum contagiosum virus
aagaggacguguacgc

SEQ ID NO: 3101761 - RNA, 22 nt, Molluscum contagiosum virus
aagacgcuggugaucacgcacg

SEQ ID NO: 3101762 - RNA, 15 nt, Molluscum contagiosum virus
aagacgggcccgcga

SEQ ID NO: 3101763 - RNA, 15 nt, Molluscum contagiosum virus
aagacggggccgcga

SEQ ID NO: 3101764 - RNA, 22 nt, Molluscum contagiosum virus
aagacguggacgaggccaaccu

SEQ ID NO: 3101765 - RNA, 22 nt, Molluscum contagiosum virus
aagauauacaccaggcgcgugc

SEQ ID NO: 3101766 - RNA, 15 nt, Molluscum contagiosum virus
aagauccaagcgcaa

SEQ ID NO: 3101767 - RNA, 14 nt, Molluscum contagiosum virus
aagaugcugcgcgu

SEQ ID NO: 3101768 - RNA, 16 nt, Molluscum contagiosum virus
aacugcagcagcuggc

SEQ ID NO: 3101769 - RNA, 12 nt, Molluscum contagiosum virus
aacuucgcgcug

SEQ ID NO: 3101770 - RNA, 22 nt, Molluscum contagiosum virus
aagaagaggccagcacaagccg

SEQ ID NO: 3101771 - RNA, 22 nt, Molluscum contagiosum virus
aagaagaggccggcacaagccg

SEQ ID NO: 3101772 - RNA, 19 nt, Molluscum contagiosum virus
aacgugcugcgccgccugc

SEQ ID NO: 3101773 - RNA, 14 nt, Molluscum contagiosum virus
aacucugcucgugc

SEQ ID NO: 3101774 - RNA, 13 nt, Molluscum contagiosum virus
aacgggcucgugc

SEQ ID NO: 3101775 - RNA, 15 nt, Molluscum contagiosum virus
ucccacguacgagca

SEQ ID NO: 3101776 - RNA, 16 nt, Molluscum contagiosum virus
uccaugcgcgcgcgau

SEQ ID NO: 3101777 - RNA, 17 nt, Molluscum contagiosum virus
uccaggugcugggcgag

SEQ ID NO: 3101778 - RNA, 24 nt, Molluscum contagiosum virus
uccagguggccaacggcgccaucg

SEQ ID NO: 3101779 - RNA, 16 nt, Molluscum contagiosum virus
uccaguggcgcccgug

SEQ ID NO: 3101780 - RNA, 23 nt, Molluscum contagiosum virus
ucgaacgcaaggugugcgcgcug

SEQ ID NO: 3101781 - RNA, 14 nt, Molluscum contagiosum virus
ucgaacgcgcgugc

SEQ ID NO: 3101782 - RNA, 15 nt, Molluscum contagiosum virus
ucgaacgcgcgugcg

SEQ ID NO: 3101783 - RNA, 17 nt, Molluscum contagiosum virus
ucgaacgcgcgugcgcg

SEQ ID NO: 3101784 - RNA, 22 nt, Molluscum contagiosum virus
ucgaagacgucggggcgcgugc

SEQ ID NO: 3101785 - RNA, 13 nt, Molluscum contagiosum virus
ucgaagaggucuc

SEQ ID NO: 3101786 - RNA, 14 nt, Molluscum contagiosum virus
ucgaagcagugcuc

SEQ ID NO: 3101787 - RNA, 19 nt, Molluscum contagiosum virus
ucgaaggcgugcgccgugc

SEQ ID NO: 3101788 - RNA, 19 nt, Molluscum contagiosum virus
uccuggcacuggcgcgcac

SEQ ID NO: 3101789 - RNA, 11 nt, Molluscum contagiosum virus
uccugggcgac

SEQ ID NO: 3101790 - RNA, 14 nt, Molluscum contagiosum virus
uccuguccucucga

SEQ ID NO: 3101791 - RNA, 14 nt, Molluscum contagiosum virus
uccgaggacgacgc

SEQ ID NO: 3101792 - RNA, 16 nt, Molluscum contagiosum virus
uccugccgucgcccgu

SEQ ID NO: 3101793 - RNA, 18 nt, Molluscum contagiosum virus
uccgagccggacgcgcga

SEQ ID NO: 3101794 - RNA, 16 nt, Molluscum contagiosum virus
uccgagcgcgcgcgcu

SEQ ID NO: 3101795 - RNA, 16 nt, Molluscum contagiosum virus
ucgacgacgcgcgcac

SEQ ID NO: 3101796 - RNA, 17 nt, Molluscum contagiosum virus
ucgacgacgcgcgcacg

SEQ ID NO: 3101797 - RNA, 13 nt, Molluscum contagiosum virus
ucgacgcgcgcgg

SEQ ID NO: 3101798 - RNA, 19 nt, Molluscum contagiosum virus
ucgacgcggugcgcgcgug

SEQ ID NO: 3101799 - RNA, 20 nt, Molluscum contagiosum virus
ucgacgcggugcgcgcgugc

SEQ ID NO: 3101800 - RNA, 21 nt, Molluscum contagiosum virus
ucgacgcggugcgcgcgugcg

SEQ ID NO: 3101801 - RNA, 23 nt, Molluscum contagiosum virus
ucgacgcgugcauggcacgcgag

SEQ ID NO: 3101802 - RNA, 22 nt, Molluscum contagiosum virus
ucgaaaaggcugauccugcgcg

SEQ ID NO: 3101803 - RNA, 23 nt, Molluscum contagiosum virus
ucgaaaaggcugauccugcgcgu

SEQ ID NO: 3101804 - RNA, 19 nt, Molluscum contagiosum virus
ucgacaagaucaaggucac

SEQ ID NO: 3101805 - RNA, 13 nt, Molluscum contagiosum virus
ucgacagcgugcg

SEQ ID NO: 3101806 - RNA, 18 nt, Molluscum contagiosum virus
ucgaccaaaugcgcgugc

SEQ ID NO: 3101807 - RNA, 19 nt, Molluscum contagiosum virus
ucgacccguaccccgaggg

SEQ ID NO: 3101808 - RNA, 17 nt, Molluscum contagiosum virus
ucgacccuucgcgcgcg

SEQ ID NO: 3101809 - RNA, 15 nt, Molluscum contagiosum virus
ucccucgucgcgcuu

SEQ ID NO: 3101810 - RNA, 14 nt, Molluscum contagiosum virus
ucccgucgagcacg

SEQ ID NO: 3101811 - RNA, 19 nt, Molluscum contagiosum virus
uccgaccucuuuccgcgcu

SEQ ID NO: 3101812 - RNA, 16 nt, Molluscum contagiosum virus
uccgacccggcucgcu

SEQ ID NO: 3101813 - RNA, 18 nt, Molluscum contagiosum virus
ucccgcgccacgagcgcc

SEQ ID NO: 3101814 - RNA, 17 nt, Molluscum contagiosum virus
ucccgcuggcggcacgu

SEQ ID NO: 3101815 - RNA, 12 nt, Molluscum contagiosum virus
uugugcucgcuu

SEQ ID NO: 3101816 - RNA, 17 nt, Molluscum contagiosum virus
ucguggccguagugcuc

SEQ ID NO: 3101817 - RNA, 21 nt, Molluscum contagiosum virus
ucguggcguugcugcugcgcg

SEQ ID NO: 3101818 - RNA, 20 nt, Molluscum contagiosum virus
ucgugggauaggcacacacg

SEQ ID NO: 3101819 - RNA, 16 nt, Molluscum contagiosum virus
ucgugcccgcacacgc

SEQ ID NO: 3101820 - RNA, 17 nt, Molluscum contagiosum virus
ucgugcccgcacacgca

SEQ ID NO: 3101821 - RNA, 20 nt, Molluscum contagiosum virus
ucgugccgccugcgcgcacc

SEQ ID NO: 3101822 - RNA, 21 nt, Molluscum contagiosum virus
ucgugccugucggcacaucuc

SEQ ID NO: 3101823 - RNA, 16 nt, Molluscum contagiosum virus
ucgugccugucucgca

SEQ ID NO: 3101824 - RNA, 20 nt, Molluscum contagiosum virus
ucgugccuuuugcgcgcugc

SEQ ID NO: 3101825 - RNA, 12 nt, Molluscum contagiosum virus
ucgugcgcgacu

SEQ ID NO: 3101826 - RNA, 23 nt, Molluscum contagiosum virus
ucgugcgcgacuuggggcucgcc

SEQ ID NO: 3101827 - RNA, 21 nt, Molluscum contagiosum virus
ucguggaggaaacacccgcgc

SEQ ID NO: 3101828 - RNA, 18 nt, Molluscum contagiosum virus
ucguggaucgcgcgcacc

SEQ ID NO: 3101829 - RNA, 18 nt, Molluscum contagiosum virus
ucguggccaacuucgcgg

SEQ ID NO: 3101830 - RNA, 17 nt, Molluscum contagiosum virus
ucgugcuccacgcgcag

SEQ ID NO: 3101831 - RNA, 21 nt, Molluscum contagiosum virus
ucgugcucguguguccgcacg

SEQ ID NO: 3101832 - RNA, 22 nt, Molluscum contagiosum virus
ucgugcucguguguccgcacgc

SEQ ID NO: 3101833 - RNA, 21 nt, Molluscum contagiosum virus
uuugcgagcacuguacgcacg

SEQ ID NO: 3101834 - RNA, 15 nt, Molluscum contagiosum virus
uuucguacgcggagg

SEQ ID NO: 3101835 - RNA, 15 nt, Molluscum contagiosum virus
uuucguccgccgcuc

SEQ ID NO: 3101836 - RNA, 15 nt, Molluscum contagiosum virus
ucgucaaugcgcacg

SEQ ID NO: 3101837 - RNA, 14 nt, Molluscum contagiosum virus
ucgucacgcuagcg

SEQ ID NO: 3101838 - RNA, 17 nt, Molluscum contagiosum virus
ucgucacggccuucgcg

SEQ ID NO: 3101839 - RNA, 15 nt, Molluscum contagiosum virus
ucgucccgcgcuccg

SEQ ID NO: 3101840 - RNA, 15 nt, Molluscum contagiosum virus
ucguaguccagcgcg

SEQ ID NO: 3101841 - RNA, 13 nt, Molluscum contagiosum virus
ucguccgcucgug

SEQ ID NO: 3101842 - RNA, 16 nt, Molluscum contagiosum virus
ucguccggcgcucgcc

SEQ ID NO: 3101843 - RNA, 22 nt, Molluscum contagiosum virus
ucgucgaucgccucgacgcugg

SEQ ID NO: 3101844 - RNA, 21 nt, Molluscum contagiosum virus
ucgucuccgggggcgcgcugg

SEQ ID NO: 3101845 - RNA, 16 nt, Molluscum contagiosum virus
ucgucugcgucucgcg

SEQ ID NO: 3101846 - RNA, 20 nt, Molluscum contagiosum virus
ucgucuuugcgaacgcgcaa

SEQ ID NO: 3101847 - RNA, 21 nt, Molluscum contagiosum virus
ucgugcaaagcaucgacgugc

SEQ ID NO: 3101848 - RNA, 19 nt, Molluscum contagiosum virus
ucgugcaauggcaggugcg

SEQ ID NO: 3101849 - RNA, 17 nt, Molluscum contagiosum virus
ucgugcaccacgugcuc

SEQ ID NO: 3101850 - RNA, 22 nt, Molluscum contagiosum virus
ucggugccagauugccggcgcg

SEQ ID NO: 3101851 - RNA, 16 nt, Molluscum contagiosum virus
ucggugcucaugcgcg

SEQ ID NO: 3101852 - RNA, 14 nt, Molluscum contagiosum virus
ucggugggcucgcg

SEQ ID NO: 3101853 - RNA, 20 nt, Molluscum contagiosum virus
ucguaaaagacgcgcucgcg

SEQ ID NO: 3101854 - RNA, 23 nt, Molluscum contagiosum virus
ucgggcuagcaagcacgccaggu

SEQ ID NO: 3101855 - RNA, 13 nt, Molluscum contagiosum virus
ucgggcugcgcgg

SEQ ID NO: 3101856 - RNA, 22 nt, Molluscum contagiosum virus
ucggggcagggaaagagcacgc

SEQ ID NO: 3101857 - RNA, 16 nt, Molluscum contagiosum virus
ucggguacacgugcuu

SEQ ID NO: 3101858 - RNA, 15 nt, Molluscum contagiosum virus
ucggggcugacggcc

SEQ ID NO: 3101859 - RNA, 20 nt, Molluscum contagiosum virus
ucgagaugcucuacgugcug

SEQ ID NO: 3101860 - RNA, 16 nt, Molluscum contagiosum virus
ucgagcaccugucgcg

SEQ ID NO: 3101861 - RNA, 19 nt, Molluscum contagiosum virus
ucgagcaccugucgcgcga

SEQ ID NO: 3101862 - RNA, 14 nt, Molluscum contagiosum virus
ucgagcacgcgcga

SEQ ID NO: 3101863 - RNA, 15 nt, Molluscum contagiosum virus
ucgagcacgcgcgag

SEQ ID NO: 3101864 - RNA, 20 nt, Molluscum contagiosum virus
ucgagcagauucacgagcuc

SEQ ID NO: 3101865 - RNA, 15 nt, Molluscum contagiosum virus
ucgggccccugcgcg

SEQ ID NO: 3101866 - RNA, 16 nt, Molluscum contagiosum virus
ucgggccccugcgcga

SEQ ID NO: 3101867 - RNA, 19 nt, Molluscum contagiosum virus
ucgggccgcugccgucgcg

SEQ ID NO: 3101868 - RNA, 20 nt, Molluscum contagiosum virus
ucgggcgccaacacgagcgc

SEQ ID NO: 3101869 - RNA, 13 nt, Molluscum contagiosum virus
ucgagaccucgcg

SEQ ID NO: 3101870 - RNA, 19 nt, Molluscum contagiosum virus
ucgagaccucgcgcuuccg

SEQ ID NO: 3101871 - RNA, 15 nt, Molluscum contagiosum virus
ucgagacgcugcgcg

SEQ ID NO: 3101872 - RNA, 20 nt, Molluscum contagiosum virus
ucgagaagacggggcgcacg

SEQ ID NO: 3101873 - RNA, 21 nt, Molluscum contagiosum virus
ucgagaagacggggcgcacgc

SEQ ID NO: 3101874 - RNA, 18 nt, Molluscum contagiosum virus
ucgagaccacgcgcgcug

SEQ ID NO: 3101875 - RNA, 19 nt, Molluscum contagiosum virus
ucgagaccacgcgcgcugc

SEQ ID NO: 3101876 - RNA, 18 nt, Molluscum contagiosum virus
ucgacggcuucauccgcg

SEQ ID NO: 3101877 - RNA, 20 nt, Molluscum contagiosum virus
ucgacggcuucauccgcgcg

SEQ ID NO: 3101878 - RNA, 22 nt, Molluscum contagiosum virus
ucgacgacgaugacaucuggag

SEQ ID NO: 3101879 - RNA, 13 nt, Molluscum contagiosum virus
uccugcggcgcug

SEQ ID NO: 3101880 - RNA, 20 nt, Molluscum contagiosum virus
ucgacgggaacgaggucauc

SEQ ID NO: 3101881 - RNA, 13 nt, Molluscum contagiosum virus
ucgacgggcgcag

SEQ ID NO: 3101882 - RNA, 17 nt, Molluscum contagiosum virus
ucgacgugaucgcgcag

SEQ ID NO: 3101883 - RNA, 15 nt, Molluscum contagiosum virus
ucgacgugcagacgc

SEQ ID NO: 3101884 - RNA, 12 nt, Molluscum contagiosum virus
ucgacguggacc

SEQ ID NO: 3101885 - RNA, 21 nt, Molluscum contagiosum virus
ucgacgugguacuggcgcccg

SEQ ID NO: 3101886 - RNA, 15 nt, Molluscum contagiosum virus
ucgacuacacgcgcu

SEQ ID NO: 3101887 - RNA, 17 nt, Molluscum contagiosum virus
ccgguggcgcgcgagcu

SEQ ID NO: 3101888 - RNA, 21 nt, Molluscum contagiosum virus
ccguaccccgagggcgcgacc

SEQ ID NO: 3101889 - RNA, 22 nt, Molluscum contagiosum virus
ccguaccccgagggcgcgaccg

SEQ ID NO: 3101890 - RNA, 14 nt, Molluscum contagiosum virus
ccguaccgcgcccg

SEQ ID NO: 3101891 - RNA, 21 nt, Molluscum contagiosum virus
ccguacgcaacuugugcgccc

SEQ ID NO: 3101892 - RNA, 15 nt, Molluscum contagiosum virus
ccguacucgcguccg

SEQ ID NO: 3101893 - RNA, 21 nt, Molluscum contagiosum virus
ccguaggcgggccugcgcccg

SEQ ID NO: 3101894 - RNA, 21 nt, Molluscum contagiosum virus
ccguagugcucaucgugcccg

SEQ ID NO: 3101895 - RNA, 19 nt, Molluscum contagiosum virus
ccguccgccucgagcacgc

SEQ ID NO: 3101896 - RNA, 12 nt, Molluscum contagiosum virus
ccgucucgcgcu

SEQ ID NO: 3101897 - RNA, 12 nt, Molluscum contagiosum virus
ccgugagcgcgc

SEQ ID NO: 3101898 - RNA, 19 nt, Molluscum contagiosum virus
ccgucuuugcggacgcgcg

SEQ ID NO: 3101899 - RNA, 13 nt, Molluscum contagiosum virus
ccgugaacucgac

SEQ ID NO: 3101900 - RNA, 15 nt, Molluscum contagiosum virus
ccgucgccgcgcccg

SEQ ID NO: 3101901 - RNA, 12 nt, Molluscum contagiosum virus
ccgucgcgagcu

SEQ ID NO: 3101902 - RNA, 13 nt, Molluscum contagiosum virus
ccgucgcgcucga

SEQ ID NO: 3101903 - RNA, 14 nt, Molluscum contagiosum virus
ccgucgucgccgcc

SEQ ID NO: 3101904 - RNA, 13 nt, Molluscum contagiosum virus
ccgucgucgccgu

SEQ ID NO: 3101905 - RNA, 22 nt, Molluscum contagiosum virus
ccgguacguacagugcgcgcac

SEQ ID NO: 3101906 - RNA, 16 nt, Molluscum contagiosum virus
ccggucaccgcguccg

SEQ ID NO: 3101907 - RNA, 13 nt, Molluscum contagiosum virus
ccggugcucgccc

SEQ ID NO: 3101908 - RNA, 17 nt, Molluscum contagiosum virus
ccgguggaagagcccgc

SEQ ID NO: 3101909 - RNA, 22 nt, Molluscum contagiosum virus
ccgugcugcggcaaccgcgccc

SEQ ID NO: 3101910 - RNA, 23 nt, Molluscum contagiosum virus
ccgugcugcggcaaccgcgcccg

SEQ ID NO: 3101911 - RNA, 16 nt, Molluscum contagiosum virus
cgcgcaauagcgcccg

SEQ ID NO: 3101912 - RNA, 17 nt, Molluscum contagiosum virus
cgcgcaauagcgcccgu

SEQ ID NO: 3101913 - RNA, 12 nt, Molluscum contagiosum virus
cgcgcacaagau

SEQ ID NO: 3101914 - RNA, 13 nt, Molluscum contagiosum virus
cgcgcacacgcug

SEQ ID NO: 3101915 - RNA, 14 nt, Molluscum contagiosum virus
cgcgcacacgcuga

SEQ ID NO: 3101916 - RNA, 20 nt, Molluscum contagiosum virus
cgcgcacaucggcacugcuc

SEQ ID NO: 3101917 - RNA, 13 nt, Molluscum contagiosum virus
ccgugcccgagcc

SEQ ID NO: 3101918 - RNA, 15 nt, Molluscum contagiosum virus
ccgugcccgagcccg

SEQ ID NO: 3101919 - RNA, 17 nt, Molluscum contagiosum virus
ccgugccgccggcgccg

SEQ ID NO: 3101920 - RNA, 19 nt, Molluscum contagiosum virus
ccgugccgccggcgccgcu

SEQ ID NO: 3101921 - RNA, 11 nt, Molluscum contagiosum virus
ccgugcgagcu

SEQ ID NO: 3101922 - RNA, 14 nt, Molluscum contagiosum virus
cgcgcaucugccgc

SEQ ID NO: 3101923 - RNA, 17 nt, Molluscum contagiosum virus
cgcgcaucugccgcgac

SEQ ID NO: 3101924 - RNA, 16 nt, Molluscum contagiosum virus
cgcgcaugaggcggcg

SEQ ID NO: 3101925 - RNA, 15 nt, Molluscum contagiosum virus
cgcgcaugcucgcgc

SEQ ID NO: 3101926 - RNA, 18 nt, Molluscum contagiosum virus
cgcgcauggagagcguac

SEQ ID NO: 3101927 - RNA, 22 nt, Molluscum contagiosum virus
cgcgccaacacguuuucuuuca

SEQ ID NO: 3101928 - RNA, 21 nt, Molluscum contagiosum virus
cgcgccaacgacuagcgugcg

SEQ ID NO: 3101929 - RNA, 14 nt, Molluscum contagiosum virus
cgcgcaucgcgggc

SEQ ID NO: 3101930 - RNA, 22 nt, Molluscum contagiosum virus
cgcgcaucggcggcagcgccag

SEQ ID NO: 3101931 - RNA, 22 nt, Molluscum contagiosum virus
cgcgccauggcgagcuagugca

SEQ ID NO: 3101932 - RNA, 22 nt, Molluscum contagiosum virus
cgcgccaugguuuccguguccg

SEQ ID NO: 3101933 - RNA, 18 nt, Molluscum contagiosum virus
cgcgcccaagaagaagca

SEQ ID NO: 3101934 - RNA, 19 nt, Molluscum contagiosum virus
cgcgcccaaggccgcgggc

SEQ ID NO: 3101935 - RNA, 17 nt, Molluscum contagiosum virus
cgcgcccaccagcagcc

SEQ ID NO: 3101936 - RNA, 17 nt, Molluscum contagiosum virus
cgcgcccagcgccacga

SEQ ID NO: 3101937 - RNA, 22 nt, Molluscum contagiosum virus
cgcgccagcacgcgcucguccg

SEQ ID NO: 3101938 - RNA, 14 nt, Molluscum contagiosum virus
cgcgccagcagcgc

SEQ ID NO: 3101939 - RNA, 15 nt, Molluscum contagiosum virus
cgcgccagcaguccg

SEQ ID NO: 3101940 - RNA, 13 nt, Molluscum contagiosum virus
cgcgccagcgaca

SEQ ID NO: 3101941 - RNA, 16 nt, Molluscum contagiosum virus
cgcgcacgagcgcggg

SEQ ID NO: 3101942 - RNA, 17 nt, Molluscum contagiosum virus
cgcgcacgagcgcgggc

SEQ ID NO: 3101943 - RNA, 14 nt, Molluscum contagiosum virus
cgcgcacgcgcacg

SEQ ID NO: 3101944 - RNA, 14 nt, Molluscum contagiosum virus
cgcgcacgcgcgac

SEQ ID NO: 3101945 - RNA, 15 nt, Molluscum contagiosum virus
cgcgcacgcgcgagc

SEQ ID NO: 3101946 - RNA, 13 nt, Molluscum contagiosum virus
cgcgcacgcgcgc

SEQ ID NO: 3101947 - RNA, 13 nt, Molluscum contagiosum virus
cgcgcacgcggcg

SEQ ID NO: 3101948 - RNA, 14 nt, Molluscum contagiosum virus
cgcgcacgcggcgc

SEQ ID NO: 3101949 - RNA, 16 nt, Molluscum contagiosum virus
cgcgcacgcugcgcac

SEQ ID NO: 3101950 - RNA, 22 nt, Molluscum contagiosum virus
cgcgcacguaccuucgcggagc

SEQ ID NO: 3101951 - RNA, 17 nt, Molluscum contagiosum virus
cgcgcacugccacgcgg

SEQ ID NO: 3101952 - RNA, 20 nt, Molluscum contagiosum virus
cgcgcacugccacgcggagc

SEQ ID NO: 3101953 - RNA, 14 nt, Molluscum contagiosum virus
cgcgcacugcucgc

SEQ ID NO: 3101954 - RNA, 16 nt, Molluscum contagiosum virus
cgcgcacugcucgcgc

SEQ ID NO: 3101955 - RNA, 19 nt, Molluscum contagiosum virus
cgcgcacugcucgcgcacg

SEQ ID NO: 3101956 - RNA, 13 nt, Molluscum contagiosum virus
cgcgcagaagcca

SEQ ID NO: 3101957 - RNA, 20 nt, Molluscum contagiosum virus
cgcgcagaagccaacacgca

SEQ ID NO: 3101958 - RNA, 21 nt, Molluscum contagiosum virus
cgcgcagacguggugcucgug

SEQ ID NO: 3101959 - RNA, 21 nt, Molluscum contagiosum virus
cgcgcagcacaccgucgcgug

SEQ ID NO: 3101960 - RNA, 13 nt, Molluscum contagiosum virus
cgcgcagcgcccg

SEQ ID NO: 3101961 - RNA, 15 nt, Molluscum contagiosum virus
cgcgcagcgcgucuu

SEQ ID NO: 3101962 - RNA, 13 nt, Molluscum contagiosum virus
cgcgcagcgugcc

SEQ ID NO: 3101963 - RNA, 15 nt, Molluscum contagiosum virus
cgcgcagcucgacgc

SEQ ID NO: 3101964 - RNA, 21 nt, Molluscum contagiosum virus
cgcgcagcucgccgcgcgccg

SEQ ID NO: 3101965 - RNA, 14 nt, Molluscum contagiosum virus
cgcgcagcugcgcc

SEQ ID NO: 3101966 - RNA, 17 nt, Molluscum contagiosum virus
cgcgcaggcgcgccaug

SEQ ID NO: 3101967 - RNA, 14 nt, Molluscum contagiosum virus
cgcgcaggcucgca

SEQ ID NO: 3101968 - RNA, 24 nt, Molluscum contagiosum virus
cgcgcagguugagcgcgcggaugc

SEQ ID NO: 3101969 - RNA, 22 nt, Molluscum contagiosum virus
cgcgcaguucgagcugcugcgc

SEQ ID NO: 3101970 - RNA, 14 nt, Molluscum contagiosum virus
cgcgcaguugugcg

SEQ ID NO: 3101971 - RNA, 15 nt, Molluscum contagiosum virus
cgcgcauacgcgccg

SEQ ID NO: 3101972 - RNA, 19 nt, Molluscum contagiosum virus
cgcgcauacgcgccgcgcg

SEQ ID NO: 3101973 - RNA, 20 nt, Molluscum contagiosum virus
cgcgcauacgcgccgcgcgc

SEQ ID NO: 3101974 - RNA, 12 nt, Molluscum contagiosum virus
cgcgcccucgcg

SEQ ID NO: 3101975 - RNA, 14 nt, Molluscum contagiosum virus
cgcgccgcgccgaa

SEQ ID NO: 3101976 - RNA, 14 nt, Molluscum contagiosum virus
cgcgccgcgcgccg

SEQ ID NO: 3101977 - RNA, 15 nt, Molluscum contagiosum virus
cgcgccgcgcugcug

SEQ ID NO: 3101978 - RNA, 12 nt, Molluscum contagiosum virus
cgcgccgcggcg

SEQ ID NO: 3101979 - RNA, 12 nt, Molluscum contagiosum virus
cgcgccgcgggc

SEQ ID NO: 3101980 - RNA, 20 nt, Molluscum contagiosum virus
cgcgccgcugcccgcgcacg

SEQ ID NO: 3101981 - RNA, 20 nt, Molluscum contagiosum virus
cgcgccgcugucacgcgagc

SEQ ID NO: 3101982 - RNA, 14 nt, Molluscum contagiosum virus
cgcgccggccagcg

SEQ ID NO: 3101983 - RNA, 21 nt, Molluscum contagiosum virus
cgcgccggccagcgagucucg

SEQ ID NO: 3101984 - RNA, 19 nt, Molluscum contagiosum virus
cgcgccggcccgagcguca

SEQ ID NO: 3101985 - RNA, 15 nt, Molluscum contagiosum virus
cgcgccggcgcggcg

SEQ ID NO: 3101986 - RNA, 20 nt, Molluscum contagiosum virus
cgcgccggcguucgcggagc

SEQ ID NO: 3101987 - RNA, 17 nt, Molluscum contagiosum virus
cgcgccgggaaugcugc

SEQ ID NO: 3101988 - RNA, 22 nt, Molluscum contagiosum virus
cgcgccgggaaugcugcgcacg

SEQ ID NO: 3101989 - RNA, 23 nt, Molluscum contagiosum virus
cgcgccgggaaugcugcgcacgc

SEQ ID NO: 3101990 - RNA, 13 nt, Molluscum contagiosum virus
cgcgccgggcgcc

SEQ ID NO: 3101991 - RNA, 15 nt, Molluscum contagiosum virus
cgcgccgggcgccag

SEQ ID NO: 3101992 - RNA, 13 nt, Molluscum contagiosum virus
cgcgcccugcacg

SEQ ID NO: 3101993 - RNA, 22 nt, Molluscum contagiosum virus
cgcgcccugcacgaccgcggac

SEQ ID NO: 3101994 - RNA, 14 nt, Molluscum contagiosum virus
cgcgcccugcgcgc

SEQ ID NO: 3101995 - RNA, 20 nt, Molluscum contagiosum virus
cgcgcccugcgcgcgagagc

SEQ ID NO: 3101996 - RNA, 19 nt, Molluscum contagiosum virus
cgcgcccuugcacucgacc

SEQ ID NO: 3101997 - RNA, 18 nt, Molluscum contagiosum virus
cgcgcccuuugcggcacg

SEQ ID NO: 3101998 - RNA, 19 nt, Molluscum contagiosum virus
cgcgccgaggacgcgcccg

SEQ ID NO: 3101999 - RNA, 21 nt, Molluscum contagiosum virus
cgcgccgaggacuaccuggcg

SEQ ID NO: 3102000 - RNA, 11 nt, Molluscum contagiosum virus
cgcgccgagua

SEQ ID NO: 3102001 - RNA, 17 nt, Molluscum contagiosum virus
cgcgccgaguacugcug

SEQ ID NO: 3102002 - RNA, 12 nt, Molluscum contagiosum virus
cgcgccgcaaac

SEQ ID NO: 3102003 - RNA, 16 nt, Molluscum contagiosum virus
cgcgccgcacgugcug

SEQ ID NO: 3102004 - RNA, 12 nt, Molluscum contagiosum virus
cgcgcccgccgc

SEQ ID NO: 3102005 - RNA, 14 nt, Molluscum contagiosum virus
cgcgcccgcgcccg

SEQ ID NO: 3102006 - RNA, 17 nt, Molluscum contagiosum virus
cgcgcccgcggcgcacg

SEQ ID NO: 3102007 - RNA, 13 nt, Molluscum contagiosum virus
cgcgcccgcgucg

SEQ ID NO: 3102008 - RNA, 22 nt, Molluscum contagiosum virus
cgcgcccgcgucgcgcgccgcg

SEQ ID NO: 3102009 - RNA, 15 nt, Molluscum contagiosum virus
cgcgcccgcugcgcg

SEQ ID NO: 3102010 - RNA, 15 nt, Molluscum contagiosum virus
cgcgcccggcgcccg

SEQ ID NO: 3102011 - RNA, 15 nt, Molluscum contagiosum virus
cgucgugcuccacgc

SEQ ID NO: 3102012 - RNA, 21 nt, Molluscum contagiosum virus
cgucguccggaggcacgggcu

SEQ ID NO: 3102013 - RNA, 14 nt, Molluscum contagiosum virus
cgucgucgucgucg

SEQ ID NO: 3102014 - RNA, 23 nt, Molluscum contagiosum virus
cgucguagcaaaugcgcugcucg

SEQ ID NO: 3102015 - RNA, 21 nt, Molluscum contagiosum virus
cgucggcuuggacagcaagca

SEQ ID NO: 3102016 - RNA, 17 nt, Molluscum contagiosum virus
cgucgggaaguguugcc

SEQ ID NO: 3102017 - RNA, 23 nt, Molluscum contagiosum virus
cgucggcggcaugcgcgcgcagc

SEQ ID NO: 3102018 - RNA, 16 nt, Molluscum contagiosum virus
cgcgccucgaacugcu

SEQ ID NO: 3102019 - RNA, 17 nt, Molluscum contagiosum virus
cgcgccucucgaggccg

SEQ ID NO: 3102020 - RNA, 20 nt, Molluscum contagiosum virus
cgcgccucucgaggccggca

SEQ ID NO: 3102021 - RNA, 14 nt, Molluscum contagiosum virus
cgcgccugcgcgag

SEQ ID NO: 3102022 - RNA, 15 nt, Molluscum contagiosum virus
cgcgccugcgcgagc

SEQ ID NO: 3102023 - RNA, 16 nt, Molluscum contagiosum virus
cgcgccugcgcgagca

SEQ ID NO: 3102024 - RNA, 13 nt, Molluscum contagiosum virus
cgcgccugcuggc

SEQ ID NO: 3102025 - RNA, 14 nt, Molluscum contagiosum virus
cgucgcgccgcucg

SEQ ID NO: 3102026 - RNA, 13 nt, Molluscum contagiosum virus
cgucgcgcgccgc

SEQ ID NO: 3102027 - RNA, 13 nt, Molluscum contagiosum virus
cgucgcgcgcucg

SEQ ID NO: 3102028 - RNA, 17 nt, Molluscum contagiosum virus
cgucgcggccacgcacu

SEQ ID NO: 3102029 - RNA, 17 nt, Molluscum contagiosum virus
cgucgcggucgcggagc

SEQ ID NO: 3102030 - RNA, 18 nt, Molluscum contagiosum virus
cgcgccgucucgcggggc

SEQ ID NO: 3102031 - RNA, 18 nt, Molluscum contagiosum virus
cgcgccgcgggcgcagag

SEQ ID NO: 3102032 - RNA, 15 nt, Molluscum contagiosum virus
cgcgccuaccgcgcg

SEQ ID NO: 3102033 - RNA, 20 nt, Molluscum contagiosum virus
gaggccuacgugcugcgcac

SEQ ID NO: 3102034 - RNA, 23 nt, Molluscum contagiosum virus
gaggcccugcuugcccgcgccgc

SEQ ID NO: 3102035 - RNA, 14 nt, Molluscum contagiosum virus
gaggccuucgcgcc

SEQ ID NO: 3102036 - RNA, 18 nt, Molluscum contagiosum virus
gaggcgcgcacgcugcgc

SEQ ID NO: 3102037 - RNA, 17 nt, Molluscum contagiosum virus
gaggcgcguccgcggcc

SEQ ID NO: 3102038 - RNA, 19 nt, Molluscum contagiosum virus
gaggcgcuaccucgcggga

SEQ ID NO: 3102039 - RNA, 14 nt, Molluscum contagiosum virus
gaggcgcugccgcg

SEQ ID NO: 3102040 - RNA, 20 nt, Molluscum contagiosum virus
gaggcgcugccgcgggacga

SEQ ID NO: 3102041 - RNA, 19 nt, Molluscum contagiosum virus
gaggcggagcugcccgcga

SEQ ID NO: 3102042 - RNA, 21 nt, Molluscum contagiosum virus
gaggcguacuccguggugcgc

SEQ ID NO: 3102043 - RNA, 18 nt, Molluscum contagiosum virus
gaggcguccugcgggagc

SEQ ID NO: 3102044 - RNA, 17 nt, Molluscum contagiosum virus
gaggcucgagcgcgcgc

SEQ ID NO: 3102045 - RNA, 16 nt, Molluscum contagiosum virus
gaggcucucgagcacu

SEQ ID NO: 3102046 - RNA, 14 nt, Molluscum contagiosum virus
gauguucucgccag

SEQ ID NO: 3102047 - RNA, 14 nt, Molluscum contagiosum virus
gauuucgcgcagca

SEQ ID NO: 3102048 - RNA, 15 nt, Molluscum contagiosum virus
gauugcccgcgcgcg

SEQ ID NO: 3102049 - RNA, 16 nt, Molluscum contagiosum virus
gcaacaaaagagcgcg

SEQ ID NO: 3102050 - RNA, 16 nt, Molluscum contagiosum virus
gcaaccccgcgcugcg

SEQ ID NO: 3102051 - RNA, 19 nt, Molluscum contagiosum virus
gcaaaugccgagcgcacgc

SEQ ID NO: 3102052 - RNA, 20 nt, Molluscum contagiosum virus
gcaaaugccgagcgcacgcc

SEQ ID NO: 3102053 - RNA, 13 nt, Molluscum contagiosum virus
gcaaaugcgcugc

SEQ ID NO: 3102054 - RNA, 18 nt, Molluscum contagiosum virus
gcaacgagcacgugugcg

SEQ ID NO: 3102055 - RNA, 20 nt, Molluscum contagiosum virus
gcaacgagcagcccgugcgc

SEQ ID NO: 3102056 - RNA, 22 nt, Molluscum contagiosum virus
gcaacgcaaacgcacgcgcgcg

SEQ ID NO: 3102057 - RNA, 16 nt, Molluscum contagiosum virus
gcaacggcggcgcaag

SEQ ID NO: 3102058 - RNA, 12 nt, Molluscum contagiosum virus
gcaacguggcgc

SEQ ID NO: 3102059 - RNA, 15 nt, Molluscum contagiosum virus
gcaacguggcgccgc

SEQ ID NO: 3102060 - RNA, 18 nt, Molluscum contagiosum virus
gcaacguugugcgcaacg

SEQ ID NO: 3102061 - RNA, 14 nt, Molluscum contagiosum virus
gcaacucgcgcugc

SEQ ID NO: 3102062 - RNA, 14 nt, Molluscum contagiosum virus
gcaaaagcgcucgc

SEQ ID NO: 3102063 - RNA, 19 nt, Molluscum contagiosum virus
gcaaacauguagcgcgcgc

SEQ ID NO: 3102064 - RNA, 15 nt, Molluscum contagiosum virus
gcaaacgcacgcgcg

SEQ ID NO: 3102065 - RNA, 11 nt, Molluscum contagiosum virus
gcaaacgcuga

SEQ ID NO: 3102066 - RNA, 18 nt, Molluscum contagiosum virus
gcaaacgcugacggcgcu

SEQ ID NO: 3102067 - RNA, 21 nt, Molluscum contagiosum virus
gcaaacgcugacggcgcugcg

SEQ ID NO: 3102068 - RNA, 23 nt, Molluscum contagiosum virus
gcaaacgcuguuuucacgcaagg

SEQ ID NO: 3102069 - RNA, 15 nt, Molluscum contagiosum virus
gcaaagccugcugcg

SEQ ID NO: 3102070 - RNA, 18 nt, Molluscum contagiosum virus
gcaaagccugcugcgcgc

SEQ ID NO: 3102071 - RNA, 20 nt, Molluscum contagiosum virus
gcaaagccugcugcgcgcgc

SEQ ID NO: 3102072 - RNA, 18 nt, Molluscum contagiosum virus
gcaaagcggggcgcgcgc

SEQ ID NO: 3102073 - RNA, 22 nt, Molluscum contagiosum virus
gcaaaggaguuggcgcgcaagc

SEQ ID NO: 3102074 - RNA, 19 nt, Molluscum contagiosum virus
gcaaaggcccgcgagcacg

SEQ ID NO: 3102075 - RNA, 19 nt, Molluscum contagiosum virus
gcaaaguucucgcguucgc

SEQ ID NO: 3102076 - RNA, 21 nt, Molluscum contagiosum virus
cuauguaaagaaacgcgcccg

SEQ ID NO: 3102077 - RNA, 17 nt, Molluscum contagiosum virus
gagcucuuccccgcggg

SEQ ID NO: 3102078 - RNA, 21 nt, Molluscum contagiosum virus
gagcucuucgacagcgugcgc

SEQ ID NO: 3102079 - RNA, 18 nt, Molluscum contagiosum virus
gagcuggagcgagugcgc

SEQ ID NO: 3102080 - RNA, 20 nt, Molluscum contagiosum virus
gagcuggccgaagucgcagc

SEQ ID NO: 3102081 - RNA, 15 nt, Molluscum contagiosum virus
gagcuggcugggcac

SEQ ID NO: 3102082 - RNA, 23 nt, Molluscum contagiosum virus
gagcugggauaacaggcgugcgc

SEQ ID NO: 3102083 - RNA, 22 nt, Molluscum contagiosum virus
gagcuguucaacaucguggcgc

SEQ ID NO: 3102084 - RNA, 14 nt, Molluscum contagiosum virus
gagcugcgcgcgcu

SEQ ID NO: 3102085 - RNA, 14 nt, Molluscum contagiosum virus
gagcugcgugugcc

SEQ ID NO: 3102086 - RNA, 20 nt, Molluscum contagiosum virus
gagcugcuaacaacaugagg

SEQ ID NO: 3102087 - RNA, 15 nt, Molluscum contagiosum virus
cuacgucaagcaggc

SEQ ID NO: 3102088 - RNA, 15 nt, Molluscum contagiosum virus
cuacguuccgcgcgg

SEQ ID NO: 3102089 - RNA, 17 nt, Molluscum contagiosum virus
cuacuucgaggccggca

SEQ ID NO: 3102090 - RNA, 22 nt, Molluscum contagiosum virus
cuagccgccgcugccgcgcgcg

SEQ ID NO: 3102091 - RNA, 16 nt, Molluscum contagiosum virus
cuagccgugcgcgcac

SEQ ID NO: 3102092 - RNA, 20 nt, Molluscum contagiosum virus
cuagccugugcccuggaagc

SEQ ID NO: 3102093 - RNA, 16 nt, Molluscum contagiosum virus
cuagcgugcgcagcau

SEQ ID NO: 3102094 - RNA, 14 nt, Molluscum contagiosum virus
cuagcucugcgcgc

SEQ ID NO: 3102095 - RNA, 16 nt, Molluscum contagiosum virus
cuagcucugcgcgcgg

SEQ ID NO: 3102096 - RNA, 23 nt, Molluscum contagiosum virus
cuagcugugcgcuacguggcgcg

SEQ ID NO: 3102097 - RNA, 22 nt, Molluscum contagiosum virus
gaggacgagccccgcgccggcg

SEQ ID NO: 3102098 - RNA, 12 nt, Molluscum contagiosum virus
gaggacgcgggc

SEQ ID NO: 3102099 - RNA, 21 nt, Molluscum contagiosum virus
gaggacgcgggcguguccgcg

SEQ ID NO: 3102100 - RNA, 22 nt, Molluscum contagiosum virus
gaggacgcgggcguguccgcgg

SEQ ID NO: 3102101 - RNA, 15 nt, Molluscum contagiosum virus
gaggacggcgcgggc

SEQ ID NO: 3102102 - RNA, 17 nt, Molluscum contagiosum virus
gaggacggcgcgggcgc

SEQ ID NO: 3102103 - RNA, 15 nt, Molluscum contagiosum virus
gaggacggcgugcgc

SEQ ID NO: 3102104 - RNA, 18 nt, Molluscum contagiosum virus
gaggacuaccuggcggcg

SEQ ID NO: 3102105 - RNA, 19 nt, Molluscum contagiosum virus
gaggacuaccuggcggcgc

SEQ ID NO: 3102106 - RNA, 16 nt, Molluscum contagiosum virus
gaggacuuccgcgcgc

SEQ ID NO: 3102107 - RNA, 13 nt, Molluscum contagiosum virus
gaggacacgcgca

SEQ ID NO: 3102108 - RNA, 14 nt, Molluscum contagiosum virus
gagcuuugugcgac

SEQ ID NO: 3102109 - RNA, 18 nt, Molluscum contagiosum virus
gaggaaaagcacgcggcc

SEQ ID NO: 3102110 - RNA, 15 nt, Molluscum contagiosum virus
gagcugcugcgcuac

SEQ ID NO: 3102111 - RNA, 17 nt, Molluscum contagiosum virus
gagcugcuucgcgacca

SEQ ID NO: 3102112 - RNA, 17 nt, Molluscum contagiosum virus
gaggaccacgccgacca

SEQ ID NO: 3102113 - RNA, 15 nt, Molluscum contagiosum virus
gaggaccgcgagcgc

SEQ ID NO: 3102114 - RNA, 15 nt, Molluscum contagiosum virus
gaggaccucgcgcgc

SEQ ID NO: 3102115 - RNA, 14 nt, Molluscum contagiosum virus
gaggagccgcccgc

SEQ ID NO: 3102116 - RNA, 14 nt, Molluscum contagiosum virus
gaggagagcggcgc

SEQ ID NO: 3102117 - RNA, 16 nt, Molluscum contagiosum virus
gaggaggcgcccucgc

SEQ ID NO: 3102118 - RNA, 16 nt, Molluscum contagiosum virus
gaggcacucgucgcgc

SEQ ID NO: 3102119 - RNA, 16 nt, Molluscum contagiosum virus
gaggcagccgcggcgc

SEQ ID NO: 3102120 - RNA, 20 nt, Molluscum contagiosum virus
gaggcagugcuugagcaucu

SEQ ID NO: 3102121 - RNA, 17 nt, Molluscum contagiosum virus
gaggcaugucgcggugc

SEQ ID NO: 3102122 - RNA, 20 nt, Molluscum contagiosum virus
cgucuugacaggcgcgcaag

SEQ ID NO: 3102123 - RNA, 21 nt, Molluscum contagiosum virus
cgucuugacaggcgcgcaagu

SEQ ID NO: 3102124 - RNA, 20 nt, Molluscum contagiosum virus
cgucuuugcgaacgcgcaag

SEQ ID NO: 3102125 - RNA, 20 nt, Molluscum contagiosum virus
cgucuuugcggacgcgcgag

SEQ ID NO: 3102126 - RNA, 15 nt, Molluscum contagiosum virus
cgucuccaacaagcu

SEQ ID NO: 3102127 - RNA, 19 nt, Molluscum contagiosum virus
cgucugcgaggcgcgcacg

SEQ ID NO: 3102128 - RNA, 13 nt, Molluscum contagiosum virus
cgucugcugcucg

SEQ ID NO: 3102129 - RNA, 22 nt, Molluscum contagiosum virus
cgucucgcggaagaauuccuuc

SEQ ID NO: 3102130 - RNA, 21 nt, Molluscum contagiosum virus
cgucucgcggggcaagcgcgc

SEQ ID NO: 3102131 - RNA, 15 nt, Molluscum contagiosum virus
cgugaauguacgcgg

SEQ ID NO: 3102132 - RNA, 20 nt, Molluscum contagiosum virus
cgugacaaucucugcgccgc

SEQ ID NO: 3102133 - RNA, 18 nt, Molluscum contagiosum virus
cgugacacuaccgucgcc

SEQ ID NO: 3102134 - RNA, 20 nt, Molluscum contagiosum virus
cgugacagagugccuggcgc

SEQ ID NO: 3102135 - RNA, 18 nt, Molluscum contagiosum virus
cgugagcucccgcgccac

SEQ ID NO: 3102136 - RNA, 23 nt, Molluscum contagiosum virus
cgugaggaagaccuuggacacgu

SEQ ID NO: 3102137 - RNA, 19 nt, Molluscum contagiosum virus
cgugacucggccgcggggc

SEQ ID NO: 3102138 - RNA, 19 nt, Molluscum contagiosum virus
cgugcacccuccgcacaga

SEQ ID NO: 3102139 - RNA, 17 nt, Molluscum contagiosum virus
cgugcaccucaagaaga

SEQ ID NO: 3102140 - RNA, 19 nt, Molluscum contagiosum virus
cgugcacguggcgcacacg

SEQ ID NO: 3102141 - RNA, 21 nt, Molluscum contagiosum virus
cgugcacguggcgcacacgga

SEQ ID NO: 3102142 - RNA, 16 nt, Molluscum contagiosum virus
cgugcagcggcgccac

SEQ ID NO: 3102143 - RNA, 17 nt, Molluscum contagiosum virus
cgugcagcggcgccacg

SEQ ID NO: 3102144 - RNA, 17 nt, Molluscum contagiosum virus
cgugcaggaacgcgcgc

SEQ ID NO: 3102145 - RNA, 20 nt, Molluscum contagiosum virus
cgugcaggaacgcgcgcucg

SEQ ID NO: 3102146 - RNA, 19 nt, Molluscum contagiosum virus
cgugcagggcgugcuugcc

SEQ ID NO: 3102147 - RNA, 16 nt, Molluscum contagiosum virus
cgugcaguuucuccuc

SEQ ID NO: 3102148 - RNA, 16 nt, Molluscum contagiosum virus
cgugcauggcacgcga

SEQ ID NO: 3102149 - RNA, 18 nt, Molluscum contagiosum virus
cgugcauggcacgcgagc

SEQ ID NO: 3102150 - RNA, 14 nt, Molluscum contagiosum virus
cgugcaagcccagc

SEQ ID NO: 3102151 - RNA, 21 nt, Molluscum contagiosum virus
cgugaucgcgcaggcgcgcca

SEQ ID NO: 3102152 - RNA, 16 nt, Molluscum contagiosum virus
cgugaugugcgcacag

SEQ ID NO: 3102153 - RNA, 15 nt, Molluscum contagiosum virus
cgugcaacaggagca

SEQ ID NO: 3102154 - RNA, 19 nt, Molluscum contagiosum virus
cgugcccacgagcgccagc

SEQ ID NO: 3102155 - RNA, 14 nt, Molluscum contagiosum virus
cgugccccgcgcgu

SEQ ID NO: 3102156 - RNA, 15 nt, Molluscum contagiosum virus
cgugcccgagcccgc

SEQ ID NO: 3102157 - RNA, 21 nt, Molluscum contagiosum virus
cgugcccgguacgcucgcgcu

SEQ ID NO: 3102158 - RNA, 18 nt, Molluscum contagiosum virus
cgugccacugccgccguu

SEQ ID NO: 3102159 - RNA, 16 nt, Molluscum contagiosum virus
cgugcgcagcagcucg

SEQ ID NO: 3102160 - RNA, 20 nt, Molluscum contagiosum virus
cgugcgcagcagcucggggc

SEQ ID NO: 3102161 - RNA, 16 nt, Molluscum contagiosum virus
cgugcgcaggagcagu

SEQ ID NO: 3102162 - RNA, 18 nt, Molluscum contagiosum virus
cgugcgcagugcugcgcg

SEQ ID NO: 3102163 - RNA, 13 nt, Molluscum contagiosum virus
cgugcgccgccgc

SEQ ID NO: 3102164 - RNA, 14 nt, Molluscum contagiosum virus
cgugcgagcggcgc

SEQ ID NO: 3102165 - RNA, 22 nt, Molluscum contagiosum virus
cgugcgagcggcgcgcgcugag

SEQ ID NO: 3102166 - RNA, 13 nt, Molluscum contagiosum virus
cgugccgccggcg

SEQ ID NO: 3102167 - RNA, 17 nt, Molluscum contagiosum virus
cgugccgccggcgccgc

SEQ ID NO: 3102168 - RNA, 15 nt, Molluscum contagiosum virus
cgugccgcugcgcgg

SEQ ID NO: 3102169 - RNA, 18 nt, Molluscum contagiosum virus
cgugccgcugcgcggagc

SEQ ID NO: 3102170 - RNA, 23 nt, Molluscum contagiosum virus
cgugccggaaauagcgcgcuagc

SEQ ID NO: 3102171 - RNA, 21 nt, Molluscum contagiosum virus
cgugccucugccagccgcucg

SEQ ID NO: 3102172 - RNA, 16 nt, Molluscum contagiosum virus
cuaccgcgcgcgcaag

SEQ ID NO: 3102173 - RNA, 14 nt, Molluscum contagiosum virus
cuaccgcgcgggag

SEQ ID NO: 3102174 - RNA, 17 nt, Molluscum contagiosum virus
cgugcugcagcugcgcg

SEQ ID NO: 3102175 - RNA, 23 nt, Molluscum contagiosum virus
cgugcugcggcaaccgcgcccgc

SEQ ID NO: 3102176 - RNA, 12 nt, Molluscum contagiosum virus
cgugcugcugcg

SEQ ID NO: 3102177 - RNA, 19 nt, Molluscum contagiosum virus
cgugcuggacgcgcacgcg

SEQ ID NO: 3102178 - RNA, 15 nt, Molluscum contagiosum virus
cgugcucugcuccgc

SEQ ID NO: 3102179 - RNA, 19 nt, Molluscum contagiosum virus
cgugcucugcuccgcggag

SEQ ID NO: 3102180 - RNA, 20 nt, Molluscum contagiosum virus
cgugcucugcuccgcggagg

SEQ ID NO: 3102181 - RNA, 12 nt, Molluscum contagiosum virus
cgugcgcgagcu

SEQ ID NO: 3102182 - RNA, 17 nt, Molluscum contagiosum virus
cgugcgcgcacacgacg

SEQ ID NO: 3102183 - RNA, 13 nt, Molluscum contagiosum virus
cgugcgcgccagg

SEQ ID NO: 3102184 - RNA, 15 nt, Molluscum contagiosum virus
cgugcgcgcugcgcg

SEQ ID NO: 3102185 - RNA, 14 nt, Molluscum contagiosum virus
cgugcgcugcgcgc

SEQ ID NO: 3102186 - RNA, 17 nt, Molluscum contagiosum virus
cgugcgcuggcccacgc

SEQ ID NO: 3102187 - RNA, 17 nt, Molluscum contagiosum virus
cgugcgggcgagcaugu

SEQ ID NO: 3102188 - RNA, 17 nt, Molluscum contagiosum virus
cgugcguacgugcacgu

SEQ ID NO: 3102189 - RNA, 17 nt, Molluscum contagiosum virus
cgugcguacucaacgcg

SEQ ID NO: 3102190 - RNA, 18 nt, Molluscum contagiosum virus
cgugcguacucaacgcga

SEQ ID NO: 3102191 - RNA, 14 nt, Molluscum contagiosum virus
cgugcgugcacagc

SEQ ID NO: 3102192 - RNA, 13 nt, Molluscum contagiosum virus
cgugcucacgcug

SEQ ID NO: 3102193 - RNA, 17 nt, Molluscum contagiosum virus
cgugcucacgcugcccg

SEQ ID NO: 3102194 - RNA, 15 nt, Molluscum contagiosum virus
cgugcucaggccagc

SEQ ID NO: 3102195 - RNA, 19 nt, Molluscum contagiosum virus
cgugcucaggccagcaucu

SEQ ID NO: 3102196 - RNA, 13 nt, Molluscum contagiosum virus
cgugcuccacgcg

SEQ ID NO: 3102197 - RNA, 16 nt, Molluscum contagiosum virus
cgugcuccacgcgcag

SEQ ID NO: 3102198 - RNA, 17 nt, Molluscum contagiosum virus
cgugcuccacgcgcagc

SEQ ID NO: 3102199 - RNA, 17 nt, Molluscum contagiosum virus
cgugcuccucgcguagc

SEQ ID NO: 3102200 - RNA, 22 nt, Molluscum contagiosum virus
cgugcuccucgcguagcagcgc

SEQ ID NO: 3102201 - RNA, 14 nt, Molluscum contagiosum virus
cgugcucgcgagcg

SEQ ID NO: 3102202 - RNA, 23 nt, Molluscum contagiosum virus
cgugcucgcucggcaacgccagc

SEQ ID NO: 3102203 - RNA, 20 nt, Molluscum contagiosum virus
cgugcucgguagcguggagc

SEQ ID NO: 3102204 - RNA, 19 nt, Molluscum contagiosum virus
cuagagaaccugugcgcgg

SEQ ID NO: 3102205 - RNA, 21 nt, Molluscum contagiosum virus
cuagagcagaaggugcgcagc

SEQ ID NO: 3102206 - RNA, 21 nt, Molluscum contagiosum virus
cuagagcuggcaccgggcgcc

SEQ ID NO: 3102207 - RNA, 15 nt, Molluscum contagiosum virus
cuagcaaggcgccgc

SEQ ID NO: 3102208 - RNA, 13 nt, Molluscum contagiosum virus
cuagcacgggcgg

SEQ ID NO: 3102209 - RNA, 21 nt, Molluscum contagiosum virus
cuagcacguuaaucacgauga

SEQ ID NO: 3102210 - RNA, 21 nt, Molluscum contagiosum virus
cuagcagcgugcgcaccagcu

SEQ ID NO: 3102211 - RNA, 18 nt, Molluscum contagiosum virus
cuagcccagcacgcgcgg

SEQ ID NO: 3102212 - RNA, 18 nt, Molluscum contagiosum virus
cuacugggaggacacgcg

SEQ ID NO: 3102213 - RNA, 19 nt, Molluscum contagiosum virus
cuacugggaggacacgcgc

SEQ ID NO: 3102214 - RNA, 21 nt, Molluscum contagiosum virus
cuacggcgaguucugccggcu

SEQ ID NO: 3102215 - RNA, 21 nt, Molluscum contagiosum virus
cuacggcgugcugugccugcg

SEQ ID NO: 3102216 - RNA, 19 nt, Molluscum contagiosum virus
cuaccggcaguagcagcgc

SEQ ID NO: 3102217 - RNA, 14 nt, Molluscum contagiosum virus
cuaccgucgccggu

SEQ ID NO: 3102218 - RNA, 18 nt, Molluscum contagiosum virus
cuaccuggcggcgcugga

SEQ ID NO: 3102219 - RNA, 20 nt, Molluscum contagiosum virus
cuacgcgcgcguaacagcgc

SEQ ID NO: 3102220 - RNA, 13 nt, Molluscum contagiosum virus
cuacgcgcgcgug

SEQ ID NO: 3102221 - RNA, 15 nt, Molluscum contagiosum virus
cuacgcgcugcuaga

SEQ ID NO: 3102222 - RNA, 13 nt, Molluscum contagiosum virus
cuacgagcagcgc

SEQ ID NO: 3102223 - RNA, 15 nt, Molluscum contagiosum virus
cuacgaggugcugcg

SEQ ID NO: 3102224 - RNA, 22 nt, Molluscum contagiosum virus
cuacgcaacacggcggugcccg

SEQ ID NO: 3102225 - RNA, 20 nt, Molluscum contagiosum virus
cuacgcaagcugaggcgugc

SEQ ID NO: 3102226 - RNA, 13 nt, Molluscum contagiosum virus
cuacgcagcgcgc

SEQ ID NO: 3102227 - RNA, 15 nt, Molluscum contagiosum virus
cuacgcagcgcgcgg

SEQ ID NO: 3102228 - RNA, 22 nt, Molluscum contagiosum virus
cuacgcgagcacugcgcgcgcg

SEQ ID NO: 3102229 - RNA, 21 nt, Molluscum contagiosum virus
gcaauccugguacgcgcgcgc

SEQ ID NO: 3102230 - RNA, 20 nt, Molluscum contagiosum virus
gcaaucgcgugcuugcugcg

SEQ ID NO: 3102231 - RNA, 20 nt, Molluscum contagiosum virus
gcaagagccgccggggccca

SEQ ID NO: 3102232 - RNA, 19 nt, Molluscum contagiosum virus
gcaagauucuucgcgaagg

SEQ ID NO: 3102233 - RNA, 20 nt, Molluscum contagiosum virus
gcaagcaccggcagcgcgau

SEQ ID NO: 3102234 - RNA, 16 nt, Molluscum contagiosum virus
gcaagcagcgcgcgca

SEQ ID NO: 3102235 - RNA, 13 nt, Molluscum contagiosum virus
gcaagcgcaagcc

SEQ ID NO: 3102236 - RNA, 14 nt, Molluscum contagiosum virus
gcaagcgcccgcga

SEQ ID NO: 3102237 - RNA, 14 nt, Molluscum contagiosum virus
gcaagcgcgcucgg

SEQ ID NO: 3102238 - RNA, 14 nt, Molluscum contagiosum virus
gcaagcgcguucgc

SEQ ID NO: 3102239 - RNA, 16 nt, Molluscum contagiosum virus
gcaagcgcguucgcgc

SEQ ID NO: 3102240 - RNA, 20 nt, Molluscum contagiosum virus
gcaagcgcguucgcgcgugc

SEQ ID NO: 3102241 - RNA, 22 nt, Molluscum contagiosum virus
gcaagcgcuacuugcuggcgcg

SEQ ID NO: 3102242 - RNA, 22 nt, Molluscum contagiosum virus
gcaagcgggcuucgccgccgga

SEQ ID NO: 3102243 - RNA, 14 nt, Molluscum contagiosum virus
gcaagcguacgcgu

SEQ ID NO: 3102244 - RNA, 17 nt, Molluscum contagiosum virus
gcaagcguacgcgucgc

SEQ ID NO: 3102245 - RNA, 20 nt, Molluscum contagiosum virus
gcaagcguacgcgucgcgga

SEQ ID NO: 3102246 - RNA, 16 nt, Molluscum contagiosum virus
gcaagcugagcgcgcu

SEQ ID NO: 3102247 - RNA, 18 nt, Molluscum contagiosum virus
gcaagcugagcgcgcugc

SEQ ID NO: 3102248 - RNA, 19 nt, Molluscum contagiosum virus
gcaagcugagcgcgcugcg

SEQ ID NO: 3102249 - RNA, 16 nt, Molluscum contagiosum virus
gcaagcuucgggccgc

SEQ ID NO: 3102250 - RNA, 24 nt, Molluscum contagiosum virus
gcaagcuucgggccgcugccgucg

SEQ ID NO: 3102251 - RNA, 17 nt, Molluscum contagiosum virus
gcaagcuuugugcucgc

SEQ ID NO: 3102252 - RNA, 13 nt, Molluscum contagiosum virus
gcaaggcgcgcgc

SEQ ID NO: 3102253 - RNA, 14 nt, Molluscum contagiosum virus
gcaaggcggacgcc

SEQ ID NO: 3102254 - RNA, 22 nt, Molluscum contagiosum virus
gcaagggccugcgggcggcaca

SEQ ID NO: 3102255 - RNA, 18 nt, Molluscum contagiosum virus
gcaaggugugcgcgcugc

SEQ ID NO: 3102256 - RNA, 16 nt, Molluscum contagiosum virus
gcaagguuuacgccgu

SEQ ID NO: 3102257 - RNA, 19 nt, Molluscum contagiosum virus
gcaaguccagcgcgcucga

SEQ ID NO: 3102258 - RNA, 16 nt, Molluscum contagiosum virus
gcaagucgcgcgcugc

SEQ ID NO: 3102259 - RNA, 14 nt, Molluscum contagiosum virus
gcaaguucgcugcu

SEQ ID NO: 3102260 - RNA, 15 nt, Molluscum contagiosum virus
gcaauagcgcccgua

SEQ ID NO: 3102261 - RNA, 16 nt, Molluscum contagiosum virus
gcaaugcagugcacca

SEQ ID NO: 3102262 - RNA, 16 nt, Molluscum contagiosum virus
gcaaugcgugcgugcg

SEQ ID NO: 3102263 - RNA, 17 nt, Molluscum contagiosum virus
gcaauugcugggcacaa

SEQ ID NO: 3102264 - RNA, 21 nt, Molluscum contagiosum virus
gcaagaagaucgcggcgccgc

SEQ ID NO: 3102265 - RNA, 21 nt, Molluscum contagiosum virus
gcaagaccaucaucgcgcugc

SEQ ID NO: 3102266 - RNA, 21 nt, Molluscum contagiosum virus
gcacaacgggcucgugcugga

SEQ ID NO: 3102267 - RNA, 23 nt, Molluscum contagiosum virus
gcacaacgggcucgugcuggagc

SEQ ID NO: 3102268 - RNA, 15 nt, Molluscum contagiosum virus
gcacaaacacgcgcg

SEQ ID NO: 3102269 - RNA, 16 nt, Molluscum contagiosum virus
gcacaaacacgcgcgc

SEQ ID NO: 3102270 - RNA, 18 nt, Molluscum contagiosum virus
gcacaaacacgcgcgcgc

SEQ ID NO: 3102271 - RNA, 14 nt, Molluscum contagiosum virus
gcacaaacgcgacu

SEQ ID NO: 3102272 - RNA, 20 nt, Molluscum contagiosum virus
gcacaagccguccgccucga

SEQ ID NO: 3102273 - RNA, 21 nt, Molluscum contagiosum virus
gcacaagccguccgccucgag

SEQ ID NO: 3102274 - RNA, 15 nt, Molluscum contagiosum virus
gcacacaccgcgagc

SEQ ID NO: 3102275 - RNA, 13 nt, Molluscum contagiosum virus
gcacaccgagcgc

SEQ ID NO: 3102276 - RNA, 12 nt, Molluscum contagiosum virus
gcacaccggcgc

SEQ ID NO: 3102277 - RNA, 18 nt, Molluscum contagiosum virus
gcacaccgucgcguggug

SEQ ID NO: 3102278 - RNA, 17 nt, Molluscum contagiosum virus
gcacacgaaucgcucgc

SEQ ID NO: 3102279 - RNA, 19 nt, Molluscum contagiosum virus
gcacacgacgacggcugcu

SEQ ID NO: 3102280 - RNA, 22 nt, Molluscum contagiosum virus
gcacacgacgacggcugcucgc

SEQ ID NO: 3102281 - RNA, 15 nt, Molluscum contagiosum virus
gcacacgagugcccg

SEQ ID NO: 3102282 - RNA, 18 nt, Molluscum contagiosum virus
gcacacgagugcccgcgc

SEQ ID NO: 3102283 - RNA, 22 nt, Molluscum contagiosum virus
gcacacgagugcccgcgcgcug

SEQ ID NO: 3102284 - RNA, 22 nt, Molluscum contagiosum virus
gcacacgcaccgccuggugcug

SEQ ID NO: 3102285 - RNA, 13 nt, Molluscum contagiosum virus
gcacacgcgcgcg

SEQ ID NO: 3102286 - RNA, 14 nt, Molluscum contagiosum virus
gcacacgcgcgcgc

SEQ ID NO: 3102287 - RNA, 17 nt, Molluscum contagiosum virus
gcacacgcgcgcgcagg

SEQ ID NO: 3102288 - RNA, 18 nt, Molluscum contagiosum virus
gcacacgcgcgcgugcug

SEQ ID NO: 3102289 - RNA, 20 nt, Molluscum contagiosum virus
gcacacgcgcgcgugcugcu

SEQ ID NO: 3102290 - RNA, 13 nt, Molluscum contagiosum virus
gcacacgcgucgc

SEQ ID NO: 3102291 - RNA, 23 nt, Molluscum contagiosum virus
gcacacugcagcacgucuugcgc

SEQ ID NO: 3102292 - RNA, 22 nt, Molluscum contagiosum virus
acuuaucccagaaaacgcacug

SEQ ID NO: 3102293 - RNA, 18 nt, Molluscum contagiosum virus
acugucgcgcagcugcgc

SEQ ID NO: 3102294 - RNA, 23 nt, Molluscum contagiosum virus
acugucuuuuccucacgucgcug

SEQ ID NO: 3102295 - RNA, 23 nt, Molluscum contagiosum virus
acuuccguugcgagaacgggcgc

SEQ ID NO: 3102296 - RNA, 15 nt, Molluscum contagiosum virus
acuuccuugcgcagg

SEQ ID NO: 3102297 - RNA, 17 nt, Molluscum contagiosum virus
acuuccuugcgcaggac

SEQ ID NO: 3102298 - RNA, 20 nt, Molluscum contagiosum virus
acuucgacgcggugcgcgcg

SEQ ID NO: 3102299 - RNA, 20 nt, Molluscum contagiosum virus
acuucgcagacgacucgcug

SEQ ID NO: 3102300 - RNA, 17 nt, Molluscum contagiosum virus
acuucauccucuaccgc

SEQ ID NO: 3102301 - RNA, 14 nt, Molluscum contagiosum virus
acuuccacgagcug

SEQ ID NO: 3102302 - RNA, 13 nt, Molluscum contagiosum virus
acuucccgaggac

SEQ ID NO: 3102303 - RNA, 18 nt, Molluscum contagiosum virus
acuggcgcccggcgccga

SEQ ID NO: 3102304 - RNA, 18 nt, Molluscum contagiosum virus
acuggcgcgcacgcgcac

SEQ ID NO: 3102305 - RNA, 14 nt, Molluscum contagiosum virus
acugggagcuuucc

SEQ ID NO: 3102306 - RNA, 19 nt, Molluscum contagiosum virus
acugggaggacacgcgcac

SEQ ID NO: 3102307 - RNA, 20 nt, Molluscum contagiosum virus
acuggggcgaucgcgucacg

SEQ ID NO: 3102308 - RNA, 15 nt, Molluscum contagiosum virus
acuggcaccugcggc

SEQ ID NO: 3102309 - RNA, 16 nt, Molluscum contagiosum virus
acuggcacgcgccgcg

SEQ ID NO: 3102310 - RNA, 17 nt, Molluscum contagiosum virus
acuggcacgcgccgcgc

SEQ ID NO: 3102311 - RNA, 15 nt, Molluscum contagiosum virus
acuggccguguaagu

SEQ ID NO: 3102312 - RNA, 18 nt, Molluscum contagiosum virus
acuggaagaacaggccgc

SEQ ID NO: 3102313 - RNA, 14 nt, Molluscum contagiosum virus
acuggagcacggac

SEQ ID NO: 3102314 - RNA, 13 nt, Molluscum contagiosum virus
acugcagcacguc

SEQ ID NO: 3102315 - RNA, 23 nt, Molluscum contagiosum virus
acugacugcugcccccgccgcgg

SEQ ID NO: 3102316 - RNA, 14 nt, Molluscum contagiosum virus
acugcucgcgcacg

SEQ ID NO: 3102317 - RNA, 19 nt, Molluscum contagiosum virus
acugcucgcgcacgcgcac

SEQ ID NO: 3102318 - RNA, 22 nt, Molluscum contagiosum virus
acugcugcaggcaaagcggggc

SEQ ID NO: 3102319 - RNA, 19 nt, Molluscum contagiosum virus
acugcugcaguguguacgg

SEQ ID NO: 3102320 - RNA, 17 nt, Molluscum contagiosum virus
acugcugcccccgccgc

SEQ ID NO: 3102321 - RNA, 22 nt, Molluscum contagiosum virus
acugcugcccccgccgcggcgc

SEQ ID NO: 3102322 - RNA, 12 nt, Molluscum contagiosum virus
acugcugggcgu

SEQ ID NO: 3102323 - RNA, 20 nt, Molluscum contagiosum virus
acugcgcgcacugcucgcgc

SEQ ID NO: 3102324 - RNA, 12 nt, Molluscum contagiosum virus
acugcgcgcaug

SEQ ID NO: 3102325 - RNA, 16 nt, Molluscum contagiosum virus
acugcgcgcgcggcgc

SEQ ID NO: 3102326 - RNA, 16 nt, Molluscum contagiosum virus
acugcggacucgcgag

SEQ ID NO: 3102327 - RNA, 21 nt, Molluscum contagiosum virus
acugcuacgucgcggcgcacg

SEQ ID NO: 3102328 - RNA, 18 nt, Molluscum contagiosum virus
acugcuagcgacgcggac

SEQ ID NO: 3102329 - RNA, 22 nt, Molluscum contagiosum virus
acugcaggccccuacacgcaac

SEQ ID NO: 3102330 - RNA, 20 nt, Molluscum contagiosum virus
acugccaaagcuaugcgcag

SEQ ID NO: 3102331 - RNA, 14 nt, Molluscum contagiosum virus
acugccacgcggag

SEQ ID NO: 3102332 - RNA, 21 nt, Molluscum contagiosum virus
acugccacgcggagcucgcca

SEQ ID NO: 3102333 - RNA, 21 nt, Molluscum contagiosum virus
acugcccgcgcccugcacgac

SEQ ID NO: 3102334 - RNA, 14 nt, Molluscum contagiosum virus
acugccgccaggaa

SEQ ID NO: 3102335 - RNA, 16 nt, Molluscum contagiosum virus
acugccgccgccgcga

SEQ ID NO: 3102336 - RNA, 18 nt, Molluscum contagiosum virus
acugcgacauccacauga

SEQ ID NO: 3102337 - RNA, 16 nt, Molluscum contagiosum virus
caccaaggacguguac

SEQ ID NO: 3102338 - RNA, 15 nt, Molluscum contagiosum virus
cacauugcugcugca

SEQ ID NO: 3102339 - RNA, 23 nt, Molluscum contagiosum virus
cacauguguuuguagccgcgcga

SEQ ID NO: 3102340 - RNA, 18 nt, Molluscum contagiosum virus
caccacggccgacggcac

SEQ ID NO: 3102341 - RNA, 20 nt, Molluscum contagiosum virus
caccagacaaagucgacgac

SEQ ID NO: 3102342 - RNA, 17 nt, Molluscum contagiosum virus
caccccgcugggccgca

SEQ ID NO: 3102343 - RNA, 16 nt, Molluscum contagiosum virus
cacccgagcggggacg

SEQ ID NO: 3102344 - RNA, 13 nt, Molluscum contagiosum virus
caccagcgcggcc

SEQ ID NO: 3102345 - RNA, 14 nt, Molluscum contagiosum virus
caccagcgcggccg

SEQ ID NO: 3102346 - RNA, 16 nt, Molluscum contagiosum virus
cacacuggugcgcgug

SEQ ID NO: 3102347 - RNA, 17 nt, Molluscum contagiosum virus
acuucaagcacgagcug

SEQ ID NO: 3102348 - RNA, 17 nt, Molluscum contagiosum virus
cacacuugcacgcgcac

SEQ ID NO: 3102349 - RNA, 19 nt, Molluscum contagiosum virus
cacacuugcacgcgcacgc

SEQ ID NO: 3102350 - RNA, 14 nt, Molluscum contagiosum virus
cacacuugcgcguc

SEQ ID NO: 3102351 - RNA, 16 nt, Molluscum contagiosum virus
cacacuugcgcguccg

SEQ ID NO: 3102352 - RNA, 14 nt, Molluscum contagiosum virus
cacacuugcgcguu

SEQ ID NO: 3102353 - RNA, 14 nt, Molluscum contagiosum virus
acuugcacgcgcac

SEQ ID NO: 3102354 - RNA, 15 nt, Molluscum contagiosum virus
acuugcacgcgcacg

SEQ ID NO: 3102355 - RNA, 15 nt, Molluscum contagiosum virus
acuugcgcguccaca

SEQ ID NO: 3102356 - RNA, 20 nt, Molluscum contagiosum virus
acuugcgcguccacaaaggc

SEQ ID NO: 3102357 - RNA, 16 nt, Molluscum contagiosum virus
acuugcugguugccgc

SEQ ID NO: 3102358 - RNA, 16 nt, Molluscum contagiosum virus
cacacucacgcgucca

SEQ ID NO: 3102359 - RNA, 16 nt, Molluscum contagiosum virus
cacacucgcgcgucca

SEQ ID NO: 3102360 - RNA, 16 nt, Molluscum contagiosum virus
cacacucgcgcguccg

SEQ ID NO: 3102361 - RNA, 16 nt, Molluscum contagiosum virus
cacagcaggagcacgc

SEQ ID NO: 3102362 - RNA, 19 nt, Molluscum contagiosum virus
cacagcaggagcacgccug

SEQ ID NO: 3102363 - RNA, 16 nt, Molluscum contagiosum virus
cacagacauggcccgc

SEQ ID NO: 3102364 - RNA, 16 nt, Molluscum contagiosum virus
cacagccccugcugcu

SEQ ID NO: 3102365 - RNA, 15 nt, Molluscum contagiosum virus
cacaguucacggcgc

SEQ ID NO: 3102366 - RNA, 19 nt, Molluscum contagiosum virus
cacaguucacggcgcucgc

SEQ ID NO: 3102367 - RNA, 19 nt, Molluscum contagiosum virus
cacaguccaacccgcggcg

SEQ ID NO: 3102368 - RNA, 21 nt, Molluscum contagiosum virus
cacaguccaacccgcggcgcg

SEQ ID NO: 3102369 - RNA, 21 nt, Molluscum contagiosum virus
cacaucaugggcucgggcaag

SEQ ID NO: 3102370 - RNA, 13 nt, Molluscum contagiosum virus
cacauccgcuacc

SEQ ID NO: 3102371 - RNA, 15 nt, Molluscum contagiosum virus
acuacacugucgcgc

SEQ ID NO: 3102372 - RNA, 23 nt, Molluscum contagiosum virus
acguuugcgucugcgaggcgcgc

SEQ ID NO: 3102373 - RNA, 17 nt, Molluscum contagiosum virus
acguuuucaagcgcgag

SEQ ID NO: 3102374 - RNA, 20 nt, Molluscum contagiosum virus
acguugcgcguucagcgcac

SEQ ID NO: 3102375 - RNA, 21 nt, Molluscum contagiosum virus
acguugcgcguucagcgcacg

SEQ ID NO: 3102376 - RNA, 13 nt, Molluscum contagiosum virus
acuccacgcccgg

SEQ ID NO: 3102377 - RNA, 17 nt, Molluscum contagiosum virus
acuccagcgcgcccucg

SEQ ID NO: 3102378 - RNA, 15 nt, Molluscum contagiosum virus
acuccaucugcgcga

SEQ ID NO: 3102379 - RNA, 14 nt, Molluscum contagiosum virus
acuccgagcgcgac

SEQ ID NO: 3102380 - RNA, 13 nt, Molluscum contagiosum virus
acuccgagcgcgc

SEQ ID NO: 3102381 - RNA, 14 nt, Molluscum contagiosum virus
acuaccucuuugag

SEQ ID NO: 3102382 - RNA, 15 nt, Molluscum contagiosum virus
acuacgcacuggcga

SEQ ID NO: 3102383 - RNA, 14 nt, Molluscum contagiosum virus
acuagcacgggcgg

SEQ ID NO: 3102384 - RNA, 18 nt, Molluscum contagiosum virus
acuagcacgggcgggaca

SEQ ID NO: 3102385 - RNA, 20 nt, Molluscum contagiosum virus
acuagcguagcaugcucguc

SEQ ID NO: 3102386 - RNA, 14 nt, Molluscum contagiosum virus
acuagcgugcgcag

SEQ ID NO: 3102387 - RNA, 19 nt, Molluscum contagiosum virus
acucgcagaacugcugcgc

SEQ ID NO: 3102388 - RNA, 24 nt, Molluscum contagiosum virus
acuccguggaggaucgcuacgugc

SEQ ID NO: 3102389 - RNA, 23 nt, Molluscum contagiosum virus
acuccguuuuucugugcucgcgc

SEQ ID NO: 3102390 - RNA, 21 nt, Molluscum contagiosum virus
acucgaacgcaaggugugcgc

SEQ ID NO: 3102391 - RNA, 22 nt, Molluscum contagiosum virus
acucgagcacguagugcucguc

SEQ ID NO: 3102392 - RNA, 23 nt, Molluscum contagiosum virus
acucgagccccagaaggucgugc

SEQ ID NO: 3102393 - RNA, 21 nt, Molluscum contagiosum virus
acucgagcgagcuacgcgcuc

SEQ ID NO: 3102394 - RNA, 20 nt, Molluscum contagiosum virus
acucgcgcguccacaagggc

SEQ ID NO: 3102395 - RNA, 17 nt, Molluscum contagiosum virus
acucgcgcguccgcaaa

SEQ ID NO: 3102396 - RNA, 20 nt, Molluscum contagiosum virus
acucgcguccgcaucggcgc

SEQ ID NO: 3102397 - RNA, 22 nt, Molluscum contagiosum virus
acucgcuacugcaacguggcgc

SEQ ID NO: 3102398 - RNA, 14 nt, Molluscum contagiosum virus
acucgcugccagag

SEQ ID NO: 3102399 - RNA, 15 nt, Molluscum contagiosum virus
acucggcaugugcgc

SEQ ID NO: 3102400 - RNA, 15 nt, Molluscum contagiosum virus
acucggugcucaugc

SEQ ID NO: 3102401 - RNA, 19 nt, Molluscum contagiosum virus
acucggugcucaugcgcgg

SEQ ID NO: 3102402 - RNA, 19 nt, Molluscum contagiosum virus
acucgugcgccgcgccgaa

SEQ ID NO: 3102403 - RNA, 23 nt, Molluscum contagiosum virus
cacggugugcuacugcacugcag

SEQ ID NO: 3102404 - RNA, 22 nt, Molluscum contagiosum virus
cacguacuugcugguugccgcu

SEQ ID NO: 3102405 - RNA, 19 nt, Molluscum contagiosum virus
cacguaggggacgcgcggu

SEQ ID NO: 3102406 - RNA, 14 nt, Molluscum contagiosum virus
cacgucuucgccgu

SEQ ID NO: 3102407 - RNA, 19 nt, Molluscum contagiosum virus
cacgugaacuccaaggucg

SEQ ID NO: 3102408 - RNA, 19 nt, Molluscum contagiosum virus
cacgucggcgagacgugcg

SEQ ID NO: 3102409 - RNA, 14 nt, Molluscum contagiosum virus
cacggcuugccgcu

SEQ ID NO: 3102410 - RNA, 18 nt, Molluscum contagiosum virus
cacggcuugccgcucggc

SEQ ID NO: 3102411 - RNA, 19 nt, Molluscum contagiosum virus
cacgggcucgaucugcgcc

SEQ ID NO: 3102412 - RNA, 22 nt, Molluscum contagiosum virus
cacggcguucaccuuggcgcug

SEQ ID NO: 3102413 - RNA, 15 nt, Molluscum contagiosum virus
cacgguagagcugcg

SEQ ID NO: 3102414 - RNA, 14 nt, Molluscum contagiosum virus
cacggcgcgcaccu

SEQ ID NO: 3102415 - RNA, 16 nt, Molluscum contagiosum virus
cacggcgcucgccucu

SEQ ID NO: 3102416 - RNA, 17 nt, Molluscum contagiosum virus
cacggcggacgcgccua

SEQ ID NO: 3102417 - RNA, 23 nt, Molluscum contagiosum virus
cacggcgacaacgacagagcccg

SEQ ID NO: 3102418 - RNA, 13 nt, Molluscum contagiosum virus
cacggcgagcgcg

SEQ ID NO: 3102419 - RNA, 19 nt, Molluscum contagiosum virus
cagagcuccccgcgcgcag

SEQ ID NO: 3102420 - RNA, 20 nt, Molluscum contagiosum virus
cagagccaugcccgggcgug

SEQ ID NO: 3102421 - RNA, 23 nt, Molluscum contagiosum virus
cagagcccaaggggagacauaug

SEQ ID NO: 3102422 - RNA, 18 nt, Molluscum contagiosum virus
cagagcccgcggcgcacg

SEQ ID NO: 3102423 - RNA, 23 nt, Molluscum contagiosum virus
cagagcccgggagaguggccgcu

SEQ ID NO: 3102424 - RNA, 18 nt, Molluscum contagiosum virus
cagagccgcgugcgccgc

SEQ ID NO: 3102425 - RNA, 13 nt, Molluscum contagiosum virus
cagagccgggacg

SEQ ID NO: 3102426 - RNA, 16 nt, Molluscum contagiosum virus
cagagauccgcccgcg

SEQ ID NO: 3102427 - RNA, 17 nt, Molluscum contagiosum virus
cagagcacugcgcgucu

SEQ ID NO: 3102428 - RNA, 15 nt, Molluscum contagiosum virus
cagacguggugcucg

SEQ ID NO: 3102429 - RNA, 17 nt, Molluscum contagiosum virus
cagagcauuagcagcga

SEQ ID NO: 3102430 - RNA, 20 nt, Molluscum contagiosum virus
cagagcauuagcagcgagga

SEQ ID NO: 3102431 - RNA, 22 nt, Molluscum contagiosum virus
cagagacacacgcuugcgcaug

SEQ ID NO: 3102432 - RNA, 22 nt, Molluscum contagiosum virus
cagagaccgucaaccugcugcc

SEQ ID NO: 3102433 - RNA, 19 nt, Molluscum contagiosum virus
cacgucgacaaguccaccu

SEQ ID NO: 3102434 - RNA, 20 nt, Molluscum contagiosum virus
cacgugccagagucgccgcu

SEQ ID NO: 3102435 - RNA, 20 nt, Molluscum contagiosum virus
cacgugccccgcgcgugcag

SEQ ID NO: 3102436 - RNA, 14 nt, Molluscum contagiosum virus
cacgugcucgcggu

SEQ ID NO: 3102437 - RNA, 20 nt, Molluscum contagiosum virus
cacgugcugaucacgcucgc

SEQ ID NO: 3102438 - RNA, 15 nt, Molluscum contagiosum virus
cagacggcgcgcucg

SEQ ID NO: 3102439 - RNA, 15 nt, Molluscum contagiosum virus
cacgcgcgagcggag

SEQ ID NO: 3102440 - RNA, 23 nt, Molluscum contagiosum virus
cacgcgcgagcggagcgggcacg

SEQ ID NO: 3102441 - RNA, 23 nt, Molluscum contagiosum virus
cacgcgcgccgcugucacgcgag

SEQ ID NO: 3102442 - RNA, 23 nt, Molluscum contagiosum virus
cacgcgcgcgccuuuccggccug

SEQ ID NO: 3102443 - RNA, 15 nt, Molluscum contagiosum virus
cacgcgcgcgcgaag

SEQ ID NO: 3102444 - RNA, 14 nt, Molluscum contagiosum virus
cacgcgcgcugccg

SEQ ID NO: 3102445 - RNA, 14 nt, Molluscum contagiosum virus
cacgcgcgggcgca

SEQ ID NO: 3102446 - RNA, 16 nt, Molluscum contagiosum virus
cacgccuucguggagc

SEQ ID NO: 3102447 - RNA, 22 nt, Molluscum contagiosum virus
cacgccuucguggagcccgugc

SEQ ID NO: 3102448 - RNA, 18 nt, Molluscum contagiosum virus
cacgcgaauguccggcgc

SEQ ID NO: 3102449 - RNA, 19 nt, Molluscum contagiosum virus
cacgcgacggugugccgcu

SEQ ID NO: 3102450 - RNA, 18 nt, Molluscum contagiosum virus
cacgcgagcacgccugca

SEQ ID NO: 3102451 - RNA, 14 nt, Molluscum contagiosum virus
cacgcgcaaggucu

SEQ ID NO: 3102452 - RNA, 16 nt, Molluscum contagiosum virus
cacgcgcaaggucuuc

SEQ ID NO: 3102453 - RNA, 17 nt, Molluscum contagiosum virus
cacgcgcacgcgcacac

SEQ ID NO: 3102454 - RNA, 16 nt, Molluscum contagiosum virus
cacgcgcacgcgcgag

SEQ ID NO: 3102455 - RNA, 16 nt, Molluscum contagiosum virus
cacgcgcacgcucucg

SEQ ID NO: 3102456 - RNA, 22 nt, Molluscum contagiosum virus
cacgcgcacgggccugcgcgcu

SEQ ID NO: 3102457 - RNA, 14 nt, Molluscum contagiosum virus
cacgcgccgcgcgg

SEQ ID NO: 3102458 - RNA, 16 nt, Molluscum contagiosum virus
cacgcgccgcgcggcu

SEQ ID NO: 3102459 - RNA, 11 nt, Molluscum contagiosum virus
cacgcgcuucg

SEQ ID NO: 3102460 - RNA, 21 nt, Molluscum contagiosum virus
cacgcgcuucguggacgagcg

SEQ ID NO: 3102461 - RNA, 21 nt, Molluscum contagiosum virus
cacgcggcgcgugucgcggag

SEQ ID NO: 3102462 - RNA, 21 nt, Molluscum contagiosum virus
cacgcgggcccaccgcgccag

SEQ ID NO: 3102463 - RNA, 12 nt, Molluscum contagiosum virus
cacgcgggcgcc

SEQ ID NO: 3102464 - RNA, 19 nt, Molluscum contagiosum virus
cacgcgguuucgaucgcgc

SEQ ID NO: 3102465 - RNA, 14 nt, Molluscum contagiosum virus
cacgcgucgcgcag

SEQ ID NO: 3102466 - RNA, 15 nt, Molluscum contagiosum virus
cacgcgugcugcgcg

SEQ ID NO: 3102467 - RNA, 18 nt, Molluscum contagiosum virus
cacgcgugcugcgcggcg

SEQ ID NO: 3102468 - RNA, 22 nt, Molluscum contagiosum virus
cacgcgugcugcgcggcgccgc

SEQ ID NO: 3102469 - RNA, 18 nt, Molluscum contagiosum virus
cacgcgugucugcgcucg

SEQ ID NO: 3102470 - RNA, 17 nt, Molluscum contagiosum virus
cacgcuacgcagcgcgc

SEQ ID NO: 3102471 - RNA, 21 nt, Molluscum contagiosum virus
cacgcuagcgagcgcccgugc

SEQ ID NO: 3102472 - RNA, 22 nt, Molluscum contagiosum virus
cacgcuagucguuggcgcgccc

SEQ ID NO: 3102473 - RNA, 19 nt, Molluscum contagiosum virus
cacgcucauacuccugcug

SEQ ID NO: 3102474 - RNA, 24 nt, Molluscum contagiosum virus
cacgcucaucucgcagacgcagcg

SEQ ID NO: 3102475 - RNA, 17 nt, Molluscum contagiosum virus
cacgcucgcgacgugcg

SEQ ID NO: 3102476 - RNA, 15 nt, Molluscum contagiosum virus
cacggccuucgcgcu

SEQ ID NO: 3102477 - RNA, 18 nt, Molluscum contagiosum virus
cacggccuucgcguuccg

SEQ ID NO: 3102478 - RNA, 22 nt, Molluscum contagiosum virus
cacggccgacggcacgggcacg

SEQ ID NO: 3102479 - RNA, 16 nt, Molluscum contagiosum virus
cacggccgcgcgcgac

SEQ ID NO: 3102480 - RNA, 15 nt, Molluscum contagiosum virus
cacggccggcgccgc

SEQ ID NO: 3102481 - RNA, 18 nt, Molluscum contagiosum virus
cacggccuccagcagcgg

SEQ ID NO: 3102482 - RNA, 14 nt, Molluscum contagiosum virus
cacggacaugguca

SEQ ID NO: 3102483 - RNA, 19 nt, Molluscum contagiosum virus
cacgcuugugcgcacgcug

SEQ ID NO: 3102484 - RNA, 16 nt, Molluscum contagiosum virus
cacggacccgggcgcg

SEQ ID NO: 3102485 - RNA, 20 nt, Molluscum contagiosum virus
cacggacccgggcgcggcac

SEQ ID NO: 3102486 - RNA, 20 nt, Molluscum contagiosum virus
cacggacucgccgcgcgccg

SEQ ID NO: 3102487 - RNA, 21 nt, Molluscum contagiosum virus
cacggacuuuucgcgcgugcg

SEQ ID NO: 3102488 - RNA, 15 nt, Molluscum contagiosum virus
cacggauacgcgcac

SEQ ID NO: 3102489 - RNA, 17 nt, Molluscum contagiosum virus
cacggauacgcgcacac

SEQ ID NO: 3102490 - RNA, 15 nt, Molluscum contagiosum virus
cacgcucucgcuggc

SEQ ID NO: 3102491 - RNA, 15 nt, Molluscum contagiosum virus
cacgcugcacgagcu

SEQ ID NO: 3102492 - RNA, 19 nt, Molluscum contagiosum virus
cacgcugcgcacgggcgcg

SEQ ID NO: 3102493 - RNA, 15 nt, Molluscum contagiosum virus
cacgcugcgcgugcu

SEQ ID NO: 3102494 - RNA, 14 nt, Molluscum contagiosum virus
cacgcugcgcucgg

SEQ ID NO: 3102495 - RNA, 18 nt, Molluscum contagiosum virus
cacgcugcgcucggcgcg

SEQ ID NO: 3102496 - RNA, 18 nt, Molluscum contagiosum virus
cacgcugcucgugcugcu

SEQ ID NO: 3102497 - RNA, 18 nt, Molluscum contagiosum virus
cacgcugcugcgugcgcg

SEQ ID NO: 3102498 - RNA, 22 nt, Molluscum contagiosum virus
cacgcugcugcgugcgcgcgau

SEQ ID NO: 3102499 - RNA, 16 nt, Molluscum contagiosum virus
cacgcuggcgcucggc

SEQ ID NO: 3102500 - RNA, 20 nt, Molluscum contagiosum virus
cacgccgguggcgcgcgagc

SEQ ID NO: 3102501 - RNA, 15 nt, Molluscum contagiosum virus
cacgccugcacgcgc

SEQ ID NO: 3102502 - RNA, 22 nt, Molluscum contagiosum virus
cacgcgcgugagcacgggcgag

SEQ ID NO: 3102503 - RNA, 13 nt, Molluscum contagiosum virus
cacgcgcucgcgc

SEQ ID NO: 3102504 - RNA, 14 nt, Molluscum contagiosum virus
cagaucgcgagagg

SEQ ID NO: 3102505 - RNA, 12 nt, Molluscum contagiosum virus
cagcaagcgcac

SEQ ID NO: 3102506 - RNA, 18 nt, Molluscum contagiosum virus
cagauucacgagcucggu

SEQ ID NO: 3102507 - RNA, 16 nt, Molluscum contagiosum virus
cagaugaggcugcucu

SEQ ID NO: 3102508 - RNA, 16 nt, Molluscum contagiosum virus
cagagucgccgcugcg

SEQ ID NO: 3102509 - RNA, 16 nt, Molluscum contagiosum virus
cagagugccuggcgcg

SEQ ID NO: 3102510 - RNA, 19 nt, Molluscum contagiosum virus
cagauaguuuggacgagcu

SEQ ID NO: 3102511 - RNA, 22 nt, Molluscum contagiosum virus
cagcacaaagagcacggacagc

SEQ ID NO: 3102512 - RNA, 23 nt, Molluscum contagiosum virus
cagcacaaagagcacggacagca

SEQ ID NO: 3102513 - RNA, 17 nt, Molluscum contagiosum virus
cagcacaccgucgcgug

SEQ ID NO: 3102514 - RNA, 19 nt, Molluscum contagiosum virus
cagcacaugcaggccgaga

SEQ ID NO: 3102515 - RNA, 16 nt, Molluscum contagiosum virus
cagcaccgcgccgcga

SEQ ID NO: 3102516 - RNA, 14 nt, Molluscum contagiosum virus
cagcacgcgcgggc

SEQ ID NO: 3102517 - RNA, 23 nt, Molluscum contagiosum virus
cagcacgcgcucguccgccgcgu

SEQ ID NO: 3102518 - RNA, 16 nt, Molluscum contagiosum virus
cagcagccccgacgcc

SEQ ID NO: 3102519 - RNA, 14 nt, Molluscum contagiosum virus
cagcagccgcagcc

SEQ ID NO: 3102520 - RNA, 18 nt, Molluscum contagiosum virus
cagcagccgcagcccacg

SEQ ID NO: 3102521 - RNA, 22 nt, Molluscum contagiosum virus
cagcagccucguucacggcuag

SEQ ID NO: 3102522 - RNA, 14 nt, Molluscum contagiosum virus
cagcagcgagacca

SEQ ID NO: 3102523 - RNA, 19 nt, Molluscum contagiosum virus
cagcacggggucguagucc

SEQ ID NO: 3102524 - RNA, 12 nt, Molluscum contagiosum virus
cagcacugcgcc

SEQ ID NO: 3102525 - RNA, 16 nt, Molluscum contagiosum virus
cagcagagcugcccgc

SEQ ID NO: 3102526 - RNA, 22 nt, Molluscum contagiosum virus
cagcaccaaggacguguacgug

SEQ ID NO: 3102527 - RNA, 17 nt, Molluscum contagiosum virus
uccaacuuccacgucuc

SEQ ID NO: 3102528 - RNA, 14 nt, Molluscum contagiosum virus
ucaugcgcguggcu

SEQ ID NO: 3102529 - RNA, 23 nt, Molluscum contagiosum virus
ucaucgugcccgguacgcucgcg

SEQ ID NO: 3102530 - RNA, 15 nt, Molluscum contagiosum virus
ucaucuucgugcuga

SEQ ID NO: 3102531 - RNA, 15 nt, Molluscum contagiosum virus
ucauccucuaccgcc

SEQ ID NO: 3102532 - RNA, 15 nt, Molluscum contagiosum virus
ucaucgacgagcacg

SEQ ID NO: 3102533 - RNA, 14 nt, Molluscum contagiosum virus
ucaggccggucgcg

SEQ ID NO: 3102534 - RNA, 13 nt, Molluscum contagiosum virus
ucauagcgccacg

SEQ ID NO: 3102535 - RNA, 17 nt, Molluscum contagiosum virus
uccacgcccggcgugau

SEQ ID NO: 3102536 - RNA, 16 nt, Molluscum contagiosum virus
uccacgccuucgugga

SEQ ID NO: 3102537 - RNA, 14 nt, Molluscum contagiosum virus
uccacgcgcgugag

SEQ ID NO: 3102538 - RNA, 14 nt, Molluscum contagiosum virus
uccacgcgugcgcg

SEQ ID NO: 3102539 - RNA, 18 nt, Molluscum contagiosum virus
uccacgcgugcgcgccag

SEQ ID NO: 3102540 - RNA, 13 nt, Molluscum contagiosum virus
uccacgcgugcug

SEQ ID NO: 3102541 - RNA, 17 nt, Molluscum contagiosum virus
uccacgcgugcugcgcg

SEQ ID NO: 3102542 - RNA, 13 nt, Molluscum contagiosum virus
uccacggacaugg

SEQ ID NO: 3102543 - RNA, 12 nt, Molluscum contagiosum virus
uccaccugcgca

SEQ ID NO: 3102544 - RNA, 16 nt, Molluscum contagiosum virus
uccaccugcgcaacgu

SEQ ID NO: 3102545 - RNA, 18 nt, Molluscum contagiosum virus
uccacgacgagccugcgg

SEQ ID NO: 3102546 - RNA, 20 nt, Molluscum contagiosum virus
uccacgauggaacggcgacu

SEQ ID NO: 3102547 - RNA, 19 nt, Molluscum contagiosum virus
uccacggguaccgugcgcg

SEQ ID NO: 3102548 - RNA, 23 nt, Molluscum contagiosum virus
uccacggguaccgugcgcgugag

SEQ ID NO: 3102549 - RNA, 19 nt, Molluscum contagiosum virus
uccacguccgacucggaca

SEQ ID NO: 3102550 - RNA, 21 nt, Molluscum contagiosum virus
uccagcccgcggugcgcacau

SEQ ID NO: 3102551 - RNA, 20 nt, Molluscum contagiosum virus
uccagccgcagccgcgcuag

SEQ ID NO: 3102552 - RNA, 20 nt, Molluscum contagiosum virus
uccagccgucgccgcgcccg

SEQ ID NO: 3102553 - RNA, 21 nt, Molluscum contagiosum virus
uccagcgcgcccucgcgcgcg

SEQ ID NO: 3102554 - RNA, 19 nt, Molluscum contagiosum virus
uccagcgcgcucgaggcgc

SEQ ID NO: 3102555 - RNA, 20 nt, Molluscum contagiosum virus
uccagcggcugcccgcggag

SEQ ID NO: 3102556 - RNA, 22 nt, Molluscum contagiosum virus
uccagcguuuccucuggcucca

SEQ ID NO: 3102557 - RNA, 14 nt, Molluscum contagiosum virus
uccagcugcgcgag

SEQ ID NO: 3102558 - RNA, 15 nt, Molluscum contagiosum virus
ucgccuuccugcgcc

SEQ ID NO: 3102559 - RNA, 21 nt, Molluscum contagiosum virus
ucgccuucuugcuggcgcucg

SEQ ID NO: 3102560 - RNA, 18 nt, Molluscum contagiosum virus
ucgccuuugugacaagga

SEQ ID NO: 3102561 - RNA, 14 nt, Molluscum contagiosum virus
ucgcgaacgcgucc

SEQ ID NO: 3102562 - RNA, 13 nt, Molluscum contagiosum virus
ucgcgaccuggcg

SEQ ID NO: 3102563 - RNA, 18 nt, Molluscum contagiosum virus
ucgcgaccuggcgcgugc

SEQ ID NO: 3102564 - RNA, 17 nt, Molluscum contagiosum virus
ucgcgacgacgagcacu

SEQ ID NO: 3102565 - RNA, 14 nt, Molluscum contagiosum virus
ucgcgacgugcgcg

SEQ ID NO: 3102566 - RNA, 22 nt, Molluscum contagiosum virus
ucgcgagcacuuuggccucgcg

SEQ ID NO: 3102567 - RNA, 14 nt, Molluscum contagiosum virus
ucgcgagcgccacu

SEQ ID NO: 3102568 - RNA, 14 nt, Molluscum contagiosum virus
ucgcggacggcgcg

SEQ ID NO: 3102569 - RNA, 14 nt, Molluscum contagiosum virus
ucgcggagcgcacg

SEQ ID NO: 3102570 - RNA, 15 nt, Molluscum contagiosum virus
ucgcggagcgcacga

SEQ ID NO: 3102571 - RNA, 16 nt, Molluscum contagiosum virus
ucgcggagcgcgcacg

SEQ ID NO: 3102572 - RNA, 15 nt, Molluscum contagiosum virus
ucgcggagcugcgcg

SEQ ID NO: 3102573 - RNA, 20 nt, Molluscum contagiosum virus
ucgcgggauacgggcgcuau

SEQ ID NO: 3102574 - RNA, 19 nt, Molluscum contagiosum virus
ucgcgccugaaccugggcg

SEQ ID NO: 3102575 - RNA, 13 nt, Molluscum contagiosum virus
ucgcgccugcgcu

SEQ ID NO: 3102576 - RNA, 14 nt, Molluscum contagiosum virus
ucgcgcgagaaguc

SEQ ID NO: 3102577 - RNA, 17 nt, Molluscum contagiosum virus
ucgcgcgcaccugcacg

SEQ ID NO: 3102578 - RNA, 12 nt, Molluscum contagiosum virus
ucgcgcgccagc

SEQ ID NO: 3102579 - RNA, 23 nt, Molluscum contagiosum virus
ucgcgcgccaguacgcaugcgcg

SEQ ID NO: 3102580 - RNA, 14 nt, Molluscum contagiosum virus
ucgcgcgccgcaaa

SEQ ID NO: 3102581 - RNA, 18 nt, Molluscum contagiosum virus
ucgcgcgccgccgcaaca

SEQ ID NO: 3102582 - RNA, 16 nt, Molluscum contagiosum virus
ucgcgcgccgcgcugg

SEQ ID NO: 3102583 - RNA, 22 nt, Molluscum contagiosum virus
ucgcgcgccgcgcuggcgcgcg

SEQ ID NO: 3102584 - RNA, 14 nt, Molluscum contagiosum virus
ucgcgcgccugccg

SEQ ID NO: 3102585 - RNA, 13 nt, Molluscum contagiosum virus
ucgcgcgccugcg

SEQ ID NO: 3102586 - RNA, 15 nt, Molluscum contagiosum virus
ucgcgcgccugcgcg

SEQ ID NO: 3102587 - RNA, 17 nt, Molluscum contagiosum virus
ucgcgcgccugcgcgag

SEQ ID NO: 3102588 - RNA, 11 nt, Molluscum contagiosum virus
ucgcgcgcgac

SEQ ID NO: 3102589 - RNA, 13 nt, Molluscum contagiosum virus
ucgcgcgcgggcu

SEQ ID NO: 3102590 - RNA, 21 nt, Molluscum contagiosum virus
ucgcgcgcguaaagagcgucc

SEQ ID NO: 3102591 - RNA, 17 nt, Molluscum contagiosum virus
ucgcgcgcuaccugcgc

SEQ ID NO: 3102592 - RNA, 18 nt, Molluscum contagiosum virus
ucgcgcgcuaccugcgca

SEQ ID NO: 3102593 - RNA, 21 nt, Molluscum contagiosum virus
ucgcgcgucgcggucgcggag

SEQ ID NO: 3102594 - RNA, 12 nt, Molluscum contagiosum virus
ucgcgcgugcug

SEQ ID NO: 3102595 - RNA, 15 nt, Molluscum contagiosum virus
ucgcgcucgcgggag

SEQ ID NO: 3102596 - RNA, 17 nt, Molluscum contagiosum virus
ucgcgcucuacgccagc

SEQ ID NO: 3102597 - RNA, 11 nt, Molluscum contagiosum virus
ucgcgcuuccc

SEQ ID NO: 3102598 - RNA, 15 nt, Molluscum contagiosum virus
ucgcgcuuccgcgag

SEQ ID NO: 3102599 - RNA, 13 nt, Molluscum contagiosum virus
ucgcgcuuugcgc

SEQ ID NO: 3102600 - RNA, 14 nt, Molluscum contagiosum virus
uccacggcgcgcac

SEQ ID NO: 3102601 - RNA, 15 nt, Molluscum contagiosum virus
uccagguccuccagc

SEQ ID NO: 3102602 - RNA, 14 nt, Molluscum contagiosum virus
ucgcgcccugcgcg

SEQ ID NO: 3102603 - RNA, 16 nt, Molluscum contagiosum virus
ucgcgcccugcgcgcg

SEQ ID NO: 3102604 - RNA, 18 nt, Molluscum contagiosum virus
ucgcgcccugcgcgcgag

SEQ ID NO: 3102605 - RNA, 15 nt, Molluscum contagiosum virus
ucgcgccgcucggaa

SEQ ID NO: 3102606 - RNA, 18 nt, Molluscum contagiosum virus
ucgcgcaaguccagcgcg

SEQ ID NO: 3102607 - RNA, 14 nt, Molluscum contagiosum virus
ucgcgcacgcgcac

SEQ ID NO: 3102608 - RNA, 16 nt, Molluscum contagiosum virus
ucgcgcacgcgcacgc

SEQ ID NO: 3102609 - RNA, 14 nt, Molluscum contagiosum virus
ucgcgcagcagcua

SEQ ID NO: 3102610 - RNA, 23 nt, Molluscum contagiosum virus
ucgcgcagcaggcacuccagcgc

SEQ ID NO: 3102611 - RNA, 14 nt, Molluscum contagiosum virus
ucgcgcaggucauc

SEQ ID NO: 3102612 - RNA, 19 nt, Molluscum contagiosum virus
ucgcgcaucaccgagcgag

SEQ ID NO: 3102613 - RNA, 21 nt, Molluscum contagiosum virus
ggggacucucccgucgccgga

SEQ ID NO: 3102614 - RNA, 14 nt, Molluscum contagiosum virus
gggcugcgcggcgg

SEQ ID NO: 3102615 - RNA, 22 nt, Molluscum contagiosum virus
ggggacgcgacgcgcguggagc

SEQ ID NO: 3102616 - RNA, 17 nt, Molluscum contagiosum virus
ggcugcucucggcagcg

SEQ ID NO: 3102617 - RNA, 20 nt, Molluscum contagiosum virus
ggcugcucucggcagcgucg

SEQ ID NO: 3102618 - RNA, 13 nt, Molluscum contagiosum virus
gggcgcugcaccg

SEQ ID NO: 3102619 - RNA, 13 nt, Molluscum contagiosum virus
gggcgcgugcugg

SEQ ID NO: 3102620 - RNA, 18 nt, Molluscum contagiosum virus
gggcgcgcgccagcagcg

SEQ ID NO: 3102621 - RNA, 11 nt, Molluscum contagiosum virus
gggcgccagcu

SEQ ID NO: 3102622 - RNA, 12 nt, Molluscum contagiosum virus
gggcgugcucac

SEQ ID NO: 3102623 - RNA, 23 nt, Molluscum contagiosum virus
gggcguguccgcgggcgcgcgcc

SEQ ID NO: 3102624 - RNA, 15 nt, Molluscum contagiosum virus
gggcgcuuccccguc

SEQ ID NO: 3102625 - RNA, 20 nt, Molluscum contagiosum virus
gggcucgggcucgaggugug

SEQ ID NO: 3102626 - RNA, 20 nt, Molluscum contagiosum virus
gggcugcaucuucagcacca

SEQ ID NO: 3102627 - RNA, 15 nt, Molluscum contagiosum virus
ggcucgaggugugcc

SEQ ID NO: 3102628 - RNA, 14 nt, Molluscum contagiosum virus
ggcuccugugucgc

SEQ ID NO: 3102629 - RNA, 19 nt, Molluscum contagiosum virus
ggcucgggcucgaggugug

SEQ ID NO: 3102630 - RNA, 19 nt, Molluscum contagiosum virus
ggcucuaagcgcacgcgcg

SEQ ID NO: 3102631 - RNA, 16 nt, Molluscum contagiosum virus
ggcucucaacugcagg

SEQ ID NO: 3102632 - RNA, 19 nt, Molluscum contagiosum virus
ggcucucaacugcaggccc

SEQ ID NO: 3102633 - RNA, 16 nt, Molluscum contagiosum virus
ggcgugugcgggcucu

SEQ ID NO: 3102634 - RNA, 13 nt, Molluscum contagiosum virus
ggcuccgcuggac

SEQ ID NO: 3102635 - RNA, 18 nt, Molluscum contagiosum virus
ggcugauccugcgcgugu

SEQ ID NO: 3102636 - RNA, 21 nt, Molluscum contagiosum virus
ggcugcagcccuuccacgaca

SEQ ID NO: 3102637 - RNA, 20 nt, Molluscum contagiosum virus
ggcugccggcgcgugagcgc

SEQ ID NO: 3102638 - RNA, 21 nt, Molluscum contagiosum virus
ggcucuuccuuugcucuacgc

SEQ ID NO: 3102639 - RNA, 17 nt, Molluscum contagiosum virus
ggcucgcgccugcgcuu

SEQ ID NO: 3102640 - RNA, 21 nt, Molluscum contagiosum virus
ggcucgcggcuaggacuagca

SEQ ID NO: 3102641 - RNA, 13 nt, Molluscum contagiosum virus
ggcugcugcgcga

SEQ ID NO: 3102642 - RNA, 19 nt, Molluscum contagiosum virus
ggcuggaccugcgccagcg

SEQ ID NO: 3102643 - RNA, 15 nt, Molluscum contagiosum virus
ggcuggacugugcuu

SEQ ID NO: 3102644 - RNA, 11 nt, Molluscum contagiosum virus
ggcgugcucgc

SEQ ID NO: 3102645 - RNA, 18 nt, Molluscum contagiosum virus
ggcggugggcgccgcggc

SEQ ID NO: 3102646 - RNA, 14 nt, Molluscum contagiosum virus
ggcguacgugcgcc

SEQ ID NO: 3102647 - RNA, 18 nt, Molluscum contagiosum virus
ggcguacgugcgccagcu

SEQ ID NO: 3102648 - RNA, 22 nt, Molluscum contagiosum virus
ggcguccuucuuugcgugcgcc

SEQ ID NO: 3102649 - RNA, 18 nt, Molluscum contagiosum virus
ggcgugcagggcgugcuu

SEQ ID NO: 3102650 - RNA, 19 nt, Molluscum contagiosum virus
ggcgugcauuuuuccgcuu

SEQ ID NO: 3102651 - RNA, 13 nt, Molluscum contagiosum virus
ggcgugcgcagca

SEQ ID NO: 3102652 - RNA, 22 nt, Molluscum contagiosum virus
ggcgugcgccgugcgucucucu

SEQ ID NO: 3102653 - RNA, 13 nt, Molluscum contagiosum virus
ggcgugcucacgc

SEQ ID NO: 3102654 - RNA, 12 nt, Molluscum contagiosum virus
ggcgugcucagc

SEQ ID NO: 3102655 - RNA, 16 nt, Molluscum contagiosum virus
ggcgugcucagcacca

SEQ ID NO: 3102656 - RNA, 13 nt, Molluscum contagiosum virus
ggccgcgagcgcg

SEQ ID NO: 3102657 - RNA, 19 nt, Molluscum contagiosum virus
ggccgcgaggcaugucgcg

SEQ ID NO: 3102658 - RNA, 18 nt, Molluscum contagiosum virus
ggccgcgcccacgggcuu

SEQ ID NO: 3102659 - RNA, 16 nt, Molluscum contagiosum virus
ggccgcgccgcgccga

SEQ ID NO: 3102660 - RNA, 23 nt, Molluscum contagiosum virus
ggcgggcacauccgcuaccuggu

SEQ ID NO: 3102661 - RNA, 16 nt, Molluscum contagiosum virus
ggcggcgucgcgcgcg

SEQ ID NO: 3102662 - RNA, 22 nt, Molluscum contagiosum virus
ggcggucuuccagcacugcgcc

SEQ ID NO: 3102663 - RNA, 18 nt, Molluscum contagiosum virus
ggcgggccugcgcccgca

SEQ ID NO: 3102664 - RNA, 22 nt, Molluscum contagiosum virus
gcgcgcguucauuugcgugagg

SEQ ID NO: 3102665 - RNA, 12 nt, Molluscum contagiosum virus
gcgcgcguugcc

SEQ ID NO: 3102666 - RNA, 20 nt, Molluscum contagiosum virus
gcgcgcguuuccguggcgug

SEQ ID NO: 3102667 - RNA, 21 nt, Molluscum contagiosum virus
gcgcgcguuugucgcgggcgc

SEQ ID NO: 3102668 - RNA, 15 nt, Molluscum contagiosum virus
gcgcccgcagcgcgc

SEQ ID NO: 3102669 - RNA, 17 nt, Molluscum contagiosum virus
gcgcccgccgcccaagg

SEQ ID NO: 3102670 - RNA, 12 nt, Molluscum contagiosum virus
gcgcgcugcgug

SEQ ID NO: 3102671 - RNA, 12 nt, Molluscum contagiosum virus
gcgcgcuggccg

SEQ ID NO: 3102672 - RNA, 16 nt, Molluscum contagiosum virus
gcgcgcuggcgugcgc

SEQ ID NO: 3102673 - RNA, 20 nt, Molluscum contagiosum virus
gcgcgcugguuaccaagggc

SEQ ID NO: 3102674 - RNA, 15 nt, Molluscum contagiosum virus
gcgcgcuuagcacac

SEQ ID NO: 3102675 - RNA, 22 nt, Molluscum contagiosum virus
gcgcgcuuuuugccgcucacag

SEQ ID NO: 3102676 - RNA, 19 nt, Molluscum contagiosum virus
gcgcggaagcccgagcgcg

SEQ ID NO: 3102677 - RNA, 16 nt, Molluscum contagiosum virus
gcgcgcuacugcgcgc

SEQ ID NO: 3102678 - RNA, 19 nt, Molluscum contagiosum virus
gcgcgcuagagcgcggcgc

SEQ ID NO: 3102679 - RNA, 23 nt, Molluscum contagiosum virus
gcgcgcuauucaaagcugugcgu

SEQ ID NO: 3102680 - RNA, 20 nt, Molluscum contagiosum virus
gcgcgcuauucucguggcgu

SEQ ID NO: 3102681 - RNA, 13 nt, Molluscum contagiosum virus
gcgcgcuccgaga

SEQ ID NO: 3102682 - RNA, 22 nt, Molluscum contagiosum virus
gcgcgcucgaacgcgcgugcgc

SEQ ID NO: 3102683 - RNA, 15 nt, Molluscum contagiosum virus
gcgcgcucgaggcgc

SEQ ID NO: 3102684 - RNA, 16 nt, Molluscum contagiosum virus
gcgcgcucgaggcgcc

SEQ ID NO: 3102685 - RNA, 20 nt, Molluscum contagiosum virus
gcgcgcucgccaccgcgccc

SEQ ID NO: 3102686 - RNA, 15 nt, Molluscum contagiosum virus
gcgcgcucgcgcagg

SEQ ID NO: 3102687 - RNA, 15 nt, Molluscum contagiosum virus
gcgcgcucuacgaga

SEQ ID NO: 3102688 - RNA, 22 nt, Molluscum contagiosum virus
gcgcgcucugccgcccgcgccc

SEQ ID NO: 3102689 - RNA, 13 nt, Molluscum contagiosum virus
gcgcgcugcacac

SEQ ID NO: 3102690 - RNA, 13 nt, Molluscum contagiosum virus
gcgcgcugccgcg

SEQ ID NO: 3102691 - RNA, 13 nt, Molluscum contagiosum virus
gcgcgcugcgaac

SEQ ID NO: 3102692 - RNA, 13 nt, Molluscum contagiosum virus
gcgcgcugcgcac

SEQ ID NO: 3102693 - RNA, 12 nt, Molluscum contagiosum virus
gcgcgcugcgcc

SEQ ID NO: 3102694 - RNA, 13 nt, Molluscum contagiosum virus
gcgcgcugcgcgc

SEQ ID NO: 3102695 - RNA, 14 nt, Molluscum contagiosum virus
gcgcgcugcgcgcg

SEQ ID NO: 3102696 - RNA, 15 nt, Molluscum contagiosum virus
gcgcgcugcgggcgc

SEQ ID NO: 3102697 - RNA, 12 nt, Molluscum contagiosum virus
gcgccagcacgc

SEQ ID NO: 3102698 - RNA, 15 nt, Molluscum contagiosum virus
gcgccagcacgcgcu

SEQ ID NO: 3102699 - RNA, 15 nt, Molluscum contagiosum virus
gcgccauccagcgca

SEQ ID NO: 3102700 - RNA, 14 nt, Molluscum contagiosum virus
gcgccauugcucgc

SEQ ID NO: 3102701 - RNA, 17 nt, Molluscum contagiosum virus
gcgcccaacgcccgcgc

SEQ ID NO: 3102702 - RNA, 18 nt, Molluscum contagiosum virus
gcgcccaaggccgcgggc

SEQ ID NO: 3102703 - RNA, 13 nt, Molluscum contagiosum virus
gcgcccacgggcu

SEQ ID NO: 3102704 - RNA, 13 nt, Molluscum contagiosum virus
gcgcccgcgcgcu

SEQ ID NO: 3102705 - RNA, 12 nt, Molluscum contagiosum virus
gcgcccgcggac

SEQ ID NO: 3102706 - RNA, 13 nt, Molluscum contagiosum virus
gcgcccgcggaga

SEQ ID NO: 3102707 - RNA, 11 nt, Molluscum contagiosum virus
gcgcccgcggc

SEQ ID NO: 3102708 - RNA, 14 nt, Molluscum contagiosum virus
gcgcccgcggcaca

SEQ ID NO: 3102709 - RNA, 13 nt, Molluscum contagiosum virus
gcgcccgcggcgc

SEQ ID NO: 3102710 - RNA, 17 nt, Molluscum contagiosum virus
gcgcccgcggcgcacgg

SEQ ID NO: 3102711 - RNA, 17 nt, Molluscum contagiosum virus
gcgcccggugcggcgug

SEQ ID NO: 3102712 - RNA, 14 nt, Molluscum contagiosum virus
gcgcccgugccgcc

SEQ ID NO: 3102713 - RNA, 20 nt, Molluscum contagiosum virus
gcgcccgugcuugcgcacgg

SEQ ID NO: 3102714 - RNA, 15 nt, Molluscum contagiosum virus
gcgcccucacgugcu

SEQ ID NO: 3102715 - RNA, 16 nt, Molluscum contagiosum virus
gcgcgcgguacucggc

SEQ ID NO: 3102716 - RNA, 16 nt, Molluscum contagiosum virus
gcgcgcggugcugcgc

SEQ ID NO: 3102717 - RNA, 14 nt, Molluscum contagiosum virus
gcgcgcgugccgcc

SEQ ID NO: 3102718 - RNA, 14 nt, Molluscum contagiosum virus
gcgcgcgugccgcg

SEQ ID NO: 3102719 - RNA, 13 nt, Molluscum contagiosum virus
gcgcgcgugccgg

SEQ ID NO: 3102720 - RNA, 19 nt, Molluscum contagiosum virus
gcgcgcgugccuguggcgc

SEQ ID NO: 3102721 - RNA, 16 nt, Molluscum contagiosum virus
gcgcgcgugcggacgc

SEQ ID NO: 3102722 - RNA, 12 nt, Molluscum contagiosum virus
gcgcgcgugcuc

SEQ ID NO: 3102723 - RNA, 13 nt, Molluscum contagiosum virus
gcgcgcgugcucg

SEQ ID NO: 3102724 - RNA, 15 nt, Molluscum contagiosum virus
gcgcgcgugcucgcg

SEQ ID NO: 3102725 - RNA, 14 nt, Molluscum contagiosum virus
gcgcgcgugcugcu

SEQ ID NO: 3102726 - RNA, 14 nt, Molluscum contagiosum virus
ggccgagcgugacc

SEQ ID NO: 3102727 - RNA, 16 nt, Molluscum contagiosum virus
ggccgaggcacgcggu

SEQ ID NO: 3102728 - RNA, 12 nt, Molluscum contagiosum virus
ggccgacggcac

SEQ ID NO: 3102729 - RNA, 13 nt, Molluscum contagiosum virus
ggccgcaugcacc

SEQ ID NO: 3102730 - RNA, 21 nt, Molluscum contagiosum virus
ggccgcaugcaccuacgcgcc

SEQ ID NO: 3102731 - RNA, 12 nt, Molluscum contagiosum virus
ggccgcacgcgu

SEQ ID NO: 3102732 - RNA, 13 nt, Molluscum contagiosum virus
ggccgcacgcgua

SEQ ID NO: 3102733 - RNA, 14 nt, Molluscum contagiosum virus
ggccgcccacgcuc

SEQ ID NO: 3102734 - RNA, 16 nt, Molluscum contagiosum virus
ggcccgcgcgugaagg

SEQ ID NO: 3102735 - RNA, 17 nt, Molluscum contagiosum virus
ggcccaccgcgccagcg

SEQ ID NO: 3102736 - RNA, 23 nt, Molluscum contagiosum virus
ggcccaccuucuugucgcgcgcc

SEQ ID NO: 3102737 - RNA, 13 nt, Molluscum contagiosum virus
ggcccgugcccga

SEQ ID NO: 3102738 - RNA, 20 nt, Molluscum contagiosum virus
ggcccgugcucaggccagca

SEQ ID NO: 3102739 - RNA, 19 nt, Molluscum contagiosum virus
ggccgaagucgcagcagcg

SEQ ID NO: 3102740 - RNA, 23 nt, Molluscum contagiosum virus
ggccgaaucgucggcacgcugca

SEQ ID NO: 3102741 - RNA, 17 nt, Molluscum contagiosum virus
ggccagcuucaucaagc

SEQ ID NO: 3102742 - RNA, 19 nt, Molluscum contagiosum virus
ggccacucucccgggcucu

SEQ ID NO: 3102743 - RNA, 16 nt, Molluscum contagiosum virus
ggccagcgcgcggcgc

SEQ ID NO: 3102744 - RNA, 19 nt, Molluscum contagiosum virus
ggccaggccuugcucccaa

SEQ ID NO: 3102745 - RNA, 12 nt, Molluscum contagiosum virus
ggccaggcgcgg

SEQ ID NO: 3102746 - RNA, 13 nt, Molluscum contagiosum virus
ggccccugcgcga

SEQ ID NO: 3102747 - RNA, 22 nt, Molluscum contagiosum virus
gcgcggagacuuccuugcgcag

SEQ ID NO: 3102748 - RNA, 19 nt, Molluscum contagiosum virus
gcgcggagaucgccgcgca

SEQ ID NO: 3102749 - RNA, 13 nt, Molluscum contagiosum virus
gcgcggagcucgc

SEQ ID NO: 3102750 - RNA, 13 nt, Molluscum contagiosum virus
gcgcggagcuggc

SEQ ID NO: 3102751 - RNA, 16 nt, Molluscum contagiosum virus
gcgcggaucugcgcac

SEQ ID NO: 3102752 - RNA, 16 nt, Molluscum contagiosum virus
ggccacgcacucgcug

SEQ ID NO: 3102753 - RNA, 14 nt, Molluscum contagiosum virus
ggccacgcucgcgc

SEQ ID NO: 3102754 - RNA, 17 nt, Molluscum contagiosum virus
ggccacgcucgcgcgca

SEQ ID NO: 3102755 - RNA, 19 nt, Molluscum contagiosum virus
gcgcggcaacagcacgacg

SEQ ID NO: 3102756 - RNA, 17 nt, Molluscum contagiosum virus
gcgcggcaagcagcgug

SEQ ID NO: 3102757 - RNA, 13 nt, Molluscum contagiosum virus
gcgcggcacgccc

SEQ ID NO: 3102758 - RNA, 14 nt, Molluscum contagiosum virus
gcgcggcacgcccu

SEQ ID NO: 3102759 - RNA, 17 nt, Molluscum contagiosum virus
gcgcggcagacgccagc

SEQ ID NO: 3102760 - RNA, 22 nt, Molluscum contagiosum virus
gcgcggccauggucacgcgcac

SEQ ID NO: 3102761 - RNA, 18 nt, Molluscum contagiosum virus
gcgcggcccgagcaggac

SEQ ID NO: 3102762 - RNA, 13 nt, Molluscum contagiosum virus
gcgcggccgcgcu

SEQ ID NO: 3102763 - RNA, 17 nt, Molluscum contagiosum virus
gcgagcguuucugccgg

SEQ ID NO: 3102764 - RNA, 18 nt, Molluscum contagiosum virus
gcgagcguuucugccgga

SEQ ID NO: 3102765 - RNA, 19 nt, Molluscum contagiosum virus
gcgagcuaaucagcgccau

SEQ ID NO: 3102766 - RNA, 16 nt, Molluscum contagiosum virus
gcgagcuagugcacac

SEQ ID NO: 3102767 - RNA, 12 nt, Molluscum contagiosum virus
gcgagcucgaga

SEQ ID NO: 3102768 - RNA, 15 nt, Molluscum contagiosum virus
gcgagcucgucgcgc

SEQ ID NO: 3102769 - RNA, 17 nt, Molluscum contagiosum virus
gcgagcucgucgcgcgc

SEQ ID NO: 3102770 - RNA, 19 nt, Molluscum contagiosum virus
gcgagcucgucgcgcgcgu

SEQ ID NO: 3102771 - RNA, 15 nt, Molluscum contagiosum virus
gcgagcugcgggcgc

SEQ ID NO: 3102772 - RNA, 16 nt, Molluscum contagiosum virus
gcgagcugcuagcggc

SEQ ID NO: 3102773 - RNA, 17 nt, Molluscum contagiosum virus
gcgaggacaacucgcgg

SEQ ID NO: 3102774 - RNA, 21 nt, Molluscum contagiosum virus
gcgagcgcaugcgcgccgcgc

SEQ ID NO: 3102775 - RNA, 19 nt, Molluscum contagiosum virus
gcgagcgcccgugcuugcg

SEQ ID NO: 3102776 - RNA, 15 nt, Molluscum contagiosum virus
gcgagcgccgcucgc

SEQ ID NO: 3102777 - RNA, 12 nt, Molluscum contagiosum virus
gcgagcgccugc

SEQ ID NO: 3102778 - RNA, 20 nt, Molluscum contagiosum virus
gcgagcggcgacuugcugcg

SEQ ID NO: 3102779 - RNA, 20 nt, Molluscum contagiosum virus
gcgagcggcuuuucgccgga

SEQ ID NO: 3102780 - RNA, 18 nt, Molluscum contagiosum virus
gcgaguccccgagcagcg

SEQ ID NO: 3102781 - RNA, 22 nt, Molluscum contagiosum virus
gcgagucgcccguguucgcgga

SEQ ID NO: 3102782 - RNA, 15 nt, Molluscum contagiosum virus
gcgagucgcgggcgc

SEQ ID NO: 3102783 - RNA, 18 nt, Molluscum contagiosum virus
gcgagucucccguggcgc

SEQ ID NO: 3102784 - RNA, 19 nt, Molluscum contagiosum virus
gcgagucucccguggcgcg

SEQ ID NO: 3102785 - RNA, 16 nt, Molluscum contagiosum virus
gcgauugcccgcgcgc

SEQ ID NO: 3102786 - RNA, 23 nt, Molluscum contagiosum virus
gcgcaaaccucugagcgagcgca

SEQ ID NO: 3102787 - RNA, 12 nt, Molluscum contagiosum virus
gcgaggccaagg

SEQ ID NO: 3102788 - RNA, 13 nt, Molluscum contagiosum virus
gcgaggcgcgcac

SEQ ID NO: 3102789 - RNA, 19 nt, Molluscum contagiosum virus
gcgaucacaaguccgcggc

SEQ ID NO: 3102790 - RNA, 19 nt, Molluscum contagiosum virus
gcgaucgcggccaugcgcu

SEQ ID NO: 3102791 - RNA, 17 nt, Molluscum contagiosum virus
gcgaugaacccgcauug

SEQ ID NO: 3102792 - RNA, 13 nt, Molluscum contagiosum virus
gcgaugcgcucgc

SEQ ID NO: 3102793 - RNA, 16 nt, Molluscum contagiosum virus
gcgcacaaacgcgcgc

SEQ ID NO: 3102794 - RNA, 14 nt, Molluscum contagiosum virus
gcgcacaacuuggg

SEQ ID NO: 3102795 - RNA, 14 nt, Molluscum contagiosum virus
gcgcacacgucagc

SEQ ID NO: 3102796 - RNA, 18 nt, Molluscum contagiosum virus
gcgcacacuccucggcgc

SEQ ID NO: 3102797 - RNA, 19 nt, Molluscum contagiosum virus
gcgcacacuccucggcgcu

SEQ ID NO: 3102798 - RNA, 14 nt, Molluscum contagiosum virus
gcgcacacuugcgc

SEQ ID NO: 3102799 - RNA, 21 nt, Molluscum contagiosum virus
gcgcacagacauggcccgcgc

SEQ ID NO: 3102800 - RNA, 16 nt, Molluscum contagiosum virus
gcgcacagacggcgcg

SEQ ID NO: 3102801 - RNA, 23 nt, Molluscum contagiosum virus
gcgcaguucgagcugcugcgcga

SEQ ID NO: 3102802 - RNA, 14 nt, Molluscum contagiosum virus
gcgcaacacggccu

SEQ ID NO: 3102803 - RNA, 20 nt, Molluscum contagiosum virus
gcgcaacauguccgcaagca

SEQ ID NO: 3102804 - RNA, 15 nt, Molluscum contagiosum virus
gcgcaaccagcuggc

SEQ ID NO: 3102805 - RNA, 17 nt, Molluscum contagiosum virus
gcgcaacgagcagcccg

SEQ ID NO: 3102806 - RNA, 13 nt, Molluscum contagiosum virus
gcgcaacgcgggc

SEQ ID NO: 3102807 - RNA, 21 nt, Molluscum contagiosum virus
gcgcaacgucuuccgcgcgcu

SEQ ID NO: 3102808 - RNA, 12 nt, Molluscum contagiosum virus
gcgcaacgugcu

SEQ ID NO: 3102809 - RNA, 19 nt, Molluscum contagiosum virus
gcgcaacgugcugcgccgc

SEQ ID NO: 3102810 - RNA, 20 nt, Molluscum contagiosum virus
gcgcaagcagcucggcgaga

SEQ ID NO: 3102811 - RNA, 19 nt, Molluscum contagiosum virus
gcgcaagcauggucuucgc

SEQ ID NO: 3102812 - RNA, 23 nt, Molluscum contagiosum virus
gcgcaagugggcgucgaccugga

SEQ ID NO: 3102813 - RNA, 12 nt, Molluscum contagiosum virus
gcgcaagugugc

SEQ ID NO: 3102814 - RNA, 13 nt, Molluscum contagiosum virus
gcgcaucaugcgc

SEQ ID NO: 3102815 - RNA, 13 nt, Molluscum contagiosum virus
gcgccaaggcgcu

SEQ ID NO: 3102816 - RNA, 21 nt, Molluscum contagiosum virus
gcgccaagguggccaagcgcu

SEQ ID NO: 3102817 - RNA, 21 nt, Molluscum contagiosum virus
gcgccacgagcgccgcgacgc

SEQ ID NO: 3102818 - RNA, 20 nt, Molluscum contagiosum virus
gcgccacgagcgccgcgugc

SEQ ID NO: 3102819 - RNA, 22 nt, Molluscum contagiosum virus
gcgccacgagcgccgcgugcgc

SEQ ID NO: 3102820 - RNA, 15 nt, Molluscum contagiosum virus
gcgcauacgcgccgc

SEQ ID NO: 3102821 - RNA, 20 nt, Molluscum contagiosum virus
gcgcauacgcgccgcgcgcu

SEQ ID NO: 3102822 - RNA, 18 nt, Molluscum contagiosum virus
gcgcaucagagaagugcu

SEQ ID NO: 3102823 - RNA, 19 nt, Molluscum contagiosum virus
gcgcaaggacaccgcgggc

SEQ ID NO: 3102824 - RNA, 15 nt, Molluscum contagiosum virus
gcgcaaggccgcgcc

SEQ ID NO: 3102825 - RNA, 17 nt, Molluscum contagiosum virus
gcgcaaguccagcgcgc

SEQ ID NO: 3102826 - RNA, 21 nt, Molluscum contagiosum virus
gcgcaagucgcgcgcugcgaa

SEQ ID NO: 3102827 - RNA, 20 nt, Molluscum contagiosum virus
gcgcaucgcgggcacgcagc

SEQ ID NO: 3102828 - RNA, 21 nt, Molluscum contagiosum virus
gcgcaucgcgggcacgcagcu

SEQ ID NO: 3102829 - RNA, 14 nt, Molluscum contagiosum virus
gcgcaucugcgagc

SEQ ID NO: 3102830 - RNA, 15 nt, Molluscum contagiosum virus
gcgcaugcgcgccgc

SEQ ID NO: 3102831 - RNA, 18 nt, Molluscum contagiosum virus
gcgcaugcggcaggcgcu

SEQ ID NO: 3102832 - RNA, 20 nt, Molluscum contagiosum virus
gcgcaugcggcaggcgcugc

SEQ ID NO: 3102833 - RNA, 18 nt, Molluscum contagiosum virus
gcgcaugcucgcgcucuc

SEQ ID NO: 3102834 - RNA, 13 nt, Molluscum contagiosum virus
gcgcauggccacg

SEQ ID NO: 3102835 - RNA, 16 nt, Molluscum contagiosum virus
gcgcauggccacgccc

SEQ ID NO: 3102836 - RNA, 14 nt, Molluscum contagiosum virus
gcgcauucgcgcgc

SEQ ID NO: 3102837 - RNA, 15 nt, Molluscum contagiosum virus
gcgcauucgcgcgcc

SEQ ID NO: 3102838 - RNA, 16 nt, Molluscum contagiosum virus
gcgcauucgcgcgccc

SEQ ID NO: 3102839 - RNA, 16 nt, Molluscum contagiosum virus
gcgcauuuaccggcgc

SEQ ID NO: 3102840 - RNA, 17 nt, Molluscum contagiosum virus
gcgcauuuaccggcgcu

SEQ ID NO: 3102841 - RNA, 20 nt, Molluscum contagiosum virus
gcgcauuuaccggcgcuugc

SEQ ID NO: 3102842 - RNA, 15 nt, Molluscum contagiosum virus
gcgccaaccgcgagc

SEQ ID NO: 3102843 - RNA, 19 nt, Molluscum contagiosum virus
cucgaccugcacgacccuc

SEQ ID NO: 3102844 - RNA, 20 nt, Molluscum contagiosum virus
cucgacgcguucuagcagcg

SEQ ID NO: 3102845 - RNA, 16 nt, Molluscum contagiosum virus
cucgacgugaucgcgc

SEQ ID NO: 3102846 - RNA, 15 nt, Molluscum contagiosum virus
cucgacugcguuguc

SEQ ID NO: 3102847 - RNA, 16 nt, Molluscum contagiosum virus
cucgagaagagggucg

SEQ ID NO: 3102848 - RNA, 11 nt, Molluscum contagiosum virus
cucgagcacgu

SEQ ID NO: 3102849 - RNA, 12 nt, Molluscum contagiosum virus
cucgagcagcgg

SEQ ID NO: 3102850 - RNA, 20 nt, Molluscum contagiosum virus
cucgagcaggucaucgggcu

SEQ ID NO: 3102851 - RNA, 18 nt, Molluscum contagiosum virus
cucgagccccagaagguc

SEQ ID NO: 3102852 - RNA, 19 nt, Molluscum contagiosum virus
cucgagcgagcuacgcgcu

SEQ ID NO: 3102853 - RNA, 14 nt, Molluscum contagiosum virus
cuccgcacacgcgc

SEQ ID NO: 3102854 - RNA, 15 nt, Molluscum contagiosum virus
cuccgcacacgcgcg

SEQ ID NO: 3102855 - RNA, 22 nt, Molluscum contagiosum virus
cuccgcacacgcgcgcgugcug

SEQ ID NO: 3102856 - RNA, 13 nt, Molluscum contagiosum virus
cuccggcugcucc

SEQ ID NO: 3102857 - RNA, 24 nt, Molluscum contagiosum virus
cuccgcgcggcgcucugccaccgc

SEQ ID NO: 3102858 - RNA, 19 nt, Molluscum contagiosum virus
cuccgcgggaagaggacgc

SEQ ID NO: 3102859 - RNA, 20 nt, Molluscum contagiosum virus
cuccggaggccgcucccgcg

SEQ ID NO: 3102860 - RNA, 17 nt, Molluscum contagiosum virus
cuccugugucgcgcgag

SEQ ID NO: 3102861 - RNA, 19 nt, Molluscum contagiosum virus
cuccuucgacgcgcguucu

SEQ ID NO: 3102862 - RNA, 23 nt, Molluscum contagiosum virus
cucgaacgcaaggugugcgcgcu

SEQ ID NO: 3102863 - RNA, 22 nt, Molluscum contagiosum virus
cucgaacgcgcgugcgcgugcc

SEQ ID NO: 3102864 - RNA, 22 nt, Molluscum contagiosum virus
cucgaacucgugcgccgcgccg

SEQ ID NO: 3102865 - RNA, 15 nt, Molluscum contagiosum virus
cuccucucgcgaucu

SEQ ID NO: 3102866 - RNA, 18 nt, Molluscum contagiosum virus
cucgacauuucgcgccug

SEQ ID NO: 3102867 - RNA, 20 nt, Molluscum contagiosum virus
cucgaccaaaugcgcgugcg

SEQ ID NO: 3102868 - RNA, 17 nt, Molluscum contagiosum virus
cuccguggugcgcgucu

SEQ ID NO: 3102869 - RNA, 14 nt, Molluscum contagiosum virus
cuccguuucccgcg

SEQ ID NO: 3102870 - RNA, 21 nt, Molluscum contagiosum virus
cuccguacagcuccccgcgca

SEQ ID NO: 3102871 - RNA, 18 nt, Molluscum contagiosum virus
cuccucggcgcuacgcac

SEQ ID NO: 3102872 - RNA, 16 nt, Molluscum contagiosum virus
cuaacggacgcggcca

SEQ ID NO: 3102873 - RNA, 21 nt, Molluscum contagiosum virus
cuaaauaaugaaccugcacgc

SEQ ID NO: 3102874 - RNA, 14 nt, Molluscum contagiosum virus
cguuugucgcgggc

SEQ ID NO: 3102875 - RNA, 22 nt, Molluscum contagiosum virus
cuacaagcggugcagcuacugc

SEQ ID NO: 3102876 - RNA, 17 nt, Molluscum contagiosum virus
cuacaccagcuggacgg

SEQ ID NO: 3102877 - RNA, 16 nt, Molluscum contagiosum virus
cuacacugucgcgcag

SEQ ID NO: 3102878 - RNA, 15 nt, Molluscum contagiosum virus
cuacagcgcgcugca

SEQ ID NO: 3102879 - RNA, 20 nt, Molluscum contagiosum virus
cuacaguuccgaucgcgaga

SEQ ID NO: 3102880 - RNA, 20 nt, Molluscum contagiosum virus
cuaccacgggcccgcgcgug

SEQ ID NO: 3102881 - RNA, 13 nt, Molluscum contagiosum virus
cuaccacgucggc

SEQ ID NO: 3102882 - RNA, 16 nt, Molluscum contagiosum virus
cuaccacgucggcgag

SEQ ID NO: 3102883 - RNA, 16 nt, Molluscum contagiosum virus
cuaccagcucgcgcag

SEQ ID NO: 3102884 - RNA, 13 nt, Molluscum contagiosum virus
cucccugcgggcg

SEQ ID NO: 3102885 - RNA, 17 nt, Molluscum contagiosum virus
cuccgaaaaaggcccgg

SEQ ID NO: 3102886 - RNA, 12 nt, Molluscum contagiosum virus
cucccgcggccg

SEQ ID NO: 3102887 - RNA, 20 nt, Molluscum contagiosum virus
cucccggcggcaagcgagau

SEQ ID NO: 3102888 - RNA, 12 nt, Molluscum contagiosum virus
cucccgucgagc

SEQ ID NO: 3102889 - RNA, 14 nt, Molluscum contagiosum virus
cucccgucgagcac

SEQ ID NO: 3102890 - RNA, 16 nt, Molluscum contagiosum virus
cucccgucgagcacga

SEQ ID NO: 3102891 - RNA, 21 nt, Molluscum contagiosum virus
cguuccagagcacugcgcguc

SEQ ID NO: 3102892 - RNA, 18 nt, Molluscum contagiosum virus
cguucgacuacacgcgcu

SEQ ID NO: 3102893 - RNA, 17 nt, Molluscum contagiosum virus
cguugcacgugcgugcc

SEQ ID NO: 3102894 - RNA, 16 nt, Molluscum contagiosum virus
cguugccgagcgagca

SEQ ID NO: 3102895 - RNA, 12 nt, Molluscum contagiosum virus
cguugccugcac

SEQ ID NO: 3102896 - RNA, 14 nt, Molluscum contagiosum virus
cguugcugcgccac

SEQ ID NO: 3102897 - RNA, 13 nt, Molluscum contagiosum virus
cguugcugcugcg

SEQ ID NO: 3102898 - RNA, 16 nt, Molluscum contagiosum virus
cguugcugcugcgcgc

SEQ ID NO: 3102899 - RNA, 13 nt, Molluscum contagiosum virus
cguuggcgccagc

SEQ ID NO: 3102900 - RNA, 13 nt, Molluscum contagiosum virus
cguuggcgcgccc

SEQ ID NO: 3102901 - RNA, 14 nt, Molluscum contagiosum virus
cguuggcgcgcccg

SEQ ID NO: 3102902 - RNA, 22 nt, Molluscum contagiosum virus
cguuggcgcgcccggcgcccgc

SEQ ID NO: 3102903 - RNA, 15 nt, Molluscum contagiosum virus
cguuguccgcgucca

SEQ ID NO: 3102904 - RNA, 15 nt, Molluscum contagiosum virus
cguucgcgcgccagu

SEQ ID NO: 3102905 - RNA, 12 nt, Molluscum contagiosum virus
cguucgcggagc

SEQ ID NO: 3102906 - RNA, 15 nt, Molluscum contagiosum virus
cgcgcgcgagcacgu

SEQ ID NO: 3102907 - RNA, 22 nt, Molluscum contagiosum virus
cgcgcgcgauguacaagcccgu

SEQ ID NO: 3102908 - RNA, 13 nt, Molluscum contagiosum virus
cgcgcgcgcacgc

SEQ ID NO: 3102909 - RNA, 12 nt, Molluscum contagiosum virus
cgcgcgcgccag

SEQ ID NO: 3102910 - RNA, 13 nt, Molluscum contagiosum virus
cgcgcgcgccagc

SEQ ID NO: 3102911 - RNA, 14 nt, Molluscum contagiosum virus
cgcgcgcgccgcag

SEQ ID NO: 3102912 - RNA, 12 nt, Molluscum contagiosum virus
cgcgcgcgccgg

SEQ ID NO: 3102913 - RNA, 13 nt, Molluscum contagiosum virus
cgcgcgcgcgccg

SEQ ID NO: 3102914 - RNA, 14 nt, Molluscum contagiosum virus
cgcgcgcgcgcgag

SEQ ID NO: 3102915 - RNA, 16 nt, Molluscum contagiosum virus
cgcgcgcgcgcggcgc

SEQ ID NO: 3102916 - RNA, 13 nt, Molluscum contagiosum virus
cgcgcgcgcggcg

SEQ ID NO: 3102917 - RNA, 14 nt, Molluscum contagiosum virus
cgcgcgcgcggcgc

SEQ ID NO: 3102918 - RNA, 14 nt, Molluscum contagiosum virus
cgcgcgcgcucugc

SEQ ID NO: 3102919 - RNA, 14 nt, Molluscum contagiosum virus
cgcgcgcgcugcug

SEQ ID NO: 3102920 - RNA, 18 nt, Molluscum contagiosum virus
cgcgcgcggagaggacgc

SEQ ID NO: 3102921 - RNA, 11 nt, Molluscum contagiosum virus
cgcgcgcggca

SEQ ID NO: 3102922 - RNA, 12 nt, Molluscum contagiosum virus
cgcgcgcggcaa

SEQ ID NO: 3102923 - RNA, 12 nt, Molluscum contagiosum virus
cgcgcgcggcac

SEQ ID NO: 3102924 - RNA, 13 nt, Molluscum contagiosum virus
cgcgcgcggcacg

SEQ ID NO: 3102925 - RNA, 21 nt, Molluscum contagiosum virus
cgcgcgcggucgacgggaacg

SEQ ID NO: 3102926 - RNA, 23 nt, Molluscum contagiosum virus
cgcgcgcguaaagagcguccagc

SEQ ID NO: 3102927 - RNA, 14 nt, Molluscum contagiosum virus
cgcgcgcgucgucg

SEQ ID NO: 3102928 - RNA, 12 nt, Molluscum contagiosum virus
cgcgcgcgugcc

SEQ ID NO: 3102929 - RNA, 20 nt, Molluscum contagiosum virus
cgcgcgcguuugucgcgggc

SEQ ID NO: 3102930 - RNA, 20 nt, Molluscum contagiosum virus
cgcgcgcuaccugcgcaagc

SEQ ID NO: 3102931 - RNA, 18 nt, Molluscum contagiosum virus
cgcgcgcuagccgccgcu

SEQ ID NO: 3102932 - RNA, 22 nt, Molluscum contagiosum virus
cgcgcgcuagccgccgcugccg

SEQ ID NO: 3102933 - RNA, 20 nt, Molluscum contagiosum virus
cgcgcgcuaggggugccgcu

SEQ ID NO: 3102934 - RNA, 13 nt, Molluscum contagiosum virus
cgcgcgcuccgag

SEQ ID NO: 3102935 - RNA, 12 nt, Molluscum contagiosum virus
cgcgcgcucgcg

SEQ ID NO: 3102936 - RNA, 13 nt, Molluscum contagiosum virus
cgcgcgcucgcgc

SEQ ID NO: 3102937 - RNA, 14 nt, Molluscum contagiosum virus
cgcgcgcucgcgcu

SEQ ID NO: 3102938 - RNA, 17 nt, Molluscum contagiosum virus
cgcgcgcucgcucgcgc

SEQ ID NO: 3102939 - RNA, 16 nt, Molluscum contagiosum virus
cgcgcgcucugccgcc

SEQ ID NO: 3102940 - RNA, 13 nt, Molluscum contagiosum virus
cgcgcgcugagcg

SEQ ID NO: 3102941 - RNA, 19 nt, Molluscum contagiosum virus
cgcgcgcugagcgcggagc

SEQ ID NO: 3102942 - RNA, 13 nt, Molluscum contagiosum virus
cgcgcgcugcgcg

SEQ ID NO: 3102943 - RNA, 14 nt, Molluscum contagiosum virus
cgcgcgcugcgcgc

SEQ ID NO: 3102944 - RNA, 17 nt, Molluscum contagiosum virus
cgcgcgcugcgcgccgc

SEQ ID NO: 3102945 - RNA, 18 nt, Molluscum contagiosum virus
cgcgcgcugcgcgcggac

SEQ ID NO: 3102946 - RNA, 13 nt, Molluscum contagiosum virus
cgcgcgcugcucu

SEQ ID NO: 3102947 - RNA, 18 nt, Molluscum contagiosum virus
cgcgcgcuuuuugccgcu

SEQ ID NO: 3102948 - RNA, 20 nt, Molluscum contagiosum virus
cgcgcggaagcccgccucgu

SEQ ID NO: 3102949 - RNA, 13 nt, Molluscum contagiosum virus
cgcgcaagugugc

SEQ ID NO: 3102950 - RNA, 14 nt, Molluscum contagiosum virus
cgcgcaagugugcg

SEQ ID NO: 3102951 - RNA, 18 nt, Molluscum contagiosum virus
cgcgcaagugugcgcauc

SEQ ID NO: 3102952 - RNA, 15 nt, Molluscum contagiosum virus
cgcgcaauagcgccc

SEQ ID NO: 3102953 - RNA, 17 nt, Molluscum contagiosum virus
cgcgcgccuugcagcgc

SEQ ID NO: 3102954 - RNA, 20 nt, Molluscum contagiosum virus
cgcgcgccuugcagcgcagc

SEQ ID NO: 3102955 - RNA, 16 nt, Molluscum contagiosum virus
cgcgcggugcugcgcc

SEQ ID NO: 3102956 - RNA, 18 nt, Molluscum contagiosum virus
cgcgcggugcugcgccag

SEQ ID NO: 3102957 - RNA, 16 nt, Molluscum contagiosum virus
cgcgcguacgcgugcg

SEQ ID NO: 3102958 - RNA, 19 nt, Molluscum contagiosum virus
cgcgcguacgcgugcgcug

SEQ ID NO: 3102959 - RNA, 17 nt, Molluscum contagiosum virus
cgcgcguacgcugcucg

SEQ ID NO: 3102960 - RNA, 13 nt, Molluscum contagiosum virus
cgcgcgucacgga

SEQ ID NO: 3102961 - RNA, 16 nt, Molluscum contagiosum virus
cguucacuugcgcgcg

SEQ ID NO: 3102962 - RNA, 20 nt, Molluscum contagiosum virus
cguucacuugcgcgcgugcc

SEQ ID NO: 3102963 - RNA, 23 nt, Molluscum contagiosum virus
cgcgcggaugcuggcgagcacgu

SEQ ID NO: 3102964 - RNA, 13 nt, Molluscum contagiosum virus
cgcgcggcagacg

SEQ ID NO: 3102965 - RNA, 12 nt, Molluscum contagiosum virus
cgcgcggcagca

SEQ ID NO: 3102966 - RNA, 14 nt, Molluscum contagiosum virus
cgcgcggcgccgag

SEQ ID NO: 3102967 - RNA, 15 nt, Molluscum contagiosum virus
cgcgcggcgcucugc

SEQ ID NO: 3102968 - RNA, 18 nt, Molluscum contagiosum virus
cgcgcggcuaagcucugc

SEQ ID NO: 3102969 - RNA, 21 nt, Molluscum contagiosum virus
cgcgcggcuuggcgcccuucc

SEQ ID NO: 3102970 - RNA, 20 nt, Molluscum contagiosum virus
cgcgcggggcacugcgcacg

SEQ ID NO: 3102971 - RNA, 19 nt, Molluscum contagiosum virus
cgcgaucuuccgcgacgag

SEQ ID NO: 3102972 - RNA, 21 nt, Molluscum contagiosum virus
cgcgaucuuccgcgacgagcu

SEQ ID NO: 3102973 - RNA, 14 nt, Molluscum contagiosum virus
cgcgaugugcaccu

SEQ ID NO: 3102974 - RNA, 23 nt, Molluscum contagiosum virus
cgcgauuuacuucgacgcggugc

SEQ ID NO: 3102975 - RNA, 15 nt, Molluscum contagiosum virus
cgcgcaacacugcag

SEQ ID NO: 3102976 - RNA, 13 nt, Molluscum contagiosum virus
cgcgcaaccagcu

SEQ ID NO: 3102977 - RNA, 18 nt, Molluscum contagiosum virus
cgcgcaaccagcuggcgc

SEQ ID NO: 3102978 - RNA, 21 nt, Molluscum contagiosum virus
cgcgcaaccagcuggcgcccg

SEQ ID NO: 3102979 - RNA, 19 nt, Molluscum contagiosum virus
cgcgcaagaacaaccagac

SEQ ID NO: 3102980 - RNA, 17 nt, Molluscum contagiosum virus
cgcgcaaggccgcgccc

SEQ ID NO: 3102981 - RNA, 20 nt, Molluscum contagiosum virus
cgcgcaagucaccgcuccgc

SEQ ID NO: 3102982 - RNA, 18 nt, Molluscum contagiosum virus
cgcgcaaguccagcgcgc

SEQ ID NO: 3102983 - RNA, 23 nt, Molluscum contagiosum virus
cgcgcaaguccagcgcgcucgag

SEQ ID NO: 3102984 - RNA, 16 nt, Molluscum contagiosum virus
cgcgcaagucgcgcgc

SEQ ID NO: 3102985 - RNA, 18 nt, Molluscum contagiosum virus
cgcgagucgcgccgagga

SEQ ID NO: 3102986 - RNA, 12 nt, Molluscum contagiosum virus
cgcgagugugca

SEQ ID NO: 3102987 - RNA, 14 nt, Molluscum contagiosum virus
cgcgagugugcgug

SEQ ID NO: 3102988 - RNA, 17 nt, Molluscum contagiosum virus
cgcgagugugcgugucu

SEQ ID NO: 3102989 - RNA, 20 nt, Molluscum contagiosum virus
cgcgaguugcgucucccgcg

SEQ ID NO: 3102990 - RNA, 19 nt, Molluscum contagiosum virus
cgcgaggagacguagagca

SEQ ID NO: 3102991 - RNA, 20 nt, Molluscum contagiosum virus
cgcgaggcaugucgcggugc

SEQ ID NO: 3102992 - RNA, 17 nt, Molluscum contagiosum virus
cgcgagcucgcgucauc

SEQ ID NO: 3102993 - RNA, 15 nt, Molluscum contagiosum virus
cgcgagcugcgggcg

SEQ ID NO: 3102994 - RNA, 19 nt, Molluscum contagiosum virus
cgcgagcuggagcgcgucg

SEQ ID NO: 3102995 - RNA, 20 nt, Molluscum contagiosum virus
cgcgagcaguucgcgcgccu

SEQ ID NO: 3102996 - RNA, 22 nt, Molluscum contagiosum virus
cgcgagcaguucgcgcgccugc

SEQ ID NO: 3102997 - RNA, 17 nt, Molluscum contagiosum virus
cgcgagcaugccgccgc

SEQ ID NO: 3102998 - RNA, 22 nt, Molluscum contagiosum virus
cgcgagcaugccgccgcguacg

SEQ ID NO: 3102999 - RNA, 13 nt, Molluscum contagiosum virus
cgcgagccacgcg

SEQ ID NO: 3103000 - RNA, 22 nt, Molluscum contagiosum virus
cgcgagcccaccgauggacuuc

SEQ ID NO: 3103001 - RNA, 17 nt, Molluscum contagiosum virus
cgcgagcaagcgcccgc

SEQ ID NO: 3103002 - RNA, 18 nt, Molluscum contagiosum virus
cgcgagcaagcgcccgcg

SEQ ID NO: 3103003 - RNA, 22 nt, Molluscum contagiosum virus
cgcgagcaagcgcccgcgagcg

SEQ ID NO: 3103004 - RNA, 16 nt, Molluscum contagiosum virus
cgcgagcacccccgcu

SEQ ID NO: 3103005 - RNA, 18 nt, Molluscum contagiosum virus
cgcgagcacgccugcacg

SEQ ID NO: 3103006 - RNA, 16 nt, Molluscum contagiosum virus
ccuccagcagcggcgc

SEQ ID NO: 3103007 - RNA, 19 nt, Molluscum contagiosum virus
cgcgagcgcaugcgcgccg

SEQ ID NO: 3103008 - RNA, 20 nt, Molluscum contagiosum virus
cgcgagcgcaugcgcgccgc

SEQ ID NO: 3103009 - RNA, 23 nt, Molluscum contagiosum virus
cgcgagcgcaugcgcgccgcgcu

SEQ ID NO: 3103010 - RNA, 13 nt, Molluscum contagiosum virus
cgcgagcgccacu

SEQ ID NO: 3103011 - RNA, 14 nt, Molluscum contagiosum virus
cgcgagcgcgcgcu

SEQ ID NO: 3103012 - RNA, 22 nt, Molluscum contagiosum virus
cgcgagcgcgcgcugcgcgccg

SEQ ID NO: 3103013 - RNA, 13 nt, Molluscum contagiosum virus
cgcgagcgcgggc

SEQ ID NO: 3103014 - RNA, 23 nt, Molluscum contagiosum virus
ccucauuguucggaggcugcucc

SEQ ID NO: 3103015 - RNA, 14 nt, Molluscum contagiosum virus
ccuccagggcacga

SEQ ID NO: 3103016 - RNA, 12 nt, Molluscum contagiosum virus
cgcgagaacuuu

SEQ ID NO: 3103017 - RNA, 22 nt, Molluscum contagiosum virus
cgcgagaagucgggcuggcgug

SEQ ID NO: 3103018 - RNA, 23 nt, Molluscum contagiosum virus
cgcgagagcuacagcaugcgugc

SEQ ID NO: 3103019 - RNA, 13 nt, Molluscum contagiosum virus
cgcgagaugcgcg

SEQ ID NO: 3103020 - RNA, 14 nt, Molluscum contagiosum virus
cgcgagaugcgcgg

SEQ ID NO: 3103021 - RNA, 15 nt, Molluscum contagiosum virus
ccucaccgcgcacau

SEQ ID NO: 3103022 - RNA, 16 nt, Molluscum contagiosum virus
ccucaccucugcgcgg

SEQ ID NO: 3103023 - RNA, 20 nt, Molluscum contagiosum virus
ccucacggcgagcgcgcccu

SEQ ID NO: 3103024 - RNA, 17 nt, Molluscum contagiosum virus
ccucagccgagcgccgc

SEQ ID NO: 3103025 - RNA, 20 nt, Molluscum contagiosum virus
ccuaucucaaagaacgcgcg

SEQ ID NO: 3103026 - RNA, 19 nt, Molluscum contagiosum virus
ccuauaaauggacgcgcuc

SEQ ID NO: 3103027 - RNA, 20 nt, Molluscum contagiosum virus
ccuacgagcacauacacgcg

SEQ ID NO: 3103028 - RNA, 20 nt, Molluscum contagiosum virus
ccuacguggcgucgcgccgc

SEQ ID NO: 3103029 - RNA, 23 nt, Molluscum contagiosum virus
ccgcguagcuagcucugcgcgcg

SEQ ID NO: 3103030 - RNA, 17 nt, Molluscum contagiosum virus
ccgcgguggccgcgccg

SEQ ID NO: 3103031 - RNA, 21 nt, Molluscum contagiosum virus
ccgcguucuucguggcgcugg

SEQ ID NO: 3103032 - RNA, 16 nt, Molluscum contagiosum virus
ccgcuagagugcgcgg

SEQ ID NO: 3103033 - RNA, 19 nt, Molluscum contagiosum virus
ccgcuagagugcgcggaag

SEQ ID NO: 3103034 - RNA, 22 nt, Molluscum contagiosum virus
ccgcucacagcuucgcgagccc

SEQ ID NO: 3103035 - RNA, 17 nt, Molluscum contagiosum virus
ccgcuccggucaccgcg

SEQ ID NO: 3103036 - RNA, 16 nt, Molluscum contagiosum virus
ccgcuccuggucuucc

SEQ ID NO: 3103037 - RNA, 16 nt, Molluscum contagiosum virus
ccgcucggcacugcug

SEQ ID NO: 3103038 - RNA, 18 nt, Molluscum contagiosum virus
ccgcucggcacugcuggc

SEQ ID NO: 3103039 - RNA, 19 nt, Molluscum contagiosum virus
ccgcucguccagcugcgcg

SEQ ID NO: 3103040 - RNA, 22 nt, Molluscum contagiosum virus
ccgcucguccagcugcgcgagc

SEQ ID NO: 3103041 - RNA, 18 nt, Molluscum contagiosum virus
ccguggaggagccgcccg

SEQ ID NO: 3103042 - RNA, 23 nt, Molluscum contagiosum virus
ccgugcugcgucacaagcaccgc

SEQ ID NO: 3103043 - RNA, 17 nt, Molluscum contagiosum virus
ccgcuggugggcgugcg

SEQ ID NO: 3103044 - RNA, 17 nt, Molluscum contagiosum virus
ccgcuguacgugcugcc

SEQ ID NO: 3103045 - RNA, 17 nt, Molluscum contagiosum virus
ccgcugucacgcgagcu

SEQ ID NO: 3103046 - RNA, 13 nt, Molluscum contagiosum virus
ccgcugcgcggag

SEQ ID NO: 3103047 - RNA, 15 nt, Molluscum contagiosum virus
ccgcugcgcggagcu

SEQ ID NO: 3103048 - RNA, 14 nt, Molluscum contagiosum virus
ccgcugcucgacau

SEQ ID NO: 3103049 - RNA, 21 nt, Molluscum contagiosum virus
ccgcugcuucguaaagcuggc

SEQ ID NO: 3103050 - RNA, 18 nt, Molluscum contagiosum virus
ccgcuggcggcgcacgcg

SEQ ID NO: 3103051 - RNA, 16 nt, Molluscum contagiosum virus
ccgcugcccgcgcacg

SEQ ID NO: 3103052 - RNA, 15 nt, Molluscum contagiosum virus
ccgcugccgcgcgcg

SEQ ID NO: 3103053 - RNA, 16 nt, Molluscum contagiosum virus
ccgcugccgcgcgcgc

SEQ ID NO: 3103054 - RNA, 18 nt, Molluscum contagiosum virus
ccgcugccgucgcgcgcu

SEQ ID NO: 3103055 - RNA, 22 nt, Molluscum contagiosum virus
ccgcugccgucgcgcgcugugg

SEQ ID NO: 3103056 - RNA, 15 nt, Molluscum contagiosum virus
ccguggugcgcgacc

SEQ ID NO: 3103057 - RNA, 16 nt, Molluscum contagiosum virus
ccguggugcgcgaccu

SEQ ID NO: 3103058 - RNA, 13 nt, Molluscum contagiosum virus
ccguggcgcgccg

SEQ ID NO: 3103059 - RNA, 13 nt, Molluscum contagiosum virus
ccgugggcgccgc

SEQ ID NO: 3103060 - RNA, 14 nt, Molluscum contagiosum virus
ccguguaccgccgc

SEQ ID NO: 3103061 - RNA, 18 nt, Molluscum contagiosum virus
ccguguccuacacgccgc

SEQ ID NO: 3103062 - RNA, 19 nt, Molluscum contagiosum virus
ccguguccuacacgccgcu

SEQ ID NO: 3103063 - RNA, 16 nt, Molluscum contagiosum virus
ccgugucggcaccgcg

SEQ ID NO: 3103064 - RNA, 15 nt, Molluscum contagiosum virus
ccguucacgggcacg

SEQ ID NO: 3103065 - RNA, 19 nt, Molluscum contagiosum virus
ccguugcacgugcgugccc

SEQ ID NO: 3103066 - RNA, 14 nt, Molluscum contagiosum virus
ccuagacacgagcg

SEQ ID NO: 3103067 - RNA, 20 nt, Molluscum contagiosum virus
ccuagaggaugcggauccuc

SEQ ID NO: 3103068 - RNA, 17 nt, Molluscum contagiosum virus
ccuagcguuucgcgaag

SEQ ID NO: 3103069 - RNA, 20 nt, Molluscum contagiosum virus
ccuaggcacuccgcgcaccg

SEQ ID NO: 3103070 - RNA, 20 nt, Molluscum contagiosum virus
ccgcaugcaccuacgcgccg

SEQ ID NO: 3103071 - RNA, 16 nt, Molluscum contagiosum virus
ccgcauugggccuuga

SEQ ID NO: 3103072 - RNA, 12 nt, Molluscum contagiosum virus
ccgccagcacca

SEQ ID NO: 3103073 - RNA, 19 nt, Molluscum contagiosum virus
ccgccagcgucgcgcgccg

SEQ ID NO: 3103074 - RNA, 13 nt, Molluscum contagiosum virus
ccgcgggcgcacg

SEQ ID NO: 3103075 - RNA, 17 nt, Molluscum contagiosum virus
ccgcgggcgcgcgccag

SEQ ID NO: 3103076 - RNA, 15 nt, Molluscum contagiosum virus
ccgcgggcgugcccg

SEQ ID NO: 3103077 - RNA, 18 nt, Molluscum contagiosum virus
ccgcgggcuggacugugc

SEQ ID NO: 3103078 - RNA, 22 nt, Molluscum contagiosum virus
ccgcggugcguugugcggggcu

SEQ ID NO: 3103079 - RNA, 20 nt, Molluscum contagiosum virus
ccgcgguguccuugcgccgc

SEQ ID NO: 3103080 - RNA, 23 nt, Molluscum contagiosum virus
ccgcguacacgugcacgcgcacg

SEQ ID NO: 3103081 - RNA, 18 nt, Molluscum contagiosum virus
ccgcguacagcgcgcgug

SEQ ID NO: 3103082 - RNA, 20 nt, Molluscum contagiosum virus
ccgcguacgcacgugccgug

SEQ ID NO: 3103083 - RNA, 14 nt, Molluscum contagiosum virus
ccgcguacgcgccg

SEQ ID NO: 3103084 - RNA, 15 nt, Molluscum contagiosum virus
ccgcgucgcgcgccg

SEQ ID NO: 3103085 - RNA, 20 nt, Molluscum contagiosum virus
ccgcgucguagacgcgcccg

SEQ ID NO: 3103086 - RNA, 12 nt, Molluscum contagiosum virus
ccgcgugcaccc

SEQ ID NO: 3103087 - RNA, 15 nt, Molluscum contagiosum virus
ccgcgugcacccucc

SEQ ID NO: 3103088 - RNA, 13 nt, Molluscum contagiosum virus
ccgcgugcgccgc

SEQ ID NO: 3103089 - RNA, 15 nt, Molluscum contagiosum virus
ccgcgugcgugcaca

SEQ ID NO: 3103090 - RNA, 13 nt, Molluscum contagiosum virus
ccgcgugcucgug

SEQ ID NO: 3103091 - RNA, 14 nt, Molluscum contagiosum virus
ccgcgugcucgugu

SEQ ID NO: 3103092 - RNA, 13 nt, Molluscum contagiosum virus
ccgcgugcucugc

SEQ ID NO: 3103093 - RNA, 18 nt, Molluscum contagiosum virus
ccgcgugcucugcuccgc

SEQ ID NO: 3103094 - RNA, 13 nt, Molluscum contagiosum virus
ccgcgugcuggcg

SEQ ID NO: 3103095 - RNA, 16 nt, Molluscum contagiosum virus
ccgcguggcgcgcgac

SEQ ID NO: 3103096 - RNA, 15 nt, Molluscum contagiosum virus
ccgcacgcugcugcg

SEQ ID NO: 3103097 - RNA, 17 nt, Molluscum contagiosum virus
ccgcacgcugcugcgug

SEQ ID NO: 3103098 - RNA, 18 nt, Molluscum contagiosum virus
ccgcacguggagucacga

SEQ ID NO: 3103099 - RNA, 23 nt, Molluscum contagiosum virus
ccgcacuauggacgcuugcuagc

SEQ ID NO: 3103100 - RNA, 14 nt, Molluscum contagiosum virus
ccgcacucgccgcg

SEQ ID NO: 3103101 - RNA, 18 nt, Molluscum contagiosum virus
ccgcacucgccgcggaac

SEQ ID NO: 3103102 - RNA, 19 nt, Molluscum contagiosum virus
ccgcaagugcacgcggcgc

SEQ ID NO: 3103103 - RNA, 22 nt, Molluscum contagiosum virus
ccgcaagugcacgcggcgcgug

SEQ ID NO: 3103104 - RNA, 19 nt, Molluscum contagiosum virus
ccgcaauuacgugcgcgag

SEQ ID NO: 3103105 - RNA, 18 nt, Molluscum contagiosum virus
ccgcagcacgcgugugcg

SEQ ID NO: 3103106 - RNA, 15 nt, Molluscum contagiosum virus
ccgcagccacggccg

SEQ ID NO: 3103107 - RNA, 16 nt, Molluscum contagiosum virus
ccgcagcccacgugcc

SEQ ID NO: 3103108 - RNA, 22 nt, Molluscum contagiosum virus
ccgcagcccgagcgcgcgugcg

SEQ ID NO: 3103109 - RNA, 15 nt, Molluscum contagiosum virus
ccgcagccgcgcucg

SEQ ID NO: 3103110 - RNA, 18 nt, Molluscum contagiosum virus
ccgcagccggagcuugcg

SEQ ID NO: 3103111 - RNA, 16 nt, Molluscum contagiosum virus
ccgcagcggcgccacc

SEQ ID NO: 3103112 - RNA, 22 nt, Molluscum contagiosum virus
ccgcaggaaaggcaccccgcag

SEQ ID NO: 3103113 - RNA, 21 nt, Molluscum contagiosum virus
ccgcaggaaagguacccgcag

SEQ ID NO: 3103114 - RNA, 18 nt, Molluscum contagiosum virus
ccgcaggaaccgcgugcg

SEQ ID NO: 3103115 - RNA, 19 nt, Molluscum contagiosum virus
ccgcaggcccggcggcccg

SEQ ID NO: 3103116 - RNA, 16 nt, Molluscum contagiosum virus
ccgcaggcgcgcgcca

SEQ ID NO: 3103117 - RNA, 20 nt, Molluscum contagiosum virus
ccgcaggcgucaugcgcgcg

SEQ ID NO: 3103118 - RNA, 22 nt, Molluscum contagiosum virus
ccgcaggcgucaugcgcgcgcg

SEQ ID NO: 3103119 - RNA, 20 nt, Molluscum contagiosum virus
ccgcagugcucgcacacgug

SEQ ID NO: 3103120 - RNA, 18 nt, Molluscum contagiosum virus
ccgauuuggacgcggcac

SEQ ID NO: 3103121 - RNA, 20 nt, Molluscum contagiosum virus
ccgcaaaauguagacgggcu

SEQ ID NO: 3103122 - RNA, 14 nt, Molluscum contagiosum virus
ccgauguccugcgg

SEQ ID NO: 3103123 - RNA, 15 nt, Molluscum contagiosum virus
ccgaucgcgagaacg

SEQ ID NO: 3103124 - RNA, 16 nt, Molluscum contagiosum virus
ccgaugcagugcggau

SEQ ID NO: 3103125 - RNA, 15 nt, Molluscum contagiosum virus
cacugcuggcgcgcg

SEQ ID NO: 3103126 - RNA, 15 nt, Molluscum contagiosum virus
cagaagcgagagcgc

SEQ ID NO: 3103127 - RNA, 18 nt, Molluscum contagiosum virus
cacuuccgugagcagucc

SEQ ID NO: 3103128 - RNA, 14 nt, Molluscum contagiosum virus
cacuugcacgcgca

SEQ ID NO: 3103129 - RNA, 16 nt, Molluscum contagiosum virus
cacuugccgggcgacg

SEQ ID NO: 3103130 - RNA, 17 nt, Molluscum contagiosum virus
cacugugcuggcgcacu

SEQ ID NO: 3103131 - RNA, 20 nt, Molluscum contagiosum virus
cacuggcgcgcacgcgcacg

SEQ ID NO: 3103132 - RNA, 22 nt, Molluscum contagiosum virus
cacugggaacaccacacgcgcg

SEQ ID NO: 3103133 - RNA, 15 nt, Molluscum contagiosum virus
cagacaacaccagcg

SEQ ID NO: 3103134 - RNA, 19 nt, Molluscum contagiosum virus
cagacaacaccagcgugcc

SEQ ID NO: 3103135 - RNA, 15 nt, Molluscum contagiosum virus
cagaccaagaagccc

SEQ ID NO: 3103136 - RNA, 21 nt, Molluscum contagiosum virus
cagaccagagugacgucuucc

SEQ ID NO: 3103137 - RNA, 19 nt, Molluscum contagiosum virus
cagaccccugaaaggcauc

SEQ ID NO: 3103138 - RNA, 18 nt, Molluscum contagiosum virus
cagacccgaaagcugccc

SEQ ID NO: 3103139 - RNA, 13 nt, Molluscum contagiosum virus
cagcagcgccagc

SEQ ID NO: 3103140 - RNA, 14 nt, Molluscum contagiosum virus
cagcagcgccagcu

SEQ ID NO: 3103141 - RNA, 17 nt, Molluscum contagiosum virus
cagcagcggcgcgugcu

SEQ ID NO: 3103142 - RNA, 12 nt, Molluscum contagiosum virus
cagcagcgugca

SEQ ID NO: 3103143 - RNA, 23 nt, Molluscum contagiosum virus
cagcagcuccagcauggcgccac

SEQ ID NO: 3103144 - RNA, 16 nt, Molluscum contagiosum virus
cagcagcuggccggcu

SEQ ID NO: 3103145 - RNA, 14 nt, Molluscum contagiosum virus
cagcagcuggcgcg

SEQ ID NO: 3103146 - RNA, 17 nt, Molluscum contagiosum virus
cagacgcagcgcgagcu

SEQ ID NO: 3103147 - RNA, 13 nt, Molluscum contagiosum virus
cagacgcgcgucc

SEQ ID NO: 3103148 - RNA, 15 nt, Molluscum contagiosum virus
cagcaggugcacgug

SEQ ID NO: 3103149 - RNA, 23 nt, Molluscum contagiosum virus
cagcaggcacuccagcgcgcccu

SEQ ID NO: 3103150 - RNA, 20 nt, Molluscum contagiosum virus
cagcagucaguuccgcggcg

SEQ ID NO: 3103151 - RNA, 15 nt, Molluscum contagiosum virus
cagcaguccgccguc

SEQ ID NO: 3103152 - RNA, 16 nt, Molluscum contagiosum virus
cagcaucgggcugucg

SEQ ID NO: 3103153 - RNA, 20 nt, Molluscum contagiosum virus
cagcaugaacucgcugcugc

SEQ ID NO: 3103154 - RNA, 15 nt, Molluscum contagiosum virus
cagcauggcgccaca

SEQ ID NO: 3103155 - RNA, 20 nt, Molluscum contagiosum virus
cagcauuagcgccaaggcgc

SEQ ID NO: 3103156 - RNA, 16 nt, Molluscum contagiosum virus
cagcauucccggcgcg

SEQ ID NO: 3103157 - RNA, 17 nt, Molluscum contagiosum virus
cagcauucccggcgcgc

SEQ ID NO: 3103158 - RNA, 14 nt, Molluscum contagiosum virus
cagccccgcgccag

SEQ ID NO: 3103159 - RNA, 20 nt, Molluscum contagiosum virus
cagccccgcgccagcagucc

SEQ ID NO: 3103160 - RNA, 16 nt, Molluscum contagiosum virus
cagccccugcugcucg

SEQ ID NO: 3103161 - RNA, 13 nt, Molluscum contagiosum virus
cagccgagccggg

SEQ ID NO: 3103162 - RNA, 19 nt, Molluscum contagiosum virus
cagccgagcgccgccagcu

SEQ ID NO: 3103163 - RNA, 16 nt, Molluscum contagiosum virus
cagccgcaccgggacg

SEQ ID NO: 3103164 - RNA, 14 nt, Molluscum contagiosum virus
cagccgcacggcgc

SEQ ID NO: 3103165 - RNA, 21 nt, Molluscum contagiosum virus
cagcccgacuucucgcgcgac

SEQ ID NO: 3103166 - RNA, 22 nt, Molluscum contagiosum virus
cagcccgacuucucgcgcgacu

SEQ ID NO: 3103167 - RNA, 24 nt, Molluscum contagiosum virus
cagccaggcuaggcgcgacugcac

SEQ ID NO: 3103168 - RNA, 18 nt, Molluscum contagiosum virus
cagccaucgugcgcgacu

SEQ ID NO: 3103169 - RNA, 20 nt, Molluscum contagiosum virus
cagcgacgagcagcugcuuc

SEQ ID NO: 3103170 - RNA, 13 nt, Molluscum contagiosum virus
cagcgacgcgacg

SEQ ID NO: 3103171 - RNA, 19 nt, Molluscum contagiosum virus
cagccgccugccgcgcucg

SEQ ID NO: 3103172 - RNA, 14 nt, Molluscum contagiosum virus
cagccgcgagcgcg

SEQ ID NO: 3103173 - RNA, 14 nt, Molluscum contagiosum virus
cagccgcgcggcag

SEQ ID NO: 3103174 - RNA, 13 nt, Molluscum contagiosum virus
cagccgcugcgcc

SEQ ID NO: 3103175 - RNA, 13 nt, Molluscum contagiosum virus
cagccgcugcugc

SEQ ID NO: 3103176 - RNA, 14 nt, Molluscum contagiosum virus
cagccgcuggacgc

SEQ ID NO: 3103177 - RNA, 20 nt, Molluscum contagiosum virus
cagccgucgccgcgcccgcg

SEQ ID NO: 3103178 - RNA, 20 nt, Molluscum contagiosum virus
cagccuagaaacgacgggcg

SEQ ID NO: 3103179 - RNA, 20 nt, Molluscum contagiosum virus
cagcgagaucaacgcgcgcg

SEQ ID NO: 3103180 - RNA, 22 nt, Molluscum contagiosum virus
cagccuccgguuuucgcgggag

SEQ ID NO: 3103181 - RNA, 21 nt, Molluscum contagiosum virus
cagccuccgugcgccaguccg

SEQ ID NO: 3103182 - RNA, 14 nt, Molluscum contagiosum virus
cacuccucggcgcu

SEQ ID NO: 3103183 - RNA, 12 nt, Molluscum contagiosum virus
cacucgagaaga

SEQ ID NO: 3103184 - RNA, 16 nt, Molluscum contagiosum virus
cacucgauggacgcca

SEQ ID NO: 3103185 - RNA, 22 nt, Molluscum contagiosum virus
cacucgcgaacuacgagcgcac

SEQ ID NO: 3103186 - RNA, 14 nt, Molluscum contagiosum virus
cacucgcgcucgcg

SEQ ID NO: 3103187 - RNA, 14 nt, Molluscum contagiosum virus
cacucucgcgcgug

SEQ ID NO: 3103188 - RNA, 17 nt, Molluscum contagiosum virus
cacucacaugugcugcc

SEQ ID NO: 3103189 - RNA, 15 nt, Molluscum contagiosum virus
cacugcucgcgcacg

SEQ ID NO: 3103190 - RNA, 18 nt, Molluscum contagiosum virus
cacugcggcaacgagcac

SEQ ID NO: 3103191 - RNA, 20 nt, Molluscum contagiosum virus
cacugcggcaacgagcacgu

SEQ ID NO: 3103192 - RNA, 14 nt, Molluscum contagiosum virus
cacuccgucgcgcu

SEQ ID NO: 3103193 - RNA, 16 nt, Molluscum contagiosum virus
cacuccgucgcgcucg

SEQ ID NO: 3103194 - RNA, 15 nt, Molluscum contagiosum virus
cacguugcacugcgc

SEQ ID NO: 3103195 - RNA, 16 nt, Molluscum contagiosum virus
cacguugccgcgcgcu

SEQ ID NO: 3103196 - RNA, 18 nt, Molluscum contagiosum virus
cacguugccgcgcgcugc

SEQ ID NO: 3103197 - RNA, 22 nt, Molluscum contagiosum virus
cacguugggguugucgggcgcu

SEQ ID NO: 3103198 - RNA, 19 nt, Molluscum contagiosum virus
cacguuuuucgcgggcgcc

SEQ ID NO: 3103199 - RNA, 13 nt, Molluscum contagiosum virus
cacgccgcucggc

SEQ ID NO: 3103200 - RNA, 23 nt, Molluscum contagiosum virus
cacgugcugcagcugcgcgagcc

SEQ ID NO: 3103201 - RNA, 17 nt, Molluscum contagiosum virus
cacgugcugcugcggcu

SEQ ID NO: 3103202 - RNA, 23 nt, Molluscum contagiosum virus
cacgugcugcugcggcugcugga

SEQ ID NO: 3103203 - RNA, 22 nt, Molluscum contagiosum virus
cacguggccaaggucucgagcu

SEQ ID NO: 3103204 - RNA, 23 nt, Molluscum contagiosum virus
cacguggugguuggcgugcucgc

SEQ ID NO: 3103205 - RNA, 19 nt, Molluscum contagiosum virus
cacguuccagagcacugcg

SEQ ID NO: 3103206 - RNA, 15 nt, Molluscum contagiosum virus
cacgccagguguucc

SEQ ID NO: 3103207 - RNA, 19 nt, Molluscum contagiosum virus
cacgcccgaggaccggcgc

SEQ ID NO: 3103208 - RNA, 15 nt, Molluscum contagiosum virus
cacgcccgcgcugcg

SEQ ID NO: 3103209 - RNA, 13 nt, Molluscum contagiosum virus
cacgcccgcgucc

SEQ ID NO: 3103210 - RNA, 22 nt, Molluscum contagiosum virus
cacgccgacuuccgacgggccg

SEQ ID NO: 3103211 - RNA, 13 nt, Molluscum contagiosum virus
cacgcacgcgcgg

SEQ ID NO: 3103212 - RNA, 15 nt, Molluscum contagiosum virus
cacgcacgcgcgggc

SEQ ID NO: 3103213 - RNA, 19 nt, Molluscum contagiosum virus
cacgcacggcccgggugcg

SEQ ID NO: 3103214 - RNA, 17 nt, Molluscum contagiosum virus
cacgcacuugcgcgccu

SEQ ID NO: 3103215 - RNA, 19 nt, Molluscum contagiosum virus
cacgcagcuggcgggcgug

SEQ ID NO: 3103216 - RNA, 18 nt, Molluscum contagiosum virus
cacgcaggacuggcaccu

SEQ ID NO: 3103217 - RNA, 18 nt, Molluscum contagiosum virus
cacgcaaaugcgcgcgaa

SEQ ID NO: 3103218 - RNA, 14 nt, Molluscum contagiosum virus
cacgcagugccacg

SEQ ID NO: 3103219 - RNA, 22 nt, Molluscum contagiosum virus
cacgacgcuuucguccgccgcu

SEQ ID NO: 3103220 - RNA, 22 nt, Molluscum contagiosum virus
cacgacggaacguuggcccgca

SEQ ID NO: 3103221 - RNA, 21 nt, Molluscum contagiosum virus
cacgacggacuucuugcgcgg

SEQ ID NO: 3103222 - RNA, 13 nt, Molluscum contagiosum virus
cacgaccgcgcac

SEQ ID NO: 3103223 - RNA, 18 nt, Molluscum contagiosum virus
cacgcaagcccgcgcgcg

SEQ ID NO: 3103224 - RNA, 20 nt, Molluscum contagiosum virus
cacgcaaggcaugcgcgcag

SEQ ID NO: 3103225 - RNA, 16 nt, Molluscum contagiosum virus
cacgcaaucgcgcgcg

SEQ ID NO: 3103226 - RNA, 15 nt, Molluscum contagiosum virus
cacgcacacgacgac

SEQ ID NO: 3103227 - RNA, 16 nt, Molluscum contagiosum virus
cacgcacacgacgacg

SEQ ID NO: 3103228 - RNA, 14 nt, Molluscum contagiosum virus
cacgaugcgcucgu

SEQ ID NO: 3103229 - RNA, 17 nt, Molluscum contagiosum virus
cacgaugcgcucguggu

SEQ ID NO: 3103230 - RNA, 19 nt, Molluscum contagiosum virus
cacgaugugcgcgcgacgu

SEQ ID NO: 3103231 - RNA, 20 nt, Molluscum contagiosum virus
caccguggaggagccgcccg

SEQ ID NO: 3103232 - RNA, 17 nt, Molluscum contagiosum virus
caccguugccgcggcag

SEQ ID NO: 3103233 - RNA, 15 nt, Molluscum contagiosum virus
caccucugcgcggcc

SEQ ID NO: 3103234 - RNA, 16 nt, Molluscum contagiosum virus
caccugcacgacguac

SEQ ID NO: 3103235 - RNA, 15 nt, Molluscum contagiosum virus
caccugcacgagccg

SEQ ID NO: 3103236 - RNA, 13 nt, Molluscum contagiosum virus
caccucgcacgug

SEQ ID NO: 3103237 - RNA, 16 nt, Molluscum contagiosum virus
caccuagagcacgaag

SEQ ID NO: 3103238 - RNA, 15 nt, Molluscum contagiosum virus
caccucaccgcgcac

SEQ ID NO: 3103239 - RNA, 16 nt, Molluscum contagiosum virus
caccgccugcugcagc

SEQ ID NO: 3103240 - RNA, 21 nt, Molluscum contagiosum virus
caccgccuguaccugcucggg

SEQ ID NO: 3103241 - RNA, 20 nt, Molluscum contagiosum virus
caccgcgagcaccacuacug

SEQ ID NO: 3103242 - RNA, 19 nt, Molluscum contagiosum virus
caccggccuuuugucguuc

SEQ ID NO: 3103243 - RNA, 13 nt, Molluscum contagiosum virus
caccgggcgccgc

SEQ ID NO: 3103244 - RNA, 15 nt, Molluscum contagiosum virus
caccgcggcgcggag

SEQ ID NO: 3103245 - RNA, 22 nt, Molluscum contagiosum virus
caccgcguccgcuaccgcagcc

SEQ ID NO: 3103246 - RNA, 16 nt, Molluscum contagiosum virus
caccguaccgcgcccg

SEQ ID NO: 3103247 - RNA, 17 nt, Molluscum contagiosum virus
caccuucggaacugcgg

SEQ ID NO: 3103248 - RNA, 18 nt, Molluscum contagiosum virus
caccuucggaacugcgga

SEQ ID NO: 3103249 - RNA, 13 nt, Molluscum contagiosum virus
caccugcgacgcc

SEQ ID NO: 3103250 - RNA, 11 nt, Molluscum contagiosum virus
caccugcgcaa

SEQ ID NO: 3103251 - RNA, 16 nt, Molluscum contagiosum virus
caccuuuuccacgcgg

SEQ ID NO: 3103252 - RNA, 17 nt, Molluscum contagiosum virus
cacgaagacuacggcac

SEQ ID NO: 3103253 - RNA, 22 nt, Molluscum contagiosum virus
cacgaaggacgcgcuugcgcgg

SEQ ID NO: 3103254 - RNA, 14 nt, Molluscum contagiosum virus
cacgaaucgcucgc

SEQ ID NO: 3103255 - RNA, 21 nt, Molluscum contagiosum virus
cacgacguacgagugcuggag

SEQ ID NO: 3103256 - RNA, 15 nt, Molluscum contagiosum virus
cacgacucgcgucug

SEQ ID NO: 3103257 - RNA, 21 nt, Molluscum contagiosum virus
cacgagacugagugcugagcc

SEQ ID NO: 3103258 - RNA, 17 nt, Molluscum contagiosum virus
cacgagauggcugcucu

SEQ ID NO: 3103259 - RNA, 21 nt, Molluscum contagiosum virus
cacgagaugggcccgcgcgcg

SEQ ID NO: 3103260 - RNA, 20 nt, Molluscum contagiosum virus
cacgagcacugccugccgcc

SEQ ID NO: 3103261 - RNA, 21 nt, Molluscum contagiosum virus
cacgagcgaaaacgcgugucu

SEQ ID NO: 3103262 - RNA, 13 nt, Molluscum contagiosum virus
cacgagcgcggca

SEQ ID NO: 3103263 - RNA, 14 nt, Molluscum contagiosum virus
cacgagcgcggcaa

SEQ ID NO: 3103264 - RNA, 14 nt, Molluscum contagiosum virus
cacgagcugcugcc

SEQ ID NO: 3103265 - RNA, 20 nt, Molluscum contagiosum virus
cacgaggacugggaacccgu

SEQ ID NO: 3103266 - RNA, 20 nt, Molluscum contagiosum virus
cacgagggccuuggcggcgc

SEQ ID NO: 3103267 - RNA, 21 nt, Molluscum contagiosum virus
cacgaggggcaagcucgcgcu

SEQ ID NO: 3103268 - RNA, 18 nt, Molluscum contagiosum virus
cacgagugcccgcgcgcu

SEQ ID NO: 3103269 - RNA, 17 nt, Molluscum contagiosum virus
cacgagugcuugcgcgg

SEQ ID NO: 3103270 - RNA, 15 nt, Molluscum contagiosum virus
agaaaaauacgugua

SEQ ID NO: 3103271 - RNA, 15 nt, Molluscum contagiosum virus
agaaacgacgggcgc

SEQ ID NO: 3103272 - RNA, 15 nt, Molluscum contagiosum virus
agaagugugccugcu

SEQ ID NO: 3103273 - RNA, 18 nt, Molluscum contagiosum virus
agaagagggucgugcagg

SEQ ID NO: 3103274 - RNA, 14 nt, Molluscum contagiosum virus
agacaacaccagcg

SEQ ID NO: 3103275 - RNA, 21 nt, Molluscum contagiosum virus
agacaacacucgugcucgugu

SEQ ID NO: 3103276 - RNA, 17 nt, Molluscum contagiosum virus
acguguccgcauccgcc

SEQ ID NO: 3103277 - RNA, 17 nt, Molluscum contagiosum virus
acgugguccaccagcac

SEQ ID NO: 3103278 - RNA, 23 nt, Molluscum contagiosum virus
acgugugcucugugcgcgcagac

SEQ ID NO: 3103279 - RNA, 13 nt, Molluscum contagiosum virus
acguggcgccgcu

SEQ ID NO: 3103280 - RNA, 16 nt, Molluscum contagiosum virus
acgucuccucgcgcac

SEQ ID NO: 3103281 - RNA, 20 nt, Molluscum contagiosum virus
acgugccaagaccugggcgu

SEQ ID NO: 3103282 - RNA, 15 nt, Molluscum contagiosum virus
acgugcccuacgcgc

SEQ ID NO: 3103283 - RNA, 21 nt, Molluscum contagiosum virus
acgugcgccagcucugggcgc

SEQ ID NO: 3103284 - RNA, 17 nt, Molluscum contagiosum virus
acgugcgcgcugcgcgc

SEQ ID NO: 3103285 - RNA, 17 nt, Molluscum contagiosum virus
acgugcguacgcggcgc

SEQ ID NO: 3103286 - RNA, 21 nt, Molluscum contagiosum virus
acgugcgucuuuuugcggcgc

SEQ ID NO: 3103287 - RNA, 22 nt, Molluscum contagiosum virus
acgugcgugguguccacgcgcg

SEQ ID NO: 3103288 - RNA, 17 nt, Molluscum contagiosum virus
acgugcugcagcguaug

SEQ ID NO: 3103289 - RNA, 19 nt, Molluscum contagiosum virus
acgugcugcagcugcgcga

SEQ ID NO: 3103290 - RNA, 20 nt, Molluscum contagiosum virus
acgugcugcagcugcgcgag

SEQ ID NO: 3103291 - RNA, 14 nt, Molluscum contagiosum virus
acgugcugcgcacg

SEQ ID NO: 3103292 - RNA, 13 nt, Molluscum contagiosum virus
acgugcugcgccg

SEQ ID NO: 3103293 - RNA, 15 nt, Molluscum contagiosum virus
acgugcugcugcggc

SEQ ID NO: 3103294 - RNA, 14 nt, Molluscum contagiosum virus
acgugcuugcgcgc

SEQ ID NO: 3103295 - RNA, 17 nt, Molluscum contagiosum virus
acgugcuugcgcgcgag

SEQ ID NO: 3103296 - RNA, 15 nt, Molluscum contagiosum virus
acguggacguggaua

SEQ ID NO: 3103297 - RNA, 14 nt, Molluscum contagiosum virus
acgucuucuaccgc

SEQ ID NO: 3103298 - RNA, 19 nt, Molluscum contagiosum virus
acgugacagucagcggcgu

SEQ ID NO: 3103299 - RNA, 16 nt, Molluscum contagiosum virus
acgugaccucgcugcu

SEQ ID NO: 3103300 - RNA, 16 nt, Molluscum contagiosum virus
acgugacgcgccucga

SEQ ID NO: 3103301 - RNA, 16 nt, Molluscum contagiosum virus
acgugacugagggcgc

SEQ ID NO: 3103302 - RNA, 15 nt, Molluscum contagiosum virus
acgugaucgcgcagg

SEQ ID NO: 3103303 - RNA, 15 nt, Molluscum contagiosum virus
acgugcacgcgcacg

SEQ ID NO: 3103304 - RNA, 14 nt, Molluscum contagiosum virus
acgugcagcggcgc

SEQ ID NO: 3103305 - RNA, 23 nt, Molluscum contagiosum virus
acgugcagcggcgccacgagcgc

SEQ ID NO: 3103306 - RNA, 15 nt, Molluscum contagiosum virus
acgucgcgcgcucgc

SEQ ID NO: 3103307 - RNA, 15 nt, Molluscum contagiosum virus
acguaguacugcagc

SEQ ID NO: 3103308 - RNA, 18 nt, Molluscum contagiosum virus
caccgacacgcgcccgcc

SEQ ID NO: 3103309 - RNA, 19 nt, Molluscum contagiosum virus
caccgagcgcuacgacgac

SEQ ID NO: 3103310 - RNA, 17 nt, Molluscum contagiosum virus
caccgccgagauggagc

SEQ ID NO: 3103311 - RNA, 16 nt, Molluscum contagiosum virus
caccgcaucccccgcg

SEQ ID NO: 3103312 - RNA, 17 nt, Molluscum contagiosum virus
agagcacgcgcucgcgc

SEQ ID NO: 3103313 - RNA, 14 nt, Molluscum contagiosum virus
agagcacugcgcgu

SEQ ID NO: 3103314 - RNA, 13 nt, Molluscum contagiosum virus
cacccgcgcucga

SEQ ID NO: 3103315 - RNA, 19 nt, Molluscum contagiosum virus
cacccgcaggaaaggcacc

SEQ ID NO: 3103316 - RNA, 20 nt, Molluscum contagiosum virus
agacuugccgucucgcgcuc

SEQ ID NO: 3103317 - RNA, 13 nt, Molluscum contagiosum virus
agagaaccugugc

SEQ ID NO: 3103318 - RNA, 15 nt, Molluscum contagiosum virus
agagaaccugugcgc

SEQ ID NO: 3103319 - RNA, 17 nt, Molluscum contagiosum virus
agacguggugcucgugg

SEQ ID NO: 3103320 - RNA, 21 nt, Molluscum contagiosum virus
agacuaccggcaguagcagcg

SEQ ID NO: 3103321 - RNA, 18 nt, Molluscum contagiosum virus
agacuauaugcgaagcgu

SEQ ID NO: 3103322 - RNA, 18 nt, Molluscum contagiosum virus
agacgucccgcagugugc

SEQ ID NO: 3103323 - RNA, 16 nt, Molluscum contagiosum virus
agacgugcggcacgcu

SEQ ID NO: 3103324 - RNA, 18 nt, Molluscum contagiosum virus
agaccuggucacacuggu

SEQ ID NO: 3103325 - RNA, 14 nt, Molluscum contagiosum virus
agacgcagcgcgag

SEQ ID NO: 3103326 - RNA, 20 nt, Molluscum contagiosum virus
agacgcagcgcgagcugugc

SEQ ID NO: 3103327 - RNA, 14 nt, Molluscum contagiosum virus
agacgcgcucgcgc

SEQ ID NO: 3103328 - RNA, 16 nt, Molluscum contagiosum virus
agacgcgcucgcgcuc

SEQ ID NO: 3103329 - RNA, 15 nt, Molluscum contagiosum virus
agacgcuagcugugc

SEQ ID NO: 3103330 - RNA, 14 nt, Molluscum contagiosum virus
agacgcugcgcgac

SEQ ID NO: 3103331 - RNA, 18 nt, Molluscum contagiosum virus
agacagcacggcacgugc

SEQ ID NO: 3103332 - RNA, 22 nt, Molluscum contagiosum virus
agacaucaucgcggagcugcgc

SEQ ID NO: 3103333 - RNA, 12 nt, Molluscum contagiosum virus
agaccacgcgcg

SEQ ID NO: 3103334 - RNA, 13 nt, Molluscum contagiosum virus
agaccacgcgcgc

SEQ ID NO: 3103335 - RNA, 15 nt, Molluscum contagiosum virus
acgcagucgccuucc

SEQ ID NO: 3103336 - RNA, 21 nt, Molluscum contagiosum virus
acgcagucgccuuccugcgcc

SEQ ID NO: 3103337 - RNA, 17 nt, Molluscum contagiosum virus
acgcauguacgcggcgg

SEQ ID NO: 3103338 - RNA, 14 nt, Molluscum contagiosum virus
acgccaagcgucgc

SEQ ID NO: 3103339 - RNA, 17 nt, Molluscum contagiosum virus
acgccauuuucgugcgc

SEQ ID NO: 3103340 - RNA, 13 nt, Molluscum contagiosum virus
acgccagcgacgc

SEQ ID NO: 3103341 - RNA, 12 nt, Molluscum contagiosum virus
acgccagcgcgc

SEQ ID NO: 3103342 - RNA, 18 nt, Molluscum contagiosum virus
acgccggggggcgccaag

SEQ ID NO: 3103343 - RNA, 22 nt, Molluscum contagiosum virus
acgccggggggcgccaaguccg

SEQ ID NO: 3103344 - RNA, 22 nt, Molluscum contagiosum virus
acgcccgagggcgggcacgugc

SEQ ID NO: 3103345 - RNA, 14 nt, Molluscum contagiosum virus
acgccgagcccgag

SEQ ID NO: 3103346 - RNA, 18 nt, Molluscum contagiosum virus
acgccgagcccgagcccg

SEQ ID NO: 3103347 - RNA, 13 nt, Molluscum contagiosum virus
acgccgagcgggc

SEQ ID NO: 3103348 - RNA, 14 nt, Molluscum contagiosum virus
acgccuagccugca

SEQ ID NO: 3103349 - RNA, 23 nt, Molluscum contagiosum virus
acgccuccaagaagaggccagca

SEQ ID NO: 3103350 - RNA, 23 nt, Molluscum contagiosum virus
acgccuccaagaagaggccggca

SEQ ID NO: 3103351 - RNA, 16 nt, Molluscum contagiosum virus
acgccguccgcgcagc

SEQ ID NO: 3103352 - RNA, 15 nt, Molluscum contagiosum virus
acgccgugcgcgugc

SEQ ID NO: 3103353 - RNA, 23 nt, Molluscum contagiosum virus
acgccgugcgcgugcggcggcgc

SEQ ID NO: 3103354 - RNA, 14 nt, Molluscum contagiosum virus
acgcagaggcgcgu

SEQ ID NO: 3103355 - RNA, 18 nt, Molluscum contagiosum virus
acgcagcgcgagcugugc

SEQ ID NO: 3103356 - RNA, 23 nt, Molluscum contagiosum virus
acgcagcuguggcgccugcgcgc

SEQ ID NO: 3103357 - RNA, 20 nt, Molluscum contagiosum virus
acgcaggaccuggcuggcgc

SEQ ID NO: 3103358 - RNA, 12 nt, Molluscum contagiosum virus
acgcacgcgcgc

SEQ ID NO: 3103359 - RNA, 14 nt, Molluscum contagiosum virus
acgcacgcgcgggc

SEQ ID NO: 3103360 - RNA, 14 nt, Molluscum contagiosum virus
acgcacucgcuggc

SEQ ID NO: 3103361 - RNA, 14 nt, Molluscum contagiosum virus
acgcacuugcgcgc

SEQ ID NO: 3103362 - RNA, 15 nt, Molluscum contagiosum virus
acgcagaaguggcgc

SEQ ID NO: 3103363 - RNA, 13 nt, Molluscum contagiosum virus
acgcgcgcgcagg

SEQ ID NO: 3103364 - RNA, 20 nt, Molluscum contagiosum virus
acgcgcgcguaacagcgcgc

SEQ ID NO: 3103365 - RNA, 13 nt, Molluscum contagiosum virus
acgcgcgcuuagc

SEQ ID NO: 3103366 - RNA, 18 nt, Molluscum contagiosum virus
acgcgcggcagacgccag

SEQ ID NO: 3103367 - RNA, 19 nt, Molluscum contagiosum virus
acgcgcggcagcagccucg

SEQ ID NO: 3103368 - RNA, 14 nt, Molluscum contagiosum virus
acgcgcggcggcgc

SEQ ID NO: 3103369 - RNA, 15 nt, Molluscum contagiosum virus
acgcggacgcgcagc

SEQ ID NO: 3103370 - RNA, 23 nt, Molluscum contagiosum virus
acgcggaggucgagcgcgccgcg

SEQ ID NO: 3103371 - RNA, 22 nt, Molluscum contagiosum virus
acgcgcguccgcaggcgucaug

SEQ ID NO: 3103372 - RNA, 17 nt, Molluscum contagiosum virus
acgcgcguggagcgcgc

SEQ ID NO: 3103373 - RNA, 21 nt, Molluscum contagiosum virus
acgcgcuaccgcaagcucaug

SEQ ID NO: 3103374 - RNA, 12 nt, Molluscum contagiosum virus
acgcgcugcgcc

SEQ ID NO: 3103375 - RNA, 14 nt, Molluscum contagiosum virus
acgcgcugcggcgc

SEQ ID NO: 3103376 - RNA, 14 nt, Molluscum contagiosum virus
acgcgcuugcgcgg

SEQ ID NO: 3103377 - RNA, 15 nt, Molluscum contagiosum virus
acgcguccacggcgc

SEQ ID NO: 3103378 - RNA, 23 nt, Molluscum contagiosum virus
acgcguccgccucuuccucgugc

SEQ ID NO: 3103379 - RNA, 20 nt, Molluscum contagiosum virus
acgcgugcauggcacgcgag

SEQ ID NO: 3103380 - RNA, 22 nt, Molluscum contagiosum virus
acgcgugccuggcuugcgcgcg

SEQ ID NO: 3103381 - RNA, 15 nt, Molluscum contagiosum virus
acgcgugcgcgccag

SEQ ID NO: 3103382 - RNA, 15 nt, Molluscum contagiosum virus
acgcgugcugcgcgg

SEQ ID NO: 3103383 - RNA, 23 nt, Molluscum contagiosum virus
acgcgugcugcgcggcgccgcag

SEQ ID NO: 3103384 - RNA, 15 nt, Molluscum contagiosum virus
acgcggugagugcgc

SEQ ID NO: 3103385 - RNA, 14 nt, Molluscum contagiosum virus
acgcggugcgcgcg

SEQ ID NO: 3103386 - RNA, 17 nt, Molluscum contagiosum virus
acgcggugcgcgcgugc

SEQ ID NO: 3103387 - RNA, 23 nt, Molluscum contagiosum virus
acgcggugugcacaugcccgugc

SEQ ID NO: 3103388 - RNA, 15 nt, Molluscum contagiosum virus
acgcguacauccgcg

SEQ ID NO: 3103389 - RNA, 17 nt, Molluscum contagiosum virus
acgcguacauccgcgag

SEQ ID NO: 3103390 - RNA, 14 nt, Molluscum contagiosum virus
acgcguaccagcgc

SEQ ID NO: 3103391 - RNA, 16 nt, Molluscum contagiosum virus
acgcguacguguccau

SEQ ID NO: 3103392 - RNA, 23 nt, Molluscum contagiosum virus
acgcguacguguccaugcacgac

SEQ ID NO: 3103393 - RNA, 22 nt, Molluscum contagiosum virus
acgcguagcacgaaggacgcgc

SEQ ID NO: 3103394 - RNA, 24 nt, Molluscum contagiosum virus
acgcgcaagugugcgcaucccucg

SEQ ID NO: 3103395 - RNA, 15 nt, Molluscum contagiosum virus
acgcgcacgcgcgag

SEQ ID NO: 3103396 - RNA, 20 nt, Molluscum contagiosum virus
acgcgcacgggccugcgcgc

SEQ ID NO: 3103397 - RNA, 14 nt, Molluscum contagiosum virus
acgcgcagcucgac

SEQ ID NO: 3103398 - RNA, 21 nt, Molluscum contagiosum virus
acgcgcagcuguuucugccgc

SEQ ID NO: 3103399 - RNA, 18 nt, Molluscum contagiosum virus
acgcgcaugaggcggcgc

SEQ ID NO: 3103400 - RNA, 15 nt, Molluscum contagiosum virus
acgcgcccuaagggc

SEQ ID NO: 3103401 - RNA, 19 nt, Molluscum contagiosum virus
acgcgccgacaugcgcacg

SEQ ID NO: 3103402 - RNA, 14 nt, Molluscum contagiosum virus
acgcgccgcgcgag

SEQ ID NO: 3103403 - RNA, 21 nt, Molluscum contagiosum virus
acgcgcaaggccgcgcccaag

SEQ ID NO: 3103404 - RNA, 18 nt, Molluscum contagiosum virus
acgcgccggggcgcgcgc

SEQ ID NO: 3103405 - RNA, 19 nt, Molluscum contagiosum virus
acgcgccucgagcagguca

SEQ ID NO: 3103406 - RNA, 15 nt, Molluscum contagiosum virus
acgcgcgagcggagc

SEQ ID NO: 3103407 - RNA, 24 nt, Molluscum contagiosum virus
acgcgcgagugugugcaucccucg

SEQ ID NO: 3103408 - RNA, 17 nt, Molluscum contagiosum virus
acgcgacuucgcccgug

SEQ ID NO: 3103409 - RNA, 13 nt, Molluscum contagiosum virus
acgcgagcggagc

SEQ ID NO: 3103410 - RNA, 23 nt, Molluscum contagiosum virus
acgcgagcggcuuuucgccggag

SEQ ID NO: 3103411 - RNA, 20 nt, Molluscum contagiosum virus
acgcgaucuuccgcgacgag

SEQ ID NO: 3103412 - RNA, 23 nt, Molluscum contagiosum virus
acgcgaccuucacucgcucgcgc

SEQ ID NO: 3103413 - RNA, 22 nt, Molluscum contagiosum virus
acgcgacgcgcguggagcgcgc

SEQ ID NO: 3103414 - RNA, 17 nt, Molluscum contagiosum virus
acgccgccagcgacgag

SEQ ID NO: 3103415 - RNA, 15 nt, Molluscum contagiosum virus
acgccuucguggagc

SEQ ID NO: 3103416 - RNA, 19 nt, Molluscum contagiosum virus
acgccuucuuccugcgcgu

SEQ ID NO: 3103417 - RNA, 20 nt, Molluscum contagiosum virus
acgcgaaacuggacugagcc

SEQ ID NO: 3103418 - RNA, 16 nt, Molluscum contagiosum virus
acgcgaacugcccgag

SEQ ID NO: 3103419 - RNA, 21 nt, Molluscum contagiosum virus
acgcguucuagcagcgugcgc

SEQ ID NO: 3103420 - RNA, 20 nt, Molluscum contagiosum virus
acggaggucuacaacgagcu

SEQ ID NO: 3103421 - RNA, 13 nt, Molluscum contagiosum virus
acggagcgcgcgc

SEQ ID NO: 3103422 - RNA, 17 nt, Molluscum contagiosum virus
acggagcggaucgugcu

SEQ ID NO: 3103423 - RNA, 14 nt, Molluscum contagiosum virus
acggcacgcugagc

SEQ ID NO: 3103424 - RNA, 13 nt, Molluscum contagiosum virus
acggcacggaccc

SEQ ID NO: 3103425 - RNA, 22 nt, Molluscum contagiosum virus
acggcacgugcguacgcggcgc

SEQ ID NO: 3103426 - RNA, 20 nt, Molluscum contagiosum virus
acggcacuaaggccgucagc

SEQ ID NO: 3103427 - RNA, 15 nt, Molluscum contagiosum virus
acggcagacggcaag

SEQ ID NO: 3103428 - RNA, 20 nt, Molluscum contagiosum virus
acggcgacgacagcgacgag

SEQ ID NO: 3103429 - RNA, 16 nt, Molluscum contagiosum virus
acggcgacgagggcgc

SEQ ID NO: 3103430 - RNA, 18 nt, Molluscum contagiosum virus
acggcgacgcgaucgugc

SEQ ID NO: 3103431 - RNA, 14 nt, Molluscum contagiosum virus
acggcgagcgccgc

SEQ ID NO: 3103432 - RNA, 13 nt, Molluscum contagiosum virus
acggcgagcgcgc

SEQ ID NO: 3103433 - RNA, 18 nt, Molluscum contagiosum virus
acggcgauucgugcucgu

SEQ ID NO: 3103434 - RNA, 14 nt, Molluscum contagiosum virus
acggcgcccaggaa

SEQ ID NO: 3103435 - RNA, 20 nt, Molluscum contagiosum virus
acggcgccuucgucgcgcgc

SEQ ID NO: 3103436 - RNA, 21 nt, Molluscum contagiosum virus
acggcgccuucgucgcgcgcu

SEQ ID NO: 3103437 - RNA, 13 nt, Molluscum contagiosum virus
acggcgcgcagcg

SEQ ID NO: 3103438 - RNA, 13 nt, Molluscum contagiosum virus
acggcgcgcgcgc

SEQ ID NO: 3103439 - RNA, 19 nt, Molluscum contagiosum virus
acggcgcggaucugcgcac

SEQ ID NO: 3103440 - RNA, 20 nt, Molluscum contagiosum virus
acggcgcggaucugcgcaca

SEQ ID NO: 3103441 - RNA, 19 nt, Molluscum contagiosum virus
acggcgcgggcgcgcccga

SEQ ID NO: 3103442 - RNA, 14 nt, Molluscum contagiosum virus
acggcgcugcgcgu

SEQ ID NO: 3103443 - RNA, 15 nt, Molluscum contagiosum virus
acggacucgccgcgc

SEQ ID NO: 3103444 - RNA, 21 nt, Molluscum contagiosum virus
acggacuuuucgcgcgugcgc

SEQ ID NO: 3103445 - RNA, 23 nt, Molluscum contagiosum virus
acgcuggcacggccggcgccgcg

SEQ ID NO: 3103446 - RNA, 20 nt, Molluscum contagiosum virus
acgcuggccgugcccgccga

SEQ ID NO: 3103447 - RNA, 15 nt, Molluscum contagiosum virus
acgcuggcgcucggc

SEQ ID NO: 3103448 - RNA, 13 nt, Molluscum contagiosum virus
acgcuggcggcgc

SEQ ID NO: 3103449 - RNA, 17 nt, Molluscum contagiosum virus
acgcuggucacgcgcuu

SEQ ID NO: 3103450 - RNA, 18 nt, Molluscum contagiosum virus
acgcuucgcauugaccuc

SEQ ID NO: 3103451 - RNA, 16 nt, Molluscum contagiosum virus
acgcuuggcgggcagc

SEQ ID NO: 3103452 - RNA, 19 nt, Molluscum contagiosum virus
acgcuuguccgcggacgcg

SEQ ID NO: 3103453 - RNA, 12 nt, Molluscum contagiosum virus
acggacccgcga

SEQ ID NO: 3103454 - RNA, 19 nt, Molluscum contagiosum virus
acggacgcccuccucgacc

SEQ ID NO: 3103455 - RNA, 11 nt, Molluscum contagiosum virus
acggacgccuu

SEQ ID NO: 3103456 - RNA, 12 nt, Molluscum contagiosum virus
acggacgcggcc

SEQ ID NO: 3103457 - RNA, 19 nt, Molluscum contagiosum virus
acgcggcucuggagcggcc

SEQ ID NO: 3103458 - RNA, 16 nt, Molluscum contagiosum virus
acgcggccaugcuccu

SEQ ID NO: 3103459 - RNA, 19 nt, Molluscum contagiosum virus
acgcggcgcgugucgcgga

SEQ ID NO: 3103460 - RNA, 13 nt, Molluscum contagiosum virus
acgcgugugcgag

SEQ ID NO: 3103461 - RNA, 14 nt, Molluscum contagiosum virus
acgcgggccugucc

SEQ ID NO: 3103462 - RNA, 13 nt, Molluscum contagiosum virus
acgcgggcgccgg

SEQ ID NO: 3103463 - RNA, 12 nt, Molluscum contagiosum virus
acgcugcgcacg

SEQ ID NO: 3103464 - RNA, 15 nt, Molluscum contagiosum virus
acgcugcgcgacgag

SEQ ID NO: 3103465 - RNA, 15 nt, Molluscum contagiosum virus
acgcugcggcggcgc

SEQ ID NO: 3103466 - RNA, 16 nt, Molluscum contagiosum virus
acgcugcucgugcugc

SEQ ID NO: 3103467 - RNA, 16 nt, Molluscum contagiosum virus
acgcuacgcagcgcgc

SEQ ID NO: 3103468 - RNA, 16 nt, Molluscum contagiosum virus
acgcucacggccuucg

SEQ ID NO: 3103469 - RNA, 23 nt, Molluscum contagiosum virus
acgcucaucucgcagacgcagcg

SEQ ID NO: 3103470 - RNA, 17 nt, Molluscum contagiosum virus
acgcucggcugccgugc

SEQ ID NO: 3103471 - RNA, 21 nt, Molluscum contagiosum virus
acgcugcacaugugcgugcac

SEQ ID NO: 3103472 - RNA, 23 nt, Molluscum contagiosum virus
acguaugcguaguaguagcgcuc

SEQ ID NO: 3103473 - RNA, 15 nt, Molluscum contagiosum virus
acgucaauggcgcgc

SEQ ID NO: 3103474 - RNA, 19 nt, Molluscum contagiosum virus
acguccaggccgcggcagc

SEQ ID NO: 3103475 - RNA, 14 nt, Molluscum contagiosum virus
acguagagcagcgc

SEQ ID NO: 3103476 - RNA, 16 nt, Molluscum contagiosum virus
acguacgagcaggcgc

SEQ ID NO: 3103477 - RNA, 15 nt, Molluscum contagiosum virus
acguacagugcgcgc

SEQ ID NO: 3103478 - RNA, 15 nt, Molluscum contagiosum virus
acggguaccgugcgc

SEQ ID NO: 3103479 - RNA, 15 nt, Molluscum contagiosum virus
acggucacgcaagcu

SEQ ID NO: 3103480 - RNA, 14 nt, Molluscum contagiosum virus
acgguccugggcga

SEQ ID NO: 3103481 - RNA, 15 nt, Molluscum contagiosum virus
acggugcugcgcacg

SEQ ID NO: 3103482 - RNA, 12 nt, Molluscum contagiosum virus
acggccgcgcgc

SEQ ID NO: 3103483 - RNA, 14 nt, Molluscum contagiosum virus
acggccgcgcgcga

SEQ ID NO: 3103484 - RNA, 16 nt, Molluscum contagiosum virus
acggccggcgccgcgc

SEQ ID NO: 3103485 - RNA, 13 nt, Molluscum contagiosum virus
acggccgucuccu

SEQ ID NO: 3103486 - RNA, 20 nt, Molluscum contagiosum virus
acggcaaacgccacuggguc

SEQ ID NO: 3103487 - RNA, 17 nt, Molluscum contagiosum virus
acggcccgggugcgcgc

SEQ ID NO: 3103488 - RNA, 19 nt, Molluscum contagiosum virus
acggcccgggugcgcgcgc

SEQ ID NO: 3103489 - RNA, 17 nt, Molluscum contagiosum virus
acggcggcacccgccgc

SEQ ID NO: 3103490 - RNA, 19 nt, Molluscum contagiosum virus
acggcggcacccgccgcgg

SEQ ID NO: 3103491 - RNA, 15 nt, Molluscum contagiosum virus
acggcggcgcucaac

SEQ ID NO: 3103492 - RNA, 12 nt, Molluscum contagiosum virus
acggccugcggc

SEQ ID NO: 3103493 - RNA, 13 nt, Molluscum contagiosum virus
acggccuucgcgc

SEQ ID NO: 3103494 - RNA, 22 nt, Molluscum contagiosum virus
acggcgugacggugcugcgcac

SEQ ID NO: 3103495 - RNA, 14 nt, Molluscum contagiosum virus
acggcgugcgcgag

SEQ ID NO: 3103496 - RNA, 17 nt, Molluscum contagiosum virus
acggcuaggcgcggcgg

SEQ ID NO: 3103497 - RNA, 22 nt, Molluscum contagiosum virus
acggcugcaagcacaacgggcu

SEQ ID NO: 3103498 - RNA, 19 nt, Molluscum contagiosum virus
acggcugccggcccccgga

SEQ ID NO: 3103499 - RNA, 16 nt, Molluscum contagiosum virus
acggcuguaaugugcu

SEQ ID NO: 3103500 - RNA, 18 nt, Molluscum contagiosum virus
acggcuucauccgcgcgc

SEQ ID NO: 3103501 - RNA, 14 nt, Molluscum contagiosum virus
acgggaaccgugcu

SEQ ID NO: 3103502 - RNA, 17 nt, Molluscum contagiosum virus
acgggcgugcgcagcag

SEQ ID NO: 3103503 - RNA, 18 nt, Molluscum contagiosum virus
acgggcucgaucugcgcc

SEQ ID NO: 3103504 - RNA, 15 nt, Molluscum contagiosum virus
acgggcacgccgcgg

SEQ ID NO: 3103505 - RNA, 14 nt, Molluscum contagiosum virus
acgggcacgcgcgc

SEQ ID NO: 3103506 - RNA, 17 nt, Molluscum contagiosum virus
acgggcgcgcguacgcg

SEQ ID NO: 3103507 - RNA, 21 nt, Molluscum contagiosum virus
acgggcgcuauugcgcggcgc

SEQ ID NO: 3103508 - RNA, 20 nt, Molluscum contagiosum virus
ccaacucugugaccugcgcc

SEQ ID NO: 3103509 - RNA, 20 nt, Molluscum contagiosum virus
ccaacuagacaaggggccau

SEQ ID NO: 3103510 - RNA, 16 nt, Molluscum contagiosum virus
ccaacagcagcuggcg

SEQ ID NO: 3103511 - RNA, 23 nt, Molluscum contagiosum virus
ccaacagcagcuggcgcgcgccg

SEQ ID NO: 3103512 - RNA, 15 nt, Molluscum contagiosum virus
ccaacccucgcaagc

SEQ ID NO: 3103513 - RNA, 15 nt, Molluscum contagiosum virus
ccaacgauggcgugg

SEQ ID NO: 3103514 - RNA, 21 nt, Molluscum contagiosum virus
ccaacgcaccggcagggaaau

SEQ ID NO: 3103515 - RNA, 16 nt, Molluscum contagiosum virus
ccaacgcccgcgcccg

SEQ ID NO: 3103516 - RNA, 19 nt, Molluscum contagiosum virus
cauugcgaggcaccgcccg

SEQ ID NO: 3103517 - RNA, 13 nt, Molluscum contagiosum virus
cauugcugcugca

SEQ ID NO: 3103518 - RNA, 21 nt, Molluscum contagiosum virus
ccaaaucgcguuugccaggca

SEQ ID NO: 3103519 - RNA, 13 nt, Molluscum contagiosum virus
ccaacuucgcggu

SEQ ID NO: 3103520 - RNA, 19 nt, Molluscum contagiosum virus
ccaagaagaggccagcaca

SEQ ID NO: 3103521 - RNA, 19 nt, Molluscum contagiosum virus
ccaagaagaggccggcaca

SEQ ID NO: 3103522 - RNA, 23 nt, Molluscum contagiosum virus
ccaagaccugggcgucgugcacc

SEQ ID NO: 3103523 - RNA, 13 nt, Molluscum contagiosum virus
ccaagcacgcgcg

SEQ ID NO: 3103524 - RNA, 14 nt, Molluscum contagiosum virus
cauguuuccugcgg

SEQ ID NO: 3103525 - RNA, 19 nt, Molluscum contagiosum virus
cauguuuguucgcgcgccg

SEQ ID NO: 3103526 - RNA, 19 nt, Molluscum contagiosum virus
cauguccuuucagacagcg

SEQ ID NO: 3103527 - RNA, 14 nt, Molluscum contagiosum virus
caugugcgugcacc

SEQ ID NO: 3103528 - RNA, 22 nt, Molluscum contagiosum virus
cauuaacgaagaguggcucaca

SEQ ID NO: 3103529 - RNA, 23 nt, Molluscum contagiosum virus
cauguguuuguagccgcgcgaac

SEQ ID NO: 3103530 - RNA, 21 nt, Molluscum contagiosum virus
caugucacgcgucgcgcgccg

SEQ ID NO: 3103531 - RNA, 15 nt, Molluscum contagiosum virus
caugucacgcucacg

SEQ ID NO: 3103532 - RNA, 16 nt, Molluscum contagiosum virus
caugucacgcucacgc

SEQ ID NO: 3103533 - RNA, 18 nt, Molluscum contagiosum virus
caugucaggccggucgcg

SEQ ID NO: 3103534 - RNA, 13 nt, Molluscum contagiosum virus
cauguccggcccg

SEQ ID NO: 3103535 - RNA, 18 nt, Molluscum contagiosum virus
cagggagcugcggacgcg

SEQ ID NO: 3103536 - RNA, 17 nt, Molluscum contagiosum virus
cagggcaaucgcgugcu

SEQ ID NO: 3103537 - RNA, 15 nt, Molluscum contagiosum virus
cagggcacgaucgcg

SEQ ID NO: 3103538 - RNA, 15 nt, Molluscum contagiosum virus
cagggcccgcgcucg

SEQ ID NO: 3103539 - RNA, 16 nt, Molluscum contagiosum virus
caggcgcugcgcggcg

SEQ ID NO: 3103540 - RNA, 18 nt, Molluscum contagiosum virus
caggcgcugcgcggcgcg

SEQ ID NO: 3103541 - RNA, 21 nt, Molluscum contagiosum virus
cagggaaaaaucccccgccag

SEQ ID NO: 3103542 - RNA, 16 nt, Molluscum contagiosum virus
cagggaaagagcacgc

SEQ ID NO: 3103543 - RNA, 23 nt, Molluscum contagiosum virus
cagggaaagagcacgcgcucgcg

SEQ ID NO: 3103544 - RNA, 22 nt, Molluscum contagiosum virus
caggcggucuuccagcacugcg

SEQ ID NO: 3103545 - RNA, 23 nt, Molluscum contagiosum virus
caggcggucuuccagcacugcgc

SEQ ID NO: 3103546 - RNA, 18 nt, Molluscum contagiosum virus
caggcggugggcgccgcg

SEQ ID NO: 3103547 - RNA, 19 nt, Molluscum contagiosum virus
caggcggugggcgccgcgg

SEQ ID NO: 3103548 - RNA, 22 nt, Molluscum contagiosum virus
caggcggugggcgccgcggccu

SEQ ID NO: 3103549 - RNA, 16 nt, Molluscum contagiosum virus
caggcguagcgcgucu

SEQ ID NO: 3103550 - RNA, 21 nt, Molluscum contagiosum virus
caggcgucaugcgcgcgcgcu

SEQ ID NO: 3103551 - RNA, 16 nt, Molluscum contagiosum virus
caggcuaggcgcgacu

SEQ ID NO: 3103552 - RNA, 12 nt, Molluscum contagiosum virus
caggcucccgcu

SEQ ID NO: 3103553 - RNA, 19 nt, Molluscum contagiosum virus
caggcucuaagcgcacgcg

SEQ ID NO: 3103554 - RNA, 20 nt, Molluscum contagiosum virus
caggcucuaagcgcacgcgc

SEQ ID NO: 3103555 - RNA, 21 nt, Molluscum contagiosum virus
caggcuguguuccagcucggg

SEQ ID NO: 3103556 - RNA, 14 nt, Molluscum contagiosum virus
caggccgcgcccgu

SEQ ID NO: 3103557 - RNA, 13 nt, Molluscum contagiosum virus
caggccgcggcag

SEQ ID NO: 3103558 - RNA, 22 nt, Molluscum contagiosum virus
caggccgcuagcaggcgucgcg

SEQ ID NO: 3103559 - RNA, 15 nt, Molluscum contagiosum virus
caggccgggcgcggu

SEQ ID NO: 3103560 - RNA, 17 nt, Molluscum contagiosum virus
caggccggucgcggaag

SEQ ID NO: 3103561 - RNA, 21 nt, Molluscum contagiosum virus
caggccucuuuugcgucgcga

SEQ ID NO: 3103562 - RNA, 16 nt, Molluscum contagiosum virus
caggcgcagcgcggcc

SEQ ID NO: 3103563 - RNA, 22 nt, Molluscum contagiosum virus
caggcccggcggcccgcggcgc

SEQ ID NO: 3103564 - RNA, 21 nt, Molluscum contagiosum virus
caggcgccaucgcgcgugacu

SEQ ID NO: 3103565 - RNA, 19 nt, Molluscum contagiosum virus
caggcgcccaacgcccgcg

SEQ ID NO: 3103566 - RNA, 22 nt, Molluscum contagiosum virus
caggcgccgcaccucaccgcgc

SEQ ID NO: 3103567 - RNA, 14 nt, Molluscum contagiosum virus
caggcgccggcgcg

SEQ ID NO: 3103568 - RNA, 20 nt, Molluscum contagiosum virus
caggcgcgaacucgcggcag

SEQ ID NO: 3103569 - RNA, 21 nt, Molluscum contagiosum virus
caggcgcgcaagugcgugucc

SEQ ID NO: 3103570 - RNA, 14 nt, Molluscum contagiosum virus
caggcgcgcgcgau

SEQ ID NO: 3103571 - RNA, 18 nt, Molluscum contagiosum virus
caggcgcggucgcccgcc

SEQ ID NO: 3103572 - RNA, 20 nt, Molluscum contagiosum virus
caggcgcggucgcccgccga

SEQ ID NO: 3103573 - RNA, 22 nt, Molluscum contagiosum virus
caggcgcgugcccugcacgcgc

SEQ ID NO: 3103574 - RNA, 14 nt, Molluscum contagiosum virus
caaaacgcgacgcc

SEQ ID NO: 3103575 - RNA, 15 nt, Molluscum contagiosum virus
caaaagagcgcgccu

SEQ ID NO: 3103576 - RNA, 16 nt, Molluscum contagiosum virus
auggucuuacgcgcuc

SEQ ID NO: 3103577 - RNA, 18 nt, Molluscum contagiosum virus
auguccaugucgcgcauc

SEQ ID NO: 3103578 - RNA, 18 nt, Molluscum contagiosum virus
caaaaaaaagugcgcgug

SEQ ID NO: 3103579 - RNA, 19 nt, Molluscum contagiosum virus
auguacaagcccguacgca

SEQ ID NO: 3103580 - RNA, 18 nt, Molluscum contagiosum virus
augucacgcgucgcgcgc

SEQ ID NO: 3103581 - RNA, 19 nt, Molluscum contagiosum virus
augucacgcucacgcaguc

SEQ ID NO: 3103582 - RNA, 14 nt, Molluscum contagiosum virus
caaagucgcgcgcg

SEQ ID NO: 3103583 - RNA, 20 nt, Molluscum contagiosum virus
caaaucuguucgagcaacag

SEQ ID NO: 3103584 - RNA, 15 nt, Molluscum contagiosum virus
caaaugcgcgcgaac

SEQ ID NO: 3103585 - RNA, 23 nt, Molluscum contagiosum virus
caaagaucgcgguggcaggcgcg

SEQ ID NO: 3103586 - RNA, 15 nt, Molluscum contagiosum virus
caaagccggccccgc

SEQ ID NO: 3103587 - RNA, 14 nt, Molluscum contagiosum virus
caaagccugcugcg

SEQ ID NO: 3103588 - RNA, 13 nt, Molluscum contagiosum virus
caaagcgcggccg

SEQ ID NO: 3103589 - RNA, 12 nt, Molluscum contagiosum virus
caaagcggggcg

SEQ ID NO: 3103590 - RNA, 17 nt, Molluscum contagiosum virus
caaaggaguuggcgcgc

SEQ ID NO: 3103591 - RNA, 16 nt, Molluscum contagiosum virus
caaaggcccgcgagca

SEQ ID NO: 3103592 - RNA, 18 nt, Molluscum contagiosum virus
caaaggcccgcgagcacg

SEQ ID NO: 3103593 - RNA, 14 nt, Molluscum contagiosum virus
caaaggcgggcccg

SEQ ID NO: 3103594 - RNA, 15 nt, Molluscum contagiosum virus
caaaggcgggcccgc

SEQ ID NO: 3103595 - RNA, 14 nt, Molluscum contagiosum virus
caaagggcggccgc

SEQ ID NO: 3103596 - RNA, 14 nt, Molluscum contagiosum virus
caaagacgggcccg

SEQ ID NO: 3103597 - RNA, 15 nt, Molluscum contagiosum virus
caaagacgggcccgc

SEQ ID NO: 3103598 - RNA, 15 nt, Molluscum contagiosum virus
caaagacggggccgc

SEQ ID NO: 3103599 - RNA, 22 nt, Molluscum contagiosum virus
caaagagacgcggccgcggagg

SEQ ID NO: 3103600 - RNA, 15 nt, Molluscum contagiosum virus
caaagaagcgcgccc

SEQ ID NO: 3103601 - RNA, 15 nt, Molluscum contagiosum virus
caaagaaugcaugcg

SEQ ID NO: 3103602 - RNA, 19 nt, Molluscum contagiosum virus
caaagacgagggaugcgca

SEQ ID NO: 3103603 - RNA, 22 nt, Molluscum contagiosum virus
caggcaguugccgcagcgggcu

SEQ ID NO: 3103604 - RNA, 17 nt, Molluscum contagiosum virus
caggcauggcauggcgc

SEQ ID NO: 3103605 - RNA, 18 nt, Molluscum contagiosum virus
caggcauggcauggcgcg

SEQ ID NO: 3103606 - RNA, 13 nt, Molluscum contagiosum virus
caagucacugcua

SEQ ID NO: 3103607 - RNA, 22 nt, Molluscum contagiosum virus
caagcuuugcacgcacgcgcuc

SEQ ID NO: 3103608 - RNA, 13 nt, Molluscum contagiosum virus
caaggacaccgcg

SEQ ID NO: 3103609 - RNA, 17 nt, Molluscum contagiosum virus
caagguuugcgggcgca

SEQ ID NO: 3103610 - RNA, 20 nt, Molluscum contagiosum virus
caaguacaugcacgucgaca

SEQ ID NO: 3103611 - RNA, 22 nt, Molluscum contagiosum virus
caaguaccagccgcugcgccgc

SEQ ID NO: 3103612 - RNA, 15 nt, Molluscum contagiosum virus
caagcugagcgcgcu

SEQ ID NO: 3103613 - RNA, 17 nt, Molluscum contagiosum virus
caagcugcaccggcgcg

SEQ ID NO: 3103614 - RNA, 21 nt, Molluscum contagiosum virus
caagcggucaggccgggcgcg

SEQ ID NO: 3103615 - RNA, 16 nt, Molluscum contagiosum virus
caaggagcugcgcgag

SEQ ID NO: 3103616 - RNA, 13 nt, Molluscum contagiosum virus
caaggaggucaug

SEQ ID NO: 3103617 - RNA, 19 nt, Molluscum contagiosum virus
caaggauuacgcugccgug

SEQ ID NO: 3103618 - RNA, 18 nt, Molluscum contagiosum virus
caagggcaucccgccgcu

SEQ ID NO: 3103619 - RNA, 12 nt, Molluscum contagiosum virus
caagggccugcg

SEQ ID NO: 3103620 - RNA, 17 nt, Molluscum contagiosum virus
caagggccugcgggcgg

SEQ ID NO: 3103621 - RNA, 14 nt, Molluscum contagiosum virus
caagggcguagagc

SEQ ID NO: 3103622 - RNA, 22 nt, Molluscum contagiosum virus
caaggucuacguguccgcaucc

SEQ ID NO: 3103623 - RNA, 16 nt, Molluscum contagiosum virus
caaggccgcgggcgcg

SEQ ID NO: 3103624 - RNA, 20 nt, Molluscum contagiosum virus
caaggccgcgggcgcggagu

SEQ ID NO: 3103625 - RNA, 22 nt, Molluscum contagiosum virus
caaggcgcgcaucgcgggcacg

SEQ ID NO: 3103626 - RNA, 16 nt, Molluscum contagiosum virus
caagcgcaacacggcc

SEQ ID NO: 3103627 - RNA, 21 nt, Molluscum contagiosum virus
caagcgcaccguugacgagcu

SEQ ID NO: 3103628 - RNA, 19 nt, Molluscum contagiosum virus
caagccccccucacggcga

SEQ ID NO: 3103629 - RNA, 14 nt, Molluscum contagiosum virus
caagcgcccgcgag

SEQ ID NO: 3103630 - RNA, 21 nt, Molluscum contagiosum virus
caagcgccgccaugcugcgcg

SEQ ID NO: 3103631 - RNA, 18 nt, Molluscum contagiosum virus
caagcgcguucgcgcgug

SEQ ID NO: 3103632 - RNA, 23 nt, Molluscum contagiosum virus
caagcgcguucgcgcgugcugga

SEQ ID NO: 3103633 - RNA, 21 nt, Molluscum contagiosum virus
caagcgcuacuugcuggcgcg

SEQ ID NO: 3103634 - RNA, 13 nt, Molluscum contagiosum virus
caagcgcugcucg

SEQ ID NO: 3103635 - RNA, 14 nt, Molluscum contagiosum virus
caagcccgaguucg

SEQ ID NO: 3103636 - RNA, 20 nt, Molluscum contagiosum virus
caagcccgaguucgcggcgc

SEQ ID NO: 3103637 - RNA, 21 nt, Molluscum contagiosum virus
caagcccgaguucgcggcgcg

SEQ ID NO: 3103638 - RNA, 16 nt, Molluscum contagiosum virus
caagcccgcgcgcgag

SEQ ID NO: 3103639 - RNA, 15 nt, Molluscum contagiosum virus
caagccgcaggcgcg

SEQ ID NO: 3103640 - RNA, 16 nt, Molluscum contagiosum virus
caagccgcaggcgcgc

SEQ ID NO: 3103641 - RNA, 22 nt, Molluscum contagiosum virus
caagccguccgccucgagcacg

SEQ ID NO: 3103642 - RNA, 17 nt, Molluscum contagiosum virus
caagauucuucgcgaag

SEQ ID NO: 3103643 - RNA, 16 nt, Molluscum contagiosum virus
caagcacaacgggcuc

SEQ ID NO: 3103644 - RNA, 17 nt, Molluscum contagiosum virus
caagcacaacgggcucg

SEQ ID NO: 3103645 - RNA, 19 nt, Molluscum contagiosum virus
caagcacacgacggaacgu

SEQ ID NO: 3103646 - RNA, 18 nt, Molluscum contagiosum virus
caagcaccgccugcugca

SEQ ID NO: 3103647 - RNA, 14 nt, Molluscum contagiosum virus
caagcacggcuucc

SEQ ID NO: 3103648 - RNA, 20 nt, Molluscum contagiosum virus
caagcacuacauggacgugc

SEQ ID NO: 3103649 - RNA, 16 nt, Molluscum contagiosum virus
caagcagcgcgccacc

SEQ ID NO: 3103650 - RNA, 15 nt, Molluscum contagiosum virus
caagcaggcaugcaa

SEQ ID NO: 3103651 - RNA, 20 nt, Molluscum contagiosum virus
caagcagguggccgcgcgcg

SEQ ID NO: 3103652 - RNA, 14 nt, Molluscum contagiosum virus
caagcaguaccugc

SEQ ID NO: 3103653 - RNA, 15 nt, Molluscum contagiosum virus
caagcccagcagcga

SEQ ID NO: 3103654 - RNA, 20 nt, Molluscum contagiosum virus
caagcccagcagcgaggccg

SEQ ID NO: 3103655 - RNA, 14 nt, Molluscum contagiosum virus
caacacgagcacga

SEQ ID NO: 3103656 - RNA, 13 nt, Molluscum contagiosum virus
caacacgagcgcg

SEQ ID NO: 3103657 - RNA, 20 nt, Molluscum contagiosum virus
caacacgcuguugcugcugc

SEQ ID NO: 3103658 - RNA, 16 nt, Molluscum contagiosum virus
caacacucgugcucgu

SEQ ID NO: 3103659 - RNA, 20 nt, Molluscum contagiosum virus
caacacugacgcucgggccg

SEQ ID NO: 3103660 - RNA, 19 nt, Molluscum contagiosum virus
caacagcacgacggucuuc

SEQ ID NO: 3103661 - RNA, 18 nt, Molluscum contagiosum virus
caacagcagcuggcgcgc

SEQ ID NO: 3103662 - RNA, 15 nt, Molluscum contagiosum virus
caacagcgcgacgcc

SEQ ID NO: 3103663 - RNA, 23 nt, Molluscum contagiosum virus
caacaggaauguguacgacgcgc

SEQ ID NO: 3103664 - RNA, 21 nt, Molluscum contagiosum virus
augccggggaugaacgcgcug

SEQ ID NO: 3103665 - RNA, 20 nt, Molluscum contagiosum virus
augcgaggccugcguggaca

SEQ ID NO: 3103666 - RNA, 18 nt, Molluscum contagiosum virus
augcucacguacgacugc

SEQ ID NO: 3103667 - RNA, 12 nt, Molluscum contagiosum virus
augcucgcgcuc

SEQ ID NO: 3103668 - RNA, 21 nt, Molluscum contagiosum virus
augcucgcuugccggcggcgc

SEQ ID NO: 3103669 - RNA, 12 nt, Molluscum contagiosum virus
augcugcgcacg

SEQ ID NO: 3103670 - RNA, 17 nt, Molluscum contagiosum virus
augcugcgcgagcgcgc

SEQ ID NO: 3103671 - RNA, 18 nt, Molluscum contagiosum virus
augcugcucgacgggcgc

SEQ ID NO: 3103672 - RNA, 19 nt, Molluscum contagiosum virus
augcugcucgacgggcgca

SEQ ID NO: 3103673 - RNA, 16 nt, Molluscum contagiosum virus
augcuggacgggcacg

SEQ ID NO: 3103674 - RNA, 15 nt, Molluscum contagiosum virus
auggacacgcugcgc

SEQ ID NO: 3103675 - RNA, 21 nt, Molluscum contagiosum virus
auggaccgguuccgugcgcuc

SEQ ID NO: 3103676 - RNA, 15 nt, Molluscum contagiosum virus
auggacgcgccgcgc

SEQ ID NO: 3103677 - RNA, 12 nt, Molluscum contagiosum virus
auggacgucgcg

SEQ ID NO: 3103678 - RNA, 15 nt, Molluscum contagiosum virus
auggacgucgcggcc

SEQ ID NO: 3103679 - RNA, 14 nt, Molluscum contagiosum virus
auggacgugcuccg

SEQ ID NO: 3103680 - RNA, 20 nt, Molluscum contagiosum virus
augcguaguaguagcgcucg

SEQ ID NO: 3103681 - RNA, 19 nt, Molluscum contagiosum virus
augcgucuuccugcugccg

SEQ ID NO: 3103682 - RNA, 20 nt, Molluscum contagiosum virus
auggagcaggagaacuacaa

SEQ ID NO: 3103683 - RNA, 15 nt, Molluscum contagiosum virus
augcgcgugcggcgc

SEQ ID NO: 3103684 - RNA, 14 nt, Molluscum contagiosum virus
augcgcuucggcuc

SEQ ID NO: 3103685 - RNA, 19 nt, Molluscum contagiosum virus
augcgcuugcggucgcgag

SEQ ID NO: 3103686 - RNA, 13 nt, Molluscum contagiosum virus
augcggcaggcgc

SEQ ID NO: 3103687 - RNA, 11 nt, Molluscum contagiosum virus
auggcugcuca

SEQ ID NO: 3103688 - RNA, 19 nt, Molluscum contagiosum virus
augggcacaagucucgcgc

SEQ ID NO: 3103689 - RNA, 14 nt, Molluscum contagiosum virus
augggcacggcaac

SEQ ID NO: 3103690 - RNA, 15 nt, Molluscum contagiosum virus
auggccgcgccgcgc

SEQ ID NO: 3103691 - RNA, 23 nt, Molluscum contagiosum virus
ccagcgagaucaacgcgcgcgug

SEQ ID NO: 3103692 - RNA, 15 nt, Molluscum contagiosum virus
ccagcgauugcccgc

SEQ ID NO: 3103693 - RNA, 18 nt, Molluscum contagiosum virus
ccagcgauugcccgcgcg

SEQ ID NO: 3103694 - RNA, 22 nt, Molluscum contagiosum virus
ccaggaucacgaugugcgcgcg

SEQ ID NO: 3103695 - RNA, 13 nt, Molluscum contagiosum virus
ccaggcacacgca

SEQ ID NO: 3103696 - RNA, 13 nt, Molluscum contagiosum virus
ccaggccgcgccg

SEQ ID NO: 3103697 - RNA, 14 nt, Molluscum contagiosum virus
ccaggcuaggcgcg

SEQ ID NO: 3103698 - RNA, 11 nt, Molluscum contagiosum virus
ccaggcgccgc

SEQ ID NO: 3103699 - RNA, 11 nt, Molluscum contagiosum virus
ccaggcgccgg

SEQ ID NO: 3103700 - RNA, 18 nt, Molluscum contagiosum virus
ccagcguacggcccgaag

SEQ ID NO: 3103701 - RNA, 17 nt, Molluscum contagiosum virus
ccagcuugagcacacgg

SEQ ID NO: 3103702 - RNA, 14 nt, Molluscum contagiosum virus
ccaggaacgcgccg

SEQ ID NO: 3103703 - RNA, 16 nt, Molluscum contagiosum virus
ccagcgucgcgcgccg

SEQ ID NO: 3103704 - RNA, 15 nt, Molluscum contagiosum virus
ccagcgugugaccgc

SEQ ID NO: 3103705 - RNA, 18 nt, Molluscum contagiosum virus
ccagcggauaugcgccug

SEQ ID NO: 3103706 - RNA, 13 nt, Molluscum contagiosum virus
ccagcggcgccgc

SEQ ID NO: 3103707 - RNA, 15 nt, Molluscum contagiosum virus
ccagcggcugcccgc

SEQ ID NO: 3103708 - RNA, 16 nt, Molluscum contagiosum virus
ccagcgccgccucgcg

SEQ ID NO: 3103709 - RNA, 14 nt, Molluscum contagiosum virus
ccagcgccuccgcg

SEQ ID NO: 3103710 - RNA, 16 nt, Molluscum contagiosum virus
ccagcgcgcccaccag

SEQ ID NO: 3103711 - RNA, 18 nt, Molluscum contagiosum virus
ccagcgcgcccaccagca

SEQ ID NO: 3103712 - RNA, 24 nt, Molluscum contagiosum virus
ccagcucauagcccaugcgcagug

SEQ ID NO: 3103713 - RNA, 13 nt, Molluscum contagiosum virus
ccagcuccgcgcg

SEQ ID NO: 3103714 - RNA, 22 nt, Molluscum contagiosum virus
ccagcucgacacugugcuggcg

SEQ ID NO: 3103715 - RNA, 19 nt, Molluscum contagiosum virus
ccagcucuuggcgggcacc

SEQ ID NO: 3103716 - RNA, 13 nt, Molluscum contagiosum virus
ccagcugcgcgag

SEQ ID NO: 3103717 - RNA, 15 nt, Molluscum contagiosum virus
ccagcugcgcgagcu

SEQ ID NO: 3103718 - RNA, 18 nt, Molluscum contagiosum virus
ccagcuggacggugcugg

SEQ ID NO: 3103719 - RNA, 20 nt, Molluscum contagiosum virus
cccaggccauggagcgcccg

SEQ ID NO: 3103720 - RNA, 22 nt, Molluscum contagiosum virus
cccagcguggccagcuucauca

SEQ ID NO: 3103721 - RNA, 21 nt, Molluscum contagiosum virus
ccaggugcgaaggcucgagcu

SEQ ID NO: 3103722 - RNA, 19 nt, Molluscum contagiosum virus
ccagggcaguacgcgcgug

SEQ ID NO: 3103723 - RNA, 20 nt, Molluscum contagiosum virus
ccaguaccagcucgcgccgc

SEQ ID NO: 3103724 - RNA, 13 nt, Molluscum contagiosum virus
ccagucgcgcgag

SEQ ID NO: 3103725 - RNA, 17 nt, Molluscum contagiosum virus
ccagucgcgcgagaagu

SEQ ID NO: 3103726 - RNA, 13 nt, Molluscum contagiosum virus
ccagugcgcuugc

SEQ ID NO: 3103727 - RNA, 20 nt, Molluscum contagiosum virus
ccaguggcgcccgugcucgc

SEQ ID NO: 3103728 - RNA, 15 nt, Molluscum contagiosum virus
cccaugcccgaccac

SEQ ID NO: 3103729 - RNA, 12 nt, Molluscum contagiosum virus
cccccgcggagc

SEQ ID NO: 3103730 - RNA, 20 nt, Molluscum contagiosum virus
ccccgaacugcugggcgugg

SEQ ID NO: 3103731 - RNA, 17 nt, Molluscum contagiosum virus
cccgccugccgcgagca

SEQ ID NO: 3103732 - RNA, 22 nt, Molluscum contagiosum virus
cccgcgaacgagagacacgcac

SEQ ID NO: 3103733 - RNA, 22 nt, Molluscum contagiosum virus
cccgcgaacgagggacacgcac

SEQ ID NO: 3103734 - RNA, 13 nt, Molluscum contagiosum virus
cccgcgaagagca

SEQ ID NO: 3103735 - RNA, 13 nt, Molluscum contagiosum virus
cccgcgcugcgcg

SEQ ID NO: 3103736 - RNA, 16 nt, Molluscum contagiosum virus
cccgcgcucgccgcac

SEQ ID NO: 3103737 - RNA, 14 nt, Molluscum contagiosum virus
cccgcgcacgagcu

SEQ ID NO: 3103738 - RNA, 23 nt, Molluscum contagiosum virus
cccgcgcacugccacgcggagcu

SEQ ID NO: 3103739 - RNA, 15 nt, Molluscum contagiosum virus
cccgcgcagcgugcc

SEQ ID NO: 3103740 - RNA, 15 nt, Molluscum contagiosum virus
cccgcgcccgcgccg

SEQ ID NO: 3103741 - RNA, 14 nt, Molluscum contagiosum virus
cccgcgccgcggcg

SEQ ID NO: 3103742 - RNA, 12 nt, Molluscum contagiosum virus
cccgcgcgcccg

SEQ ID NO: 3103743 - RNA, 19 nt, Molluscum contagiosum virus
cccgcgcgcgacuacgcac

SEQ ID NO: 3103744 - RNA, 14 nt, Molluscum contagiosum virus
cccgcgcgcgagcu

SEQ ID NO: 3103745 - RNA, 15 nt, Molluscum contagiosum virus
cccgcgcgcgugccg

SEQ ID NO: 3103746 - RNA, 18 nt, Molluscum contagiosum virus
cccgcgcggcucgcgcac

SEQ ID NO: 3103747 - RNA, 13 nt, Molluscum contagiosum virus
ccccgccgcggcg

SEQ ID NO: 3103748 - RNA, 16 nt, Molluscum contagiosum virus
cgcuguacaugccgca

SEQ ID NO: 3103749 - RNA, 20 nt, Molluscum contagiosum virus
cgcuguacgugcugcccgug

SEQ ID NO: 3103750 - RNA, 22 nt, Molluscum contagiosum virus
cgcuguauaguccccggcgccg

SEQ ID NO: 3103751 - RNA, 18 nt, Molluscum contagiosum virus
cgcuguauucggcguacg

SEQ ID NO: 3103752 - RNA, 13 nt, Molluscum contagiosum virus
cgcugucacgcga

SEQ ID NO: 3103753 - RNA, 14 nt, Molluscum contagiosum virus
cgcugggcgcgccg

SEQ ID NO: 3103754 - RNA, 15 nt, Molluscum contagiosum virus
cgcugcuggcgcaca

SEQ ID NO: 3103755 - RNA, 16 nt, Molluscum contagiosum virus
cgcugcuggcgcacau

SEQ ID NO: 3103756 - RNA, 15 nt, Molluscum contagiosum virus
cgcugcuguccuuca

SEQ ID NO: 3103757 - RNA, 15 nt, Molluscum contagiosum virus
cgcuggucacgcgcu

SEQ ID NO: 3103758 - RNA, 20 nt, Molluscum contagiosum virus
cgcuggugggcgugcggcgc

SEQ ID NO: 3103759 - RNA, 23 nt, Molluscum contagiosum virus
cgcuggugggcgugcggcgcacc

SEQ ID NO: 3103760 - RNA, 16 nt, Molluscum contagiosum virus
cgcuggugugcacuga

SEQ ID NO: 3103761 - RNA, 14 nt, Molluscum contagiosum virus
cgcugcuucccgcu

SEQ ID NO: 3103762 - RNA, 19 nt, Molluscum contagiosum virus
cgcugcuucccgcugagcg

SEQ ID NO: 3103763 - RNA, 14 nt, Molluscum contagiosum virus
cgcuggacgccucg

SEQ ID NO: 3103764 - RNA, 18 nt, Molluscum contagiosum virus
cgcuggacuugcgcgagc

SEQ ID NO: 3103765 - RNA, 20 nt, Molluscum contagiosum virus
cgcuggagaaagaagugugc

SEQ ID NO: 3103766 - RNA, 16 nt, Molluscum contagiosum virus
cgcuggagacggcagu

SEQ ID NO: 3103767 - RNA, 19 nt, Molluscum contagiosum virus
cgcuggagaugauuccguc

SEQ ID NO: 3103768 - RNA, 20 nt, Molluscum contagiosum virus
cgcuggcacggccggcgccg

SEQ ID NO: 3103769 - RNA, 22 nt, Molluscum contagiosum virus
cgcuggcccacgcuggcgcucg

SEQ ID NO: 3103770 - RNA, 15 nt, Molluscum contagiosum virus
cgcuggccgugcccg

SEQ ID NO: 3103771 - RNA, 16 nt, Molluscum contagiosum virus
cgcuggccgugcccgc

SEQ ID NO: 3103772 - RNA, 20 nt, Molluscum contagiosum virus
cgcuggccgugcccgccgac

SEQ ID NO: 3103773 - RNA, 22 nt, Molluscum contagiosum virus
cgcuggccucugccugcaagga

SEQ ID NO: 3103774 - RNA, 14 nt, Molluscum contagiosum virus
cgcuggcgcgcgcg

SEQ ID NO: 3103775 - RNA, 15 nt, Molluscum contagiosum virus
cgcuggcggcgcacg

SEQ ID NO: 3103776 - RNA, 13 nt, Molluscum contagiosum virus
cgcccgagcgcgu

SEQ ID NO: 3103777 - RNA, 17 nt, Molluscum contagiosum virus
cgcccgagcgcgugucu

SEQ ID NO: 3103778 - RNA, 16 nt, Molluscum contagiosum virus
cgcccgaggacgagcc

SEQ ID NO: 3103779 - RNA, 21 nt, Molluscum contagiosum virus
cgcccgcaaugcagugcacca

SEQ ID NO: 3103780 - RNA, 14 nt, Molluscum contagiosum virus
cgcccgcagcgcgc

SEQ ID NO: 3103781 - RNA, 19 nt, Molluscum contagiosum virus
cgcccgacuuuucgcgccg

SEQ ID NO: 3103782 - RNA, 13 nt, Molluscum contagiosum virus
cgcccgccgagua

SEQ ID NO: 3103783 - RNA, 15 nt, Molluscum contagiosum virus
cgcccgccgaguacc

SEQ ID NO: 3103784 - RNA, 20 nt, Molluscum contagiosum virus
cgcccgcgaaaaacgugacu

SEQ ID NO: 3103785 - RNA, 13 nt, Molluscum contagiosum virus
cgcccgcugcucu

SEQ ID NO: 3103786 - RNA, 14 nt, Molluscum contagiosum virus
cgcccgcgcccgcg

SEQ ID NO: 3103787 - RNA, 17 nt, Molluscum contagiosum virus
cgcccgcgcccgcgccg

SEQ ID NO: 3103788 - RNA, 12 nt, Molluscum contagiosum virus
cgcccgcggcac

SEQ ID NO: 3103789 - RNA, 14 nt, Molluscum contagiosum virus
cgcccgcggcgcac

SEQ ID NO: 3103790 - RNA, 23 nt, Molluscum contagiosum virus
cgcccggcagcgacuacgcgcug

SEQ ID NO: 3103791 - RNA, 17 nt, Molluscum contagiosum virus
cgcccggcaggcucccg

SEQ ID NO: 3103792 - RNA, 15 nt, Molluscum contagiosum virus
cgcccggcgugaucu

SEQ ID NO: 3103793 - RNA, 20 nt, Molluscum contagiosum virus
cgcccggugcggcguguucc

SEQ ID NO: 3103794 - RNA, 16 nt, Molluscum contagiosum virus
cgcccguaaagaagcg

SEQ ID NO: 3103795 - RNA, 19 nt, Molluscum contagiosum virus
cgcgugucuacccggcacg

SEQ ID NO: 3103796 - RNA, 22 nt, Molluscum contagiosum virus
cgcgugucugcgcucgccugcu

SEQ ID NO: 3103797 - RNA, 18 nt, Molluscum contagiosum virus
cgcguugccgcccgccga

SEQ ID NO: 3103798 - RNA, 22 nt, Molluscum contagiosum virus
cgcgugcugagcuagugccgag

SEQ ID NO: 3103799 - RNA, 14 nt, Molluscum contagiosum virus
cgcgugcugcggcu

SEQ ID NO: 3103800 - RNA, 15 nt, Molluscum contagiosum virus
cgcgugcugcuacgc

SEQ ID NO: 3103801 - RNA, 14 nt, Molluscum contagiosum virus
cgcgugcuggacgc

SEQ ID NO: 3103802 - RNA, 20 nt, Molluscum contagiosum virus
cgcgugcuggacgcgcacgc

SEQ ID NO: 3103803 - RNA, 22 nt, Molluscum contagiosum virus
cgcgugcuggacgcgcacgcgg

SEQ ID NO: 3103804 - RNA, 14 nt, Molluscum contagiosum virus
cgcguggugcuuac

SEQ ID NO: 3103805 - RNA, 19 nt, Molluscum contagiosum virus
cgcguggugcuuacugcgg

SEQ ID NO: 3103806 - RNA, 15 nt, Molluscum contagiosum virus
cgcccucgcgcgcag

SEQ ID NO: 3103807 - RNA, 22 nt, Molluscum contagiosum virus
cgcccucacgugcugaucacgc

SEQ ID NO: 3103808 - RNA, 17 nt, Molluscum contagiosum virus
cgcccgugcucgcgggc

SEQ ID NO: 3103809 - RNA, 18 nt, Molluscum contagiosum virus
cgcccguguucgcggagc

SEQ ID NO: 3103810 - RNA, 13 nt, Molluscum contagiosum virus
cgccgaaguacuu

SEQ ID NO: 3103811 - RNA, 19 nt, Molluscum contagiosum virus
cgccgacaacgcacccgcg

SEQ ID NO: 3103812 - RNA, 18 nt, Molluscum contagiosum virus
cgcccuucaacgcgcgug

SEQ ID NO: 3103813 - RNA, 14 nt, Molluscum contagiosum virus
cgcccucguguacg

SEQ ID NO: 3103814 - RNA, 16 nt, Molluscum contagiosum virus
cgcugcugcgugcgcg

SEQ ID NO: 3103815 - RNA, 13 nt, Molluscum contagiosum virus
cgcugcucgcgcu

SEQ ID NO: 3103816 - RNA, 21 nt, Molluscum contagiosum virus
cgcugcucgcuugcccggagc

SEQ ID NO: 3103817 - RNA, 22 nt, Molluscum contagiosum virus
cgcugcucuacgucuccucgcg

SEQ ID NO: 3103818 - RNA, 20 nt, Molluscum contagiosum virus
cgcugcucuacuuccacgag

SEQ ID NO: 3103819 - RNA, 14 nt, Molluscum contagiosum virus
cgcugcugcacagc

SEQ ID NO: 3103820 - RNA, 22 nt, Molluscum contagiosum virus
cgcucgaacgcgcgugcgcgug

SEQ ID NO: 3103821 - RNA, 22 nt, Molluscum contagiosum virus
cgcugccgguggaagagcccgc

SEQ ID NO: 3103822 - RNA, 22 nt, Molluscum contagiosum virus
cgcugccugugcuacgcgagca

SEQ ID NO: 3103823 - RNA, 19 nt, Molluscum contagiosum virus
cgcugcgaacauggacgcg

SEQ ID NO: 3103824 - RNA, 20 nt, Molluscum contagiosum virus
cgcugcgcacgugcgcgccg

SEQ ID NO: 3103825 - RNA, 18 nt, Molluscum contagiosum virus
cgcugcgccggcugcgcc

SEQ ID NO: 3103826 - RNA, 18 nt, Molluscum contagiosum virus
cgcugcuacaagcggugc

SEQ ID NO: 3103827 - RNA, 21 nt, Molluscum contagiosum virus
cgcugcuagagaaccugugcg

SEQ ID NO: 3103828 - RNA, 23 nt, Molluscum contagiosum virus
cgcugcuagagaaccugugcgcg

SEQ ID NO: 3103829 - RNA, 18 nt, Molluscum contagiosum virus
cgcugcuauacgcgccag

SEQ ID NO: 3103830 - RNA, 16 nt, Molluscum contagiosum virus
cgcugcuccccgccag

SEQ ID NO: 3103831 - RNA, 19 nt, Molluscum contagiosum virus
cgcucacagcuucgcgagc

SEQ ID NO: 3103832 - RNA, 23 nt, Molluscum contagiosum virus
cgcucacagcuucgcgagcccgg

SEQ ID NO: 3103833 - RNA, 18 nt, Molluscum contagiosum virus
cgcuccgagcggcugcuc

SEQ ID NO: 3103834 - RNA, 20 nt, Molluscum contagiosum virus
cgcuccgagucguacacgca

SEQ ID NO: 3103835 - RNA, 16 nt, Molluscum contagiosum virus
cgcuccgcagccggag

SEQ ID NO: 3103836 - RNA, 13 nt, Molluscum contagiosum virus
cgcuccgcucgcg

SEQ ID NO: 3103837 - RNA, 14 nt, Molluscum contagiosum virus
cgcuccgcucgcgc

SEQ ID NO: 3103838 - RNA, 17 nt, Molluscum contagiosum virus
cgcuccgcucgcgcgug

SEQ ID NO: 3103839 - RNA, 14 nt, Molluscum contagiosum virus
cgcugcgcgacgag

SEQ ID NO: 3103840 - RNA, 14 nt, Molluscum contagiosum virus
cgcugcgcgccgcg

SEQ ID NO: 3103841 - RNA, 18 nt, Molluscum contagiosum virus
cgcugcgcggagcucgcg

SEQ ID NO: 3103842 - RNA, 13 nt, Molluscum contagiosum virus
cgcugcgcggcgc

SEQ ID NO: 3103843 - RNA, 16 nt, Molluscum contagiosum virus
cgcugcgcggcgcgcg

SEQ ID NO: 3103844 - RNA, 18 nt, Molluscum contagiosum virus
cgcugcgcucggcgcgcg

SEQ ID NO: 3103845 - RNA, 21 nt, Molluscum contagiosum virus
cgcugcgcuggaugcugcucg

SEQ ID NO: 3103846 - RNA, 18 nt, Molluscum contagiosum virus
cgcugcggcggcgcaacg

SEQ ID NO: 3103847 - RNA, 13 nt, Molluscum contagiosum virus
cgcugcgggcgcc

SEQ ID NO: 3103848 - RNA, 14 nt, Molluscum contagiosum virus
cgcugcgggcgccg

SEQ ID NO: 3103849 - RNA, 15 nt, Molluscum contagiosum virus
cgcugcgggcgccgg

SEQ ID NO: 3103850 - RNA, 22 nt, Molluscum contagiosum virus
cgcucauacuccugcuggcgug

SEQ ID NO: 3103851 - RNA, 20 nt, Molluscum contagiosum virus
cgcucaucaccgacacgcgc

SEQ ID NO: 3103852 - RNA, 21 nt, Molluscum contagiosum virus
cgcucaucaccgacacgcgcc

SEQ ID NO: 3103853 - RNA, 18 nt, Molluscum contagiosum virus
cgcucauccacgcggagg

SEQ ID NO: 3103854 - RNA, 19 nt, Molluscum contagiosum virus
cgcucauccacgcggagga

SEQ ID NO: 3103855 - RNA, 21 nt, Molluscum contagiosum virus
cgcucaucucgcagacgcagc

SEQ ID NO: 3103856 - RNA, 15 nt, Molluscum contagiosum virus
cgcuccacgcccgag

SEQ ID NO: 3103857 - RNA, 16 nt, Molluscum contagiosum virus
cgcuccagagccgcgu

SEQ ID NO: 3103858 - RNA, 16 nt, Molluscum contagiosum virus
cgcguuuucgcggccu

SEQ ID NO: 3103859 - RNA, 17 nt, Molluscum contagiosum virus
cgcuaaagaucgugcgc

SEQ ID NO: 3103860 - RNA, 22 nt, Molluscum contagiosum virus
cgcuaggggugccgcugcgcug

SEQ ID NO: 3103861 - RNA, 14 nt, Molluscum contagiosum virus
cgcuaugccgcgug

SEQ ID NO: 3103862 - RNA, 16 nt, Molluscum contagiosum virus
cgcuaugccgcgugcu

SEQ ID NO: 3103863 - RNA, 23 nt, Molluscum contagiosum virus
cgcuaugccgcgugcucugcucc

SEQ ID NO: 3103864 - RNA, 20 nt, Molluscum contagiosum virus
cgcuaaucugccgcggcgga

SEQ ID NO: 3103865 - RNA, 14 nt, Molluscum contagiosum virus
cgcuacagcagccg

SEQ ID NO: 3103866 - RNA, 21 nt, Molluscum contagiosum virus
cgcuacauguaugccagcgag

SEQ ID NO: 3103867 - RNA, 19 nt, Molluscum contagiosum virus
cgcuacccguugcugcgcc

SEQ ID NO: 3103868 - RNA, 22 nt, Molluscum contagiosum virus
cgcuacccguugcugcgccacg

SEQ ID NO: 3103869 - RNA, 17 nt, Molluscum contagiosum virus
cgcuaccuaccggcagc

SEQ ID NO: 3103870 - RNA, 18 nt, Molluscum contagiosum virus
cgcuaccugaugcgcaug

SEQ ID NO: 3103871 - RNA, 22 nt, Molluscum contagiosum virus
cgcuacgacgacaugcacacgc

SEQ ID NO: 3103872 - RNA, 16 nt, Molluscum contagiosum virus
cgcguuucggccugca

SEQ ID NO: 3103873 - RNA, 19 nt, Molluscum contagiosum virus
cgcguuugucgcgggcgcg

SEQ ID NO: 3103874 - RNA, 23 nt, Molluscum contagiosum virus
cgcuacuugcuggcgcgcggaga

SEQ ID NO: 3103875 - RNA, 16 nt, Molluscum contagiosum virus
cgcuagagcgcggcgc

SEQ ID NO: 3103876 - RNA, 21 nt, Molluscum contagiosum virus
cgcuagcaggcgucgcgcaca

SEQ ID NO: 3103877 - RNA, 13 nt, Molluscum contagiosum virus
cccggcgcgcgcg

SEQ ID NO: 3103878 - RNA, 18 nt, Molluscum contagiosum virus
cccggcacgugccccgcg

SEQ ID NO: 3103879 - RNA, 17 nt, Molluscum contagiosum virus
cccggcaggcucccgcu

SEQ ID NO: 3103880 - RNA, 16 nt, Molluscum contagiosum virus
cccgcuuccgcggccg

SEQ ID NO: 3103881 - RNA, 14 nt, Molluscum contagiosum virus
cccggaauuccgug

SEQ ID NO: 3103882 - RNA, 17 nt, Molluscum contagiosum virus
cccggaucagccccgcg

SEQ ID NO: 3103883 - RNA, 21 nt, Molluscum contagiosum virus
cccggaucagccccgcgccag

SEQ ID NO: 3103884 - RNA, 15 nt, Molluscum contagiosum virus
cccgcuggcggcacg

SEQ ID NO: 3103885 - RNA, 17 nt, Molluscum contagiosum virus
cccgcuggcggcgcacg

SEQ ID NO: 3103886 - RNA, 23 nt, Molluscum contagiosum virus
cccgcugucgcgcgucgcggucg

SEQ ID NO: 3103887 - RNA, 17 nt, Molluscum contagiosum virus
cccgcggacgcgcagcu

SEQ ID NO: 3103888 - RNA, 13 nt, Molluscum contagiosum virus
cccgcggcgcacg

SEQ ID NO: 3103889 - RNA, 14 nt, Molluscum contagiosum virus
cccgcggcgcgccg

SEQ ID NO: 3103890 - RNA, 13 nt, Molluscum contagiosum virus
cccgcggcgugcc

SEQ ID NO: 3103891 - RNA, 23 nt, Molluscum contagiosum virus
cccgcguccgugcgcagggcaau

SEQ ID NO: 3103892 - RNA, 16 nt, Molluscum contagiosum virus
cccgcgucgcgcgccg

SEQ ID NO: 3103893 - RNA, 18 nt, Molluscum contagiosum virus
cccgcggaagugcgagcc

SEQ ID NO: 3103894 - RNA, 21 nt, Molluscum contagiosum virus
cccgcuccgcucgcgcgugcu

SEQ ID NO: 3103895 - RNA, 20 nt, Molluscum contagiosum virus
ccgagcagaaggaagggccc

SEQ ID NO: 3103896 - RNA, 18 nt, Molluscum contagiosum virus
ccgagaucacggcgugcg

SEQ ID NO: 3103897 - RNA, 22 nt, Molluscum contagiosum virus
ccgagaucacggcgugcgcgag

SEQ ID NO: 3103898 - RNA, 14 nt, Molluscum contagiosum virus
ccgacggcgacgac

SEQ ID NO: 3103899 - RNA, 18 nt, Molluscum contagiosum virus
ccgacgggccgccgcccg

SEQ ID NO: 3103900 - RNA, 17 nt, Molluscum contagiosum virus
ccgacugcccgcgcccu

SEQ ID NO: 3103901 - RNA, 16 nt, Molluscum contagiosum virus
ccgacugccgccgccg

SEQ ID NO: 3103902 - RNA, 16 nt, Molluscum contagiosum virus
ccgacuuuucgcgccg

SEQ ID NO: 3103903 - RNA, 17 nt, Molluscum contagiosum virus
ccgagaaaaagcugucg

SEQ ID NO: 3103904 - RNA, 15 nt, Molluscum contagiosum virus
cccgggggcgcuucc

SEQ ID NO: 3103905 - RNA, 16 nt, Molluscum contagiosum virus
cccggcucgcucauca

SEQ ID NO: 3103906 - RNA, 17 nt, Molluscum contagiosum virus
cccgggcccgcaugcag

SEQ ID NO: 3103907 - RNA, 17 nt, Molluscum contagiosum virus
ccgacgccagcgcgccc

SEQ ID NO: 3103908 - RNA, 18 nt, Molluscum contagiosum virus
ccgacgccagcgcgccca

SEQ ID NO: 3103909 - RNA, 20 nt, Molluscum contagiosum virus
ccgaccgugcccuggaccuc

SEQ ID NO: 3103910 - RNA, 15 nt, Molluscum contagiosum virus
ccgagggcgcgaccg

SEQ ID NO: 3103911 - RNA, 13 nt, Molluscum contagiosum virus
ccgagggcgugcg

SEQ ID NO: 3103912 - RNA, 20 nt, Molluscum contagiosum virus
cgagccagccaggcgccggc

SEQ ID NO: 3103913 - RNA, 15 nt, Molluscum contagiosum virus
cgagccaaggaugcc

SEQ ID NO: 3103914 - RNA, 23 nt, Molluscum contagiosum virus
cgagccaaggaugccugccagca

SEQ ID NO: 3103915 - RNA, 18 nt, Molluscum contagiosum virus
ccgaguaccgcgcgcacg

SEQ ID NO: 3103916 - RNA, 22 nt, Molluscum contagiosum virus
ccgaguauacucgacgcgcgcg

SEQ ID NO: 3103917 - RNA, 18 nt, Molluscum contagiosum virus
ccgaguauucgcccauca

SEQ ID NO: 3103918 - RNA, 22 nt, Molluscum contagiosum virus
ccgagucgagcacgcgcgagcg

SEQ ID NO: 3103919 - RNA, 15 nt, Molluscum contagiosum virus
ccgagucgcgccucg

SEQ ID NO: 3103920 - RNA, 20 nt, Molluscum contagiosum virus
cgagcacagcgcgcggaagc

SEQ ID NO: 3103921 - RNA, 20 nt, Molluscum contagiosum virus
cgagcacccccgcugcacgc

SEQ ID NO: 3103922 - RNA, 13 nt, Molluscum contagiosum virus
cgagccgcgcgag

SEQ ID NO: 3103923 - RNA, 15 nt, Molluscum contagiosum virus
cgagccgcgcgagcg

SEQ ID NO: 3103924 - RNA, 17 nt, Molluscum contagiosum virus
cgagccgcgcgagcgcg

SEQ ID NO: 3103925 - RNA, 17 nt, Molluscum contagiosum virus
cgagccggacgcgcgaa

SEQ ID NO: 3103926 - RNA, 19 nt, Molluscum contagiosum virus
cgagccugccagcgccagc

SEQ ID NO: 3103927 - RNA, 15 nt, Molluscum contagiosum virus
cgagccugccgcgag

SEQ ID NO: 3103928 - RNA, 21 nt, Molluscum contagiosum virus
cgagcgaaaacgcgugucuuc

SEQ ID NO: 3103929 - RNA, 18 nt, Molluscum contagiosum virus
cgagcgaaccgcggcagc

SEQ ID NO: 3103930 - RNA, 19 nt, Molluscum contagiosum virus
cgagcgaaccgcggcagcc

SEQ ID NO: 3103931 - RNA, 19 nt, Molluscum contagiosum virus
cgagcgacuacaccuggcg

SEQ ID NO: 3103932 - RNA, 13 nt, Molluscum contagiosum virus
cgagcgagcacgc

SEQ ID NO: 3103933 - RNA, 19 nt, Molluscum contagiosum virus
cgagcgcacgccgcucucg

SEQ ID NO: 3103934 - RNA, 13 nt, Molluscum contagiosum virus
cgagcgccacuag

SEQ ID NO: 3103935 - RNA, 22 nt, Molluscum contagiosum virus
cgagcgccacuagcaaggcgcc

SEQ ID NO: 3103936 - RNA, 18 nt, Molluscum contagiosum virus
cgagcgccagccugugcg

SEQ ID NO: 3103937 - RNA, 13 nt, Molluscum contagiosum virus
ccgagcccgagcc

SEQ ID NO: 3103938 - RNA, 15 nt, Molluscum contagiosum virus
ccgagcccgcccccg

SEQ ID NO: 3103939 - RNA, 14 nt, Molluscum contagiosum virus
ccgagcccggccag

SEQ ID NO: 3103940 - RNA, 19 nt, Molluscum contagiosum virus
ccgagcccggccagacuac

SEQ ID NO: 3103941 - RNA, 19 nt, Molluscum contagiosum virus
ccgagccggacgcgcgaac

SEQ ID NO: 3103942 - RNA, 19 nt, Molluscum contagiosum virus
ccgagccgggggaacacgc

SEQ ID NO: 3103943 - RNA, 16 nt, Molluscum contagiosum virus
ccgagcgcacgccgcu

SEQ ID NO: 3103944 - RNA, 16 nt, Molluscum contagiosum virus
ccgagcgccgccagcu

SEQ ID NO: 3103945 - RNA, 13 nt, Molluscum contagiosum virus
ccgagcgcgcgcg

SEQ ID NO: 3103946 - RNA, 15 nt, Molluscum contagiosum virus
ccgagcgcgcgugcu

SEQ ID NO: 3103947 - RNA, 22 nt, Molluscum contagiosum virus
ccgagcugcggcgcgugcugag

SEQ ID NO: 3103948 - RNA, 22 nt, Molluscum contagiosum virus
ccgagcuucuaaaucgcgcgcg

SEQ ID NO: 3103949 - RNA, 21 nt, Molluscum contagiosum virus
ccgaggacgacgccgagcccg

SEQ ID NO: 3103950 - RNA, 21 nt, Molluscum contagiosum virus
ccgaggacgagccccgcgccg

SEQ ID NO: 3103951 - RNA, 15 nt, Molluscum contagiosum virus
ccgaggacgcgcccg

SEQ ID NO: 3103952 - RNA, 20 nt, Molluscum contagiosum virus
ccgaggacuuccgcgcgcuc

SEQ ID NO: 3103953 - RNA, 18 nt, Molluscum contagiosum virus
ccgaggagagcggcgccc

SEQ ID NO: 3103954 - RNA, 15 nt, Molluscum contagiosum virus
cgagcaccugucgcg

SEQ ID NO: 3103955 - RNA, 16 nt, Molluscum contagiosum virus
cgagcaccugucgcgc

SEQ ID NO: 3103956 - RNA, 20 nt, Molluscum contagiosum virus
cgagcaccugucgcgcgagc

SEQ ID NO: 3103957 - RNA, 18 nt, Molluscum contagiosum virus
cgagcacgccuccaagaa

SEQ ID NO: 3103958 - RNA, 16 nt, Molluscum contagiosum virus
cgagcacgccugcacg

SEQ ID NO: 3103959 - RNA, 17 nt, Molluscum contagiosum virus
cgagcacgccugcacgc

SEQ ID NO: 3103960 - RNA, 18 nt, Molluscum contagiosum virus
cgagcacgccugcacgcg

SEQ ID NO: 3103961 - RNA, 15 nt, Molluscum contagiosum virus
cgagcacgcgcgagc

SEQ ID NO: 3103962 - RNA, 14 nt, Molluscum contagiosum virus
cgagcacgggcgcc

SEQ ID NO: 3103963 - RNA, 21 nt, Molluscum contagiosum virus
cgagcacguccguugcacgug

SEQ ID NO: 3103964 - RNA, 19 nt, Molluscum contagiosum virus
cgagcacguggacagcauc

SEQ ID NO: 3103965 - RNA, 16 nt, Molluscum contagiosum virus
cgagcacuacgugcuc

SEQ ID NO: 3103966 - RNA, 16 nt, Molluscum contagiosum virus
cgagcacugccugccg

SEQ ID NO: 3103967 - RNA, 14 nt, Molluscum contagiosum virus
cgagcacugcgcgc

SEQ ID NO: 3103968 - RNA, 15 nt, Molluscum contagiosum virus
cgagcacugcgcgcg

SEQ ID NO: 3103969 - RNA, 17 nt, Molluscum contagiosum virus
cgagcacugcgcgcgcg

SEQ ID NO: 3103970 - RNA, 19 nt, Molluscum contagiosum virus
cgagcagagccgggacgcg

SEQ ID NO: 3103971 - RNA, 24 nt, Molluscum contagiosum virus
cgagcagagccgggacgcggaugc

SEQ ID NO: 3103972 - RNA, 19 nt, Molluscum contagiosum virus
cgagcagcccgugcgccug

SEQ ID NO: 3103973 - RNA, 22 nt, Molluscum contagiosum virus
cgagcagcgcuugcgcgccaac

SEQ ID NO: 3103974 - RNA, 15 nt, Molluscum contagiosum virus
cgagcagcugcugcg

SEQ ID NO: 3103975 - RNA, 19 nt, Molluscum contagiosum virus
cgagcagcugcugcgcacg

SEQ ID NO: 3103976 - RNA, 14 nt, Molluscum contagiosum virus
cgagcaggcgcagc

SEQ ID NO: 3103977 - RNA, 15 nt, Molluscum contagiosum virus
cgagcaggcgcagcg

SEQ ID NO: 3103978 - RNA, 18 nt, Molluscum contagiosum virus
cgagcaguccgccucgag

SEQ ID NO: 3103979 - RNA, 22 nt, Molluscum contagiosum virus
cgagcaguccgccucgagcacg

SEQ ID NO: 3103980 - RNA, 16 nt, Molluscum contagiosum virus
cgagcaguucgcgcgc

SEQ ID NO: 3103981 - RNA, 14 nt, Molluscum contagiosum virus
cgagcaucugcgcg

SEQ ID NO: 3103982 - RNA, 15 nt, Molluscum contagiosum virus
cgagcaucugcgcgu

SEQ ID NO: 3103983 - RNA, 16 nt, Molluscum contagiosum virus
cgagcaucugcgcgug

SEQ ID NO: 3103984 - RNA, 15 nt, Molluscum contagiosum virus
cgcaccuccuucgcg

SEQ ID NO: 3103985 - RNA, 19 nt, Molluscum contagiosum virus
cgcagccucgagcgccgug

SEQ ID NO: 3103986 - RNA, 19 nt, Molluscum contagiosum virus
cgcagccuccgugcgccag

SEQ ID NO: 3103987 - RNA, 20 nt, Molluscum contagiosum virus
cgcagccuccgugcgccagu

SEQ ID NO: 3103988 - RNA, 13 nt, Molluscum contagiosum virus
cgcagcgcccgcg

SEQ ID NO: 3103989 - RNA, 13 nt, Molluscum contagiosum virus
cgcagcgcgagcu

SEQ ID NO: 3103990 - RNA, 18 nt, Molluscum contagiosum virus
cgcagcgcgagcugugca

SEQ ID NO: 3103991 - RNA, 13 nt, Molluscum contagiosum virus
cgcagcgcgcgcg

SEQ ID NO: 3103992 - RNA, 13 nt, Molluscum contagiosum virus
cgcagcgcgcggu

SEQ ID NO: 3103993 - RNA, 13 nt, Molluscum contagiosum virus
cgcagcgcggccu

SEQ ID NO: 3103994 - RNA, 14 nt, Molluscum contagiosum virus
cgcagcggcgccac

SEQ ID NO: 3103995 - RNA, 20 nt, Molluscum contagiosum virus
cgcagcguuccaggaacgcc

SEQ ID NO: 3103996 - RNA, 16 nt, Molluscum contagiosum virus
cgcagcuccuagcgcg

SEQ ID NO: 3103997 - RNA, 16 nt, Molluscum contagiosum virus
cgcagcucgccgcgcg

SEQ ID NO: 3103998 - RNA, 19 nt, Molluscum contagiosum virus
cgcagcucgccgcgcgccg

SEQ ID NO: 3103999 - RNA, 21 nt, Molluscum contagiosum virus
cgcagcucgccgcgcgccgcu

SEQ ID NO: 3104000 - RNA, 19 nt, Molluscum contagiosum virus
cgcagcucuuccacgaagu

SEQ ID NO: 3104001 - RNA, 15 nt, Molluscum contagiosum virus
cgcagcugcgccugc

SEQ ID NO: 3104002 - RNA, 21 nt, Molluscum contagiosum virus
cgcagcuguggcgccugcgcg

SEQ ID NO: 3104003 - RNA, 19 nt, Molluscum contagiosum virus
cgcaggaaagguacccgca

SEQ ID NO: 3104004 - RNA, 20 nt, Molluscum contagiosum virus
cgcaggaaaggucgggcccg

SEQ ID NO: 3104005 - RNA, 20 nt, Molluscum contagiosum virus
cgcaggacaugauccgcgac

SEQ ID NO: 3104006 - RNA, 14 nt, Molluscum contagiosum virus
cgcaggaccgcgac

SEQ ID NO: 3104007 - RNA, 21 nt, Molluscum contagiosum virus
cgcaggacgcggucgcgcccu

SEQ ID NO: 3104008 - RNA, 22 nt, Molluscum contagiosum virus
cgcaggacgcggucgcgcccuu

SEQ ID NO: 3104009 - RNA, 20 nt, Molluscum contagiosum virus
cgcaggacuggcaccugcgg

SEQ ID NO: 3104010 - RNA, 15 nt, Molluscum contagiosum virus
cgcaggccgcgcccg

SEQ ID NO: 3104011 - RNA, 15 nt, Molluscum contagiosum virus
cgcaggccgggcacc

SEQ ID NO: 3104012 - RNA, 18 nt, Molluscum contagiosum virus
cgccaagccugcucacgg

SEQ ID NO: 3104013 - RNA, 22 nt, Molluscum contagiosum virus
cgccaagccugcucacggcggc

SEQ ID NO: 3104014 - RNA, 16 nt, Molluscum contagiosum virus
cgcauucgcgcgcccc

SEQ ID NO: 3104015 - RNA, 20 nt, Molluscum contagiosum virus
cgccaaagaggacguguacg

SEQ ID NO: 3104016 - RNA, 15 nt, Molluscum contagiosum virus
cgccaacacgagcgc

SEQ ID NO: 3104017 - RNA, 14 nt, Molluscum contagiosum virus
cgccaaccgcgagc

SEQ ID NO: 3104018 - RNA, 20 nt, Molluscum contagiosum virus
cgccaacgcggacgcgcagc

SEQ ID NO: 3104019 - RNA, 22 nt, Molluscum contagiosum virus
cgcaucccccgcguuguccgcg

SEQ ID NO: 3104020 - RNA, 23 nt, Molluscum contagiosum virus
cgcaugaaaggcaccugcggcuc

SEQ ID NO: 3104021 - RNA, 18 nt, Molluscum contagiosum virus
cgcagugcucgcacacgu

SEQ ID NO: 3104022 - RNA, 21 nt, Molluscum contagiosum virus
cgcaguucggcgacacgcccg

SEQ ID NO: 3104023 - RNA, 23 nt, Molluscum contagiosum virus
cgcaguuggucaccgccuguacc

SEQ ID NO: 3104024 - RNA, 23 nt, Molluscum contagiosum virus
cgcaguugugcguacccuggcag

SEQ ID NO: 3104025 - RNA, 16 nt, Molluscum contagiosum virus
cgcaugcaccuacgcg

SEQ ID NO: 3104026 - RNA, 22 nt, Molluscum contagiosum virus
cgcaugcgcgguccuguccgcg

SEQ ID NO: 3104027 - RNA, 16 nt, Molluscum contagiosum virus
cgcauggccacgcccg

SEQ ID NO: 3104028 - RNA, 21 nt, Molluscum contagiosum virus
cgcagucccagcaccgcgccg

SEQ ID NO: 3104029 - RNA, 17 nt, Molluscum contagiosum virus
cgcaggcgucaugcgcg

SEQ ID NO: 3104030 - RNA, 19 nt, Molluscum contagiosum virus
cgcaggucaucgacgagca

SEQ ID NO: 3104031 - RNA, 22 nt, Molluscum contagiosum virus
cgcaguaccaguaccugcugcc

SEQ ID NO: 3104032 - RNA, 23 nt, Molluscum contagiosum virus
cgcacacgaaucgcucgcggugc

SEQ ID NO: 3104033 - RNA, 20 nt, Molluscum contagiosum virus
cgcacacgagugcccgcgcg

SEQ ID NO: 3104034 - RNA, 14 nt, Molluscum contagiosum virus
cgcacacgccgcgu

SEQ ID NO: 3104035 - RNA, 21 nt, Molluscum contagiosum virus
cgcacacgcgucgggaagugu

SEQ ID NO: 3104036 - RNA, 18 nt, Molluscum contagiosum virus
cgcacacggacgagcccu

SEQ ID NO: 3104037 - RNA, 18 nt, Molluscum contagiosum virus
cgcacacucgcgcguccg

SEQ ID NO: 3104038 - RNA, 14 nt, Molluscum contagiosum virus
cgcacacuugcgcg

SEQ ID NO: 3104039 - RNA, 16 nt, Molluscum contagiosum virus
cgcacacuugcgcguc

SEQ ID NO: 3104040 - RNA, 18 nt, Molluscum contagiosum virus
cgcacacuugcgcgucca

SEQ ID NO: 3104041 - RNA, 18 nt, Molluscum contagiosum virus
cgcacacuugcgcguccg

SEQ ID NO: 3104042 - RNA, 16 nt, Molluscum contagiosum virus
cgcacacuugcgcguu

SEQ ID NO: 3104043 - RNA, 18 nt, Molluscum contagiosum virus
cgcacacuugcgcguucg

SEQ ID NO: 3104044 - RNA, 21 nt, Molluscum contagiosum virus
cgcacagacauggcccgcgcg

SEQ ID NO: 3104045 - RNA, 20 nt, Molluscum contagiosum virus
cgcacagucuccacgcgugc

SEQ ID NO: 3104046 - RNA, 21 nt, Molluscum contagiosum virus
cgcacagucuccacgcgugcg

SEQ ID NO: 3104047 - RNA, 20 nt, Molluscum contagiosum virus
cgcacaguucacggcgcuug

SEQ ID NO: 3104048 - RNA, 14 nt, Molluscum contagiosum virus
cgcacaaacgcgcg

SEQ ID NO: 3104049 - RNA, 20 nt, Molluscum contagiosum virus
cgcacaaagaacgcgcgucg

SEQ ID NO: 3104050 - RNA, 18 nt, Molluscum contagiosum virus
cgcaacuagggagcggca

SEQ ID NO: 3104051 - RNA, 20 nt, Molluscum contagiosum virus
cgcaaaaggcacgaggcagc

SEQ ID NO: 3104052 - RNA, 12 nt, Molluscum contagiosum virus
cgcacccgccac

SEQ ID NO: 3104053 - RNA, 14 nt, Molluscum contagiosum virus
cgcacccgccacga

SEQ ID NO: 3104054 - RNA, 13 nt, Molluscum contagiosum virus
cgcacccgcgccg

SEQ ID NO: 3104055 - RNA, 15 nt, Molluscum contagiosum virus
cgcacccgcgcggcu

SEQ ID NO: 3104056 - RNA, 14 nt, Molluscum contagiosum virus
cgcaccguacucgc

SEQ ID NO: 3104057 - RNA, 21 nt, Molluscum contagiosum virus
cgcaccgccuggugcugcgcg

SEQ ID NO: 3104058 - RNA, 14 nt, Molluscum contagiosum virus
cgcaagagccgccg

SEQ ID NO: 3104059 - RNA, 12 nt, Molluscum contagiosum virus
cgcaagccagag

SEQ ID NO: 3104060 - RNA, 19 nt, Molluscum contagiosum virus
cgcaagcccgcgcgcgagc

SEQ ID NO: 3104061 - RNA, 15 nt, Molluscum contagiosum virus
cgcaagccgcguacc

SEQ ID NO: 3104062 - RNA, 19 nt, Molluscum contagiosum virus
cgcaagcgcugcucguaga

SEQ ID NO: 3104063 - RNA, 17 nt, Molluscum contagiosum virus
cgcaagcguacgcgucg

SEQ ID NO: 3104064 - RNA, 23 nt, Molluscum contagiosum virus
cgcaagcuuugugcucgcuuagc

SEQ ID NO: 3104065 - RNA, 19 nt, Molluscum contagiosum virus
cgcaaggacaccgcgggcg

SEQ ID NO: 3104066 - RNA, 16 nt, Molluscum contagiosum virus
cgcaaggccgcgccca

SEQ ID NO: 3104067 - RNA, 20 nt, Molluscum contagiosum virus
cgcaaggugugcgcgcugca

SEQ ID NO: 3104068 - RNA, 18 nt, Molluscum contagiosum virus
cgcaagucaccgcuccgc

SEQ ID NO: 3104069 - RNA, 19 nt, Molluscum contagiosum virus
cgcaaguccagcgcgcucg

SEQ ID NO: 3104070 - RNA, 21 nt, Molluscum contagiosum virus
cgcaaguccagcgcgcucgag

SEQ ID NO: 3104071 - RNA, 19 nt, Molluscum contagiosum virus
cgcaagugcacaccagaca

SEQ ID NO: 3104072 - RNA, 17 nt, Molluscum contagiosum virus
cgcaagugcacgcggcg

SEQ ID NO: 3104073 - RNA, 18 nt, Molluscum contagiosum virus
cgagcgcccgugcuugcg

SEQ ID NO: 3104074 - RNA, 13 nt, Molluscum contagiosum virus
cgcaacacggcgg

SEQ ID NO: 3104075 - RNA, 14 nt, Molluscum contagiosum virus
cgcaaccccgcgcg

SEQ ID NO: 3104076 - RNA, 20 nt, Molluscum contagiosum virus
cgcaaccccgcgcugcgcgg

SEQ ID NO: 3104077 - RNA, 14 nt, Molluscum contagiosum virus
cgcaaccgcgugcg

SEQ ID NO: 3104078 - RNA, 20 nt, Molluscum contagiosum virus
cgcaaccgcgugcgugcaca

SEQ ID NO: 3104079 - RNA, 22 nt, Molluscum contagiosum virus
cgcaaccucuuccggaggcagc

SEQ ID NO: 3104080 - RNA, 16 nt, Molluscum contagiosum virus
cgagccccgcgccggc

SEQ ID NO: 3104081 - RNA, 14 nt, Molluscum contagiosum virus
cgagcccgcggcgc

SEQ ID NO: 3104082 - RNA, 16 nt, Molluscum contagiosum virus
cgagcccgcggcgcgc

SEQ ID NO: 3104083 - RNA, 19 nt, Molluscum contagiosum virus
cgagcccgcggcgcgcagc

SEQ ID NO: 3104084 - RNA, 22 nt, Molluscum contagiosum virus
cgagcccgggcccgugcccgag

SEQ ID NO: 3104085 - RNA, 21 nt, Molluscum contagiosum virus
cgagcccuucuuuccggcgcg

SEQ ID NO: 3104086 - RNA, 18 nt, Molluscum contagiosum virus
aacagcaccguugccgcg

SEQ ID NO: 3104087 - RNA, 16 nt, Molluscum contagiosum virus
aacagcagcuggcgcg

SEQ ID NO: 3104088 - RNA, 17 nt, Molluscum contagiosum virus
aacacugucucugcgcg

SEQ ID NO: 3104089 - RNA, 23 nt, Molluscum contagiosum virus
aacacgcuguugcugcugccgcg

SEQ ID NO: 3104090 - RNA, 21 nt, Molluscum contagiosum virus
aaaugguguacgaaaguacuu

SEQ ID NO: 3104091 - RNA, 17 nt, Molluscum contagiosum virus
aaacacgcuacgcagcg

SEQ ID NO: 3104092 - RNA, 20 nt, Molluscum contagiosum virus
aaacacggccuccagcagcg

SEQ ID NO: 3104093 - RNA, 18 nt, Molluscum contagiosum virus
aaaccucugagcgagcgc

SEQ ID NO: 3104094 - RNA, 20 nt, Molluscum contagiosum virus
aaagcuggccgaggucuucc

SEQ ID NO: 3104095 - RNA, 15 nt, Molluscum contagiosum virus
aaaguacgagagcgc

SEQ ID NO: 3104096 - RNA, 18 nt, Molluscum contagiosum virus
aaaggugcgauggacgac

SEQ ID NO: 3104097 - RNA, 23 nt, Molluscum contagiosum virus
aaacguguuggcgcgguccgcgu

SEQ ID NO: 3104098 - RNA, 19 nt, Molluscum contagiosum virus
uggauuucggcgcgcgugc

SEQ ID NO: 3104099 - RNA, 19 nt, Molluscum contagiosum virus
uggcaacgcaaacgcacgc

SEQ ID NO: 3104100 - RNA, 19 nt, Molluscum contagiosum virus
uggcaauccugguacgcgc

SEQ ID NO: 3104101 - RNA, 17 nt, Molluscum contagiosum virus
uggaggugcgcgacucc

SEQ ID NO: 3104102 - RNA, 22 nt, Molluscum contagiosum virus
uggaguccaugcccacgcgcaa

SEQ ID NO: 3104103 - RNA, 20 nt, Molluscum contagiosum virus
uggaguuuaaugacgcgcac

SEQ ID NO: 3104104 - RNA, 17 nt, Molluscum contagiosum virus
uggcacccuggcugcug

SEQ ID NO: 3104105 - RNA, 21 nt, Molluscum contagiosum virus
uggcacccuggcugcugcgcg

SEQ ID NO: 3104106 - RNA, 15 nt, Molluscum contagiosum virus
uggcaccgcgcgcgc

SEQ ID NO: 3104107 - RNA, 16 nt, Molluscum contagiosum virus
uggcaccgggcgccgc

SEQ ID NO: 3104108 - RNA, 20 nt, Molluscum contagiosum virus
uggcaccugcggcugcggcg

SEQ ID NO: 3104109 - RNA, 14 nt, Molluscum contagiosum virus
uggcacuggcgcgc

SEQ ID NO: 3104110 - RNA, 14 nt, Molluscum contagiosum virus
uggcaggcgcgcgc

SEQ ID NO: 3104111 - RNA, 22 nt, Molluscum contagiosum virus
uggcaugcgcccucacgugcug

SEQ ID NO: 3104112 - RNA, 13 nt, Molluscum contagiosum virus
uggcaugcgugcu

SEQ ID NO: 3104113 - RNA, 17 nt, Molluscum contagiosum virus
uggcauggcgcgcucgc

SEQ ID NO: 3104114 - RNA, 15 nt, Molluscum contagiosum virus
uggcauucucggaca

SEQ ID NO: 3104115 - RNA, 22 nt, Molluscum contagiosum virus
uggccaacaggaauguguacga

SEQ ID NO: 3104116 - RNA, 19 nt, Molluscum contagiosum virus
uggccacucucgcgcguga

SEQ ID NO: 3104117 - RNA, 20 nt, Molluscum contagiosum virus
uggcccgugcacguccucca

SEQ ID NO: 3104118 - RNA, 16 nt, Molluscum contagiosum virus
uggcacgcgccgcgcg

SEQ ID NO: 3104119 - RNA, 21 nt, Molluscum contagiosum virus
uggagcccacguugccgcgcg

SEQ ID NO: 3104120 - RNA, 14 nt, Molluscum contagiosum virus
uggagcccgugcug

SEQ ID NO: 3104121 - RNA, 17 nt, Molluscum contagiosum virus
uggagccgcugcugcgg

SEQ ID NO: 3104122 - RNA, 19 nt, Molluscum contagiosum virus
uggagccucccccgcgcac

SEQ ID NO: 3104123 - RNA, 14 nt, Molluscum contagiosum virus
uggagcgagugcgc

SEQ ID NO: 3104124 - RNA, 18 nt, Molluscum contagiosum virus
uggagcgagugcgcgugc

SEQ ID NO: 3104125 - RNA, 19 nt, Molluscum contagiosum virus
uggagcgccuugccgagga

SEQ ID NO: 3104126 - RNA, 16 nt, Molluscum contagiosum virus
uggagcgcgcggacgc

SEQ ID NO: 3104127 - RNA, 23 nt, Molluscum contagiosum virus
uggagaaagaagugugccugcug

SEQ ID NO: 3104128 - RNA, 15 nt, Molluscum contagiosum virus
uggagaacggcgugc

SEQ ID NO: 3104129 - RNA, 22 nt, Molluscum contagiosum virus
uggagaaggucuacgaggagca

SEQ ID NO: 3104130 - RNA, 12 nt, Molluscum contagiosum virus
uggacggugcug

SEQ ID NO: 3104131 - RNA, 17 nt, Molluscum contagiosum virus
uggacgucgcggccacg

SEQ ID NO: 3104132 - RNA, 22 nt, Molluscum contagiosum virus
uggacgugggcgaacugcccgg

SEQ ID NO: 3104133 - RNA, 17 nt, Molluscum contagiosum virus
uggacguguccgacgcg

SEQ ID NO: 3104134 - RNA, 16 nt, Molluscum contagiosum virus
uggagcuagcgcgcgc

SEQ ID NO: 3104135 - RNA, 18 nt, Molluscum contagiosum virus
uggagcugccgcugcgcg

SEQ ID NO: 3104136 - RNA, 19 nt, Molluscum contagiosum virus
uggagcugccgcugcgcga

SEQ ID NO: 3104137 - RNA, 19 nt, Molluscum contagiosum virus
uggagcaagcgcguucgcg

SEQ ID NO: 3104138 - RNA, 17 nt, Molluscum contagiosum virus
uggagcacuuccgcgcg

SEQ ID NO: 3104139 - RNA, 19 nt, Molluscum contagiosum virus
uggagcacuuccgcgcgcu

SEQ ID NO: 3104140 - RNA, 17 nt, Molluscum contagiosum virus
uggagggucacgcgcac

SEQ ID NO: 3104141 - RNA, 19 nt, Molluscum contagiosum virus
uggacgccguugcgcguga

SEQ ID NO: 3104142 - RNA, 17 nt, Molluscum contagiosum virus
uggagggcacgcugcac

SEQ ID NO: 3104143 - RNA, 18 nt, Molluscum contagiosum virus
uaagcgccccgagcacgu

SEQ ID NO: 3104144 - RNA, 15 nt, Molluscum contagiosum virus
uaaauggcgcgcgcg

SEQ ID NO: 3104145 - RNA, 21 nt, Molluscum contagiosum virus
uaaaguacgagagcgcaugcc

SEQ ID NO: 3104146 - RNA, 19 nt, Molluscum contagiosum virus
uaaagaguuccagcagcgc

SEQ ID NO: 3104147 - RNA, 17 nt, Molluscum contagiosum virus
uacacgugcacgcgcac

SEQ ID NO: 3104148 - RNA, 20 nt, Molluscum contagiosum virus
uacagaugccacgaccgcgc

SEQ ID NO: 3104149 - RNA, 15 nt, Molluscum contagiosum virus
uacagccgccugccg

SEQ ID NO: 3104150 - RNA, 14 nt, Molluscum contagiosum virus
uacagcgcgcgugc

SEQ ID NO: 3104151 - RNA, 14 nt, Molluscum contagiosum virus
uacagugcgcgcac

SEQ ID NO: 3104152 - RNA, 15 nt, Molluscum contagiosum virus
uaaugacgcgcacgc

SEQ ID NO: 3104153 - RNA, 15 nt, Molluscum contagiosum virus
uaaggcggaccgcgc

SEQ ID NO: 3104154 - RNA, 16 nt, Molluscum contagiosum virus
uaagggcccgcuggcg

SEQ ID NO: 3104155 - RNA, 20 nt, Molluscum contagiosum virus
uaagggcggacgcacuagac

SEQ ID NO: 3104156 - RNA, 15 nt, Molluscum contagiosum virus
uacacauugcgugug

SEQ ID NO: 3104157 - RNA, 18 nt, Molluscum contagiosum virus
uacacgcagagccagcgc

SEQ ID NO: 3104158 - RNA, 18 nt, Molluscum contagiosum virus
uacacgcgcuuugucgcg

SEQ ID NO: 3104159 - RNA, 17 nt, Molluscum contagiosum virus
ucaaggcgcgcaucgcg

SEQ ID NO: 3104160 - RNA, 19 nt, Molluscum contagiosum virus
ucaacuccgagcgcgcgcg

SEQ ID NO: 3104161 - RNA, 17 nt, Molluscum contagiosum virus
ucaaugcgcacgugcuc

SEQ ID NO: 3104162 - RNA, 16 nt, Molluscum contagiosum virus
ucacaugugcugccgg

SEQ ID NO: 3104163 - RNA, 17 nt, Molluscum contagiosum virus
ucacaaagggguccgcg

SEQ ID NO: 3104164 - RNA, 20 nt, Molluscum contagiosum virus
ucaccgccuguaccugcucg

SEQ ID NO: 3104165 - RNA, 20 nt, Molluscum contagiosum virus
ucacgaccgacccaucggag

SEQ ID NO: 3104166 - RNA, 22 nt, Molluscum contagiosum virus
ucacgcacacgaaucgcucgcg

SEQ ID NO: 3104167 - RNA, 16 nt, Molluscum contagiosum virus
ucacgcccgcgcugcg

SEQ ID NO: 3104168 - RNA, 21 nt, Molluscum contagiosum virus
ucacgcccuucaacgcgcgug

SEQ ID NO: 3104169 - RNA, 18 nt, Molluscum contagiosum virus
ucacgccgguggcgcgcg

SEQ ID NO: 3104170 - RNA, 20 nt, Molluscum contagiosum virus
ucacgccgguggcgcgcgag

SEQ ID NO: 3104171 - RNA, 18 nt, Molluscum contagiosum virus
ucaacagcuacaccgaga

SEQ ID NO: 3104172 - RNA, 13 nt, Molluscum contagiosum virus
uacaugcgugcua

SEQ ID NO: 3104173 - RNA, 18 nt, Molluscum contagiosum virus
ucaaccucgagaagaccu

SEQ ID NO: 3104174 - RNA, 17 nt, Molluscum contagiosum virus
ucaacgcgauggcgcag

SEQ ID NO: 3104175 - RNA, 14 nt, Molluscum contagiosum virus
ucaacgcgcgcgug

SEQ ID NO: 3104176 - RNA, 17 nt, Molluscum contagiosum virus
ucaacgcgcgcgugcug

SEQ ID NO: 3104177 - RNA, 13 nt, Molluscum contagiosum virus
ucaacgcgcgugc

SEQ ID NO: 3104178 - RNA, 14 nt, Molluscum contagiosum virus
ucaacuuccacauc

SEQ ID NO: 3104179 - RNA, 15 nt, Molluscum contagiosum virus
ucaacuucgcgcugu

SEQ ID NO: 3104180 - RNA, 22 nt, Molluscum contagiosum virus
ucaagaacagucgcgcgccugc

SEQ ID NO: 3104181 - RNA, 16 nt, Molluscum contagiosum virus
ucaagacucgcccgcg

SEQ ID NO: 3104182 - RNA, 15 nt, Molluscum contagiosum virus
ucaagaggugcgugc

SEQ ID NO: 3104183 - RNA, 15 nt, Molluscum contagiosum virus
ucaagcaccugcgcu

SEQ ID NO: 3104184 - RNA, 19 nt, Molluscum contagiosum virus
ucaagcaccugcgcuuccu

SEQ ID NO: 3104185 - RNA, 21 nt, Molluscum contagiosum virus
ucaagcacggcuuccggcacc

SEQ ID NO: 3104186 - RNA, 23 nt, Molluscum contagiosum virus
ucaagcacuacauggacgugcug

SEQ ID NO: 3104187 - RNA, 19 nt, Molluscum contagiosum virus
ucaagcagguggccgcgcg

SEQ ID NO: 3104188 - RNA, 21 nt, Molluscum contagiosum virus
ucaagcagguggccgcgcgcg

SEQ ID NO: 3104189 - RNA, 22 nt, Molluscum contagiosum virus
ucaagccgcaggcgcgcgccau

SEQ ID NO: 3104190 - RNA, 16 nt, Molluscum contagiosum virus
guucugcgcgccgcuc

SEQ ID NO: 3104191 - RNA, 21 nt, Molluscum contagiosum virus
guucugcacagcacaggcccc

SEQ ID NO: 3104192 - RNA, 17 nt, Molluscum contagiosum virus
guugccaggcacacgca

SEQ ID NO: 3104193 - RNA, 23 nt, Molluscum contagiosum virus
guugccgcccgccgaguaccgcg

SEQ ID NO: 3104194 - RNA, 17 nt, Molluscum contagiosum virus
guugccgcgcgcugcuc

SEQ ID NO: 3104195 - RNA, 13 nt, Molluscum contagiosum virus
guugccgugccca

SEQ ID NO: 3104196 - RNA, 19 nt, Molluscum contagiosum virus
guugcgagccagccaggcg

SEQ ID NO: 3104197 - RNA, 19 nt, Molluscum contagiosum virus
guugcgcacguuggccacg

SEQ ID NO: 3104198 - RNA, 16 nt, Molluscum contagiosum virus
guugcgcaugcgcaag

SEQ ID NO: 3104199 - RNA, 13 nt, Molluscum contagiosum virus
guuccccgugagc

SEQ ID NO: 3104200 - RNA, 13 nt, Molluscum contagiosum virus
guucgcgcgccag

SEQ ID NO: 3104201 - RNA, 13 nt, Molluscum contagiosum virus
guucgcgcugcuc

SEQ ID NO: 3104202 - RNA, 16 nt, Molluscum contagiosum virus
guucgcgggaccgccc

SEQ ID NO: 3104203 - RNA, 19 nt, Molluscum contagiosum virus
guuccggacgugcacgcac

SEQ ID NO: 3104204 - RNA, 17 nt, Molluscum contagiosum virus
guuccggcagcgccgcg

SEQ ID NO: 3104205 - RNA, 17 nt, Molluscum contagiosum virus
guucgacuacacgcgcu

SEQ ID NO: 3104206 - RNA, 22 nt, Molluscum contagiosum virus
guucgagaagacggggcgcacg

SEQ ID NO: 3104207 - RNA, 20 nt, Molluscum contagiosum virus
guuuacaucggcuccgcgcc

SEQ ID NO: 3104208 - RNA, 16 nt, Molluscum contagiosum virus
guugucgaguucgcuc

SEQ ID NO: 3104209 - RNA, 17 nt, Molluscum contagiosum virus
guuuacguccacgcgcc

SEQ ID NO: 3104210 - RNA, 15 nt, Molluscum contagiosum virus
guuugcacccgcgca

SEQ ID NO: 3104211 - RNA, 20 nt, Molluscum contagiosum virus
guuugccacggccgcgcgcg

SEQ ID NO: 3104212 - RNA, 20 nt, Molluscum contagiosum virus
guucuggacguguccgacgc

SEQ ID NO: 3104213 - RNA, 12 nt, Molluscum contagiosum virus
guugcgcgcgcc

SEQ ID NO: 3104214 - RNA, 16 nt, Molluscum contagiosum virus
guugcgcgugugcagc

SEQ ID NO: 3104215 - RNA, 19 nt, Molluscum contagiosum virus
guugacgagcgcgugcccg

SEQ ID NO: 3104216 - RNA, 21 nt, Molluscum contagiosum virus
guuggcgcgcaagcgcugcuc

SEQ ID NO: 3104217 - RNA, 16 nt, Molluscum contagiosum virus
guuggcgugcucgcuc

SEQ ID NO: 3104218 - RNA, 20 nt, Molluscum contagiosum virus
guuggcuuucugugcgcgac

SEQ ID NO: 3104219 - RNA, 17 nt, Molluscum contagiosum virus
guugcguuggcgccagc

SEQ ID NO: 3104220 - RNA, 18 nt, Molluscum contagiosum virus
guugcguuggcgccagcc

SEQ ID NO: 3104221 - RNA, 22 nt, Molluscum contagiosum virus
guugcugcugccgcgcggcacg

SEQ ID NO: 3104222 - RNA, 12 nt, Molluscum contagiosum virus
ugcccacgcgca

SEQ ID NO: 3104223 - RNA, 14 nt, Molluscum contagiosum virus
ugcccagccugacg

SEQ ID NO: 3104224 - RNA, 22 nt, Molluscum contagiosum virus
ugccaagaccugggcgucgugc

SEQ ID NO: 3104225 - RNA, 22 nt, Molluscum contagiosum virus
ugccaagguucuggacgugucc

SEQ ID NO: 3104226 - RNA, 20 nt, Molluscum contagiosum virus
ugcaucuuugccuucgugga

SEQ ID NO: 3104227 - RNA, 17 nt, Molluscum contagiosum virus
ugcaugacggcgcgagc

SEQ ID NO: 3104228 - RNA, 15 nt, Molluscum contagiosum virus
ugcaugcggagcugg

SEQ ID NO: 3104229 - RNA, 20 nt, Molluscum contagiosum virus
ugcauguuuguucgcgcgcc

SEQ ID NO: 3104230 - RNA, 17 nt, Molluscum contagiosum virus
ugccacaugcaguacgc

SEQ ID NO: 3104231 - RNA, 18 nt, Molluscum contagiosum virus
ugccacgaccgcgcacgc

SEQ ID NO: 3104232 - RNA, 17 nt, Molluscum contagiosum virus
ugccacgcagcuggcgg

SEQ ID NO: 3104233 - RNA, 22 nt, Molluscum contagiosum virus
ugccagagucgccgcugcgcau

SEQ ID NO: 3104234 - RNA, 21 nt, Molluscum contagiosum virus
ugccagauugccggcgcgcgc

SEQ ID NO: 3104235 - RNA, 22 nt, Molluscum contagiosum virus
ugccagcgagcucaaggacauc

SEQ ID NO: 3104236 - RNA, 18 nt, Molluscum contagiosum virus
ugccagcggcgccgcagc

SEQ ID NO: 3104237 - RNA, 17 nt, Molluscum contagiosum virus
ugccaggcggucuucca

SEQ ID NO: 3104238 - RNA, 19 nt, Molluscum contagiosum virus
ugccagucgcgccucgcau

SEQ ID NO: 3104239 - RNA, 21 nt, Molluscum contagiosum virus
ugagcagcaccgcacgccagc

SEQ ID NO: 3104240 - RNA, 17 nt, Molluscum contagiosum virus
ugagcgcgccgcucgcg

SEQ ID NO: 3104241 - RNA, 14 nt, Molluscum contagiosum virus
ugagcgcgcugcgc

SEQ ID NO: 3104242 - RNA, 23 nt, Molluscum contagiosum virus
ugagcggcacgggaaggcucuca

SEQ ID NO: 3104243 - RNA, 13 nt, Molluscum contagiosum virus
ugagcucgcgcgc

SEQ ID NO: 3104244 - RNA, 21 nt, Molluscum contagiosum virus
ugagcucuuuguacacccgug

SEQ ID NO: 3104245 - RNA, 17 nt, Molluscum contagiosum virus
ugagcccagaacauguc

SEQ ID NO: 3104246 - RNA, 16 nt, Molluscum contagiosum virus
ugcaggaacgcgcgcu

SEQ ID NO: 3104247 - RNA, 22 nt, Molluscum contagiosum virus
ugcaggaggaccgcgagcgcau

SEQ ID NO: 3104248 - RNA, 17 nt, Molluscum contagiosum virus
ugcaggauuuccucgcg

SEQ ID NO: 3104249 - RNA, 18 nt, Molluscum contagiosum virus
ugcaggauuuccucgcgg

SEQ ID NO: 3104250 - RNA, 14 nt, Molluscum contagiosum virus
ugcagggcgugcuu

SEQ ID NO: 3104251 - RNA, 14 nt, Molluscum contagiosum virus
ugcaguacggcgcg

SEQ ID NO: 3104252 - RNA, 21 nt, Molluscum contagiosum virus
ugacggccggcgggcgcgugc

SEQ ID NO: 3104253 - RNA, 15 nt, Molluscum contagiosum virus
ugacgguccugcgcg

SEQ ID NO: 3104254 - RNA, 17 nt, Molluscum contagiosum virus
ugacgucuuccagacgc

SEQ ID NO: 3104255 - RNA, 16 nt, Molluscum contagiosum virus
ugacggcgcugcgcgu

SEQ ID NO: 3104256 - RNA, 18 nt, Molluscum contagiosum virus
ugacggcgcugcgcgugg

SEQ ID NO: 3104257 - RNA, 20 nt, Molluscum contagiosum virus
ugacggcgguucucgcgcuu

SEQ ID NO: 3104258 - RNA, 19 nt, Molluscum contagiosum virus
ugacggcgucucucgaaca

SEQ ID NO: 3104259 - RNA, 14 nt, Molluscum contagiosum virus
ugacggcagcaagc

SEQ ID NO: 3104260 - RNA, 14 nt, Molluscum contagiosum virus
ugacgagcgcgugc

SEQ ID NO: 3104261 - RNA, 17 nt, Molluscum contagiosum virus
ugaccucgcugcugagc

SEQ ID NO: 3104262 - RNA, 16 nt, Molluscum contagiosum virus
ugaccagugcgugcuc

SEQ ID NO: 3104263 - RNA, 15 nt, Molluscum contagiosum virus
ugaccgacggcgacg

SEQ ID NO: 3104264 - RNA, 18 nt, Molluscum contagiosum virus
ugaccggagcggcggacg

SEQ ID NO: 3104265 - RNA, 14 nt, Molluscum contagiosum virus
ugacgccgcgcgcg

SEQ ID NO: 3104266 - RNA, 12 nt, Molluscum contagiosum virus
ugacgcgcacgc

SEQ ID NO: 3104267 - RNA, 19 nt, Molluscum contagiosum virus
ugacgcguacauccgcgag

SEQ ID NO: 3104268 - RNA, 13 nt, Molluscum contagiosum virus
ugacggagccgcg

SEQ ID NO: 3104269 - RNA, 14 nt, Molluscum contagiosum virus
ugacgaagcugcgc

SEQ ID NO: 3104270 - RNA, 18 nt, Molluscum contagiosum virus
ugacgaagcugcgcuugc

SEQ ID NO: 3104271 - RNA, 17 nt, Molluscum contagiosum virus
ucacggagcgcgcgcag

SEQ ID NO: 3104272 - RNA, 16 nt, Molluscum contagiosum virus
ucacggccuucgcgcu

SEQ ID NO: 3104273 - RNA, 18 nt, Molluscum contagiosum virus
ucacgucaauggcgcgcg

SEQ ID NO: 3104274 - RNA, 20 nt, Molluscum contagiosum virus
ucacgucaauggcgcgcgag

SEQ ID NO: 3104275 - RNA, 22 nt, Molluscum contagiosum virus
ucacgugcugaucacgcucgcg

SEQ ID NO: 3104276 - RNA, 13 nt, Molluscum contagiosum virus
ucacucgcucgcg

SEQ ID NO: 3104277 - RNA, 15 nt, Molluscum contagiosum virus
ucacgcucgcgacgu

SEQ ID NO: 3104278 - RNA, 23 nt, Molluscum contagiosum virus
ucacgcugcccgcgccgcccgug

SEQ ID NO: 3104279 - RNA, 15 nt, Molluscum contagiosum virus
ucacgcugcgcucgg

SEQ ID NO: 3104280 - RNA, 19 nt, Molluscum contagiosum virus
ucacgcgcuaccgcaagcu

SEQ ID NO: 3104281 - RNA, 16 nt, Molluscum contagiosum virus
ucacgcgcuucgugga

SEQ ID NO: 3104282 - RNA, 18 nt, Molluscum contagiosum virus
ucacgaugugcgcgcgac

SEQ ID NO: 3104283 - RNA, 16 nt, Molluscum contagiosum virus
ucagcacacgucggag

SEQ ID NO: 3104284 - RNA, 13 nt, Molluscum contagiosum virus
ucagcagcgcgag

SEQ ID NO: 3104285 - RNA, 15 nt, Molluscum contagiosum virus
ucagccccgcgccag

SEQ ID NO: 3104286 - RNA, 18 nt, Molluscum contagiosum virus
ucagccccgggcccgcau

SEQ ID NO: 3104287 - RNA, 13 nt, Molluscum contagiosum virus
ucagccgagcgcc

SEQ ID NO: 3104288 - RNA, 19 nt, Molluscum contagiosum virus
ucagccgagcgccgccagc

SEQ ID NO: 3104289 - RNA, 13 nt, Molluscum contagiosum virus
ucagaacgacacc

SEQ ID NO: 3104290 - RNA, 22 nt, Molluscum contagiosum virus
ucacuucucggaagcgcccgug

SEQ ID NO: 3104291 - RNA, 12 nt, Molluscum contagiosum virus
ucacuuucgcgc

SEQ ID NO: 3104292 - RNA, 13 nt, Molluscum contagiosum virus
ucacuuucgcgcg

SEQ ID NO: 3104293 - RNA, 15 nt, Molluscum contagiosum virus
ucacuuucgcgcgca

SEQ ID NO: 3104294 - RNA, 16 nt, Molluscum contagiosum virus
ucacuuucgcgcgcac

SEQ ID NO: 3104295 - RNA, 14 nt, Molluscum contagiosum virus
ucagcgucgacggc

SEQ ID NO: 3104296 - RNA, 14 nt, Molluscum contagiosum virus
ucagcuucauggag

SEQ ID NO: 3104297 - RNA, 20 nt, Molluscum contagiosum virus
ucaggacaaagucgcgcgcg

SEQ ID NO: 3104298 - RNA, 23 nt, Molluscum contagiosum virus
ucaggacgcaggacgcggucgcg

SEQ ID NO: 3104299 - RNA, 19 nt, Molluscum contagiosum virus
ucaggcaaaagccgccgcg

SEQ ID NO: 3104300 - RNA, 23 nt, Molluscum contagiosum virus
ucaggcaaaagccgccgcgcgcg

SEQ ID NO: 3104301 - RNA, 12 nt, Molluscum contagiosum virus
ucagcgcgcgca

SEQ ID NO: 3104302 - RNA, 13 nt, Molluscum contagiosum virus
ucagcgcgcgcag

SEQ ID NO: 3104303 - RNA, 19 nt, Molluscum contagiosum virus
ucagcggcacugcgcgcau

SEQ ID NO: 3104304 - RNA, 13 nt, Molluscum contagiosum virus
ucagcggcggucu

SEQ ID NO: 3104305 - RNA, 17 nt, Molluscum contagiosum virus
ucagccucugugcggcg

SEQ ID NO: 3104306 - RNA, 14 nt, Molluscum contagiosum virus
ugacaggcgcgcaa

SEQ ID NO: 3104307 - RNA, 20 nt, Molluscum contagiosum virus
ugacagucagcggcgugcug

SEQ ID NO: 3104308 - RNA, 12 nt, Molluscum contagiosum virus
ugaaggcgcggc

SEQ ID NO: 3104309 - RNA, 15 nt, Molluscum contagiosum virus
ugacacgcgugucug

SEQ ID NO: 3104310 - RNA, 17 nt, Molluscum contagiosum virus
ugaaccugggcgcgcac

SEQ ID NO: 3104311 - RNA, 12 nt, Molluscum contagiosum virus
ugaacgcgcugc

SEQ ID NO: 3104312 - RNA, 14 nt, Molluscum contagiosum virus
ugaacucgcugcug

SEQ ID NO: 3104313 - RNA, 13 nt, Molluscum contagiosum virus
ugccggcgcguga

SEQ ID NO: 3104314 - RNA, 22 nt, Molluscum contagiosum virus
ugccgggcuugcucccucgcgc

SEQ ID NO: 3104315 - RNA, 19 nt, Molluscum contagiosum virus
ugccggggaugaacgcgcu

SEQ ID NO: 3104316 - RNA, 23 nt, Molluscum contagiosum virus
ugccggggaugaacgcgcugcgc

SEQ ID NO: 3104317 - RNA, 15 nt, Molluscum contagiosum virus
ugcgugcgcugcgcg

SEQ ID NO: 3104318 - RNA, 21 nt, Molluscum contagiosum virus
ugcgugguguccacgcgcgug

SEQ ID NO: 3104319 - RNA, 21 nt, Molluscum contagiosum virus
ugcguguuggcuucugcgcgg

SEQ ID NO: 3104320 - RNA, 21 nt, Molluscum contagiosum virus
ugccggcaacgcugccgcugg

SEQ ID NO: 3104321 - RNA, 19 nt, Molluscum contagiosum virus
ugccggcgcaaucucgcgg

SEQ ID NO: 3104322 - RNA, 12 nt, Molluscum contagiosum virus
ugccgcgugcuc

SEQ ID NO: 3104323 - RNA, 14 nt, Molluscum contagiosum virus
ugccgcugcgcugg

SEQ ID NO: 3104324 - RNA, 24 nt, Molluscum contagiosum virus
ugccggaaauagcgcgcuagcucc

SEQ ID NO: 3104325 - RNA, 19 nt, Molluscum contagiosum virus
ugccgccgccgcgaggacc

SEQ ID NO: 3104326 - RNA, 14 nt, Molluscum contagiosum virus
ugccgccucggacg

SEQ ID NO: 3104327 - RNA, 18 nt, Molluscum contagiosum virus
ugccgcgcgcuacgcgcc

SEQ ID NO: 3104328 - RNA, 14 nt, Molluscum contagiosum virus
ugccgcggcacugg

SEQ ID NO: 3104329 - RNA, 13 nt, Molluscum contagiosum virus
ugcccccgaggug

SEQ ID NO: 3104330 - RNA, 18 nt, Molluscum contagiosum virus
ugcccccgagguggccaa

SEQ ID NO: 3104331 - RNA, 13 nt, Molluscum contagiosum virus
ugccccgcgcgcc

SEQ ID NO: 3104332 - RNA, 16 nt, Molluscum contagiosum virus
ugcccgcgcgcggaca

SEQ ID NO: 3104333 - RNA, 14 nt, Molluscum contagiosum virus
ugcccgcgcgcugu

SEQ ID NO: 3104334 - RNA, 22 nt, Molluscum contagiosum virus
ugcccgcuccgcucgcgcgugc

SEQ ID NO: 3104335 - RNA, 14 nt, Molluscum contagiosum virus
ugcccggcagcgag

SEQ ID NO: 3104336 - RNA, 18 nt, Molluscum contagiosum virus
ugcccgguacgcucgcgc

SEQ ID NO: 3104337 - RNA, 14 nt, Molluscum contagiosum virus
ugccgagcgcacgc

SEQ ID NO: 3104338 - RNA, 22 nt, Molluscum contagiosum virus
ugccgagcucugucccgcaagc

SEQ ID NO: 3104339 - RNA, 14 nt, Molluscum contagiosum virus
ugccgaggcgcugc

SEQ ID NO: 3104340 - RNA, 19 nt, Molluscum contagiosum virus
ugccgaggcgcugccgcgg

SEQ ID NO: 3104341 - RNA, 20 nt, Molluscum contagiosum virus
ugcugcccgccuucgacggc

SEQ ID NO: 3104342 - RNA, 18 nt, Molluscum contagiosum virus
ugcugccgcgcggcacgc

SEQ ID NO: 3104343 - RNA, 20 nt, Molluscum contagiosum virus
ugcugccgggagaggaaagg

SEQ ID NO: 3104344 - RNA, 20 nt, Molluscum contagiosum virus
ugcugccucccaagcagcgc

SEQ ID NO: 3104345 - RNA, 14 nt, Molluscum contagiosum virus
ugcugcgcagcauc

SEQ ID NO: 3104346 - RNA, 13 nt, Molluscum contagiosum virus
ugcugcgccacgu

SEQ ID NO: 3104347 - RNA, 19 nt, Molluscum contagiosum virus
ugcugcgccacgugcgcau

SEQ ID NO: 3104348 - RNA, 11 nt, Molluscum contagiosum virus
ugcugcgcgac

SEQ ID NO: 3104349 - RNA, 13 nt, Molluscum contagiosum virus
ugcugcgcgccgc

SEQ ID NO: 3104350 - RNA, 15 nt, Molluscum contagiosum virus
ugcugcgcgcgccau

SEQ ID NO: 3104351 - RNA, 13 nt, Molluscum contagiosum virus
ugcugcgcgcgcu

SEQ ID NO: 3104352 - RNA, 15 nt, Molluscum contagiosum virus
ugcugcgcggcgccg

SEQ ID NO: 3104353 - RNA, 22 nt, Molluscum contagiosum virus
ugcugcgcuucgccgcgcgcgc

SEQ ID NO: 3104354 - RNA, 19 nt, Molluscum contagiosum virus
ugcugcggcaaccgcgccc

SEQ ID NO: 3104355 - RNA, 15 nt, Molluscum contagiosum virus
ugcugcggcugcugg

SEQ ID NO: 3104356 - RNA, 17 nt, Molluscum contagiosum virus
ugcugcgugcgcgcgau

SEQ ID NO: 3104357 - RNA, 23 nt, Molluscum contagiosum virus
ugcugcucaaggacuaccagcuc

SEQ ID NO: 3104358 - RNA, 14 nt, Molluscum contagiosum virus
ugcugcucgacggg

SEQ ID NO: 3104359 - RNA, 18 nt, Molluscum contagiosum virus
ugcugcucgcacccgcgc

SEQ ID NO: 3104360 - RNA, 15 nt, Molluscum contagiosum virus
ugcugcugcgcgcgc

SEQ ID NO: 3104361 - RNA, 22 nt, Molluscum contagiosum virus
ugcugcuuguugugggcucgcg

SEQ ID NO: 3104362 - RNA, 15 nt, Molluscum contagiosum virus
ugcuggacacucgcg

SEQ ID NO: 3104363 - RNA, 15 nt, Molluscum contagiosum virus
ugcuggacgcgcacg

SEQ ID NO: 3104364 - RNA, 16 nt, Molluscum contagiosum virus
ugcuggacgcgcacgc

SEQ ID NO: 3104365 - RNA, 15 nt, Molluscum contagiosum virus
ugcuggacgggcacg

SEQ ID NO: 3104366 - RNA, 14 nt, Molluscum contagiosum virus
ugcuggagcggcau

SEQ ID NO: 3104367 - RNA, 14 nt, Molluscum contagiosum virus
ugcuggagggcacg

SEQ ID NO: 3104368 - RNA, 15 nt, Molluscum contagiosum virus
ugcuggagggcacgc

SEQ ID NO: 3104369 - RNA, 19 nt, Molluscum contagiosum virus
ugcuggcaccgcgcgcgcu

SEQ ID NO: 3104370 - RNA, 22 nt, Molluscum contagiosum virus
ugcuggcgaaaccugggcgccg

SEQ ID NO: 3104371 - RNA, 19 nt, Molluscum contagiosum virus
ugcuggcgagcacguccuc

SEQ ID NO: 3104372 - RNA, 12 nt, Molluscum contagiosum virus
ugcuggcgcgcu

SEQ ID NO: 3104373 - RNA, 19 nt, Molluscum contagiosum virus
ugcuggcgcucgcgcgcac

SEQ ID NO: 3104374 - RNA, 22 nt, Molluscum contagiosum virus
ugcuggcgcucgcgcgcacgcg

SEQ ID NO: 3104375 - RNA, 15 nt, Molluscum contagiosum virus
ugcuggcggggcugg

SEQ ID NO: 3104376 - RNA, 12 nt, Molluscum contagiosum virus
ugcugggcgugg

SEQ ID NO: 3104377 - RNA, 20 nt, Molluscum contagiosum virus
ugcuggucaagaaggcgcug

SEQ ID NO: 3104378 - RNA, 15 nt, Molluscum contagiosum virus
ugcugguggugcugg

SEQ ID NO: 3104379 - RNA, 15 nt, Molluscum contagiosum virus
ugcugugccugcgca

SEQ ID NO: 3104380 - RNA, 19 nt, Molluscum contagiosum virus
ugcuguugccgcgcucgug

SEQ ID NO: 3104381 - RNA, 11 nt, Molluscum contagiosum virus
uggaccugauu

SEQ ID NO: 3104382 - RNA, 11 nt, Molluscum contagiosum virus
uggacgcgcaa

SEQ ID NO: 3104383 - RNA, 11 nt, Molluscum contagiosum virus
uggacgcgcac

SEQ ID NO: 3104384 - RNA, 14 nt, Molluscum contagiosum virus
uggacgcgcacgcg

SEQ ID NO: 3104385 - RNA, 17 nt, Molluscum contagiosum virus
uggacgcgccgcgcgag

SEQ ID NO: 3104386 - RNA, 20 nt, Molluscum contagiosum virus
uggacgcgccgcgcgagugc

SEQ ID NO: 3104387 - RNA, 19 nt, Molluscum contagiosum virus
uggacgaugguggcgcugc

SEQ ID NO: 3104388 - RNA, 21 nt, Molluscum contagiosum virus
uggacgaugguggcgcugcug

SEQ ID NO: 3104389 - RNA, 21 nt, Molluscum contagiosum virus
uggacgcacagggcugcgugg

SEQ ID NO: 3104390 - RNA, 19 nt, Molluscum contagiosum virus
uggacgacaugcugugcgg

SEQ ID NO: 3104391 - RNA, 14 nt, Molluscum contagiosum virus
uggacgagcagagc

SEQ ID NO: 3104392 - RNA, 20 nt, Molluscum contagiosum virus
uggacgagcgcuaccugaug

SEQ ID NO: 3104393 - RNA, 20 nt, Molluscum contagiosum virus
uggacacgcacuggcgcugc

SEQ ID NO: 3104394 - RNA, 16 nt, Molluscum contagiosum virus
uggacacgcugcgcgu

SEQ ID NO: 3104395 - RNA, 20 nt, Molluscum contagiosum virus
uggacacgcugcgcgugcug

SEQ ID NO: 3104396 - RNA, 17 nt, Molluscum contagiosum virus
uggacacgugcguggug

SEQ ID NO: 3104397 - RNA, 17 nt, Molluscum contagiosum virus
uggacagcaagcagcgc

SEQ ID NO: 3104398 - RNA, 21 nt, Molluscum contagiosum virus
uggacagcaagcagcgcgcgc

SEQ ID NO: 3104399 - RNA, 23 nt, Molluscum contagiosum virus
uggacagccugcaccgagugcug

SEQ ID NO: 3104400 - RNA, 18 nt, Molluscum contagiosum virus
uggaacaggugcgcaagc

SEQ ID NO: 3104401 - RNA, 13 nt, Molluscum contagiosum virus
uggaaaggaggcu

SEQ ID NO: 3104402 - RNA, 22 nt, Molluscum contagiosum virus
ugcguuggcgccagccuggcgg

SEQ ID NO: 3104403 - RNA, 14 nt, Molluscum contagiosum virus
ugcuacaggacguc

SEQ ID NO: 3104404 - RNA, 20 nt, Molluscum contagiosum virus
ugcuacgucgcggcgcacgg

SEQ ID NO: 3104405 - RNA, 21 nt, Molluscum contagiosum virus
ugcuagcccgcaccugcgccg

SEQ ID NO: 3104406 - RNA, 17 nt, Molluscum contagiosum virus
ugcuagcgacgcggaca

SEQ ID NO: 3104407 - RNA, 23 nt, Molluscum contagiosum virus
ugcucgagauucguggcgagcau

SEQ ID NO: 3104408 - RNA, 16 nt, Molluscum contagiosum virus
ugcucgcaggcggugg

SEQ ID NO: 3104409 - RNA, 16 nt, Molluscum contagiosum virus
ugcucugugcgcgcag

SEQ ID NO: 3104410 - RNA, 14 nt, Molluscum contagiosum virus
ugcucuuccaggag

SEQ ID NO: 3104411 - RNA, 15 nt, Molluscum contagiosum virus
ugcugaagacgcugg

SEQ ID NO: 3104412 - RNA, 19 nt, Molluscum contagiosum virus
ugcugcacagcuuccugga

SEQ ID NO: 3104413 - RNA, 15 nt, Molluscum contagiosum virus
ugcugcagcugcgcg

SEQ ID NO: 3104414 - RNA, 13 nt, Molluscum contagiosum virus
ugcugcaggcgua

SEQ ID NO: 3104415 - RNA, 22 nt, Molluscum contagiosum virus
ugcugcaguaugaaucuacggc

SEQ ID NO: 3104416 - RNA, 14 nt, Molluscum contagiosum virus
ugcuucugcgcugg

SEQ ID NO: 3104417 - RNA, 13 nt, Molluscum contagiosum virus
ugcuugcgcacga

SEQ ID NO: 3104418 - RNA, 16 nt, Molluscum contagiosum virus
ugcuugugcgccugug

SEQ ID NO: 3104419 - RNA, 19 nt, Molluscum contagiosum virus
ugcuuuuucugugcgccuu

SEQ ID NO: 3104420 - RNA, 14 nt, Molluscum contagiosum virus
ugcucgcgcucgcg

SEQ ID NO: 3104421 - RNA, 20 nt, Molluscum contagiosum virus
ugcucgcggagggcagcauc

SEQ ID NO: 3104422 - RNA, 17 nt, Molluscum contagiosum virus
ugcucgcgugcgugcug

SEQ ID NO: 3104423 - RNA, 16 nt, Molluscum contagiosum virus
ugcucggacacacgca

SEQ ID NO: 3104424 - RNA, 17 nt, Molluscum contagiosum virus
ugcucggacacacgcac

SEQ ID NO: 3104425 - RNA, 21 nt, Molluscum contagiosum virus
ugcucgguagcguggagcugg

SEQ ID NO: 3104426 - RNA, 18 nt, Molluscum contagiosum virus
ugcucuaccuggugcugg

SEQ ID NO: 3104427 - RNA, 22 nt, Molluscum contagiosum virus
ugcucuacuggcggcgcccgug

SEQ ID NO: 3104428 - RNA, 20 nt, Molluscum contagiosum virus
ugcucucgcugcugcccaua

SEQ ID NO: 3104429 - RNA, 15 nt, Molluscum contagiosum virus
ugcucaugcgcaagc

SEQ ID NO: 3104430 - RNA, 15 nt, Molluscum contagiosum virus
ugcuccacgcgcagc

SEQ ID NO: 3104431 - RNA, 17 nt, Molluscum contagiosum virus
ugcucccgaggcgcgcu

SEQ ID NO: 3104432 - RNA, 17 nt, Molluscum contagiosum virus
ugcucccucgcgcgcag

SEQ ID NO: 3104433 - RNA, 13 nt, Molluscum contagiosum virus
ugcucccucucga

SEQ ID NO: 3104434 - RNA, 12 nt, Molluscum contagiosum virus
ugcuccgaggag

SEQ ID NO: 3104435 - RNA, 15 nt, Molluscum contagiosum virus
ugcuccgaggaggca

SEQ ID NO: 3104436 - RNA, 19 nt, Molluscum contagiosum virus
gugcgcagcauucccggcg

SEQ ID NO: 3104437 - RNA, 16 nt, Molluscum contagiosum virus
gugcgagaucgacugc

SEQ ID NO: 3104438 - RNA, 13 nt, Molluscum contagiosum virus
gugcgagcacgag

SEQ ID NO: 3104439 - RNA, 21 nt, Molluscum contagiosum virus
gugcgcacagacggcgcgcuc

SEQ ID NO: 3104440 - RNA, 16 nt, Molluscum contagiosum virus
gugcgcacaugccgag

SEQ ID NO: 3104441 - RNA, 12 nt, Molluscum contagiosum virus
gugcgcaccauc

SEQ ID NO: 3104442 - RNA, 20 nt, Molluscum contagiosum virus
gugccuccgcggacgcgccc

SEQ ID NO: 3104443 - RNA, 17 nt, Molluscum contagiosum virus
gugcgaccugcugcgag

SEQ ID NO: 3104444 - RNA, 16 nt, Molluscum contagiosum virus
gugccguucacgcaca

SEQ ID NO: 3104445 - RNA, 15 nt, Molluscum contagiosum virus
guccgcgggcgcacg

SEQ ID NO: 3104446 - RNA, 19 nt, Molluscum contagiosum virus
guccgcgggcgcgcgccag

SEQ ID NO: 3104447 - RNA, 19 nt, Molluscum contagiosum virus
gugcgcgacggcgagcucu

SEQ ID NO: 3104448 - RNA, 14 nt, Molluscum contagiosum virus
gugcgcgacgggcu

SEQ ID NO: 3104449 - RNA, 15 nt, Molluscum contagiosum virus
gugcgcgagcugagg

SEQ ID NO: 3104450 - RNA, 13 nt, Molluscum contagiosum virus
gugcgccgcgccc

SEQ ID NO: 3104451 - RNA, 15 nt, Molluscum contagiosum virus
gugcgccgcgcccgc

SEQ ID NO: 3104452 - RNA, 21 nt, Molluscum contagiosum virus
gugcgccucggacuucgacgc

SEQ ID NO: 3104453 - RNA, 14 nt, Molluscum contagiosum virus
gugcgcgcugcacg

SEQ ID NO: 3104454 - RNA, 22 nt, Molluscum contagiosum virus
gugcgcgcugcacgccgccagc

SEQ ID NO: 3104455 - RNA, 13 nt, Molluscum contagiosum virus
gugcgcgcugcgc

SEQ ID NO: 3104456 - RNA, 18 nt, Molluscum contagiosum virus
gugcgcgcugcgcgcgcu

SEQ ID NO: 3104457 - RNA, 19 nt, Molluscum contagiosum virus
gugcgcgcugcgcgcgcuc

SEQ ID NO: 3104458 - RNA, 15 nt, Molluscum contagiosum virus
gugcgccaguccgcg

SEQ ID NO: 3104459 - RNA, 22 nt, Molluscum contagiosum virus
gugcgcgguggugcugggcgug

SEQ ID NO: 3104460 - RNA, 17 nt, Molluscum contagiosum virus
gugcgcgugacacaccg

SEQ ID NO: 3104461 - RNA, 16 nt, Molluscum contagiosum virus
gugcgcgugcgccugc

SEQ ID NO: 3104462 - RNA, 14 nt, Molluscum contagiosum virus
gugcgcuacguggc

SEQ ID NO: 3104463 - RNA, 21 nt, Molluscum contagiosum virus
gugcgcucgcuagaggacgcc

SEQ ID NO: 3104464 - RNA, 17 nt, Molluscum contagiosum virus
gugcgcuggcgcgcgcg

SEQ ID NO: 3104465 - RNA, 12 nt, Molluscum contagiosum virus
gugcggagagcc

SEQ ID NO: 3104466 - RNA, 19 nt, Molluscum contagiosum virus
gugcggccaccagcgcggc

SEQ ID NO: 3104467 - RNA, 18 nt, Molluscum contagiosum virus
ggucgccuacgaggugcg

SEQ ID NO: 3104468 - RNA, 19 nt, Molluscum contagiosum virus
ggucgccuacgaggugcgc

SEQ ID NO: 3104469 - RNA, 20 nt, Molluscum contagiosum virus
ggucgagcgcgccgcgcgcu

SEQ ID NO: 3104470 - RNA, 21 nt, Molluscum contagiosum virus
ggucgagcgcgccgcgcgcuc

SEQ ID NO: 3104471 - RNA, 17 nt, Molluscum contagiosum virus
ggucgaguucacggcga

SEQ ID NO: 3104472 - RNA, 18 nt, Molluscum contagiosum virus
ggcacaugcagcugcagg

SEQ ID NO: 3104473 - RNA, 17 nt, Molluscum contagiosum virus
ggcacauggacggcgcc

SEQ ID NO: 3104474 - RNA, 20 nt, Molluscum contagiosum virus
ggucgacgacgcgcgcacgu

SEQ ID NO: 3104475 - RNA, 15 nt, Molluscum contagiosum virus
ggucgacgagugcgc

SEQ ID NO: 3104476 - RNA, 20 nt, Molluscum contagiosum virus
ggugccgccgugggcgccgc

SEQ ID NO: 3104477 - RNA, 12 nt, Molluscum contagiosum virus
ggugccgcgcgc

SEQ ID NO: 3104478 - RNA, 19 nt, Molluscum contagiosum virus
ggugccguccccgcgcuca

SEQ ID NO: 3104479 - RNA, 20 nt, Molluscum contagiosum virus
ggugccuggcguccgcacgc

SEQ ID NO: 3104480 - RNA, 21 nt, Molluscum contagiosum virus
ggugccuggcguccgcacgca

SEQ ID NO: 3104481 - RNA, 15 nt, Molluscum contagiosum virus
ggugcgcccgcggca

SEQ ID NO: 3104482 - RNA, 17 nt, Molluscum contagiosum virus
ggugcgcgacgggcucu

SEQ ID NO: 3104483 - RNA, 13 nt, Molluscum contagiosum virus
ggugcgcgcgcgc

SEQ ID NO: 3104484 - RNA, 14 nt, Molluscum contagiosum virus
ggugcgcgcgcgcg

SEQ ID NO: 3104485 - RNA, 17 nt, Molluscum contagiosum virus
gguggcaggcgcgcgcg

SEQ ID NO: 3104486 - RNA, 14 nt, Molluscum contagiosum virus
gguggccaagcgcu

SEQ ID NO: 3104487 - RNA, 14 nt, Molluscum contagiosum virus
gguggccgcgcgcg

SEQ ID NO: 3104488 - RNA, 14 nt, Molluscum contagiosum virus
ggugcugcgcacgg

SEQ ID NO: 3104489 - RNA, 20 nt, Molluscum contagiosum virus
ggugcugcgccacgugcgca

SEQ ID NO: 3104490 - RNA, 12 nt, Molluscum contagiosum virus
ggugcuggccau

SEQ ID NO: 3104491 - RNA, 21 nt, Molluscum contagiosum virus
gguggaagagcccgcacacgc

SEQ ID NO: 3104492 - RNA, 17 nt, Molluscum contagiosum virus
ggugcacgugcugcagc

SEQ ID NO: 3104493 - RNA, 14 nt, Molluscum contagiosum virus
ggugagugcgcgca

SEQ ID NO: 3104494 - RNA, 16 nt, Molluscum contagiosum virus
gguguucugcgcgccg

SEQ ID NO: 3104495 - RNA, 16 nt, Molluscum contagiosum virus
ggugucgagcucgcgc

SEQ ID NO: 3104496 - RNA, 23 nt, Molluscum contagiosum virus
ggugucgagcucgcgcgccagca

SEQ ID NO: 3104497 - RNA, 17 nt, Molluscum contagiosum virus
gucagccgcacggcgcc

SEQ ID NO: 3104498 - RNA, 18 nt, Molluscum contagiosum virus
gucagccucugugcggcg

SEQ ID NO: 3104499 - RNA, 17 nt, Molluscum contagiosum virus
gucacugcuagugcugg

SEQ ID NO: 3104500 - RNA, 17 nt, Molluscum contagiosum virus
gguucacuagcgcaggc

SEQ ID NO: 3104501 - RNA, 17 nt, Molluscum contagiosum virus
gucagcggcgugcugca

SEQ ID NO: 3104502 - RNA, 20 nt, Molluscum contagiosum virus
guccagccgcaccgggacga

SEQ ID NO: 3104503 - RNA, 16 nt, Molluscum contagiosum virus
gucaucgggcugcagc

SEQ ID NO: 3104504 - RNA, 14 nt, Molluscum contagiosum virus
gucaugcgcgcgcg

SEQ ID NO: 3104505 - RNA, 16 nt, Molluscum contagiosum virus
guccaacccgcggcgc

SEQ ID NO: 3104506 - RNA, 20 nt, Molluscum contagiosum virus
guccaacccgcggcgcgccg

SEQ ID NO: 3104507 - RNA, 17 nt, Molluscum contagiosum virus
guccaccagcacgaagc

SEQ ID NO: 3104508 - RNA, 22 nt, Molluscum contagiosum virus
guccacgugguccaccagcacg

SEQ ID NO: 3104509 - RNA, 19 nt, Molluscum contagiosum virus
guccagcgcguccaugcug

SEQ ID NO: 3104510 - RNA, 16 nt, Molluscum contagiosum virus
guccagcggcugcccg

SEQ ID NO: 3104511 - RNA, 13 nt, Molluscum contagiosum virus
guccaugcccacg

SEQ ID NO: 3104512 - RNA, 19 nt, Molluscum contagiosum virus
gucccagcaccgcgccgcg

SEQ ID NO: 3104513 - RNA, 17 nt, Molluscum contagiosum virus
guccagcuucucgaagg

SEQ ID NO: 3104514 - RNA, 17 nt, Molluscum contagiosum virus
guccaucaaggccuacg

SEQ ID NO: 3104515 - RNA, 16 nt, Molluscum contagiosum virus
gugccgccgugggcgc

SEQ ID NO: 3104516 - RNA, 20 nt, Molluscum contagiosum virus
gugccgccgugggcgccgcg

SEQ ID NO: 3104517 - RNA, 16 nt, Molluscum contagiosum virus
gugccgcucgcugucc

SEQ ID NO: 3104518 - RNA, 18 nt, Molluscum contagiosum virus
gugccgcucggaggcuug

SEQ ID NO: 3104519 - RNA, 16 nt, Molluscum contagiosum virus
gugccguccccgcgcu

SEQ ID NO: 3104520 - RNA, 16 nt, Molluscum contagiosum virus
gugcccuacgcgcgcg

SEQ ID NO: 3104521 - RNA, 15 nt, Molluscum contagiosum virus
gugccgacgugugcc

SEQ ID NO: 3104522 - RNA, 17 nt, Molluscum contagiosum virus
gugccgacgugugccgc

SEQ ID NO: 3104523 - RNA, 18 nt, Molluscum contagiosum virus
gugccugcaagaggcgcu

SEQ ID NO: 3104524 - RNA, 19 nt, Molluscum contagiosum virus
gugccugcaagaggcgcug

SEQ ID NO: 3104525 - RNA, 19 nt, Molluscum contagiosum virus
gugccugccaucuacgagc

SEQ ID NO: 3104526 - RNA, 15 nt, Molluscum contagiosum virus
gugccuggcuugcgc

SEQ ID NO: 3104527 - RNA, 20 nt, Molluscum contagiosum virus
gugccuggcuugcgcgcgcc

SEQ ID NO: 3104528 - RNA, 17 nt, Molluscum contagiosum virus
gugccugucucgcaagc

SEQ ID NO: 3104529 - RNA, 18 nt, Molluscum contagiosum virus
gugccugucucgcaagca

SEQ ID NO: 3104530 - RNA, 18 nt, Molluscum contagiosum virus
gugccuguggcgcacacg

SEQ ID NO: 3104531 - RNA, 21 nt, Molluscum contagiosum virus
gugcgaacacggauacgcgca

SEQ ID NO: 3104532 - RNA, 12 nt, Molluscum contagiosum virus
gugcgaagggcu

SEQ ID NO: 3104533 - RNA, 19 nt, Molluscum contagiosum virus
guccgacaccagcggcagg

SEQ ID NO: 3104534 - RNA, 21 nt, Molluscum contagiosum virus
guccgacaccggacgaaaggu

SEQ ID NO: 3104535 - RNA, 13 nt, Molluscum contagiosum virus
guccgcacgcaca

SEQ ID NO: 3104536 - RNA, 18 nt, Molluscum contagiosum virus
guccgcagcggcgccacc

SEQ ID NO: 3104537 - RNA, 21 nt, Molluscum contagiosum virus
guccgcaggcgucaugcgcgc

SEQ ID NO: 3104538 - RNA, 17 nt, Molluscum contagiosum virus
ggcaaccgcgacgagca

SEQ ID NO: 3104539 - RNA, 19 nt, Molluscum contagiosum virus
ggcaaccgcgacgagcaga

SEQ ID NO: 3104540 - RNA, 20 nt, Molluscum contagiosum virus
ggcaaccgcgcccgcgcgcu

SEQ ID NO: 3104541 - RNA, 14 nt, Molluscum contagiosum virus
ggcaagccgagcca

SEQ ID NO: 3104542 - RNA, 17 nt, Molluscum contagiosum virus
ggcaagcgcgcucgggc

SEQ ID NO: 3104543 - RNA, 20 nt, Molluscum contagiosum virus
ggcaagcucccgcugcgcuu

SEQ ID NO: 3104544 - RNA, 19 nt, Molluscum contagiosum virus
ggcaaggcguaagagcgug

SEQ ID NO: 3104545 - RNA, 15 nt, Molluscum contagiosum virus
ggcaaucgcgugcuu

SEQ ID NO: 3104546 - RNA, 18 nt, Molluscum contagiosum virus
ggcaaugccgaugcuagc

SEQ ID NO: 3104547 - RNA, 22 nt, Molluscum contagiosum virus
ggcaauguuugcggaugcucgc

SEQ ID NO: 3104548 - RNA, 20 nt, Molluscum contagiosum virus
ggcacacacuugcacgcgca

SEQ ID NO: 3104549 - RNA, 13 nt, Molluscum contagiosum virus
ggaugccugucuu

SEQ ID NO: 3104550 - RNA, 22 nt, Molluscum contagiosum virus
ggcaaagccugcugcgcgcgcc

SEQ ID NO: 3104551 - RNA, 20 nt, Molluscum contagiosum virus
ggcaaagcggggcgcgcgcc

SEQ ID NO: 3104552 - RNA, 22 nt, Molluscum contagiosum virus
ggauaccaugcucucgcugcug

SEQ ID NO: 3104553 - RNA, 12 nt, Molluscum contagiosum virus
ggauacgcgcac

SEQ ID NO: 3104554 - RNA, 16 nt, Molluscum contagiosum virus
ggagucacgaccgacc

SEQ ID NO: 3104555 - RNA, 17 nt, Molluscum contagiosum virus
ggaguccaugcccacgc

SEQ ID NO: 3104556 - RNA, 22 nt, Molluscum contagiosum virus
ggaggucugcuuugucugcagg

SEQ ID NO: 3104557 - RNA, 20 nt, Molluscum contagiosum virus
ggaucacgaugugcgcgcga

SEQ ID NO: 3104558 - RNA, 13 nt, Molluscum contagiosum virus
ggaucacggcucu

SEQ ID NO: 3104559 - RNA, 17 nt, Molluscum contagiosum virus
ggaucagccccgcgcca

SEQ ID NO: 3104560 - RNA, 15 nt, Molluscum contagiosum virus
ggaugaacgcgcugc

SEQ ID NO: 3104561 - RNA, 14 nt, Molluscum contagiosum virus
ggagggucacgcgc

SEQ ID NO: 3104562 - RNA, 19 nt, Molluscum contagiosum virus
ggagguaguaguacggcac

SEQ ID NO: 3104563 - RNA, 14 nt, Molluscum contagiosum virus
ggaggacacgcgca

SEQ ID NO: 3104564 - RNA, 17 nt, Molluscum contagiosum virus
ggaggaccgcgagcgca

SEQ ID NO: 3104565 - RNA, 20 nt, Molluscum contagiosum virus
ggaggaccgcgagcgcaugc

SEQ ID NO: 3104566 - RNA, 20 nt, Molluscum contagiosum virus
ggaggaucgcuacgugcgca

SEQ ID NO: 3104567 - RNA, 19 nt, Molluscum contagiosum virus
ggaggccgucuucgccggc

SEQ ID NO: 3104568 - RNA, 16 nt, Molluscum contagiosum virus
ggaggcggcacugcua

SEQ ID NO: 3104569 - RNA, 20 nt, Molluscum contagiosum virus
ggaggcggcacugcuagcga

SEQ ID NO: 3104570 - RNA, 16 nt, Molluscum contagiosum virus
ggaggcguccugcggg

SEQ ID NO: 3104571 - RNA, 15 nt, Molluscum contagiosum virus
ggaggcucgagcgcg

SEQ ID NO: 3104572 - RNA, 15 nt, Molluscum contagiosum virus
gcuuggccggaacgc

SEQ ID NO: 3104573 - RNA, 14 nt, Molluscum contagiosum virus
ggagcugcggacgc

SEQ ID NO: 3104574 - RNA, 16 nt, Molluscum contagiosum virus
gcuucuuugcgcgcau

SEQ ID NO: 3104575 - RNA, 19 nt, Molluscum contagiosum virus
gcuugccgugccuagcguu

SEQ ID NO: 3104576 - RNA, 14 nt, Molluscum contagiosum virus
gcuugcggcacgca

SEQ ID NO: 3104577 - RNA, 19 nt, Molluscum contagiosum virus
gcuugcucccucgcgcgca

SEQ ID NO: 3104578 - RNA, 22 nt, Molluscum contagiosum virus
gcuugcucuucgaccucugcuu

SEQ ID NO: 3104579 - RNA, 13 nt, Molluscum contagiosum virus
gcuuccggcacca

SEQ ID NO: 3104580 - RNA, 23 nt, Molluscum contagiosum virus
gcuuccggcaccacgugcgcugg

SEQ ID NO: 3104581 - RNA, 14 nt, Molluscum contagiosum virus
gcuuccggugccgg

SEQ ID NO: 3104582 - RNA, 14 nt, Molluscum contagiosum virus
gcuuccuuuucucc

SEQ ID NO: 3104583 - RNA, 14 nt, Molluscum contagiosum virus
gcuucgccgcgcgc

SEQ ID NO: 3104584 - RNA, 21 nt, Molluscum contagiosum virus
gcuucucgaacuccaggcgca

SEQ ID NO: 3104585 - RNA, 20 nt, Molluscum contagiosum virus
gcuucuggcaaacgcacugu

SEQ ID NO: 3104586 - RNA, 19 nt, Molluscum contagiosum virus
gcuucggcggcugugcccg

SEQ ID NO: 3104587 - RNA, 13 nt, Molluscum contagiosum virus
gcuucgggcucag

SEQ ID NO: 3104588 - RNA, 23 nt, Molluscum contagiosum virus
gcuuagaccuuuacgucgcgcgc

SEQ ID NO: 3104589 - RNA, 17 nt, Molluscum contagiosum virus
gcuuagcacacgcgcgc

SEQ ID NO: 3104590 - RNA, 16 nt, Molluscum contagiosum virus
gcuucauccgcgcgcu

SEQ ID NO: 3104591 - RNA, 15 nt, Molluscum contagiosum virus
gcuucccgaguacua

SEQ ID NO: 3104592 - RNA, 14 nt, Molluscum contagiosum virus
gcuguucgcggcgc

SEQ ID NO: 3104593 - RNA, 18 nt, Molluscum contagiosum virus
gcuguugcugcugccgcg

SEQ ID NO: 3104594 - RNA, 14 nt, Molluscum contagiosum virus
gcugggcguggcgc

SEQ ID NO: 3104595 - RNA, 18 nt, Molluscum contagiosum virus
gcugugagcgcgccgcuc

SEQ ID NO: 3104596 - RNA, 22 nt, Molluscum contagiosum virus
gcugugccuaggaggagaacuc

SEQ ID NO: 3104597 - RNA, 20 nt, Molluscum contagiosum virus
gcuguucaacaucguggcgc

SEQ ID NO: 3104598 - RNA, 21 nt, Molluscum contagiosum virus
gcuggcgugcgcagugcugcg

SEQ ID NO: 3104599 - RNA, 15 nt, Molluscum contagiosum virus
gcuggcggggaaagc

SEQ ID NO: 3104600 - RNA, 16 nt, Molluscum contagiosum virus
gcuggcgggugccgug

SEQ ID NO: 3104601 - RNA, 14 nt, Molluscum contagiosum virus
gcugcccgugcccg

SEQ ID NO: 3104602 - RNA, 20 nt, Molluscum contagiosum virus
gcugcccguggugggccgcg

SEQ ID NO: 3104603 - RNA, 18 nt, Molluscum contagiosum virus
gcuggcgcacuggggcga

SEQ ID NO: 3104604 - RNA, 15 nt, Molluscum contagiosum virus
gcuggcgcccgcgga

SEQ ID NO: 3104605 - RNA, 14 nt, Molluscum contagiosum virus
gcugcccgcgcgcg

SEQ ID NO: 3104606 - RNA, 15 nt, Molluscum contagiosum virus
gcugccagcucgaca

SEQ ID NO: 3104607 - RNA, 14 nt, Molluscum contagiosum virus
gcugcccccgccgc

SEQ ID NO: 3104608 - RNA, 15 nt, Molluscum contagiosum virus
gcuggcgcgcgcgca

SEQ ID NO: 3104609 - RNA, 16 nt, Molluscum contagiosum virus
gcuggcgcgcgcgcaa

SEQ ID NO: 3104610 - RNA, 23 nt, Molluscum contagiosum virus
gcuggcgcguccguucacgggca

SEQ ID NO: 3104611 - RNA, 17 nt, Molluscum contagiosum virus
gcuggcgcucgcgcgca

SEQ ID NO: 3104612 - RNA, 17 nt, Molluscum contagiosum virus
gcuggcgcucggcgugg

SEQ ID NO: 3104613 - RNA, 20 nt, Molluscum contagiosum virus
gcuggcgcucggcguggugc

SEQ ID NO: 3104614 - RNA, 17 nt, Molluscum contagiosum virus
gcuggcggcgcacgcga

SEQ ID NO: 3104615 - RNA, 19 nt, Molluscum contagiosum virus
gcugcaaagcgcggccgcg

SEQ ID NO: 3104616 - RNA, 22 nt, Molluscum contagiosum virus
gcugcaaagcgcggccgcgcuc

SEQ ID NO: 3104617 - RNA, 23 nt, Molluscum contagiosum virus
gcugcaagccagcccgcugcgca

SEQ ID NO: 3104618 - RNA, 16 nt, Molluscum contagiosum virus
gcugcaaggcgcgcgc

SEQ ID NO: 3104619 - RNA, 19 nt, Molluscum contagiosum virus
gcugcaaggcgcgcgcugg

SEQ ID NO: 3104620 - RNA, 19 nt, Molluscum contagiosum virus
gcugcacacaccgcgagca

SEQ ID NO: 3104621 - RNA, 23 nt, Molluscum contagiosum virus
gcugcacaguucacggcgcucgc

SEQ ID NO: 3104622 - RNA, 13 nt, Molluscum contagiosum virus
gcugcaccggcgc

SEQ ID NO: 3104623 - RNA, 14 nt, Molluscum contagiosum virus
gcugcacgugcagc

SEQ ID NO: 3104624 - RNA, 15 nt, Molluscum contagiosum virus
gcugcacgugcagcg

SEQ ID NO: 3104625 - RNA, 18 nt, Molluscum contagiosum virus
gcugcacgugcagcggcg

SEQ ID NO: 3104626 - RNA, 21 nt, Molluscum contagiosum virus
gcugcacuacaaccauggcgc

SEQ ID NO: 3104627 - RNA, 14 nt, Molluscum contagiosum virus
gcugcagagcgugc

SEQ ID NO: 3104628 - RNA, 22 nt, Molluscum contagiosum virus
gcugaugcuagcgugugccgcc

SEQ ID NO: 3104629 - RNA, 19 nt, Molluscum contagiosum virus
gcugaguuacguggccgcg

SEQ ID NO: 3104630 - RNA, 21 nt, Molluscum contagiosum virus
gcugaucaccgaggagccgcg

SEQ ID NO: 3104631 - RNA, 14 nt, Molluscum contagiosum virus
gcggacguggucgc

SEQ ID NO: 3104632 - RNA, 18 nt, Molluscum contagiosum virus
gcggacguggucgcgcgc

SEQ ID NO: 3104633 - RNA, 15 nt, Molluscum contagiosum virus
gcggagcgcacgaag

SEQ ID NO: 3104634 - RNA, 23 nt, Molluscum contagiosum virus
gcggagcgcuagcagggcggcgc

SEQ ID NO: 3104635 - RNA, 20 nt, Molluscum contagiosum virus
gcggagaaaaggaagcuugc

SEQ ID NO: 3104636 - RNA, 21 nt, Molluscum contagiosum virus
gcggagacuuccuugcgcagg

SEQ ID NO: 3104637 - RNA, 14 nt, Molluscum contagiosum virus
gcggagagcagugc

SEQ ID NO: 3104638 - RNA, 18 nt, Molluscum contagiosum virus
gcggagagcagugccgcu

SEQ ID NO: 3104639 - RNA, 21 nt, Molluscum contagiosum virus
gcggagagcagugccgcucgc

SEQ ID NO: 3104640 - RNA, 16 nt, Molluscum contagiosum virus
gcggagaucgccgcgc

SEQ ID NO: 3104641 - RNA, 17 nt, Molluscum contagiosum virus
gcggagaucgccgcgca

SEQ ID NO: 3104642 - RNA, 20 nt, Molluscum contagiosum virus
gcggagaucgccgcgcaagu

SEQ ID NO: 3104643 - RNA, 15 nt, Molluscum contagiosum virus
gcggccguugccgga

SEQ ID NO: 3104644 - RNA, 19 nt, Molluscum contagiosum virus
gcggccucccucgucgcgc

SEQ ID NO: 3104645 - RNA, 19 nt, Molluscum contagiosum virus
gcggauacuucgcgcgucg

SEQ ID NO: 3104646 - RNA, 23 nt, Molluscum contagiosum virus
gcggccuguucuuccaguggcgc

SEQ ID NO: 3104647 - RNA, 16 nt, Molluscum contagiosum virus
gcggagggugcacgcg

SEQ ID NO: 3104648 - RNA, 19 nt, Molluscum contagiosum virus
gcggagggugcacgcgggc

SEQ ID NO: 3104649 - RNA, 21 nt, Molluscum contagiosum virus
gcggaggucgagcgcgccgcg

SEQ ID NO: 3104650 - RNA, 14 nt, Molluscum contagiosum virus
gcggagcuggccac

SEQ ID NO: 3104651 - RNA, 12 nt, Molluscum contagiosum virus
gcggagcugugc

SEQ ID NO: 3104652 - RNA, 20 nt, Molluscum contagiosum virus
gcggagcugugccaucucgc

SEQ ID NO: 3104653 - RNA, 19 nt, Molluscum contagiosum virus
gcggagcugugccgcagca

SEQ ID NO: 3104654 - RNA, 12 nt, Molluscum contagiosum virus
gcggacgcgggc

SEQ ID NO: 3104655 - RNA, 19 nt, Molluscum contagiosum virus
gcggacgcgggccgcgcgc

SEQ ID NO: 3104656 - RNA, 23 nt, Molluscum contagiosum virus
gcggacgaaagcgucgugugcgc

SEQ ID NO: 3104657 - RNA, 13 nt, Molluscum contagiosum virus
gcggacgccggcg

SEQ ID NO: 3104658 - RNA, 14 nt, Molluscum contagiosum virus
gcggacgccggcgc

SEQ ID NO: 3104659 - RNA, 22 nt, Molluscum contagiosum virus
gcggaacuggacgccguugcgc

SEQ ID NO: 3104660 - RNA, 16 nt, Molluscum contagiosum virus
gcggaagcccgagcgc

SEQ ID NO: 3104661 - RNA, 16 nt, Molluscum contagiosum virus
gcggaaguggugcccg

SEQ ID NO: 3104662 - RNA, 18 nt, Molluscum contagiosum virus
gcggacagagcccgcggc

SEQ ID NO: 3104663 - RNA, 20 nt, Molluscum contagiosum virus
gcggacagagcccgcggcgc

SEQ ID NO: 3104664 - RNA, 21 nt, Molluscum contagiosum virus
gcgcuugcucacgcugcgcuc

SEQ ID NO: 3104665 - RNA, 14 nt, Molluscum contagiosum virus
gcgcuucuuugcgc

SEQ ID NO: 3104666 - RNA, 21 nt, Molluscum contagiosum virus
gcgcuucggcucccagcagcg

SEQ ID NO: 3104667 - RNA, 21 nt, Molluscum contagiosum virus
gcgcuucguggacgagcgcua

SEQ ID NO: 3104668 - RNA, 18 nt, Molluscum contagiosum virus
gcgcugugagcgcgccgc

SEQ ID NO: 3104669 - RNA, 14 nt, Molluscum contagiosum virus
gcgcugucgcgcag

SEQ ID NO: 3104670 - RNA, 17 nt, Molluscum contagiosum virus
gcgcuugggcacugcua

SEQ ID NO: 3104671 - RNA, 16 nt, Molluscum contagiosum virus
gcgcuuugcgcggcgu

SEQ ID NO: 3104672 - RNA, 19 nt, Molluscum contagiosum virus
gcggaaaaaaacugcgcac

SEQ ID NO: 3104673 - RNA, 15 nt, Molluscum contagiosum virus
gcggaaacaagcaca

SEQ ID NO: 3104674 - RNA, 12 nt, Molluscum contagiosum virus
gcggcgugcccg

SEQ ID NO: 3104675 - RNA, 15 nt, Molluscum contagiosum virus
gcggcgggugccgcc

SEQ ID NO: 3104676 - RNA, 14 nt, Molluscum contagiosum virus
gcggcgucgcgcgc

SEQ ID NO: 3104677 - RNA, 12 nt, Molluscum contagiosum virus
gcggcgugcagg

SEQ ID NO: 3104678 - RNA, 21 nt, Molluscum contagiosum virus
gcggcgagcgcauucgcgcgc

SEQ ID NO: 3104679 - RNA, 19 nt, Molluscum contagiosum virus
gcggcgcuugauguccgcg

SEQ ID NO: 3104680 - RNA, 20 nt, Molluscum contagiosum virus
gcggcgcuugauguccgcga

SEQ ID NO: 3104681 - RNA, 22 nt, Molluscum contagiosum virus
gcggcgcuuucgcccgccgcgc

SEQ ID NO: 3104682 - RNA, 19 nt, Molluscum contagiosum virus
gcggcggaaguggugcccg

SEQ ID NO: 3104683 - RNA, 13 nt, Molluscum contagiosum virus
gcggcggacagca

SEQ ID NO: 3104684 - RNA, 21 nt, Molluscum contagiosum virus
gcggcgcacaaucucgccggc

SEQ ID NO: 3104685 - RNA, 15 nt, Molluscum contagiosum virus
gcggcgcacgcggcu

SEQ ID NO: 3104686 - RNA, 22 nt, Molluscum contagiosum virus
gcggcgccacgagcgccgcgac

SEQ ID NO: 3104687 - RNA, 22 nt, Molluscum contagiosum virus
gcggcgccgacaacgugcugcu

SEQ ID NO: 3104688 - RNA, 15 nt, Molluscum contagiosum virus
gcggcgccguggcgc

SEQ ID NO: 3104689 - RNA, 20 nt, Molluscum contagiosum virus
gcggcgccugcgccuggcau

SEQ ID NO: 3104690 - RNA, 18 nt, Molluscum contagiosum virus
gcggcgcgacggcgacgc

SEQ ID NO: 3104691 - RNA, 14 nt, Molluscum contagiosum virus
gcggcgcgcccagc

SEQ ID NO: 3104692 - RNA, 13 nt, Molluscum contagiosum virus
gcggcgcgccgcg

SEQ ID NO: 3104693 - RNA, 14 nt, Molluscum contagiosum virus
gcggcgcgccgcgc

SEQ ID NO: 3104694 - RNA, 14 nt, Molluscum contagiosum virus
gcggcgcgccggcc

SEQ ID NO: 3104695 - RNA, 15 nt, Molluscum contagiosum virus
gcggcgcgccggccc

SEQ ID NO: 3104696 - RNA, 23 nt, Molluscum contagiosum virus
gcggcgcgcgcugagcgcggagc

SEQ ID NO: 3104697 - RNA, 18 nt, Molluscum contagiosum virus
gcggcgcguacucgcgcc

SEQ ID NO: 3104698 - RNA, 14 nt, Molluscum contagiosum virus
gcggcgcgugccgc

SEQ ID NO: 3104699 - RNA, 19 nt, Molluscum contagiosum virus
gcggcgcgugccgcugcgc

SEQ ID NO: 3104700 - RNA, 15 nt, Molluscum contagiosum virus
gcggcgcgugcugag

SEQ ID NO: 3104701 - RNA, 14 nt, Molluscum contagiosum virus
gcggcgcgugucgc

SEQ ID NO: 3104702 - RNA, 15 nt, Molluscum contagiosum virus
gcggcgcgugucgcg

SEQ ID NO: 3104703 - RNA, 17 nt, Molluscum contagiosum virus
gcggcgcgugucgcgga

SEQ ID NO: 3104704 - RNA, 19 nt, Molluscum contagiosum virus
gcggcgcguuuucgcggcc

SEQ ID NO: 3104705 - RNA, 16 nt, Molluscum contagiosum virus
gcggcgcucguggcgc

SEQ ID NO: 3104706 - RNA, 17 nt, Molluscum contagiosum virus
gcggcgcucguggcgcg

SEQ ID NO: 3104707 - RNA, 15 nt, Molluscum contagiosum virus
gcggcgcucugccac

SEQ ID NO: 3104708 - RNA, 23 nt, Molluscum contagiosum virus
gcggcgcucugccaccgcggcgc

SEQ ID NO: 3104709 - RNA, 16 nt, Molluscum contagiosum virus
gcgucgagggcgccgg

SEQ ID NO: 3104710 - RNA, 20 nt, Molluscum contagiosum virus
gcgucgagggcgccgggcgc

SEQ ID NO: 3104711 - RNA, 22 nt, Molluscum contagiosum virus
gcgucgcacaguucacggcgcu

SEQ ID NO: 3104712 - RNA, 14 nt, Molluscum contagiosum virus
gcguccggcgcucg

SEQ ID NO: 3104713 - RNA, 15 nt, Molluscum contagiosum virus
gcguccggcgcucgc

SEQ ID NO: 3104714 - RNA, 14 nt, Molluscum contagiosum virus
gcguccggcgcuug

SEQ ID NO: 3104715 - RNA, 16 nt, Molluscum contagiosum virus
gcgucgcgcacgcgcg

SEQ ID NO: 3104716 - RNA, 12 nt, Molluscum contagiosum virus
gcgucgcgcagg

SEQ ID NO: 3104717 - RNA, 17 nt, Molluscum contagiosum virus
gcgucgcgcaggcgccc

SEQ ID NO: 3104718 - RNA, 17 nt, Molluscum contagiosum virus
gcgucgcgcgccgcgcu

SEQ ID NO: 3104719 - RNA, 19 nt, Molluscum contagiosum virus
gcgucgcgcgccgcgcugg

SEQ ID NO: 3104720 - RNA, 20 nt, Molluscum contagiosum virus
gcgucgcggagcgcgcacgg

SEQ ID NO: 3104721 - RNA, 13 nt, Molluscum contagiosum virus
gcggcugcggcgc

SEQ ID NO: 3104722 - RNA, 19 nt, Molluscum contagiosum virus
gcggcuggaccugcgccag

SEQ ID NO: 3104723 - RNA, 13 nt, Molluscum contagiosum virus
gcggcugugcccg

SEQ ID NO: 3104724 - RNA, 17 nt, Molluscum contagiosum virus
gcggcugugcccgcggc

SEQ ID NO: 3104725 - RNA, 19 nt, Molluscum contagiosum virus
gcggcugugcccgcggcgu

SEQ ID NO: 3104726 - RNA, 21 nt, Molluscum contagiosum virus
gcguccagccgcagccgcgcu

SEQ ID NO: 3104727 - RNA, 22 nt, Molluscum contagiosum virus
gcggcuacgaugaacuaccgug

SEQ ID NO: 3104728 - RNA, 14 nt, Molluscum contagiosum virus
gcggcuccgcgcgc

SEQ ID NO: 3104729 - RNA, 15 nt, Molluscum contagiosum virus
gcggcucucgcggcc

SEQ ID NO: 3104730 - RNA, 15 nt, Molluscum contagiosum virus
gcggcugcccgcgga

SEQ ID NO: 3104731 - RNA, 17 nt, Molluscum contagiosum virus
gcucgggaagcacguag

SEQ ID NO: 3104732 - RNA, 20 nt, Molluscum contagiosum virus
gcucgggccggcgcgccgcg

SEQ ID NO: 3104733 - RNA, 22 nt, Molluscum contagiosum virus
gcucgggcuagcaagcacgcca

SEQ ID NO: 3104734 - RNA, 18 nt, Molluscum contagiosum virus
gcucguccccgugcacga

SEQ ID NO: 3104735 - RNA, 20 nt, Molluscum contagiosum virus
gcucgugcucucugcgcagg

SEQ ID NO: 3104736 - RNA, 21 nt, Molluscum contagiosum virus
gcucgugcucuuggcguucgc

SEQ ID NO: 3104737 - RNA, 21 nt, Molluscum contagiosum virus
gcucguggacagccugcaccg

SEQ ID NO: 3104738 - RNA, 20 nt, Molluscum contagiosum virus
gcucgugguugcgcacguug

SEQ ID NO: 3104739 - RNA, 18 nt, Molluscum contagiosum virus
gcucuaagcgcacgcgcg

SEQ ID NO: 3104740 - RNA, 14 nt, Molluscum contagiosum virus
gcucuacgccagcg

SEQ ID NO: 3104741 - RNA, 17 nt, Molluscum contagiosum virus
gcucuacgccagcgacg

SEQ ID NO: 3104742 - RNA, 18 nt, Molluscum contagiosum virus
gcugaagaaggagcccuu

SEQ ID NO: 3104743 - RNA, 24 nt, Molluscum contagiosum virus
gcugaaggcauaccugugccagcg

SEQ ID NO: 3104744 - RNA, 18 nt, Molluscum contagiosum virus
gcugacccucgcggcucu

SEQ ID NO: 3104745 - RNA, 17 nt, Molluscum contagiosum virus
gcugaccgagcgugggc

SEQ ID NO: 3104746 - RNA, 19 nt, Molluscum contagiosum virus
gcugacggccggcgggcgc

SEQ ID NO: 3104747 - RNA, 14 nt, Molluscum contagiosum virus
gcugagcgugucga

SEQ ID NO: 3104748 - RNA, 16 nt, Molluscum contagiosum virus
gcugagcuagugccga

SEQ ID NO: 3104749 - RNA, 17 nt, Molluscum contagiosum virus
gcugagcuagugccgag

SEQ ID NO: 3104750 - RNA, 23 nt, Molluscum contagiosum virus
gcucucggccauggaggcgcuag

SEQ ID NO: 3104751 - RNA, 14 nt, Molluscum contagiosum virus
gcucucgagcacuu

SEQ ID NO: 3104752 - RNA, 22 nt, Molluscum contagiosum virus
gcucugcgugcuugugcgccug

SEQ ID NO: 3104753 - RNA, 18 nt, Molluscum contagiosum virus
gcucugcguuuugcgcgg

SEQ ID NO: 3104754 - RNA, 22 nt, Molluscum contagiosum virus
gcucuggagccucccccgcgca

SEQ ID NO: 3104755 - RNA, 20 nt, Molluscum contagiosum virus
gcucugucccgcaagccaca

SEQ ID NO: 3104756 - RNA, 18 nt, Molluscum contagiosum virus
gcgugcaggaacgcgcgc

SEQ ID NO: 3104757 - RNA, 15 nt, Molluscum contagiosum virus
gcgugcaguuucucc

SEQ ID NO: 3104758 - RNA, 16 nt, Molluscum contagiosum virus
gcgugcauuuuuccgc

SEQ ID NO: 3104759 - RNA, 20 nt, Molluscum contagiosum virus
gcgugacucggccgcggggc

SEQ ID NO: 3104760 - RNA, 19 nt, Molluscum contagiosum virus
gcgugcaagcccagcagcg

SEQ ID NO: 3104761 - RNA, 21 nt, Molluscum contagiosum virus
gcgugcacccuccgcacagag

SEQ ID NO: 3104762 - RNA, 23 nt, Molluscum contagiosum virus
gcgugccgcccgaguccgcgcuc

SEQ ID NO: 3104763 - RNA, 15 nt, Molluscum contagiosum virus
gcgugccgcggacgc

SEQ ID NO: 3104764 - RNA, 19 nt, Molluscum contagiosum virus
gcgugccuggcuugcgcgc

SEQ ID NO: 3104765 - RNA, 21 nt, Molluscum contagiosum virus
gcgugccuggcuugcgcgcgc

SEQ ID NO: 3104766 - RNA, 15 nt, Molluscum contagiosum virus
gcgugccuguggcgc

SEQ ID NO: 3104767 - RNA, 14 nt, Molluscum contagiosum virus
gcgugcgagcagag

SEQ ID NO: 3104768 - RNA, 17 nt, Molluscum contagiosum virus
gcgugcgagcggcgcgc

SEQ ID NO: 3104769 - RNA, 22 nt, Molluscum contagiosum virus
gcgugcgauugccccugggcuu

SEQ ID NO: 3104770 - RNA, 13 nt, Molluscum contagiosum virus
gcgugcgccucgc

SEQ ID NO: 3104771 - RNA, 22 nt, Molluscum contagiosum virus
gcgugcgcgccaggugcgaagg

SEQ ID NO: 3104772 - RNA, 16 nt, Molluscum contagiosum virus
gcucggcgagagcgcg

SEQ ID NO: 3104773 - RNA, 18 nt, Molluscum contagiosum virus
gcgucgugcuccacgcgc

SEQ ID NO: 3104774 - RNA, 19 nt, Molluscum contagiosum virus
gcgucgugcuccacgcgca

SEQ ID NO: 3104775 - RNA, 17 nt, Molluscum contagiosum virus
gcgucguagacgcgccc

SEQ ID NO: 3104776 - RNA, 23 nt, Molluscum contagiosum virus
gcguccuucuuugcgugcgccuc

SEQ ID NO: 3104777 - RNA, 14 nt, Molluscum contagiosum virus
gcgucuccgcgcgg

SEQ ID NO: 3104778 - RNA, 22 nt, Molluscum contagiosum virus
gcgucucucugucucccgccgc

SEQ ID NO: 3104779 - RNA, 21 nt, Molluscum contagiosum virus
gcgugacaaucucugcgccgc

SEQ ID NO: 3104780 - RNA, 23 nt, Molluscum contagiosum virus
gcgugacaaucucugcgccgcgc

SEQ ID NO: 3104781 - RNA, 13 nt, Molluscum contagiosum virus
gcgucgugugcgc

SEQ ID NO: 3104782 - RNA, 14 nt, Molluscum contagiosum virus
gcgucgugugcgcg

SEQ ID NO: 3104783 - RNA, 14 nt, Molluscum contagiosum virus
gcgucucccgcggc

SEQ ID NO: 3104784 - RNA, 18 nt, Molluscum contagiosum virus
gaaagagcacgcgcucgc

SEQ ID NO: 3104785 - RNA, 12 nt, Molluscum contagiosum virus
gaaagcgccgcg

SEQ ID NO: 3104786 - RNA, 16 nt, Molluscum contagiosum virus
gaaagcgccgcgcgcg

SEQ ID NO: 3104787 - RNA, 20 nt, Molluscum contagiosum virus
gaaagcuucugucgcuucgc

SEQ ID NO: 3104788 - RNA, 19 nt, Molluscum contagiosum virus
gaaaggcacccaccaggaa

SEQ ID NO: 3104789 - RNA, 18 nt, Molluscum contagiosum virus
gaaaggcaccccgcagga

SEQ ID NO: 3104790 - RNA, 17 nt, Molluscum contagiosum virus
gaaaggcacccgcagga

SEQ ID NO: 3104791 - RNA, 20 nt, Molluscum contagiosum virus
gaaaggcaccugcggcucgc

SEQ ID NO: 3104792 - RNA, 14 nt, Molluscum contagiosum virus
gaaaggcaugauuc

SEQ ID NO: 3104793 - RNA, 19 nt, Molluscum contagiosum virus
gaaaccucaccucugcgcg

SEQ ID NO: 3104794 - RNA, 21 nt, Molluscum contagiosum virus
gaaacucuccgacgugcugcg

SEQ ID NO: 3104795 - RNA, 17 nt, Molluscum contagiosum virus
gaaacacccgcgcucga

SEQ ID NO: 3104796 - RNA, 22 nt, Molluscum contagiosum virus
gaaacagcaccguugccgcggc

SEQ ID NO: 3104797 - RNA, 22 nt, Molluscum contagiosum virus
gaaacaguaggacauguccggc

SEQ ID NO: 3104798 - RNA, 18 nt, Molluscum contagiosum virus
gaaacagccgugcuccga

SEQ ID NO: 3104799 - RNA, 19 nt, Molluscum contagiosum virus
gaaaacggaaacagcaccg

SEQ ID NO: 3104800 - RNA, 14 nt, Molluscum contagiosum virus
gaaaagcgcgagcc

SEQ ID NO: 3104801 - RNA, 20 nt, Molluscum contagiosum virus
gaaaaggcugauccugcgcg

SEQ ID NO: 3104802 - RNA, 14 nt, Molluscum contagiosum virus
gaacaucagcacgg

SEQ ID NO: 3104803 - RNA, 17 nt, Molluscum contagiosum virus
gaacauguugugcucgu

SEQ ID NO: 3104804 - RNA, 23 nt, Molluscum contagiosum virus
gaacaagucgucgaucgccucga

SEQ ID NO: 3104805 - RNA, 18 nt, Molluscum contagiosum virus
gaacacgggggcugccgg

SEQ ID NO: 3104806 - RNA, 18 nt, Molluscum contagiosum virus
gaacagucgcgcgccugc

SEQ ID NO: 3104807 - RNA, 14 nt, Molluscum contagiosum virus
gaagggcccgcggc

SEQ ID NO: 3104808 - RNA, 18 nt, Molluscum contagiosum virus
gaagguacuucccgagga

SEQ ID NO: 3104809 - RNA, 23 nt, Molluscum contagiosum virus
gaaguacuucgcgaugugcaccu

SEQ ID NO: 3104810 - RNA, 21 nt, Molluscum contagiosum virus
gaaguccaucggugggcucgc

SEQ ID NO: 3104811 - RNA, 17 nt, Molluscum contagiosum virus
gaacgcgcaagugugcg

SEQ ID NO: 3104812 - RNA, 21 nt, Molluscum contagiosum virus
gaaggaucccugcccgcguga

SEQ ID NO: 3104813 - RNA, 14 nt, Molluscum contagiosum virus
gaaggccaccucgc

SEQ ID NO: 3104814 - RNA, 17 nt, Molluscum contagiosum virus
gaaccugcacgcggcgu

SEQ ID NO: 3104815 - RNA, 23 nt, Molluscum contagiosum virus
gaaccuggaacucuacgccgcgc

SEQ ID NO: 3104816 - RNA, 20 nt, Molluscum contagiosum virus
gaaccugggcaucgucucgc

SEQ ID NO: 3104817 - RNA, 16 nt, Molluscum contagiosum virus
gaacgagccugccgcg

SEQ ID NO: 3104818 - RNA, 19 nt, Molluscum contagiosum virus
gaacgaggcugcugccgcg

SEQ ID NO: 3104819 - RNA, 20 nt, Molluscum contagiosum virus
gaacgccgugcgcgugcggc

SEQ ID NO: 3104820 - RNA, 21 nt, Molluscum contagiosum virus
cguaauccaugucgagcccug

SEQ ID NO: 3104821 - RNA, 17 nt, Molluscum contagiosum virus
cguacagcgcgcgugcc

SEQ ID NO: 3104822 - RNA, 18 nt, Molluscum contagiosum virus
cguacagcgcgcgugccg

SEQ ID NO: 3104823 - RNA, 17 nt, Molluscum contagiosum virus
cguacagcuccccgcgc

SEQ ID NO: 3104824 - RNA, 20 nt, Molluscum contagiosum virus
cguacagcuccccgcgcaag

SEQ ID NO: 3104825 - RNA, 15 nt, Molluscum contagiosum virus
cguaccagcgccugc

SEQ ID NO: 3104826 - RNA, 23 nt, Molluscum contagiosum virus
cggugugcuacugcacugcagcg

SEQ ID NO: 3104827 - RNA, 15 nt, Molluscum contagiosum virus
cgguggcaggcgcgc

SEQ ID NO: 3104828 - RNA, 22 nt, Molluscum contagiosum virus
cgguggccgcgccgggcgccag

SEQ ID NO: 3104829 - RNA, 14 nt, Molluscum contagiosum virus
cgguggacgcacag

SEQ ID NO: 3104830 - RNA, 15 nt, Molluscum contagiosum virus
cgggccugcgcccgc

SEQ ID NO: 3104831 - RNA, 16 nt, Molluscum contagiosum virus
cgggccugcgcccgca

SEQ ID NO: 3104832 - RNA, 13 nt, Molluscum contagiosum virus
cgggccugcgcgc

SEQ ID NO: 3104833 - RNA, 21 nt, Molluscum contagiosum virus
cgggccuguaccugcgacagc

SEQ ID NO: 3104834 - RNA, 14 nt, Molluscum contagiosum virus
cggugcucgccccu

SEQ ID NO: 3104835 - RNA, 21 nt, Molluscum contagiosum virus
cggugcucuucggggacggcg

SEQ ID NO: 3104836 - RNA, 15 nt, Molluscum contagiosum virus
cggugcugcgccagg

SEQ ID NO: 3104837 - RNA, 23 nt, Molluscum contagiosum virus
cguacuugcugguugccgcucgc

SEQ ID NO: 3104838 - RNA, 23 nt, Molluscum contagiosum virus
cguagacgcgcccguccuccguc

SEQ ID NO: 3104839 - RNA, 13 nt, Molluscum contagiosum virus
cguagagcagcgc

SEQ ID NO: 3104840 - RNA, 21 nt, Molluscum contagiosum virus
cguagcaaaugcgcugcucgc

SEQ ID NO: 3104841 - RNA, 14 nt, Molluscum contagiosum virus
cgguugagcgccgu

SEQ ID NO: 3104842 - RNA, 12 nt, Molluscum contagiosum virus
cguacgcggagg

SEQ ID NO: 3104843 - RNA, 17 nt, Molluscum contagiosum virus
cguacgcgucgcggagg

SEQ ID NO: 3104844 - RNA, 15 nt, Molluscum contagiosum virus
cguacgugcgccagc

SEQ ID NO: 3104845 - RNA, 20 nt, Molluscum contagiosum virus
cguacucgcguccgcgcagc

SEQ ID NO: 3104846 - RNA, 23 nt, Molluscum contagiosum virus
cguacucgcugcuccccgccagc

SEQ ID NO: 3104847 - RNA, 14 nt, Molluscum contagiosum virus
cguaccgcgcccgc

SEQ ID NO: 3104848 - RNA, 17 nt, Molluscum contagiosum virus
cguacgagcagcugcug

SEQ ID NO: 3104849 - RNA, 18 nt, Molluscum contagiosum virus
cguacgagcagcugcugc

SEQ ID NO: 3104850 - RNA, 13 nt, Molluscum contagiosum virus
cguacgagcaggc

SEQ ID NO: 3104851 - RNA, 14 nt, Molluscum contagiosum virus
cguacgagcaggcg

SEQ ID NO: 3104852 - RNA, 19 nt, Molluscum contagiosum virus
cguagcagcgccugcacgc

SEQ ID NO: 3104853 - RNA, 13 nt, Molluscum contagiosum virus
cguagcgcgucuc

SEQ ID NO: 3104854 - RNA, 21 nt, Molluscum contagiosum virus
cguagcggacgaagcugugca

SEQ ID NO: 3104855 - RNA, 18 nt, Molluscum contagiosum virus
cguaguccagcgcgucca

SEQ ID NO: 3104856 - RNA, 15 nt, Molluscum contagiosum virus
cgucaagcagcgcgc

SEQ ID NO: 3104857 - RNA, 17 nt, Molluscum contagiosum virus
cgucaagcagcgcgcca

SEQ ID NO: 3104858 - RNA, 18 nt, Molluscum contagiosum virus
cgucaagcagcgcgccac

SEQ ID NO: 3104859 - RNA, 22 nt, Molluscum contagiosum virus
cgucaagcagguggccgcgcgc

SEQ ID NO: 3104860 - RNA, 21 nt, Molluscum contagiosum virus
cuuuucgcgccgcgggcacau

SEQ ID NO: 3104861 - RNA, 15 nt, Molluscum contagiosum virus
cuuuugccgcggcgc

SEQ ID NO: 3104862 - RNA, 16 nt, Molluscum contagiosum virus
cuuuuugcggcgccgc

SEQ ID NO: 3104863 - RNA, 16 nt, Molluscum contagiosum virus
gaaaaaagagccggcu

SEQ ID NO: 3104864 - RNA, 19 nt, Molluscum contagiosum virus
gaauguguacgacgcgccc

SEQ ID NO: 3104865 - RNA, 18 nt, Molluscum contagiosum virus
gaagugacuagcgcuggc

SEQ ID NO: 3104866 - RNA, 18 nt, Molluscum contagiosum virus
gaaguggccgucgcgagc

SEQ ID NO: 3104867 - RNA, 17 nt, Molluscum contagiosum virus
gacaaucucugcgccgc

SEQ ID NO: 3104868 - RNA, 22 nt, Molluscum contagiosum virus
gacaaucucugcgccgcgcgcg

SEQ ID NO: 3104869 - RNA, 15 nt, Molluscum contagiosum virus
gacaaguacaugcac

SEQ ID NO: 3104870 - RNA, 13 nt, Molluscum contagiosum virus
gacaaagucgcgc

SEQ ID NO: 3104871 - RNA, 19 nt, Molluscum contagiosum virus
gacacgagccgugugcucg

SEQ ID NO: 3104872 - RNA, 21 nt, Molluscum contagiosum virus
gacacgagggccuuggcggcg

SEQ ID NO: 3104873 - RNA, 19 nt, Molluscum contagiosum virus
gacaccgacgaggugcgcg

SEQ ID NO: 3104874 - RNA, 12 nt, Molluscum contagiosum virus
gacaccgcgggc

SEQ ID NO: 3104875 - RNA, 18 nt, Molluscum contagiosum virus
gacaccgcguuuguggcg

SEQ ID NO: 3104876 - RNA, 22 nt, Molluscum contagiosum virus
gacacucuucgcaggcgugcuc

SEQ ID NO: 3104877 - RNA, 14 nt, Molluscum contagiosum virus
gacagagcccggga

SEQ ID NO: 3104878 - RNA, 18 nt, Molluscum contagiosum virus
gacagagugccuggcgcg

SEQ ID NO: 3104879 - RNA, 20 nt, Molluscum contagiosum virus
gacacguuccagagcacugc

SEQ ID NO: 3104880 - RNA, 16 nt, Molluscum contagiosum virus
gacacguugcagcagc

SEQ ID NO: 3104881 - RNA, 16 nt, Molluscum contagiosum virus
gacacgcgugcaugcg

SEQ ID NO: 3104882 - RNA, 22 nt, Molluscum contagiosum virus
gacacgcgugcaugcgagcgcg

SEQ ID NO: 3104883 - RNA, 17 nt, Molluscum contagiosum virus
gacacgcgugucugcgc

SEQ ID NO: 3104884 - RNA, 19 nt, Molluscum contagiosum virus
gacacgcugcgcgugcugg

SEQ ID NO: 3104885 - RNA, 23 nt, Molluscum contagiosum virus
gacagcaaacagccuguguugcg

SEQ ID NO: 3104886 - RNA, 20 nt, Molluscum contagiosum virus
gacgccaagcgucgcgacgc

SEQ ID NO: 3104887 - RNA, 13 nt, Molluscum contagiosum virus
gacgccagcgcgc

SEQ ID NO: 3104888 - RNA, 20 nt, Molluscum contagiosum virus
gacgcccggcaccgcggcgg

SEQ ID NO: 3104889 - RNA, 15 nt, Molluscum contagiosum virus
gacgccuuccugcug

SEQ ID NO: 3104890 - RNA, 20 nt, Molluscum contagiosum virus
gacgccuuccugcuggcgcg

SEQ ID NO: 3104891 - RNA, 17 nt, Molluscum contagiosum virus
gacgccuuuugugcagc

SEQ ID NO: 3104892 - RNA, 19 nt, Molluscum contagiosum virus
gacgcgacgccguccgcgc

SEQ ID NO: 3104893 - RNA, 15 nt, Molluscum contagiosum virus
gacgcgagacugugc

SEQ ID NO: 3104894 - RNA, 19 nt, Molluscum contagiosum virus
gacgccgauguccugcgga

SEQ ID NO: 3104895 - RNA, 20 nt, Molluscum contagiosum virus
gacgccggggggcgccaagu

SEQ ID NO: 3104896 - RNA, 15 nt, Molluscum contagiosum virus
gacgccguccgcgca

SEQ ID NO: 3104897 - RNA, 23 nt, Molluscum contagiosum virus
gacgccgucgaugaaggcgcggc

SEQ ID NO: 3104898 - RNA, 15 nt, Molluscum contagiosum virus
gacuuacggacgccc

SEQ ID NO: 3104899 - RNA, 14 nt, Molluscum contagiosum virus
gacuuagccacugu

SEQ ID NO: 3104900 - RNA, 18 nt, Molluscum contagiosum virus
gacuuagccacugugcug

SEQ ID NO: 3104901 - RNA, 13 nt, Molluscum contagiosum virus
gacugcgcccgug

SEQ ID NO: 3104902 - RNA, 22 nt, Molluscum contagiosum virus
gacugcgccuucugccugcccg

SEQ ID NO: 3104903 - RNA, 22 nt, Molluscum contagiosum virus
gacugcguugucuccuccugau

SEQ ID NO: 3104904 - RNA, 17 nt, Molluscum contagiosum virus
gacugcuacgucgcggc

SEQ ID NO: 3104905 - RNA, 19 nt, Molluscum contagiosum virus
gacugcuacgucgcggcgc

SEQ ID NO: 3104906 - RNA, 19 nt, Molluscum contagiosum virus
gacugcugcccccgccgcg

SEQ ID NO: 3104907 - RNA, 23 nt, Molluscum contagiosum virus
gacugcugcccccgccgcggcgc

SEQ ID NO: 3104908 - RNA, 14 nt, Molluscum contagiosum virus
gacuggcacgcgcc

SEQ ID NO: 3104909 - RNA, 16 nt, Molluscum contagiosum virus
gacuggcacgcgccgc

SEQ ID NO: 3104910 - RNA, 17 nt, Molluscum contagiosum virus
gacgcucgggccggcgc

SEQ ID NO: 3104911 - RNA, 16 nt, Molluscum contagiosum virus
gacgcugcggcggcgc

SEQ ID NO: 3104912 - RNA, 18 nt, Molluscum contagiosum virus
gacgcgggccuguccgcg

SEQ ID NO: 3104913 - RNA, 22 nt, Molluscum contagiosum virus
gacggcaccguaccgcgcccgc

SEQ ID NO: 3104914 - RNA, 16 nt, Molluscum contagiosum virus
gacggcacgggcacgc

SEQ ID NO: 3104915 - RNA, 20 nt, Molluscum contagiosum virus
gacggcacgggcacgcgcgc

SEQ ID NO: 3104916 - RNA, 16 nt, Molluscum contagiosum virus
gacggccggcgggcgc

SEQ ID NO: 3104917 - RNA, 21 nt, Molluscum contagiosum virus
gacucgagcgagcuacgcgcu

SEQ ID NO: 3104918 - RNA, 17 nt, Molluscum contagiosum virus
gacucgcgcccgcuccc

SEQ ID NO: 3104919 - RNA, 20 nt, Molluscum contagiosum virus
gacuccuuugcgagcacugu

SEQ ID NO: 3104920 - RNA, 14 nt, Molluscum contagiosum virus
gacgcggccgcgga

SEQ ID NO: 3104921 - RNA, 13 nt, Molluscum contagiosum virus
gacgcggucgcgc

SEQ ID NO: 3104922 - RNA, 13 nt, Molluscum contagiosum virus
gacgcggugcgcg

SEQ ID NO: 3104923 - RNA, 19 nt, Molluscum contagiosum virus
gacgcgugcaagcccagca

SEQ ID NO: 3104924 - RNA, 23 nt, Molluscum contagiosum virus
gacgcgugcauggcacgcgagca

SEQ ID NO: 3104925 - RNA, 16 nt, Molluscum contagiosum virus
gacgcuagcugugcgc

SEQ ID NO: 3104926 - RNA, 14 nt, Molluscum contagiosum virus
gacgcucacggccu

SEQ ID NO: 3104927 - RNA, 14 nt, Molluscum contagiosum virus
gacgcuggcggcgc

SEQ ID NO: 3104928 - RNA, 15 nt, Molluscum contagiosum virus
gacgcuggugaucac

SEQ ID NO: 3104929 - RNA, 23 nt, Molluscum contagiosum virus
gacgcuggugaucacgcacgaag

SEQ ID NO: 3104930 - RNA, 15 nt, Molluscum contagiosum virus
gacggaaccguggug

SEQ ID NO: 3104931 - RNA, 17 nt, Molluscum contagiosum virus
gacggaauuugcggcgc

SEQ ID NO: 3104932 - RNA, 13 nt, Molluscum contagiosum virus
gacggacccgcga

SEQ ID NO: 3104933 - RNA, 21 nt, Molluscum contagiosum virus
gacggacuucuugcgcggcgg

SEQ ID NO: 3104934 - RNA, 19 nt, Molluscum contagiosum virus
gacggagagcgcgcggcgc

SEQ ID NO: 3104935 - RNA, 17 nt, Molluscum contagiosum virus
gacgcgccucgagcagg

SEQ ID NO: 3104936 - RNA, 20 nt, Molluscum contagiosum virus
gacgcgccucgagcagguca

SEQ ID NO: 3104937 - RNA, 15 nt, Molluscum contagiosum virus
gacgcgcgagugugc

SEQ ID NO: 3104938 - RNA, 16 nt, Molluscum contagiosum virus
gacgcgcgagugugcg

SEQ ID NO: 3104939 - RNA, 17 nt, Molluscum contagiosum virus
gacgcgcgagugugcgu

SEQ ID NO: 3104940 - RNA, 16 nt, Molluscum contagiosum virus
gacgcgcggcagacgc

SEQ ID NO: 3104941 - RNA, 24 nt, Molluscum contagiosum virus
gacgcgcguggagcgcgcggacgc

SEQ ID NO: 3104942 - RNA, 16 nt, Molluscum contagiosum virus
gacgcgcuugcgcgga

SEQ ID NO: 3104943 - RNA, 22 nt, Molluscum contagiosum virus
gacgcgaguugcgucucccgcg

SEQ ID NO: 3104944 - RNA, 16 nt, Molluscum contagiosum virus
gacgcgaucuuccgcg

SEQ ID NO: 3104945 - RNA, 16 nt, Molluscum contagiosum virus
gacgcgcaagugugcg

SEQ ID NO: 3104946 - RNA, 17 nt, Molluscum contagiosum virus
gacgcgcaagugugcgc

SEQ ID NO: 3104947 - RNA, 18 nt, Molluscum contagiosum virus
gacgcgcacgcgggacgc

SEQ ID NO: 3104948 - RNA, 15 nt, Molluscum contagiosum virus
gacgcgcagcucgac

SEQ ID NO: 3104949 - RNA, 20 nt, Molluscum contagiosum virus
gacgcccuccucgaccugca

SEQ ID NO: 3104950 - RNA, 13 nt, Molluscum contagiosum virus
gcccgcccgcgcu

SEQ ID NO: 3104951 - RNA, 17 nt, Molluscum contagiosum virus
gcccgccgacugccgcc

SEQ ID NO: 3104952 - RNA, 23 nt, Molluscum contagiosum virus
gcccgccgggcaccggcgcucac

SEQ ID NO: 3104953 - RNA, 22 nt, Molluscum contagiosum virus
gcccgaguauacucgacgcgcg

SEQ ID NO: 3104954 - RNA, 15 nt, Molluscum contagiosum virus
gcccgaguccgcgcu

SEQ ID NO: 3104955 - RNA, 17 nt, Molluscum contagiosum virus
gcccgaguucgcggcgc

SEQ ID NO: 3104956 - RNA, 22 nt, Molluscum contagiosum virus
gcccgacuuuggcuacgacggc

SEQ ID NO: 3104957 - RNA, 19 nt, Molluscum contagiosum virus
gcccgacuuuucgcgccgc

SEQ ID NO: 3104958 - RNA, 12 nt, Molluscum contagiosum virus
gcccgagcccga

SEQ ID NO: 3104959 - RNA, 24 nt, Molluscum contagiosum virus
gcccgagcuaaauggacgcggacc

SEQ ID NO: 3104960 - RNA, 23 nt, Molluscum contagiosum virus
gcccgaggacgagccccgcgccg

SEQ ID NO: 3104961 - RNA, 20 nt, Molluscum contagiosum virus
gcccgaggagagcggcgccc

SEQ ID NO: 3104962 - RNA, 14 nt, Molluscum contagiosum virus
gcccgaagccguag

SEQ ID NO: 3104963 - RNA, 15 nt, Molluscum contagiosum virus
gcccgacgcgggcgc

SEQ ID NO: 3104964 - RNA, 14 nt, Molluscum contagiosum virus
gccccgacgccagc

SEQ ID NO: 3104965 - RNA, 15 nt, Molluscum contagiosum virus
gccccgacgccagcg

SEQ ID NO: 3104966 - RNA, 15 nt, Molluscum contagiosum virus
gccccgagacccgca

SEQ ID NO: 3104967 - RNA, 14 nt, Molluscum contagiosum virus
gccccgcgccagca

SEQ ID NO: 3104968 - RNA, 11 nt, Molluscum contagiosum virus
gccccgcgcgc

SEQ ID NO: 3104969 - RNA, 19 nt, Molluscum contagiosum virus
gccccguccucgcucgugc

SEQ ID NO: 3104970 - RNA, 16 nt, Molluscum contagiosum virus
gccagcgucgcgcgcc

SEQ ID NO: 3104971 - RNA, 20 nt, Molluscum contagiosum virus
gccagcgucgcgcgccgugc

SEQ ID NO: 3104972 - RNA, 17 nt, Molluscum contagiosum virus
gccagcgugcagacgac

SEQ ID NO: 3104973 - RNA, 18 nt, Molluscum contagiosum virus
gccagcuccgcgcggcgc

SEQ ID NO: 3104974 - RNA, 23 nt, Molluscum contagiosum virus
gccagcuccgcgcggcgcucugc

SEQ ID NO: 3104975 - RNA, 17 nt, Molluscum contagiosum virus
gccagcucgacacugug

SEQ ID NO: 3104976 - RNA, 18 nt, Molluscum contagiosum virus
gccagcucgacacugugc

SEQ ID NO: 3104977 - RNA, 21 nt, Molluscum contagiosum virus
gccagcucgacacugugcugg

SEQ ID NO: 3104978 - RNA, 16 nt, Molluscum contagiosum virus
gccagcgacgcgacgc

SEQ ID NO: 3104979 - RNA, 23 nt, Molluscum contagiosum virus
gccagcgagaucaacgcgcgcgu

SEQ ID NO: 3104980 - RNA, 20 nt, Molluscum contagiosum virus
gccagcgagucucgcgcgcc

SEQ ID NO: 3104981 - RNA, 23 nt, Molluscum contagiosum virus
gccagcgagucucgcgcgccacc

SEQ ID NO: 3104982 - RNA, 14 nt, Molluscum contagiosum virus
gccagcgcgcgccu

SEQ ID NO: 3104983 - RNA, 14 nt, Molluscum contagiosum virus
gccagcggcgccgc

SEQ ID NO: 3104984 - RNA, 15 nt, Molluscum contagiosum virus
gccagcuugagcaca

SEQ ID NO: 3104985 - RNA, 16 nt, Molluscum contagiosum virus
gcccccgccaugccaa

SEQ ID NO: 3104986 - RNA, 22 nt, Molluscum contagiosum virus
gcccccgguucccggugcugcu

SEQ ID NO: 3104987 - RNA, 14 nt, Molluscum contagiosum virus
gcccccgugcugug

SEQ ID NO: 3104988 - RNA, 13 nt, Molluscum contagiosum virus
gccaccgcggcgc

SEQ ID NO: 3104989 - RNA, 17 nt, Molluscum contagiosum virus
gccacgaacacggcgcg

SEQ ID NO: 3104990 - RNA, 22 nt, Molluscum contagiosum virus
gccacgaagagucgcgccugga

SEQ ID NO: 3104991 - RNA, 20 nt, Molluscum contagiosum virus
gccaagaccugggcgucgug

SEQ ID NO: 3104992 - RNA, 20 nt, Molluscum contagiosum virus
gccaagcguuggcgcccgag

SEQ ID NO: 3104993 - RNA, 13 nt, Molluscum contagiosum virus
gccaaggucucga

SEQ ID NO: 3104994 - RNA, 21 nt, Molluscum contagiosum virus
gccaagguucuggacgugucc

SEQ ID NO: 3104995 - RNA, 20 nt, Molluscum contagiosum virus
gccacaccccguacggcgca

SEQ ID NO: 3104996 - RNA, 15 nt, Molluscum contagiosum virus
gccacgagcgccgcg

SEQ ID NO: 3104997 - RNA, 21 nt, Molluscum contagiosum virus
gccacgagcgccgcgugcgcg

SEQ ID NO: 3104998 - RNA, 14 nt, Molluscum contagiosum virus
gccacgcagcuggc

SEQ ID NO: 3104999 - RNA, 14 nt, Molluscum contagiosum virus
gccacgccagcccg

SEQ ID NO: 3105000 - RNA, 15 nt, Molluscum contagiosum virus
gccacggccgcgcgc

SEQ ID NO: 3105001 - RNA, 14 nt, Molluscum contagiosum virus
gccacggccgcgcu

SEQ ID NO: 3105002 - RNA, 14 nt, Molluscum contagiosum virus
gccagacgcagagc

SEQ ID NO: 3105003 - RNA, 17 nt, Molluscum contagiosum virus
gccagcaagcucgaugc

SEQ ID NO: 3105004 - RNA, 16 nt, Molluscum contagiosum virus
gccagcacgcgcucgu

SEQ ID NO: 3105005 - RNA, 22 nt, Molluscum contagiosum virus
gccagcagcgcccggugcggcg

SEQ ID NO: 3105006 - RNA, 15 nt, Molluscum contagiosum virus
gccagccaggcgccg

SEQ ID NO: 3105007 - RNA, 17 nt, Molluscum contagiosum virus
gccagccaucgugcgcg

SEQ ID NO: 3105008 - RNA, 20 nt, Molluscum contagiosum virus
gccagcccgacuucucgcgc

SEQ ID NO: 3105009 - RNA, 16 nt, Molluscum contagiosum virus
gccagccugugcgcca

SEQ ID NO: 3105010 - RNA, 23 nt, Molluscum contagiosum virus
gcaggucaacuccgagcgcgcgc

SEQ ID NO: 3105011 - RNA, 17 nt, Molluscum contagiosum virus
gcagguggccgcgcgcg

SEQ ID NO: 3105012 - RNA, 18 nt, Molluscum contagiosum virus
gcagguggccgcgcgcgc

SEQ ID NO: 3105013 - RNA, 16 nt, Molluscum contagiosum virus
gccaacuucgucucga

SEQ ID NO: 3105014 - RNA, 13 nt, Molluscum contagiosum virus
gccaagaacaagc

SEQ ID NO: 3105015 - RNA, 20 nt, Molluscum contagiosum virus
gccaacacgcaaucgcgcgc

SEQ ID NO: 3105016 - RNA, 21 nt, Molluscum contagiosum virus
gccaacacgcaaucgcgcgcg

SEQ ID NO: 3105017 - RNA, 17 nt, Molluscum contagiosum virus
gccaacccucgcaagcu

SEQ ID NO: 3105018 - RNA, 13 nt, Molluscum contagiosum virus
gcaggcgagguca

SEQ ID NO: 3105019 - RNA, 15 nt, Molluscum contagiosum virus
gcaggcgcagcgcgg

SEQ ID NO: 3105020 - RNA, 16 nt, Molluscum contagiosum virus
gcaggcgcaggccgcg

SEQ ID NO: 3105021 - RNA, 13 nt, Molluscum contagiosum virus
gcaggcgcgcgcg

SEQ ID NO: 3105022 - RNA, 14 nt, Molluscum contagiosum virus
gcaggcgcugcgcg

SEQ ID NO: 3105023 - RNA, 19 nt, Molluscum contagiosum virus
gcaggcggugggcgccgcg

SEQ ID NO: 3105024 - RNA, 22 nt, Molluscum contagiosum virus
gcaggccccgcaccagugccga

SEQ ID NO: 3105025 - RNA, 21 nt, Molluscum contagiosum virus
gcaggcccggcggcccgcggc

SEQ ID NO: 3105026 - RNA, 13 nt, Molluscum contagiosum virus
gcaggccgcccac

SEQ ID NO: 3105027 - RNA, 17 nt, Molluscum contagiosum virus
gcagcuguccaagguga

SEQ ID NO: 3105028 - RNA, 18 nt, Molluscum contagiosum virus
gcagcuguuucugccgcg

SEQ ID NO: 3105029 - RNA, 15 nt, Molluscum contagiosum virus
gcaggcgucgcgcac

SEQ ID NO: 3105030 - RNA, 14 nt, Molluscum contagiosum virus
gcaggcgugcucag

SEQ ID NO: 3105031 - RNA, 20 nt, Molluscum contagiosum virus
gcagggaaagagcacgcgcu

SEQ ID NO: 3105032 - RNA, 22 nt, Molluscum contagiosum virus
gcagggaaagagcacgcgcucg

SEQ ID NO: 3105033 - RNA, 16 nt, Molluscum contagiosum virus
gcagggagcugcggac

SEQ ID NO: 3105034 - RNA, 16 nt, Molluscum contagiosum virus
gcagggcccgcgcucg

SEQ ID NO: 3105035 - RNA, 17 nt, Molluscum contagiosum virus
gcagggcccgcgcucgc

SEQ ID NO: 3105036 - RNA, 23 nt, Molluscum contagiosum virus
gagaacgcaagcguacgcgucgc

SEQ ID NO: 3105037 - RNA, 15 nt, Molluscum contagiosum virus
gagaacucgcgugcc

SEQ ID NO: 3105038 - RNA, 15 nt, Molluscum contagiosum virus
gacucuggaagccuu

SEQ ID NO: 3105039 - RNA, 20 nt, Molluscum contagiosum virus
gacuugcugcggagcgccuu

SEQ ID NO: 3105040 - RNA, 17 nt, Molluscum contagiosum virus
gacuugugcccaugucc

SEQ ID NO: 3105041 - RNA, 18 nt, Molluscum contagiosum virus
gacuuuguccugagccuu

SEQ ID NO: 3105042 - RNA, 16 nt, Molluscum contagiosum virus
gagaaagacgucccgc

SEQ ID NO: 3105043 - RNA, 17 nt, Molluscum contagiosum virus
gagaagaugcugcgcgu

SEQ ID NO: 3105044 - RNA, 18 nt, Molluscum contagiosum virus
gagaagcaaugcgcaagg

SEQ ID NO: 3105045 - RNA, 18 nt, Molluscum contagiosum virus
gagacaucaucgcggagc

SEQ ID NO: 3105046 - RNA, 12 nt, Molluscum contagiosum virus
gagaccagccgc

SEQ ID NO: 3105047 - RNA, 18 nt, Molluscum contagiosum virus
gagaccagccgcgagcgc

SEQ ID NO: 3105048 - RNA, 14 nt, Molluscum contagiosum virus
gagacgcggccgcg

SEQ ID NO: 3105049 - RNA, 20 nt, Molluscum contagiosum virus
gagaccgucaaccugcugcc

SEQ ID NO: 3105050 - RNA, 16 nt, Molluscum contagiosum virus
gagacgugcggcacgc

SEQ ID NO: 3105051 - RNA, 14 nt, Molluscum contagiosum virus
gagacguugccgga

SEQ ID NO: 3105052 - RNA, 14 nt, Molluscum contagiosum virus
gagacuucuugcac

SEQ ID NO: 3105053 - RNA, 13 nt, Molluscum contagiosum virus
gagagcgcgcgca

SEQ ID NO: 3105054 - RNA, 19 nt, Molluscum contagiosum virus
gagagcguacucgggccgc

SEQ ID NO: 3105055 - RNA, 23 nt, Molluscum contagiosum virus
gagacgcugccggcaacgcugcc

SEQ ID NO: 3105056 - RNA, 16 nt, Molluscum contagiosum virus
gcagcuucugcucgcg

SEQ ID NO: 3105057 - RNA, 19 nt, Molluscum contagiosum virus
gcagcuucuuggagcccuu

SEQ ID NO: 3105058 - RNA, 18 nt, Molluscum contagiosum virus
gcagcucggcgagagcgc

SEQ ID NO: 3105059 - RNA, 17 nt, Molluscum contagiosum virus
gcagcucugcagcgccg

SEQ ID NO: 3105060 - RNA, 18 nt, Molluscum contagiosum virus
gcaggauuuccucgcgga

SEQ ID NO: 3105061 - RNA, 18 nt, Molluscum contagiosum virus
gcaggcaaagcggggcgc

SEQ ID NO: 3105062 - RNA, 17 nt, Molluscum contagiosum virus
gcaggcacgacgccgac

SEQ ID NO: 3105063 - RNA, 18 nt, Molluscum contagiosum virus
gcaggcacgacgccgaca

SEQ ID NO: 3105064 - RNA, 17 nt, Molluscum contagiosum virus
gcaggaaccgcgugcgc

SEQ ID NO: 3105065 - RNA, 17 nt, Molluscum contagiosum virus
gcaggaacgcgcgcucg

SEQ ID NO: 3105066 - RNA, 17 nt, Molluscum contagiosum virus
gcaggaagcuggcgcgg

SEQ ID NO: 3105067 - RNA, 18 nt, Molluscum contagiosum virus
gcaggaccuggcuggcgc

SEQ ID NO: 3105068 - RNA, 17 nt, Molluscum contagiosum virus
gcaggagcacgccuggc

SEQ ID NO: 3105069 - RNA, 19 nt, Molluscum contagiosum virus
gcaggagcacgccuggcgg

SEQ ID NO: 3105070 - RNA, 14 nt, Molluscum contagiosum virus
gagagguugcgcgg

SEQ ID NO: 3105071 - RNA, 16 nt, Molluscum contagiosum virus
gagagugacgccucga

SEQ ID NO: 3105072 - RNA, 14 nt, Molluscum contagiosum virus
gagagugcgggagc

SEQ ID NO: 3105073 - RNA, 16 nt, Molluscum contagiosum virus
gcagcuacugcgugcg

SEQ ID NO: 3105074 - RNA, 19 nt, Molluscum contagiosum virus
gcagcucaagacgcugcug

SEQ ID NO: 3105075 - RNA, 22 nt, Molluscum contagiosum virus
gcagcucaagacgcugcuggcg

SEQ ID NO: 3105076 - RNA, 12 nt, Molluscum contagiosum virus
gcagcuccgcga

SEQ ID NO: 3105077 - RNA, 18 nt, Molluscum contagiosum virus
gcagcuccuagcgcgcgu

SEQ ID NO: 3105078 - RNA, 19 nt, Molluscum contagiosum virus
gcagcugcaggaccugcug

SEQ ID NO: 3105079 - RNA, 12 nt, Molluscum contagiosum virus
gcagcugccgca

SEQ ID NO: 3105080 - RNA, 15 nt, Molluscum contagiosum virus
gcagcugcugcgcac

SEQ ID NO: 3105081 - RNA, 18 nt, Molluscum contagiosum virus
gcagcugcugcgcacgug

SEQ ID NO: 3105082 - RNA, 15 nt, Molluscum contagiosum virus
gcagcugcugcgcuc

SEQ ID NO: 3105083 - RNA, 18 nt, Molluscum contagiosum virus
gcagcuggagcugccgcu

SEQ ID NO: 3105084 - RNA, 16 nt, Molluscum contagiosum virus
gcagcuggcgcgcgcc

SEQ ID NO: 3105085 - RNA, 20 nt, Molluscum contagiosum virus
gcccgcaaugcagugcacca

SEQ ID NO: 3105086 - RNA, 13 nt, Molluscum contagiosum virus
gcccgcacacgca

SEQ ID NO: 3105087 - RNA, 15 nt, Molluscum contagiosum virus
cggcaggcucccgcu

SEQ ID NO: 3105088 - RNA, 19 nt, Molluscum contagiosum virus
cggcaggcucccgcugucg

SEQ ID NO: 3105089 - RNA, 22 nt, Molluscum contagiosum virus
cggcaggcucccgcugucgcgc

SEQ ID NO: 3105090 - RNA, 22 nt, Molluscum contagiosum virus
cggcagguuugcacccgcgcag

SEQ ID NO: 3105091 - RNA, 23 nt, Molluscum contagiosum virus
cggcagguuugcacccgcgcagc

SEQ ID NO: 3105092 - RNA, 21 nt, Molluscum contagiosum virus
cggcaguggccgucgggcgcc

SEQ ID NO: 3105093 - RNA, 15 nt, Molluscum contagiosum virus
cggcaucgcgcugcu

SEQ ID NO: 3105094 - RNA, 14 nt, Molluscum contagiosum virus
cggcaugcgcgcgc

SEQ ID NO: 3105095 - RNA, 17 nt, Molluscum contagiosum virus
cggcaugcgcgcgcagc

SEQ ID NO: 3105096 - RNA, 22 nt, Molluscum contagiosum virus
cggcaugugcgcaccgcgggcu

SEQ ID NO: 3105097 - RNA, 21 nt, Molluscum contagiosum virus
cggccacaccccguacggcgc

SEQ ID NO: 3105098 - RNA, 12 nt, Molluscum contagiosum virus
cggccaccagcg

SEQ ID NO: 3105099 - RNA, 12 nt, Molluscum contagiosum virus
cggcccgcggac

SEQ ID NO: 3105100 - RNA, 13 nt, Molluscum contagiosum virus
cggcccgcggcgc

SEQ ID NO: 3105101 - RNA, 12 nt, Molluscum contagiosum virus
cggcccgcgggc

SEQ ID NO: 3105102 - RNA, 19 nt, Molluscum contagiosum virus
cggcccgcgggcugcaaga

SEQ ID NO: 3105103 - RNA, 13 nt, Molluscum contagiosum virus
cggccgccggcgc

SEQ ID NO: 3105104 - RNA, 14 nt, Molluscum contagiosum virus
cggccacgcucgcg

SEQ ID NO: 3105105 - RNA, 13 nt, Molluscum contagiosum virus
cggccagagccca

SEQ ID NO: 3105106 - RNA, 21 nt, Molluscum contagiosum virus
cggccagcgugcagacgaccg

SEQ ID NO: 3105107 - RNA, 15 nt, Molluscum contagiosum virus
cggccauggucacgc

SEQ ID NO: 3105108 - RNA, 21 nt, Molluscum contagiosum virus
cggccguguacaugcucaagc

SEQ ID NO: 3105109 - RNA, 21 nt, Molluscum contagiosum virus
cggccguguccuacacgccgc

SEQ ID NO: 3105110 - RNA, 19 nt, Molluscum contagiosum virus
cggccggauugccgcagcc

SEQ ID NO: 3105111 - RNA, 22 nt, Molluscum contagiosum virus
cggccgcgagacgcagacgacg

SEQ ID NO: 3105112 - RNA, 13 nt, Molluscum contagiosum virus
cggccguugccgg

SEQ ID NO: 3105113 - RNA, 19 nt, Molluscum contagiosum virus
cggccugcccugcucaugc

SEQ ID NO: 3105114 - RNA, 17 nt, Molluscum contagiosum virus
cggccuagagcuggcac

SEQ ID NO: 3105115 - RNA, 19 nt, Molluscum contagiosum virus
cggccuccagcagcggcgc

SEQ ID NO: 3105116 - RNA, 18 nt, Molluscum contagiosum virus
cggcgcaagcaccggcag

SEQ ID NO: 3105117 - RNA, 15 nt, Molluscum contagiosum virus
cggcgcaaucucgcg

SEQ ID NO: 3105118 - RNA, 20 nt, Molluscum contagiosum virus
cggcgcacacuccucggcgc

SEQ ID NO: 3105119 - RNA, 14 nt, Molluscum contagiosum virus
cggcgauguacgcg

SEQ ID NO: 3105120 - RNA, 16 nt, Molluscum contagiosum virus
cggcgauguacgcgug

SEQ ID NO: 3105121 - RNA, 19 nt, Molluscum contagiosum virus
cggcgauguacgcgugcag

SEQ ID NO: 3105122 - RNA, 15 nt, Molluscum contagiosum virus
cggcgccaccggcag

SEQ ID NO: 3105123 - RNA, 14 nt, Molluscum contagiosum virus
cggcgccacgagcg

SEQ ID NO: 3105124 - RNA, 17 nt, Molluscum contagiosum virus
cggcgcccaggaacagu

SEQ ID NO: 3105125 - RNA, 11 nt, Molluscum contagiosum virus
cggcgcccgca

SEQ ID NO: 3105126 - RNA, 15 nt, Molluscum contagiosum virus
cggcgcccgcgugca

SEQ ID NO: 3105127 - RNA, 17 nt, Molluscum contagiosum virus
cggcgcccggugccagc

SEQ ID NO: 3105128 - RNA, 23 nt, Molluscum contagiosum virus
cggcgccgacaacgugcugcuca

SEQ ID NO: 3105129 - RNA, 22 nt, Molluscum contagiosum virus
cggcgagcgcauucgcgcgccc

SEQ ID NO: 3105130 - RNA, 13 nt, Molluscum contagiosum virus
cggcgagcgccgc

SEQ ID NO: 3105131 - RNA, 18 nt, Molluscum contagiosum virus
cggcgagcgccgcucgca

SEQ ID NO: 3105132 - RNA, 14 nt, Molluscum contagiosum virus
cggcgagcgcgccc

SEQ ID NO: 3105133 - RNA, 19 nt, Molluscum contagiosum virus
cggcgagcugccauggcag

SEQ ID NO: 3105134 - RNA, 23 nt, Molluscum contagiosum virus
cggcgagcugccauggcagcucg

SEQ ID NO: 3105135 - RNA, 21 nt, Molluscum contagiosum virus
cggcgagaugcgagcgcgucu

SEQ ID NO: 3105136 - RNA, 15 nt, Molluscum contagiosum virus
cggccuguucuucca

SEQ ID NO: 3105137 - RNA, 21 nt, Molluscum contagiosum virus
cggcgaacaucucggcuccgc

SEQ ID NO: 3105138 - RNA, 23 nt, Molluscum contagiosum virus
cggcgaaccgacugcccgcgccc

SEQ ID NO: 3105139 - RNA, 16 nt, Molluscum contagiosum virus
cggcgacaacgacaga

SEQ ID NO: 3105140 - RNA, 22 nt, Molluscum contagiosum virus
cggcgacaacgacagagcccgg

SEQ ID NO: 3105141 - RNA, 15 nt, Molluscum contagiosum virus
cggcggcaagcgaga

SEQ ID NO: 3105142 - RNA, 12 nt, Molluscum contagiosum virus
cggcggccacgc

SEQ ID NO: 3105143 - RNA, 14 nt, Molluscum contagiosum virus
cggcggcaugcgcg

SEQ ID NO: 3105144 - RNA, 13 nt, Molluscum contagiosum virus
cggcggcuuucuc

SEQ ID NO: 3105145 - RNA, 20 nt, Molluscum contagiosum virus
cggcggcuuucucacgcccg

SEQ ID NO: 3105146 - RNA, 22 nt, Molluscum contagiosum virus
cggcggcuuucucacgcccgcg

SEQ ID NO: 3105147 - RNA, 15 nt, Molluscum contagiosum virus
cggcgggcgcgugcu

SEQ ID NO: 3105148 - RNA, 14 nt, Molluscum contagiosum virus
cggcggggcugcug

SEQ ID NO: 3105149 - RNA, 16 nt, Molluscum contagiosum virus
cggcggugcccgccaa

SEQ ID NO: 3105150 - RNA, 12 nt, Molluscum contagiosum virus
cggcggcuccgc

SEQ ID NO: 3105151 - RNA, 14 nt, Molluscum contagiosum virus
cggcggcgcgugcu

SEQ ID NO: 3105152 - RNA, 19 nt, Molluscum contagiosum virus
cggcguguuuugugucgcg

SEQ ID NO: 3105153 - RNA, 14 nt, Molluscum contagiosum virus
cggcguucgcggag

SEQ ID NO: 3105154 - RNA, 17 nt, Molluscum contagiosum virus
cggcgugugcgcgagcu

SEQ ID NO: 3105155 - RNA, 15 nt, Molluscum contagiosum virus
cggcgugugcgggcu

SEQ ID NO: 3105156 - RNA, 16 nt, Molluscum contagiosum virus
cggcguguuccggcag

SEQ ID NO: 3105157 - RNA, 22 nt, Molluscum contagiosum virus
cggcgugagcucgucgcggaag

SEQ ID NO: 3105158 - RNA, 15 nt, Molluscum contagiosum virus
cggcguccgcggcac

SEQ ID NO: 3105159 - RNA, 19 nt, Molluscum contagiosum virus
cggcguccgcggcacgcga

SEQ ID NO: 3105160 - RNA, 16 nt, Molluscum contagiosum virus
cggcguccggugcucg

SEQ ID NO: 3105161 - RNA, 19 nt, Molluscum contagiosum virus
cggcgucgaaacacugcgg

SEQ ID NO: 3105162 - RNA, 19 nt, Molluscum contagiosum virus
cggcgucgucgugaacgcg

SEQ ID NO: 3105163 - RNA, 21 nt, Molluscum contagiosum virus
cggcgccuguuuccgcucgcg

SEQ ID NO: 3105164 - RNA, 22 nt, Molluscum contagiosum virus
cggcgccuguuuccgcucgcgc

SEQ ID NO: 3105165 - RNA, 21 nt, Molluscum contagiosum virus
cggcgccuuugccacgccagc

SEQ ID NO: 3105166 - RNA, 17 nt, Molluscum contagiosum virus
cggcgcgaaaagucggg

SEQ ID NO: 3105167 - RNA, 21 nt, Molluscum contagiosum virus
cggcgagucgcgggcgcgcgc

SEQ ID NO: 3105168 - RNA, 19 nt, Molluscum contagiosum virus
cggcgcgacggcgacgcga

SEQ ID NO: 3105169 - RNA, 16 nt, Molluscum contagiosum virus
cggcgcgagaugcucg

SEQ ID NO: 3105170 - RNA, 14 nt, Molluscum contagiosum virus
cggcgcgcagcucg

SEQ ID NO: 3105171 - RNA, 15 nt, Molluscum contagiosum virus
cggcgcgccggcccg

SEQ ID NO: 3105172 - RNA, 13 nt, Molluscum contagiosum virus
cggcgcgcgccgc

SEQ ID NO: 3105173 - RNA, 16 nt, Molluscum contagiosum virus
cggcgcgcgcgcgcag

SEQ ID NO: 3105174 - RNA, 19 nt, Molluscum contagiosum virus
cggcgcgcgcgcgcaggcu

SEQ ID NO: 3105175 - RNA, 16 nt, Molluscum contagiosum virus
cggcgcgcgcgcuagc

SEQ ID NO: 3105176 - RNA, 14 nt, Molluscum contagiosum virus
cggcgcgcgcggcg

SEQ ID NO: 3105177 - RNA, 19 nt, Molluscum contagiosum virus
cggcgcuuucgcccgccgc

SEQ ID NO: 3105178 - RNA, 22 nt, Molluscum contagiosum virus
cggcgccgcuaccagcucgcgc

SEQ ID NO: 3105179 - RNA, 19 nt, Molluscum contagiosum virus
cggcgcggccuggccacgc

SEQ ID NO: 3105180 - RNA, 14 nt, Molluscum contagiosum virus
cggcgcggcuagca

SEQ ID NO: 3105181 - RNA, 15 nt, Molluscum contagiosum virus
cggcgcgggcaagca

SEQ ID NO: 3105182 - RNA, 22 nt, Molluscum contagiosum virus
cggcgcgugccagucgcgcgag

SEQ ID NO: 3105183 - RNA, 19 nt, Molluscum contagiosum virus
cggcgcgugccgcugcgcg

SEQ ID NO: 3105184 - RNA, 16 nt, Molluscum contagiosum virus
cggcgcgugcuccucg

SEQ ID NO: 3105185 - RNA, 23 nt, Molluscum contagiosum virus
cggcgcgugcugcggcugcugcc

SEQ ID NO: 3105186 - RNA, 19 nt, Molluscum contagiosum virus
cggcgcguuucggccugca

SEQ ID NO: 3105187 - RNA, 16 nt, Molluscum contagiosum virus
cggcgcuagcgcccgu

SEQ ID NO: 3105188 - RNA, 15 nt, Molluscum contagiosum virus
cggcgcuaugccgcg

SEQ ID NO: 3105189 - RNA, 14 nt, Molluscum contagiosum virus
cggcgcucacugcg

SEQ ID NO: 3105190 - RNA, 14 nt, Molluscum contagiosum virus
cggcgcugcgcgug

SEQ ID NO: 3105191 - RNA, 16 nt, Molluscum contagiosum virus
cggcucagcguggagc

SEQ ID NO: 3105192 - RNA, 20 nt, Molluscum contagiosum virus
cggcucagcguggagcaccu

SEQ ID NO: 3105193 - RNA, 14 nt, Molluscum contagiosum virus
cggcucccagcagc

SEQ ID NO: 3105194 - RNA, 15 nt, Molluscum contagiosum virus
cggcucugcguugcg

SEQ ID NO: 3105195 - RNA, 22 nt, Molluscum contagiosum virus
cggcugccgugcgggcgcggcg

SEQ ID NO: 3105196 - RNA, 13 nt, Molluscum contagiosum virus
cggcugcgccacc

SEQ ID NO: 3105197 - RNA, 16 nt, Molluscum contagiosum virus
cggcugcggcgcgacg

SEQ ID NO: 3105198 - RNA, 21 nt, Molluscum contagiosum virus
cggcuaagcucugcguuuugc

SEQ ID NO: 3105199 - RNA, 15 nt, Molluscum contagiosum virus
cggcuaggcgcggcg

SEQ ID NO: 3105200 - RNA, 13 nt, Molluscum contagiosum virus
cggcucaagaaca

SEQ ID NO: 3105201 - RNA, 17 nt, Molluscum contagiosum virus
cggcugugcccgcggcg

SEQ ID NO: 3105202 - RNA, 15 nt, Molluscum contagiosum virus
cggcuuacacacgca

SEQ ID NO: 3105203 - RNA, 14 nt, Molluscum contagiosum virus
cggcuucugcugca

SEQ ID NO: 3105204 - RNA, 17 nt, Molluscum contagiosum virus
cgggaaaacgcgcggca

SEQ ID NO: 3105205 - RNA, 20 nt, Molluscum contagiosum virus
cgggaaguguugccgccggc

SEQ ID NO: 3105206 - RNA, 21 nt, Molluscum contagiosum virus
cgggaaguguugccgccggcc

SEQ ID NO: 3105207 - RNA, 19 nt, Molluscum contagiosum virus
cgggaaugcugcgcacgcu

SEQ ID NO: 3105208 - RNA, 22 nt, Molluscum contagiosum virus
cgggacagacaucacgcguucg

SEQ ID NO: 3105209 - RNA, 22 nt, Molluscum contagiosum virus
cgggaccgcccuuguggacgcg

SEQ ID NO: 3105210 - RNA, 21 nt, Molluscum contagiosum virus
cgggaccucuuucucgcgccg

SEQ ID NO: 3105211 - RNA, 22 nt, Molluscum contagiosum virus
cgggacgagagggcgcgcgucg

SEQ ID NO: 3105212 - RNA, 17 nt, Molluscum contagiosum virus
cgggagcaacgaaccgu

SEQ ID NO: 3105213 - RNA, 21 nt, Molluscum contagiosum virus
cgggagcaagucugcgcagga

SEQ ID NO: 3105214 - RNA, 19 nt, Molluscum contagiosum virus
cgggacgcggaugccacgc

SEQ ID NO: 3105215 - RNA, 13 nt, Molluscum contagiosum virus
cgggacgcgugcc

SEQ ID NO: 3105216 - RNA, 18 nt, Molluscum contagiosum virus
cgggauacagcgcggaga

SEQ ID NO: 3105217 - RNA, 23 nt, Molluscum contagiosum virus
cgggaggcuccugccgucgcccg

SEQ ID NO: 3105218 - RNA, 19 nt, Molluscum contagiosum virus
cgggaggcucucgagcacu

SEQ ID NO: 3105219 - RNA, 21 nt, Molluscum contagiosum virus
cgggaucggacgcagacgcgc

SEQ ID NO: 3105220 - RNA, 21 nt, Molluscum contagiosum virus
cgggauggucucgcugcuggg

SEQ ID NO: 3105221 - RNA, 22 nt, Molluscum contagiosum virus
cgggauuugccgguugcgcgug

SEQ ID NO: 3105222 - RNA, 18 nt, Molluscum contagiosum virus
cgggcacauggacggcgc

SEQ ID NO: 3105223 - RNA, 20 nt, Molluscum contagiosum virus
cgggcaccggcgcucacugc

SEQ ID NO: 3105224 - RNA, 12 nt, Molluscum contagiosum virus
cgggcacgagca

SEQ ID NO: 3105225 - RNA, 15 nt, Molluscum contagiosum virus
cgggcacgagcacgu

SEQ ID NO: 3105226 - RNA, 23 nt, Molluscum contagiosum virus
cgggcacgccgcagcgcuggagc

SEQ ID NO: 3105227 - RNA, 17 nt, Molluscum contagiosum virus
cgggcacgcgcgcgccu

SEQ ID NO: 3105228 - RNA, 20 nt, Molluscum contagiosum virus
cgggcacgcucauacuccug

SEQ ID NO: 3105229 - RNA, 16 nt, Molluscum contagiosum virus
cgggcacgugcugcug

SEQ ID NO: 3105230 - RNA, 21 nt, Molluscum contagiosum virus
cgggcacgugcugcugcggcu

SEQ ID NO: 3105231 - RNA, 16 nt, Molluscum contagiosum virus
cgggcacuucucgcgc

SEQ ID NO: 3105232 - RNA, 22 nt, Molluscum contagiosum virus
cgggcacuucucgcgcgacacg

SEQ ID NO: 3105233 - RNA, 18 nt, Molluscum contagiosum virus
cgggcccaccgcgccagc

SEQ ID NO: 3105234 - RNA, 15 nt, Molluscum contagiosum virus
cgggccggcgcgccg

SEQ ID NO: 3105235 - RNA, 16 nt, Molluscum contagiosum virus
cgggccccugcgcgag

SEQ ID NO: 3105236 - RNA, 17 nt, Molluscum contagiosum virus
cgggccccugcgcgagc

SEQ ID NO: 3105237 - RNA, 18 nt, Molluscum contagiosum virus
cgggccccugcgcgagca

SEQ ID NO: 3105238 - RNA, 21 nt, Molluscum contagiosum virus
cgggccccugucgcgcacgag

SEQ ID NO: 3105239 - RNA, 14 nt, Molluscum contagiosum virus
cgggcccgacacgu

SEQ ID NO: 3105240 - RNA, 22 nt, Molluscum contagiosum virus
cgggcccgccuuuguggacgcg

SEQ ID NO: 3105241 - RNA, 22 nt, Molluscum contagiosum virus
cgggcccggguuugugcccgag

SEQ ID NO: 3105242 - RNA, 16 nt, Molluscum contagiosum virus
cgggcccgugcccgag

SEQ ID NO: 3105243 - RNA, 22 nt, Molluscum contagiosum virus
cgggcccgugcucaggccagca

SEQ ID NO: 3105244 - RNA, 18 nt, Molluscum contagiosum virus
cgggcccuucuugacgcg

SEQ ID NO: 3105245 - RNA, 16 nt, Molluscum contagiosum virus
cgggccgccgcccgcg

SEQ ID NO: 3105246 - RNA, 17 nt, Molluscum contagiosum virus
cgggccgccgcccgcga

SEQ ID NO: 3105247 - RNA, 21 nt, Molluscum contagiosum virus
aggaccucgcgcgccgccgca

SEQ ID NO: 3105248 - RNA, 14 nt, Molluscum contagiosum virus
aggacgcgcggagc

SEQ ID NO: 3105249 - RNA, 19 nt, Molluscum contagiosum virus
aggacgcguucuccaggaa

SEQ ID NO: 3105250 - RNA, 22 nt, Molluscum contagiosum virus
aggaacugcccgcgucgcgcac

SEQ ID NO: 3105251 - RNA, 17 nt, Molluscum contagiosum virus
aggacaaagucgcgcgc

SEQ ID NO: 3105252 - RNA, 16 nt, Molluscum contagiosum virus
aggacacgcgcacgcg

SEQ ID NO: 3105253 - RNA, 17 nt, Molluscum contagiosum virus
aggaagggcccgcggcu

SEQ ID NO: 3105254 - RNA, 18 nt, Molluscum contagiosum virus
aggaauguguacgacgcg

SEQ ID NO: 3105255 - RNA, 13 nt, Molluscum contagiosum virus
aggagagcggcgc

SEQ ID NO: 3105256 - RNA, 17 nt, Molluscum contagiosum virus
aggagagcggcgccccu

SEQ ID NO: 3105257 - RNA, 17 nt, Molluscum contagiosum virus
aggaugcuggugucgag

SEQ ID NO: 3105258 - RNA, 20 nt, Molluscum contagiosum virus
aggcaaaagccgccgcgcgc

SEQ ID NO: 3105259 - RNA, 14 nt, Molluscum contagiosum virus
aggagccgcccgcg

SEQ ID NO: 3105260 - RNA, 21 nt, Molluscum contagiosum virus
aggagccucuguccugcgugc

SEQ ID NO: 3105261 - RNA, 19 nt, Molluscum contagiosum virus
aggagcuccgugcugcggc

SEQ ID NO: 3105262 - RNA, 14 nt, Molluscum contagiosum virus
aggagcugcgcgag

SEQ ID NO: 3105263 - RNA, 18 nt, Molluscum contagiosum virus
aggaggccaacgccagcu

SEQ ID NO: 3105264 - RNA, 14 nt, Molluscum contagiosum virus
aggauacgcccgcg

SEQ ID NO: 3105265 - RNA, 18 nt, Molluscum contagiosum virus
aggaucacgaugugcgcg

SEQ ID NO: 3105266 - RNA, 19 nt, Molluscum contagiosum virus
agcgggcaaugggcacgcu

SEQ ID NO: 3105267 - RNA, 18 nt, Molluscum contagiosum virus
agcguacggcccgaaggc

SEQ ID NO: 3105268 - RNA, 16 nt, Molluscum contagiosum virus
agcuggcguugccgag

SEQ ID NO: 3105269 - RNA, 17 nt, Molluscum contagiosum virus
agcugguagagaacgac

SEQ ID NO: 3105270 - RNA, 15 nt, Molluscum contagiosum virus
agcuuggugcgcucg

SEQ ID NO: 3105271 - RNA, 13 nt, Molluscum contagiosum virus
aggaaacgcagca

SEQ ID NO: 3105272 - RNA, 18 nt, Molluscum contagiosum virus
aggaaaggcacccgcagg

SEQ ID NO: 3105273 - RNA, 17 nt, Molluscum contagiosum virus
agcuguaccuggugcgc

SEQ ID NO: 3105274 - RNA, 21 nt, Molluscum contagiosum virus
agcuguagcaggaucggagcg

SEQ ID NO: 3105275 - RNA, 18 nt, Molluscum contagiosum virus
agcuucaucaagcacggc

SEQ ID NO: 3105276 - RNA, 19 nt, Molluscum contagiosum virus
agcuuccucaaggcgcacg

SEQ ID NO: 3105277 - RNA, 15 nt, Molluscum contagiosum virus
agcuucggacgagcu

SEQ ID NO: 3105278 - RNA, 21 nt, Molluscum contagiosum virus
agcuucuccggaggccgcucc

SEQ ID NO: 3105279 - RNA, 22 nt, Molluscum contagiosum virus
agcgcugccugugcuacgcgag

SEQ ID NO: 3105280 - RNA, 17 nt, Molluscum contagiosum virus
agcgcuucuuccggcag

SEQ ID NO: 3105281 - RNA, 17 nt, Molluscum contagiosum virus
agcggacguggucgcgc

SEQ ID NO: 3105282 - RNA, 21 nt, Molluscum contagiosum virus
agcggagaaaaggaagcuugc

SEQ ID NO: 3105283 - RNA, 15 nt, Molluscum contagiosum virus
agcggcaagccgugc

SEQ ID NO: 3105284 - RNA, 16 nt, Molluscum contagiosum virus
agcggcgcgcgcugag

SEQ ID NO: 3105285 - RNA, 14 nt, Molluscum contagiosum virus
agcggcggacagca

SEQ ID NO: 3105286 - RNA, 18 nt, Molluscum contagiosum virus
agcgccgucucgcggaag

SEQ ID NO: 3105287 - RNA, 20 nt, Molluscum contagiosum virus
agcggcgacuugcugcggag

SEQ ID NO: 3105288 - RNA, 12 nt, Molluscum contagiosum virus
agcggcgccgac

SEQ ID NO: 3105289 - RNA, 18 nt, Molluscum contagiosum virus
agugugccugcugcgcuu

SEQ ID NO: 3105290 - RNA, 17 nt, Molluscum contagiosum virus
aguuauucucugcgcgc

SEQ ID NO: 3105291 - RNA, 19 nt, Molluscum contagiosum virus
aguucucgcguucgcguuc

SEQ ID NO: 3105292 - RNA, 19 nt, Molluscum contagiosum virus
aguucugcacagcacaggc

SEQ ID NO: 3105293 - RNA, 20 nt, Molluscum contagiosum virus
aguucgagcugcugcgcgag

SEQ ID NO: 3105294 - RNA, 15 nt, Molluscum contagiosum virus
aguuccgaucgcgag

SEQ ID NO: 3105295 - RNA, 20 nt, Molluscum contagiosum virus
aggcaccugcggcucgcacu

SEQ ID NO: 3105296 - RNA, 15 nt, Molluscum contagiosum virus
aggcagcugcugcgc

SEQ ID NO: 3105297 - RNA, 15 nt, Molluscum contagiosum virus
aggccaccucgcacg

SEQ ID NO: 3105298 - RNA, 14 nt, Molluscum contagiosum virus
aggccagcacaagc

SEQ ID NO: 3105299 - RNA, 16 nt, Molluscum contagiosum virus
aggcacuccagcgcgc

SEQ ID NO: 3105300 - RNA, 13 nt, Molluscum contagiosum virus
aggcacuccgcgc

SEQ ID NO: 3105301 - RNA, 19 nt, Molluscum contagiosum virus
aggcacucgucgcgcugcu

SEQ ID NO: 3105302 - RNA, 15 nt, Molluscum contagiosum virus
aggcagccgcggcgc

SEQ ID NO: 3105303 - RNA, 20 nt, Molluscum contagiosum virus
aggcagccgcggcgcccggu

SEQ ID NO: 3105304 - RNA, 18 nt, Molluscum contagiosum virus
aggcaaagccugcugcgc

SEQ ID NO: 3105305 - RNA, 18 nt, Molluscum contagiosum virus
aggcaaagcggggcgcgc

SEQ ID NO: 3105306 - RNA, 20 nt, Molluscum contagiosum virus
aggcaaagcggggcgcgcgc

SEQ ID NO: 3105307 - RNA, 13 nt, Molluscum contagiosum virus
aggcaagcgggcu

SEQ ID NO: 3105308 - RNA, 21 nt, Molluscum contagiosum virus
agugccgggcgccggcucugc

SEQ ID NO: 3105309 - RNA, 22 nt, Molluscum contagiosum virus
agugcgagaucgacugcgccuu

SEQ ID NO: 3105310 - RNA, 17 nt, Molluscum contagiosum virus
agugcgagccgugaccu

SEQ ID NO: 3105311 - RNA, 17 nt, Molluscum contagiosum virus
agugcgccgcgcccgcg

SEQ ID NO: 3105312 - RNA, 17 nt, Molluscum contagiosum virus
agugcacaccggcgcgc

SEQ ID NO: 3105313 - RNA, 13 nt, Molluscum contagiosum virus
agugcaccagcac

SEQ ID NO: 3105314 - RNA, 20 nt, Molluscum contagiosum virus
agugcucccgaggcgcgcuc

SEQ ID NO: 3105315 - RNA, 22 nt, Molluscum contagiosum virus
agugcccggaauuauguguagu

SEQ ID NO: 3105316 - RNA, 15 nt, Molluscum contagiosum virus
agugccgagcgugca

SEQ ID NO: 3105317 - RNA, 15 nt, Molluscum contagiosum virus
aguggccgucgcgag

SEQ ID NO: 3105318 - RNA, 15 nt, Molluscum contagiosum virus
aguggcgcucgcgag

SEQ ID NO: 3105319 - RNA, 17 nt, Molluscum contagiosum virus
agcacuguacgcacgca

SEQ ID NO: 3105320 - RNA, 21 nt, Molluscum contagiosum virus
agcacgccagguguuccugcc

SEQ ID NO: 3105321 - RNA, 15 nt, Molluscum contagiosum virus
agcacgcgugugcga

SEQ ID NO: 3105322 - RNA, 16 nt, Molluscum contagiosum virus
agcacgucuugcgcgg

SEQ ID NO: 3105323 - RNA, 21 nt, Molluscum contagiosum virus
agcacguuguucuugcgcgug

SEQ ID NO: 3105324 - RNA, 14 nt, Molluscum contagiosum virus
agcaagcgcccgcg

SEQ ID NO: 3105325 - RNA, 14 nt, Molluscum contagiosum virus
agcacaccgucgcg

SEQ ID NO: 3105326 - RNA, 21 nt, Molluscum contagiosum virus
agcaccgccugcugcagcucc

SEQ ID NO: 3105327 - RNA, 15 nt, Molluscum contagiosum virus
agcaccugcgcuucc

SEQ ID NO: 3105328 - RNA, 16 nt, Molluscum contagiosum virus
agcacgacggucuucc

SEQ ID NO: 3105329 - RNA, 23 nt, Molluscum contagiosum virus
agcagcucggcgagagcgcgcag

SEQ ID NO: 3105330 - RNA, 20 nt, Molluscum contagiosum virus
agcagcugcugcgcacgugc

SEQ ID NO: 3105331 - RNA, 18 nt, Molluscum contagiosum virus
agcagcugcugcgcuucg

SEQ ID NO: 3105332 - RNA, 19 nt, Molluscum contagiosum virus
agcaggacgacgacacagc

SEQ ID NO: 3105333 - RNA, 15 nt, Molluscum contagiosum virus
agcaggugcacgugc

SEQ ID NO: 3105334 - RNA, 16 nt, Molluscum contagiosum virus
agcagguucucgcaca

SEQ ID NO: 3105335 - RNA, 15 nt, Molluscum contagiosum virus
agcagugccgcucgc

SEQ ID NO: 3105336 - RNA, 17 nt, Molluscum contagiosum virus
agcagccccgacgccag

SEQ ID NO: 3105337 - RNA, 14 nt, Molluscum contagiosum virus
agcagcgcgcgcag

SEQ ID NO: 3105338 - RNA, 15 nt, Molluscum contagiosum virus
agcagcggcgcgugc

SEQ ID NO: 3105339 - RNA, 19 nt, Molluscum contagiosum virus
agcagcggucucggcagca

SEQ ID NO: 3105340 - RNA, 19 nt, Molluscum contagiosum virus
agcagcuccagcauggcgc

SEQ ID NO: 3105341 - RNA, 23 nt, Molluscum contagiosum virus
agcaugccgccgcguacgcgccg

SEQ ID NO: 3105342 - RNA, 19 nt, Molluscum contagiosum virus
agccacgaagagucgcgcc

SEQ ID NO: 3105343 - RNA, 23 nt, Molluscum contagiosum virus
agcgccagcuuggugcgcucgag

SEQ ID NO: 3105344 - RNA, 15 nt, Molluscum contagiosum virus
agcgcgugccgcucg

SEQ ID NO: 3105345 - RNA, 11 nt, Molluscum contagiosum virus
agcgcgugucu

SEQ ID NO: 3105346 - RNA, 17 nt, Molluscum contagiosum virus
agcgcguucgcgcgugc

SEQ ID NO: 3105347 - RNA, 20 nt, Molluscum contagiosum virus
agcgcguucgcgcgugcugg

SEQ ID NO: 3105348 - RNA, 15 nt, Molluscum contagiosum virus
agcgccgccaugcug

SEQ ID NO: 3105349 - RNA, 21 nt, Molluscum contagiosum virus
agcgccgccaugcugcgcgag

SEQ ID NO: 3105350 - RNA, 15 nt, Molluscum contagiosum virus
agcgccgcucgcacg

SEQ ID NO: 3105351 - RNA, 19 nt, Molluscum contagiosum virus
agcgccgcucgcacggcga

SEQ ID NO: 3105352 - RNA, 14 nt, Molluscum contagiosum virus
agcgccuugccgag

SEQ ID NO: 3105353 - RNA, 20 nt, Molluscum contagiosum virus
agcgcgaauuggccgcggag

SEQ ID NO: 3105354 - RNA, 14 nt, Molluscum contagiosum virus
agcgcgagcugugc

SEQ ID NO: 3105355 - RNA, 13 nt, Molluscum contagiosum virus
agcgcgagcuugc

SEQ ID NO: 3105356 - RNA, 20 nt, Molluscum contagiosum virus
agcgcgaguacaagcucgac

SEQ ID NO: 3105357 - RNA, 15 nt, Molluscum contagiosum virus
agcgcgcaguugugc

SEQ ID NO: 3105358 - RNA, 12 nt, Molluscum contagiosum virus
agcgcgccgcgc

SEQ ID NO: 3105359 - RNA, 17 nt, Molluscum contagiosum virus
agcgcgccgcgcgcucg

SEQ ID NO: 3105360 - RNA, 18 nt, Molluscum contagiosum virus
agcgcgccgcucgcgcuc

SEQ ID NO: 3105361 - RNA, 14 nt, Molluscum contagiosum virus
agcgcgccucucga

SEQ ID NO: 3105362 - RNA, 22 nt, Molluscum contagiosum virus
agcgcgcgccgacgugcgcgug

SEQ ID NO: 3105363 - RNA, 15 nt, Molluscum contagiosum virus
agcgcgcgcugcgcg

SEQ ID NO: 3105364 - RNA, 13 nt, Molluscum contagiosum virus
agcgcgcugcaca

SEQ ID NO: 3105365 - RNA, 13 nt, Molluscum contagiosum virus
agcgcgcugcgcc

SEQ ID NO: 3105366 - RNA, 14 nt, Molluscum contagiosum virus
agcgcgcugcgccg

SEQ ID NO: 3105367 - RNA, 15 nt, Molluscum contagiosum virus
agcgcgcuggacuug

SEQ ID NO: 3105368 - RNA, 21 nt, Molluscum contagiosum virus
agcgcgcuggacuugcgcgag

SEQ ID NO: 3105369 - RNA, 14 nt, Molluscum contagiosum virus
agcgcggagcuggc

SEQ ID NO: 3105370 - RNA, 19 nt, Molluscum contagiosum virus
agcgcggcaacagcacgac

SEQ ID NO: 3105371 - RNA, 16 nt, Molluscum contagiosum virus
agcgcggccgcgcucg

SEQ ID NO: 3105372 - RNA, 18 nt, Molluscum contagiosum virus
agcgcggccgcgcucguc

SEQ ID NO: 3105373 - RNA, 14 nt, Molluscum contagiosum virus
agaucaacgcgcgc

SEQ ID NO: 3105374 - RNA, 12 nt, Molluscum contagiosum virus
agaucacggcgu

SEQ ID NO: 3105375 - RNA, 18 nt, Molluscum contagiosum virus
agaucaggcagcugcugc

SEQ ID NO: 3105376 - RNA, 18 nt, Molluscum contagiosum virus
agagcuggcaccgggcgc

SEQ ID NO: 3105377 - RNA, 14 nt, Molluscum contagiosum virus
agaggaaagcgcac

SEQ ID NO: 3105378 - RNA, 17 nt, Molluscum contagiosum virus
agaugcgagcgcgucug

SEQ ID NO: 3105379 - RNA, 15 nt, Molluscum contagiosum virus
acgacccucuucgac

SEQ ID NO: 3105380 - RNA, 22 nt, Molluscum contagiosum virus
acgaccgcaagugcacgcggcg

SEQ ID NO: 3105381 - RNA, 23 nt, Molluscum contagiosum virus
acgaccgcaagugcacgcggcgc

SEQ ID NO: 3105382 - RNA, 18 nt, Molluscum contagiosum virus
acgaccgcgcacgcagca

SEQ ID NO: 3105383 - RNA, 22 nt, Molluscum contagiosum virus
agagcucguggacagccugcac

SEQ ID NO: 3105384 - RNA, 13 nt, Molluscum contagiosum virus
acgacggcacgcu

SEQ ID NO: 3105385 - RNA, 15 nt, Molluscum contagiosum virus
acgacggcugcucgc

SEQ ID NO: 3105386 - RNA, 20 nt, Molluscum contagiosum virus
agagcgguuccugcuucucg

SEQ ID NO: 3105387 - RNA, 19 nt, Molluscum contagiosum virus
agagcguccagccgcagcc

SEQ ID NO: 3105388 - RNA, 16 nt, Molluscum contagiosum virus
agagcuccccgcgcgc

SEQ ID NO: 3105389 - RNA, 21 nt, Molluscum contagiosum virus
agagcuccccgcgcgcagcgc

SEQ ID NO: 3105390 - RNA, 15 nt, Molluscum contagiosum virus
acgacaugcucgcgc

SEQ ID NO: 3105391 - RNA, 16 nt, Molluscum contagiosum virus
acgacaugcugugcgg

SEQ ID NO: 3105392 - RNA, 22 nt, Molluscum contagiosum virus
acgacaugcugugcggcacgcc

SEQ ID NO: 3105393 - RNA, 14 nt, Molluscum contagiosum virus
acgaacgcugcagc

SEQ ID NO: 3105394 - RNA, 23 nt, Molluscum contagiosum virus
acgaacaugggguuucggaacgc

SEQ ID NO: 3105395 - RNA, 15 nt, Molluscum contagiosum virus
acgaaccgugcgagc

SEQ ID NO: 3105396 - RNA, 17 nt, Molluscum contagiosum virus
acgaacgacagcgccgc

SEQ ID NO: 3105397 - RNA, 20 nt, Molluscum contagiosum virus
acgaaucgccgucuuuacgu

SEQ ID NO: 3105398 - RNA, 18 nt, Molluscum contagiosum virus
acgacaauacggugcagc

SEQ ID NO: 3105399 - RNA, 20 nt, Molluscum contagiosum virus
acgacacagcccuggacgac

SEQ ID NO: 3105400 - RNA, 13 nt, Molluscum contagiosum virus
acgacacuggcgc

SEQ ID NO: 3105401 - RNA, 20 nt, Molluscum contagiosum virus
acgacagcgccgccaccucg

SEQ ID NO: 3105402 - RNA, 12 nt, Molluscum contagiosum virus
accuggccuucg

SEQ ID NO: 3105403 - RNA, 14 nt, Molluscum contagiosum virus
accugggcgucgug

SEQ ID NO: 3105404 - RNA, 14 nt, Molluscum contagiosum virus
accugucgcgcgag

SEQ ID NO: 3105405 - RNA, 19 nt, Molluscum contagiosum virus
accugcucgggcugcgcgg

SEQ ID NO: 3105406 - RNA, 14 nt, Molluscum contagiosum virus
accuggaacgcgag

SEQ ID NO: 3105407 - RNA, 17 nt, Molluscum contagiosum virus
accugucggagcaggac

SEQ ID NO: 3105408 - RNA, 18 nt, Molluscum contagiosum virus
accuucaggacgcaggac

SEQ ID NO: 3105409 - RNA, 19 nt, Molluscum contagiosum virus
accuguucuuucagcgcgc

SEQ ID NO: 3105410 - RNA, 23 nt, Molluscum contagiosum virus
accuguucuuucagcgcgcgcag

SEQ ID NO: 3105411 - RNA, 14 nt, Molluscum contagiosum virus
accuuccugggcgg

SEQ ID NO: 3105412 - RNA, 16 nt, Molluscum contagiosum virus
aauguguacgacgcgc

SEQ ID NO: 3105413 - RNA, 13 nt, Molluscum contagiosum virus
aauuccgugucgu

SEQ ID NO: 3105414 - RNA, 20 nt, Molluscum contagiosum virus
acaacaaguuccccgugagc

SEQ ID NO: 3105415 - RNA, 16 nt, Molluscum contagiosum virus
acaaggaggcuuucuu

SEQ ID NO: 3105416 - RNA, 21 nt, Molluscum contagiosum virus
acaagucgucgaucgccucga

SEQ ID NO: 3105417 - RNA, 18 nt, Molluscum contagiosum virus
acaaucucugcgccgcgc

SEQ ID NO: 3105418 - RNA, 16 nt, Molluscum contagiosum virus
acacauggccgcgcgc

SEQ ID NO: 3105419 - RNA, 12 nt, Molluscum contagiosum virus
acaccaugcagc

SEQ ID NO: 3105420 - RNA, 12 nt, Molluscum contagiosum virus
acacacucgcgc

SEQ ID NO: 3105421 - RNA, 16 nt, Molluscum contagiosum virus
acacacucgcgcgucc

SEQ ID NO: 3105422 - RNA, 20 nt, Molluscum contagiosum virus
acaccuggcgagcgcucugc

SEQ ID NO: 3105423 - RNA, 13 nt, Molluscum contagiosum virus
accagcugccgcu

SEQ ID NO: 3105424 - RNA, 16 nt, Molluscum contagiosum virus
accaguacaucaccgc

SEQ ID NO: 3105425 - RNA, 13 nt, Molluscum contagiosum virus
accagugcgccuc

SEQ ID NO: 3105426 - RNA, 14 nt, Molluscum contagiosum virus
accaucaucgcgcu

SEQ ID NO: 3105427 - RNA, 20 nt, Molluscum contagiosum virus
accaugcggcguacgcgcag

SEQ ID NO: 3105428 - RNA, 23 nt, Molluscum contagiosum virus
acaccgagaucaugggcgugcuc

SEQ ID NO: 3105429 - RNA, 19 nt, Molluscum contagiosum virus
acaacucauagcgccacga

SEQ ID NO: 3105430 - RNA, 16 nt, Molluscum contagiosum virus
acaacucugcucgugc

SEQ ID NO: 3105431 - RNA, 15 nt, Molluscum contagiosum virus
acaagaagcgcuucu

SEQ ID NO: 3105432 - RNA, 23 nt, Molluscum contagiosum virus
acaagaagcgcuucuuugcgcgc

SEQ ID NO: 3105433 - RNA, 22 nt, Molluscum contagiosum virus
acaagcguaagccaccgcgcag

SEQ ID NO: 3105434 - RNA, 16 nt, Molluscum contagiosum virus
acaagcguguucgugc

SEQ ID NO: 3105435 - RNA, 19 nt, Molluscum contagiosum virus
acaagcugcaccggcgcga

SEQ ID NO: 3105436 - RNA, 16 nt, Molluscum contagiosum virus
acaaagggguccgcgu

SEQ ID NO: 3105437 - RNA, 22 nt, Molluscum contagiosum virus
accugauuuucccgggcggcgc

SEQ ID NO: 3105438 - RNA, 18 nt, Molluscum contagiosum virus
accugcacgagccggcgc

SEQ ID NO: 3105439 - RNA, 22 nt, Molluscum contagiosum virus
acccuggcugcugcgcgaccgc

SEQ ID NO: 3105440 - RNA, 18 nt, Molluscum contagiosum virus
accucugagcgagcgcag

SEQ ID NO: 3105441 - RNA, 23 nt, Molluscum contagiosum virus
accugcaggaaaggcacccgcag

SEQ ID NO: 3105442 - RNA, 22 nt, Molluscum contagiosum virus
accugcaggcucuaagcgcacg

SEQ ID NO: 3105443 - RNA, 19 nt, Molluscum contagiosum virus
accugcauugagcucgcgc

SEQ ID NO: 3105444 - RNA, 17 nt, Molluscum contagiosum virus
accugcgcaacgugcug

SEQ ID NO: 3105445 - RNA, 17 nt, Molluscum contagiosum virus
accugcggcugcggcgc

SEQ ID NO: 3105446 - RNA, 21 nt, Molluscum contagiosum virus
acccucgcaagcugagcgcgc

SEQ ID NO: 3105447 - RNA, 23 nt, Molluscum contagiosum virus
acccucgcaagcugagcgcgcug

SEQ ID NO: 3105448 - RNA, 13 nt, Molluscum contagiosum virus
acccggcacgugc

SEQ ID NO: 3105449 - RNA, 16 nt, Molluscum contagiosum virus
acccggcucgcucauc

SEQ ID NO: 3105450 - RNA, 22 nt, Molluscum contagiosum virus
acccgcgcucgacgcgugcaug

SEQ ID NO: 3105451 - RNA, 17 nt, Molluscum contagiosum virus
acccgugcccgcuccgc

SEQ ID NO: 3105452 - RNA, 18 nt, Molluscum contagiosum virus
acccgugcgcgcgcugag

SEQ ID NO: 3105453 - RNA, 18 nt, Molluscum contagiosum virus
accccaagaagaacgucu

SEQ ID NO: 3105454 - RNA, 18 nt, Molluscum contagiosum virus
acccaucggagaagugcu

SEQ ID NO: 3105455 - RNA, 22 nt, Molluscum contagiosum virus
accccagugcgagaucgacugc

SEQ ID NO: 3105456 - RNA, 21 nt, Molluscum contagiosum virus
accccgagcugcggcgcgugc

SEQ ID NO: 3105457 - RNA, 13 nt, Molluscum contagiosum virus
accccgagggcgc

SEQ ID NO: 3105458 - RNA, 20 nt, Molluscum contagiosum virus
accccuugcuacaggacguc

SEQ ID NO: 3105459 - RNA, 10 nt, Molluscum contagiosum virus
accccgccgc

SEQ ID NO: 3105460 - RNA, 13 nt, Molluscum contagiosum virus
accccgccgcgua

SEQ ID NO: 3105461 - RNA, 21 nt, Molluscum contagiosum virus
acccgcaggaaaggcaccccg

SEQ ID NO: 3105462 - RNA, 23 nt, Molluscum contagiosum virus
acccgcaggaaagguacccgcag

SEQ ID NO: 3105463 - RNA, 14 nt, Molluscum contagiosum virus
accccgcugggccg

SEQ ID NO: 3105464 - RNA, 22 nt, Molluscum contagiosum virus
ccacaccgggaauggccgcgag

SEQ ID NO: 3105465 - RNA, 23 nt, Molluscum contagiosum virus
ccacaggcgcgaacucgcggcag

SEQ ID NO: 3105466 - RNA, 22 nt, Molluscum contagiosum virus
ccacauuucaaaaacgcgcccc

SEQ ID NO: 3105467 - RNA, 15 nt, Molluscum contagiosum virus
ccacaaagacgggcc

SEQ ID NO: 3105468 - RNA, 13 nt, Molluscum contagiosum virus
ccaagugcgcgug

SEQ ID NO: 3105469 - RNA, 20 nt, Molluscum contagiosum virus
ccaaggccgcgggcgcggag

SEQ ID NO: 3105470 - RNA, 17 nt, Molluscum contagiosum virus
ccaaggagcugcgcgag

SEQ ID NO: 3105471 - RNA, 16 nt, Molluscum contagiosum virus
caucggcgccgccccg

SEQ ID NO: 3105472 - RNA, 17 nt, Molluscum contagiosum virus
caucggcuccgcgcccg

SEQ ID NO: 3105473 - RNA, 14 nt, Molluscum contagiosum virus
caucgggcugcagc

SEQ ID NO: 3105474 - RNA, 13 nt, Molluscum contagiosum virus
caucgggcugucg

SEQ ID NO: 3105475 - RNA, 17 nt, Molluscum contagiosum virus
ccaagcucuggcuugcg

SEQ ID NO: 3105476 - RNA, 19 nt, Molluscum contagiosum virus
ccacgccgucgaaguacuu

SEQ ID NO: 3105477 - RNA, 18 nt, Molluscum contagiosum virus
ccacgcgcaugaggcggc

SEQ ID NO: 3105478 - RNA, 11 nt, Molluscum contagiosum virus
ccacgcgcccg

SEQ ID NO: 3105479 - RNA, 13 nt, Molluscum contagiosum virus
ccacgcgggcccg

SEQ ID NO: 3105480 - RNA, 14 nt, Molluscum contagiosum virus
ccacgcgggcccgu

SEQ ID NO: 3105481 - RNA, 13 nt, Molluscum contagiosum virus
ccacgcgugcgcg

SEQ ID NO: 3105482 - RNA, 14 nt, Molluscum contagiosum virus
ccacgcgugcugcg

SEQ ID NO: 3105483 - RNA, 13 nt, Molluscum contagiosum virus
ccacgagcgccgc

SEQ ID NO: 3105484 - RNA, 22 nt, Molluscum contagiosum virus
ccacgagcgccgcgugcgcgcg

SEQ ID NO: 3105485 - RNA, 16 nt, Molluscum contagiosum virus
ccacgacauggaccgc

SEQ ID NO: 3105486 - RNA, 14 nt, Molluscum contagiosum virus
ccacgcagcuggcg

SEQ ID NO: 3105487 - RNA, 21 nt, Molluscum contagiosum virus
ccacgcccgagggcgggcacg

SEQ ID NO: 3105488 - RNA, 16 nt, Molluscum contagiosum virus
ccaccguggaggagcc

SEQ ID NO: 3105489 - RNA, 19 nt, Molluscum contagiosum virus
ccaccuggaaaagcgcgag

SEQ ID NO: 3105490 - RNA, 19 nt, Molluscum contagiosum virus
ccacgaacgacagcgccgc

SEQ ID NO: 3105491 - RNA, 17 nt, Molluscum contagiosum virus
ccacgaagaacgcggcg

SEQ ID NO: 3105492 - RNA, 15 nt, Molluscum contagiosum virus
ccaccuucaggacgc

SEQ ID NO: 3105493 - RNA, 17 nt, Molluscum contagiosum virus
ccaccacguggaccuga

SEQ ID NO: 3105494 - RNA, 14 nt, Molluscum contagiosum virus
ccaccgcggcgcgg

SEQ ID NO: 3105495 - RNA, 13 nt, Molluscum contagiosum virus
auucccguggacc

SEQ ID NO: 3105496 - RNA, 19 nt, Molluscum contagiosum virus
auucgcgcgcccccgcaaa

SEQ ID NO: 3105497 - RNA, 20 nt, Molluscum contagiosum virus
auucggcguacgugcgccag

SEQ ID NO: 3105498 - RNA, 14 nt, Molluscum contagiosum virus
auugccacgcaaaa

SEQ ID NO: 3105499 - RNA, 20 nt, Molluscum contagiosum virus
auuucguugauuugcgcacc

SEQ ID NO: 3105500 - RNA, 20 nt, Molluscum contagiosum virus
auuacgcugccgugagcacg

SEQ ID NO: 3105501 - RNA, 18 nt, Molluscum contagiosum virus
auucacuuucgucgccuc

SEQ ID NO: 3105502 - RNA, 19 nt, Molluscum contagiosum virus
auacaccggcuuggccaag

SEQ ID NO: 3105503 - RNA, 15 nt, Molluscum contagiosum virus
auguugugcucgugu

SEQ ID NO: 3105504 - RNA, 16 nt, Molluscum contagiosum virus
augugcuggucaagaa

SEQ ID NO: 3105505 - RNA, 14 nt, Molluscum contagiosum virus
cauccgcgagcacc

SEQ ID NO: 3105506 - RNA, 14 nt, Molluscum contagiosum virus
cauccuccacgcug

SEQ ID NO: 3105507 - RNA, 14 nt, Molluscum contagiosum virus
cauccggcacgcac

SEQ ID NO: 3105508 - RNA, 16 nt, Molluscum contagiosum virus
cauccggccgaggcac

SEQ ID NO: 3105509 - RNA, 15 nt, Molluscum contagiosum virus
caucgacgagcacga

SEQ ID NO: 3105510 - RNA, 13 nt, Molluscum contagiosum virus
caucgcgcugcug

SEQ ID NO: 3105511 - RNA, 15 nt, Molluscum contagiosum virus
caucgcgcugcuggu

SEQ ID NO: 3105512 - RNA, 17 nt, Molluscum contagiosum virus
caucgcggagcugcgcg

SEQ ID NO: 3105513 - RNA, 21 nt, Molluscum contagiosum virus
caucggagaagugcuccgcac

SEQ ID NO: 3105514 - RNA, 17 nt, Molluscum contagiosum virus
cauccagccgucgccgc

SEQ ID NO: 3105515 - RNA, 22 nt, Molluscum contagiosum virus
cauccagccgucgccgcgcccg

SEQ ID NO: 3105516 - RNA, 18 nt, Molluscum contagiosum virus
caucaucgccagcaucaa

SEQ ID NO: 3105517 - RNA, 15 nt, Molluscum contagiosum virus
cauacuccugcuggc

SEQ ID NO: 3105518 - RNA, 14 nt, Molluscum contagiosum virus
cauagcgccacgag

SEQ ID NO: 3105519 - RNA, 19 nt, Molluscum contagiosum virus
auuucuuuuuccgggacgc

SEQ ID NO: 3105520 - RNA, 14 nt, Molluscum contagiosum virus
aacccucgcaagcu

SEQ ID NO: 3105521 - RNA, 17 nt, Molluscum contagiosum virus
aaccuacuugcucgugu

SEQ ID NO: 3105522 - RNA, 15 nt, Molluscum contagiosum virus
aaccgcgugcgcagu

SEQ ID NO: 3105523 - RNA, 17 nt, Molluscum contagiosum virus
aaccagcuggcgcccgc

SEQ ID NO: 3105524 - RNA, 22 nt, Molluscum contagiosum virus
aacagcuuggcacagugcugga

SEQ ID NO: 3105525 - RNA, 22 nt, Molluscum contagiosum virus
aacggcggcgcaagcgcaagcc

SEQ ID NO: 3105526 - RNA, 14 nt, Molluscum contagiosum virus
aaccugggcgccgc

SEQ ID NO: 3105527 - RNA, 14 nt, Molluscum contagiosum virus
aacgacuagcgugc

SEQ ID NO: 3105528 - RNA, 13 nt, Molluscum contagiosum virus
aacgacgggcgcg

SEQ ID NO: 3105529 - RNA, 17 nt, Molluscum contagiosum virus
aacgcgagacgggcacg

SEQ ID NO: 3105530 - RNA, 19 nt, Molluscum contagiosum virus
aacgcgaggccggccgugc

SEQ ID NO: 3105531 - RNA, 19 nt, Molluscum contagiosum virus
aacgcgcaagugugcgcau

SEQ ID NO: 3105532 - RNA, 16 nt, Molluscum contagiosum virus
aacgcgcgcgccucgc

SEQ ID NO: 3105533 - RNA, 14 nt, Molluscum contagiosum virus
aacgcgcgcucguc

SEQ ID NO: 3105534 - RNA, 22 nt, Molluscum contagiosum virus
aacgcgcgcucgucaaugcgca

SEQ ID NO: 3105535 - RNA, 15 nt, Molluscum contagiosum virus
aacgcgcgugcgcgu

SEQ ID NO: 3105536 - RNA, 17 nt, Molluscum contagiosum virus
aacgcggcgugugcggg

SEQ ID NO: 3105537 - RNA, 12 nt, Molluscum contagiosum virus
aacgcugccgcu

SEQ ID NO: 3105538 - RNA, 15 nt, Molluscum contagiosum virus
ucggcguacgugcgc

SEQ ID NO: 3105539 - RNA, 23 nt, Molluscum contagiosum virus
ucggcuuggacagcaagcagcgc

SEQ ID NO: 3105540 - RNA, 17 nt, Molluscum contagiosum virus
ucggcggcagcgccagc

SEQ ID NO: 3105541 - RNA, 15 nt, Molluscum contagiosum virus
ucggcggcaugcgcg

SEQ ID NO: 3105542 - RNA, 17 nt, Molluscum contagiosum virus
ucggcggcugugcccgc

SEQ ID NO: 3105543 - RNA, 18 nt, Molluscum contagiosum virus
ucggcgcgccgucucgcg

SEQ ID NO: 3105544 - RNA, 22 nt, Molluscum contagiosum virus
ucggcgcuacgcacuucacggc

SEQ ID NO: 3105545 - RNA, 21 nt, Molluscum contagiosum virus
ucggcgcuaugccgcgugcuc

SEQ ID NO: 3105546 - RNA, 17 nt, Molluscum contagiosum virus
ucggcgacacgcccgcg

SEQ ID NO: 3105547 - RNA, 14 nt, Molluscum contagiosum virus
ucggcagcgucgcg

SEQ ID NO: 3105548 - RNA, 17 nt, Molluscum contagiosum virus
ucggagcaggacgacga

SEQ ID NO: 3105549 - RNA, 12 nt, Molluscum contagiosum virus
ucggcaccgcgc

SEQ ID NO: 3105550 - RNA, 14 nt, Molluscum contagiosum virus
ucggagaagugcuc

SEQ ID NO: 3105551 - RNA, 18 nt, Molluscum contagiosum virus
ucggacagugccuccgcg

SEQ ID NO: 3105552 - RNA, 20 nt, Molluscum contagiosum virus
ucggacgcagacgcgcgucc

SEQ ID NO: 3105553 - RNA, 21 nt, Molluscum contagiosum virus
ucgcugcugggcaucgugcuc

SEQ ID NO: 3105554 - RNA, 20 nt, Molluscum contagiosum virus
ucgcuugccggcggcgcaag

SEQ ID NO: 3105555 - RNA, 15 nt, Molluscum contagiosum virus
ucgcugcacgcgaau

SEQ ID NO: 3105556 - RNA, 18 nt, Molluscum contagiosum virus
ucgcugcgcaggugcacg

SEQ ID NO: 3105557 - RNA, 18 nt, Molluscum contagiosum virus
ucgcugcuccccgccagc

SEQ ID NO: 3105558 - RNA, 20 nt, Molluscum contagiosum virus
ucgcguaccaagccgugacg

SEQ ID NO: 3105559 - RNA, 22 nt, Molluscum contagiosum virus
ucgcguagcagcgccugcacgc

SEQ ID NO: 3105560 - RNA, 22 nt, Molluscum contagiosum virus
ucgcguccacgaugcgcucgug

SEQ ID NO: 3105561 - RNA, 23 nt, Molluscum contagiosum virus
ucgcguggugcuuacugcgggcu

SEQ ID NO: 3105562 - RNA, 22 nt, Molluscum contagiosum virus
ucgcggucgacgagugcgccgc

SEQ ID NO: 3105563 - RNA, 19 nt, Molluscum contagiosum virus
ucgcgguggcaggcgcgcg

SEQ ID NO: 3105564 - RNA, 16 nt, Molluscum contagiosum virus
gguccaccugcgacgc

SEQ ID NO: 3105565 - RNA, 14 nt, Molluscum contagiosum virus
gguccuguccgcgg

SEQ ID NO: 3105566 - RNA, 17 nt, Molluscum contagiosum virus
ggucgacgacgcgcgca

SEQ ID NO: 3105567 - RNA, 18 nt, Molluscum contagiosum virus
ucgcgggcacgagcaugu

SEQ ID NO: 3105568 - RNA, 12 nt, Molluscum contagiosum virus
ucgcgggcgccg

SEQ ID NO: 3105569 - RNA, 13 nt, Molluscum contagiosum virus
ucgcgggcgcgcg

SEQ ID NO: 3105570 - RNA, 23 nt, Molluscum contagiosum virus
ggucacgcgcaaggccgcgccca

SEQ ID NO: 3105571 - RNA, 13 nt, Molluscum contagiosum virus
ggucacgcgcaca

SEQ ID NO: 3105572 - RNA, 22 nt, Molluscum contagiosum virus
gguacugaacgucuucgagagc

SEQ ID NO: 3105573 - RNA, 23 nt, Molluscum contagiosum virus
ggucaccaccaccuccagguccc

SEQ ID NO: 3105574 - RNA, 19 nt, Molluscum contagiosum virus
ggucaccacuccgucgcgc

SEQ ID NO: 3105575 - RNA, 18 nt, Molluscum contagiosum virus
gguacuggcgcccggcgc

SEQ ID NO: 3105576 - RNA, 14 nt, Molluscum contagiosum virus
gguagcgcgccgca

SEQ ID NO: 3105577 - RNA, 12 nt, Molluscum contagiosum virus
gguagcggaggc

SEQ ID NO: 3105578 - RNA, 16 nt, Molluscum contagiosum virus
ggucaacuccgagcgc

SEQ ID NO: 3105579 - RNA, 20 nt, Molluscum contagiosum virus
ggucaacuccgagcgcgcgc

SEQ ID NO: 3105580 - RNA, 21 nt, Molluscum contagiosum virus
ggucaacuccgagcgcgcgcg

SEQ ID NO: 3105581 - RNA, 21 nt, Molluscum contagiosum virus
gguacggugccguccccgcgc

SEQ ID NO: 3105582 - RNA, 17 nt, Molluscum contagiosum virus
gguacguacagugcgcg

SEQ ID NO: 3105583 - RNA, 16 nt, Molluscum contagiosum virus
gguaccgugcgcguga

SEQ ID NO: 3105584 - RNA, 16 nt, Molluscum contagiosum virus
gguaccugcaggcucu

SEQ ID NO: 3105585 - RNA, 21 nt, Molluscum contagiosum virus
gguacccgcaaccccgcgcgu

SEQ ID NO: 3105586 - RNA, 22 nt, Molluscum contagiosum virus
gguacccgcaaccccgcgcgua

SEQ ID NO: 3105587 - RNA, 13 nt, Molluscum contagiosum virus
gguacccgcagga

SEQ ID NO: 3105588 - RNA, 20 nt, Molluscum contagiosum virus
gguacaagucaucggagagc

SEQ ID NO: 3105589 - RNA, 13 nt, Molluscum contagiosum virus
gguaacgcgcgcg

SEQ ID NO: 3105590 - RNA, 14 nt, Molluscum contagiosum virus
gguaacgcgcgcgc

SEQ ID NO: 3105591 - RNA, 17 nt, Molluscum contagiosum virus
gggcgagagacagcacg

SEQ ID NO: 3105592 - RNA, 12 nt, Molluscum contagiosum virus
gggucacgcaga

SEQ ID NO: 3105593 - RNA, 15 nt, Molluscum contagiosum virus
gcgcagagcuccccg

SEQ ID NO: 3105594 - RNA, 18 nt, Molluscum contagiosum virus
gcgcagagcuccccgcgc

SEQ ID NO: 3105595 - RNA, 23 nt, Molluscum contagiosum virus
gcgcagagcuccccgcgcgcagc

SEQ ID NO: 3105596 - RNA, 18 nt, Molluscum contagiosum virus
gcgcacgggccugcgcgc

SEQ ID NO: 3105597 - RNA, 16 nt, Molluscum contagiosum virus
gcgcacguuggccacg

SEQ ID NO: 3105598 - RNA, 20 nt, Molluscum contagiosum virus
gcgcacuacucgucuugcgc

SEQ ID NO: 3105599 - RNA, 13 nt, Molluscum contagiosum virus
gcgcacugcggga

SEQ ID NO: 3105600 - RNA, 13 nt, Molluscum contagiosum virus
gcgcacugcucgc

SEQ ID NO: 3105601 - RNA, 15 nt, Molluscum contagiosum virus
gcgcagacgccgagc

SEQ ID NO: 3105602 - RNA, 23 nt, Molluscum contagiosum virus
gcgcagcaggcacuccagcgcgc

SEQ ID NO: 3105603 - RNA, 20 nt, Molluscum contagiosum virus
gcgcagcaggugcacgugcu

SEQ ID NO: 3105604 - RNA, 18 nt, Molluscum contagiosum virus
gcgcagcauucccggcgc

SEQ ID NO: 3105605 - RNA, 13 nt, Molluscum contagiosum virus
gcgcagccacgac

SEQ ID NO: 3105606 - RNA, 18 nt, Molluscum contagiosum virus
gcgcagcucgccgcgcgc

SEQ ID NO: 3105607 - RNA, 21 nt, Molluscum contagiosum virus
gcgcagcucgccgcgcgccgc

SEQ ID NO: 3105608 - RNA, 13 nt, Molluscum contagiosum virus
gcgcagcugcgcc

SEQ ID NO: 3105609 - RNA, 17 nt, Molluscum contagiosum virus
gcgcagcugcgccugca

SEQ ID NO: 3105610 - RNA, 14 nt, Molluscum contagiosum virus
gcgcagucccagca

SEQ ID NO: 3105611 - RNA, 17 nt, Molluscum contagiosum virus
gcgcagucccagcaccg

SEQ ID NO: 3105612 - RNA, 21 nt, Molluscum contagiosum virus
gcgcagucccagcaccgcgcc

SEQ ID NO: 3105613 - RNA, 19 nt, Molluscum contagiosum virus
gcgcagugccgcugagaga

SEQ ID NO: 3105614 - RNA, 13 nt, Molluscum contagiosum virus
gcgcagugcugcg

SEQ ID NO: 3105615 - RNA, 19 nt, Molluscum contagiosum virus
gcgcaguucgagcugcugc

SEQ ID NO: 3105616 - RNA, 18 nt, Molluscum contagiosum virus
gcgcgcauacgcgccgcg

SEQ ID NO: 3105617 - RNA, 19 nt, Molluscum contagiosum virus
gcgcgcaucgcgggcacgc

SEQ ID NO: 3105618 - RNA, 22 nt, Molluscum contagiosum virus
gcgcgcaucggcggcagcgcca

SEQ ID NO: 3105619 - RNA, 14 nt, Molluscum contagiosum virus
gcgcgcaugcucgc

SEQ ID NO: 3105620 - RNA, 20 nt, Molluscum contagiosum virus
gcgcgccaacgacuagcgug

SEQ ID NO: 3105621 - RNA, 21 nt, Molluscum contagiosum virus
gcgcgccaacgacuagcgugc

SEQ ID NO: 3105622 - RNA, 17 nt, Molluscum contagiosum virus
gcgcgccaagugcuccg

SEQ ID NO: 3105623 - RNA, 22 nt, Molluscum contagiosum virus
gcgcagcuguuucugccgcgcc

SEQ ID NO: 3105624 - RNA, 21 nt, Molluscum contagiosum virus
gcgcagcuucucugcgaucgc

SEQ ID NO: 3105625 - RNA, 14 nt, Molluscum contagiosum virus
gcgcaggccgcgcc

SEQ ID NO: 3105626 - RNA, 16 nt, Molluscum contagiosum virus
gcgcaggccgcgcccg

SEQ ID NO: 3105627 - RNA, 17 nt, Molluscum contagiosum virus
gcgcagggagcugcgga

SEQ ID NO: 3105628 - RNA, 14 nt, Molluscum contagiosum virus
gcgcgccagcagcg

SEQ ID NO: 3105629 - RNA, 16 nt, Molluscum contagiosum virus
gcgcgccagcagcgcc

SEQ ID NO: 3105630 - RNA, 17 nt, Molluscum contagiosum virus
gcgcgccaguacgcaug

SEQ ID NO: 3105631 - RNA, 22 nt, Molluscum contagiosum virus
gcgcaggucaucgacgagcacg

SEQ ID NO: 3105632 - RNA, 20 nt, Molluscum contagiosum virus
gcgcgcccccgagcugcgug

SEQ ID NO: 3105633 - RNA, 20 nt, Molluscum contagiosum virus
gcgcgcccccgugcuguguu

SEQ ID NO: 3105634 - RNA, 15 nt, Molluscum contagiosum virus
gcgcgccgcgccgca

SEQ ID NO: 3105635 - RNA, 13 nt, Molluscum contagiosum virus
gcgcgccgcgcgc

SEQ ID NO: 3105636 - RNA, 14 nt, Molluscum contagiosum virus
gcgcgccgcgcgcu

SEQ ID NO: 3105637 - RNA, 17 nt, Molluscum contagiosum virus
gcgcgccgcgcuggcgc

SEQ ID NO: 3105638 - RNA, 15 nt, Molluscum contagiosum virus
gcgcgccgcgggccg

SEQ ID NO: 3105639 - RNA, 16 nt, Molluscum contagiosum virus
gcgcgccgcgggccgc

SEQ ID NO: 3105640 - RNA, 19 nt, Molluscum contagiosum virus
gcgcgccgggaaugcugcg

SEQ ID NO: 3105641 - RNA, 14 nt, Molluscum contagiosum virus
gcgcgccgggccgc

SEQ ID NO: 3105642 - RNA, 15 nt, Molluscum contagiosum virus
gcgcgccgggccgcg

SEQ ID NO: 3105643 - RNA, 21 nt, Molluscum contagiosum virus
gcgcgccgguagggugccgag

SEQ ID NO: 3105644 - RNA, 17 nt, Molluscum contagiosum virus
gcgcgcccgcugcgcgc

SEQ ID NO: 3105645 - RNA, 19 nt, Molluscum contagiosum virus
gcgcgcccgcugcgcgcuc

SEQ ID NO: 3105646 - RNA, 15 nt, Molluscum contagiosum virus
gcgcgcccggcgccc

SEQ ID NO: 3105647 - RNA, 22 nt, Molluscum contagiosum virus
gcgcgcccucgcgcgcagcaca

SEQ ID NO: 3105648 - RNA, 16 nt, Molluscum contagiosum virus
gcgcgccgacgugcgc

SEQ ID NO: 3105649 - RNA, 17 nt, Molluscum contagiosum virus
gcgcgccgacgugcgcg

SEQ ID NO: 3105650 - RNA, 14 nt, Molluscum contagiosum virus
gcgcgccgagcgca

SEQ ID NO: 3105651 - RNA, 20 nt, Molluscum contagiosum virus
gcgcgccgaguacugcugcg

SEQ ID NO: 3105652 - RNA, 14 nt, Molluscum contagiosum virus
gcgcgccgcaaagc

SEQ ID NO: 3105653 - RNA, 22 nt, Molluscum contagiosum virus
gcgcgccgcacgcugcugcgug

SEQ ID NO: 3105654 - RNA, 13 nt, Molluscum contagiosum virus
gcgcgccgccgca

SEQ ID NO: 3105655 - RNA, 13 nt, Molluscum contagiosum virus
gcgcgcgcggcgc

SEQ ID NO: 3105656 - RNA, 15 nt, Molluscum contagiosum virus
gcgcgcgcggucgac

SEQ ID NO: 3105657 - RNA, 20 nt, Molluscum contagiosum virus
gcgcgcggagaggacgcgug

SEQ ID NO: 3105658 - RNA, 12 nt, Molluscum contagiosum virus
gcgcgcgccgca

SEQ ID NO: 3105659 - RNA, 14 nt, Molluscum contagiosum virus
gcgcgcgcgcaagu

SEQ ID NO: 3105660 - RNA, 13 nt, Molluscum contagiosum virus
gcgcgcgcgcgag

SEQ ID NO: 3105661 - RNA, 16 nt, Molluscum contagiosum virus
gcgcgcgcgcgccgga

SEQ ID NO: 3105662 - RNA, 15 nt, Molluscum contagiosum virus
gcgcgcgcgcggcgc

SEQ ID NO: 3105663 - RNA, 18 nt, Molluscum contagiosum virus
gcgcgccugccgccugca

SEQ ID NO: 3105664 - RNA, 14 nt, Molluscum contagiosum virus
gcgcgccugcgcga

SEQ ID NO: 3105665 - RNA, 22 nt, Molluscum contagiosum virus
gcgcgcgacgacguugugcucc

SEQ ID NO: 3105666 - RNA, 13 nt, Molluscum contagiosum virus
gcgcgcgagcaca

SEQ ID NO: 3105667 - RNA, 19 nt, Molluscum contagiosum virus
gcgcgcgagcacagcgcgc

SEQ ID NO: 3105668 - RNA, 17 nt, Molluscum contagiosum virus
gcgcgcgagcugcugcg

SEQ ID NO: 3105669 - RNA, 12 nt, Molluscum contagiosum virus
gcgcgcgcacgc

SEQ ID NO: 3105670 - RNA, 15 nt, Molluscum contagiosum virus
gcgcgcgcacgcgcg

SEQ ID NO: 3105671 - RNA, 15 nt, Molluscum contagiosum virus
gcgcgcgcagcaccg

SEQ ID NO: 3105672 - RNA, 15 nt, Molluscum contagiosum virus
gcgcgcgcagcgcgc

SEQ ID NO: 3105673 - RNA, 14 nt, Molluscum contagiosum virus
gcgcgcgcauggag

SEQ ID NO: 3105674 - RNA, 13 nt, Molluscum contagiosum virus
gcgcgcgccagcu

SEQ ID NO: 3105675 - RNA, 21 nt, Molluscum contagiosum virus
gcgcgcgccauccagcgcauc

SEQ ID NO: 3105676 - RNA, 18 nt, Molluscum contagiosum virus
ggcacccaccaggaacga

SEQ ID NO: 3105677 - RNA, 18 nt, Molluscum contagiosum virus
ggcacccgugcgcgcgcu

SEQ ID NO: 3105678 - RNA, 19 nt, Molluscum contagiosum virus
ggcacccgugcgcgcgcug

SEQ ID NO: 3105679 - RNA, 17 nt, Molluscum contagiosum virus
ggcacccucagaccaga

SEQ ID NO: 3105680 - RNA, 21 nt, Molluscum contagiosum virus
ggcacccuggcugcugcgcga

SEQ ID NO: 3105681 - RNA, 23 nt, Molluscum contagiosum virus
ggcaccgccguguugcguagagc

SEQ ID NO: 3105682 - RNA, 12 nt, Molluscum contagiosum virus
ggcaccgcgcgc

SEQ ID NO: 3105683 - RNA, 19 nt, Molluscum contagiosum virus
ggcacggcacccgccagcu

SEQ ID NO: 3105684 - RNA, 16 nt, Molluscum contagiosum virus
ggcacgggcacgcgcg

SEQ ID NO: 3105685 - RNA, 12 nt, Molluscum contagiosum virus
ggcacgggcucg

SEQ ID NO: 3105686 - RNA, 20 nt, Molluscum contagiosum virus
ggcacgggcucgaucugcgc

SEQ ID NO: 3105687 - RNA, 21 nt, Molluscum contagiosum virus
ggcacguggcuaugagcggca

SEQ ID NO: 3105688 - RNA, 21 nt, Molluscum contagiosum virus
ggcacguuugcgucugcgagg

SEQ ID NO: 3105689 - RNA, 15 nt, Molluscum contagiosum virus
ggcacuccagcgcgc

SEQ ID NO: 3105690 - RNA, 16 nt, Molluscum contagiosum virus
ggcacuccgcgcaccg

SEQ ID NO: 3105691 - RNA, 16 nt, Molluscum contagiosum virus
ggcacugcuacgagcc

SEQ ID NO: 3105692 - RNA, 19 nt, Molluscum contagiosum virus
ggcacugcuggcgcgcgcg

SEQ ID NO: 3105693 - RNA, 14 nt, Molluscum contagiosum virus
ggcacuucucgcgc

SEQ ID NO: 3105694 - RNA, 22 nt, Molluscum contagiosum virus
ggcagaacaguaacugcugcag

SEQ ID NO: 3105695 - RNA, 14 nt, Molluscum contagiosum virus
ggcagacgccagcg

SEQ ID NO: 3105696 - RNA, 21 nt, Molluscum contagiosum virus
ggcaucgucucgcucuuccgc

SEQ ID NO: 3105697 - RNA, 17 nt, Molluscum contagiosum virus
ggcaucgugcucuucgc

SEQ ID NO: 3105698 - RNA, 23 nt, Molluscum contagiosum virus
ggcaggcagugccgccgcgcgcg

SEQ ID NO: 3105699 - RNA, 17 nt, Molluscum contagiosum virus
ggcagggaaagagcacg

SEQ ID NO: 3105700 - RNA, 21 nt, Molluscum contagiosum virus
ggcagggaaagagcacgcgcu

SEQ ID NO: 3105701 - RNA, 13 nt, Molluscum contagiosum virus
ggcaggucgcggu

SEQ ID NO: 3105702 - RNA, 16 nt, Molluscum contagiosum virus
ggcaguacgcgcgugg

SEQ ID NO: 3105703 - RNA, 22 nt, Molluscum contagiosum virus
ggcagugcuugcuucggcggcu

SEQ ID NO: 3105704 - RNA, 21 nt, Molluscum contagiosum virus
ggcauaccugugccagcgccu

SEQ ID NO: 3105705 - RNA, 18 nt, Molluscum contagiosum virus
ggcagcucugcagcgccg

SEQ ID NO: 3105706 - RNA, 16 nt, Molluscum contagiosum virus
ggcagcuucugcucgc

SEQ ID NO: 3105707 - RNA, 19 nt, Molluscum contagiosum virus
ggcagcuucugcucgcgca

SEQ ID NO: 3105708 - RNA, 14 nt, Molluscum contagiosum virus
ggcagauagcucgc

SEQ ID NO: 3105709 - RNA, 23 nt, Molluscum contagiosum virus
ggcagauagcucgcgcgcgagca

SEQ ID NO: 3105710 - RNA, 13 nt, Molluscum contagiosum virus
ggcagcagcgugc

SEQ ID NO: 3105711 - RNA, 20 nt, Molluscum contagiosum virus
ggcagcaggaagacgcauag

SEQ ID NO: 3105712 - RNA, 12 nt, Molluscum contagiosum virus
ggcacgagcacg

SEQ ID NO: 3105713 - RNA, 21 nt, Molluscum contagiosum virus
ggcacgaggcagccgcggcgc

SEQ ID NO: 3105714 - RNA, 17 nt, Molluscum contagiosum virus
gcgcgcggcacgccgcu

SEQ ID NO: 3105715 - RNA, 15 nt, Molluscum contagiosum virus
gcgcgcggcgcgccc

SEQ ID NO: 3105716 - RNA, 15 nt, Molluscum contagiosum virus
ggcagccuugcgaga

SEQ ID NO: 3105717 - RNA, 23 nt, Molluscum contagiosum virus
ggcagcgacuacgcgcugcuaga

SEQ ID NO: 3105718 - RNA, 16 nt, Molluscum contagiosum virus
ggcagcgccagcgaga

SEQ ID NO: 3105719 - RNA, 15 nt, Molluscum contagiosum virus
ggcagcgccgcgcgc

SEQ ID NO: 3105720 - RNA, 16 nt, Molluscum contagiosum virus
ggcagcgccgcgcgcg

SEQ ID NO: 3105721 - RNA, 23 nt, Molluscum contagiosum virus
ggcagcgccgcgcgcgcgcguga

SEQ ID NO: 3105722 - RNA, 17 nt, Molluscum contagiosum virus
ggcagcuaccgcgcgcg

SEQ ID NO: 3105723 - RNA, 21 nt, Molluscum contagiosum virus
ggcagcgucgcggagcgcgca

SEQ ID NO: 3105724 - RNA, 15 nt, Molluscum contagiosum virus
gggcacugcgcacgg

SEQ ID NO: 3105725 - RNA, 17 nt, Molluscum contagiosum virus
gggcacuucucgcgcga

SEQ ID NO: 3105726 - RNA, 19 nt, Molluscum contagiosum virus
gggcagggaaagagcacgc

SEQ ID NO: 3105727 - RNA, 13 nt, Molluscum contagiosum virus
gggcccgcgcgcg

SEQ ID NO: 3105728 - RNA, 12 nt, Molluscum contagiosum virus
gggccgcgcgca

SEQ ID NO: 3105729 - RNA, 12 nt, Molluscum contagiosum virus
gggccgcggcgc

SEQ ID NO: 3105730 - RNA, 14 nt, Molluscum contagiosum virus
ggguacacgugcuu

SEQ ID NO: 3105731 - RNA, 13 nt, Molluscum contagiosum virus
ggguaccgugcgc

SEQ ID NO: 3105732 - RNA, 19 nt, Molluscum contagiosum virus
gggccuuuucacuggccgu

SEQ ID NO: 3105733 - RNA, 18 nt, Molluscum contagiosum virus
gggcaccugcaucgcgcc

SEQ ID NO: 3105734 - RNA, 15 nt, Molluscum contagiosum virus
gggcacgccgugggc

SEQ ID NO: 3105735 - RNA, 13 nt, Molluscum contagiosum virus
gggcacgcgcgca

SEQ ID NO: 3105736 - RNA, 13 nt, Molluscum contagiosum virus
gggcacgcgcgcg

SEQ ID NO: 3105737 - RNA, 22 nt, Molluscum contagiosum virus
gggauuugccgguugcgcgugu

SEQ ID NO: 3105738 - RNA, 14 nt, Molluscum contagiosum virus
gggcaacgcgcgcg

SEQ ID NO: 3105739 - RNA, 15 nt, Molluscum contagiosum virus
gggcaaugggcacgc

SEQ ID NO: 3105740 - RNA, 14 nt, Molluscum contagiosum virus
gggaacccguggcc

SEQ ID NO: 3105741 - RNA, 13 nt, Molluscum contagiosum virus
ggcuucugcgcgg

SEQ ID NO: 3105742 - RNA, 16 nt, Molluscum contagiosum virus
ggcuuugacaugcacc

SEQ ID NO: 3105743 - RNA, 17 nt, Molluscum contagiosum virus
ggcuuuucaugugcgag

SEQ ID NO: 3105744 - RNA, 21 nt, Molluscum contagiosum virus
gggacacgcacuugcgcgccu

SEQ ID NO: 3105745 - RNA, 18 nt, Molluscum contagiosum virus
ggccgucgggcgccaaca

SEQ ID NO: 3105746 - RNA, 17 nt, Molluscum contagiosum virus
ggccggcgggcgcgugc

SEQ ID NO: 3105747 - RNA, 18 nt, Molluscum contagiosum virus
ggccugcccugcucaugc

SEQ ID NO: 3105748 - RNA, 17 nt, Molluscum contagiosum virus
ggccugcguggacagca

SEQ ID NO: 3105749 - RNA, 13 nt, Molluscum contagiosum virus
ggccggucgcgga

SEQ ID NO: 3105750 - RNA, 22 nt, Molluscum contagiosum virus
ggccguagugcucaucgugccc

SEQ ID NO: 3105751 - RNA, 16 nt, Molluscum contagiosum virus
ggccgcuccagagccg

SEQ ID NO: 3105752 - RNA, 22 nt, Molluscum contagiosum virus
ggccaccucgcacgugugcagg

SEQ ID NO: 3105753 - RNA, 17 nt, Molluscum contagiosum virus
ggccacgaacacggcgc

SEQ ID NO: 3105754 - RNA, 13 nt, Molluscum contagiosum virus
ggccgcgcucguc

SEQ ID NO: 3105755 - RNA, 15 nt, Molluscum contagiosum virus
ggcgacgacagcgac

SEQ ID NO: 3105756 - RNA, 20 nt, Molluscum contagiosum virus
ggcgacgucaaccgggcucu

SEQ ID NO: 3105757 - RNA, 20 nt, Molluscum contagiosum virus
ggcgacguucgagaccagcc

SEQ ID NO: 3105758 - RNA, 19 nt, Molluscum contagiosum virus
ggcgagcaucugcgcgugc

SEQ ID NO: 3105759 - RNA, 14 nt, Molluscum contagiosum virus
ggcgagcgcucugc

SEQ ID NO: 3105760 - RNA, 13 nt, Molluscum contagiosum virus
ggccuguccgcgg

SEQ ID NO: 3105761 - RNA, 14 nt, Molluscum contagiosum virus
ggccugugcugugc

SEQ ID NO: 3105762 - RNA, 23 nt, Molluscum contagiosum virus
ggccuucuaccacagguuucuca

SEQ ID NO: 3105763 - RNA, 20 nt, Molluscum contagiosum virus
ggccucguccuggaggggug

SEQ ID NO: 3105764 - RNA, 20 nt, Molluscum contagiosum virus
ggcgcaacgcuggccgccau

SEQ ID NO: 3105765 - RNA, 15 nt, Molluscum contagiosum virus
ggcgcaagcgcaagc

SEQ ID NO: 3105766 - RNA, 24 nt, Molluscum contagiosum virus
ggcgcacacuccucggcgcuacgc

SEQ ID NO: 3105767 - RNA, 20 nt, Molluscum contagiosum virus
ggcgcacauuaguagcgagc

SEQ ID NO: 3105768 - RNA, 14 nt, Molluscum contagiosum virus
ggcgcacgcgagca

SEQ ID NO: 3105769 - RNA, 12 nt, Molluscum contagiosum virus
ggcgcacgcuug

SEQ ID NO: 3105770 - RNA, 20 nt, Molluscum contagiosum virus
ggcgcacggccugcggcagg

SEQ ID NO: 3105771 - RNA, 19 nt, Molluscum contagiosum virus
ggcgcagcuccuagcgcgc

SEQ ID NO: 3105772 - RNA, 20 nt, Molluscum contagiosum virus
ggcgcagcuccuagcgcgcg

SEQ ID NO: 3105773 - RNA, 16 nt, Molluscum contagiosum virus
ggcgcaggccgcgccc

SEQ ID NO: 3105774 - RNA, 13 nt, Molluscum contagiosum virus
ggcgagucgcggg

SEQ ID NO: 3105775 - RNA, 14 nt, Molluscum contagiosum virus
ggcgaucugcucgc

SEQ ID NO: 3105776 - RNA, 19 nt, Molluscum contagiosum virus
ggcgcaucagagaagugcu

SEQ ID NO: 3105777 - RNA, 22 nt, Molluscum contagiosum virus
gcgcaccugcacgagccggcgc

SEQ ID NO: 3105778 - RNA, 14 nt, Molluscum contagiosum virus
gcgcaccugcuaga

SEQ ID NO: 3105779 - RNA, 19 nt, Molluscum contagiosum virus
gcgcaccugcuagagcaua

SEQ ID NO: 3105780 - RNA, 19 nt, Molluscum contagiosum virus
gcgcacgaccacgugcagg

SEQ ID NO: 3105781 - RNA, 16 nt, Molluscum contagiosum virus
gcgcacgagcgcgggc

SEQ ID NO: 3105782 - RNA, 18 nt, Molluscum contagiosum virus
gcgcacgagcgcgggcgc

SEQ ID NO: 3105783 - RNA, 17 nt, Molluscum contagiosum virus
gcgcacgagcugcugcc

SEQ ID NO: 3105784 - RNA, 20 nt, Molluscum contagiosum virus
gcgcacgcaagcccgcgcgc

SEQ ID NO: 3105785 - RNA, 24 nt, Molluscum contagiosum virus
gcgcacgcaagcccgcgcgcgagc

SEQ ID NO: 3105786 - RNA, 12 nt, Molluscum contagiosum virus
gcgcacgcagca

SEQ ID NO: 3105787 - RNA, 14 nt, Molluscum contagiosum virus
gcgcacgcagcagg

SEQ ID NO: 3105788 - RNA, 15 nt, Molluscum contagiosum virus
gcgcacgcgagcacg

SEQ ID NO: 3105789 - RNA, 18 nt, Molluscum contagiosum virus
gcgcacgcgagcacgccu

SEQ ID NO: 3105790 - RNA, 18 nt, Molluscum contagiosum virus
gcgcacgcgcacgggccu

SEQ ID NO: 3105791 - RNA, 21 nt, Molluscum contagiosum virus
gcgcacgcuagucguuggcgc

SEQ ID NO: 3105792 - RNA, 17 nt, Molluscum contagiosum virus
gcgcacgcugcgcacgg

SEQ ID NO: 3105793 - RNA, 21 nt, Molluscum contagiosum virus
gcgcacgcugcgcacgggcgc

SEQ ID NO: 3105794 - RNA, 17 nt, Molluscum contagiosum virus
gcgcacgcuuguccgcg

SEQ ID NO: 3105795 - RNA, 18 nt, Molluscum contagiosum virus
gcgcacgcuuguccgcgg

SEQ ID NO: 3105796 - RNA, 20 nt, Molluscum contagiosum virus
gcgcacgcuuguccgcggac

SEQ ID NO: 3105797 - RNA, 22 nt, Molluscum contagiosum virus
gcgcacgcuuguccgcggacgc

SEQ ID NO: 3105798 - RNA, 19 nt, Molluscum contagiosum virus
gcgcacgcuugugcgcacg

SEQ ID NO: 3105799 - RNA, 12 nt, Molluscum contagiosum virus
gcgcacggaccu

SEQ ID NO: 3105800 - RNA, 20 nt, Molluscum contagiosum virus
gcgcacccgagggcgugcgc

SEQ ID NO: 3105801 - RNA, 14 nt, Molluscum contagiosum virus
gcgcacccgccacg

SEQ ID NO: 3105802 - RNA, 13 nt, Molluscum contagiosum virus
gcgcaccgcgggc

SEQ ID NO: 3105803 - RNA, 21 nt, Molluscum contagiosum virus
gcgcaccgcguugccgcccgc

SEQ ID NO: 3105804 - RNA, 15 nt, Molluscum contagiosum virus
gcaccacgugcuccg

SEQ ID NO: 3105805 - RNA, 15 nt, Molluscum contagiosum virus
gcaccagguagagca

SEQ ID NO: 3105806 - RNA, 17 nt, Molluscum contagiosum virus
gcacaucggcacugcuc

SEQ ID NO: 3105807 - RNA, 18 nt, Molluscum contagiosum virus
gcacaugugcgugcaccu

SEQ ID NO: 3105808 - RNA, 15 nt, Molluscum contagiosum virus
gcacagccccugcug

SEQ ID NO: 3105809 - RNA, 20 nt, Molluscum contagiosum virus
gcacagccccugcugcucgc

SEQ ID NO: 3105810 - RNA, 21 nt, Molluscum contagiosum virus
gcacagccccugcugcucgcg

SEQ ID NO: 3105811 - RNA, 19 nt, Molluscum contagiosum virus
gcacagcgcgcggaagccc

SEQ ID NO: 3105812 - RNA, 18 nt, Molluscum contagiosum virus
gcacagggauucgccgcg

SEQ ID NO: 3105813 - RNA, 17 nt, Molluscum contagiosum virus
gcacaggguuccgcgcc

SEQ ID NO: 3105814 - RNA, 19 nt, Molluscum contagiosum virus
gcacaguccaacccgcggc

SEQ ID NO: 3105815 - RNA, 17 nt, Molluscum contagiosum virus
gcacaguccagcccgcg

SEQ ID NO: 3105816 - RNA, 20 nt, Molluscum contagiosum virus
gcacaguucacggcgcucgc

SEQ ID NO: 3105817 - RNA, 20 nt, Molluscum contagiosum virus
gcacaguucacggcgcuugc

SEQ ID NO: 3105818 - RNA, 14 nt, Molluscum contagiosum virus
gcaccgagugcugg

SEQ ID NO: 3105819 - RNA, 17 nt, Molluscum contagiosum virus
gcacccuggcugcugcg

SEQ ID NO: 3105820 - RNA, 14 nt, Molluscum contagiosum virus
gcaccccgcaggaa

SEQ ID NO: 3105821 - RNA, 13 nt, Molluscum contagiosum virus
gcacccgcaggaa

SEQ ID NO: 3105822 - RNA, 16 nt, Molluscum contagiosum virus
gcacccgcgcagcgug

SEQ ID NO: 3105823 - RNA, 21 nt, Molluscum contagiosum virus
gcaccgcccgcccgcgcucga

SEQ ID NO: 3105824 - RNA, 16 nt, Molluscum contagiosum virus
gcaccgccgacaacgc

SEQ ID NO: 3105825 - RNA, 16 nt, Molluscum contagiosum virus
gcaccgccguguugcg

SEQ ID NO: 3105826 - RNA, 18 nt, Molluscum contagiosum virus
gcaccgccuggugcugcg

SEQ ID NO: 3105827 - RNA, 22 nt, Molluscum contagiosum virus
gcaccgccuggugcugcgcgac

SEQ ID NO: 3105828 - RNA, 14 nt, Molluscum contagiosum virus
gcaccgcgcgcgcu

SEQ ID NO: 3105829 - RNA, 16 nt, Molluscum contagiosum virus
gcaccgcgcgcgcucc

SEQ ID NO: 3105830 - RNA, 16 nt, Molluscum contagiosum virus
gaguacagccgcgcgg

SEQ ID NO: 3105831 - RNA, 23 nt, Molluscum contagiosum virus
gaguacgcucuccaugcgcgcgc

SEQ ID NO: 3105832 - RNA, 19 nt, Molluscum contagiosum virus
gaguauacucgacgcgcgc

SEQ ID NO: 3105833 - RNA, 12 nt, Molluscum contagiosum virus
gagucacgaccg

SEQ ID NO: 3105834 - RNA, 16 nt, Molluscum contagiosum virus
gagugaaggguguggc

SEQ ID NO: 3105835 - RNA, 12 nt, Molluscum contagiosum virus
gagugacgccuc

SEQ ID NO: 3105836 - RNA, 22 nt, Molluscum contagiosum virus
gagugcgggagcaagucugcgc

SEQ ID NO: 3105837 - RNA, 17 nt, Molluscum contagiosum virus
gagugcuggagcagacg

SEQ ID NO: 3105838 - RNA, 16 nt, Molluscum contagiosum virus
gagucgagcacgcgcg

SEQ ID NO: 3105839 - RNA, 19 nt, Molluscum contagiosum virus
gagucgccgcugcgcaucu

SEQ ID NO: 3105840 - RNA, 10 nt, Molluscum contagiosum virus
gaguccgcgc

SEQ ID NO: 3105841 - RNA, 13 nt, Molluscum contagiosum virus
gaguccgcggcga

SEQ ID NO: 3105842 - RNA, 19 nt, Molluscum contagiosum virus
gcacagacggcgcgcucgg

SEQ ID NO: 3105843 - RNA, 22 nt, Molluscum contagiosum virus
gauagcgauggcuguuccggcg

SEQ ID NO: 3105844 - RNA, 22 nt, Molluscum contagiosum virus
gagcagcccgugcgccugccgc

SEQ ID NO: 3105845 - RNA, 23 nt, Molluscum contagiosum virus
gagcagcccgugcgccugccgcg

SEQ ID NO: 3105846 - RNA, 14 nt, Molluscum contagiosum virus
gagcaagcgcccgc

SEQ ID NO: 3105847 - RNA, 14 nt, Molluscum contagiosum virus
gagcaaggccuggc

SEQ ID NO: 3105848 - RNA, 14 nt, Molluscum contagiosum virus
gagcaagucugcgc

SEQ ID NO: 3105849 - RNA, 15 nt, Molluscum contagiosum virus
gagcaaugcgagcaa

SEQ ID NO: 3105850 - RNA, 21 nt, Molluscum contagiosum virus
gagcaguccgccucgagcacg

SEQ ID NO: 3105851 - RNA, 17 nt, Molluscum contagiosum virus
gagcagugccgccgcgc

SEQ ID NO: 3105852 - RNA, 18 nt, Molluscum contagiosum virus
gagcagugccgccgcgca

SEQ ID NO: 3105853 - RNA, 20 nt, Molluscum contagiosum virus
gagcagugccgcucgcuguc

SEQ ID NO: 3105854 - RNA, 16 nt, Molluscum contagiosum virus
gagcaguuccggucuc

SEQ ID NO: 3105855 - RNA, 16 nt, Molluscum contagiosum virus
gagcaguucgcgcgcc

SEQ ID NO: 3105856 - RNA, 19 nt, Molluscum contagiosum virus
gagcaguucgcgcgccugc

SEQ ID NO: 3105857 - RNA, 22 nt, Molluscum contagiosum virus
gagcaguucgcgcgccugcgcg

SEQ ID NO: 3105858 - RNA, 20 nt, Molluscum contagiosum virus
gagcacgccugcacgcgcac

SEQ ID NO: 3105859 - RNA, 12 nt, Molluscum contagiosum virus
gagcacgcgcga

SEQ ID NO: 3105860 - RNA, 17 nt, Molluscum contagiosum virus
gagcacgcgcucgcgca

SEQ ID NO: 3105861 - RNA, 22 nt, Molluscum contagiosum virus
gagcacgcuuuccuuugcggcg

SEQ ID NO: 3105862 - RNA, 16 nt, Molluscum contagiosum virus
gagcacggacagcacc

SEQ ID NO: 3105863 - RNA, 17 nt, Molluscum contagiosum virus
gagcacggacagcaccc

SEQ ID NO: 3105864 - RNA, 19 nt, Molluscum contagiosum virus
gagcacguccucugcgagc

SEQ ID NO: 3105865 - RNA, 18 nt, Molluscum contagiosum virus
gagcacguggacagcauc

SEQ ID NO: 3105866 - RNA, 15 nt, Molluscum contagiosum virus
gagcacugcgcgcgc

SEQ ID NO: 3105867 - RNA, 16 nt, Molluscum contagiosum virus
gagcacugcgcgcgcg

SEQ ID NO: 3105868 - RNA, 21 nt, Molluscum contagiosum virus
gagcacugcgcgucugugcgc

SEQ ID NO: 3105869 - RNA, 18 nt, Molluscum contagiosum virus
gagcacuguacgcacgca

SEQ ID NO: 3105870 - RNA, 16 nt, Molluscum contagiosum virus
gagcacuuccgcgcgc

SEQ ID NO: 3105871 - RNA, 14 nt, Molluscum contagiosum virus
gagcacuugccgcg

SEQ ID NO: 3105872 - RNA, 15 nt, Molluscum contagiosum virus
gagcagaaggugcgc

SEQ ID NO: 3105873 - RNA, 14 nt, Molluscum contagiosum virus
gagguacugccgcc

SEQ ID NO: 3105874 - RNA, 18 nt, Molluscum contagiosum virus
gaggucaagggugugggc

SEQ ID NO: 3105875 - RNA, 17 nt, Molluscum contagiosum virus
gaggucgagcgcgccgc

SEQ ID NO: 3105876 - RNA, 14 nt, Molluscum contagiosum virus
gagggucgugcagg

SEQ ID NO: 3105877 - RNA, 13 nt, Molluscum contagiosum virus
gaguaccgcgcgc

SEQ ID NO: 3105878 - RNA, 22 nt, Molluscum contagiosum virus
gaguaccgcgcgcacgcggcgc

SEQ ID NO: 3105879 - RNA, 16 nt, Molluscum contagiosum virus
gaguacgacgcggagg

SEQ ID NO: 3105880 - RNA, 21 nt, Molluscum contagiosum virus
gaguacgacgguuuccgcgcc

SEQ ID NO: 3105881 - RNA, 20 nt, Molluscum contagiosum virus
gagguucguccgcucgugcc

SEQ ID NO: 3105882 - RNA, 13 nt, Molluscum contagiosum virus
gaggugcgcgcaa

SEQ ID NO: 3105883 - RNA, 17 nt, Molluscum contagiosum virus
gagcagcgcuugcgcgc

SEQ ID NO: 3105884 - RNA, 14 nt, Molluscum contagiosum virus
gagcagcugcugcg

SEQ ID NO: 3105885 - RNA, 18 nt, Molluscum contagiosum virus
gagcaggcgcagcgcggc

SEQ ID NO: 3105886 - RNA, 15 nt, Molluscum contagiosum virus
gagcagggcuacgag

SEQ ID NO: 3105887 - RNA, 20 nt, Molluscum contagiosum virus
gagcaggguuuucacgcagg

SEQ ID NO: 3105888 - RNA, 20 nt, Molluscum contagiosum virus
gaggggaaagaugaagcucu

SEQ ID NO: 3105889 - RNA, 15 nt, Molluscum contagiosum virus
gagggucacgcgcac

SEQ ID NO: 3105890 - RNA, 17 nt, Molluscum contagiosum virus
gagggccuuggcggcgc

SEQ ID NO: 3105891 - RNA, 20 nt, Molluscum contagiosum virus
gagggccuuggcggcgcggc

SEQ ID NO: 3105892 - RNA, 14 nt, Molluscum contagiosum virus
gagggcgaggccuu

SEQ ID NO: 3105893 - RNA, 22 nt, Molluscum contagiosum virus
gagggcgagucucccguggcgc

SEQ ID NO: 3105894 - RNA, 15 nt, Molluscum contagiosum virus
gagggcgccgggcgc

SEQ ID NO: 3105895 - RNA, 15 nt, Molluscum contagiosum virus
gcaccuggaacgcga

SEQ ID NO: 3105896 - RNA, 16 nt, Molluscum contagiosum virus
gcaccuggaacgcgac

SEQ ID NO: 3105897 - RNA, 23 nt, Molluscum contagiosum virus
gcaccuuuggugcagaucucgcg

SEQ ID NO: 3105898 - RNA, 15 nt, Molluscum contagiosum virus
gcacgaacggacgcc

SEQ ID NO: 3105899 - RNA, 13 nt, Molluscum contagiosum virus
gcaccugcaggaa

SEQ ID NO: 3105900 - RNA, 18 nt, Molluscum contagiosum virus
gcaccugcaucgcgccgc

SEQ ID NO: 3105901 - RNA, 13 nt, Molluscum contagiosum virus
gcaccugcgccgc

SEQ ID NO: 3105902 - RNA, 15 nt, Molluscum contagiosum virus
gcaccugcggcugcg

SEQ ID NO: 3105903 - RNA, 14 nt, Molluscum contagiosum virus
gcaccggcgcucac

SEQ ID NO: 3105904 - RNA, 14 nt, Molluscum contagiosum virus
gcaccgggcgccgc

SEQ ID NO: 3105905 - RNA, 18 nt, Molluscum contagiosum virus
gcaccguaccgcgcccgc

SEQ ID NO: 3105906 - RNA, 22 nt, Molluscum contagiosum virus
gcaccguacucgcguccgcgca

SEQ ID NO: 3105907 - RNA, 12 nt, Molluscum contagiosum virus
gcaccgcggcga

SEQ ID NO: 3105908 - RNA, 14 nt, Molluscum contagiosum virus
gcaccgcguggcgc

SEQ ID NO: 3105909 - RNA, 16 nt, Molluscum contagiosum virus
ccggcgagaugcgagc

SEQ ID NO: 3105910 - RNA, 23 nt, Molluscum contagiosum virus
ccggcgagaugcgagcgcgucug

SEQ ID NO: 3105911 - RNA, 19 nt, Molluscum contagiosum virus
ccggcaguagcagcgccgg

SEQ ID NO: 3105912 - RNA, 16 nt, Molluscum contagiosum virus
ccggcauccggccgag

SEQ ID NO: 3105913 - RNA, 14 nt, Molluscum contagiosum virus
ccggcgcccgccac

SEQ ID NO: 3105914 - RNA, 17 nt, Molluscum contagiosum virus
ccggccuuguucgcgcu

SEQ ID NO: 3105915 - RNA, 20 nt, Molluscum contagiosum virus
ccggccuuguucgcgcuucu

SEQ ID NO: 3105916 - RNA, 21 nt, Molluscum contagiosum virus
cgcgcgacgugugcucugugc

SEQ ID NO: 3105917 - RNA, 22 nt, Molluscum contagiosum virus
cgcgcgacgugugcucugugcg

SEQ ID NO: 3105918 - RNA, 20 nt, Molluscum contagiosum virus
cgcgcgacuggcacgcgccg

SEQ ID NO: 3105919 - RNA, 16 nt, Molluscum contagiosum virus
cgcgcgagaagucggg

SEQ ID NO: 3105920 - RNA, 22 nt, Molluscum contagiosum virus
cgcgcgagaagucgggcuggcg

SEQ ID NO: 3105921 - RNA, 20 nt, Molluscum contagiosum virus
cgcgcgagaugcgcggacag

SEQ ID NO: 3105922 - RNA, 21 nt, Molluscum contagiosum virus
cgcgcgagcaugccgccgcgu

SEQ ID NO: 3105923 - RNA, 14 nt, Molluscum contagiosum virus
cgcgcgagcgccgg

SEQ ID NO: 3105924 - RNA, 19 nt, Molluscum contagiosum virus
cgcgcgagcggagcgggca

SEQ ID NO: 3105925 - RNA, 13 nt, Molluscum contagiosum virus
ccggcgcgccgcg

SEQ ID NO: 3105926 - RNA, 15 nt, Molluscum contagiosum virus
ccggcgcgcgcgcgc

SEQ ID NO: 3105927 - RNA, 20 nt, Molluscum contagiosum virus
ccggcgcgcgcggcgcgccc

SEQ ID NO: 3105928 - RNA, 11 nt, Molluscum contagiosum virus
ccggcgcggcc

SEQ ID NO: 3105929 - RNA, 15 nt, Molluscum contagiosum virus
ccggcgcggcgagcc

SEQ ID NO: 3105930 - RNA, 18 nt, Molluscum contagiosum virus
cgcgccugcuggcgggga

SEQ ID NO: 3105931 - RNA, 23 nt, Molluscum contagiosum virus
cgcgccugucaagacgggcacgc

SEQ ID NO: 3105932 - RNA, 15 nt, Molluscum contagiosum virus
cgcgccuuccgcgcg

SEQ ID NO: 3105933 - RNA, 18 nt, Molluscum contagiosum virus
cgcgccuuccgcgcgggc

SEQ ID NO: 3105934 - RNA, 17 nt, Molluscum contagiosum virus
cgcgcgcccgcugcgcg

SEQ ID NO: 3105935 - RNA, 19 nt, Molluscum contagiosum virus
cgcgcgcccgcugcgcgcu

SEQ ID NO: 3105936 - RNA, 11 nt, Molluscum contagiosum virus
cgcgcgccgag

SEQ ID NO: 3105937 - RNA, 17 nt, Molluscum contagiosum virus
cgcgcgccgcaaaagca

SEQ ID NO: 3105938 - RNA, 19 nt, Molluscum contagiosum virus
cgcgcgccgcagaacacgg

SEQ ID NO: 3105939 - RNA, 12 nt, Molluscum contagiosum virus
cgcgcgccgcgc

SEQ ID NO: 3105940 - RNA, 13 nt, Molluscum contagiosum virus
cgcgcgccgcgcg

SEQ ID NO: 3105941 - RNA, 12 nt, Molluscum contagiosum virus
cgcgcgccgcgg

SEQ ID NO: 3105942 - RNA, 19 nt, Molluscum contagiosum virus
cgcgcgccgcugucacgcg

SEQ ID NO: 3105943 - RNA, 13 nt, Molluscum contagiosum virus
cgcgcgccugcug

SEQ ID NO: 3105944 - RNA, 19 nt, Molluscum contagiosum virus
cgcggaacugacugcugcc

SEQ ID NO: 3105945 - RNA, 16 nt, Molluscum contagiosum virus
cgcggaagaauuccuu

SEQ ID NO: 3105946 - RNA, 17 nt, Molluscum contagiosum virus
cgcggaagaucgcgucg

SEQ ID NO: 3105947 - RNA, 22 nt, Molluscum contagiosum virus
cgcggaagcccgagcgcgucca

SEQ ID NO: 3105948 - RNA, 19 nt, Molluscum contagiosum virus
cgcggacacauugcgaggc

SEQ ID NO: 3105949 - RNA, 21 nt, Molluscum contagiosum virus
cgcggacagagcccgcggcgc

SEQ ID NO: 3105950 - RNA, 14 nt, Molluscum contagiosum virus
cgcgcgcaagaaca

SEQ ID NO: 3105951 - RNA, 16 nt, Molluscum contagiosum virus
cgcgcgcaagcgccgc

SEQ ID NO: 3105952 - RNA, 17 nt, Molluscum contagiosum virus
cgcgcgcaagcgccgcu

SEQ ID NO: 3105953 - RNA, 19 nt, Molluscum contagiosum virus
cgcgcgcaagcgccgcucg

SEQ ID NO: 3105954 - RNA, 13 nt, Molluscum contagiosum virus
cgcgcgcacgcga

SEQ ID NO: 3105955 - RNA, 18 nt, Molluscum contagiosum virus
cgcgcgcacgcgaacgcc

SEQ ID NO: 3105956 - RNA, 16 nt, Molluscum contagiosum virus
cgcgcgcacgcgcacg

SEQ ID NO: 3105957 - RNA, 13 nt, Molluscum contagiosum virus
cgcgcgcacugcg

SEQ ID NO: 3105958 - RNA, 14 nt, Molluscum contagiosum virus
cgcgcgcacugcgg

SEQ ID NO: 3105959 - RNA, 11 nt, Molluscum contagiosum virus
cgcgcgcagca

SEQ ID NO: 3105960 - RNA, 15 nt, Molluscum contagiosum virus
cgcgcgcagcaccgc

SEQ ID NO: 3105961 - RNA, 22 nt, Molluscum contagiosum virus
cgcgcgcagcaggugcacgugc

SEQ ID NO: 3105962 - RNA, 17 nt, Molluscum contagiosum virus
cgcgcgcaggaaagguc

SEQ ID NO: 3105963 - RNA, 14 nt, Molluscum contagiosum virus
cgcgcgcaggcucg

SEQ ID NO: 3105964 - RNA, 14 nt, Molluscum contagiosum virus
cgcgcgcagggcgc

SEQ ID NO: 3105965 - RNA, 18 nt, Molluscum contagiosum virus
cgcgcgcauacgcgccgc

SEQ ID NO: 3105966 - RNA, 17 nt, Molluscum contagiosum virus
cgcgcgcaugcucgcgc

SEQ ID NO: 3105967 - RNA, 11 nt, Molluscum contagiosum virus
cgcgcgccaca

SEQ ID NO: 3105968 - RNA, 12 nt, Molluscum contagiosum virus
cgcgcgccagca

SEQ ID NO: 3105969 - RNA, 22 nt, Molluscum contagiosum virus
cgcgcgccagcaagcucgaugc

SEQ ID NO: 3105970 - RNA, 20 nt, Molluscum contagiosum virus
cgcgcgccagcacgcgcucg

SEQ ID NO: 3105971 - RNA, 16 nt, Molluscum contagiosum virus
cgcgcgccagcagcgc

SEQ ID NO: 3105972 - RNA, 21 nt, Molluscum contagiosum virus
cgcgcgccagcuaugcgcccg

SEQ ID NO: 3105973 - RNA, 18 nt, Molluscum contagiosum virus
cgcggauauggcgcgccg

SEQ ID NO: 3105974 - RNA, 20 nt, Molluscum contagiosum virus
cgcggauauggcgcgccgag

SEQ ID NO: 3105975 - RNA, 17 nt, Molluscum contagiosum virus
cgcggaucugcgcacac

SEQ ID NO: 3105976 - RNA, 18 nt, Molluscum contagiosum virus
cgcggaucugcgcacacg

SEQ ID NO: 3105977 - RNA, 20 nt, Molluscum contagiosum virus
cgcggaggucgagcgcgccg

SEQ ID NO: 3105978 - RNA, 13 nt, Molluscum contagiosum virus
cgcggacgcgggc

SEQ ID NO: 3105979 - RNA, 17 nt, Molluscum contagiosum virus
cgcggacggcgcgcagc

SEQ ID NO: 3105980 - RNA, 16 nt, Molluscum contagiosum virus
cgcggacucgugcacc

SEQ ID NO: 3105981 - RNA, 19 nt, Molluscum contagiosum virus
cgcggacucgugcaccacg

SEQ ID NO: 3105982 - RNA, 22 nt, Molluscum contagiosum virus
cgcggacuucucgcucacgcgc

SEQ ID NO: 3105983 - RNA, 14 nt, Molluscum contagiosum virus
cgcggagaagugcg

SEQ ID NO: 3105984 - RNA, 15 nt, Molluscum contagiosum virus
cgcggagcgcgcacg

SEQ ID NO: 3105985 - RNA, 22 nt, Molluscum contagiosum virus
cgcggagcgcuagcagggcggc

SEQ ID NO: 3105986 - RNA, 15 nt, Molluscum contagiosum virus
cgcggagcugcgcgc

SEQ ID NO: 3105987 - RNA, 14 nt, Molluscum contagiosum virus
cgcggagcugugcc

SEQ ID NO: 3105988 - RNA, 20 nt, Molluscum contagiosum virus
cgcgcgagcugcuagcggca

SEQ ID NO: 3105989 - RNA, 14 nt, Molluscum contagiosum virus
cgcgcgagcugcug

SEQ ID NO: 3105990 - RNA, 16 nt, Molluscum contagiosum virus
cgcgcgagcugcugcg

SEQ ID NO: 3105991 - RNA, 13 nt, Molluscum contagiosum virus
cgcgcgagggcgc

SEQ ID NO: 3105992 - RNA, 17 nt, Molluscum contagiosum virus
cgcgcgagugccagcga

SEQ ID NO: 3105993 - RNA, 14 nt, Molluscum contagiosum virus
cgcgcgagugugcg

SEQ ID NO: 3105994 - RNA, 16 nt, Molluscum contagiosum virus
cgcgcgagugugugca

SEQ ID NO: 3105995 - RNA, 18 nt, Molluscum contagiosum virus
cgcgccuugagcgcgccg

SEQ ID NO: 3105996 - RNA, 20 nt, Molluscum contagiosum virus
cgcgccuugagcgcgccgcg

SEQ ID NO: 3105997 - RNA, 13 nt, Molluscum contagiosum virus
cgcgcgaacgugc

SEQ ID NO: 3105998 - RNA, 20 nt, Molluscum contagiosum virus
cgcgcgaacucucaucgagc

SEQ ID NO: 3105999 - RNA, 17 nt, Molluscum contagiosum virus
cgcggaccuaaagcugc

SEQ ID NO: 3106000 - RNA, 16 nt, Molluscum contagiosum virus
cgcgcgaucgcggcca

SEQ ID NO: 3106001 - RNA, 17 nt, Molluscum contagiosum virus
cgcggcagcucugcagc

SEQ ID NO: 3106002 - RNA, 18 nt, Molluscum contagiosum virus
cgcggccaugcgcuugcg

SEQ ID NO: 3106003 - RNA, 22 nt, Molluscum contagiosum virus
cgcggccauggucacgcgcacg

SEQ ID NO: 3106004 - RNA, 22 nt, Molluscum contagiosum virus
cgcggccgagucacgccccagc

SEQ ID NO: 3106005 - RNA, 12 nt, Molluscum contagiosum virus
cgcggccgccac

SEQ ID NO: 3106006 - RNA, 13 nt, Molluscum contagiosum virus
cgcggccgcgaga

SEQ ID NO: 3106007 - RNA, 14 nt, Molluscum contagiosum virus
cgcggccgcgcucg

SEQ ID NO: 3106008 - RNA, 14 nt, Molluscum contagiosum virus
cgcggccgcggagg

SEQ ID NO: 3106009 - RNA, 15 nt, Molluscum contagiosum virus
cgcggccgcggaggg

SEQ ID NO: 3106010 - RNA, 16 nt, Molluscum contagiosum virus
cgcggaugccacgcag

SEQ ID NO: 3106011 - RNA, 17 nt, Molluscum contagiosum virus
cgcggaugccacgcagc

SEQ ID NO: 3106012 - RNA, 22 nt, Molluscum contagiosum virus
cgcggauguccuugaugccgug

SEQ ID NO: 3106013 - RNA, 19 nt, Molluscum contagiosum virus
cgcggcacaugcagcugca

SEQ ID NO: 3106014 - RNA, 16 nt, Molluscum contagiosum virus
cgcggcaccugucgcg

SEQ ID NO: 3106015 - RNA, 20 nt, Molluscum contagiosum virus
cgcggcacugggugcccgag

SEQ ID NO: 3106016 - RNA, 16 nt, Molluscum contagiosum virus
cgcggcagacgccagc

SEQ ID NO: 3106017 - RNA, 17 nt, Molluscum contagiosum virus
cgcggcgagucgcgggc

SEQ ID NO: 3106018 - RNA, 20 nt, Molluscum contagiosum virus
cgcggcgagugcggccacca

SEQ ID NO: 3106019 - RNA, 23 nt, Molluscum contagiosum virus
cgcggcgcacaaucucgccggcu

SEQ ID NO: 3106020 - RNA, 19 nt, Molluscum contagiosum virus
cgcggccguggcacugacg

SEQ ID NO: 3106021 - RNA, 21 nt, Molluscum contagiosum virus
cgcggcgcgcagcucgccgcg

SEQ ID NO: 3106022 - RNA, 14 nt, Molluscum contagiosum virus
cgcggcgcgcccag

SEQ ID NO: 3106023 - RNA, 15 nt, Molluscum contagiosum virus
cgcggcgcgcccagc

SEQ ID NO: 3106024 - RNA, 12 nt, Molluscum contagiosum virus
cgcggcgcgccg

SEQ ID NO: 3106025 - RNA, 13 nt, Molluscum contagiosum virus
cgcggcgcgccgc

SEQ ID NO: 3106026 - RNA, 19 nt, Molluscum contagiosum virus
cgugcuggagggcacgcug

SEQ ID NO: 3106027 - RNA, 13 nt, Molluscum contagiosum virus
cgugcugucagug

SEQ ID NO: 3106028 - RNA, 19 nt, Molluscum contagiosum virus
cgugcuguugccgcgcucg

SEQ ID NO: 3106029 - RNA, 14 nt, Molluscum contagiosum virus
cgugcuugcgcacg

SEQ ID NO: 3106030 - RNA, 17 nt, Molluscum contagiosum virus
cgugcuuguagcgcaag

SEQ ID NO: 3106031 - RNA, 12 nt, Molluscum contagiosum virus
cucgccggcgag

SEQ ID NO: 3106032 - RNA, 15 nt, Molluscum contagiosum virus
cucgccuuuccccgg

SEQ ID NO: 3106033 - RNA, 21 nt, Molluscum contagiosum virus
cucgcgggcguggggagcugg

SEQ ID NO: 3106034 - RNA, 20 nt, Molluscum contagiosum virus
cucgcgcucgggaagcacgu

SEQ ID NO: 3106035 - RNA, 15 nt, Molluscum contagiosum virus
cucgcgcuuccccgc

SEQ ID NO: 3106036 - RNA, 23 nt, Molluscum contagiosum virus
cucgcguuagcgcuggcccgugc

SEQ ID NO: 3106037 - RNA, 24 nt, Molluscum contagiosum virus
cucgcucaucaccgacacgcgccc

SEQ ID NO: 3106038 - RNA, 19 nt, Molluscum contagiosum virus
cucgcucauccacgcggag

SEQ ID NO: 3106039 - RNA, 22 nt, Molluscum contagiosum virus
cucgcgucaucgcugcacgcga

SEQ ID NO: 3106040 - RNA, 14 nt, Molluscum contagiosum virus
cucgcucgcgcaag

SEQ ID NO: 3106041 - RNA, 21 nt, Molluscum contagiosum virus
cucgcgcgacacgagcgaguu

SEQ ID NO: 3106042 - RNA, 15 nt, Molluscum contagiosum virus
cucgcgcgacuggca

SEQ ID NO: 3106043 - RNA, 17 nt, Molluscum contagiosum virus
cucgcgcgacuggcacg

SEQ ID NO: 3106044 - RNA, 21 nt, Molluscum contagiosum virus
cucgcgcgcagcacaccgucg

SEQ ID NO: 3106045 - RNA, 13 nt, Molluscum contagiosum virus
cucgcgcgccacc

SEQ ID NO: 3106046 - RNA, 13 nt, Molluscum contagiosum virus
cucgcgcgccagc

SEQ ID NO: 3106047 - RNA, 12 nt, Molluscum contagiosum virus
cucgcgcgcgag

SEQ ID NO: 3106048 - RNA, 16 nt, Molluscum contagiosum virus
cucgcgcgcgagcacg

SEQ ID NO: 3106049 - RNA, 17 nt, Molluscum contagiosum virus
cucgcgcgcgagcacgu

SEQ ID NO: 3106050 - RNA, 17 nt, Molluscum contagiosum virus
cucgcgacgugcgcgcu

SEQ ID NO: 3106051 - RNA, 14 nt, Molluscum contagiosum virus
cucgcgagaaguuc

SEQ ID NO: 3106052 - RNA, 22 nt, Molluscum contagiosum virus
cucgcgagaaguucugcacagc

SEQ ID NO: 3106053 - RNA, 19 nt, Molluscum contagiosum virus
cucgcgagcgccacuagca

SEQ ID NO: 3106054 - RNA, 16 nt, Molluscum contagiosum virus
cucgcgagggcucguc

SEQ ID NO: 3106055 - RNA, 20 nt, Molluscum contagiosum virus
cucgcgcaauacugcgggcu

SEQ ID NO: 3106056 - RNA, 17 nt, Molluscum contagiosum virus
cucgcgcacgaccacgu

SEQ ID NO: 3106057 - RNA, 17 nt, Molluscum contagiosum virus
cucgcgcaucugccgcg

SEQ ID NO: 3106058 - RNA, 20 nt, Molluscum contagiosum virus
gagcacaaagagacgcggcc

SEQ ID NO: 3106059 - RNA, 23 nt, Molluscum contagiosum virus
gagcacaaagagacgcggccgcg

SEQ ID NO: 3106060 - RNA, 17 nt, Molluscum contagiosum virus
gagcacauacacgcgca

SEQ ID NO: 3106061 - RNA, 16 nt, Molluscum contagiosum virus
gagcaccgcguggcgc

SEQ ID NO: 3106062 - RNA, 17 nt, Molluscum contagiosum virus
gagcaccugucgcgcga

SEQ ID NO: 3106063 - RNA, 22 nt, Molluscum contagiosum virus
gagcacgacuacggcgagccca

SEQ ID NO: 3106064 - RNA, 17 nt, Molluscum contagiosum virus
gagaucgacaagaucaa

SEQ ID NO: 3106065 - RNA, 23 nt, Molluscum contagiosum virus
gagaugauuccgucccccgcgga

SEQ ID NO: 3106066 - RNA, 20 nt, Molluscum contagiosum virus
gagaugcgccuuuuccgcga

SEQ ID NO: 3106067 - RNA, 20 nt, Molluscum contagiosum virus
gagaugcgguccgacucggu

SEQ ID NO: 3106068 - RNA, 23 nt, Molluscum contagiosum virus
gagaugggcccgcgcgcgcagcg

SEQ ID NO: 3106069 - RNA, 16 nt, Molluscum contagiosum virus
gagauggucacgcgca

SEQ ID NO: 3106070 - RNA, 19 nt, Molluscum contagiosum virus
gagaucaacgcgcgcgugc

SEQ ID NO: 3106071 - RNA, 20 nt, Molluscum contagiosum virus
gagaucacggcgugcgcgag

SEQ ID NO: 3106072 - RNA, 20 nt, Molluscum contagiosum virus
gagauccacgcgugcugcgc

SEQ ID NO: 3106073 - RNA, 22 nt, Molluscum contagiosum virus
cucgcugccagagauccgcccg

SEQ ID NO: 3106074 - RNA, 23 nt, Molluscum contagiosum virus
cucgcucggaaagagcgcgcgaa

SEQ ID NO: 3106075 - RNA, 12 nt, Molluscum contagiosum virus
cucgcugcugcc

SEQ ID NO: 3106076 - RNA, 14 nt, Molluscum contagiosum virus
cucgcugcugcucu

SEQ ID NO: 3106077 - RNA, 20 nt, Molluscum contagiosum virus
cucgcuguccuuccgacccg

SEQ ID NO: 3106078 - RNA, 19 nt, Molluscum contagiosum virus
cucggaaaauccgcgcccg

SEQ ID NO: 3106079 - RNA, 16 nt, Molluscum contagiosum virus
cucggaagagcguccg

SEQ ID NO: 3106080 - RNA, 19 nt, Molluscum contagiosum virus
cucggacagugccuccgcg

SEQ ID NO: 3106081 - RNA, 17 nt, Molluscum contagiosum virus
gagaguucugcgcccgc

SEQ ID NO: 3106082 - RNA, 20 nt, Molluscum contagiosum virus
gagaguucugcgcccgcgga

SEQ ID NO: 3106083 - RNA, 20 nt, Molluscum contagiosum virus
cguggcgcugggcgcgccgc

SEQ ID NO: 3106084 - RNA, 21 nt, Molluscum contagiosum virus
cguggcgcugggcgcgccgcg

SEQ ID NO: 3106085 - RNA, 23 nt, Molluscum contagiosum virus
cguggcgcuuggcgagcgcugcc

SEQ ID NO: 3106086 - RNA, 22 nt, Molluscum contagiosum virus
cgugggcaccugcaucgcgccg

SEQ ID NO: 3106087 - RNA, 19 nt, Molluscum contagiosum virus
cgugggcagcuucugcucg

SEQ ID NO: 3106088 - RNA, 22 nt, Molluscum contagiosum virus
cguggcgugcuuguagcgcaag

SEQ ID NO: 3106089 - RNA, 16 nt, Molluscum contagiosum virus
cguggcguugcugcug

SEQ ID NO: 3106090 - RNA, 20 nt, Molluscum contagiosum virus
cguggugguuggcgugcucg

SEQ ID NO: 3106091 - RNA, 15 nt, Molluscum contagiosum virus
cgugguguccacgcg

SEQ ID NO: 3106092 - RNA, 14 nt, Molluscum contagiosum virus
cgugguugcgcagc

SEQ ID NO: 3106093 - RNA, 18 nt, Molluscum contagiosum virus
cguguaccgccgcggccg

SEQ ID NO: 3106094 - RNA, 16 nt, Molluscum contagiosum virus
cguguacgagaaguuc

SEQ ID NO: 3106095 - RNA, 19 nt, Molluscum contagiosum virus
cgugucagcagcgcgagcu

SEQ ID NO: 3106096 - RNA, 18 nt, Molluscum contagiosum virus
cguguccuacacgccgcu

SEQ ID NO: 3106097 - RNA, 13 nt, Molluscum contagiosum virus
cgugucgcggagc

SEQ ID NO: 3106098 - RNA, 19 nt, Molluscum contagiosum virus
cguggaccuuggcgcgccg

SEQ ID NO: 3106099 - RNA, 12 nt, Molluscum contagiosum virus
cguggacgagca

SEQ ID NO: 3106100 - RNA, 19 nt, Molluscum contagiosum virus
cguggaggacaccgccgua

SEQ ID NO: 3106101 - RNA, 20 nt, Molluscum contagiosum virus
cguggaggacaccgccguac

SEQ ID NO: 3106102 - RNA, 20 nt, Molluscum contagiosum virus
cguggagucacgaccgaccc

SEQ ID NO: 3106103 - RNA, 19 nt, Molluscum contagiosum virus
cguggauaccaugcucucg

SEQ ID NO: 3106104 - RNA, 18 nt, Molluscum contagiosum virus
cguggccaggccgcgccg

SEQ ID NO: 3106105 - RNA, 16 nt, Molluscum contagiosum virus
cguggcgccgcugcug

SEQ ID NO: 3106106 - RNA, 13 nt, Molluscum contagiosum virus
cguggcgcgccgg

SEQ ID NO: 3106107 - RNA, 14 nt, Molluscum contagiosum virus
cguggcgcgccggc

SEQ ID NO: 3106108 - RNA, 14 nt, Molluscum contagiosum virus
cguggcgcgcgagc

SEQ ID NO: 3106109 - RNA, 15 nt, Molluscum contagiosum virus
cguggcgcgcgagcu

SEQ ID NO: 3106110 - RNA, 19 nt, Molluscum contagiosum virus
cguguuccggcagcgccgc

SEQ ID NO: 3106111 - RNA, 23 nt, Molluscum contagiosum virus
cguguguccgcacgcacacgacg

SEQ ID NO: 3106112 - RNA, 14 nt, Molluscum contagiosum virus
cgugugcgagcacg

SEQ ID NO: 3106113 - RNA, 17 nt, Molluscum contagiosum virus
cguggucgccgcggccg

SEQ ID NO: 3106114 - RNA, 16 nt, Molluscum contagiosum virus
cgugggcgagcgcacg

SEQ ID NO: 3106115 - RNA, 12 nt, Molluscum contagiosum virus
cgugggcgccgc

SEQ ID NO: 3106116 - RNA, 22 nt, Molluscum contagiosum virus
cgugucuggagcccacguugcc

SEQ ID NO: 3106117 - RNA, 21 nt, Molluscum contagiosum virus
cgugucugguguauccaggau

SEQ ID NO: 3106118 - RNA, 21 nt, Molluscum contagiosum virus
cucgaggccggcacgagcagu

SEQ ID NO: 3106119 - RNA, 14 nt, Molluscum contagiosum virus
cucgagugcacgua

SEQ ID NO: 3106120 - RNA, 17 nt, Molluscum contagiosum virus
cucgauggacgccagcu

SEQ ID NO: 3106121 - RNA, 17 nt, Molluscum contagiosum virus
cucgcacacgugcacgu

SEQ ID NO: 3106122 - RNA, 21 nt, Molluscum contagiosum virus
cucgcagccuccgugcgccag

SEQ ID NO: 3106123 - RNA, 15 nt, Molluscum contagiosum virus
cucgcagcucacgag

SEQ ID NO: 3106124 - RNA, 23 nt, Molluscum contagiosum virus
cucgcaggcgaggucacacucga

SEQ ID NO: 3106125 - RNA, 22 nt, Molluscum contagiosum virus
cucgcaggcggugggcgccgcg

SEQ ID NO: 3106126 - RNA, 22 nt, Molluscum contagiosum virus
cucgccaguggccagcgcgcgg

SEQ ID NO: 3106127 - RNA, 20 nt, Molluscum contagiosum virus
cucgcccgacuuuucgcgcc

SEQ ID NO: 3106128 - RNA, 20 nt, Molluscum contagiosum virus
cucgcccgcgcgcgcgcgaa

SEQ ID NO: 3106129 - RNA, 15 nt, Molluscum contagiosum virus
ccggaacgccgugcg

SEQ ID NO: 3106130 - RNA, 17 nt, Molluscum contagiosum virus
ccgcuucgugcgcggag

SEQ ID NO: 3106131 - RNA, 15 nt, Molluscum contagiosum virus
ccggagacaccagcu

SEQ ID NO: 3106132 - RNA, 14 nt, Molluscum contagiosum virus
ccggacguccaucc

SEQ ID NO: 3106133 - RNA, 20 nt, Molluscum contagiosum virus
ccggacgauaaauggaccuc

SEQ ID NO: 3106134 - RNA, 15 nt, Molluscum contagiosum virus
ccggacgcgcgaacu

SEQ ID NO: 3106135 - RNA, 15 nt, Molluscum contagiosum virus
ccggcacgugccccg

SEQ ID NO: 3106136 - RNA, 21 nt, Molluscum contagiosum virus
ccggcacgugccccgcgcgug

SEQ ID NO: 3106137 - RNA, 14 nt, Molluscum contagiosum virus
ccggcacgugcccg

SEQ ID NO: 3106138 - RNA, 15 nt, Molluscum contagiosum virus
ccggcagcgcauccg

SEQ ID NO: 3106139 - RNA, 13 nt, Molluscum contagiosum virus
ccggcagcgccgc

SEQ ID NO: 3106140 - RNA, 14 nt, Molluscum contagiosum virus
ccggcagcgccgcg

SEQ ID NO: 3106141 - RNA, 19 nt, Molluscum contagiosum virus
ccggcagcgccgcgcgcgc

SEQ ID NO: 3106142 - RNA, 14 nt, Molluscum contagiosum virus
ccggcagcgcgccu

SEQ ID NO: 3106143 - RNA, 16 nt, Molluscum contagiosum virus
ccggcagcgcgccuag

SEQ ID NO: 3106144 - RNA, 18 nt, Molluscum contagiosum virus
ccggcagcuggagcugcc

SEQ ID NO: 3106145 - RNA, 21 nt, Molluscum contagiosum virus
ccggcagcuggagcugccgcu

SEQ ID NO: 3106146 - RNA, 18 nt, Molluscum contagiosum virus
ccggcacccgugcgcgcg

SEQ ID NO: 3106147 - RNA, 19 nt, Molluscum contagiosum virus
ccggaaagaagggcucgcc

SEQ ID NO: 3106148 - RNA, 20 nt, Molluscum contagiosum virus
ccggaaagauauacaccagg

SEQ ID NO: 3106149 - RNA, 13 nt, Molluscum contagiosum virus
gaugcugcgcgug

SEQ ID NO: 3106150 - RNA, 21 nt, Molluscum contagiosum virus
gaugcuggacgggcacgagca

SEQ ID NO: 3106151 - RNA, 20 nt, Molluscum contagiosum virus
gauggaccgguuccgugcgc

SEQ ID NO: 3106152 - RNA, 14 nt, Molluscum contagiosum virus
gauggacgccagcu

SEQ ID NO: 3106153 - RNA, 12 nt, Molluscum contagiosum virus
gauggcgcugag

SEQ ID NO: 3106154 - RNA, 16 nt, Molluscum contagiosum virus
gauggcguccucgcuc

SEQ ID NO: 3106155 - RNA, 13 nt, Molluscum contagiosum virus
gauggcguggcgg

SEQ ID NO: 3106156 - RNA, 14 nt, Molluscum contagiosum virus
gauggcucgcgggc

SEQ ID NO: 3106157 - RNA, 16 nt, Molluscum contagiosum virus
gaugcucaagcacugc

SEQ ID NO: 3106158 - RNA, 18 nt, Molluscum contagiosum virus
gaugcucuacgugcugca

SEQ ID NO: 3106159 - RNA, 16 nt, Molluscum contagiosum virus
gaugcuagcgugugcc

SEQ ID NO: 3106160 - RNA, 20 nt, Molluscum contagiosum virus
gaugccgugguacacguaga

SEQ ID NO: 3106161 - RNA, 22 nt, Molluscum contagiosum virus
gaugcagugcggaugugcuagc

SEQ ID NO: 3106162 - RNA, 17 nt, Molluscum contagiosum virus
gaugacgggcacgcuca

SEQ ID NO: 3106163 - RNA, 18 nt, Molluscum contagiosum virus
gaugaguaccgcgggcgc

SEQ ID NO: 3106164 - RNA, 22 nt, Molluscum contagiosum virus
gaugcaaacauguagcgcgcgc

SEQ ID NO: 3106165 - RNA, 16 nt, Molluscum contagiosum virus
gaugaacuaccgugug

SEQ ID NO: 3106166 - RNA, 16 nt, Molluscum contagiosum virus
gaucuugaugaccacg

SEQ ID NO: 3106167 - RNA, 16 nt, Molluscum contagiosum virus
gaugaacgcgcugcgc

SEQ ID NO: 3106168 - RNA, 14 nt, Molluscum contagiosum virus
gaucgcgagaacgc

SEQ ID NO: 3106169 - RNA, 18 nt, Molluscum contagiosum virus
gaucaggcagcugcugcg

SEQ ID NO: 3106170 - RNA, 16 nt, Molluscum contagiosum virus
gaucacaaguccgcgg

SEQ ID NO: 3106171 - RNA, 15 nt, Molluscum contagiosum virus
gaucacgaugugcgc

SEQ ID NO: 3106172 - RNA, 16 nt, Molluscum contagiosum virus
gaucacgaugugcgcg

SEQ ID NO: 3106173 - RNA, 15 nt, Molluscum contagiosum virus
gaucacggcgugcgc

SEQ ID NO: 3106174 - RNA, 16 nt, Molluscum contagiosum virus
gaucacggcgugcgcg

SEQ ID NO: 3106175 - RNA, 17 nt, Molluscum contagiosum virus
gaucagccccgcgccag

SEQ ID NO: 3106176 - RNA, 15 nt, Molluscum contagiosum virus
gagcgucgaacuucu

SEQ ID NO: 3106177 - RNA, 22 nt, Molluscum contagiosum virus
gagcucaaucucgcccagcacc

SEQ ID NO: 3106178 - RNA, 22 nt, Molluscum contagiosum virus
gagcucacgccggaccagaucc

SEQ ID NO: 3106179 - RNA, 16 nt, Molluscum contagiosum virus
gagcuccccgcgcgca

SEQ ID NO: 3106180 - RNA, 17 nt, Molluscum contagiosum virus
gagcucgaaaaaguucu

SEQ ID NO: 3106181 - RNA, 13 nt, Molluscum contagiosum virus
gagcucgcgcgca

SEQ ID NO: 3106182 - RNA, 19 nt, Molluscum contagiosum virus
gagcucgcgcgccagcacg

SEQ ID NO: 3106183 - RNA, 23 nt, Molluscum contagiosum virus
gagcucgcgcgccagcacgcgcu

SEQ ID NO: 3106184 - RNA, 16 nt, Molluscum contagiosum virus
gagcucgucgcgcgcg

SEQ ID NO: 3106185 - RNA, 19 nt, Molluscum contagiosum virus
gagcucugucccgcaagcc

SEQ ID NO: 3106186 - RNA, 14 nt, Molluscum contagiosum virus
gaucaacgcgcgcg

SEQ ID NO: 3106187 - RNA, 20 nt, Molluscum contagiosum virus
gagcggcacgggaaggcucu

SEQ ID NO: 3106188 - RNA, 20 nt, Molluscum contagiosum virus
gagcggcauggaaagcuucu

SEQ ID NO: 3106189 - RNA, 22 nt, Molluscum contagiosum virus
gagcggccuccggagaagcuuu

SEQ ID NO: 3106190 - RNA, 20 nt, Molluscum contagiosum virus
gagcggcgacuugcugcgga

SEQ ID NO: 3106191 - RNA, 14 nt, Molluscum contagiosum virus
gagcggcgcgcgcu

SEQ ID NO: 3106192 - RNA, 12 nt, Molluscum contagiosum virus
gagcgcgcacga

SEQ ID NO: 3106193 - RNA, 12 nt, Molluscum contagiosum virus
gagcgcgcgcac

SEQ ID NO: 3106194 - RNA, 22 nt, Molluscum contagiosum virus
gagcgcgcggcgccgagcaacu

SEQ ID NO: 3106195 - RNA, 12 nt, Molluscum contagiosum virus
gagcgcgcgugc

SEQ ID NO: 3106196 - RNA, 18 nt, Molluscum contagiosum virus
gagcgcggcaacagcacg

SEQ ID NO: 3106197 - RNA, 21 nt, Molluscum contagiosum virus
gagcgcggcuuacacacgcac

SEQ ID NO: 3106198 - RNA, 20 nt, Molluscum contagiosum virus
gagcgcguccaugagcaucu

SEQ ID NO: 3106199 - RNA, 13 nt, Molluscum contagiosum virus
gagcgcugccgcu

SEQ ID NO: 3106200 - RNA, 20 nt, Molluscum contagiosum virus
gagcgcccgugcuugcgcac

SEQ ID NO: 3106201 - RNA, 19 nt, Molluscum contagiosum virus
gagcgccgccagcuccgcg

SEQ ID NO: 3106202 - RNA, 15 nt, Molluscum contagiosum virus
gagcgccgcgugcgc

SEQ ID NO: 3106203 - RNA, 18 nt, Molluscum contagiosum virus
cucacaccuagagcacga

SEQ ID NO: 3106204 - RNA, 16 nt, Molluscum contagiosum virus
cucaacucguaggaca

SEQ ID NO: 3106205 - RNA, 20 nt, Molluscum contagiosum virus
cucaagagccgcuucgggcu

SEQ ID NO: 3106206 - RNA, 16 nt, Molluscum contagiosum virus
cucacgcgcuaccgca

SEQ ID NO: 3106207 - RNA, 17 nt, Molluscum contagiosum virus
cucacgcuucguggcca

SEQ ID NO: 3106208 - RNA, 19 nt, Molluscum contagiosum virus
cucacggccuucgcguucc

SEQ ID NO: 3106209 - RNA, 16 nt, Molluscum contagiosum virus
cucacggcgagcgcgc

SEQ ID NO: 3106210 - RNA, 20 nt, Molluscum contagiosum virus
cucacggcgagcgcgcccuu

SEQ ID NO: 3106211 - RNA, 21 nt, Molluscum contagiosum virus
cucacgugcugaucacgcucg

SEQ ID NO: 3106212 - RNA, 22 nt, Molluscum contagiosum virus
cgcgcuuuuugccgcucacagc

SEQ ID NO: 3106213 - RNA, 16 nt, Molluscum contagiosum virus
cgcgcuuugcgcggcg

SEQ ID NO: 3106214 - RNA, 13 nt, Molluscum contagiosum virus
cgcgcuugcgcgg

SEQ ID NO: 3106215 - RNA, 24 nt, Molluscum contagiosum virus
cgcgcuuagcacacgcgcgcgcag

SEQ ID NO: 3106216 - RNA, 18 nt, Molluscum contagiosum virus
cgcgcuuccgcgagucug

SEQ ID NO: 3106217 - RNA, 18 nt, Molluscum contagiosum virus
cgcgcuggcgcgcgcgcu

SEQ ID NO: 3106218 - RNA, 18 nt, Molluscum contagiosum virus
cgcgcuccauguacgucg

SEQ ID NO: 3106219 - RNA, 14 nt, Molluscum contagiosum virus
cgcgcuccgagucg

SEQ ID NO: 3106220 - RNA, 16 nt, Molluscum contagiosum virus
cgcgcugagcgcggag

SEQ ID NO: 3106221 - RNA, 20 nt, Molluscum contagiosum virus
cgcgcugaucaccgaggagc

SEQ ID NO: 3106222 - RNA, 21 nt, Molluscum contagiosum virus
cgcgcugcacgccgccagcga

SEQ ID NO: 3106223 - RNA, 13 nt, Molluscum contagiosum virus
cgcgcugcgcaag

SEQ ID NO: 3106224 - RNA, 13 nt, Molluscum contagiosum virus
cgcgcugcgcacg

SEQ ID NO: 3106225 - RNA, 14 nt, Molluscum contagiosum virus
cgcgcugcgcacgu

SEQ ID NO: 3106226 - RNA, 14 nt, Molluscum contagiosum virus
cgcgcugcgccacu

SEQ ID NO: 3106227 - RNA, 14 nt, Molluscum contagiosum virus
cgcgcugcgcgccg

SEQ ID NO: 3106228 - RNA, 15 nt, Molluscum contagiosum virus
cgcgcugcgcgcgcu

SEQ ID NO: 3106229 - RNA, 20 nt, Molluscum contagiosum virus
cgcgcugcuucccgcugagc

SEQ ID NO: 3106230 - RNA, 19 nt, Molluscum contagiosum virus
cgcgcuggacuugcgcgag

SEQ ID NO: 3106231 - RNA, 21 nt, Molluscum contagiosum virus
cgcgcuggacuugcgcgagcg

SEQ ID NO: 3106232 - RNA, 17 nt, Molluscum contagiosum virus
cgcgcucacccugcacg

SEQ ID NO: 3106233 - RNA, 14 nt, Molluscum contagiosum virus
cgcgcucacugcag

SEQ ID NO: 3106234 - RNA, 16 nt, Molluscum contagiosum virus
cgcgcucacugcagca

SEQ ID NO: 3106235 - RNA, 19 nt, Molluscum contagiosum virus
cgcgcucacugcagcagcc

SEQ ID NO: 3106236 - RNA, 20 nt, Molluscum contagiosum virus
cgcgcucgaacgcgcgugcg

SEQ ID NO: 3106237 - RNA, 16 nt, Molluscum contagiosum virus
cgcgcucgacgcgugc

SEQ ID NO: 3106238 - RNA, 17 nt, Molluscum contagiosum virus
cgcgcucgacgcgugca

SEQ ID NO: 3106239 - RNA, 13 nt, Molluscum contagiosum virus
cgcgcucgcgcag

SEQ ID NO: 3106240 - RNA, 15 nt, Molluscum contagiosum virus
cgcgcucgcgcuucc

SEQ ID NO: 3106241 - RNA, 15 nt, Molluscum contagiosum virus
cgcgcucgcgugccg

SEQ ID NO: 3106242 - RNA, 20 nt, Molluscum contagiosum virus
cgcgcucgcgugccgcggac

SEQ ID NO: 3106243 - RNA, 19 nt, Molluscum contagiosum virus
cgcgcucgcucgcgcuccg

SEQ ID NO: 3106244 - RNA, 20 nt, Molluscum contagiosum virus
cgcgcucgucaaugcgcacg

SEQ ID NO: 3106245 - RNA, 18 nt, Molluscum contagiosum virus
cgcgcucguccgccgcgu

SEQ ID NO: 3106246 - RNA, 13 nt, Molluscum contagiosum virus
cgcgcucucacgc

SEQ ID NO: 3106247 - RNA, 22 nt, Molluscum contagiosum virus
cgcgcucugccgcccgcgcccg

SEQ ID NO: 3106248 - RNA, 16 nt, Molluscum contagiosum virus
cgcgcguugcugcccg

SEQ ID NO: 3106249 - RNA, 18 nt, Molluscum contagiosum virus
cgcgcguugcugcccgug

SEQ ID NO: 3106250 - RNA, 17 nt, Molluscum contagiosum virus
cgcgcuaccugcgcaag

SEQ ID NO: 3106251 - RNA, 14 nt, Molluscum contagiosum virus
cgcgcuacgcgccg

SEQ ID NO: 3106252 - RNA, 16 nt, Molluscum contagiosum virus
cgcgcuacgcgccgag

SEQ ID NO: 3106253 - RNA, 22 nt, Molluscum contagiosum virus
cgcgcuacugcgcgcacugcuc

SEQ ID NO: 3106254 - RNA, 16 nt, Molluscum contagiosum virus
cgcgcuagcuccacgu

SEQ ID NO: 3106255 - RNA, 20 nt, Molluscum contagiosum virus
cgcgcuauucaaagcugugc

SEQ ID NO: 3106256 - RNA, 21 nt, Molluscum contagiosum virus
cgcgcuauucaaagcugugcg

SEQ ID NO: 3106257 - RNA, 22 nt, Molluscum contagiosum virus
gagcaugccgccgcguacgcgc

SEQ ID NO: 3106258 - RNA, 21 nt, Molluscum contagiosum virus
cucccgcacgcaccgcgacau

SEQ ID NO: 3106259 - RNA, 15 nt, Molluscum contagiosum virus
cucaucaagcccgag

SEQ ID NO: 3106260 - RNA, 12 nt, Molluscum contagiosum virus
gagccccgcgga

SEQ ID NO: 3106261 - RNA, 22 nt, Molluscum contagiosum virus
gagcccgaucuugaaugucgcg

SEQ ID NO: 3106262 - RNA, 13 nt, Molluscum contagiosum virus
gagcccgcggcgc

SEQ ID NO: 3106263 - RNA, 18 nt, Molluscum contagiosum virus
gagcccggaucagccccg

SEQ ID NO: 3106264 - RNA, 19 nt, Molluscum contagiosum virus
gagccgcgcgagcgcgccc

SEQ ID NO: 3106265 - RNA, 14 nt, Molluscum contagiosum virus
gagccgcccgcgga

SEQ ID NO: 3106266 - RNA, 20 nt, Molluscum contagiosum virus
gagcgcaguuguuugucgcg

SEQ ID NO: 3106267 - RNA, 19 nt, Molluscum contagiosum virus
gagcgcaugccggggauga

SEQ ID NO: 3106268 - RNA, 14 nt, Molluscum contagiosum virus
gagcgcaugcgcgc

SEQ ID NO: 3106269 - RNA, 18 nt, Molluscum contagiosum virus
gagcgcaugcgcgccgcg

SEQ ID NO: 3106270 - RNA, 14 nt, Molluscum contagiosum virus
gagcgagcacgcca

SEQ ID NO: 3106271 - RNA, 22 nt, Molluscum contagiosum virus
gagcgaguucgcacgcuagcga

SEQ ID NO: 3106272 - RNA, 15 nt, Molluscum contagiosum virus
gagcgcagcugccgg

SEQ ID NO: 3106273 - RNA, 23 nt, Molluscum contagiosum virus
cucacucacaugugcugccggcu

SEQ ID NO: 3106274 - RNA, 14 nt, Molluscum contagiosum virus
cucacugcagcagc

SEQ ID NO: 3106275 - RNA, 16 nt, Molluscum contagiosum virus
cucagccgagcgccgc

SEQ ID NO: 3106276 - RNA, 14 nt, Molluscum contagiosum virus
cucauagcgccacg

SEQ ID NO: 3106277 - RNA, 20 nt, Molluscum contagiosum virus
cucauagcgccacgagcagu

SEQ ID NO: 3106278 - RNA, 20 nt, Molluscum contagiosum virus
cucagcggcacugcgcgcau

SEQ ID NO: 3106279 - RNA, 21 nt, Molluscum contagiosum virus
cucaggacaaagucgcgcgcg

SEQ ID NO: 3106280 - RNA, 23 nt, Molluscum contagiosum virus
cucaugcgcgggaugcuggacgg

SEQ ID NO: 3106281 - RNA, 17 nt, Molluscum contagiosum virus
cuccaacguuuucggcu

SEQ ID NO: 3106282 - RNA, 13 nt, Molluscum contagiosum virus
cuccacgcccgag

SEQ ID NO: 3106283 - RNA, 20 nt, Molluscum contagiosum virus
cuccacgcugcguucgagcu

SEQ ID NO: 3106284 - RNA, 17 nt, Molluscum contagiosum virus
cucaucggcgagcucuu

SEQ ID NO: 3106285 - RNA, 13 nt, Molluscum contagiosum virus
cuccagcgccagc

SEQ ID NO: 3106286 - RNA, 20 nt, Molluscum contagiosum virus
cuccagcgcgcccucgcgcg

SEQ ID NO: 3106287 - RNA, 16 nt, Molluscum contagiosum virus
cuccaggaacgcgccg

SEQ ID NO: 3106288 - RNA, 19 nt, Molluscum contagiosum virus
cuccaggggaaugaucgac

SEQ ID NO: 3106289 - RNA, 16 nt, Molluscum contagiosum virus
cuccaugagguacucc

SEQ ID NO: 3106290 - RNA, 13 nt, Molluscum contagiosum virus
ccgcccgaguccg

SEQ ID NO: 3106291 - RNA, 13 nt, Molluscum contagiosum virus
ccgcccgcgcccg

SEQ ID NO: 3106292 - RNA, 21 nt, Molluscum contagiosum virus
ccgcccuuguggacgcgcgag

SEQ ID NO: 3106293 - RNA, 18 nt, Molluscum contagiosum virus
ccgccgacaacgcacccg

SEQ ID NO: 3106294 - RNA, 20 nt, Molluscum contagiosum virus
ccgccgacaacgcacccgcg

SEQ ID NO: 3106295 - RNA, 14 nt, Molluscum contagiosum virus
ccgccgcgugcccg

SEQ ID NO: 3106296 - RNA, 13 nt, Molluscum contagiosum virus
ccgccggcgccgc

SEQ ID NO: 3106297 - RNA, 14 nt, Molluscum contagiosum virus
ccgccgcgcgcgau

SEQ ID NO: 3106298 - RNA, 16 nt, Molluscum contagiosum virus
ccgccggucuccacgu

SEQ ID NO: 3106299 - RNA, 17 nt, Molluscum contagiosum virus
ccgccugcugcagcucc

SEQ ID NO: 3106300 - RNA, 14 nt, Molluscum contagiosum virus
ccgccuguaccugc

SEQ ID NO: 3106301 - RNA, 20 nt, Molluscum contagiosum virus
ccgccuuuguggacgcgcaa

SEQ ID NO: 3106302 - RNA, 15 nt, Molluscum contagiosum virus
ccgccaugcugcgcg

SEQ ID NO: 3106303 - RNA, 23 nt, Molluscum contagiosum virus
ccgcgaaagaggaaagcgcacac

SEQ ID NO: 3106304 - RNA, 23 nt, Molluscum contagiosum virus
ccgcgaacgagaaaugcgcacac

SEQ ID NO: 3106305 - RNA, 22 nt, Molluscum contagiosum virus
ccgcgacaugccucgcggcccg

SEQ ID NO: 3106306 - RNA, 12 nt, Molluscum contagiosum virus
ccgcgaagagca

SEQ ID NO: 3106307 - RNA, 15 nt, Molluscum contagiosum virus
ccgcgaagagcacga

SEQ ID NO: 3106308 - RNA, 17 nt, Molluscum contagiosum virus
ccgcgaaguccugggcg

SEQ ID NO: 3106309 - RNA, 17 nt, Molluscum contagiosum virus
ccgcgacgaacucgaca

SEQ ID NO: 3106310 - RNA, 19 nt, Molluscum contagiosum virus
ccgcgagcacuggcuggcg

SEQ ID NO: 3106311 - RNA, 19 nt, Molluscum contagiosum virus
ccgcgagcgcaugcgcgcc

SEQ ID NO: 3106312 - RNA, 23 nt, Molluscum contagiosum virus
ccgcgcaauacgguggaggcgac

SEQ ID NO: 3106313 - RNA, 12 nt, Molluscum contagiosum virus
ccgcgcaccgcg

SEQ ID NO: 3106314 - RNA, 17 nt, Molluscum contagiosum virus
ccgcgccuagccgugcg

SEQ ID NO: 3106315 - RNA, 15 nt, Molluscum contagiosum virus
ccgcgcgagcgcgcc

SEQ ID NO: 3106316 - RNA, 16 nt, Molluscum contagiosum virus
ccgcgcgagcgcgccc

SEQ ID NO: 3106317 - RNA, 17 nt, Molluscum contagiosum virus
ccgcgcgagcgcgcccc

SEQ ID NO: 3106318 - RNA, 13 nt, Molluscum contagiosum virus
ccgcgcgcacgcg

SEQ ID NO: 3106319 - RNA, 18 nt, Molluscum contagiosum virus
ccgcgcgcccgcugcgcg

SEQ ID NO: 3106320 - RNA, 17 nt, Molluscum contagiosum virus
ccgcgcgccgcgcgccg

SEQ ID NO: 3106321 - RNA, 19 nt, Molluscum contagiosum virus
ccgcgcgcgcaagcgccgc

SEQ ID NO: 3106322 - RNA, 12 nt, Molluscum contagiosum virus
ccgcgcgcgcca

SEQ ID NO: 3106323 - RNA, 13 nt, Molluscum contagiosum virus
ccgcgcgcgccag

SEQ ID NO: 3106324 - RNA, 20 nt, Molluscum contagiosum virus
ccgcgcgcgccagcuaugcg

SEQ ID NO: 3106325 - RNA, 13 nt, Molluscum contagiosum virus
ccgcgcgcgcgcg

SEQ ID NO: 3106326 - RNA, 16 nt, Molluscum contagiosum virus
ccgcgcgcgcgcgaac

SEQ ID NO: 3106327 - RNA, 15 nt, Molluscum contagiosum virus
ccgcgcgcgcgcgug

SEQ ID NO: 3106328 - RNA, 22 nt, Molluscum contagiosum virus
ccgcgcgcggcuaagcucugcg

SEQ ID NO: 3106329 - RNA, 17 nt, Molluscum contagiosum virus
ccgcgcacugccacgcg

SEQ ID NO: 3106330 - RNA, 13 nt, Molluscum contagiosum virus
ccgcgcagcgugc

SEQ ID NO: 3106331 - RNA, 17 nt, Molluscum contagiosum virus
ccgcgcaugccagaccc

SEQ ID NO: 3106332 - RNA, 12 nt, Molluscum contagiosum virus
ccgcgccacgag

SEQ ID NO: 3106333 - RNA, 13 nt, Molluscum contagiosum virus
ccgcgccagcgac

SEQ ID NO: 3106334 - RNA, 19 nt, Molluscum contagiosum virus
ccgcgcccaagaagaagca

SEQ ID NO: 3106335 - RNA, 18 nt, Molluscum contagiosum virus
ccgcgcccgcggcgcacg

SEQ ID NO: 3106336 - RNA, 22 nt, Molluscum contagiosum virus
ccgcgcgggccaugucugugcg

SEQ ID NO: 3106337 - RNA, 13 nt, Molluscum contagiosum virus
ccgcgccgcgccg

SEQ ID NO: 3106338 - RNA, 14 nt, Molluscum contagiosum virus
ccgcgccgggcgcc

SEQ ID NO: 3106339 - RNA, 12 nt, Molluscum contagiosum virus
ccgcgcucgaca

SEQ ID NO: 3106340 - RNA, 14 nt, Molluscum contagiosum virus
ccgcgcucgccgca

SEQ ID NO: 3106341 - RNA, 21 nt, Molluscum contagiosum virus
ccgcgcucgccgcacgcgaag

SEQ ID NO: 3106342 - RNA, 16 nt, Molluscum contagiosum virus
ccgcgcugaugcuagc

SEQ ID NO: 3106343 - RNA, 11 nt, Molluscum contagiosum virus
ccgcgcgucug

SEQ ID NO: 3106344 - RNA, 17 nt, Molluscum contagiosum virus
ccgcgcgucugcgagug

SEQ ID NO: 3106345 - RNA, 12 nt, Molluscum contagiosum virus
ccgcgcguugcu

SEQ ID NO: 3106346 - RNA, 22 nt, Molluscum contagiosum virus
ccgcgcguuuucccgaggcguc

SEQ ID NO: 3106347 - RNA, 14 nt, Molluscum contagiosum virus
ccgcgcugcgcaag

SEQ ID NO: 3106348 - RNA, 13 nt, Molluscum contagiosum virus
ccgcgcugcgcgg

SEQ ID NO: 3106349 - RNA, 16 nt, Molluscum contagiosum virus
ccgcgcuucgagcacg

SEQ ID NO: 3106350 - RNA, 15 nt, Molluscum contagiosum virus
ccgcgcuuugcgcgg

SEQ ID NO: 3106351 - RNA, 17 nt, Molluscum contagiosum virus
ccgcggaagugcgagcc

SEQ ID NO: 3106352 - RNA, 19 nt, Molluscum contagiosum virus
ccgcggaagugcgagccgu

SEQ ID NO: 3106353 - RNA, 18 nt, Molluscum contagiosum virus
ccgcggacgccggcgccc

SEQ ID NO: 3106354 - RNA, 15 nt, Molluscum contagiosum virus
cgcgcgugagcacgg

SEQ ID NO: 3106355 - RNA, 17 nt, Molluscum contagiosum virus
cgcgcgugccgcccgag

SEQ ID NO: 3106356 - RNA, 23 nt, Molluscum contagiosum virus
cgcgcgugccuguggcgcacacg

SEQ ID NO: 3106357 - RNA, 14 nt, Molluscum contagiosum virus
cgcgcgugcucgac

SEQ ID NO: 3106358 - RNA, 21 nt, Molluscum contagiosum virus
cgcgacuccaucugcgcgacg

SEQ ID NO: 3106359 - RNA, 18 nt, Molluscum contagiosum virus
cgcgacuggcacgcgccg

SEQ ID NO: 3106360 - RNA, 20 nt, Molluscum contagiosum virus
cgcgacuggcacgcgccgcg

SEQ ID NO: 3106361 - RNA, 15 nt, Molluscum contagiosum virus
cgcgacuucgcccgu

SEQ ID NO: 3106362 - RNA, 16 nt, Molluscum contagiosum virus
cgcgcgucugcgagug

SEQ ID NO: 3106363 - RNA, 20 nt, Molluscum contagiosum virus
cgcgcgucugcgaguggcgc

SEQ ID NO: 3106364 - RNA, 16 nt, Molluscum contagiosum virus
cgcgacgugcgcgcug

SEQ ID NO: 3106365 - RNA, 15 nt, Molluscum contagiosum virus
cgcgaccgcaccgag

SEQ ID NO: 3106366 - RNA, 15 nt, Molluscum contagiosum virus
cgcgaccggcgugcc

SEQ ID NO: 3106367 - RNA, 21 nt, Molluscum contagiosum virus
cgcgacgacggcacgcugagc

SEQ ID NO: 3106368 - RNA, 15 nt, Molluscum contagiosum virus
cgcgacgagcagacg

SEQ ID NO: 3106369 - RNA, 16 nt, Molluscum contagiosum virus
cgcgacgagcucacgc

SEQ ID NO: 3106370 - RNA, 16 nt, Molluscum contagiosum virus
cgcgacgauggccacg

SEQ ID NO: 3106371 - RNA, 20 nt, Molluscum contagiosum virus
cgcgacgccguccgcgcagc

SEQ ID NO: 3106372 - RNA, 13 nt, Molluscum contagiosum virus
cgcgacgcgcgug

SEQ ID NO: 3106373 - RNA, 17 nt, Molluscum contagiosum virus
cgcgacgcgcguggagc

SEQ ID NO: 3106374 - RNA, 17 nt, Molluscum contagiosum virus
cgcgacgcguccgccuc

SEQ ID NO: 3106375 - RNA, 22 nt, Molluscum contagiosum virus
cgcgacggcgugcuggccagcc

SEQ ID NO: 3106376 - RNA, 15 nt, Molluscum contagiosum virus
cgcgacgggaaccgu

SEQ ID NO: 3106377 - RNA, 15 nt, Molluscum contagiosum virus
cgccugcucucgcgc

SEQ ID NO: 3106378 - RNA, 21 nt, Molluscum contagiosum virus
cgccugcucucgcgcgccagc

SEQ ID NO: 3106379 - RNA, 16 nt, Molluscum contagiosum virus
cgcgacaggggccaca

SEQ ID NO: 3106380 - RNA, 15 nt, Molluscum contagiosum virus
cgcgacaugcugccc

SEQ ID NO: 3106381 - RNA, 19 nt, Molluscum contagiosum virus
cgcgaacgugcgaacacgg

SEQ ID NO: 3106382 - RNA, 19 nt, Molluscum contagiosum virus
cgcgaauuggccgcggagg

SEQ ID NO: 3106383 - RNA, 20 nt, Molluscum contagiosum virus
cgcgaauuggccgcggagga

SEQ ID NO: 3106384 - RNA, 17 nt, Molluscum contagiosum virus
cgcgacaagcgcgucug

SEQ ID NO: 3106385 - RNA, 14 nt, Molluscum contagiosum virus
cgcgaacgcgucca

SEQ ID NO: 3106386 - RNA, 16 nt, Molluscum contagiosum virus
cgcgaacgcguccacg

SEQ ID NO: 3106387 - RNA, 20 nt, Molluscum contagiosum virus
cgcgaacgcguccacggcgc

SEQ ID NO: 3106388 - RNA, 23 nt, Molluscum contagiosum virus
cgccuucuugcuggcgcucgcgc

SEQ ID NO: 3106389 - RNA, 18 nt, Molluscum contagiosum virus
cgccuugcagcgcagcag

SEQ ID NO: 3106390 - RNA, 15 nt, Molluscum contagiosum virus
cgccuugccgaggag

SEQ ID NO: 3106391 - RNA, 13 nt, Molluscum contagiosum virus
cgccuuugcgcug

SEQ ID NO: 3106392 - RNA, 21 nt, Molluscum contagiosum virus
cgcgaaaaccggaggcugcgc

SEQ ID NO: 3106393 - RNA, 15 nt, Molluscum contagiosum virus
cgcgaaagaacacgg

SEQ ID NO: 3106394 - RNA, 22 nt, Molluscum contagiosum virus
cgcgaaagcgucgugcuccacg

SEQ ID NO: 3106395 - RNA, 13 nt, Molluscum contagiosum virus
cgccuuccugcug

SEQ ID NO: 3106396 - RNA, 15 nt, Molluscum contagiosum virus
cgccuuccugcuggc

SEQ ID NO: 3106397 - RNA, 15 nt, Molluscum contagiosum virus
cgccugccgcgagca

SEQ ID NO: 3106398 - RNA, 22 nt, Molluscum contagiosum virus
cgccugccgcgagcacuggcug

SEQ ID NO: 3106399 - RNA, 16 nt, Molluscum contagiosum virus
ccgggcucgggcucga

SEQ ID NO: 3106400 - RNA, 18 nt, Molluscum contagiosum virus
ccgggcucuuccggcccg

SEQ ID NO: 3106401 - RNA, 12 nt, Molluscum contagiosum virus
ccgggcgcgcca

SEQ ID NO: 3106402 - RNA, 15 nt, Molluscum contagiosum virus
ccgggcccgggcccg

SEQ ID NO: 3106403 - RNA, 21 nt, Molluscum contagiosum virus
ccgggcccggguuugugcccg

SEQ ID NO: 3106404 - RNA, 12 nt, Molluscum contagiosum virus
ccgggcgcacaa

SEQ ID NO: 3106405 - RNA, 23 nt, Molluscum contagiosum virus
ccggggagaagaugcugcgcgug

SEQ ID NO: 3106406 - RNA, 13 nt, Molluscum contagiosum virus
ccgggcacgcccg

SEQ ID NO: 3106407 - RNA, 16 nt, Molluscum contagiosum virus
ccgggaaggcaggccc

SEQ ID NO: 3106408 - RNA, 20 nt, Molluscum contagiosum virus
ccgggccccugucgcgcacg

SEQ ID NO: 3106409 - RNA, 15 nt, Molluscum contagiosum virus
ccgggcccgagcccg

SEQ ID NO: 3106410 - RNA, 12 nt, Molluscum contagiosum virus
ccggcugccgcu

SEQ ID NO: 3106411 - RNA, 15 nt, Molluscum contagiosum virus
ccgggaaacgcacag

SEQ ID NO: 3106412 - RNA, 21 nt, Molluscum contagiosum virus
ccgggaaagcaaccacacgcg

SEQ ID NO: 3106413 - RNA, 23 nt, Molluscum contagiosum virus
ccgggauuugccgguugcgcgug

SEQ ID NO: 3106414 - RNA, 15 nt, Molluscum contagiosum virus
ccggcgugagcucgu

SEQ ID NO: 3106415 - RNA, 22 nt, Molluscum contagiosum virus
ccggcguucacggacucgagcc

SEQ ID NO: 3106416 - RNA, 20 nt, Molluscum contagiosum virus
ccggcguccggcgcucgccc

SEQ ID NO: 3106417 - RNA, 21 nt, Molluscum contagiosum virus
ccggcguuggcuuucugugcg

SEQ ID NO: 3106418 - RNA, 17 nt, Molluscum contagiosum virus
ccggcggcuggaccugc

SEQ ID NO: 3106419 - RNA, 14 nt, Molluscum contagiosum virus
ccggcgggcgcgug

SEQ ID NO: 3106420 - RNA, 20 nt, Molluscum contagiosum virus
ccggcggcccgcggcgcgcc

SEQ ID NO: 3106421 - RNA, 15 nt, Molluscum contagiosum virus
ccggcgcucgccccu

SEQ ID NO: 3106422 - RNA, 21 nt, Molluscum contagiosum virus
ccggcgcuugccccucguccg

SEQ ID NO: 3106423 - RNA, 12 nt, Molluscum contagiosum virus
ccggcgcuugcg

SEQ ID NO: 3106424 - RNA, 13 nt, Molluscum contagiosum virus
ccgcggcgcgccg

SEQ ID NO: 3106425 - RNA, 14 nt, Molluscum contagiosum virus
ccgcggcgugcccg

SEQ ID NO: 3106426 - RNA, 20 nt, Molluscum contagiosum virus
ccgcggcuaccacgggcccg

SEQ ID NO: 3106427 - RNA, 17 nt, Molluscum contagiosum virus
ccgcggcugccucgugc

SEQ ID NO: 3106428 - RNA, 22 nt, Molluscum contagiosum virus
ccgcgggcacauggacggcgcc

SEQ ID NO: 3106429 - RNA, 14 nt, Molluscum contagiosum virus
ccgcggacgcgcag

SEQ ID NO: 3106430 - RNA, 15 nt, Molluscum contagiosum virus
ccgcggacgcgcccu

SEQ ID NO: 3106431 - RNA, 14 nt, Molluscum contagiosum virus
ccgcggacucgugc

SEQ ID NO: 3106432 - RNA, 23 nt, Molluscum contagiosum virus
ccgcggagaccaccgcuggggcg

SEQ ID NO: 3106433 - RNA, 14 nt, Molluscum contagiosum virus
ccgcggagcugugc

SEQ ID NO: 3106434 - RNA, 20 nt, Molluscum contagiosum virus
ccgcggagggaggcucgagc

SEQ ID NO: 3106435 - RNA, 19 nt, Molluscum contagiosum virus
ucgccgcgcgccgcugcuc

SEQ ID NO: 3106436 - RNA, 17 nt, Molluscum contagiosum virus
ucgccgcgcgcgccagc

SEQ ID NO: 3106437 - RNA, 19 nt, Molluscum contagiosum virus
ucgccggcaucgcgcugcu

SEQ ID NO: 3106438 - RNA, 19 nt, Molluscum contagiosum virus
ucgccgggccccugucgcg

SEQ ID NO: 3106439 - RNA, 16 nt, Molluscum contagiosum virus
ucgcccugcccgcgcg

SEQ ID NO: 3106440 - RNA, 23 nt, Molluscum contagiosum virus
ucgccagaagucagaguccgacc

SEQ ID NO: 3106441 - RNA, 17 nt, Molluscum contagiosum virus
ucgccuccgggcgcaca

SEQ ID NO: 3106442 - RNA, 20 nt, Molluscum contagiosum virus
ucgccuccuugcccgaggag

SEQ ID NO: 3106443 - RNA, 20 nt, Molluscum contagiosum virus
uccucgaaggcgugcgccgu

SEQ ID NO: 3106444 - RNA, 16 nt, Molluscum contagiosum virus
uccucaaggcgcacga

SEQ ID NO: 3106445 - RNA, 23 nt, Molluscum contagiosum virus
uccuagagcagaaggugcgcagc

SEQ ID NO: 3106446 - RNA, 21 nt, Molluscum contagiosum virus
uccggcuuagcuggcgcccgu

SEQ ID NO: 3106447 - RNA, 12 nt, Molluscum contagiosum virus
uccgggcgcugc

SEQ ID NO: 3106448 - RNA, 12 nt, Molluscum contagiosum virus
uccgugucguuc

SEQ ID NO: 3106449 - RNA, 18 nt, Molluscum contagiosum virus
uccgugccauuucguuga

SEQ ID NO: 3106450 - RNA, 17 nt, Molluscum contagiosum virus
uccgugcccacgagcgc

SEQ ID NO: 3106451 - RNA, 16 nt, Molluscum contagiosum virus
ucgagcgcgccgcgcg

SEQ ID NO: 3106452 - RNA, 18 nt, Molluscum contagiosum virus
ucgagcgcgccgcgcgcu

SEQ ID NO: 3106453 - RNA, 22 nt, Molluscum contagiosum virus
ucgagcgcgccgcgcgcucgcg

SEQ ID NO: 3106454 - RNA, 14 nt, Molluscum contagiosum virus
ucgagcgcgcgccu

SEQ ID NO: 3106455 - RNA, 22 nt, Molluscum contagiosum virus
ucgagcgcgcgccugcuggcgg

SEQ ID NO: 3106456 - RNA, 22 nt, Molluscum contagiosum virus
ucgagcgcgcuggacuugcgcg

SEQ ID NO: 3106457 - RNA, 23 nt, Molluscum contagiosum virus
ucgagcuccgagggcgcgugcuc

SEQ ID NO: 3106458 - RNA, 17 nt, Molluscum contagiosum virus
ucgagcugacucggaca

SEQ ID NO: 3106459 - RNA, 17 nt, Molluscum contagiosum virus
ucgagcugcugcgcgag

SEQ ID NO: 3106460 - RNA, 19 nt, Molluscum contagiosum virus
ucgagcuucggacgagcuc

SEQ ID NO: 3106461 - RNA, 17 nt, Molluscum contagiosum virus
ucgaggcacucgucgcg

SEQ ID NO: 3106462 - RNA, 14 nt, Molluscum contagiosum virus
ucgaggccuucgcg

SEQ ID NO: 3106463 - RNA, 16 nt, Molluscum contagiosum virus
ucgaggccuucgcgcc

SEQ ID NO: 3106464 - RNA, 12 nt, Molluscum contagiosum virus
ucgagggcgccg

SEQ ID NO: 3106465 - RNA, 16 nt, Molluscum contagiosum virus
ucgagggggacgugcc

SEQ ID NO: 3106466 - RNA, 23 nt, Molluscum contagiosum virus
ucgagggggacgugcccuacgcg

SEQ ID NO: 3106467 - RNA, 19 nt, Molluscum contagiosum virus
ucgagugcucccgaggcgc

SEQ ID NO: 3106468 - RNA, 19 nt, Molluscum contagiosum virus
uccucucacgcccucucga

SEQ ID NO: 3106469 - RNA, 13 nt, Molluscum contagiosum virus
uccucggcgcaca

SEQ ID NO: 3106470 - RNA, 14 nt, Molluscum contagiosum virus
ucgagcaggucauc

SEQ ID NO: 3106471 - RNA, 18 nt, Molluscum contagiosum virus
uccugcauuucaugcgcg

SEQ ID NO: 3106472 - RNA, 14 nt, Molluscum contagiosum virus
ucgagcccgagccc

SEQ ID NO: 3106473 - RNA, 20 nt, Molluscum contagiosum virus
ucgagccgcgcuucgagcac

SEQ ID NO: 3106474 - RNA, 19 nt, Molluscum contagiosum virus
ucgagcgagcuacgcgcuc

SEQ ID NO: 3106475 - RNA, 15 nt, Molluscum contagiosum virus
ucgaucucgcgcacg

SEQ ID NO: 3106476 - RNA, 17 nt, Molluscum contagiosum virus
ucgaugacagcaucggg

SEQ ID NO: 3106477 - RNA, 20 nt, Molluscum contagiosum virus
ucgcaaccccgcgcugcgcg

SEQ ID NO: 3106478 - RNA, 20 nt, Molluscum contagiosum virus
ucgcaagcugagcgcgcugc

SEQ ID NO: 3106479 - RNA, 18 nt, Molluscum contagiosum virus
ucgcaagucucccucgcg

SEQ ID NO: 3106480 - RNA, 22 nt, Molluscum contagiosum virus
ucgcaagucucccucgcgcgca

SEQ ID NO: 3106481 - RNA, 16 nt, Molluscum contagiosum virus
ucgccaaugacggcgu

SEQ ID NO: 3106482 - RNA, 15 nt, Molluscum contagiosum virus
ucgaguucgcucgcu

SEQ ID NO: 3106483 - RNA, 19 nt, Molluscum contagiosum virus
ucgcacgcuagcgagcgcc

SEQ ID NO: 3106484 - RNA, 22 nt, Molluscum contagiosum virus
ucgcacgcuagcgagcgcccgu

SEQ ID NO: 3106485 - RNA, 18 nt, Molluscum contagiosum virus
ucgcagaacugcugcgcg

SEQ ID NO: 3106486 - RNA, 16 nt, Molluscum contagiosum virus
ucgcagacgacucgcu

SEQ ID NO: 3106487 - RNA, 20 nt, Molluscum contagiosum virus
ucgcagacgacucgcugcca

SEQ ID NO: 3106488 - RNA, 19 nt, Molluscum contagiosum virus
ucgcagacgcagcgcgagc

SEQ ID NO: 3106489 - RNA, 20 nt, Molluscum contagiosum virus
ucgcagcguuccaggaacgc

SEQ ID NO: 3106490 - RNA, 13 nt, Molluscum contagiosum virus
ucgcaggcgugcu

SEQ ID NO: 3106491 - RNA, 22 nt, Molluscum contagiosum virus
ucgcagggggggcuugcggucu

SEQ ID NO: 3106492 - RNA, 14 nt, Molluscum contagiosum virus
ggcgcucgcgcgca

SEQ ID NO: 3106493 - RNA, 13 nt, Molluscum contagiosum virus
ggcgcucacugcg

SEQ ID NO: 3106494 - RNA, 12 nt, Molluscum contagiosum virus
ggcgcugucgcg

SEQ ID NO: 3106495 - RNA, 18 nt, Molluscum contagiosum virus
ggcgcuugggcacugcua

SEQ ID NO: 3106496 - RNA, 17 nt, Molluscum contagiosum virus
ggcggcaagcuuugcuu

SEQ ID NO: 3106497 - RNA, 22 nt, Molluscum contagiosum virus
ggcggcauccugaugacggcag

SEQ ID NO: 3106498 - RNA, 21 nt, Molluscum contagiosum virus
ggcgcguugcucccgucgagc

SEQ ID NO: 3106499 - RNA, 14 nt, Molluscum contagiosum virus
ggcgcgugcgagca

SEQ ID NO: 3106500 - RNA, 11 nt, Molluscum contagiosum virus
ggcgcgugcuc

SEQ ID NO: 3106501 - RNA, 12 nt, Molluscum contagiosum virus
ggcggcgcggcu

SEQ ID NO: 3106502 - RNA, 14 nt, Molluscum contagiosum virus
ggcggcgcuggaga

SEQ ID NO: 3106503 - RNA, 20 nt, Molluscum contagiosum virus
ggcggcgauggcgauagcga

SEQ ID NO: 3106504 - RNA, 12 nt, Molluscum contagiosum virus
ggcggcgcaagg

SEQ ID NO: 3106505 - RNA, 20 nt, Molluscum contagiosum virus
ggcggccucccucgucgcgc

SEQ ID NO: 3106506 - RNA, 19 nt, Molluscum contagiosum virus
uccggcggcuccgcgcgcg

SEQ ID NO: 3106507 - RNA, 20 nt, Molluscum contagiosum virus
uccggcgugagcucgucgcg

SEQ ID NO: 3106508 - RNA, 13 nt, Molluscum contagiosum virus
uccggcgcucgcc

SEQ ID NO: 3106509 - RNA, 16 nt, Molluscum contagiosum virus
uccgcuguacgugcug

SEQ ID NO: 3106510 - RNA, 20 nt, Molluscum contagiosum virus
uccggacgugcacgcacgcg

SEQ ID NO: 3106511 - RNA, 19 nt, Molluscum contagiosum virus
uccgcguacagcgcgcgug

SEQ ID NO: 3106512 - RNA, 13 nt, Molluscum contagiosum virus
ggcggcgucgcgc

SEQ ID NO: 3106513 - RNA, 21 nt, Molluscum contagiosum virus
uccgaggacgacgccgagccc

SEQ ID NO: 3106514 - RNA, 18 nt, Molluscum contagiosum virus
uccgcaauuacgugcgcg

SEQ ID NO: 3106515 - RNA, 18 nt, Molluscum contagiosum virus
uccgcaauucuagcgcga

SEQ ID NO: 3106516 - RNA, 16 nt, Molluscum contagiosum virus
uccgcacacgcgcgcg

SEQ ID NO: 3106517 - RNA, 20 nt, Molluscum contagiosum virus
uccgcacacgcgcgcgugcu

SEQ ID NO: 3106518 - RNA, 23 nt, Molluscum contagiosum virus
uccgcaggcgucaugcgcgcgcg

SEQ ID NO: 3106519 - RNA, 22 nt, Molluscum contagiosum virus
uccgccucggaaaacgcccgag

SEQ ID NO: 3106520 - RNA, 18 nt, Molluscum contagiosum virus
uccgcgaaguccugggcg

SEQ ID NO: 3106521 - RNA, 20 nt, Molluscum contagiosum virus
uccgcgaaguccugggcgag

SEQ ID NO: 3106522 - RNA, 18 nt, Molluscum contagiosum virus
uccgcgacgaacucgaca

SEQ ID NO: 3106523 - RNA, 15 nt, Molluscum contagiosum virus
uccgcggcacgcgag

SEQ ID NO: 3106524 - RNA, 15 nt, Molluscum contagiosum virus
gcgcgugaguccgcg

SEQ ID NO: 3106525 - RNA, 17 nt, Molluscum contagiosum virus
gcgcgugaguccgcggc

SEQ ID NO: 3106526 - RNA, 17 nt, Molluscum contagiosum virus
gcgcguacucgcgccgc

SEQ ID NO: 3106527 - RNA, 18 nt, Molluscum contagiosum virus
gcgcguacucgcgccgcg

SEQ ID NO: 3106528 - RNA, 16 nt, Molluscum contagiosum virus
gcgcgucucugcgcag

SEQ ID NO: 3106529 - RNA, 19 nt, Molluscum contagiosum virus
gcgcgucugcaucgugggc

SEQ ID NO: 3106530 - RNA, 19 nt, Molluscum contagiosum virus
gcgcgucugcgaguggcgc

SEQ ID NO: 3106531 - RNA, 15 nt, Molluscum contagiosum virus
gcgcgucugugcgcg

SEQ ID NO: 3106532 - RNA, 17 nt, Molluscum contagiosum virus
gcgcguccgcaggcguc

SEQ ID NO: 3106533 - RNA, 15 nt, Molluscum contagiosum virus
gcgcgucgcggucgc

SEQ ID NO: 3106534 - RNA, 20 nt, Molluscum contagiosum virus
gcgcguacgcgugcgcuggc

SEQ ID NO: 3106535 - RNA, 18 nt, Molluscum contagiosum virus
gcgcguacgcugcucgag

SEQ ID NO: 3106536 - RNA, 14 nt, Molluscum contagiosum virus
gcgcgacaugcugc

SEQ ID NO: 3106537 - RNA, 20 nt, Molluscum contagiosum virus
gcgcgugccagucgcgcgag

SEQ ID NO: 3106538 - RNA, 18 nt, Molluscum contagiosum virus
gcgcgugccgcugcgcgg

SEQ ID NO: 3106539 - RNA, 21 nt, Molluscum contagiosum virus
gcgcgugcgagcggcgcgcgc

SEQ ID NO: 3106540 - RNA, 13 nt, Molluscum contagiosum virus
gcgcgugcgcagg

SEQ ID NO: 3106541 - RNA, 13 nt, Molluscum contagiosum virus
gcgcgugcgcgug

SEQ ID NO: 3106542 - RNA, 21 nt, Molluscum contagiosum virus
gcgcgugcguacgugcacgug

SEQ ID NO: 3106543 - RNA, 13 nt, Molluscum contagiosum virus
gcgcgugcgucuc

SEQ ID NO: 3106544 - RNA, 12 nt, Molluscum contagiosum virus
gcgcgugcucga

SEQ ID NO: 3106545 - RNA, 23 nt, Molluscum contagiosum virus
gcgcgugcucgacucggaugcgc

SEQ ID NO: 3106546 - RNA, 12 nt, Molluscum contagiosum virus
gcgcgugcucgc

SEQ ID NO: 3106547 - RNA, 12 nt, Molluscum contagiosum virus
gcgcgugcucgg

SEQ ID NO: 3106548 - RNA, 16 nt, Molluscum contagiosum virus
gcgcgugcugcggcug

SEQ ID NO: 3106549 - RNA, 17 nt, Molluscum contagiosum virus
gcgcgugcuggacgcgc

SEQ ID NO: 3106550 - RNA, 19 nt, Molluscum contagiosum virus
gcgcgugcuggacgcgcac

SEQ ID NO: 3106551 - RNA, 15 nt, Molluscum contagiosum virus
gcgcgugcugggccc

SEQ ID NO: 3106552 - RNA, 20 nt, Molluscum contagiosum virus
ggcgcgagaugcucgccggc

SEQ ID NO: 3106553 - RNA, 21 nt, Molluscum contagiosum virus
ggcgcgagaugcucgccggca

SEQ ID NO: 3106554 - RNA, 22 nt, Molluscum contagiosum virus
ggcgcgagcgacggcaggcccu

SEQ ID NO: 3106555 - RNA, 17 nt, Molluscum contagiosum virus
ggcgcgggagcucacgg

SEQ ID NO: 3106556 - RNA, 15 nt, Molluscum contagiosum virus
ggcgcgccgcgcgcg

SEQ ID NO: 3106557 - RNA, 19 nt, Molluscum contagiosum virus
ggcgcgcgagcacagcgcg

SEQ ID NO: 3106558 - RNA, 14 nt, Molluscum contagiosum virus
ggcgcgcgccagca

SEQ ID NO: 3106559 - RNA, 18 nt, Molluscum contagiosum virus
ggcgcgcgcugcgcacgu

SEQ ID NO: 3106560 - RNA, 14 nt, Molluscum contagiosum virus
ggcgcgcggagagc

SEQ ID NO: 3106561 - RNA, 14 nt, Molluscum contagiosum virus
ggcgcgcguacgcg

SEQ ID NO: 3106562 - RNA, 13 nt, Molluscum contagiosum virus
ggcgcgcgugcuu

SEQ ID NO: 3106563 - RNA, 19 nt, Molluscum contagiosum virus
ggcgcgcucgcgugcuagg

SEQ ID NO: 3106564 - RNA, 16 nt, Molluscum contagiosum virus
ggcgcgcugugagcgc

SEQ ID NO: 3106565 - RNA, 17 nt, Molluscum contagiosum virus
gcgcgugucuggagccc

SEQ ID NO: 3106566 - RNA, 18 nt, Molluscum contagiosum virus
ggcgcauccuccacgcug

SEQ ID NO: 3106567 - RNA, 17 nt, Molluscum contagiosum virus
gcgcguggcucgcgacc

SEQ ID NO: 3106568 - RNA, 21 nt, Molluscum contagiosum virus
ggcgcccgugcucgcgggccu

SEQ ID NO: 3106569 - RNA, 18 nt, Molluscum contagiosum virus
ggcgccgccccgccagca

SEQ ID NO: 3106570 - RNA, 22 nt, Molluscum contagiosum virus
ggcgccgcgcugaugcuagcgu

SEQ ID NO: 3106571 - RNA, 23 nt, Molluscum contagiosum virus
ggcgccgcgcugaugcuagcgug

SEQ ID NO: 3106572 - RNA, 16 nt, Molluscum contagiosum virus
ggcgccggcgcgcgcg

SEQ ID NO: 3106573 - RNA, 21 nt, Molluscum contagiosum virus
ggcgccagaacauugccacgc

SEQ ID NO: 3106574 - RNA, 19 nt, Molluscum contagiosum virus
ggcgccuucgucgcgcgcu

SEQ ID NO: 3106575 - RNA, 13 nt, Molluscum contagiosum virus
gcgccgugcugcg

SEQ ID NO: 3106576 - RNA, 17 nt, Molluscum contagiosum virus
gcgccgugcugcgucac

SEQ ID NO: 3106577 - RNA, 17 nt, Molluscum contagiosum virus
gcgccgugucggcaccg

SEQ ID NO: 3106578 - RNA, 16 nt, Molluscum contagiosum virus
gcgccuacucuugcgc

SEQ ID NO: 3106579 - RNA, 14 nt, Molluscum contagiosum virus
gcgccuagcuccag

SEQ ID NO: 3106580 - RNA, 18 nt, Molluscum contagiosum virus
gcgccguccaugugcccg

SEQ ID NO: 3106581 - RNA, 15 nt, Molluscum contagiosum virus
gcgccgcgcgccgcg

SEQ ID NO: 3106582 - RNA, 18 nt, Molluscum contagiosum virus
gcgccugugccugcaaga

SEQ ID NO: 3106583 - RNA, 15 nt, Molluscum contagiosum virus
gcgccuuccgcgcgg

SEQ ID NO: 3106584 - RNA, 23 nt, Molluscum contagiosum virus
gcgccuuggcggggaucuugcgu

SEQ ID NO: 3106585 - RNA, 17 nt, Molluscum contagiosum virus
gcgccuuugccacgcca

SEQ ID NO: 3106586 - RNA, 23 nt, Molluscum contagiosum virus
gcgcgaacucucaucgagcaccu

SEQ ID NO: 3106587 - RNA, 14 nt, Molluscum contagiosum virus
gcgcgaagcaggcg

SEQ ID NO: 3106588 - RNA, 16 nt, Molluscum contagiosum virus
gcgcgaauuggccgcg

SEQ ID NO: 3106589 - RNA, 14 nt, Molluscum contagiosum virus
gcgccugccgcgca

SEQ ID NO: 3106590 - RNA, 12 nt, Molluscum contagiosum virus
gcgccugcgcga

SEQ ID NO: 3106591 - RNA, 16 nt, Molluscum contagiosum virus
gcgccugcgcgagcaa

SEQ ID NO: 3106592 - RNA, 14 nt, Molluscum contagiosum virus
gcgccugcuugcgc

SEQ ID NO: 3106593 - RNA, 17 nt, Molluscum contagiosum virus
gcgccgggcgcgccaac

SEQ ID NO: 3106594 - RNA, 17 nt, Molluscum contagiosum virus
gcgccggggcgcgcgcu

SEQ ID NO: 3106595 - RNA, 19 nt, Molluscum contagiosum virus
gcgccgguagggugccgag

SEQ ID NO: 3106596 - RNA, 12 nt, Molluscum contagiosum virus
gcgccgcggcgg

SEQ ID NO: 3106597 - RNA, 17 nt, Molluscum contagiosum virus
gcgccgcguacgcacgu

SEQ ID NO: 3106598 - RNA, 13 nt, Molluscum contagiosum virus
gcgccgcuaccag

SEQ ID NO: 3106599 - RNA, 13 nt, Molluscum contagiosum virus
gcgccgcucgcac

SEQ ID NO: 3106600 - RNA, 21 nt, Molluscum contagiosum virus
gcgccgcucgucgcugcggac

SEQ ID NO: 3106601 - RNA, 23 nt, Molluscum contagiosum virus
gcgccgcugcccgcgcacgagcu

SEQ ID NO: 3106602 - RNA, 13 nt, Molluscum contagiosum virus
gcgccgcugcgcc

SEQ ID NO: 3106603 - RNA, 15 nt, Molluscum contagiosum virus
gcgccgcugcgccgg

SEQ ID NO: 3106604 - RNA, 16 nt, Molluscum contagiosum virus
gcgccgcugcucgcuu

SEQ ID NO: 3106605 - RNA, 19 nt, Molluscum contagiosum virus
gcgccggcacccgugcgcg

SEQ ID NO: 3106606 - RNA, 20 nt, Molluscum contagiosum virus
gcgccggcacccgugcgcgc

SEQ ID NO: 3106607 - RNA, 23 nt, Molluscum contagiosum virus
gcgccggcacccgugcgcgcgcu

SEQ ID NO: 3106608 - RNA, 19 nt, Molluscum contagiosum virus
gcgccggcgcgcgcgcgca

SEQ ID NO: 3106609 - RNA, 12 nt, Molluscum contagiosum virus
gcgccgccucgc

SEQ ID NO: 3106610 - RNA, 17 nt, Molluscum contagiosum virus
gcgccgccucgcgcgca

SEQ ID NO: 3106611 - RNA, 18 nt, Molluscum contagiosum virus
gcgccgccucgcgcgcac

SEQ ID NO: 3106612 - RNA, 16 nt, Molluscum contagiosum virus
gcgccgaggacgcgcc

SEQ ID NO: 3106613 - RNA, 13 nt, Molluscum contagiosum virus
gcgccgaggacua

SEQ ID NO: 3106614 - RNA, 15 nt, Molluscum contagiosum virus
gcgccgcacgcugcu

SEQ ID NO: 3106615 - RNA, 23 nt, Molluscum contagiosum virus
gcgccgcacgcugcugcgugcgc

SEQ ID NO: 3106616 - RNA, 14 nt, Molluscum contagiosum virus
gcgccgcacgugcu

SEQ ID NO: 3106617 - RNA, 18 nt, Molluscum contagiosum virus
gcgccgcacgugcugcgc

SEQ ID NO: 3106618 - RNA, 16 nt, Molluscum contagiosum virus
gcgccgcagcacgcgu

SEQ ID NO: 3106619 - RNA, 12 nt, Molluscum contagiosum virus
gcgccgccagcg

SEQ ID NO: 3106620 - RNA, 15 nt, Molluscum contagiosum virus
gcgccgccagcuccg

SEQ ID NO: 3106621 - RNA, 16 nt, Molluscum contagiosum virus
gcgccgccgacgccuu

SEQ ID NO: 3106622 - RNA, 20 nt, Molluscum contagiosum virus
gcgccgccgcgccgcugcgc

SEQ ID NO: 3106623 - RNA, 12 nt, Molluscum contagiosum virus
gcgcgcacgcga

SEQ ID NO: 3106624 - RNA, 13 nt, Molluscum contagiosum virus
gcgcgcacgcgca

SEQ ID NO: 3106625 - RNA, 14 nt, Molluscum contagiosum virus
gcgcgcacgcgcac

SEQ ID NO: 3106626 - RNA, 12 nt, Molluscum contagiosum virus
gcgcgcacggca

SEQ ID NO: 3106627 - RNA, 18 nt, Molluscum contagiosum virus
gcgcgcacggcuaggcgc

SEQ ID NO: 3106628 - RNA, 19 nt, Molluscum contagiosum virus
gcgcgcacucgggugcccg

SEQ ID NO: 3106629 - RNA, 17 nt, Molluscum contagiosum virus
gcgcgcacugcgggacc

SEQ ID NO: 3106630 - RNA, 13 nt, Molluscum contagiosum virus
gcgcgcacugcuc

SEQ ID NO: 3106631 - RNA, 18 nt, Molluscum contagiosum virus
gcgcgcacugcucgcgca

SEQ ID NO: 3106632 - RNA, 13 nt, Molluscum contagiosum virus
gcgcgcaagcgcu

SEQ ID NO: 3106633 - RNA, 21 nt, Molluscum contagiosum virus
gcgcgcaagucgcgcgcugcg

SEQ ID NO: 3106634 - RNA, 19 nt, Molluscum contagiosum virus
gcgcgcacaaacgcgcgca

SEQ ID NO: 3106635 - RNA, 20 nt, Molluscum contagiosum virus
gcgcgcacaaacgcgcgcac

SEQ ID NO: 3106636 - RNA, 16 nt, Molluscum contagiosum virus
gcgcgcacacgacgcu

SEQ ID NO: 3106637 - RNA, 14 nt, Molluscum contagiosum virus
gcgcgcacaucggc

SEQ ID NO: 3106638 - RNA, 23 nt, Molluscum contagiosum virus
gcgcgcacaucggcacugcucac

SEQ ID NO: 3106639 - RNA, 18 nt, Molluscum contagiosum virus
gcgcgacuggcacgcgcc

SEQ ID NO: 3106640 - RNA, 20 nt, Molluscum contagiosum virus
gcgcgagacgcugcugcaca

SEQ ID NO: 3106641 - RNA, 15 nt, Molluscum contagiosum virus
gcgcgagaugcucgc

SEQ ID NO: 3106642 - RNA, 15 nt, Molluscum contagiosum virus
gcgcgagcaugccgc

SEQ ID NO: 3106643 - RNA, 12 nt, Molluscum contagiosum virus
gcgcgagcgacg

SEQ ID NO: 3106644 - RNA, 15 nt, Molluscum contagiosum virus
gcgcgagcgacggca

SEQ ID NO: 3106645 - RNA, 15 nt, Molluscum contagiosum virus
gcgcgagcgcgcgcu

SEQ ID NO: 3106646 - RNA, 12 nt, Molluscum contagiosum virus
gcgcgagcuugc

SEQ ID NO: 3106647 - RNA, 15 nt, Molluscum contagiosum virus
gcgcgagugccagcg

SEQ ID NO: 3106648 - RNA, 12 nt, Molluscum contagiosum virus
gcgcgagugugc

SEQ ID NO: 3106649 - RNA, 14 nt, Molluscum contagiosum virus
gcgcgacgccauca

SEQ ID NO: 3106650 - RNA, 16 nt, Molluscum contagiosum virus
gcgcgacgccaucagg

SEQ ID NO: 3106651 - RNA, 17 nt, Molluscum contagiosum virus
gcgcgacgccgucgaug

SEQ ID NO: 3106652 - RNA, 13 nt, Molluscum contagiosum virus
gcgcgacgucguc

SEQ ID NO: 3106653 - RNA, 24 nt, Molluscum contagiosum virus
gcgcgacgucgucaaggauguagc

SEQ ID NO: 3106654 - RNA, 14 nt, Molluscum contagiosum virus
gcgcgacuacgcac

SEQ ID NO: 3106655 - RNA, 21 nt, Molluscum contagiosum virus
gcgcgacuccaucugcgcgac

SEQ ID NO: 3106656 - RNA, 17 nt, Molluscum contagiosum virus
gcgcgcagacguggugc

SEQ ID NO: 3106657 - RNA, 13 nt, Molluscum contagiosum virus
gcgcgcagcacac

SEQ ID NO: 3106658 - RNA, 18 nt, Molluscum contagiosum virus
gcgcgcagcaggugcacg

SEQ ID NO: 3106659 - RNA, 13 nt, Molluscum contagiosum virus
gcgcgcagcgccc

SEQ ID NO: 3106660 - RNA, 15 nt, Molluscum contagiosum virus
gcgcgcaggaaaggu

SEQ ID NO: 3106661 - RNA, 14 nt, Molluscum contagiosum virus
gcgcgcaguugugc

SEQ ID NO: 3106662 - RNA, 24 nt, Molluscum contagiosum virus
gcgcgcaaaaggcacgaggcagcc

SEQ ID NO: 3106663 - RNA, 21 nt, Molluscum contagiosum virus
gcgcgcaaccagcuggcgccc

SEQ ID NO: 3106664 - RNA, 17 nt, Molluscum contagiosum virus
gcgcggcuagcaccgca

SEQ ID NO: 3106665 - RNA, 18 nt, Molluscum contagiosum virus
gcgcggcuuacacacgca

SEQ ID NO: 3106666 - RNA, 14 nt, Molluscum contagiosum virus
gcgcgggagcucac

SEQ ID NO: 3106667 - RNA, 22 nt, Molluscum contagiosum virus
gcgcgggaggcguccugcggga

SEQ ID NO: 3106668 - RNA, 16 nt, Molluscum contagiosum virus
gcgcgggcacgccgca

SEQ ID NO: 3106669 - RNA, 22 nt, Molluscum contagiosum virus
gcgcgggccaugucugugcgcg

SEQ ID NO: 3106670 - RNA, 17 nt, Molluscum contagiosum virus
gcgcgggccuguccgcg

SEQ ID NO: 3106671 - RNA, 18 nt, Molluscum contagiosum virus
gcgcgguaacgcgcgcgc

SEQ ID NO: 3106672 - RNA, 16 nt, Molluscum contagiosum virus
gcgcgguagcucgugc

SEQ ID NO: 3106673 - RNA, 16 nt, Molluscum contagiosum virus
gcgcgguccagccgca

SEQ ID NO: 3106674 - RNA, 17 nt, Molluscum contagiosum virus
gcgcgguccuguccgcg

SEQ ID NO: 3106675 - RNA, 22 nt, Molluscum contagiosum virus
gcgcggucgcccgccgagcucu

SEQ ID NO: 3106676 - RNA, 15 nt, Molluscum contagiosum virus
gcgcggugcugcgcc

SEQ ID NO: 3106677 - RNA, 19 nt, Molluscum contagiosum virus
gcgcggugcugcgccagga

SEQ ID NO: 3106678 - RNA, 18 nt, Molluscum contagiosum virus
gcgcgguggugcugggcg

SEQ ID NO: 3106679 - RNA, 17 nt, Molluscum contagiosum virus
gcgcggggcacugcgca

SEQ ID NO: 3106680 - RNA, 18 nt, Molluscum contagiosum virus
gcgcggggcacugcgcac

SEQ ID NO: 3106681 - RNA, 22 nt, Molluscum contagiosum virus
gcgcggggcaggcagugccgcc

SEQ ID NO: 3106682 - RNA, 15 nt, Molluscum contagiosum virus
gcgcggcgagccgcg

SEQ ID NO: 3106683 - RNA, 19 nt, Molluscum contagiosum virus
gcgcggcgagccgcgcgag

SEQ ID NO: 3106684 - RNA, 22 nt, Molluscum contagiosum virus
gcgcggcgcgugccagucgcgc

SEQ ID NO: 3106685 - RNA, 17 nt, Molluscum contagiosum virus
gcgcggcgcucugccac

SEQ ID NO: 3106686 - RNA, 20 nt, Molluscum contagiosum virus
gcgcggcgguguaugcucgu

SEQ ID NO: 3106687 - RNA, 21 nt, Molluscum contagiosum virus
gcgcccuuugcggcacgggcu

SEQ ID NO: 3106688 - RNA, 18 nt, Molluscum contagiosum virus
gcgccgacagcgcgcgca

SEQ ID NO: 3106689 - RNA, 15 nt, Molluscum contagiosum virus
gcgccgacaugcgca

SEQ ID NO: 3106690 - RNA, 16 nt, Molluscum contagiosum virus
gcgccgacaugcgcac

SEQ ID NO: 3106691 - RNA, 21 nt, Molluscum contagiosum virus
gcgccgacaugcgcacgcgcg

SEQ ID NO: 3106692 - RNA, 15 nt, Molluscum contagiosum virus
gcgcccucgcgcgca

SEQ ID NO: 3106693 - RNA, 15 nt, Molluscum contagiosum virus
gcgcccucgcgcgcg

SEQ ID NO: 3106694 - RNA, 22 nt, Molluscum contagiosum virus
gcgcccuggagcgcagucccag

SEQ ID NO: 3106695 - RNA, 16 nt, Molluscum contagiosum virus
uuggucaccacgaucu

SEQ ID NO: 3106696 - RNA, 13 nt, Molluscum contagiosum virus
uuggccgcggagg

SEQ ID NO: 3106697 - RNA, 11 nt, Molluscum contagiosum virus
uuggcgcgcaa

SEQ ID NO: 3106698 - RNA, 20 nt, Molluscum contagiosum virus
uugcugcugccgcgcggcac

SEQ ID NO: 3106699 - RNA, 24 nt, Molluscum contagiosum virus
uugcgcagagcuccccgcgcgcag

SEQ ID NO: 3106700 - RNA, 14 nt, Molluscum contagiosum virus
uugccgcgcgcugc

SEQ ID NO: 3106701 - RNA, 16 nt, Molluscum contagiosum virus
uugccgcgcgcugcuc

SEQ ID NO: 3106702 - RNA, 18 nt, Molluscum contagiosum virus
uuccgucccccgcggagc

SEQ ID NO: 3106703 - RNA, 17 nt, Molluscum contagiosum virus
uuccgugcuugacaagu

SEQ ID NO: 3106704 - RNA, 19 nt, Molluscum contagiosum virus
uucgaaguuucacgcguga

SEQ ID NO: 3106705 - RNA, 21 nt, Molluscum contagiosum virus
uuccuggcacuggcgcgcacg

SEQ ID NO: 3106706 - RNA, 12 nt, Molluscum contagiosum virus
uuccgcucgcgc

SEQ ID NO: 3106707 - RNA, 13 nt, Molluscum contagiosum virus
uuccggcaccacg

SEQ ID NO: 3106708 - RNA, 23 nt, Molluscum contagiosum virus
uuccggcaccacgugcgcuggcc

SEQ ID NO: 3106709 - RNA, 21 nt, Molluscum contagiosum virus
uuccggcgcggccuggccacg

SEQ ID NO: 3106710 - RNA, 13 nt, Molluscum contagiosum virus
uuccgcgacgagc

SEQ ID NO: 3106711 - RNA, 22 nt, Molluscum contagiosum virus
uucgggcgcaaucacggcugua

SEQ ID NO: 3106712 - RNA, 20 nt, Molluscum contagiosum virus
uucguguucgcggacggcgc

SEQ ID NO: 3106713 - RNA, 20 nt, Molluscum contagiosum virus
uucguugagaccgccgcuga

SEQ ID NO: 3106714 - RNA, 18 nt, Molluscum contagiosum virus
uucgcggacggcgcgcag

SEQ ID NO: 3106715 - RNA, 19 nt, Molluscum contagiosum virus
uucgcggacggcgcgcagc

SEQ ID NO: 3106716 - RNA, 21 nt, Molluscum contagiosum virus
uucgcggagcugugccgcagc

SEQ ID NO: 3106717 - RNA, 13 nt, Molluscum contagiosum virus
uucgaucgcgcuc

SEQ ID NO: 3106718 - RNA, 20 nt, Molluscum contagiosum virus
uucgcaagucucccucgcgc

SEQ ID NO: 3106719 - RNA, 15 nt, Molluscum contagiosum virus
uucgcacgaccacgc

SEQ ID NO: 3106720 - RNA, 13 nt, Molluscum contagiosum virus
uucgccgcgcgcg

SEQ ID NO: 3106721 - RNA, 23 nt, Molluscum contagiosum virus
uucgcgaaggcaaccgcgacgag

SEQ ID NO: 3106722 - RNA, 22 nt, Molluscum contagiosum virus
uucgcgaccuggcgcgugcgag

SEQ ID NO: 3106723 - RNA, 19 nt, Molluscum contagiosum virus
uucgacuucuccgcgcugc

SEQ ID NO: 3106724 - RNA, 20 nt, Molluscum contagiosum virus
uucgagaccuacgucaagca

SEQ ID NO: 3106725 - RNA, 19 nt, Molluscum contagiosum virus
uucgagacgcugcgcgacg

SEQ ID NO: 3106726 - RNA, 15 nt, Molluscum contagiosum virus
uugaaugucgcgacg

SEQ ID NO: 3106727 - RNA, 15 nt, Molluscum contagiosum virus
uugaacucgagcacg

SEQ ID NO: 3106728 - RNA, 13 nt, Molluscum contagiosum virus
uucugcgcugcca

SEQ ID NO: 3106729 - RNA, 23 nt, Molluscum contagiosum virus
uucugguuccugcgcuccgacgc

SEQ ID NO: 3106730 - RNA, 15 nt, Molluscum contagiosum virus
uugcacccgcgcagc

SEQ ID NO: 3106731 - RNA, 23 nt, Molluscum contagiosum virus
uugcaccggcaacagcgcgacgc

SEQ ID NO: 3106732 - RNA, 14 nt, Molluscum contagiosum virus
uugcacgcgcacgc

SEQ ID NO: 3106733 - RNA, 18 nt, Molluscum contagiosum virus
uugcacgcgcacgcgccc

SEQ ID NO: 3106734 - RNA, 16 nt, Molluscum contagiosum virus
uugcacgugcgugccc

SEQ ID NO: 3106735 - RNA, 14 nt, Molluscum contagiosum virus
uugcgcgagcgcgu

SEQ ID NO: 3106736 - RNA, 12 nt, Molluscum contagiosum virus
uugcgcgcgccc

SEQ ID NO: 3106737 - RNA, 22 nt, Molluscum contagiosum virus
uugcgcgcgcccucgcgcgcag

SEQ ID NO: 3106738 - RNA, 23 nt, Molluscum contagiosum virus
uugcgcgcggggcacugcgcacg

SEQ ID NO: 3106739 - RNA, 22 nt, Molluscum contagiosum virus
uugcgcgcggugcgggcgcgag

SEQ ID NO: 3106740 - RNA, 23 nt, Molluscum contagiosum virus
uugcgcggauauggcgcgccgag

SEQ ID NO: 3106741 - RNA, 16 nt, Molluscum contagiosum virus
uugcggaugcucgcuu

SEQ ID NO: 3106742 - RNA, 18 nt, Molluscum contagiosum virus
uugcgugcgccucgcagg

SEQ ID NO: 3106743 - RNA, 24 nt, Molluscum contagiosum virus
uugcgugggugaggagcucgacuc

SEQ ID NO: 3106744 - RNA, 23 nt, Molluscum contagiosum virus
uugcguguugaacucgagcacgu

SEQ ID NO: 3106745 - RNA, 20 nt, Molluscum contagiosum virus
uugcuauuaccugaccgacg

SEQ ID NO: 3106746 - RNA, 13 nt, Molluscum contagiosum virus
uuaaucacgauga

SEQ ID NO: 3106747 - RNA, 16 nt, Molluscum contagiosum virus
uuaccaagucgcgcuc

SEQ ID NO: 3106748 - RNA, 17 nt, Molluscum contagiosum virus
uuagcguggcgcgcgag

SEQ ID NO: 3106749 - RNA, 16 nt, Molluscum contagiosum virus
uuagcacacgcgcgcg

SEQ ID NO: 3106750 - RNA, 19 nt, Molluscum contagiosum virus
uuagcacacgcgcgcgcag

SEQ ID NO: 3106751 - RNA, 16 nt, Molluscum contagiosum virus
uucccgcggcgugccc

SEQ ID NO: 3106752 - RNA, 21 nt, Molluscum contagiosum virus
uuccgacaacucgcgcuggcc

SEQ ID NO: 3106753 - RNA, 18 nt, Molluscum contagiosum virus
uuccgacccggcucgcuc

SEQ ID NO: 3106754 - RNA, 20 nt, Molluscum contagiosum virus
uuccgagccgccggucucca

SEQ ID NO: 3106755 - RNA, 15 nt, Molluscum contagiosum virus
uuccgagcgcgcacg

SEQ ID NO: 3106756 - RNA, 13 nt, Molluscum contagiosum virus
uuccacgucucca

SEQ ID NO: 3106757 - RNA, 18 nt, Molluscum contagiosum virus
uuccagcacugcgccaag

SEQ ID NO: 3106758 - RNA, 22 nt, Molluscum contagiosum virus
uucacaagguagucacgcgcga

SEQ ID NO: 3106759 - RNA, 12 nt, Molluscum contagiosum virus
uucagcgcacgc

SEQ ID NO: 3106760 - RNA, 16 nt, Molluscum contagiosum virus
uguagucgcccccgug

SEQ ID NO: 3106761 - RNA, 20 nt, Molluscum contagiosum virus
ugucacgcgucgcgcgccgc

SEQ ID NO: 3106762 - RNA, 14 nt, Molluscum contagiosum virus
uguacgugcugccc

SEQ ID NO: 3106763 - RNA, 15 nt, Molluscum contagiosum virus
uguagaagcgcacga

SEQ ID NO: 3106764 - RNA, 16 nt, Molluscum contagiosum virus
uguagagacgcugccg

SEQ ID NO: 3106765 - RNA, 19 nt, Molluscum contagiosum virus
uguagcaucugcgacacgc

SEQ ID NO: 3106766 - RNA, 14 nt, Molluscum contagiosum virus
uguacgacgcgccc

SEQ ID NO: 3106767 - RNA, 17 nt, Molluscum contagiosum virus
uguacgacgugcugcug

SEQ ID NO: 3106768 - RNA, 19 nt, Molluscum contagiosum virus
uguacggcgugugcgcgag

SEQ ID NO: 3106769 - RNA, 17 nt, Molluscum contagiosum virus
uguccgcgggcgcacgc

SEQ ID NO: 3106770 - RNA, 13 nt, Molluscum contagiosum virus
uguccggcccgaa

SEQ ID NO: 3106771 - RNA, 13 nt, Molluscum contagiosum virus
ugucccgcaagcc

SEQ ID NO: 3106772 - RNA, 13 nt, Molluscum contagiosum virus
ugucucgcaagca

SEQ ID NO: 3106773 - RNA, 23 nt, Molluscum contagiosum virus
ugucgcucguggaucgcgcgcac

SEQ ID NO: 3106774 - RNA, 22 nt, Molluscum contagiosum virus
uguccuucugguuccugcgcuc

SEQ ID NO: 3106775 - RNA, 19 nt, Molluscum contagiosum virus
ugucgaggccuucgcgccc

SEQ ID NO: 3106776 - RNA, 14 nt, Molluscum contagiosum virus
uguugcgcgcgccu

SEQ ID NO: 3106777 - RNA, 18 nt, Molluscum contagiosum virus
uuaaacaacacgcgcgag

SEQ ID NO: 3106778 - RNA, 13 nt, Molluscum contagiosum virus
uguguugagccuu

SEQ ID NO: 3106779 - RNA, 19 nt, Molluscum contagiosum virus
uguuacggacggcgcacgc

SEQ ID NO: 3106780 - RNA, 22 nt, Molluscum contagiosum virus
ugugucgcgagugugcgcgccc

SEQ ID NO: 3106781 - RNA, 13 nt, Molluscum contagiosum virus
uguucacgugcuc

SEQ ID NO: 3106782 - RNA, 20 nt, Molluscum contagiosum virus
uguucgcgcugcucgcgcuc

SEQ ID NO: 3106783 - RNA, 20 nt, Molluscum contagiosum virus
uguucgcggacggcgcgcag

SEQ ID NO: 3106784 - RNA, 12 nt, Molluscum contagiosum virus
uguucgcggagc

SEQ ID NO: 3106785 - RNA, 23 nt, Molluscum contagiosum virus
ugugccgcucggcccgcggacgc

SEQ ID NO: 3106786 - RNA, 18 nt, Molluscum contagiosum virus
ugugccggugcugcggcg

SEQ ID NO: 3106787 - RNA, 12 nt, Molluscum contagiosum virus
ugucuuccgcuc

SEQ ID NO: 3106788 - RNA, 14 nt, Molluscum contagiosum virus
ugugagcgcgccgc

SEQ ID NO: 3106789 - RNA, 13 nt, Molluscum contagiosum virus
ugugcaggaacug

SEQ ID NO: 3106790 - RNA, 21 nt, Molluscum contagiosum virus
ugugcauggcggcggccacgc

SEQ ID NO: 3106791 - RNA, 16 nt, Molluscum contagiosum virus
ugugccugcgcaacgc

SEQ ID NO: 3106792 - RNA, 16 nt, Molluscum contagiosum virus
ugugcgcacgcugacc

SEQ ID NO: 3106793 - RNA, 13 nt, Molluscum contagiosum virus
ugugcgcgcacgg

SEQ ID NO: 3106794 - RNA, 13 nt, Molluscum contagiosum virus
ugugcggacaugc

SEQ ID NO: 3106795 - RNA, 18 nt, Molluscum contagiosum virus
ugugcggagggugcacgc

SEQ ID NO: 3106796 - RNA, 16 nt, Molluscum contagiosum virus
ugugcgugacacgcga

SEQ ID NO: 3106797 - RNA, 14 nt, Molluscum contagiosum virus
ugugcgugcaccuc

SEQ ID NO: 3106798 - RNA, 23 nt, Molluscum contagiosum virus
ugugcugacccccuccccagcgc

SEQ ID NO: 3106799 - RNA, 20 nt, Molluscum contagiosum virus
uguaccgccgcggccgcgag

SEQ ID NO: 3106800 - RNA, 18 nt, Molluscum contagiosum virus
ugguguccacgcgcguga

SEQ ID NO: 3106801 - RNA, 15 nt, Molluscum contagiosum virus
ugguguucugcgcgc

SEQ ID NO: 3106802 - RNA, 18 nt, Molluscum contagiosum virus
ugguguucugcgcgccgc

SEQ ID NO: 3106803 - RNA, 18 nt, Molluscum contagiosum virus
ugguugccaggcacacgc

SEQ ID NO: 3106804 - RNA, 15 nt, Molluscum contagiosum virus
ugguugccgcucgca

SEQ ID NO: 3106805 - RNA, 13 nt, Molluscum contagiosum virus
ugguugcgcacgu

SEQ ID NO: 3106806 - RNA, 17 nt, Molluscum contagiosum virus
uggugcgcgacgacggc

SEQ ID NO: 3106807 - RNA, 21 nt, Molluscum contagiosum virus
uggugcgcgacgacggcacgc

SEQ ID NO: 3106808 - RNA, 18 nt, Molluscum contagiosum virus
uggugggccgcggcgcgg

SEQ ID NO: 3106809 - RNA, 14 nt, Molluscum contagiosum virus
uggugccgcgcgcu

SEQ ID NO: 3106810 - RNA, 18 nt, Molluscum contagiosum virus
uggugccgcgcgcuacgc

SEQ ID NO: 3106811 - RNA, 17 nt, Molluscum contagiosum virus
uggucuucccgcuggcg

SEQ ID NO: 3106812 - RNA, 13 nt, Molluscum contagiosum virus
uggugcacacaca

SEQ ID NO: 3106813 - RNA, 13 nt, Molluscum contagiosum virus
uggucacgcgcac

SEQ ID NO: 3106814 - RNA, 15 nt, Molluscum contagiosum virus
uggucacgcgcacgc

SEQ ID NO: 3106815 - RNA, 16 nt, Molluscum contagiosum virus
uggucacgcgcacgcg

SEQ ID NO: 3106816 - RNA, 13 nt, Molluscum contagiosum virus
uggucgcgcgcgc

SEQ ID NO: 3106817 - RNA, 14 nt, Molluscum contagiosum virus
uggucgcgcgcgcu

SEQ ID NO: 3106818 - RNA, 12 nt, Molluscum contagiosum virus
ugggcgcgccgc

SEQ ID NO: 3106819 - RNA, 11 nt, Molluscum contagiosum virus
ugggcgcgugc

SEQ ID NO: 3106820 - RNA, 17 nt, Molluscum contagiosum virus
ugggcggcauccugaug

SEQ ID NO: 3106821 - RNA, 22 nt, Molluscum contagiosum virus
ugggcgucgcacaguucacggc

SEQ ID NO: 3106822 - RNA, 17 nt, Molluscum contagiosum virus
ugggcgugcggcgcacc

SEQ ID NO: 3106823 - RNA, 15 nt, Molluscum contagiosum virus
ugggcgugcucacgc

SEQ ID NO: 3106824 - RNA, 20 nt, Molluscum contagiosum virus
ugggcgugcucacgcugccc

SEQ ID NO: 3106825 - RNA, 17 nt, Molluscum contagiosum virus
ugggccgaaucgucggc

SEQ ID NO: 3106826 - RNA, 15 nt, Molluscum contagiosum virus
ugggcgagcgcacgu

SEQ ID NO: 3106827 - RNA, 14 nt, Molluscum contagiosum virus
uggggcucgccggc

SEQ ID NO: 3106828 - RNA, 11 nt, Molluscum contagiosum virus
uggggcucgcg

SEQ ID NO: 3106829 - RNA, 20 nt, Molluscum contagiosum virus
ugggcucggaguccgcgccc

SEQ ID NO: 3106830 - RNA, 16 nt, Molluscum contagiosum virus
ugggcuugcggcacgc

SEQ ID NO: 3106831 - RNA, 20 nt, Molluscum contagiosum virus
uggcgaaaccugggcgccgc

SEQ ID NO: 3106832 - RNA, 23 nt, Molluscum contagiosum virus
uggccgcgcccucgcucgagggc

SEQ ID NO: 3106833 - RNA, 17 nt, Molluscum contagiosum virus
uggccgcgcgcgcacgc

SEQ ID NO: 3106834 - RNA, 22 nt, Molluscum contagiosum virus
uggccgcgcgcgcacgcaagcc

SEQ ID NO: 3106835 - RNA, 20 nt, Molluscum contagiosum virus
uggcgagcaucugcgcgugc

SEQ ID NO: 3106836 - RNA, 22 nt, Molluscum contagiosum virus
uggcgagcaucugcgcgugcug

SEQ ID NO: 3106837 - RNA, 15 nt, Molluscum contagiosum virus
uggcgagcgcugccg

SEQ ID NO: 3106838 - RNA, 16 nt, Molluscum contagiosum virus
uggcgcaccugcuaga

SEQ ID NO: 3106839 - RNA, 16 nt, Molluscum contagiosum virus
uggcgccagccuggcg

SEQ ID NO: 3106840 - RNA, 19 nt, Molluscum contagiosum virus
uggcgcccgaggacgagcc

SEQ ID NO: 3106841 - RNA, 16 nt, Molluscum contagiosum virus
uggcgcucgcgcgcac

SEQ ID NO: 3106842 - RNA, 18 nt, Molluscum contagiosum virus
uggcgcucgcgcgcacgc

SEQ ID NO: 3106843 - RNA, 17 nt, Molluscum contagiosum virus
uggcgcucggcguggug

SEQ ID NO: 3106844 - RNA, 21 nt, Molluscum contagiosum virus
uggcgcugcacaguucacggc

SEQ ID NO: 3106845 - RNA, 21 nt, Molluscum contagiosum virus
uggcgcugggcgcgccgcgcg

SEQ ID NO: 3106846 - RNA, 14 nt, Molluscum contagiosum virus
uggcgccgcugcug

SEQ ID NO: 3106847 - RNA, 14 nt, Molluscum contagiosum virus
uggcgccugcgcgc

SEQ ID NO: 3106848 - RNA, 19 nt, Molluscum contagiosum virus
uggcgcgcccggcgcccgc

SEQ ID NO: 3106849 - RNA, 15 nt, Molluscum contagiosum virus
uggcgcgccgcugcc

SEQ ID NO: 3106850 - RNA, 15 nt, Molluscum contagiosum virus
uggcgcgccggcgcg

SEQ ID NO: 3106851 - RNA, 14 nt, Molluscum contagiosum virus
uggcgcgcgagcug

SEQ ID NO: 3106852 - RNA, 19 nt, Molluscum contagiosum virus
uggcgcgcgagcugcuagc

SEQ ID NO: 3106853 - RNA, 14 nt, Molluscum contagiosum virus
uggcgcgcgcgcug

SEQ ID NO: 3106854 - RNA, 17 nt, Molluscum contagiosum virus
uggcgcgcgcgcugcgc

SEQ ID NO: 3106855 - RNA, 20 nt, Molluscum contagiosum virus
uggcgcgcgcggucgacggg

SEQ ID NO: 3106856 - RNA, 14 nt, Molluscum contagiosum virus
uggcgcgcgugccg

SEQ ID NO: 3106857 - RNA, 17 nt, Molluscum contagiosum virus
ugggcacgcucuacggc

SEQ ID NO: 3106858 - RNA, 23 nt, Molluscum contagiosum virus
ugggcacgcucuacggcgugcug

SEQ ID NO: 3106859 - RNA, 15 nt, Molluscum contagiosum virus
ugggcacugcuacga

SEQ ID NO: 3106860 - RNA, 18 nt, Molluscum contagiosum virus
ugggcaggccgcccacgc

SEQ ID NO: 3106861 - RNA, 17 nt, Molluscum contagiosum virus
ugggauaacaggcgugc

SEQ ID NO: 3106862 - RNA, 16 nt, Molluscum contagiosum virus
ugggcaacgcgcgcgc

SEQ ID NO: 3106863 - RNA, 21 nt, Molluscum contagiosum virus
ugggcaccugcaucgcgccgc

SEQ ID NO: 3106864 - RNA, 19 nt, Molluscum contagiosum virus
uggcugcgguagcggacgc

SEQ ID NO: 3106865 - RNA, 14 nt, Molluscum contagiosum virus
uggcugcugcgcga

SEQ ID NO: 3106866 - RNA, 23 nt, Molluscum contagiosum virus
ugggaaaccucaccucugcgcgg

SEQ ID NO: 3106867 - RNA, 19 nt, Molluscum contagiosum virus
ugggaggacacgcgcacgc

SEQ ID NO: 3106868 - RNA, 14 nt, Molluscum contagiosum virus
uggcggaugucacg

SEQ ID NO: 3106869 - RNA, 13 nt, Molluscum contagiosum virus
uggcggcgcacgc

SEQ ID NO: 3106870 - RNA, 21 nt, Molluscum contagiosum virus
uggcggcgcacgcgagcacgc

SEQ ID NO: 3106871 - RNA, 12 nt, Molluscum contagiosum virus
uggcggcgcugg

SEQ ID NO: 3106872 - RNA, 14 nt, Molluscum contagiosum virus
uggcgggcgugccc

SEQ ID NO: 3106873 - RNA, 16 nt, Molluscum contagiosum virus
uggcucuucucgcagc

SEQ ID NO: 3106874 - RNA, 13 nt, Molluscum contagiosum virus
uggcgugacaggu

SEQ ID NO: 3106875 - RNA, 13 nt, Molluscum contagiosum virus
uggcgugcgcagu

SEQ ID NO: 3106876 - RNA, 12 nt, Molluscum contagiosum virus
uggcguguacgu

SEQ ID NO: 3106877 - RNA, 14 nt, Molluscum contagiosum virus
uggcguucgacggc

SEQ ID NO: 3106878 - RNA, 22 nt, Molluscum contagiosum virus
uggcuacuggaggagugucgcg

SEQ ID NO: 3106879 - RNA, 16 nt, Molluscum contagiosum virus
ugcggcacgggcucga

SEQ ID NO: 3106880 - RNA, 19 nt, Molluscum contagiosum virus
ugcggcaggaagcuggcgc

SEQ ID NO: 3106881 - RNA, 21 nt, Molluscum contagiosum virus
ugcggcaggaagcuggcgcgg

SEQ ID NO: 3106882 - RNA, 13 nt, Molluscum contagiosum virus
ugcggcaggcgcu

SEQ ID NO: 3106883 - RNA, 14 nt, Molluscum contagiosum virus
ugcggcaggcgcug

SEQ ID NO: 3106884 - RNA, 18 nt, Molluscum contagiosum virus
ugcggcaggcgcugcgcg

SEQ ID NO: 3106885 - RNA, 15 nt, Molluscum contagiosum virus
ugcggccaccagcgc

SEQ ID NO: 3106886 - RNA, 16 nt, Molluscum contagiosum virus
ugcggccaccagcgcg

SEQ ID NO: 3106887 - RNA, 19 nt, Molluscum contagiosum virus
ugcgcgugcgggcgagcau

SEQ ID NO: 3106888 - RNA, 20 nt, Molluscum contagiosum virus
ugcgcguguagcggcgcuug

SEQ ID NO: 3106889 - RNA, 11 nt, Molluscum contagiosum virus
ugcgcgugucu

SEQ ID NO: 3106890 - RNA, 22 nt, Molluscum contagiosum virus
ugcgcgugucuggagcccacgu

SEQ ID NO: 3106891 - RNA, 20 nt, Molluscum contagiosum virus
ugcgcgugugcagcagguag

SEQ ID NO: 3106892 - RNA, 18 nt, Molluscum contagiosum virus
ugcgcuacguuccgcgcg

SEQ ID NO: 3106893 - RNA, 17 nt, Molluscum contagiosum virus
ugcgcugccagcucgac

SEQ ID NO: 3106894 - RNA, 21 nt, Molluscum contagiosum virus
ugcgcugccgguggaagagcc

SEQ ID NO: 3106895 - RNA, 16 nt, Molluscum contagiosum virus
ugcgcuucgccgcgcg

SEQ ID NO: 3106896 - RNA, 18 nt, Molluscum contagiosum virus
ugcgcgucugugcgcgcu

SEQ ID NO: 3106897 - RNA, 22 nt, Molluscum contagiosum virus
ugcgcgugccucugccagccgc

SEQ ID NO: 3106898 - RNA, 17 nt, Molluscum contagiosum virus
ugcgcgugcgccugccg

SEQ ID NO: 3106899 - RNA, 15 nt, Molluscum contagiosum virus
ugcgcguccgcaaag

SEQ ID NO: 3106900 - RNA, 22 nt, Molluscum contagiosum virus
ugcgcggggcaggcagugccgc

SEQ ID NO: 3106901 - RNA, 21 nt, Molluscum contagiosum virus
ugcgcgcacggcuaggcgcgg

SEQ ID NO: 3106902 - RNA, 22 nt, Molluscum contagiosum virus
ugcgcgcacugcucgcgcacgc

SEQ ID NO: 3106903 - RNA, 15 nt, Molluscum contagiosum virus
ugcgcgccgcgcugc

SEQ ID NO: 3106904 - RNA, 21 nt, Molluscum contagiosum virus
ugcgcgcgcccucgcgcgcag

SEQ ID NO: 3106905 - RNA, 13 nt, Molluscum contagiosum virus
ugcgcgcgcgcgu

SEQ ID NO: 3106906 - RNA, 12 nt, Molluscum contagiosum virus
ugcgcgcgcgcu

SEQ ID NO: 3106907 - RNA, 18 nt, Molluscum contagiosum virus
ugcgcgcgcuacugcgcg

SEQ ID NO: 3106908 - RNA, 18 nt, Molluscum contagiosum virus
ugcgcgcgcucauggcgc

SEQ ID NO: 3106909 - RNA, 12 nt, Molluscum contagiosum virus
ugcgcgcgcuga

SEQ ID NO: 3106910 - RNA, 23 nt, Molluscum contagiosum virus
ugcgcgcgguaacgcgcgcgccu

SEQ ID NO: 3106911 - RNA, 11 nt, Molluscum contagiosum virus
ugcgcgcgugc

SEQ ID NO: 3106912 - RNA, 13 nt, Molluscum contagiosum virus
ugcgcgcugcgcg

SEQ ID NO: 3106913 - RNA, 12 nt, Molluscum contagiosum virus
ugcggcgcgugc

SEQ ID NO: 3106914 - RNA, 20 nt, Molluscum contagiosum virus
ugcggcgcgugccgcugcgc

SEQ ID NO: 3106915 - RNA, 21 nt, Molluscum contagiosum virus
ugcggcgcgugccgcugcgcg

SEQ ID NO: 3106916 - RNA, 22 nt, Molluscum contagiosum virus
ugcggcgcgugccgcugcgcgg

SEQ ID NO: 3106917 - RNA, 17 nt, Molluscum contagiosum virus
ugcggcgcgugcugagc

SEQ ID NO: 3106918 - RNA, 15 nt, Molluscum contagiosum virus
ugcggcggcgcacgc

SEQ ID NO: 3106919 - RNA, 20 nt, Molluscum contagiosum virus
ugcggcguacgcgcagggag

SEQ ID NO: 3106920 - RNA, 21 nt, Molluscum contagiosum virus
ugcggcaaccgcgcccgcgcg

SEQ ID NO: 3106921 - RNA, 19 nt, Molluscum contagiosum virus
ugcggcaacugccugcgcu

SEQ ID NO: 3106922 - RNA, 18 nt, Molluscum contagiosum virus
ugcgcuugggcgucgucu

SEQ ID NO: 3106923 - RNA, 20 nt, Molluscum contagiosum virus
ugcggagacuguuaggcauc

SEQ ID NO: 3106924 - RNA, 20 nt, Molluscum contagiosum virus
ugcggugacgguccugcgcg

SEQ ID NO: 3106925 - RNA, 17 nt, Molluscum contagiosum virus
ugcgggcuagcacgcau

SEQ ID NO: 3106926 - RNA, 17 nt, Molluscum contagiosum virus
uggccgagccgcuggcc

SEQ ID NO: 3106927 - RNA, 22 nt, Molluscum contagiosum virus
ugcguacacauggccgcgcgcu

SEQ ID NO: 3106928 - RNA, 23 nt, Molluscum contagiosum virus
ugcgucacaagcaccgccugcug

SEQ ID NO: 3106929 - RNA, 22 nt, Molluscum contagiosum virus
ugcgugaggaagaccuuggaca

SEQ ID NO: 3106930 - RNA, 13 nt, Molluscum contagiosum virus
uagcccagcacgc

SEQ ID NO: 3106931 - RNA, 14 nt, Molluscum contagiosum virus
uagccgccgcugcc

SEQ ID NO: 3106932 - RNA, 17 nt, Molluscum contagiosum virus
uagccgcgacgcaagcg

SEQ ID NO: 3106933 - RNA, 21 nt, Molluscum contagiosum virus
uagaccuuuacgucgcgcgcu

SEQ ID NO: 3106934 - RNA, 20 nt, Molluscum contagiosum virus
uagagcagaaggugcgcagc

SEQ ID NO: 3106935 - RNA, 21 nt, Molluscum contagiosum virus
uagagcuggcaccgggcgccg

SEQ ID NO: 3106936 - RNA, 15 nt, Molluscum contagiosum virus
uagaggagauggcaa

SEQ ID NO: 3106937 - RNA, 15 nt, Molluscum contagiosum virus
uagcacacgcgcgcg

SEQ ID NO: 3106938 - RNA, 22 nt, Molluscum contagiosum virus
uagcaccgcaugggcccuggcg

SEQ ID NO: 3106939 - RNA, 13 nt, Molluscum contagiosum virus
uagcagagcacga

SEQ ID NO: 3106940 - RNA, 16 nt, Molluscum contagiosum virus
uagcagcgccugcacg

SEQ ID NO: 3106941 - RNA, 14 nt, Molluscum contagiosum virus
uagcagcgugcgca

SEQ ID NO: 3106942 - RNA, 21 nt, Molluscum contagiosum virus
uagcagggcggcgccugcgcc

SEQ ID NO: 3106943 - RNA, 23 nt, Molluscum contagiosum virus
uagcaugucacgcgucgcgcgcc

SEQ ID NO: 3106944 - RNA, 18 nt, Molluscum contagiosum virus
uacuucuacgagcagcgc

SEQ ID NO: 3106945 - RNA, 17 nt, Molluscum contagiosum virus
uacuuggaagagucgcg

SEQ ID NO: 3106946 - RNA, 19 nt, Molluscum contagiosum virus
uacugcaacguggcgccgc

SEQ ID NO: 3106947 - RNA, 21 nt, Molluscum contagiosum virus
uacgucgcgcgcucgcucgcg

SEQ ID NO: 3106948 - RNA, 14 nt, Molluscum contagiosum virus
uacgucuccucgcg

SEQ ID NO: 3106949 - RNA, 14 nt, Molluscum contagiosum virus
uacgcgucgcggag

SEQ ID NO: 3106950 - RNA, 18 nt, Molluscum contagiosum virus
uaccggcaguagcagcgc

SEQ ID NO: 3106951 - RNA, 13 nt, Molluscum contagiosum virus
uaccagcucgcgc

SEQ ID NO: 3106952 - RNA, 21 nt, Molluscum contagiosum virus
uacgagcacauacacgcgcau

SEQ ID NO: 3106953 - RNA, 13 nt, Molluscum contagiosum virus
uacgagcaggcgc

SEQ ID NO: 3106954 - RNA, 14 nt, Molluscum contagiosum virus
uacgagcaggcgca

SEQ ID NO: 3106955 - RNA, 19 nt, Molluscum contagiosum virus
uacgagcccaucaaggcgc

SEQ ID NO: 3106956 - RNA, 23 nt, Molluscum contagiosum virus
uacgagcccaucaaggcgcgcau

SEQ ID NO: 3106957 - RNA, 19 nt, Molluscum contagiosum virus
uacgaggugcugcgccacg

SEQ ID NO: 3106958 - RNA, 14 nt, Molluscum contagiosum virus
uaccugcgcaagcu

SEQ ID NO: 3106959 - RNA, 19 nt, Molluscum contagiosum virus
uaccuguguuucguacgcg

SEQ ID NO: 3106960 - RNA, 19 nt, Molluscum contagiosum virus
uacgacaugcucgcgcucu

SEQ ID NO: 3106961 - RNA, 14 nt, Molluscum contagiosum virus
uacgccagcgacgc

SEQ ID NO: 3106962 - RNA, 21 nt, Molluscum contagiosum virus
uacgcacgcacguggcgcugc

SEQ ID NO: 3106963 - RNA, 14 nt, Molluscum contagiosum virus
uacgcgcagggagc

SEQ ID NO: 3106964 - RNA, 15 nt, Molluscum contagiosum virus
uacgcgccggggcgc

SEQ ID NO: 3106965 - RNA, 22 nt, Molluscum contagiosum virus
uacgcgccggggcgcgcgcugc

SEQ ID NO: 3106966 - RNA, 19 nt, Molluscum contagiosum virus
uacgcgcgcguaacagcgc

SEQ ID NO: 3106967 - RNA, 15 nt, Molluscum contagiosum virus
uacgcgcgcgugcug

SEQ ID NO: 3106968 - RNA, 20 nt, Molluscum contagiosum virus
uacgcgcugcggcgcucgca

SEQ ID NO: 3106969 - RNA, 14 nt, Molluscum contagiosum virus
uacgcuacagcagc

SEQ ID NO: 3106970 - RNA, 14 nt, Molluscum contagiosum virus
uacgcucgcgcugu

SEQ ID NO: 3106971 - RNA, 15 nt, Molluscum contagiosum virus
uacggacggcgcacg

SEQ ID NO: 3106972 - RNA, 20 nt, Molluscum contagiosum virus
uacgggaagcugcacgugca

SEQ ID NO: 3106973 - RNA, 19 nt, Molluscum contagiosum virus
uacgggcgcuauugcgcgg

SEQ ID NO: 3106974 - RNA, 13 nt, Molluscum contagiosum virus
guguucugcgcgc

SEQ ID NO: 3106975 - RNA, 17 nt, Molluscum contagiosum virus
gugugcucugugcgcgc

SEQ ID NO: 3106976 - RNA, 15 nt, Molluscum contagiosum virus
guuccagcagcgcca

SEQ ID NO: 3106977 - RNA, 16 nt, Molluscum contagiosum virus
guuccagcagcgccag

SEQ ID NO: 3106978 - RNA, 20 nt, Molluscum contagiosum virus
guuccaggaacgccgccacg

SEQ ID NO: 3106979 - RNA, 21 nt, Molluscum contagiosum virus
uacaugcucaagcaccugcgc

SEQ ID NO: 3106980 - RNA, 15 nt, Molluscum contagiosum virus
guucagguagcgcgc

SEQ ID NO: 3106981 - RNA, 22 nt, Molluscum contagiosum virus
guucaacaucguggcgcgcgcg

SEQ ID NO: 3106982 - RNA, 18 nt, Molluscum contagiosum virus
uaccgcgacggcgugcug

SEQ ID NO: 3106983 - RNA, 14 nt, Molluscum contagiosum virus
uaccgcgcgcacgc

SEQ ID NO: 3106984 - RNA, 17 nt, Molluscum contagiosum virus
uaccgcgcgcgcaagcg

SEQ ID NO: 3106985 - RNA, 17 nt, Molluscum contagiosum virus
gugguuuacaucggcuc

SEQ ID NO: 3106986 - RNA, 20 nt, Molluscum contagiosum virus
gugucagccccgggcccgca

SEQ ID NO: 3106987 - RNA, 15 nt, Molluscum contagiosum virus
gugucgagcucgcgc

SEQ ID NO: 3106988 - RNA, 24 nt, Molluscum contagiosum virus
gugugcaggaacugcccgcgucgc

SEQ ID NO: 3106989 - RNA, 18 nt, Molluscum contagiosum virus
gugugccagcggcgccgc

SEQ ID NO: 3106990 - RNA, 15 nt, Molluscum contagiosum virus
guguaccgccgcggc

SEQ ID NO: 3106991 - RNA, 22 nt, Molluscum contagiosum virus
guguacgcacggggccgcacgc

SEQ ID NO: 3106992 - RNA, 12 nt, Molluscum contagiosum virus
guggugcgcgac

SEQ ID NO: 3106993 - RNA, 16 nt, Molluscum contagiosum virus
guggucgcgcgcgcuc

SEQ ID NO: 3106994 - RNA, 22 nt, Molluscum contagiosum virus
gugggcaccugcaucgcgccgc

SEQ ID NO: 3106995 - RNA, 14 nt, Molluscum contagiosum virus
gugggccgcggcgc

SEQ ID NO: 3106996 - RNA, 20 nt, Molluscum contagiosum virus
gugggcgacgugaagacgcu

SEQ ID NO: 3106997 - RNA, 15 nt, Molluscum contagiosum virus
guggcuugcugcagu

SEQ ID NO: 3106998 - RNA, 17 nt, Molluscum contagiosum virus
guggcggcucugccgcg

SEQ ID NO: 3106999 - RNA, 21 nt, Molluscum contagiosum virus
guggcguccgcacgaggagcc

SEQ ID NO: 3107000 - RNA, 20 nt, Molluscum contagiosum virus
guggcguugcugcugcgcgc

SEQ ID NO: 3107001 - RNA, 14 nt, Molluscum contagiosum virus
guggccuacguggc

SEQ ID NO: 3107002 - RNA, 16 nt, Molluscum contagiosum virus
guggccuacguggcgu

SEQ ID NO: 3107003 - RNA, 13 nt, Molluscum contagiosum virus
guggcgagcaucu

SEQ ID NO: 3107004 - RNA, 20 nt, Molluscum contagiosum virus
guggcgagcaucugcgcgug

SEQ ID NO: 3107005 - RNA, 20 nt, Molluscum contagiosum virus
guggcgcacacggacgagcc

SEQ ID NO: 3107006 - RNA, 15 nt, Molluscum contagiosum virus
guggcgccugcgcgc

SEQ ID NO: 3107007 - RNA, 16 nt, Molluscum contagiosum virus
guggcgccugcgcgcg

SEQ ID NO: 3107008 - RNA, 14 nt, Molluscum contagiosum virus
guggcgcugggcgc

SEQ ID NO: 3107009 - RNA, 15 nt, Molluscum contagiosum virus
guggcgcuuggcgag

SEQ ID NO: 3107010 - RNA, 22 nt, Molluscum contagiosum virus
guggcgcuuggcgagcgcugcc

SEQ ID NO: 3107011 - RNA, 18 nt, Molluscum contagiosum virus
guggccaacggcgccauc

SEQ ID NO: 3107012 - RNA, 21 nt, Molluscum contagiosum virus
guggccaacuucgcggucgac

SEQ ID NO: 3107013 - RNA, 15 nt, Molluscum contagiosum virus
guggaggugcgcgac

SEQ ID NO: 3107014 - RNA, 14 nt, Molluscum contagiosum virus
guggaucgcgcgca

SEQ ID NO: 3107015 - RNA, 13 nt, Molluscum contagiosum virus
guggccagcgcgc

SEQ ID NO: 3107016 - RNA, 21 nt, Molluscum contagiosum virus
guggccgcgccgggcgccaga

SEQ ID NO: 3107017 - RNA, 23 nt, Molluscum contagiosum virus
guggccgcgcgcgcacgcaagcc

SEQ ID NO: 3107018 - RNA, 20 nt, Molluscum contagiosum virus
guggacgcgcaagugugcgc

SEQ ID NO: 3107019 - RNA, 23 nt, Molluscum contagiosum virus
guggacgcgcgagugugugcauc

SEQ ID NO: 3107020 - RNA, 14 nt, Molluscum contagiosum virus
guggaccuuggcgc

SEQ ID NO: 3107021 - RNA, 19 nt, Molluscum contagiosum virus
guggaccuuggcgcgccgc

SEQ ID NO: 3107022 - RNA, 23 nt, Molluscum contagiosum virus
guggaccuuggcgcgccgcugcc

SEQ ID NO: 3107023 - RNA, 17 nt, Molluscum contagiosum virus
guggacgaugguggcgc

SEQ ID NO: 3107024 - RNA, 16 nt, Molluscum contagiosum virus
gugcucguguguccgc

SEQ ID NO: 3107025 - RNA, 20 nt, Molluscum contagiosum virus
gugcucguguguccgcacgc

SEQ ID NO: 3107026 - RNA, 22 nt, Molluscum contagiosum virus
gugcucguguguccgcacgcac

SEQ ID NO: 3107027 - RNA, 15 nt, Molluscum contagiosum virus
gugcucugugcgcgc

SEQ ID NO: 3107028 - RNA, 20 nt, Molluscum contagiosum virus
gugcucuucggggacggcgu

SEQ ID NO: 3107029 - RNA, 22 nt, Molluscum contagiosum virus
gugcucuuuaguacaacgcgcu

SEQ ID NO: 3107030 - RNA, 18 nt, Molluscum contagiosum virus
gugcugaagacgcuggcc

SEQ ID NO: 3107031 - RNA, 18 nt, Molluscum contagiosum virus
gugcugcagcugcgcgag

SEQ ID NO: 3107032 - RNA, 13 nt, Molluscum contagiosum virus
gugcugcgcacgc

SEQ ID NO: 3107033 - RNA, 13 nt, Molluscum contagiosum virus
gugcugcgccacg

SEQ ID NO: 3107034 - RNA, 23 nt, Molluscum contagiosum virus
gugcgucacguacucgcugcucc

SEQ ID NO: 3107035 - RNA, 19 nt, Molluscum contagiosum virus
gugcgugcccaagugcgcg

SEQ ID NO: 3107036 - RNA, 21 nt, Molluscum contagiosum virus
gugcgugcccaagugcgcgug

SEQ ID NO: 3107037 - RNA, 15 nt, Molluscum contagiosum virus
gugcgugcgcugcgc

SEQ ID NO: 3107038 - RNA, 18 nt, Molluscum contagiosum virus
gugcgugguguccacgcg

SEQ ID NO: 3107039 - RNA, 20 nt, Molluscum contagiosum virus
gugcgugguguccacgcgcg

SEQ ID NO: 3107040 - RNA, 14 nt, Molluscum contagiosum virus
gugcuugcgcacgg

SEQ ID NO: 3107041 - RNA, 14 nt, Molluscum contagiosum virus
gugcuggacgcgca

SEQ ID NO: 3107042 - RNA, 23 nt, Molluscum contagiosum virus
gugcuggagcagacguacgagca

SEQ ID NO: 3107043 - RNA, 21 nt, Molluscum contagiosum virus
gugcuggagggcacgcugcac

SEQ ID NO: 3107044 - RNA, 20 nt, Molluscum contagiosum virus
gugcuggucaagaaggcgcu

SEQ ID NO: 3107045 - RNA, 22 nt, Molluscum contagiosum virus
gugcuguccuacuucgucaagc

SEQ ID NO: 3107046 - RNA, 16 nt, Molluscum contagiosum virus
gugcuguugccgcgcu

SEQ ID NO: 3107047 - RNA, 15 nt, Molluscum contagiosum virus
ucgugguugcgcacg

SEQ ID NO: 3107048 - RNA, 15 nt, Molluscum contagiosum virus
ucgugugcgcgcacg

SEQ ID NO: 3107049 - RNA, 19 nt, Molluscum contagiosum virus
ucguguguccgcacgcaca

SEQ ID NO: 3107050 - RNA, 22 nt, Molluscum contagiosum virus
uauaguccccggcgccggcacc

SEQ ID NO: 3107051 - RNA, 19 nt, Molluscum contagiosum virus
ucuacguguccgcauccgc

SEQ ID NO: 3107052 - RNA, 23 nt, Molluscum contagiosum virus
ucuacuaaaguacgagagcgcau

SEQ ID NO: 3107053 - RNA, 20 nt, Molluscum contagiosum virus
ucuacugcgacauccacaug

SEQ ID NO: 3107054 - RNA, 17 nt, Molluscum contagiosum virus
ucuacuggcggcgcccg

SEQ ID NO: 3107055 - RNA, 16 nt, Molluscum contagiosum virus
ucguuggcgcgcccgg

SEQ ID NO: 3107056 - RNA, 18 nt, Molluscum contagiosum virus
ucuaagcgcacgcgcgac

SEQ ID NO: 3107057 - RNA, 15 nt, Molluscum contagiosum virus
ucuacgaggagcacg

SEQ ID NO: 3107058 - RNA, 19 nt, Molluscum contagiosum virus
uagcucgugccugucggca

SEQ ID NO: 3107059 - RNA, 15 nt, Molluscum contagiosum virus
uagcuggcgcccgua

SEQ ID NO: 3107060 - RNA, 16 nt, Molluscum contagiosum virus
uaggcgggccugcgcc

SEQ ID NO: 3107061 - RNA, 21 nt, Molluscum contagiosum virus
uagggcaucgagaacgccgcg

SEQ ID NO: 3107062 - RNA, 15 nt, Molluscum contagiosum virus
uagguacccgcaacc

SEQ ID NO: 3107063 - RNA, 16 nt, Molluscum contagiosum virus
uagcgcccguggcgcc

SEQ ID NO: 3107064 - RNA, 12 nt, Molluscum contagiosum virus
uagcgcgcgugu

SEQ ID NO: 3107065 - RNA, 22 nt, Molluscum contagiosum virus
uagcggcggcguaggccugcgg

SEQ ID NO: 3107066 - RNA, 16 nt, Molluscum contagiosum virus
uagcguucccaagcaa

SEQ ID NO: 3107067 - RNA, 14 nt, Molluscum contagiosum virus
uaguagcgcucgcc

SEQ ID NO: 3107068 - RNA, 21 nt, Molluscum contagiosum virus
uaggcacacacgaacgcacgc

SEQ ID NO: 3107069 - RNA, 17 nt, Molluscum contagiosum virus
uaggcacuccgcgcacc

SEQ ID NO: 3107070 - RNA, 20 nt, Molluscum contagiosum virus
uauacuccccgcgcgcgugc

SEQ ID NO: 3107071 - RNA, 17 nt, Molluscum contagiosum virus
uauacucgacgcgcgcg

SEQ ID NO: 3107072 - RNA, 17 nt, Molluscum contagiosum virus
uaguccgcguacagcgc

SEQ ID NO: 3107073 - RNA, 14 nt, Molluscum contagiosum virus
uaguggcgcucgcg

SEQ ID NO: 3107074 - RNA, 18 nt, Molluscum contagiosum virus
uagugguccaccagcugc

SEQ ID NO: 3107075 - RNA, 14 nt, Molluscum contagiosum virus
ucuccgcgcugcac

SEQ ID NO: 3107076 - RNA, 16 nt, Molluscum contagiosum virus
ucucccucgcgcgcau

SEQ ID NO: 3107077 - RNA, 22 nt, Molluscum contagiosum virus
ucuccgaagagcagaaggcgua

SEQ ID NO: 3107078 - RNA, 15 nt, Molluscum contagiosum virus
ucuccgaccgugccc

SEQ ID NO: 3107079 - RNA, 17 nt, Molluscum contagiosum virus
ucuccgagacacgcgag

SEQ ID NO: 3107080 - RNA, 15 nt, Molluscum contagiosum virus
ucuagcucgcgcgcg

SEQ ID NO: 3107081 - RNA, 18 nt, Molluscum contagiosum virus
ucucagcggcacugcgcg

SEQ ID NO: 3107082 - RNA, 17 nt, Molluscum contagiosum virus
ucucccgccgcgugccc

SEQ ID NO: 3107083 - RNA, 23 nt, Molluscum contagiosum virus
ucuccaagaagacggcgcgcgcg

SEQ ID NO: 3107084 - RNA, 13 nt, Molluscum contagiosum virus
ucuccaggaacgc

SEQ ID NO: 3107085 - RNA, 14 nt, Molluscum contagiosum virus
ucucgcacgcggag

SEQ ID NO: 3107086 - RNA, 20 nt, Molluscum contagiosum virus
ucucgcagacgcagcgcgag

SEQ ID NO: 3107087 - RNA, 22 nt, Molluscum contagiosum virus
ucuccuccuugauuucgcgcag

SEQ ID NO: 3107088 - RNA, 20 nt, Molluscum contagiosum virus
ucucgcgcgggcagggcgac

SEQ ID NO: 3107089 - RNA, 13 nt, Molluscum contagiosum virus
ucucgcgcucgcc

SEQ ID NO: 3107090 - RNA, 20 nt, Molluscum contagiosum virus
ucucgcggggcaagcgcgcu

SEQ ID NO: 3107091 - RNA, 19 nt, Molluscum contagiosum virus
ucucggcagcgucgcggag

SEQ ID NO: 3107092 - RNA, 14 nt, Molluscum contagiosum virus
ucucgccggcugua

SEQ ID NO: 3107093 - RNA, 12 nt, Molluscum contagiosum virus
ucucgcgcacga

SEQ ID NO: 3107094 - RNA, 20 nt, Molluscum contagiosum virus
ucucugcgaucgcgggcacg

SEQ ID NO: 3107095 - RNA, 13 nt, Molluscum contagiosum virus
ucucugcgcgcaa

SEQ ID NO: 3107096 - RNA, 16 nt, Molluscum contagiosum virus
ucugccguucggcgag

SEQ ID NO: 3107097 - RNA, 13 nt, Molluscum contagiosum virus
ucugccucgugga

SEQ ID NO: 3107098 - RNA, 15 nt, Molluscum contagiosum virus
ucugcgagcgcgaau

SEQ ID NO: 3107099 - RNA, 22 nt, Molluscum contagiosum virus
ucugcgcagguagcggcucgcg

SEQ ID NO: 3107100 - RNA, 15 nt, Molluscum contagiosum virus
ucugcgcccgcggag

SEQ ID NO: 3107101 - RNA, 15 nt, Molluscum contagiosum virus
ucugcgccgcgcgcg

SEQ ID NO: 3107102 - RNA, 14 nt, Molluscum contagiosum virus
ucugcgcgagcagc

SEQ ID NO: 3107103 - RNA, 19 nt, Molluscum contagiosum virus
ucugcgcuccacgcccgag

SEQ ID NO: 3107104 - RNA, 17 nt, Molluscum contagiosum virus
ucugcguugcgcgucau

SEQ ID NO: 3107105 - RNA, 14 nt, Molluscum contagiosum virus
ucugcuccgcggag

SEQ ID NO: 3107106 - RNA, 12 nt, Molluscum contagiosum virus
ucugcucgcagu

SEQ ID NO: 3107107 - RNA, 13 nt, Molluscum contagiosum virus
ucugcucgcgcau

SEQ ID NO: 3107108 - RNA, 20 nt, Molluscum contagiosum virus
ucugcugcacacaccgcgag

SEQ ID NO: 3107109 - RNA, 17 nt, Molluscum contagiosum virus
ucuggacguguccgacg

SEQ ID NO: 3107110 - RNA, 22 nt, Molluscum contagiosum virus
ucuggaucaccacuggacacgu

SEQ ID NO: 3107111 - RNA, 19 nt, Molluscum contagiosum virus
ucugguuccugcgcuccga

SEQ ID NO: 3107112 - RNA, 15 nt, Molluscum contagiosum virus
ucugucccgcccgug

SEQ ID NO: 3107113 - RNA, 19 nt, Molluscum contagiosum virus
ucuguccgucuugcgcaca

SEQ ID NO: 3107114 - RNA, 11 nt, Molluscum contagiosum virus
ucuuccacaug

SEQ ID NO: 3107115 - RNA, 20 nt, Molluscum contagiosum virus
ucuucccguuccugggcaac

SEQ ID NO: 3107116 - RNA, 14 nt, Molluscum contagiosum virus
ucuuccggcccgac

SEQ ID NO: 3107117 - RNA, 15 nt, Molluscum contagiosum virus
ucuuccuggggcugg

SEQ ID NO: 3107118 - RNA, 22 nt, Molluscum contagiosum virus
ucuucgaaguggccgucgcgag

SEQ ID NO: 3107119 - RNA, 20 nt, Molluscum contagiosum virus
ucuucgagacgcugcgcgac

SEQ ID NO: 3107120 - RNA, 23 nt, Molluscum contagiosum virus
ucuucgagacgcugcgcgacgag

SEQ ID NO: 3107121 - RNA, 22 nt, Molluscum contagiosum virus
ucuucgcgcugguuugcgcgag

SEQ ID NO: 3107122 - RNA, 19 nt, Molluscum contagiosum virus
ucugaaaggacaugggcac

SEQ ID NO: 3107123 - RNA, 20 nt, Molluscum contagiosum virus
ucugacacuugcggcgcuag

SEQ ID NO: 3107124 - RNA, 20 nt, Molluscum contagiosum virus
ucugcaaggccuguccgacg

SEQ ID NO: 3107125 - RNA, 15 nt, Molluscum contagiosum virus
ucugcacgggcacgc

SEQ ID NO: 3107126 - RNA, 13 nt, Molluscum contagiosum virus
ucugcagcgccgc

SEQ ID NO: 3107127 - RNA, 17 nt, Molluscum contagiosum virus
ucugcagcgccgcgcgg

SEQ ID NO: 3107128 - RNA, 18 nt, Molluscum contagiosum virus
ucugccaccgcggcgcgg

SEQ ID NO: 3107129 - RNA, 20 nt, Molluscum contagiosum virus
ucugccaccgcggcgcggag

SEQ ID NO: 3107130 - RNA, 14 nt, Molluscum contagiosum virus
ugaggcugcucucc

SEQ ID NO: 3107131 - RNA, 19 nt, Molluscum contagiosum virus
ugagguacuccacgcccgg

SEQ ID NO: 3107132 - RNA, 22 nt, Molluscum contagiosum virus
ugaguaccgcgggcgcagacgc

SEQ ID NO: 3107133 - RNA, 13 nt, Molluscum contagiosum virus
ugagugcgcgcac

SEQ ID NO: 3107134 - RNA, 18 nt, Molluscum contagiosum virus
ugaguuucuggugccgcg

SEQ ID NO: 3107135 - RNA, 14 nt, Molluscum contagiosum virus
ucuuuccggcgcgg

SEQ ID NO: 3107136 - RNA, 24 nt, Molluscum contagiosum virus
ucuuugccccccccccgacgcgag

SEQ ID NO: 3107137 - RNA, 18 nt, Molluscum contagiosum virus
ucuuugcgaacgcgcaag

SEQ ID NO: 3107138 - RNA, 18 nt, Molluscum contagiosum virus
ucuuugcggacgcgcgag

SEQ ID NO: 3107139 - RNA, 20 nt, Molluscum contagiosum virus
ugaaaagcgugauguugagc

SEQ ID NO: 3107140 - RNA, 17 nt, Molluscum contagiosum virus
ugaacaacauggugcug

SEQ ID NO: 3107141 - RNA, 18 nt, Molluscum contagiosum virus
ugaacaccauccugcgcu

SEQ ID NO: 3107142 - RNA, 17 nt, Molluscum contagiosum virus
ugaacagcauuagcgcc

SEQ ID NO: 3107143 - RNA, 18 nt, Molluscum contagiosum virus
ugaacagcuucacgauga

SEQ ID NO: 3107144 - RNA, 16 nt, Molluscum contagiosum virus
ucugggcgcgugcgag

SEQ ID NO: 3107145 - RNA, 14 nt, Molluscum contagiosum virus
ucuuguugcgcaug

SEQ ID NO: 3107146 - RNA, 18 nt, Molluscum contagiosum virus
ucuuguugucugcggacg

SEQ ID NO: 3107147 - RNA, 17 nt, Molluscum contagiosum virus
ucuugcuggcgcucgcg

SEQ ID NO: 3107148 - RNA, 23 nt, Molluscum contagiosum virus
ucuugcuggcgcucgcgcgcacg

SEQ ID NO: 3107149 - RNA, 16 nt, Molluscum contagiosum virus
ucugccgcccgcgccc

SEQ ID NO: 3107150 - RNA, 15 nt, Molluscum contagiosum virus
ucuucguggcgcugg

SEQ ID NO: 3107151 - RNA, 19 nt, Molluscum contagiosum virus
ucuucguggcgcugggcgc

SEQ ID NO: 3107152 - RNA, 21 nt, Molluscum contagiosum virus
ucuugaaacaguaggacaugu

SEQ ID NO: 3107153 - RNA, 20 nt, Molluscum contagiosum virus
ugaucgcgcaggcgcgccau

SEQ ID NO: 3107154 - RNA, 21 nt, Molluscum contagiosum virus
ugcaacucgcgcugcagcacc

SEQ ID NO: 3107155 - RNA, 22 nt, Molluscum contagiosum virus
ugcaagcacaacgggcucgugc

SEQ ID NO: 3107156 - RNA, 23 nt, Molluscum contagiosum virus
ugcaaagacgguacauauucccu

SEQ ID NO: 3107157 - RNA, 13 nt, Molluscum contagiosum virus
ugcaaagcgcggc

SEQ ID NO: 3107158 - RNA, 14 nt, Molluscum contagiosum virus
ugcaaggcgcgcgc

SEQ ID NO: 3107159 - RNA, 19 nt, Molluscum contagiosum virus
ugcaagguuuacgccgugc

SEQ ID NO: 3107160 - RNA, 16 nt, Molluscum contagiosum virus
ugcacaagcaggaguc

SEQ ID NO: 3107161 - RNA, 14 nt, Molluscum contagiosum virus
ugcacaccggcgcg

SEQ ID NO: 3107162 - RNA, 16 nt, Molluscum contagiosum virus
ugcacaccggcgcgcu

SEQ ID NO: 3107163 - RNA, 18 nt, Molluscum contagiosum virus
ugcacaccggcgcgcuga

SEQ ID NO: 3107164 - RNA, 20 nt, Molluscum contagiosum virus
ugcacgacguacgagugcug

SEQ ID NO: 3107165 - RNA, 15 nt, Molluscum contagiosum virus
ugcacgcacgcgcgg

SEQ ID NO: 3107166 - RNA, 19 nt, Molluscum contagiosum virus
ugcacgcacgcgcgggcau

SEQ ID NO: 3107167 - RNA, 14 nt, Molluscum contagiosum virus
ugcacagcguagcg

SEQ ID NO: 3107168 - RNA, 18 nt, Molluscum contagiosum virus
ugcacaguucacggcgcu

SEQ ID NO: 3107169 - RNA, 20 nt, Molluscum contagiosum virus
ugcaccagcaccggcgugug

SEQ ID NO: 3107170 - RNA, 13 nt, Molluscum contagiosum virus
ugcacgcgcacgc

SEQ ID NO: 3107171 - RNA, 16 nt, Molluscum contagiosum virus
ugcacgcggcgcgugu

SEQ ID NO: 3107172 - RNA, 14 nt, Molluscum contagiosum virus
ugcacgcgggcgcc

SEQ ID NO: 3107173 - RNA, 22 nt, Molluscum contagiosum virus
ugcacggcuaccgcgacggcgu

SEQ ID NO: 3107174 - RNA, 15 nt, Molluscum contagiosum virus
ugcacguccugcgag

SEQ ID NO: 3107175 - RNA, 15 nt, Molluscum contagiosum virus
ugcacgucgacaagu

SEQ ID NO: 3107176 - RNA, 22 nt, Molluscum contagiosum virus
ugcacuacaaccauggcgcgcu

SEQ ID NO: 3107177 - RNA, 13 nt, Molluscum contagiosum virus
ugcacucgcgcuc

SEQ ID NO: 3107178 - RNA, 12 nt, Molluscum contagiosum virus
ugcacugcgcgg

SEQ ID NO: 3107179 - RNA, 18 nt, Molluscum contagiosum virus
ugcacugcgcggcgugcg

SEQ ID NO: 3107180 - RNA, 17 nt, Molluscum contagiosum virus
ugcagaaacagccgugc

SEQ ID NO: 3107181 - RNA, 15 nt, Molluscum contagiosum virus
ugcagaacagcacgu

SEQ ID NO: 3107182 - RNA, 14 nt, Molluscum contagiosum virus
ugcagaaccugcgg

SEQ ID NO: 3107183 - RNA, 12 nt, Molluscum contagiosum virus
ugcagcgcccgg

SEQ ID NO: 3107184 - RNA, 14 nt, Molluscum contagiosum virus
ugcagcgccgcgcg

SEQ ID NO: 3107185 - RNA, 15 nt, Molluscum contagiosum virus
ugcagcgccgcgcgg

SEQ ID NO: 3107186 - RNA, 12 nt, Molluscum contagiosum virus
ugcagcgcgugc

SEQ ID NO: 3107187 - RNA, 16 nt, Molluscum contagiosum virus
ugcagcggcgccacga

SEQ ID NO: 3107188 - RNA, 14 nt, Molluscum contagiosum virus
ugcagagcgugcug

SEQ ID NO: 3107189 - RNA, 18 nt, Molluscum contagiosum virus
ugcagcacgucuugcgcg

SEQ ID NO: 3107190 - RNA, 23 nt, Molluscum contagiosum virus
ugcagcccgacgcgggcgcgcac

SEQ ID NO: 3107191 - RNA, 16 nt, Molluscum contagiosum virus
ugcagccgcugcugcu

SEQ ID NO: 3107192 - RNA, 16 nt, Molluscum contagiosum virus
ugccguucacgcacac

SEQ ID NO: 3107193 - RNA, 16 nt, Molluscum contagiosum virus
ugccuaugccgaggug

SEQ ID NO: 3107194 - RNA, 14 nt, Molluscum contagiosum virus
ugccgucgcccgug

SEQ ID NO: 3107195 - RNA, 12 nt, Molluscum contagiosum virus
ugcagcugcgcg

SEQ ID NO: 3107196 - RNA, 20 nt, Molluscum contagiosum virus
ugcacccgcgcagcgugccg

SEQ ID NO: 3107197 - RNA, 17 nt, Molluscum contagiosum virus
ugcgagaacucgcgugc

SEQ ID NO: 3107198 - RNA, 20 nt, Molluscum contagiosum virus
ugcgagcacuguacgcacgc

SEQ ID NO: 3107199 - RNA, 14 nt, Molluscum contagiosum virus
ugcgagcagcccgc

SEQ ID NO: 3107200 - RNA, 17 nt, Molluscum contagiosum virus
ugcgagcggcgcgcgcu

SEQ ID NO: 3107201 - RNA, 19 nt, Molluscum contagiosum virus
ugcgagcggcgcgcgcuga

SEQ ID NO: 3107202 - RNA, 16 nt, Molluscum contagiosum virus
ugcgaggccugcgugg

SEQ ID NO: 3107203 - RNA, 14 nt, Molluscum contagiosum virus
ugcgaggcgcgcac

SEQ ID NO: 3107204 - RNA, 16 nt, Molluscum contagiosum virus
ugcgaggcgcgcacgc

SEQ ID NO: 3107205 - RNA, 15 nt, Molluscum contagiosum virus
ugcgaguggcgcgca

SEQ ID NO: 3107206 - RNA, 21 nt, Molluscum contagiosum virus
ugcgcaaagcaacugcggacu

SEQ ID NO: 3107207 - RNA, 22 nt, Molluscum contagiosum virus
ugcgcaacgucuuccgcgcgcu

SEQ ID NO: 3107208 - RNA, 14 nt, Molluscum contagiosum virus
ugcgcaacgugcug

SEQ ID NO: 3107209 - RNA, 17 nt, Molluscum contagiosum virus
ugcgcaacgugcugcgc

SEQ ID NO: 3107210 - RNA, 20 nt, Molluscum contagiosum virus
ugcgcaacgugcugcgccgc

SEQ ID NO: 3107211 - RNA, 18 nt, Molluscum contagiosum virus
ugcgcaauaaggcggugg

SEQ ID NO: 3107212 - RNA, 13 nt, Molluscum contagiosum virus
ugcgccucggacu

SEQ ID NO: 3107213 - RNA, 14 nt, Molluscum contagiosum virus
ugcgccugccggcg

SEQ ID NO: 3107214 - RNA, 16 nt, Molluscum contagiosum virus
ugcgcaccgcgggcug

SEQ ID NO: 3107215 - RNA, 16 nt, Molluscum contagiosum virus
ugcgcgacgaggaggc

SEQ ID NO: 3107216 - RNA, 20 nt, Molluscum contagiosum virus
ugcgcgacuccaucugcgcg

SEQ ID NO: 3107217 - RNA, 17 nt, Molluscum contagiosum virus
ugcgcgagccgcugcac

SEQ ID NO: 3107218 - RNA, 19 nt, Molluscum contagiosum virus
ugcgcgagccgcugcacgc

SEQ ID NO: 3107219 - RNA, 20 nt, Molluscum contagiosum virus
ugcgcgagcgcgcgcugcgc

SEQ ID NO: 3107220 - RNA, 13 nt, Molluscum contagiosum virus
ugcgcgagucgcg

SEQ ID NO: 3107221 - RNA, 19 nt, Molluscum contagiosum virus
ugcgccuucugccugcccg

SEQ ID NO: 3107222 - RNA, 13 nt, Molluscum contagiosum virus
ugcgcccgcaaac

SEQ ID NO: 3107223 - RNA, 19 nt, Molluscum contagiosum virus
ugcgcccgugcgaggagca

SEQ ID NO: 3107224 - RNA, 16 nt, Molluscum contagiosum virus
ugcgcacgcgcgucau

SEQ ID NO: 3107225 - RNA, 14 nt, Molluscum contagiosum virus
ugcgcacgugcgcg

SEQ ID NO: 3107226 - RNA, 15 nt, Molluscum contagiosum virus
ugcgcacgugcgcgc

SEQ ID NO: 3107227 - RNA, 23 nt, Molluscum contagiosum virus
ugcgcagagcuccccgcgcgcag

SEQ ID NO: 3107228 - RNA, 23 nt, Molluscum contagiosum virus
ugcgcagcauucccggcgcgcgc

SEQ ID NO: 3107229 - RNA, 15 nt, Molluscum contagiosum virus
ugcgcaggaccgcga

SEQ ID NO: 3107230 - RNA, 18 nt, Molluscum contagiosum virus
ugcgcaucccugcgcacc

SEQ ID NO: 3107231 - RNA, 15 nt, Molluscum contagiosum virus
ugcgcauggccacgc

SEQ ID NO: 3107232 - RNA, 16 nt, Molluscum contagiosum virus
ugccuuggcgcccgug

SEQ ID NO: 3107233 - RNA, 23 nt, Molluscum contagiosum virus
ugcgaacgcgcaagugugcgcau

SEQ ID NO: 3107234 - RNA, 19 nt, Molluscum contagiosum virus
ugcgaagacgagcgcgugc

SEQ ID NO: 3107235 - RNA, 13 nt, Molluscum contagiosum virus
ugcgaaggucauc

SEQ ID NO: 3107236 - RNA, 14 nt, Molluscum contagiosum virus
ugcgacagcugcug

SEQ ID NO: 3107237 - RNA, 19 nt, Molluscum contagiosum virus
ugccugcaagaggcgcugu

SEQ ID NO: 3107238 - RNA, 16 nt, Molluscum contagiosum virus
ugccugcaaggagguc

SEQ ID NO: 3107239 - RNA, 17 nt, Molluscum contagiosum virus
gaagcaggcgccaucgc

SEQ ID NO: 3107240 - RNA, 23 nt, Molluscum contagiosum virus
gaagcaggcgccaucgcgcguga

SEQ ID NO: 3107241 - RNA, 14 nt, Molluscum contagiosum virus
gaagcagugcucgg

SEQ ID NO: 3107242 - RNA, 18 nt, Molluscum contagiosum virus
gaagcagugcucgggaga

SEQ ID NO: 3107243 - RNA, 14 nt, Molluscum contagiosum virus
gaagcacguagcuc

SEQ ID NO: 3107244 - RNA, 16 nt, Molluscum contagiosum virus
gaagcacguagcucgc

SEQ ID NO: 3107245 - RNA, 17 nt, Molluscum contagiosum virus
gaagaugcugcgcgugg

SEQ ID NO: 3107246 - RNA, 23 nt, Molluscum contagiosum virus
gaagagacgccaagcgucgcgac

SEQ ID NO: 3107247 - RNA, 19 nt, Molluscum contagiosum virus
gaagaggccagcacaagcc

SEQ ID NO: 3107248 - RNA, 19 nt, Molluscum contagiosum virus
gaagaggccggcacaagcc

SEQ ID NO: 3107249 - RNA, 12 nt, Molluscum contagiosum virus
gaagagucgcgc

SEQ ID NO: 3107250 - RNA, 20 nt, Molluscum contagiosum virus
gacagcacaaacacgcgcgc

SEQ ID NO: 3107251 - RNA, 16 nt, Molluscum contagiosum virus
gacagcgacgagaucu

SEQ ID NO: 3107252 - RNA, 13 nt, Molluscum contagiosum virus
gacagcgcgcgca

SEQ ID NO: 3107253 - RNA, 16 nt, Molluscum contagiosum virus
gacagcgcgcgcacgc

SEQ ID NO: 3107254 - RNA, 13 nt, Molluscum contagiosum virus
gacagcgugcgcg

SEQ ID NO: 3107255 - RNA, 20 nt, Molluscum contagiosum virus
gacagcgugcgcgggcacgc

SEQ ID NO: 3107256 - RNA, 16 nt, Molluscum contagiosum virus
gaagcucucgcgcgca

SEQ ID NO: 3107257 - RNA, 16 nt, Molluscum contagiosum virus
gaagcugcacgugcag

SEQ ID NO: 3107258 - RNA, 15 nt, Molluscum contagiosum virus
gaagcccgucggggc

SEQ ID NO: 3107259 - RNA, 22 nt, Molluscum contagiosum virus
gaagccuucuucgugcugugcc

SEQ ID NO: 3107260 - RNA, 17 nt, Molluscum contagiosum virus
gaagcgaaaggacgcgc

SEQ ID NO: 3107261 - RNA, 12 nt, Molluscum contagiosum virus
gaagcgcgcccc

SEQ ID NO: 3107262 - RNA, 15 nt, Molluscum contagiosum virus
gaagacggcgcgcgc

SEQ ID NO: 3107263 - RNA, 16 nt, Molluscum contagiosum virus
gaagacggcgcgcgcg

SEQ ID NO: 3107264 - RNA, 16 nt, Molluscum contagiosum virus
gaagacgucggggcgc

SEQ ID NO: 3107265 - RNA, 12 nt, Molluscum contagiosum virus
gaagacgugcuu

SEQ ID NO: 3107266 - RNA, 20 nt, Molluscum contagiosum virus
gaagacguuuacguccacgc

SEQ ID NO: 3107267 - RNA, 21 nt, Molluscum contagiosum virus
gaagacguuuacguccacgcg

SEQ ID NO: 3107268 - RNA, 18 nt, Molluscum contagiosum virus
gaagacuugccgucucgc

SEQ ID NO: 3107269 - RNA, 14 nt, Molluscum contagiosum virus
gaagaacgcggcgu

SEQ ID NO: 3107270 - RNA, 23 nt, Molluscum contagiosum virus
gaagaagaaaagacgagcugugc

SEQ ID NO: 3107271 - RNA, 14 nt, Molluscum contagiosum virus
gaagaaggagccca

SEQ ID NO: 3107272 - RNA, 14 nt, Molluscum contagiosum virus
gaagaaggagcccu

SEQ ID NO: 3107273 - RNA, 20 nt, Molluscum contagiosum virus
gaagacgagcgcgugccgcu

SEQ ID NO: 3107274 - RNA, 22 nt, Molluscum contagiosum virus
gaagacgcguaccagcgccugc

SEQ ID NO: 3107275 - RNA, 18 nt, Molluscum contagiosum virus
gaacgcgcaagugugcgc

SEQ ID NO: 3107276 - RNA, 12 nt, Molluscum contagiosum virus
gaacgcgccgcg

SEQ ID NO: 3107277 - RNA, 11 nt, Molluscum contagiosum virus
gaacgcgcgcu

SEQ ID NO: 3107278 - RNA, 14 nt, Molluscum contagiosum virus
gaacgcgcgcucgu

SEQ ID NO: 3107279 - RNA, 23 nt, Molluscum contagiosum virus
gaacgcgcugcgccacugccacg

SEQ ID NO: 3107280 - RNA, 23 nt, Molluscum contagiosum virus
gaacgcguccacggcgcgcaccu

SEQ ID NO: 3107281 - RNA, 18 nt, Molluscum contagiosum virus
gaacgugacgcgccucga

SEQ ID NO: 3107282 - RNA, 17 nt, Molluscum contagiosum virus
gaacguggucaagaucc

SEQ ID NO: 3107283 - RNA, 14 nt, Molluscum contagiosum virus
gaacuagugcugcu

SEQ ID NO: 3107284 - RNA, 12 nt, Molluscum contagiosum virus
gaacuccaggcg

SEQ ID NO: 3107285 - RNA, 16 nt, Molluscum contagiosum virus
gaacucgagcacguag

SEQ ID NO: 3107286 - RNA, 17 nt, Molluscum contagiosum virus
gaacucgugcgccgcgc

SEQ ID NO: 3107287 - RNA, 22 nt, Molluscum contagiosum virus
gaacucuacacguggaauugcg

SEQ ID NO: 3107288 - RNA, 15 nt, Molluscum contagiosum virus
gaacucuacgccgcg

SEQ ID NO: 3107289 - RNA, 20 nt, Molluscum contagiosum virus
gaacucuacgccgcgcaccu

SEQ ID NO: 3107290 - RNA, 16 nt, Molluscum contagiosum virus
gaacugcccgcgucgc

SEQ ID NO: 3107291 - RNA, 23 nt, Molluscum contagiosum virus
gaacugcugggcguggcgcaccu

SEQ ID NO: 3107292 - RNA, 19 nt, Molluscum contagiosum virus
gaacuggacgccguugcgc

SEQ ID NO: 3107293 - RNA, 20 nt, Molluscum contagiosum virus
gacccagaagcgagagcgcg

SEQ ID NO: 3107294 - RNA, 18 nt, Molluscum contagiosum virus
gacggcgacgacagcgac

SEQ ID NO: 3107295 - RNA, 18 nt, Molluscum contagiosum virus
gacggcgccucgagcgcg

SEQ ID NO: 3107296 - RNA, 15 nt, Molluscum contagiosum virus
gacggcgcgcagcgc

SEQ ID NO: 3107297 - RNA, 12 nt, Molluscum contagiosum virus
gacggcgcgcgc

SEQ ID NO: 3107298 - RNA, 14 nt, Molluscum contagiosum virus
gacggcgcgggcgc

SEQ ID NO: 3107299 - RNA, 14 nt, Molluscum contagiosum virus
gacggcgcugcgcg

SEQ ID NO: 3107300 - RNA, 14 nt, Molluscum contagiosum virus
gacggcgugcgccg

SEQ ID NO: 3107301 - RNA, 15 nt, Molluscum contagiosum virus
gacggcgugcgccgc

SEQ ID NO: 3107302 - RNA, 21 nt, Molluscum contagiosum virus
gaccgcaagugcacgcggcgc

SEQ ID NO: 3107303 - RNA, 16 nt, Molluscum contagiosum virus
gaccagauccgggcgc

SEQ ID NO: 3107304 - RNA, 13 nt, Molluscum contagiosum virus
gaccaccagcacc

SEQ ID NO: 3107305 - RNA, 14 nt, Molluscum contagiosum virus
gaccaccagcacca

SEQ ID NO: 3107306 - RNA, 13 nt, Molluscum contagiosum virus
gaccacgcgcgcu

SEQ ID NO: 3107307 - RNA, 14 nt, Molluscum contagiosum virus
gacaucaucgcgga

SEQ ID NO: 3107308 - RNA, 22 nt, Molluscum contagiosum virus
gacaucaucgcggagcugcgcg

SEQ ID NO: 3107309 - RNA, 16 nt, Molluscum contagiosum virus
gacaugcacacgcacc

SEQ ID NO: 3107310 - RNA, 12 nt, Molluscum contagiosum virus
gacaugccucgc

SEQ ID NO: 3107311 - RNA, 13 nt, Molluscum contagiosum virus
gacaugcgcacgc

SEQ ID NO: 3107312 - RNA, 22 nt, Molluscum contagiosum virus
gacauggaccgcgucaagauca

SEQ ID NO: 3107313 - RNA, 23 nt, Molluscum contagiosum virus
gacagggugccuacucgcgacgc

SEQ ID NO: 3107314 - RNA, 17 nt, Molluscum contagiosum virus
gacagugccuccgcgga

SEQ ID NO: 3107315 - RNA, 16 nt, Molluscum contagiosum virus
gacaucacgcguucgc

SEQ ID NO: 3107316 - RNA, 16 nt, Molluscum contagiosum virus
cugcugcucgcggagg

SEQ ID NO: 3107317 - RNA, 22 nt, Molluscum contagiosum virus
cugcugcugcaaagcgcggccg

SEQ ID NO: 3107318 - RNA, 18 nt, Molluscum contagiosum virus
cugcuggcaccgcgcgcg

SEQ ID NO: 3107319 - RNA, 14 nt, Molluscum contagiosum virus
cugcuggcagacac

SEQ ID NO: 3107320 - RNA, 15 nt, Molluscum contagiosum virus
cugcuggcgcgcgcg

SEQ ID NO: 3107321 - RNA, 17 nt, Molluscum contagiosum virus
cugcuucacgcugcucg

SEQ ID NO: 3107322 - RNA, 21 nt, Molluscum contagiosum virus
cugaucaccgaggagccgcgc

SEQ ID NO: 3107323 - RNA, 19 nt, Molluscum contagiosum virus
cuggacgggcacgagcacg

SEQ ID NO: 3107324 - RNA, 20 nt, Molluscum contagiosum virus
cuggacgggcacgagcacgu

SEQ ID NO: 3107325 - RNA, 17 nt, Molluscum contagiosum virus
cuggaagaacaggccgc

SEQ ID NO: 3107326 - RNA, 18 nt, Molluscum contagiosum virus
cugcagaaacagccgugc

SEQ ID NO: 3107327 - RNA, 18 nt, Molluscum contagiosum virus
cugcacgugcagcggcgc

SEQ ID NO: 3107328 - RNA, 15 nt, Molluscum contagiosum virus
cugcacuacugcucc

SEQ ID NO: 3107329 - RNA, 20 nt, Molluscum contagiosum virus
cugcacgcgaauguccggcg

SEQ ID NO: 3107330 - RNA, 16 nt, Molluscum contagiosum virus
cugcacgcuacggcug

SEQ ID NO: 3107331 - RNA, 17 nt, Molluscum contagiosum virus
cugcacgagcugcugua

SEQ ID NO: 3107332 - RNA, 22 nt, Molluscum contagiosum virus
cugcagcagccccgacgccagc

SEQ ID NO: 3107333 - RNA, 16 nt, Molluscum contagiosum virus
cugcagcagcuccagc

SEQ ID NO: 3107334 - RNA, 16 nt, Molluscum contagiosum virus
cugcagcagcuccucc

SEQ ID NO: 3107335 - RNA, 14 nt, Molluscum contagiosum virus
cugcagcagcuggc

SEQ ID NO: 3107336 - RNA, 21 nt, Molluscum contagiosum virus
cugcagcccgacgcgggcgcg

SEQ ID NO: 3107337 - RNA, 16 nt, Molluscum contagiosum virus
cugcagcugcgcgagc

SEQ ID NO: 3107338 - RNA, 23 nt, Molluscum contagiosum virus
cugcagcugcgcgagccgcugca

SEQ ID NO: 3107339 - RNA, 13 nt, Molluscum contagiosum virus
cugcaggaccugc

SEQ ID NO: 3107340 - RNA, 11 nt, Molluscum contagiosum virus
cuggccaacac

SEQ ID NO: 3107341 - RNA, 19 nt, Molluscum contagiosum virus
cuggacgccguugcgcgug

SEQ ID NO: 3107342 - RNA, 14 nt, Molluscum contagiosum virus
cuggcccugcuagu

SEQ ID NO: 3107343 - RNA, 16 nt, Molluscum contagiosum virus
cuggcccugcuugacg

SEQ ID NO: 3107344 - RNA, 14 nt, Molluscum contagiosum virus
cuggccgagcguga

SEQ ID NO: 3107345 - RNA, 18 nt, Molluscum contagiosum virus
cuggccgugcccgccgac

SEQ ID NO: 3107346 - RNA, 21 nt, Molluscum contagiosum virus
cuggcgaaaccugggcgccgc

SEQ ID NO: 3107347 - RNA, 13 nt, Molluscum contagiosum virus
cuggcgagcacgu

SEQ ID NO: 3107348 - RNA, 17 nt, Molluscum contagiosum virus
cuggcaccgcgcgcgcu

SEQ ID NO: 3107349 - RNA, 17 nt, Molluscum contagiosum virus
cuggcaccgggcgccgc

SEQ ID NO: 3107350 - RNA, 14 nt, Molluscum contagiosum virus
cuggcacgcgccgc

SEQ ID NO: 3107351 - RNA, 21 nt, Molluscum contagiosum virus
cuggcacuggcgcgcacgcgc

SEQ ID NO: 3107352 - RNA, 18 nt, Molluscum contagiosum virus
cuggcagugccgggcgcc

SEQ ID NO: 3107353 - RNA, 21 nt, Molluscum contagiosum virus
cuggcagugccgggcgccggc

SEQ ID NO: 3107354 - RNA, 22 nt, Molluscum contagiosum virus
cuggcagugccgggcgccggcu

SEQ ID NO: 3107355 - RNA, 22 nt, Molluscum contagiosum virus
cuggagcaagcgcguucgcgcg

SEQ ID NO: 3107356 - RNA, 20 nt, Molluscum contagiosum virus
cuggagcgagugcgcgugcg

SEQ ID NO: 3107357 - RNA, 19 nt, Molluscum contagiosum virus
cuggagcugccgcugcgcg

SEQ ID NO: 3107358 - RNA, 17 nt, Molluscum contagiosum virus
cuggagggcacgcugca

SEQ ID NO: 3107359 - RNA, 17 nt, Molluscum contagiosum virus
cuggagggucacgcgca

SEQ ID NO: 3107360 - RNA, 17 nt, Molluscum contagiosum virus
cuggagguucguccgcu

SEQ ID NO: 3107361 - RNA, 18 nt, Molluscum contagiosum virus
cuggaguuuaaugacgcg

SEQ ID NO: 3107362 - RNA, 14 nt, Molluscum contagiosum virus
cuugccccucgucc

SEQ ID NO: 3107363 - RNA, 23 nt, Molluscum contagiosum virus
cuuggcggcgcggcuagcaccgc

SEQ ID NO: 3107364 - RNA, 18 nt, Molluscum contagiosum virus
cuugggagcaaggccugg

SEQ ID NO: 3107365 - RNA, 20 nt, Molluscum contagiosum virus
cuugggcacugcuacgagcc

SEQ ID NO: 3107366 - RNA, 16 nt, Molluscum contagiosum virus
cuuggggaagacgucg

SEQ ID NO: 3107367 - RNA, 20 nt, Molluscum contagiosum virus
cuugguguucugcgcgccgc

SEQ ID NO: 3107368 - RNA, 13 nt, Molluscum contagiosum virus
cuuguccgcggac

SEQ ID NO: 3107369 - RNA, 19 nt, Molluscum contagiosum virus
cuugcgcgcggugcgggcg

SEQ ID NO: 3107370 - RNA, 16 nt, Molluscum contagiosum virus
cuuugcgaacgcgcaa

SEQ ID NO: 3107371 - RNA, 21 nt, Molluscum contagiosum virus
cuuugcggcacgggcucgagc

SEQ ID NO: 3107372 - RNA, 19 nt, Molluscum contagiosum virus
cuuucucacgcccgcgcug

SEQ ID NO: 3107373 - RNA, 15 nt, Molluscum contagiosum virus
cuuucucacgcgcua

SEQ ID NO: 3107374 - RNA, 20 nt, Molluscum contagiosum virus
cuuucaggggucugucguuu

SEQ ID NO: 3107375 - RNA, 16 nt, Molluscum contagiosum virus
cuuuacgggcgccagc

SEQ ID NO: 3107376 - RNA, 19 nt, Molluscum contagiosum virus
cuugcucacgcugcgcucg

SEQ ID NO: 3107377 - RNA, 18 nt, Molluscum contagiosum virus
cuugcucggacacacgca

SEQ ID NO: 3107378 - RNA, 12 nt, Molluscum contagiosum virus
cuugcuggcacg

SEQ ID NO: 3107379 - RNA, 18 nt, Molluscum contagiosum virus
cuugcuggcgcgcggaga

SEQ ID NO: 3107380 - RNA, 15 nt, Molluscum contagiosum virus
cuuggaagagucgcg

SEQ ID NO: 3107381 - RNA, 21 nt, Molluscum contagiosum virus
cuuggacagcaagcagcgcgc

SEQ ID NO: 3107382 - RNA, 15 nt, Molluscum contagiosum virus
cuuggcaugcgugcu

SEQ ID NO: 3107383 - RNA, 20 nt, Molluscum contagiosum virus
cuuggccaagcuuugcacgc

SEQ ID NO: 3107384 - RNA, 21 nt, Molluscum contagiosum virus
cuuggcgcccgugccgccggc

SEQ ID NO: 3107385 - RNA, 13 nt, Molluscum contagiosum virus
cuuggcgcgccgc

SEQ ID NO: 3107386 - RNA, 20 nt, Molluscum contagiosum virus
cuuggcgcgccgcugcccgc

SEQ ID NO: 3107387 - RNA, 14 nt, Molluscum contagiosum virus
cuugacaggcgcgc

SEQ ID NO: 3107388 - RNA, 14 nt, Molluscum contagiosum virus
cuugagcgcgccgc

SEQ ID NO: 3107389 - RNA, 16 nt, Molluscum contagiosum virus
cuucgucaagcagcgc

SEQ ID NO: 3107390 - RNA, 13 nt, Molluscum contagiosum virus
cuucucgucgaga

SEQ ID NO: 3107391 - RNA, 19 nt, Molluscum contagiosum virus
cuucucugcgaucgcgggc

SEQ ID NO: 3107392 - RNA, 16 nt, Molluscum contagiosum virus
cuggcggcgcacgcga

SEQ ID NO: 3107393 - RNA, 20 nt, Molluscum contagiosum virus
cuggcgauguccaugucgcg

SEQ ID NO: 3107394 - RNA, 16 nt, Molluscum contagiosum virus
cuggcgcgcgccgagc

SEQ ID NO: 3107395 - RNA, 21 nt, Molluscum contagiosum virus
cuggcgcgcggagagcagugc

SEQ ID NO: 3107396 - RNA, 15 nt, Molluscum contagiosum virus
cuucgugcgcggaga

SEQ ID NO: 3107397 - RNA, 14 nt, Molluscum contagiosum virus
cuucguggacgagc

SEQ ID NO: 3107398 - RNA, 15 nt, Molluscum contagiosum virus
cuucguggagcccgu

SEQ ID NO: 3107399 - RNA, 23 nt, Molluscum contagiosum virus
cuucguggcgcugggcgcgccgc

SEQ ID NO: 3107400 - RNA, 14 nt, Molluscum contagiosum virus
cuggcgggcgcggu

SEQ ID NO: 3107401 - RNA, 22 nt, Molluscum contagiosum virus
cuggcucagaacgacaccgcga

SEQ ID NO: 3107402 - RNA, 22 nt, Molluscum contagiosum virus
cuggcuccugugucgcgcgagc

SEQ ID NO: 3107403 - RNA, 14 nt, Molluscum contagiosum virus
cgggccuguccgcg

SEQ ID NO: 3107404 - RNA, 17 nt, Molluscum contagiosum virus
cgggccuguccgcgggc

SEQ ID NO: 3107405 - RNA, 23 nt, Molluscum contagiosum virus
cgggccuguccgcgggcgcacgc

SEQ ID NO: 3107406 - RNA, 13 nt, Molluscum contagiosum virus
cgggcgcgccaac

SEQ ID NO: 3107407 - RNA, 21 nt, Molluscum contagiosum virus
cgggcgcgccaacgacuagcg

SEQ ID NO: 3107408 - RNA, 13 nt, Molluscum contagiosum virus
cgggcgcgcgcca

SEQ ID NO: 3107409 - RNA, 14 nt, Molluscum contagiosum virus
cgggcgcgcgccag

SEQ ID NO: 3107410 - RNA, 15 nt, Molluscum contagiosum virus
cgggcgcgcgccagc

SEQ ID NO: 3107411 - RNA, 15 nt, Molluscum contagiosum virus
cgggcgcgcgcggag

SEQ ID NO: 3107412 - RNA, 14 nt, Molluscum contagiosum virus
cgggcgcgcguacg

SEQ ID NO: 3107413 - RNA, 16 nt, Molluscum contagiosum virus
cgggcgaaagcgccgc

SEQ ID NO: 3107414 - RNA, 18 nt, Molluscum contagiosum virus
cgggcgaaagcgccgcgc

SEQ ID NO: 3107415 - RNA, 22 nt, Molluscum contagiosum virus
cgggcgagagacagcacggcac

SEQ ID NO: 3107416 - RNA, 13 nt, Molluscum contagiosum virus
cggacucgcgagc

SEQ ID NO: 3107417 - RNA, 14 nt, Molluscum contagiosum virus
cggacucgcgagca

SEQ ID NO: 3107418 - RNA, 14 nt, Molluscum contagiosum virus
cgggggcgcuuccc

SEQ ID NO: 3107419 - RNA, 23 nt, Molluscum contagiosum virus
cggggcccaugcucaccgccgag

SEQ ID NO: 3107420 - RNA, 19 nt, Molluscum contagiosum virus
cggggcccucggcgcgccg

SEQ ID NO: 3107421 - RNA, 21 nt, Molluscum contagiosum virus
cggggcccucggcgcgccguc

SEQ ID NO: 3107422 - RNA, 17 nt, Molluscum contagiosum virus
cgguaacgcgcgcgccu

SEQ ID NO: 3107423 - RNA, 13 nt, Molluscum contagiosum virus
cgguaagcgcccc

SEQ ID NO: 3107424 - RNA, 20 nt, Molluscum contagiosum virus
cggguaccgugcgcgugagc

SEQ ID NO: 3107425 - RNA, 11 nt, Molluscum contagiosum virus
cgguacugcug

SEQ ID NO: 3107426 - RNA, 13 nt, Molluscum contagiosum virus
cgguacugcugca

SEQ ID NO: 3107427 - RNA, 15 nt, Molluscum contagiosum virus
cgguacaugcugucc

SEQ ID NO: 3107428 - RNA, 21 nt, Molluscum contagiosum virus
cgggcucgaucugcgccuccg

SEQ ID NO: 3107429 - RNA, 13 nt, Molluscum contagiosum virus
cgggcucgggcag

SEQ ID NO: 3107430 - RNA, 17 nt, Molluscum contagiosum virus
cgggcucgugcuggagc

SEQ ID NO: 3107431 - RNA, 19 nt, Molluscum contagiosum virus
cgggcucuuccaccggcag

SEQ ID NO: 3107432 - RNA, 21 nt, Molluscum contagiosum virus
cgggcugcacgacggucacgc

SEQ ID NO: 3107433 - RNA, 14 nt, Molluscum contagiosum virus
cgggcugcgcggcg

SEQ ID NO: 3107434 - RNA, 18 nt, Molluscum contagiosum virus
cgggcugucgcccggcag

SEQ ID NO: 3107435 - RNA, 14 nt, Molluscum contagiosum virus
cgggcuucgccgcc

SEQ ID NO: 3107436 - RNA, 21 nt, Molluscum contagiosum virus
cgggcuucgcgacgacgagca

SEQ ID NO: 3107437 - RNA, 23 nt, Molluscum contagiosum virus
cgggcuugcucccucgcgcgcag

SEQ ID NO: 3107438 - RNA, 24 nt, Molluscum contagiosum virus
cgggcuugcucccucgcgcgcagc

SEQ ID NO: 3107439 - RNA, 15 nt, Molluscum contagiosum virus
cgggcgugcgcagca

SEQ ID NO: 3107440 - RNA, 20 nt, Molluscum contagiosum virus
cgggcguguccgcgggcgcg

SEQ ID NO: 3107441 - RNA, 14 nt, Molluscum contagiosum virus
cgggcgcggcgucg

SEQ ID NO: 3107442 - RNA, 22 nt, Molluscum contagiosum virus
cgggcgucaagacucgcccgcg

SEQ ID NO: 3107443 - RNA, 14 nt, Molluscum contagiosum virus
cgggcggcgcgccg

SEQ ID NO: 3107444 - RNA, 15 nt, Molluscum contagiosum virus
cgggcggcgcgccgc

SEQ ID NO: 3107445 - RNA, 19 nt, Molluscum contagiosum virus
cgggcgcuauugcgcggcg

SEQ ID NO: 3107446 - RNA, 18 nt, Molluscum contagiosum virus
cgggcgcuccgagcggcu

SEQ ID NO: 3107447 - RNA, 13 nt, Molluscum contagiosum virus
cgggcgcugcacc

SEQ ID NO: 3107448 - RNA, 15 nt, Molluscum contagiosum virus
cgggcgcugcaccgc

SEQ ID NO: 3107449 - RNA, 19 nt, Molluscum contagiosum virus
cgggcgcagacgccgagcg

SEQ ID NO: 3107450 - RNA, 18 nt, Molluscum contagiosum virus
cgggcgccaacacgagcg

SEQ ID NO: 3107451 - RNA, 14 nt, Molluscum contagiosum virus
cgggcgccgcggcu

SEQ ID NO: 3107452 - RNA, 14 nt, Molluscum contagiosum virus
cgggcgccggcguc

SEQ ID NO: 3107453 - RNA, 19 nt, Molluscum contagiosum virus
cggucgacgacgcgcgcac

SEQ ID NO: 3107454 - RNA, 13 nt, Molluscum contagiosum virus
cggucgacgagug

SEQ ID NO: 3107455 - RNA, 23 nt, Molluscum contagiosum virus
cggucgacgagugcgccgcgccc

SEQ ID NO: 3107456 - RNA, 15 nt, Molluscum contagiosum virus
cggucgcccgccgag

SEQ ID NO: 3107457 - RNA, 18 nt, Molluscum contagiosum virus
cggucgcccuccgccgua

SEQ ID NO: 3107458 - RNA, 13 nt, Molluscum contagiosum virus
cggugagcgccgu

SEQ ID NO: 3107459 - RNA, 17 nt, Molluscum contagiosum virus
cggugcagccgcugcug

SEQ ID NO: 3107460 - RNA, 16 nt, Molluscum contagiosum virus
cggugcagcuacugcg

SEQ ID NO: 3107461 - RNA, 14 nt, Molluscum contagiosum virus
cggugcagcugccg

SEQ ID NO: 3107462 - RNA, 18 nt, Molluscum contagiosum virus
cggugcagcugccgcaga

SEQ ID NO: 3107463 - RNA, 23 nt, Molluscum contagiosum virus
cggugcccgccaagagcuggucg

SEQ ID NO: 3107464 - RNA, 17 nt, Molluscum contagiosum virus
cggugccggccgccggc

SEQ ID NO: 3107465 - RNA, 18 nt, Molluscum contagiosum virus
cggugcgggucucggggc

SEQ ID NO: 3107466 - RNA, 16 nt, Molluscum contagiosum virus
cggugagugcgcgcac

SEQ ID NO: 3107467 - RNA, 23 nt, Molluscum contagiosum virus
cgucagccucugugcggcgccgu

SEQ ID NO: 3107468 - RNA, 15 nt, Molluscum contagiosum virus
cgucacggccggcgc

SEQ ID NO: 3107469 - RNA, 14 nt, Molluscum contagiosum virus
cgucacggccuucg

SEQ ID NO: 3107470 - RNA, 14 nt, Molluscum contagiosum virus
cgucacguacucgc

SEQ ID NO: 3107471 - RNA, 15 nt, Molluscum contagiosum virus
cguccgcgcagcucg

SEQ ID NO: 3107472 - RNA, 18 nt, Molluscum contagiosum virus
cguccgcggggcuccucg

SEQ ID NO: 3107473 - RNA, 13 nt, Molluscum contagiosum virus
cguccggcgcucg

SEQ ID NO: 3107474 - RNA, 13 nt, Molluscum contagiosum virus
cgucaugugcgug

SEQ ID NO: 3107475 - RNA, 15 nt, Molluscum contagiosum virus
cguccacaggcgcga

SEQ ID NO: 3107476 - RNA, 15 nt, Molluscum contagiosum virus
cguccacgacgagcc

SEQ ID NO: 3107477 - RNA, 12 nt, Molluscum contagiosum virus
cguccacgcgcc

SEQ ID NO: 3107478 - RNA, 17 nt, Molluscum contagiosum virus
cguccagcugcgcgagc

SEQ ID NO: 3107479 - RNA, 18 nt, Molluscum contagiosum virus
cguccaugugcccgcggc

SEQ ID NO: 3107480 - RNA, 20 nt, Molluscum contagiosum virus
cguccaugugcccgcggcgc

SEQ ID NO: 3107481 - RNA, 19 nt, Molluscum contagiosum virus
cgucgccggacagcucagc

SEQ ID NO: 3107482 - RNA, 15 nt, Molluscum contagiosum virus
cgucgccgcgcccgc

SEQ ID NO: 3107483 - RNA, 17 nt, Molluscum contagiosum virus
cucugggcgucgcacag

SEQ ID NO: 3107484 - RNA, 14 nt, Molluscum contagiosum virus
cucugucucccgcc

SEQ ID NO: 3107485 - RNA, 13 nt, Molluscum contagiosum virus
cucuuccggcccg

SEQ ID NO: 3107486 - RNA, 13 nt, Molluscum contagiosum virus
cucuucggcgucc

SEQ ID NO: 3107487 - RNA, 15 nt, Molluscum contagiosum virus
cgucgagggcgccgg

SEQ ID NO: 3107488 - RNA, 20 nt, Molluscum contagiosum virus
cgucgcacaguucacggcgc

SEQ ID NO: 3107489 - RNA, 21 nt, Molluscum contagiosum virus
cgucgcccggcaggcucccgc

SEQ ID NO: 3107490 - RNA, 19 nt, Molluscum contagiosum virus
cgucgaaguccgucacgga

SEQ ID NO: 3107491 - RNA, 12 nt, Molluscum contagiosum virus
cgucgacggcgc

SEQ ID NO: 3107492 - RNA, 22 nt, Molluscum contagiosum virus
cgucgaccuggaagccgccagc

SEQ ID NO: 3107493 - RNA, 15 nt, Molluscum contagiosum virus
cugcaaagcgcggcc

SEQ ID NO: 3107494 - RNA, 17 nt, Molluscum contagiosum virus
cugaugcccaggcgcgu

SEQ ID NO: 3107495 - RNA, 15 nt, Molluscum contagiosum virus
cugagguuggccagc

SEQ ID NO: 3107496 - RNA, 15 nt, Molluscum contagiosum virus
cugcaacucgcgcug

SEQ ID NO: 3107497 - RNA, 20 nt, Molluscum contagiosum virus
cugcaagaggcgcugucgcg

SEQ ID NO: 3107498 - RNA, 18 nt, Molluscum contagiosum virus
cugcacacaccgcgagca

SEQ ID NO: 3107499 - RNA, 21 nt, Molluscum contagiosum virus
cugagauauacaaagaagcgc

SEQ ID NO: 3107500 - RNA, 21 nt, Molluscum contagiosum virus
cugagauccacgcgugcugcg

SEQ ID NO: 3107501 - RNA, 12 nt, Molluscum contagiosum virus
cugagcgcagca

SEQ ID NO: 3107502 - RNA, 18 nt, Molluscum contagiosum virus
cugagcgcgcugcgccgc

SEQ ID NO: 3107503 - RNA, 13 nt, Molluscum contagiosum virus
cugagcgcggagc

SEQ ID NO: 3107504 - RNA, 20 nt, Molluscum contagiosum virus
cugagcgugucgaagcgcgc

SEQ ID NO: 3107505 - RNA, 23 nt, Molluscum contagiosum virus
cugagcgugucgaagcgcgcagc

SEQ ID NO: 3107506 - RNA, 21 nt, Molluscum contagiosum virus
cugacagcguguucggggccg

SEQ ID NO: 3107507 - RNA, 23 nt, Molluscum contagiosum virus
cugacagcguguucggggccgcg

SEQ ID NO: 3107508 - RNA, 22 nt, Molluscum contagiosum virus
cugacccccuccccagcgccgc

SEQ ID NO: 3107509 - RNA, 21 nt, Molluscum contagiosum virus
cugaccgacggcgacgacagc

SEQ ID NO: 3107510 - RNA, 22 nt, Molluscum contagiosum virus
cugagaagcaaugcgcaaggcc

SEQ ID NO: 3107511 - RNA, 14 nt, Molluscum contagiosum virus
gcccacgcgcaagg

SEQ ID NO: 3107512 - RNA, 13 nt, Molluscum contagiosum virus
gcccagcgccacg

SEQ ID NO: 3107513 - RNA, 15 nt, Molluscum contagiosum virus
gcccagcguggccag

SEQ ID NO: 3107514 - RNA, 21 nt, Molluscum contagiosum virus
gcccaggccauggagcgcccg

SEQ ID NO: 3107515 - RNA, 21 nt, Molluscum contagiosum virus
gcccaucaaggcgcgcaucgc

SEQ ID NO: 3107516 - RNA, 17 nt, Molluscum contagiosum virus
gcccaugcucaccgccg

SEQ ID NO: 3107517 - RNA, 20 nt, Molluscum contagiosum virus
gccccagcaccagguagagc

SEQ ID NO: 3107518 - RNA, 16 nt, Molluscum contagiosum virus
gccaugcuccugaucu

SEQ ID NO: 3107519 - RNA, 14 nt, Molluscum contagiosum virus
gccaugcugcgcga

SEQ ID NO: 3107520 - RNA, 16 nt, Molluscum contagiosum virus
gccauggagcgcccgc

SEQ ID NO: 3107521 - RNA, 19 nt, Molluscum contagiosum virus
gccauggucacgcgcacgc

SEQ ID NO: 3107522 - RNA, 16 nt, Molluscum contagiosum virus
gccaugucugugcgcg

SEQ ID NO: 3107523 - RNA, 22 nt, Molluscum contagiosum virus
gccauguuuccugcggcgcugc

SEQ ID NO: 3107524 - RNA, 22 nt, Molluscum contagiosum virus
gccaguagcgaaugcagugccc

SEQ ID NO: 3107525 - RNA, 15 nt, Molluscum contagiosum virus
gccaguccgcggcgc

SEQ ID NO: 3107526 - RNA, 20 nt, Molluscum contagiosum virus
gccagucgcgacgcgcuugc

SEQ ID NO: 3107527 - RNA, 16 nt, Molluscum contagiosum virus
gccagucgcgccucgc

SEQ ID NO: 3107528 - RNA, 22 nt, Molluscum contagiosum virus
gccaugaacaacauggugcugg

SEQ ID NO: 3107529 - RNA, 22 nt, Molluscum contagiosum virus
gcccacgagcgccagccugugc

SEQ ID NO: 3107530 - RNA, 14 nt, Molluscum contagiosum virus
gccauugugacacg

SEQ ID NO: 3107531 - RNA, 17 nt, Molluscum contagiosum virus
gcccaccuucuugucgc

SEQ ID NO: 3107532 - RNA, 15 nt, Molluscum contagiosum virus
gcccacguugccgcg

SEQ ID NO: 3107533 - RNA, 18 nt, Molluscum contagiosum virus
gcccacguugccgcgcgc

SEQ ID NO: 3107534 - RNA, 19 nt, Molluscum contagiosum virus
gcccacguugccgcgcgcu

SEQ ID NO: 3107535 - RNA, 14 nt, Molluscum contagiosum virus
gcccagcacgcgcg

SEQ ID NO: 3107536 - RNA, 16 nt, Molluscum contagiosum virus
gacggucacgcaagcu

SEQ ID NO: 3107537 - RNA, 14 nt, Molluscum contagiosum virus
gacgugcgcgcugc

SEQ ID NO: 3107538 - RNA, 14 nt, Molluscum contagiosum virus
gacgugcggcacgc

SEQ ID NO: 3107539 - RNA, 23 nt, Molluscum contagiosum virus
gacgugcuccgaguccagcuucu

SEQ ID NO: 3107540 - RNA, 17 nt, Molluscum contagiosum virus
gacgugcuucacgaccu

SEQ ID NO: 3107541 - RNA, 22 nt, Molluscum contagiosum virus
gacguggaccuuggcgcgccgc

SEQ ID NO: 3107542 - RNA, 22 nt, Molluscum contagiosum virus
gacguggauaccaugcucucgc

SEQ ID NO: 3107543 - RNA, 17 nt, Molluscum contagiosum virus
gacguggucgcgcgcgc

SEQ ID NO: 3107544 - RNA, 19 nt, Molluscum contagiosum virus
gacuacgcacggcggacgc

SEQ ID NO: 3107545 - RNA, 18 nt, Molluscum contagiosum virus
gacuacgcgcugcggcgc

SEQ ID NO: 3107546 - RNA, 22 nt, Molluscum contagiosum virus
gccaggcacacgcagugccacg

SEQ ID NO: 3107547 - RNA, 12 nt, Molluscum contagiosum virus
gacucagcaugu

SEQ ID NO: 3107548 - RNA, 19 nt, Molluscum contagiosum virus
gccagcuuggugcgcucga

SEQ ID NO: 3107549 - RNA, 11 nt, Molluscum contagiosum virus
gccaggaacga

SEQ ID NO: 3107550 - RNA, 18 nt, Molluscum contagiosum virus
gccaggugcgaaggcucg

SEQ ID NO: 3107551 - RNA, 19 nt, Molluscum contagiosum virus
gccaggcgccggcgcgcgc

SEQ ID NO: 3107552 - RNA, 15 nt, Molluscum contagiosum virus
gccaggcgcggucgc

SEQ ID NO: 3107553 - RNA, 22 nt, Molluscum contagiosum virus
gccaggcgcggucgcccgccga

SEQ ID NO: 3107554 - RNA, 14 nt, Molluscum contagiosum virus
gccaggcguagcgc

SEQ ID NO: 3107555 - RNA, 15 nt, Molluscum contagiosum virus
gccaggcuaggcgcg

SEQ ID NO: 3107556 - RNA, 11 nt, Molluscum contagiosum virus
gacgucgcggc

SEQ ID NO: 3107557 - RNA, 22 nt, Molluscum contagiosum virus
gacgucgcggccacgcacucgc

SEQ ID NO: 3107558 - RNA, 19 nt, Molluscum contagiosum virus
gacgugaucgcgcaggcgc

SEQ ID NO: 3107559 - RNA, 18 nt, Molluscum contagiosum virus
gacgugcccuacgcgcgc

SEQ ID NO: 3107560 - RNA, 20 nt, Molluscum contagiosum virus
gacgucaaccgggcucucgc

SEQ ID NO: 3107561 - RNA, 23 nt, Molluscum contagiosum virus
gacgucaaccgggcucucgcgga

SEQ ID NO: 3107562 - RNA, 22 nt, Molluscum contagiosum virus
gacguacgagcaggcgcagcgc

SEQ ID NO: 3107563 - RNA, 23 nt, Molluscum contagiosum virus
gacggcugguguuaccgggucgc

SEQ ID NO: 3107564 - RNA, 19 nt, Molluscum contagiosum virus
gacggcuucauccgcgcgc

SEQ ID NO: 3107565 - RNA, 22 nt, Molluscum contagiosum virus
gacgggagagguugcgcggggc

SEQ ID NO: 3107566 - RNA, 13 nt, Molluscum contagiosum virus
gacgggcccgcga

SEQ ID NO: 3107567 - RNA, 17 nt, Molluscum contagiosum virus
gacgggccgccgcccgc

SEQ ID NO: 3107568 - RNA, 22 nt, Molluscum contagiosum virus
gacgggcgcagccacgacucgc

SEQ ID NO: 3107569 - RNA, 12 nt, Molluscum contagiosum virus
gacggugcugcg

SEQ ID NO: 3107570 - RNA, 15 nt, Molluscum contagiosum virus
gacggugcugcgcac

SEQ ID NO: 3107571 - RNA, 15 nt, Molluscum contagiosum virus
gugaccugcgccauc

SEQ ID NO: 3107572 - RNA, 20 nt, Molluscum contagiosum virus
gugacaaucucugcgccgcg

SEQ ID NO: 3107573 - RNA, 23 nt, Molluscum contagiosum virus
gugacaaucucugcgccgcgcgc

SEQ ID NO: 3107574 - RNA, 21 nt, Molluscum contagiosum virus
gugagaaaguucccguccgcg

SEQ ID NO: 3107575 - RNA, 14 nt, Molluscum contagiosum virus
gugacucggccgcg

SEQ ID NO: 3107576 - RNA, 12 nt, Molluscum contagiosum virus
gugaguccgcgg

SEQ ID NO: 3107577 - RNA, 12 nt, Molluscum contagiosum virus
gugagugcgcgc

SEQ ID NO: 3107578 - RNA, 17 nt, Molluscum contagiosum virus
gugcaagcccagcagcg

SEQ ID NO: 3107579 - RNA, 13 nt, Molluscum contagiosum virus
gugcaauuccguc

SEQ ID NO: 3107580 - RNA, 19 nt, Molluscum contagiosum virus
gugcacagcguagcggacg

SEQ ID NO: 3107581 - RNA, 19 nt, Molluscum contagiosum virus
gugcacauugcugcugcag

SEQ ID NO: 3107582 - RNA, 14 nt, Molluscum contagiosum virus
gugcaccagcaccg

SEQ ID NO: 3107583 - RNA, 15 nt, Molluscum contagiosum virus
gugcacgcacgcgcg

SEQ ID NO: 3107584 - RNA, 19 nt, Molluscum contagiosum virus
gugcacgcacgcgcgggca

SEQ ID NO: 3107585 - RNA, 20 nt, Molluscum contagiosum virus
gugcacgcggcgcgugucgc

SEQ ID NO: 3107586 - RNA, 17 nt, Molluscum contagiosum virus
gugcacguccugcgagu

SEQ ID NO: 3107587 - RNA, 17 nt, Molluscum contagiosum virus
gugcacguggcgcacac

SEQ ID NO: 3107588 - RNA, 21 nt, Molluscum contagiosum virus
gugaacgaggcugcugccgcg

SEQ ID NO: 3107589 - RNA, 13 nt, Molluscum contagiosum virus
gucuucuaccgcc

SEQ ID NO: 3107590 - RNA, 15 nt, Molluscum contagiosum virus
gucugggaggugucc

SEQ ID NO: 3107591 - RNA, 15 nt, Molluscum contagiosum virus
gucuggccgggcucg

SEQ ID NO: 3107592 - RNA, 13 nt, Molluscum contagiosum virus
gucugugcgcgag

SEQ ID NO: 3107593 - RNA, 19 nt, Molluscum contagiosum virus
gucguuccggacgugcacg

SEQ ID NO: 3107594 - RNA, 21 nt, Molluscum contagiosum virus
gucuccuccuugauuucgcgc

SEQ ID NO: 3107595 - RNA, 21 nt, Molluscum contagiosum virus
gucucgaaccgaggccgcgcu

SEQ ID NO: 3107596 - RNA, 23 nt, Molluscum contagiosum virus
gucucgagcuuccucaaggcgca

SEQ ID NO: 3107597 - RNA, 14 nt, Molluscum contagiosum virus
gucucgcgcucgcc

SEQ ID NO: 3107598 - RNA, 22 nt, Molluscum contagiosum virus
gucucgcggggcaagcgcgcuc

SEQ ID NO: 3107599 - RNA, 18 nt, Molluscum contagiosum virus
gucucgcucuuccgcgag

SEQ ID NO: 3107600 - RNA, 13 nt, Molluscum contagiosum virus
gucugcaaggccu

SEQ ID NO: 3107601 - RNA, 13 nt, Molluscum contagiosum virus
gucucugcgcgag

SEQ ID NO: 3107602 - RNA, 16 nt, Molluscum contagiosum virus
gugcagcgcgugcgca

SEQ ID NO: 3107603 - RNA, 16 nt, Molluscum contagiosum virus
gugcagcggcgccacg

SEQ ID NO: 3107604 - RNA, 17 nt, Molluscum contagiosum virus
gugcaggaacgcgcgcu

SEQ ID NO: 3107605 - RNA, 13 nt, Molluscum contagiosum virus
gugcauggcacgc

SEQ ID NO: 3107606 - RNA, 18 nt, Molluscum contagiosum virus
gugcauggcacgcgagca

SEQ ID NO: 3107607 - RNA, 22 nt, Molluscum contagiosum virus
gugcauggcggcggccacgcuc

SEQ ID NO: 3107608 - RNA, 13 nt, Molluscum contagiosum virus
gugcccgccaaga

SEQ ID NO: 3107609 - RNA, 13 nt, Molluscum contagiosum virus
gugcccgcgcgcu

SEQ ID NO: 3107610 - RNA, 21 nt, Molluscum contagiosum virus
gugccagagucgccgcugcgc

SEQ ID NO: 3107611 - RNA, 20 nt, Molluscum contagiosum virus
gugccagcguacggcccgaa

SEQ ID NO: 3107612 - RNA, 15 nt, Molluscum contagiosum virus
gugccaucucgcaca

SEQ ID NO: 3107613 - RNA, 18 nt, Molluscum contagiosum virus
gugcccacgcuggcgcgc

SEQ ID NO: 3107614 - RNA, 17 nt, Molluscum contagiosum virus
gugcccaugcucgagcc

SEQ ID NO: 3107615 - RNA, 22 nt, Molluscum contagiosum virus
ggaaucguuccuucugcuagga

SEQ ID NO: 3107616 - RNA, 16 nt, Molluscum contagiosum virus
ggacaaagucgcgcgc

SEQ ID NO: 3107617 - RNA, 17 nt, Molluscum contagiosum virus
ggacaaagucgcgcgcg

SEQ ID NO: 3107618 - RNA, 17 nt, Molluscum contagiosum virus
ggacaacucauagcgcc

SEQ ID NO: 3107619 - RNA, 16 nt, Molluscum contagiosum virus
ggacaagucacugcua

SEQ ID NO: 3107620 - RNA, 13 nt, Molluscum contagiosum virus
ggacaccgcgggc

SEQ ID NO: 3107621 - RNA, 16 nt, Molluscum contagiosum virus
ggacaccgcgggcgug

SEQ ID NO: 3107622 - RNA, 21 nt, Molluscum contagiosum virus
ggacacguugcagcagcacag

SEQ ID NO: 3107623 - RNA, 14 nt, Molluscum contagiosum virus
ggacacucgcggca

SEQ ID NO: 3107624 - RNA, 19 nt, Molluscum contagiosum virus
ggacagagcccgcggcgca

SEQ ID NO: 3107625 - RNA, 22 nt, Molluscum contagiosum virus
ggacagagcccgcggcgcacgg

SEQ ID NO: 3107626 - RNA, 18 nt, Molluscum contagiosum virus
ggacagcaagcagcgcgc

SEQ ID NO: 3107627 - RNA, 22 nt, Molluscum contagiosum virus
ggacagcaugaacucgcugcug

SEQ ID NO: 3107628 - RNA, 15 nt, Molluscum contagiosum virus
ggacagccugcaccg

SEQ ID NO: 3107629 - RNA, 12 nt, Molluscum contagiosum virus
ggaagcgcgugc

SEQ ID NO: 3107630 - RNA, 15 nt, Molluscum contagiosum virus
ggaagcugcacgugc

SEQ ID NO: 3107631 - RNA, 18 nt, Molluscum contagiosum virus
ggaagugcgagccgugac

SEQ ID NO: 3107632 - RNA, 19 nt, Molluscum contagiosum virus
ggaagagcguccgcggugc

SEQ ID NO: 3107633 - RNA, 23 nt, Molluscum contagiosum virus
ggaacgaggucaucuucgugcug

SEQ ID NO: 3107634 - RNA, 16 nt, Molluscum contagiosum virus
ggaacuagugcugcug

SEQ ID NO: 3107635 - RNA, 14 nt, Molluscum contagiosum virus
ggaacucgcgcgcg

SEQ ID NO: 3107636 - RNA, 21 nt, Molluscum contagiosum virus
ggaacucuacgacaugcucgc

SEQ ID NO: 3107637 - RNA, 14 nt, Molluscum contagiosum virus
ggaacugacugcug

SEQ ID NO: 3107638 - RNA, 16 nt, Molluscum contagiosum virus
guacucgcguccgcgc

SEQ ID NO: 3107639 - RNA, 21 nt, Molluscum contagiosum virus
guacuucaucuucaagccgca

SEQ ID NO: 3107640 - RNA, 13 nt, Molluscum contagiosum virus
guacugcugcagg

SEQ ID NO: 3107641 - RNA, 16 nt, Molluscum contagiosum virus
ggaccuaaagcugcug

SEQ ID NO: 3107642 - RNA, 16 nt, Molluscum contagiosum virus
ggaccucaaggaggcg

SEQ ID NO: 3107643 - RNA, 16 nt, Molluscum contagiosum virus
guacguacagugcgcg

SEQ ID NO: 3107644 - RNA, 16 nt, Molluscum contagiosum virus
guacgugcuugcgcgc

SEQ ID NO: 3107645 - RNA, 15 nt, Molluscum contagiosum virus
guagcgugcgccugc

SEQ ID NO: 3107646 - RNA, 18 nt, Molluscum contagiosum virus
guagcuagcucugcgcgc

SEQ ID NO: 3107647 - RNA, 13 nt, Molluscum contagiosum virus
guagguacccgca

SEQ ID NO: 3107648 - RNA, 16 nt, Molluscum contagiosum virus
guagguacccgcaacc

SEQ ID NO: 3107649 - RNA, 16 nt, Molluscum contagiosum virus
guagagcaacaugcug

SEQ ID NO: 3107650 - RNA, 17 nt, Molluscum contagiosum virus
guagagcagcgcuagcc

SEQ ID NO: 3107651 - RNA, 19 nt, Molluscum contagiosum virus
guagcacgaaggacgcgcu

SEQ ID NO: 3107652 - RNA, 14 nt, Molluscum contagiosum virus
guagccgcgacgca

SEQ ID NO: 3107653 - RNA, 17 nt, Molluscum contagiosum virus
guagccgcgacgcaagc

SEQ ID NO: 3107654 - RNA, 18 nt, Molluscum contagiosum virus
guagccgcgacgcaagcg

SEQ ID NO: 3107655 - RNA, 12 nt, Molluscum contagiosum virus
guagccgcgcga

SEQ ID NO: 3107656 - RNA, 23 nt, Molluscum contagiosum virus
guagccuuuguucuuagcagcgc

SEQ ID NO: 3107657 - RNA, 12 nt, Molluscum contagiosum virus
guagcgcgccgc

SEQ ID NO: 3107658 - RNA, 18 nt, Molluscum contagiosum virus
guauacucgacgcgcgcg

SEQ ID NO: 3107659 - RNA, 19 nt, Molluscum contagiosum virus
guauauacuccccgcgcgc

SEQ ID NO: 3107660 - RNA, 20 nt, Molluscum contagiosum virus
guauauacuccccgcgcgcg

SEQ ID NO: 3107661 - RNA, 15 nt, Molluscum contagiosum virus
guaguaguagcgcuc

SEQ ID NO: 3107662 - RNA, 13 nt, Molluscum contagiosum virus
gucacacuacgcu

SEQ ID NO: 3107663 - RNA, 21 nt, Molluscum contagiosum virus
gucaagacucgcccgcgcgcg

SEQ ID NO: 3107664 - RNA, 18 nt, Molluscum contagiosum virus
gucaagcagcgcgccacc

SEQ ID NO: 3107665 - RNA, 19 nt, Molluscum contagiosum virus
gucacgcuggucacgcgcu

SEQ ID NO: 3107666 - RNA, 16 nt, Molluscum contagiosum virus
gucacggccuucgcgc

SEQ ID NO: 3107667 - RNA, 21 nt, Molluscum contagiosum virus
gucgcgcgcuaccugcgcaag

SEQ ID NO: 3107668 - RNA, 22 nt, Molluscum contagiosum virus
gucgcgcgcuaccugcgcaagc

SEQ ID NO: 3107669 - RNA, 16 nt, Molluscum contagiosum virus
gucgcgcuuccgcgag

SEQ ID NO: 3107670 - RNA, 21 nt, Molluscum contagiosum virus
gucacgcaagcuuugugcucg

SEQ ID NO: 3107671 - RNA, 18 nt, Molluscum contagiosum virus
gucacgcgcaaggccgcg

SEQ ID NO: 3107672 - RNA, 18 nt, Molluscum contagiosum virus
gucgggccccugcgcgag

SEQ ID NO: 3107673 - RNA, 14 nt, Molluscum contagiosum virus
gucguaccuguguu

SEQ ID NO: 3107674 - RNA, 21 nt, Molluscum contagiosum virus
gucguagcaaaugcgcugcuc

SEQ ID NO: 3107675 - RNA, 13 nt, Molluscum contagiosum virus
gucguagcggcgg

SEQ ID NO: 3107676 - RNA, 22 nt, Molluscum contagiosum virus
gucgugcuuccugcaaacuuga

SEQ ID NO: 3107677 - RNA, 20 nt, Molluscum contagiosum virus
gucgugcgcguucggaacgc

SEQ ID NO: 3107678 - RNA, 18 nt, Molluscum contagiosum virus
gucggcggcaugcgcgcg

SEQ ID NO: 3107679 - RNA, 16 nt, Molluscum contagiosum virus
gucgcgggcgcgcgcg

SEQ ID NO: 3107680 - RNA, 15 nt, Molluscum contagiosum virus
gccucagccgagcgc

SEQ ID NO: 3107681 - RNA, 22 nt, Molluscum contagiosum virus
gccuccgaggacgacgccgagc

SEQ ID NO: 3107682 - RNA, 14 nt, Molluscum contagiosum virus
gccucgucguccac

SEQ ID NO: 3107683 - RNA, 15 nt, Molluscum contagiosum virus
gccucgagcacgccu

SEQ ID NO: 3107684 - RNA, 16 nt, Molluscum contagiosum virus
gccucgagcacgccuc

SEQ ID NO: 3107685 - RNA, 18 nt, Molluscum contagiosum virus
gccugccgcgagcacugg

SEQ ID NO: 3107686 - RNA, 13 nt, Molluscum contagiosum virus
gccugcacgcgca

SEQ ID NO: 3107687 - RNA, 12 nt, Molluscum contagiosum virus
gccugcacggcu

SEQ ID NO: 3107688 - RNA, 16 nt, Molluscum contagiosum virus
gccugagaagcuguac

SEQ ID NO: 3107689 - RNA, 14 nt, Molluscum contagiosum virus
gccugcacacgcgu

SEQ ID NO: 3107690 - RNA, 23 nt, Molluscum contagiosum virus
gccucugccagccgcucguccag

SEQ ID NO: 3107691 - RNA, 15 nt, Molluscum contagiosum virus
gccucguucacggcu

SEQ ID NO: 3107692 - RNA, 16 nt, Molluscum contagiosum virus
gccucguucacggcua

SEQ ID NO: 3107693 - RNA, 20 nt, Molluscum contagiosum virus
gcgggaggcucucgagcacu

SEQ ID NO: 3107694 - RNA, 16 nt, Molluscum contagiosum virus
gcgggcaagcagggcc

SEQ ID NO: 3107695 - RNA, 22 nt, Molluscum contagiosum virus
gcgggcacggcuaccacgagca

SEQ ID NO: 3107696 - RNA, 16 nt, Molluscum contagiosum virus
gcgggcacgggcaccg

SEQ ID NO: 3107697 - RNA, 20 nt, Molluscum contagiosum virus
gcgggcacgugcugcugcgg

SEQ ID NO: 3107698 - RNA, 22 nt, Molluscum contagiosum virus
gcgggaccugguucaugcuggc

SEQ ID NO: 3107699 - RNA, 22 nt, Molluscum contagiosum virus
gccugcggacccgccggugcuu

SEQ ID NO: 3107700 - RNA, 22 nt, Molluscum contagiosum virus
gccugcuggcggggaaagcuga

SEQ ID NO: 3107701 - RNA, 21 nt, Molluscum contagiosum virus
gcggcuuuaacguuagcacua

SEQ ID NO: 3107702 - RNA, 17 nt, Molluscum contagiosum virus
gcggcuuucucacgccc

SEQ ID NO: 3107703 - RNA, 20 nt, Molluscum contagiosum virus
gcgggaagaggacgccggca

SEQ ID NO: 3107704 - RNA, 20 nt, Molluscum contagiosum virus
gcgggccaguacuacucggc

SEQ ID NO: 3107705 - RNA, 22 nt, Molluscum contagiosum virus
gcgggccaguacuacucggcgc

SEQ ID NO: 3107706 - RNA, 15 nt, Molluscum contagiosum virus
gcgggccgcgcgcac

SEQ ID NO: 3107707 - RNA, 13 nt, Molluscum contagiosum virus
gcgggccugcgcc

SEQ ID NO: 3107708 - RNA, 14 nt, Molluscum contagiosum virus
gcgggccugcgccc

SEQ ID NO: 3107709 - RNA, 17 nt, Molluscum contagiosum virus
gcgggccugcgcccgca

SEQ ID NO: 3107710 - RNA, 19 nt, Molluscum contagiosum virus
gcgggccuguaccugcgac

SEQ ID NO: 3107711 - RNA, 20 nt, Molluscum contagiosum virus
gcgggccuguaccugcgaca

SEQ ID NO: 3107712 - RNA, 17 nt, Molluscum contagiosum virus
gcgggccuguccgcggg

SEQ ID NO: 3107713 - RNA, 18 nt, Molluscum contagiosum virus
gcgggccuguccgcgggc

SEQ ID NO: 3107714 - RNA, 20 nt, Molluscum contagiosum virus
gcgggccuguccgcgggcgc

SEQ ID NO: 3107715 - RNA, 18 nt, Molluscum contagiosum virus
gcgggcgaaagcgccgcg

SEQ ID NO: 3107716 - RNA, 19 nt, Molluscum contagiosum virus
gcgggcgaaagcgccgcgc

SEQ ID NO: 3107717 - RNA, 13 nt, Molluscum contagiosum virus
gcgggcgcaggcc

SEQ ID NO: 3107718 - RNA, 14 nt, Molluscum contagiosum virus
gcgggcgcaggccc

SEQ ID NO: 3107719 - RNA, 22 nt, Molluscum contagiosum virus
gcguguacucgaaggugcucag

SEQ ID NO: 3107720 - RNA, 22 nt, Molluscum contagiosum virus
gcguguaucaugcacaugcgcu

SEQ ID NO: 3107721 - RNA, 18 nt, Molluscum contagiosum virus
gcgugucgcggagcaacg

SEQ ID NO: 3107722 - RNA, 23 nt, Molluscum contagiosum virus
gcgugucgcggagcaacgcgacc

SEQ ID NO: 3107723 - RNA, 16 nt, Molluscum contagiosum virus
gcgugcuucacgugcu

SEQ ID NO: 3107724 - RNA, 19 nt, Molluscum contagiosum virus
gcgugcuuguagcgcaagg

SEQ ID NO: 3107725 - RNA, 22 nt, Molluscum contagiosum virus
gcguggacagcaucccugccac

SEQ ID NO: 3107726 - RNA, 22 nt, Molluscum contagiosum virus
gcguggcuuugucggugugcuu

SEQ ID NO: 3107727 - RNA, 19 nt, Molluscum contagiosum virus
gcguggugcuuacugcggg

SEQ ID NO: 3107728 - RNA, 18 nt, Molluscum contagiosum virus
gcgugguguccacgcgcg

SEQ ID NO: 3107729 - RNA, 17 nt, Molluscum contagiosum virus
gcgugguguucgccggc

SEQ ID NO: 3107730 - RNA, 16 nt, Molluscum contagiosum virus
gcguucgcagugcccg

SEQ ID NO: 3107731 - RNA, 17 nt, Molluscum contagiosum virus
gcguucuccaggaacgc

SEQ ID NO: 3107732 - RNA, 19 nt, Molluscum contagiosum virus
gcguuggucuugugacccg

SEQ ID NO: 3107733 - RNA, 13 nt, Molluscum contagiosum virus
gcguuguccgcgu

SEQ ID NO: 3107734 - RNA, 16 nt, Molluscum contagiosum virus
gcguucuucguggcgc

SEQ ID NO: 3107735 - RNA, 19 nt, Molluscum contagiosum virus
gcguguuccggcagcgccg

SEQ ID NO: 3107736 - RNA, 15 nt, Molluscum contagiosum virus
gcguuccaggaacgc

SEQ ID NO: 3107737 - RNA, 20 nt, Molluscum contagiosum virus
gcguggacuuuggcgugacc

SEQ ID NO: 3107738 - RNA, 16 nt, Molluscum contagiosum virus
gcgugucugcgcucgc

SEQ ID NO: 3107739 - RNA, 16 nt, Molluscum contagiosum virus
gcgugucuggagccca

SEQ ID NO: 3107740 - RNA, 18 nt, Molluscum contagiosum virus
gcgggugccgccgugggc

SEQ ID NO: 3107741 - RNA, 18 nt, Molluscum contagiosum virus
gcgugcgcuggcgcgcgc

SEQ ID NO: 3107742 - RNA, 17 nt, Molluscum contagiosum virus
gcgugcguacgugcacg

SEQ ID NO: 3107743 - RNA, 13 nt, Molluscum contagiosum virus
gcgugcgugcaca

SEQ ID NO: 3107744 - RNA, 14 nt, Molluscum contagiosum virus
gcgugcgugcacag

SEQ ID NO: 3107745 - RNA, 14 nt, Molluscum contagiosum virus
gcgugcucacgccc

SEQ ID NO: 3107746 - RNA, 15 nt, Molluscum contagiosum virus
gcgugcucacgcccu

SEQ ID NO: 3107747 - RNA, 17 nt, Molluscum contagiosum virus
gcgugcucgguagcgug

SEQ ID NO: 3107748 - RNA, 21 nt, Molluscum contagiosum virus
gcgugcucgguagcguggagc

SEQ ID NO: 3107749 - RNA, 16 nt, Molluscum contagiosum virus
gcgugcugcgcggcgc

SEQ ID NO: 3107750 - RNA, 14 nt, Molluscum contagiosum virus
gcgggcggcggccc

SEQ ID NO: 3107751 - RNA, 16 nt, Molluscum contagiosum virus
gcgggcggcgucgcgc

SEQ ID NO: 3107752 - RNA, 21 nt, Molluscum contagiosum virus
gcggggcucguccucgggcgc

SEQ ID NO: 3107753 - RNA, 16 nt, Molluscum contagiosum virus
gcggggcugcuggcgg

SEQ ID NO: 3107754 - RNA, 17 nt, Molluscum contagiosum virus
gcgggcguguccgcggg

SEQ ID NO: 3107755 - RNA, 20 nt, Molluscum contagiosum virus
gcgggcguguccgcgggcgc

SEQ ID NO: 3107756 - RNA, 19 nt, Molluscum contagiosum virus
gcgggcucuuccaccggca

SEQ ID NO: 3107757 - RNA, 23 nt, Molluscum contagiosum virus
gcggggacucucccgucgccgga

SEQ ID NO: 3107758 - RNA, 15 nt, Molluscum contagiosum virus
gcgggcgccgggcgc

SEQ ID NO: 3107759 - RNA, 12 nt, Molluscum contagiosum virus
gcgggcgcgcac

SEQ ID NO: 3107760 - RNA, 15 nt, Molluscum contagiosum virus
gcgggcgcgcgcgga

SEQ ID NO: 3107761 - RNA, 22 nt, Molluscum contagiosum virus
gcuccgcgcccggcgggcacau

SEQ ID NO: 3107762 - RNA, 18 nt, Molluscum contagiosum virus
gcuccgcggaggccaagc

SEQ ID NO: 3107763 - RNA, 15 nt, Molluscum contagiosum virus
gcuccgcuggacccc

SEQ ID NO: 3107764 - RNA, 23 nt, Molluscum contagiosum virus
gcuccgcuggaccccgagcugcg

SEQ ID NO: 3107765 - RNA, 23 nt, Molluscum contagiosum virus
gcuccggcuuagcuggcgcccgu

SEQ ID NO: 3107766 - RNA, 13 nt, Molluscum contagiosum virus
gcuccgugcugcg

SEQ ID NO: 3107767 - RNA, 22 nt, Molluscum contagiosum virus
gcuccuauaaauggccgcgccc

SEQ ID NO: 3107768 - RNA, 17 nt, Molluscum contagiosum virus
gcuccucgcacgggcgc

SEQ ID NO: 3107769 - RNA, 14 nt, Molluscum contagiosum virus
gcuacgcagcgcgc

SEQ ID NO: 3107770 - RNA, 15 nt, Molluscum contagiosum virus
gcucccucgcgcgca

SEQ ID NO: 3107771 - RNA, 19 nt, Molluscum contagiosum virus
gcucgaacgcgcgugcgcg

SEQ ID NO: 3107772 - RNA, 20 nt, Molluscum contagiosum virus
gcucgacacugugcuggcgc

SEQ ID NO: 3107773 - RNA, 15 nt, Molluscum contagiosum virus
gcucgacgggcgcag

SEQ ID NO: 3107774 - RNA, 15 nt, Molluscum contagiosum virus
gcuaccugcgcaagc

SEQ ID NO: 3107775 - RNA, 19 nt, Molluscum contagiosum virus
gcuaccugguggagcacuu

SEQ ID NO: 3107776 - RNA, 22 nt, Molluscum contagiosum virus
gcuacgacgacaugcacacgca

SEQ ID NO: 3107777 - RNA, 22 nt, Molluscum contagiosum virus
gcuacgaggccuacgugcugcg

SEQ ID NO: 3107778 - RNA, 22 nt, Molluscum contagiosum virus
gcuccgcacguggagucacgac

SEQ ID NO: 3107779 - RNA, 16 nt, Molluscum contagiosum virus
gcuccgccaacgcgga

SEQ ID NO: 3107780 - RNA, 21 nt, Molluscum contagiosum virus
gcuccgccaacgcggacgcgc

SEQ ID NO: 3107781 - RNA, 16 nt, Molluscum contagiosum virus
gcuaaucugccgcggc

SEQ ID NO: 3107782 - RNA, 16 nt, Molluscum contagiosum virus
gcuaccagcucgcgca

SEQ ID NO: 3107783 - RNA, 16 nt, Molluscum contagiosum virus
gcuacccguugcugcg

SEQ ID NO: 3107784 - RNA, 21 nt, Molluscum contagiosum virus
gcuaccgcagccacggccgcg

SEQ ID NO: 3107785 - RNA, 15 nt, Molluscum contagiosum virus
gcuaccgcgcgcgca

SEQ ID NO: 3107786 - RNA, 16 nt, Molluscum contagiosum virus
gcuaccgcgcgcgcaa

SEQ ID NO: 3107787 - RNA, 14 nt, Molluscum contagiosum virus
gcucggaguccgcg

SEQ ID NO: 3107788 - RNA, 16 nt, Molluscum contagiosum virus
gcugcccuuuagcgug

SEQ ID NO: 3107789 - RNA, 20 nt, Molluscum contagiosum virus
gcugcccuuuagcguggcgc

SEQ ID NO: 3107790 - RNA, 21 nt, Molluscum contagiosum virus
gcugcccuuuagcguggcgcg

SEQ ID NO: 3107791 - RNA, 15 nt, Molluscum contagiosum virus
gcugccgcgcgcgcc

SEQ ID NO: 3107792 - RNA, 20 nt, Molluscum contagiosum virus
gcucgcggcuaggacuagca

SEQ ID NO: 3107793 - RNA, 21 nt, Molluscum contagiosum virus
gcucgcuuagccaacagcgca

SEQ ID NO: 3107794 - RNA, 23 nt, Molluscum contagiosum virus
gcucgcuugccggcggcgcaagc

SEQ ID NO: 3107795 - RNA, 16 nt, Molluscum contagiosum virus
gcucggaaagagcgcg

SEQ ID NO: 3107796 - RNA, 16 nt, Molluscum contagiosum virus
gcucggaagagcgucc

SEQ ID NO: 3107797 - RNA, 15 nt, Molluscum contagiosum virus
gcucggacacacgca

SEQ ID NO: 3107798 - RNA, 14 nt, Molluscum contagiosum virus
gcucgcggugccgg

SEQ ID NO: 3107799 - RNA, 15 nt, Molluscum contagiosum virus
gcucgcggugccgga

SEQ ID NO: 3107800 - RNA, 14 nt, Molluscum contagiosum virus
gcucgcgugccgcg

SEQ ID NO: 3107801 - RNA, 20 nt, Molluscum contagiosum virus
gcucgcgugccgcggacgcc

SEQ ID NO: 3107802 - RNA, 18 nt, Molluscum contagiosum virus
gcucgcgugcgugcugcg

SEQ ID NO: 3107803 - RNA, 18 nt, Molluscum contagiosum virus
gcucgcuaaucugccgcg

SEQ ID NO: 3107804 - RNA, 14 nt, Molluscum contagiosum virus
gcucgccgcgcgcc

SEQ ID NO: 3107805 - RNA, 18 nt, Molluscum contagiosum virus
gcucgcgacgugcgcgcu

SEQ ID NO: 3107806 - RNA, 14 nt, Molluscum contagiosum virus
gcucgcgagugugc

SEQ ID NO: 3107807 - RNA, 18 nt, Molluscum contagiosum virus
gcucgcgcaaguccagcg

SEQ ID NO: 3107808 - RNA, 22 nt, Molluscum contagiosum virus
gcucgcgcaaguccagcgcgcu

SEQ ID NO: 3107809 - RNA, 23 nt, Molluscum contagiosum virus
gcucgcgcaauacugcgggcugu

SEQ ID NO: 3107810 - RNA, 15 nt, Molluscum contagiosum virus
gcucgcgcacgcgca

SEQ ID NO: 3107811 - RNA, 18 nt, Molluscum contagiosum virus
gcucgcgcaucugccgcg

SEQ ID NO: 3107812 - RNA, 22 nt, Molluscum contagiosum virus
gcucgcgccugaaccugggcgc

SEQ ID NO: 3107813 - RNA, 13 nt, Molluscum contagiosum virus
gcucgcgcgcaag

SEQ ID NO: 3107814 - RNA, 12 nt, Molluscum contagiosum virus
gcucgcgcgcau

SEQ ID NO: 3107815 - RNA, 23 nt, Molluscum contagiosum virus
gcucgcgcgcaugcucgcgcucu

SEQ ID NO: 3107816 - RNA, 15 nt, Molluscum contagiosum virus
gcucgcgcgugcucg

SEQ ID NO: 3107817 - RNA, 12 nt, Molluscum contagiosum virus
gcucgcggaggg

SEQ ID NO: 3107818 - RNA, 12 nt, Molluscum contagiosum virus
gcucgagaacga

SEQ ID NO: 3107819 - RNA, 15 nt, Molluscum contagiosum virus
gcucgagcgcgcgcc

SEQ ID NO: 3107820 - RNA, 21 nt, Molluscum contagiosum virus
gcucgagggcgccgugcugcg

SEQ ID NO: 3107821 - RNA, 15 nt, Molluscum contagiosum virus
gcucgcacacgugca

SEQ ID NO: 3107822 - RNA, 18 nt, Molluscum contagiosum virus
gcucgcacccgcgccgcg

SEQ ID NO: 3107823 - RNA, 19 nt, Molluscum contagiosum virus
gcucgcacuugccgggcga

SEQ ID NO: 3107824 - RNA, 22 nt, Molluscum contagiosum virus
gcucgcagccuccgugcgccag

SEQ ID NO: 3107825 - RNA, 19 nt, Molluscum contagiosum virus
gcucgcaggcggugggcgc

SEQ ID NO: 3107826 - RNA, 15 nt, Molluscum contagiosum virus
gcucgccgcacgcga

SEQ ID NO: 3107827 - RNA, 15 nt, Molluscum contagiosum virus
gcuuucucacgcgcu

SEQ ID NO: 3107828 - RNA, 16 nt, Molluscum contagiosum virus
gcuuugucgcgaacgc

SEQ ID NO: 3107829 - RNA, 22 nt, Molluscum contagiosum virus
ggaaaccucaccucugcgcggc

SEQ ID NO: 3107830 - RNA, 23 nt, Molluscum contagiosum virus
ggaaagauauacaccaggcgcgu

SEQ ID NO: 3107831 - RNA, 12 nt, Molluscum contagiosum virus
ggaaagcgcaca

SEQ ID NO: 3107832 - RNA, 22 nt, Molluscum contagiosum virus
ggaaagcuggcgggugccgugc

SEQ ID NO: 3107833 - RNA, 21 nt, Molluscum contagiosum virus
ggaaaacgcccgagcgcgugu

SEQ ID NO: 3107834 - RNA, 22 nt, Molluscum contagiosum virus
ggaaaauccgcgcccgcgcggc

SEQ ID NO: 3107835 - RNA, 24 nt, Molluscum contagiosum virus
ggaacaucugcaacucgcgcugca

SEQ ID NO: 3107836 - RNA, 19 nt, Molluscum contagiosum virus
ggaacaccacacgcgcggc

SEQ ID NO: 3107837 - RNA, 22 nt, Molluscum contagiosum virus
gcuggaccccgagcugcggcgc

SEQ ID NO: 3107838 - RNA, 18 nt, Molluscum contagiosum virus
gcuggacgggcacgagca

SEQ ID NO: 3107839 - RNA, 22 nt, Molluscum contagiosum virus
gcuggacgggcacgagcacguc

SEQ ID NO: 3107840 - RNA, 13 nt, Molluscum contagiosum virus
gcuggacgugggc

SEQ ID NO: 3107841 - RNA, 21 nt, Molluscum contagiosum virus
gcuggacuuccugcugcgcag

SEQ ID NO: 3107842 - RNA, 19 nt, Molluscum contagiosum virus
gcuggagaaagaagugugc

SEQ ID NO: 3107843 - RNA, 13 nt, Molluscum contagiosum virus
gcuggagcacgac

SEQ ID NO: 3107844 - RNA, 12 nt, Molluscum contagiosum virus
gcuggagcagac

SEQ ID NO: 3107845 - RNA, 17 nt, Molluscum contagiosum virus
gcuggagcgagugcgcg

SEQ ID NO: 3107846 - RNA, 22 nt, Molluscum contagiosum virus
gcuggagcgagugcgcgugcgc

SEQ ID NO: 3107847 - RNA, 18 nt, Molluscum contagiosum virus
gcuggagggcacgcugca

SEQ ID NO: 3107848 - RNA, 15 nt, Molluscum contagiosum virus
gcuggcaccgggcgc

SEQ ID NO: 3107849 - RNA, 12 nt, Molluscum contagiosum virus
gcuggcacgcga

SEQ ID NO: 3107850 - RNA, 23 nt, Molluscum contagiosum virus
gcuggcacggccggcgccgcgca

SEQ ID NO: 3107851 - RNA, 17 nt, Molluscum contagiosum virus
gcugcuucgcgaccacg

SEQ ID NO: 3107852 - RNA, 19 nt, Molluscum contagiosum virus
gcugcuguuucugugucac

SEQ ID NO: 3107853 - RNA, 14 nt, Molluscum contagiosum virus
gcuggccgugcccg

SEQ ID NO: 3107854 - RNA, 23 nt, Molluscum contagiosum virus
gcuggcgaaaccugggcgccgcg

SEQ ID NO: 3107855 - RNA, 15 nt, Molluscum contagiosum virus
gcuggcgagcacguc

SEQ ID NO: 3107856 - RNA, 16 nt, Molluscum contagiosum virus
gcugcgcacgugcgcg

SEQ ID NO: 3107857 - RNA, 16 nt, Molluscum contagiosum virus
gcugcgccacugccac

SEQ ID NO: 3107858 - RNA, 15 nt, Molluscum contagiosum virus
gcugcgccggcugcg

SEQ ID NO: 3107859 - RNA, 18 nt, Molluscum contagiosum virus
gcugcgcgagcgcgcgcu

SEQ ID NO: 3107860 - RNA, 16 nt, Molluscum contagiosum virus
gcugcgcgccgccgac

SEQ ID NO: 3107861 - RNA, 13 nt, Molluscum contagiosum virus
gcugcgcgccgcg

SEQ ID NO: 3107862 - RNA, 12 nt, Molluscum contagiosum virus
gcugcgcgcgcu

SEQ ID NO: 3107863 - RNA, 18 nt, Molluscum contagiosum virus
gcugcgcgcgcucgcgca

SEQ ID NO: 3107864 - RNA, 22 nt, Molluscum contagiosum virus
gcugcgcggcgccgcagcacgc

SEQ ID NO: 3107865 - RNA, 19 nt, Molluscum contagiosum virus
gcugcgcucggcgcgcgcc

SEQ ID NO: 3107866 - RNA, 19 nt, Molluscum contagiosum virus
gcugcgcuggaugcugcuc

SEQ ID NO: 3107867 - RNA, 20 nt, Molluscum contagiosum virus
gcugcgcuucgccgcgcgcg

SEQ ID NO: 3107868 - RNA, 20 nt, Molluscum contagiosum virus
gcugcgcuucuauugccgcg

SEQ ID NO: 3107869 - RNA, 23 nt, Molluscum contagiosum virus
gcugcggacgcgggccgcgcgca

SEQ ID NO: 3107870 - RNA, 13 nt, Molluscum contagiosum virus
gcugcggcgcucg

SEQ ID NO: 3107871 - RNA, 15 nt, Molluscum contagiosum virus
gcugccgcugcgcga

SEQ ID NO: 3107872 - RNA, 16 nt, Molluscum contagiosum virus
gcugccgcugcgcgac

SEQ ID NO: 3107873 - RNA, 18 nt, Molluscum contagiosum virus
gcugccgcuucgugcgcg

SEQ ID NO: 3107874 - RNA, 12 nt, Molluscum contagiosum virus
gcugcgugcgcg

SEQ ID NO: 3107875 - RNA, 14 nt, Molluscum contagiosum virus
gcugcgugugccgg

SEQ ID NO: 3107876 - RNA, 20 nt, Molluscum contagiosum virus
gcugcuacaagcggugcagc

SEQ ID NO: 3107877 - RNA, 19 nt, Molluscum contagiosum virus
gcugcuagagaaccugugc

SEQ ID NO: 3107878 - RNA, 14 nt, Molluscum contagiosum virus
gcugcugcgcacgu

SEQ ID NO: 3107879 - RNA, 15 nt, Molluscum contagiosum virus
gcugcugcgcgcgcu

SEQ ID NO: 3107880 - RNA, 14 nt, Molluscum contagiosum virus
gcugcugcucgcac

SEQ ID NO: 3107881 - RNA, 21 nt, Molluscum contagiosum virus
gcugcuggugcucgccugcau

SEQ ID NO: 3107882 - RNA, 21 nt, Molluscum contagiosum virus
gcugcucuacuuccacgagcu

SEQ ID NO: 3107883 - RNA, 16 nt, Molluscum contagiosum virus
gcugcucugcgugcuu

SEQ ID NO: 3107884 - RNA, 16 nt, Molluscum contagiosum virus
gcugccgucgcgcgcu

SEQ ID NO: 3107885 - RNA, 14 nt, Molluscum contagiosum virus
gcccuucuugacgc

SEQ ID NO: 3107886 - RNA, 22 nt, Molluscum contagiosum virus
gcccuucuugacgcgagacugu

SEQ ID NO: 3107887 - RNA, 22 nt, Molluscum contagiosum virus
gccgacgccuuccugcuggcgc

SEQ ID NO: 3107888 - RNA, 18 nt, Molluscum contagiosum virus
gccgaagucgcagcagcg

SEQ ID NO: 3107889 - RNA, 15 nt, Molluscum contagiosum virus
gccgaaucgucggca

SEQ ID NO: 3107890 - RNA, 15 nt, Molluscum contagiosum virus
gccgugucggcaccg

SEQ ID NO: 3107891 - RNA, 14 nt, Molluscum contagiosum virus
gccgugggcgccgc

SEQ ID NO: 3107892 - RNA, 16 nt, Molluscum contagiosum virus
gccgugguacacguag

SEQ ID NO: 3107893 - RNA, 23 nt, Molluscum contagiosum virus
gccuacgagcacauacacgcgca

SEQ ID NO: 3107894 - RNA, 16 nt, Molluscum contagiosum virus
gccuacgaggugcgcg

SEQ ID NO: 3107895 - RNA, 13 nt, Molluscum contagiosum virus
gccuacguggcgg

SEQ ID NO: 3107896 - RNA, 13 nt, Molluscum contagiosum virus
gccuagagcuggc

SEQ ID NO: 3107897 - RNA, 22 nt, Molluscum contagiosum virus
gccuagagcuggcaccgggcgc

SEQ ID NO: 3107898 - RNA, 19 nt, Molluscum contagiosum virus
gccggcgcccgcgugcacc

SEQ ID NO: 3107899 - RNA, 20 nt, Molluscum contagiosum virus
gccggcgcccgcgugcaccc

SEQ ID NO: 3107900 - RNA, 22 nt, Molluscum contagiosum virus
gccggcgcgcgcgcgcaggcuc

SEQ ID NO: 3107901 - RNA, 13 nt, Molluscum contagiosum virus
gccggcgcggcga

SEQ ID NO: 3107902 - RNA, 16 nt, Molluscum contagiosum virus
gccggcgcgugagcgc

SEQ ID NO: 3107903 - RNA, 21 nt, Molluscum contagiosum virus
gccggcgcuucuacugcgcac

SEQ ID NO: 3107904 - RNA, 22 nt, Molluscum contagiosum virus
gccgugcugucucucgcccgac

SEQ ID NO: 3107905 - RNA, 14 nt, Molluscum contagiosum virus
gccguggcgugcuu

SEQ ID NO: 3107906 - RNA, 17 nt, Molluscum contagiosum virus
gccggccuuguucgcgc

SEQ ID NO: 3107907 - RNA, 23 nt, Molluscum contagiosum virus
gccggcaacgcugccgcuggcgc

SEQ ID NO: 3107908 - RNA, 16 nt, Molluscum contagiosum virus
gccggaacucgcgcgc

SEQ ID NO: 3107909 - RNA, 20 nt, Molluscum contagiosum virus
gccggaccagauccgggcgc

SEQ ID NO: 3107910 - RNA, 20 nt, Molluscum contagiosum virus
gccggcacccgugcgcgcgc

SEQ ID NO: 3107911 - RNA, 13 nt, Molluscum contagiosum virus
gccggccccgcga

SEQ ID NO: 3107912 - RNA, 14 nt, Molluscum contagiosum virus
gccggccgccggcg

SEQ ID NO: 3107913 - RNA, 15 nt, Molluscum contagiosum virus
gccggccgccggcgc

SEQ ID NO: 3107914 - RNA, 21 nt, Molluscum contagiosum virus
gccgcuggugggcgugcggcg

SEQ ID NO: 3107915 - RNA, 15 nt, Molluscum contagiosum virus
gccgcuucgggcuca

SEQ ID NO: 3107916 - RNA, 15 nt, Molluscum contagiosum virus
gccgcuucgugcgcg

SEQ ID NO: 3107917 - RNA, 19 nt, Molluscum contagiosum virus
gccgcuucgugcgcggaga

SEQ ID NO: 3107918 - RNA, 15 nt, Molluscum contagiosum virus
gccgcuucuugacgc

SEQ ID NO: 3107919 - RNA, 17 nt, Molluscum contagiosum virus
gccgcuugaaggacgcg

SEQ ID NO: 3107920 - RNA, 12 nt, Molluscum contagiosum virus
gccgcugcgcau

SEQ ID NO: 3107921 - RNA, 13 nt, Molluscum contagiosum virus
gccgcugcgccgc

SEQ ID NO: 3107922 - RNA, 17 nt, Molluscum contagiosum virus
gccgcugcgccgccagc

SEQ ID NO: 3107923 - RNA, 13 nt, Molluscum contagiosum virus
gccgcugcgcgac

SEQ ID NO: 3107924 - RNA, 18 nt, Molluscum contagiosum virus
gccgcugcgcuugcucac

SEQ ID NO: 3107925 - RNA, 13 nt, Molluscum contagiosum virus
gccgcuggacgcc

SEQ ID NO: 3107926 - RNA, 14 nt, Molluscum contagiosum virus
gccgcuggacgccu

SEQ ID NO: 3107927 - RNA, 19 nt, Molluscum contagiosum virus
gccgcucguccagcugcgc

SEQ ID NO: 3107928 - RNA, 16 nt, Molluscum contagiosum virus
gccgcucgucgcugcg

SEQ ID NO: 3107929 - RNA, 19 nt, Molluscum contagiosum virus
gccgcucgcaagaguucaa

SEQ ID NO: 3107930 - RNA, 17 nt, Molluscum contagiosum virus
gccgcucggcccgcgga

SEQ ID NO: 3107931 - RNA, 16 nt, Molluscum contagiosum virus
gccgcugcccgcgcac

SEQ ID NO: 3107932 - RNA, 19 nt, Molluscum contagiosum virus
gccgcugccaacgcggacc

SEQ ID NO: 3107933 - RNA, 21 nt, Molluscum contagiosum virus
gccgcacgcugcugcgugcgc

SEQ ID NO: 3107934 - RNA, 14 nt, Molluscum contagiosum virus
gccgcacggcgccc

SEQ ID NO: 3107935 - RNA, 23 nt, Molluscum contagiosum virus
gccgcagagccgcgaaagcgucg

SEQ ID NO: 3107936 - RNA, 20 nt, Molluscum contagiosum virus
gccgcagcgcuggagcuggc

SEQ ID NO: 3107937 - RNA, 16 nt, Molluscum contagiosum virus
gccgcaggcgcgcgcc

SEQ ID NO: 3107938 - RNA, 17 nt, Molluscum contagiosum virus
gccgcagugcucgcaca

SEQ ID NO: 3107939 - RNA, 14 nt, Molluscum contagiosum virus
gccgccaccucggc

SEQ ID NO: 3107940 - RNA, 13 nt, Molluscum contagiosum virus
gccgccagcgacg

SEQ ID NO: 3107941 - RNA, 22 nt, Molluscum contagiosum virus
gccgccagcuccgcgcggcgcu

SEQ ID NO: 3107942 - RNA, 12 nt, Molluscum contagiosum virus
gccgcgugcccg

SEQ ID NO: 3107943 - RNA, 13 nt, Molluscum contagiosum virus
gccgcgugcgccg

SEQ ID NO: 3107944 - RNA, 14 nt, Molluscum contagiosum virus
gccgcgugcgcgcg

SEQ ID NO: 3107945 - RNA, 13 nt, Molluscum contagiosum virus
gccgcgugcucgu

SEQ ID NO: 3107946 - RNA, 15 nt, Molluscum contagiosum virus
gccgcgugcucgugu

SEQ ID NO: 3107947 - RNA, 11 nt, Molluscum contagiosum virus
gccgcgugcug

SEQ ID NO: 3107948 - RNA, 12 nt, Molluscum contagiosum virus
gccgcgugcugg

SEQ ID NO: 3107949 - RNA, 23 nt, Molluscum contagiosum virus
gccgcguagcuagcucugcgcgc

SEQ ID NO: 3107950 - RNA, 14 nt, Molluscum contagiosum virus
gccgccaugcugcg

SEQ ID NO: 3107951 - RNA, 17 nt, Molluscum contagiosum virus
gccgccaugcugcgcga

SEQ ID NO: 3107952 - RNA, 15 nt, Molluscum contagiosum virus
gccgagcucgccucc

SEQ ID NO: 3107953 - RNA, 16 nt, Molluscum contagiosum virus
gccgagauggagcuca

SEQ ID NO: 3107954 - RNA, 17 nt, Molluscum contagiosum virus
gccgagccgcuggccga

SEQ ID NO: 3107955 - RNA, 14 nt, Molluscum contagiosum virus
gccgagccggggga

SEQ ID NO: 3107956 - RNA, 17 nt, Molluscum contagiosum virus
gccgagcgccgccagcu

SEQ ID NO: 3107957 - RNA, 19 nt, Molluscum contagiosum virus
gccgagcggcaagccgugc

SEQ ID NO: 3107958 - RNA, 14 nt, Molluscum contagiosum virus
gccgagcgugacca

SEQ ID NO: 3107959 - RNA, 20 nt, Molluscum contagiosum virus
gccgaguaccgcgcgcacgc

SEQ ID NO: 3107960 - RNA, 15 nt, Molluscum contagiosum virus
gccgacagcgcgcgc

SEQ ID NO: 3107961 - RNA, 16 nt, Molluscum contagiosum virus
gccgacgugugccgcu

SEQ ID NO: 3107962 - RNA, 20 nt, Molluscum contagiosum virus
gccgacuuccgacgggccgc

SEQ ID NO: 3107963 - RNA, 21 nt, Molluscum contagiosum virus
gccgagaaaaagcugucgcgc

SEQ ID NO: 3107964 - RNA, 13 nt, Molluscum contagiosum virus
aagucugcgcagg

SEQ ID NO: 3107965 - RNA, 12 nt, Molluscum contagiosum virus
aagugcgcgugu

SEQ ID NO: 3107966 - RNA, 16 nt, Molluscum contagiosum virus
aagggcggucccgcga

SEQ ID NO: 3107967 - RNA, 17 nt, Molluscum contagiosum virus
aagguaccccgcaggaa

SEQ ID NO: 3107968 - RNA, 16 nt, Molluscum contagiosum virus
aagguacccgcaggaa

SEQ ID NO: 3107969 - RNA, 15 nt, Molluscum contagiosum virus
aaggcgggcccgcga

SEQ ID NO: 3107970 - RNA, 19 nt, Molluscum contagiosum virus
aaggcgguggcggcucugc

SEQ ID NO: 3107971 - RNA, 16 nt, Molluscum contagiosum virus
aaggcgugcgccgugc

SEQ ID NO: 3107972 - RNA, 15 nt, Molluscum contagiosum virus
aagguggccaagcgc

SEQ ID NO: 3107973 - RNA, 12 nt, Molluscum contagiosum virus
aaggcgccgcgu

SEQ ID NO: 3107974 - RNA, 24 nt, Molluscum contagiosum virus
aaguacaugaggcagugcuugagc

SEQ ID NO: 3107975 - RNA, 23 nt, Molluscum contagiosum virus
aaguaccagccgcugcgccgcca

SEQ ID NO: 3107976 - RNA, 16 nt, Molluscum contagiosum virus
aaggcacccgcaggaa

SEQ ID NO: 3107977 - RNA, 17 nt, Molluscum contagiosum virus
aaggccaaagccgcgga

SEQ ID NO: 3107978 - RNA, 15 nt, Molluscum contagiosum virus
aaggccguccccgga

SEQ ID NO: 3107979 - RNA, 19 nt, Molluscum contagiosum virus
aaggaaaaggcacaccccg

SEQ ID NO: 3107980 - RNA, 15 nt, Molluscum contagiosum virus
aaggagcccaagcac

SEQ ID NO: 3107981 - RNA, 18 nt, Molluscum contagiosum virus
aagcguacgcgucgcgga

SEQ ID NO: 3107982 - RNA, 12 nt, Molluscum contagiosum virus
aaugacgcgcac

SEQ ID NO: 3107983 - RNA, 21 nt, Molluscum contagiosum virus
acacguuggaggacguggaca

SEQ ID NO: 3107984 - RNA, 18 nt, Molluscum contagiosum virus
aaugcaugcggagcuggc

SEQ ID NO: 3107985 - RNA, 20 nt, Molluscum contagiosum virus
aaugcgguucacuagcgcag

SEQ ID NO: 3107986 - RNA, 22 nt, Molluscum contagiosum virus
aaugcgguucacuagcgcaggc

SEQ ID NO: 3107987 - RNA, 17 nt, Molluscum contagiosum virus
aaugcugccguguacgu

SEQ ID NO: 3107988 - RNA, 22 nt, Molluscum contagiosum virus
acaccuggcgagcgcucugcau

SEQ ID NO: 3107989 - RNA, 21 nt, Molluscum contagiosum virus
acacgaggggcaagcucgcgc

SEQ ID NO: 3107990 - RNA, 20 nt, Molluscum contagiosum virus
acacgccgggaaacgcacag

SEQ ID NO: 3107991 - RNA, 14 nt, Molluscum contagiosum virus
acacgcgcgcgugc

SEQ ID NO: 3107992 - RNA, 13 nt, Molluscum contagiosum virus
acacgcgcggcgg

SEQ ID NO: 3107993 - RNA, 15 nt, Molluscum contagiosum virus
acacgcgucgcgcag

SEQ ID NO: 3107994 - RNA, 17 nt, Molluscum contagiosum virus
acacgcucuucggcacg

SEQ ID NO: 3107995 - RNA, 14 nt, Molluscum contagiosum virus
acacgcuggcgaag

SEQ ID NO: 3107996 - RNA, 16 nt, Molluscum contagiosum virus
acacggauacgcgcac

SEQ ID NO: 3107997 - RNA, 23 nt, Molluscum contagiosum virus
acacgacgacggcugcucgcugc

SEQ ID NO: 3107998 - RNA, 21 nt, Molluscum contagiosum virus
acacugcagaaacagccgugc

SEQ ID NO: 3107999 - RNA, 16 nt, Molluscum contagiosum virus
acacucgugcucgugu

SEQ ID NO: 3108000 - RNA, 15 nt, Molluscum contagiosum virus
acacucuucgcaggc

SEQ ID NO: 3108001 - RNA, 13 nt, Molluscum contagiosum virus
acagacggcgcgc

SEQ ID NO: 3108002 - RNA, 15 nt, Molluscum contagiosum virus
acacuuuccgucguc

SEQ ID NO: 3108003 - RNA, 16 nt, Molluscum contagiosum virus
acacuuuccgucgucg

SEQ ID NO: 3108004 - RNA, 17 nt, Molluscum contagiosum virus
acacugucucugcgcga

SEQ ID NO: 3108005 - RNA, 18 nt, Molluscum contagiosum virus
acagccccugcugcucgc

SEQ ID NO: 3108006 - RNA, 21 nt, Molluscum contagiosum virus
acagccccugcugcucgcgga

SEQ ID NO: 3108007 - RNA, 15 nt, Molluscum contagiosum virus
acagccgccugccgc

SEQ ID NO: 3108008 - RNA, 16 nt, Molluscum contagiosum virus
acagccgccugccgcg

SEQ ID NO: 3108009 - RNA, 23 nt, Molluscum contagiosum virus
acagccgccugccgcgcucgugc

SEQ ID NO: 3108010 - RNA, 19 nt, Molluscum contagiosum virus
acagccgcuuucugggcgc

SEQ ID NO: 3108011 - RNA, 22 nt, Molluscum contagiosum virus
acagccuagaaacgacgggcgc

SEQ ID NO: 3108012 - RNA, 18 nt, Molluscum contagiosum virus
acagccuguguugcgcgc

SEQ ID NO: 3108013 - RNA, 12 nt, Molluscum contagiosum virus
acagcgcaagcu

SEQ ID NO: 3108014 - RNA, 14 nt, Molluscum contagiosum virus
acagcgcgcgcacg

SEQ ID NO: 3108015 - RNA, 13 nt, Molluscum contagiosum virus
acagcgcgcgugc

SEQ ID NO: 3108016 - RNA, 16 nt, Molluscum contagiosum virus
acagcaagcagcgcgc

SEQ ID NO: 3108017 - RNA, 16 nt, Molluscum contagiosum virus
acagcacggcacgugc

SEQ ID NO: 3108018 - RNA, 16 nt, Molluscum contagiosum virus
acagagugccuggcgc

SEQ ID NO: 3108019 - RNA, 17 nt, Molluscum contagiosum virus
acaugaucgacgaggac

SEQ ID NO: 3108020 - RNA, 16 nt, Molluscum contagiosum virus
acaugcaacgcaggac

SEQ ID NO: 3108021 - RNA, 23 nt, Molluscum contagiosum virus
acaugcacacucacgcguccaca

SEQ ID NO: 3108022 - RNA, 20 nt, Molluscum contagiosum virus
acaugcgcacgcgcgucaug

SEQ ID NO: 3108023 - RNA, 23 nt, Molluscum contagiosum virus
acaugcucgacgugaucgcgcag

SEQ ID NO: 3108024 - RNA, 22 nt, Molluscum contagiosum virus
acaugcucgcgcucuacgccag

SEQ ID NO: 3108025 - RNA, 16 nt, Molluscum contagiosum virus
acaugcuguccaccuc

SEQ ID NO: 3108026 - RNA, 17 nt, Molluscum contagiosum virus
acaugcugugcggcacg

SEQ ID NO: 3108027 - RNA, 17 nt, Molluscum contagiosum virus
acauggagcgcaucaug

SEQ ID NO: 3108028 - RNA, 15 nt, Molluscum contagiosum virus
acauccggcacgugc

SEQ ID NO: 3108029 - RNA, 23 nt, Molluscum contagiosum virus
acaucgacaagcacgucuuugac

SEQ ID NO: 3108030 - RNA, 13 nt, Molluscum contagiosum virus
acauguccaagaa

SEQ ID NO: 3108031 - RNA, 22 nt, Molluscum contagiosum virus
acaucaucgcggagcugcgcgc

SEQ ID NO: 3108032 - RNA, 14 nt, Molluscum contagiosum virus
acaggugcguaaug

SEQ ID NO: 3108033 - RNA, 18 nt, Molluscum contagiosum virus
acagcgugcgcgggcacg

SEQ ID NO: 3108034 - RNA, 21 nt, Molluscum contagiosum virus
acagcguguucggggccgcga

SEQ ID NO: 3108035 - RNA, 17 nt, Molluscum contagiosum virus
acagcuccccgcgcaag

SEQ ID NO: 3108036 - RNA, 17 nt, Molluscum contagiosum virus
acaguccaacccgcggc

SEQ ID NO: 3108037 - RNA, 17 nt, Molluscum contagiosum virus
acaguccagcccgcggu

SEQ ID NO: 3108038 - RNA, 17 nt, Molluscum contagiosum virus
acauguugugcucgugu

SEQ ID NO: 3108039 - RNA, 19 nt, Molluscum contagiosum virus
accaagguggggcgcaucc

SEQ ID NO: 3108040 - RNA, 15 nt, Molluscum contagiosum virus
accaagaagcccgag

SEQ ID NO: 3108041 - RNA, 12 nt, Molluscum contagiosum virus
accacacgcgcg

SEQ ID NO: 3108042 - RNA, 15 nt, Molluscum contagiosum virus
accagccgcugcgcc

SEQ ID NO: 3108043 - RNA, 20 nt, Molluscum contagiosum virus
accagcggcaggcggccgcg

SEQ ID NO: 3108044 - RNA, 23 nt, Molluscum contagiosum virus
accagcuacgagccgcugcuccu

SEQ ID NO: 3108045 - RNA, 19 nt, Molluscum contagiosum virus
accagcucgcgccgccgcg

SEQ ID NO: 3108046 - RNA, 17 nt, Molluscum contagiosum virus
accacuccgucgcgcuc

SEQ ID NO: 3108047 - RNA, 22 nt, Molluscum contagiosum virus
accagaaccuucuucgucgugc

SEQ ID NO: 3108048 - RNA, 15 nt, Molluscum contagiosum virus
accgagugcuggccg

SEQ ID NO: 3108049 - RNA, 19 nt, Molluscum contagiosum virus
accgcauuuguguugccga

SEQ ID NO: 3108050 - RNA, 20 nt, Molluscum contagiosum virus
accgcccuuguggacgcgcg

SEQ ID NO: 3108051 - RNA, 17 nt, Molluscum contagiosum virus
accgccugcugcagcuc

SEQ ID NO: 3108052 - RNA, 21 nt, Molluscum contagiosum virus
accgccuguaccugcucgggc

SEQ ID NO: 3108053 - RNA, 14 nt, Molluscum contagiosum virus
accgcggcgcggag

SEQ ID NO: 3108054 - RNA, 12 nt, Molluscum contagiosum virus
accgcgggcacg

SEQ ID NO: 3108055 - RNA, 14 nt, Molluscum contagiosum virus
accuacgcgccgac

SEQ ID NO: 3108056 - RNA, 14 nt, Molluscum contagiosum virus
accuagagcacgaa

SEQ ID NO: 3108057 - RNA, 17 nt, Molluscum contagiosum virus
accucaccucugcgcgg

SEQ ID NO: 3108058 - RNA, 14 nt, Molluscum contagiosum virus
accuccugcaccug

SEQ ID NO: 3108059 - RNA, 13 nt, Molluscum contagiosum virus
accucgcgcuucc

SEQ ID NO: 3108060 - RNA, 21 nt, Molluscum contagiosum virus
accguacucgcguccgcgcag

SEQ ID NO: 3108061 - RNA, 13 nt, Molluscum contagiosum virus
accgucaccgcag

SEQ ID NO: 3108062 - RNA, 18 nt, Molluscum contagiosum virus
acgacgggcgcgcuucuc

SEQ ID NO: 3108063 - RNA, 22 nt, Molluscum contagiosum virus
accgcuggggcgugacucggcc

SEQ ID NO: 3108064 - RNA, 21 nt, Molluscum contagiosum virus
accgcguugccgcccgccgag

SEQ ID NO: 3108065 - RNA, 13 nt, Molluscum contagiosum virus
accgcgucaagau

SEQ ID NO: 3108066 - RNA, 20 nt, Molluscum contagiosum virus
accgcgucaagaucaaccgc

SEQ ID NO: 3108067 - RNA, 13 nt, Molluscum contagiosum virus
accgcgugcgcag

SEQ ID NO: 3108068 - RNA, 16 nt, Molluscum contagiosum virus
accgcgugcgugcaca

SEQ ID NO: 3108069 - RNA, 22 nt, Molluscum contagiosum virus
accgcguggacaacagcacgac

SEQ ID NO: 3108070 - RNA, 22 nt, Molluscum contagiosum virus
accgcuucuuuacgggcgccag

SEQ ID NO: 3108071 - RNA, 20 nt, Molluscum contagiosum virus
accggccaaggcaaaguucu

SEQ ID NO: 3108072 - RNA, 13 nt, Molluscum contagiosum virus
accgggcgccgcg

SEQ ID NO: 3108073 - RNA, 20 nt, Molluscum contagiosum virus
accgggcacuucucgcgcga

SEQ ID NO: 3108074 - RNA, 15 nt, Molluscum contagiosum virus
aggcgggccugcgcc

SEQ ID NO: 3108075 - RNA, 17 nt, Molluscum contagiosum virus
aggcgcugucgcgcagg

SEQ ID NO: 3108076 - RNA, 19 nt, Molluscum contagiosum virus
aggcgcugucgcgcaggcu

SEQ ID NO: 3108077 - RNA, 23 nt, Molluscum contagiosum virus
aggcgcaccuugacgccgcgcgc

SEQ ID NO: 3108078 - RNA, 14 nt, Molluscum contagiosum virus
aggccggcacaagc

SEQ ID NO: 3108079 - RNA, 18 nt, Molluscum contagiosum virus
aggccggcacgagcaguc

SEQ ID NO: 3108080 - RNA, 21 nt, Molluscum contagiosum virus
aggcgccgcguacgcacgugc

SEQ ID NO: 3108081 - RNA, 17 nt, Molluscum contagiosum virus
aggcgcgccauggcgag

SEQ ID NO: 3108082 - RNA, 24 nt, Molluscum contagiosum virus
aggcgcgccauggcgagcuagugc

SEQ ID NO: 3108083 - RNA, 18 nt, Molluscum contagiosum virus
aggccgcccacgcucaac

SEQ ID NO: 3108084 - RNA, 14 nt, Molluscum contagiosum virus
aggccgagaugagc

SEQ ID NO: 3108085 - RNA, 19 nt, Molluscum contagiosum virus
aggccgagaugagcggcgc

SEQ ID NO: 3108086 - RNA, 23 nt, Molluscum contagiosum virus
aggccgggcgcgguagcucgugc

SEQ ID NO: 3108087 - RNA, 19 nt, Molluscum contagiosum virus
aggccggucgcggaagacg

SEQ ID NO: 3108088 - RNA, 22 nt, Molluscum contagiosum virus
aggccgucagcgucgacggcgc

SEQ ID NO: 3108089 - RNA, 21 nt, Molluscum contagiosum virus
aggccguccccggaaagcagc

SEQ ID NO: 3108090 - RNA, 16 nt, Molluscum contagiosum virus
aggccucagccgagcg

SEQ ID NO: 3108091 - RNA, 15 nt, Molluscum contagiosum virus
aggccugcguggaca

SEQ ID NO: 3108092 - RNA, 17 nt, Molluscum contagiosum virus
aggccuucgcgcccgac

SEQ ID NO: 3108093 - RNA, 19 nt, Molluscum contagiosum virus
aggccuucgcgcccgacga

SEQ ID NO: 3108094 - RNA, 22 nt, Molluscum contagiosum virus
aggccuucgcgcccgacgagcu

SEQ ID NO: 3108095 - RNA, 15 nt, Molluscum contagiosum virus
auacuucaacuacaa

SEQ ID NO: 3108096 - RNA, 10 nt, Molluscum contagiosum virus
auacgcgcuc

SEQ ID NO: 3108097 - RNA, 16 nt, Molluscum contagiosum virus
auagcccaugcgcagu

SEQ ID NO: 3108098 - RNA, 17 nt, Molluscum contagiosum virus
auaguccccggcgccgg

SEQ ID NO: 3108099 - RNA, 14 nt, Molluscum contagiosum virus
agggaggcucgagc

SEQ ID NO: 3108100 - RNA, 22 nt, Molluscum contagiosum virus
agggaggcucgagcgcgcgccu

SEQ ID NO: 3108101 - RNA, 15 nt, Molluscum contagiosum virus
agggcgcgcgucgag

SEQ ID NO: 3108102 - RNA, 15 nt, Molluscum contagiosum virus
agggcacgcugcaca

SEQ ID NO: 3108103 - RNA, 19 nt, Molluscum contagiosum virus
aggcuucgaggugcgcgag

SEQ ID NO: 3108104 - RNA, 21 nt, Molluscum contagiosum virus
aggcuuucuuccucgacgagg

SEQ ID NO: 3108105 - RNA, 17 nt, Molluscum contagiosum virus
aggcggugggcgccgcg

SEQ ID NO: 3108106 - RNA, 16 nt, Molluscum contagiosum virus
aggcgucaugcgcgcg

SEQ ID NO: 3108107 - RNA, 16 nt, Molluscum contagiosum virus
aggcguccugcgggag

SEQ ID NO: 3108108 - RNA, 14 nt, Molluscum contagiosum virus
aggcucgagcgcgc

SEQ ID NO: 3108109 - RNA, 15 nt, Molluscum contagiosum virus
aggcucgagcugcau

SEQ ID NO: 3108110 - RNA, 23 nt, Molluscum contagiosum virus
aggcucuguucugcuuggacgac

SEQ ID NO: 3108111 - RNA, 14 nt, Molluscum contagiosum virus
acgcaaaugcgcgc

SEQ ID NO: 3108112 - RNA, 21 nt, Molluscum contagiosum virus
acgcaaccuacuugcucgugu

SEQ ID NO: 3108113 - RNA, 14 nt, Molluscum contagiosum virus
acgcaacugcccgc

SEQ ID NO: 3108114 - RNA, 23 nt, Molluscum contagiosum virus
acgaucuucuucuugcgcaccuc

SEQ ID NO: 3108115 - RNA, 22 nt, Molluscum contagiosum virus
acgaugcaaacauguagcgcgc

SEQ ID NO: 3108116 - RNA, 15 nt, Molluscum contagiosum virus
acgaugcgcucgugg

SEQ ID NO: 3108117 - RNA, 16 nt, Molluscum contagiosum virus
acgagugcccgcgcgc

SEQ ID NO: 3108118 - RNA, 15 nt, Molluscum contagiosum virus
acgagugcgccgcgc

SEQ ID NO: 3108119 - RNA, 22 nt, Molluscum contagiosum virus
acgauuccgcuguacgugcugc

SEQ ID NO: 3108120 - RNA, 16 nt, Molluscum contagiosum virus
acgcaagcccgcgcgc

SEQ ID NO: 3108121 - RNA, 19 nt, Molluscum contagiosum virus
acgcaagcccgcgcgcgag

SEQ ID NO: 3108122 - RNA, 15 nt, Molluscum contagiosum virus
acgcaagcguacgcg

SEQ ID NO: 3108123 - RNA, 18 nt, Molluscum contagiosum virus
acgcaagcugaggcgugc

SEQ ID NO: 3108124 - RNA, 17 nt, Molluscum contagiosum virus
acgcaaggcaugcgcgc

SEQ ID NO: 3108125 - RNA, 17 nt, Molluscum contagiosum virus
acgcaaggugugcgcgc

SEQ ID NO: 3108126 - RNA, 14 nt, Molluscum contagiosum virus
acgcaaucgcgcgc

SEQ ID NO: 3108127 - RNA, 15 nt, Molluscum contagiosum virus
acgcacaaaacacaa

SEQ ID NO: 3108128 - RNA, 22 nt, Molluscum contagiosum virus
acgcacacgagugcccgcgcgc

SEQ ID NO: 3108129 - RNA, 14 nt, Molluscum contagiosum virus
acgcacacucgcgc

SEQ ID NO: 3108130 - RNA, 18 nt, Molluscum contagiosum virus
acgcacacucgcgcgucc

SEQ ID NO: 3108131 - RNA, 23 nt, Molluscum contagiosum virus
acgcaccgccuggugcugcgcga

SEQ ID NO: 3108132 - RNA, 17 nt, Molluscum contagiosum virus
acgcacgcacguggcgc

SEQ ID NO: 3108133 - RNA, 18 nt, Molluscum contagiosum virus
aggccagcacaagccguc

SEQ ID NO: 3108134 - RNA, 22 nt, Molluscum contagiosum virus
aggcccacuuccgugagcaguc

SEQ ID NO: 3108135 - RNA, 15 nt, Molluscum contagiosum virus
acgacuagcgugcgc

SEQ ID NO: 3108136 - RNA, 23 nt, Molluscum contagiosum virus
acgacugcuuugacacgcucauc

SEQ ID NO: 3108137 - RNA, 16 nt, Molluscum contagiosum virus
acgacuuccgcggcgu

SEQ ID NO: 3108138 - RNA, 21 nt, Molluscum contagiosum virus
acgacuuccgcggcgugcagg

SEQ ID NO: 3108139 - RNA, 16 nt, Molluscum contagiosum virus
acgagaaaugcgcaca

SEQ ID NO: 3108140 - RNA, 12 nt, Molluscum contagiosum virus
acgagagggcgc

SEQ ID NO: 3108141 - RNA, 19 nt, Molluscum contagiosum virus
acgagaugggcccgcgcgc

SEQ ID NO: 3108142 - RNA, 20 nt, Molluscum contagiosum virus
acgagauggucacgcgcaag

SEQ ID NO: 3108143 - RNA, 18 nt, Molluscum contagiosum virus
acgagcacugccugccgc

SEQ ID NO: 3108144 - RNA, 23 nt, Molluscum contagiosum virus
acgagcacugccugccgccucgg

SEQ ID NO: 3108145 - RNA, 17 nt, Molluscum contagiosum virus
acgagcagcccgugcgc

SEQ ID NO: 3108146 - RNA, 19 nt, Molluscum contagiosum virus
acgagcagcgcuugcgcgc

SEQ ID NO: 3108147 - RNA, 17 nt, Molluscum contagiosum virus
acgagcagcugcugcgc

SEQ ID NO: 3108148 - RNA, 14 nt, Molluscum contagiosum virus
acgagcaggcgcag

SEQ ID NO: 3108149 - RNA, 16 nt, Molluscum contagiosum virus
acgagcaggcgcagcg

SEQ ID NO: 3108150 - RNA, 16 nt, Molluscum contagiosum virus
acgagccccgcgccgg

SEQ ID NO: 3108151 - RNA, 14 nt, Molluscum contagiosum virus
acgagcgcaucagc

SEQ ID NO: 3108152 - RNA, 20 nt, Molluscum contagiosum virus
acgagcgccagccugugcgc

SEQ ID NO: 3108153 - RNA, 13 nt, Molluscum contagiosum virus
acgagcgccgcga

SEQ ID NO: 3108154 - RNA, 16 nt, Molluscum contagiosum virus
acgagcugcugcccgc

SEQ ID NO: 3108155 - RNA, 16 nt, Molluscum contagiosum virus
acgagcugcugcgcgc

SEQ ID NO: 3108156 - RNA, 14 nt, Molluscum contagiosum virus
acgagcugugcgag

SEQ ID NO: 3108157 - RNA, 22 nt, Molluscum contagiosum virus
acgaggccuacgugcugcgcac

SEQ ID NO: 3108158 - RNA, 16 nt, Molluscum contagiosum virus
acgagggaugcgcaca

SEQ ID NO: 3108159 - RNA, 23 nt, Molluscum contagiosum virus
acgaggucgcguccacgcaggac

SEQ ID NO: 3108160 - RNA, 13 nt, Molluscum contagiosum virus
acgaggugcgcgc

SEQ ID NO: 3108161 - RNA, 16 nt, Molluscum contagiosum virus
acgagcgcgugccgcu

SEQ ID NO: 3108162 - RNA, 17 nt, Molluscum contagiosum virus
acgaggagcacggcauc

SEQ ID NO: 3108163 - RNA, 21 nt, Molluscum contagiosum virus
caaucccacguacgagcagcu

SEQ ID NO: 3108164 - RNA, 14 nt, Molluscum contagiosum virus
caauacccgcuucc

SEQ ID NO: 3108165 - RNA, 18 nt, Molluscum contagiosum virus
caaugcagugcaccagca

SEQ ID NO: 3108166 - RNA, 17 nt, Molluscum contagiosum virus
caaugcgcacgugcucg

SEQ ID NO: 3108167 - RNA, 18 nt, Molluscum contagiosum virus
caaugcgcacgugcucgc

SEQ ID NO: 3108168 - RNA, 16 nt, Molluscum contagiosum virus
caauggcgcgcgagca

SEQ ID NO: 3108169 - RNA, 21 nt, Molluscum contagiosum virus
caauggcgcgcgagcacagcg

SEQ ID NO: 3108170 - RNA, 14 nt, Molluscum contagiosum virus
caagaugacgacgg

SEQ ID NO: 3108171 - RNA, 14 nt, Molluscum contagiosum virus
caagauucugcgga

SEQ ID NO: 3108172 - RNA, 16 nt, Molluscum contagiosum virus
caagucgcgcgcugcg

SEQ ID NO: 3108173 - RNA, 21 nt, Molluscum contagiosum virus
caagucggggcccucggcgcg

SEQ ID NO: 3108174 - RNA, 19 nt, Molluscum contagiosum virus
caagucguuugcucggggc

SEQ ID NO: 3108175 - RNA, 15 nt, Molluscum contagiosum virus
caagucucccucgcg

SEQ ID NO: 3108176 - RNA, 18 nt, Molluscum contagiosum virus
caacguaguacugcagca

SEQ ID NO: 3108177 - RNA, 22 nt, Molluscum contagiosum virus
caacguaguacugcagcagcuc

SEQ ID NO: 3108178 - RNA, 22 nt, Molluscum contagiosum virus
caacuugcucuacuggcggcgc

SEQ ID NO: 3108179 - RNA, 14 nt, Molluscum contagiosum virus
caacuugggcccgc

SEQ ID NO: 3108180 - RNA, 19 nt, Molluscum contagiosum virus
caacuacaaggugcugucc

SEQ ID NO: 3108181 - RNA, 15 nt, Molluscum contagiosum virus
caagaagacggcgcg

SEQ ID NO: 3108182 - RNA, 21 nt, Molluscum contagiosum virus
caagaagacggcgcgcgcgcu

SEQ ID NO: 3108183 - RNA, 20 nt, Molluscum contagiosum virus
caagaagaucgcggcgccgc

SEQ ID NO: 3108184 - RNA, 21 nt, Molluscum contagiosum virus
caagaccgugacggccgugua

SEQ ID NO: 3108185 - RNA, 15 nt, Molluscum contagiosum virus
caagacgcugcuggc

SEQ ID NO: 3108186 - RNA, 13 nt, Molluscum contagiosum virus
caagacgggcacg

SEQ ID NO: 3108187 - RNA, 19 nt, Molluscum contagiosum virus
caagacucgcccgcgcgcg

SEQ ID NO: 3108188 - RNA, 19 nt, Molluscum contagiosum virus
caacgggcucgugcuggag

SEQ ID NO: 3108189 - RNA, 13 nt, Molluscum contagiosum virus
caacgcgcgcgcg

SEQ ID NO: 3108190 - RNA, 13 nt, Molluscum contagiosum virus
caacgcggacgcg

SEQ ID NO: 3108191 - RNA, 20 nt, Molluscum contagiosum virus
caacgucgcacuggccugca

SEQ ID NO: 3108192 - RNA, 14 nt, Molluscum contagiosum virus
caacgugcugcgcc

SEQ ID NO: 3108193 - RNA, 16 nt, Molluscum contagiosum virus
caacgugcugcgccgc

SEQ ID NO: 3108194 - RNA, 14 nt, Molluscum contagiosum virus
caacgugcugcuca

SEQ ID NO: 3108195 - RNA, 16 nt, Molluscum contagiosum virus
caacgcacccgcgcgg

SEQ ID NO: 3108196 - RNA, 14 nt, Molluscum contagiosum virus
caacgccgggcacg

SEQ ID NO: 3108197 - RNA, 21 nt, Molluscum contagiosum virus
caacgccuaccaccgggcacu

SEQ ID NO: 3108198 - RNA, 20 nt, Molluscum contagiosum virus
aucccggaacgcaaguacaa

SEQ ID NO: 3108199 - RNA, 21 nt, Molluscum contagiosum virus
auccgcaauuacgugcgcgag

SEQ ID NO: 3108200 - RNA, 20 nt, Molluscum contagiosum virus
auccgcaauucuagcgcgag

SEQ ID NO: 3108201 - RNA, 15 nt, Molluscum contagiosum virus
aucgacgagcacgag

SEQ ID NO: 3108202 - RNA, 16 nt, Molluscum contagiosum virus
aucgagcugguggccu

SEQ ID NO: 3108203 - RNA, 23 nt, Molluscum contagiosum virus
caaccgcaaggaaaacugcaucc

SEQ ID NO: 3108204 - RNA, 15 nt, Molluscum contagiosum virus
caaccuccugcaccu

SEQ ID NO: 3108205 - RNA, 19 nt, Molluscum contagiosum virus
caaccuccugcaccugcug

SEQ ID NO: 3108206 - RNA, 21 nt, Molluscum contagiosum virus
caaccuccugcaccugcugga

SEQ ID NO: 3108207 - RNA, 23 nt, Molluscum contagiosum virus
caaccuguuaaauggacgugcuc

SEQ ID NO: 3108208 - RNA, 19 nt, Molluscum contagiosum virus
caacgacuagcgugcgcag

SEQ ID NO: 3108209 - RNA, 20 nt, Molluscum contagiosum virus
caacgagcacgugugcggag

SEQ ID NO: 3108210 - RNA, 15 nt, Molluscum contagiosum virus
caacgagcgcaucag

SEQ ID NO: 3108211 - RNA, 14 nt, Molluscum contagiosum virus
caacgaggucuucc

SEQ ID NO: 3108212 - RNA, 16 nt, Molluscum contagiosum virus
caaccagcuggcgccc

SEQ ID NO: 3108213 - RNA, 20 nt, Molluscum contagiosum virus
caacauuuacuucgggcgca

SEQ ID NO: 3108214 - RNA, 15 nt, Molluscum contagiosum virus
caaccacagcucucc

SEQ ID NO: 3108215 - RNA, 15 nt, Molluscum contagiosum virus
auccaaacccccgag

SEQ ID NO: 3108216 - RNA, 19 nt, Molluscum contagiosum virus
auccacauuacgcucgugg

SEQ ID NO: 3108217 - RNA, 21 nt, Molluscum contagiosum virus
auccagcgcaucaugcgcuuc

SEQ ID NO: 3108218 - RNA, 20 nt, Molluscum contagiosum virus
aucagcuccgacgugaccuc

SEQ ID NO: 3108219 - RNA, 22 nt, Molluscum contagiosum virus
aucaaggauuuaaauggcgcgc

SEQ ID NO: 3108220 - RNA, 18 nt, Molluscum contagiosum virus
aucaaggccuacggcaag

SEQ ID NO: 3108221 - RNA, 16 nt, Molluscum contagiosum virus
auaucugucgccgcgg

SEQ ID NO: 3108222 - RNA, 18 nt, Molluscum contagiosum virus
auauggccgugcgcgacg

SEQ ID NO: 3108223 - RNA, 17 nt, Molluscum contagiosum virus
aucacgaugugcgcgcg

SEQ ID NO: 3108224 - RNA, 17 nt, Molluscum contagiosum virus
aucacggcgugcgcgag

SEQ ID NO: 3108225 - RNA, 17 nt, Molluscum contagiosum virus
aucagagaagugcuccg

SEQ ID NO: 3108226 - RNA, 18 nt, Molluscum contagiosum virus
caggcagugccgccgcgc

SEQ ID NO: 3108227 - RNA, 21 nt, Molluscum contagiosum virus
caggcagugccgccgcgcgcg

SEQ ID NO: 3108228 - RNA, 19 nt, Molluscum contagiosum virus
caggcacuccagcgcgccc

SEQ ID NO: 3108229 - RNA, 15 nt, Molluscum contagiosum virus
caggcagcugcugcg

SEQ ID NO: 3108230 - RNA, 15 nt, Molluscum contagiosum virus
caggacgugcacgug

SEQ ID NO: 3108231 - RNA, 14 nt, Molluscum contagiosum virus
caggaccugcuggu

SEQ ID NO: 3108232 - RNA, 18 nt, Molluscum contagiosum virus
caggaccuuaacgccguc

SEQ ID NO: 3108233 - RNA, 18 nt, Molluscum contagiosum virus
caggaucggagcgcagcu

SEQ ID NO: 3108234 - RNA, 17 nt, Molluscum contagiosum virus
caggaggaccgcgagcg

SEQ ID NO: 3108235 - RNA, 19 nt, Molluscum contagiosum virus
caggaaaggcaccccgcag

SEQ ID NO: 3108236 - RNA, 18 nt, Molluscum contagiosum virus
caggaaaggcacccgcag

SEQ ID NO: 3108237 - RNA, 19 nt, Molluscum contagiosum virus
caggaaagguaccccgcag

SEQ ID NO: 3108238 - RNA, 18 nt, Molluscum contagiosum virus
caggaaagguacccgcag

SEQ ID NO: 3108239 - RNA, 18 nt, Molluscum contagiosum virus
caggaacgcaccacggcc

SEQ ID NO: 3108240 - RNA, 14 nt, Molluscum contagiosum virus
caggaacgccgcca

SEQ ID NO: 3108241 - RNA, 16 nt, Molluscum contagiosum virus
caggaacgcgccgcgg

SEQ ID NO: 3108242 - RNA, 14 nt, Molluscum contagiosum virus
caggaacgcgcgcu

SEQ ID NO: 3108243 - RNA, 18 nt, Molluscum contagiosum virus
caggaacugcccgcgucg

SEQ ID NO: 3108244 - RNA, 15 nt, Molluscum contagiosum virus
caggaagcuggcgcg

SEQ ID NO: 3108245 - RNA, 17 nt, Molluscum contagiosum virus
caggaagcuggcgcggu

SEQ ID NO: 3108246 - RNA, 18 nt, Molluscum contagiosum virus
cacacuacgcuggcucgc

SEQ ID NO: 3108247 - RNA, 15 nt, Molluscum contagiosum virus
cacacucacgcgucc

SEQ ID NO: 3108248 - RNA, 19 nt, Molluscum contagiosum virus
cagcuaccgcgcgcgcaag

SEQ ID NO: 3108249 - RNA, 19 nt, Molluscum contagiosum virus
cagcuacgagccgcugcuc

SEQ ID NO: 3108250 - RNA, 20 nt, Molluscum contagiosum virus
cagcuacgagccgcugcucc

SEQ ID NO: 3108251 - RNA, 18 nt, Molluscum contagiosum virus
cagcucaagacgcugcug

SEQ ID NO: 3108252 - RNA, 15 nt, Molluscum contagiosum virus
cagcucaagcugcuc

SEQ ID NO: 3108253 - RNA, 16 nt, Molluscum contagiosum virus
cagcucaagcugcuca

SEQ ID NO: 3108254 - RNA, 21 nt, Molluscum contagiosum virus
cagcucacgagauggcugcuc

SEQ ID NO: 3108255 - RNA, 16 nt, Molluscum contagiosum virus
cagcucauagcccaug

SEQ ID NO: 3108256 - RNA, 15 nt, Molluscum contagiosum virus
cagcuccgcgcggcg

SEQ ID NO: 3108257 - RNA, 13 nt, Molluscum contagiosum virus
cagcucgccgcgc

SEQ ID NO: 3108258 - RNA, 17 nt, Molluscum contagiosum virus
cagcucgccgcgcgccg

SEQ ID NO: 3108259 - RNA, 12 nt, Molluscum contagiosum virus
cagcucgcgcag

SEQ ID NO: 3108260 - RNA, 18 nt, Molluscum contagiosum virus
cagcucgcgccgccgcgc

SEQ ID NO: 3108261 - RNA, 16 nt, Molluscum contagiosum virus
cacaagauggcgcagc

SEQ ID NO: 3108262 - RNA, 16 nt, Molluscum contagiosum virus
cacaaagacggggccg

SEQ ID NO: 3108263 - RNA, 18 nt, Molluscum contagiosum virus
cacaaagagacgcggccg

SEQ ID NO: 3108264 - RNA, 19 nt, Molluscum contagiosum virus
cacaaagccaaccccgagc

SEQ ID NO: 3108265 - RNA, 20 nt, Molluscum contagiosum virus
cacaaagggguccgcgucug

SEQ ID NO: 3108266 - RNA, 20 nt, Molluscum contagiosum virus
caauucaaaggugcucaccc

SEQ ID NO: 3108267 - RNA, 12 nt, Molluscum contagiosum virus
cagcugcgcgag

SEQ ID NO: 3108268 - RNA, 15 nt, Molluscum contagiosum virus
cagcugcgcgagccg

SEQ ID NO: 3108269 - RNA, 21 nt, Molluscum contagiosum virus
cagcugcugcgcuucgccgcg

SEQ ID NO: 3108270 - RNA, 22 nt, Molluscum contagiosum virus
cagcugcugcgcuucgccgcgc

SEQ ID NO: 3108271 - RNA, 20 nt, Molluscum contagiosum virus
cacaagucucgcgcgggcag

SEQ ID NO: 3108272 - RNA, 18 nt, Molluscum contagiosum virus
cagcugcaggaccugcug

SEQ ID NO: 3108273 - RNA, 16 nt, Molluscum contagiosum virus
cagcuucgcgagcccg

SEQ ID NO: 3108274 - RNA, 19 nt, Molluscum contagiosum virus
cagcugcugucgcucgugg

SEQ ID NO: 3108275 - RNA, 15 nt, Molluscum contagiosum virus
cagcuggagcugccg

SEQ ID NO: 3108276 - RNA, 15 nt, Molluscum contagiosum virus
cagcuggcgcccgcg

SEQ ID NO: 3108277 - RNA, 16 nt, Molluscum contagiosum virus
cagcuggcgcgcgccg

SEQ ID NO: 3108278 - RNA, 15 nt, Molluscum contagiosum virus
cacaccgcguggaca

SEQ ID NO: 3108279 - RNA, 10 nt, Molluscum contagiosum virus
cacacacacu

SEQ ID NO: 3108280 - RNA, 14 nt, Molluscum contagiosum virus
cacacaccgcgagc

SEQ ID NO: 3108281 - RNA, 15 nt, Molluscum contagiosum virus
cacacacgaacgcac

SEQ ID NO: 3108282 - RNA, 20 nt, Molluscum contagiosum virus
cacacacuugcacgcgcacg

SEQ ID NO: 3108283 - RNA, 16 nt, Molluscum contagiosum virus
cagcucggcgagagcg

SEQ ID NO: 3108284 - RNA, 20 nt, Molluscum contagiosum virus
cagcucggcgagagcgcgca

SEQ ID NO: 3108285 - RNA, 21 nt, Molluscum contagiosum virus
cagcucggcgagagcgcgcag

SEQ ID NO: 3108286 - RNA, 17 nt, Molluscum contagiosum virus
cagcucguugcgcagcc

SEQ ID NO: 3108287 - RNA, 13 nt, Molluscum contagiosum virus
cacacgcgcggcg

SEQ ID NO: 3108288 - RNA, 22 nt, Molluscum contagiosum virus
cacacgcgucgcgcaggcgccc

SEQ ID NO: 3108289 - RNA, 22 nt, Molluscum contagiosum virus
cacacgcugaguuacguggccg

SEQ ID NO: 3108290 - RNA, 14 nt, Molluscum contagiosum virus
cacacggacgagcc

SEQ ID NO: 3108291 - RNA, 22 nt, Molluscum contagiosum virus
ccauuuuuugccccgcgcgccc

SEQ ID NO: 3108292 - RNA, 16 nt, Molluscum contagiosum virus
cccaaggccgcgggcg

SEQ ID NO: 3108293 - RNA, 19 nt, Molluscum contagiosum virus
cccaaggccgcgggcgcgg

SEQ ID NO: 3108294 - RNA, 14 nt, Molluscum contagiosum virus
cccaagugcgcgug

SEQ ID NO: 3108295 - RNA, 16 nt, Molluscum contagiosum virus
ccauggucacgcgcac

SEQ ID NO: 3108296 - RNA, 17 nt, Molluscum contagiosum virus
ccauggucacgcgcacg

SEQ ID NO: 3108297 - RNA, 14 nt, Molluscum contagiosum virus
ccaugucgagcccu

SEQ ID NO: 3108298 - RNA, 22 nt, Molluscum contagiosum virus
ccaugucgcgcaucaccgagcg

SEQ ID NO: 3108299 - RNA, 17 nt, Molluscum contagiosum virus
ccaugucugugcgcgag

SEQ ID NO: 3108300 - RNA, 21 nt, Molluscum contagiosum virus
ccaugugcccgcggcgcgaaa

SEQ ID NO: 3108301 - RNA, 21 nt, Molluscum contagiosum virus
ccauguuuccugcggcgcugc

SEQ ID NO: 3108302 - RNA, 20 nt, Molluscum contagiosum virus
cccaaaagugaagaucaagc

SEQ ID NO: 3108303 - RNA, 12 nt, Molluscum contagiosum virus
cccacgcuggcg

SEQ ID NO: 3108304 - RNA, 23 nt, Molluscum contagiosum virus
ccaucggagaagugcuccgcacg

SEQ ID NO: 3108305 - RNA, 14 nt, Molluscum contagiosum virus
ccaucugcgcgacg

SEQ ID NO: 3108306 - RNA, 19 nt, Molluscum contagiosum virus
ccaucuccaagcacgcgcg

SEQ ID NO: 3108307 - RNA, 18 nt, Molluscum contagiosum virus
ccaugaucauggcgccgc

SEQ ID NO: 3108308 - RNA, 20 nt, Molluscum contagiosum virus
ccauggacacgcugcgcgug

SEQ ID NO: 3108309 - RNA, 15 nt, Molluscum contagiosum virus
ccauggaggcgcuag

SEQ ID NO: 3108310 - RNA, 17 nt, Molluscum contagiosum virus
ccaugcccacgcgcaag

SEQ ID NO: 3108311 - RNA, 15 nt, Molluscum contagiosum virus
cccagcaccgcgccg

SEQ ID NO: 3108312 - RNA, 22 nt, Molluscum contagiosum virus
cccagcaccuggaacgcgaccu

SEQ ID NO: 3108313 - RNA, 16 nt, Molluscum contagiosum virus
cccagcagcgaggccg

SEQ ID NO: 3108314 - RNA, 19 nt, Molluscum contagiosum virus
ccccggcguccggcgcucg

SEQ ID NO: 3108315 - RNA, 23 nt, Molluscum contagiosum virus
ccccuugcgucuccgcgaguccu

SEQ ID NO: 3108316 - RNA, 18 nt, Molluscum contagiosum virus
cccgaacugcugggcgug

SEQ ID NO: 3108317 - RNA, 14 nt, Molluscum contagiosum virus
ccccugagcgaguu

SEQ ID NO: 3108318 - RNA, 19 nt, Molluscum contagiosum virus
ccccugcugcucgcggagg

SEQ ID NO: 3108319 - RNA, 21 nt, Molluscum contagiosum virus
cccgaguuccuguugcgcgag

SEQ ID NO: 3108320 - RNA, 23 nt, Molluscum contagiosum virus
cccgaguuccuguugcgcgagcg

SEQ ID NO: 3108321 - RNA, 16 nt, Molluscum contagiosum virus
cccgagcccgagcccg

SEQ ID NO: 3108322 - RNA, 15 nt, Molluscum contagiosum virus
cccgagcccgcggcg

SEQ ID NO: 3108323 - RNA, 22 nt, Molluscum contagiosum virus
cccgagcccgcggcgcgcagcu

SEQ ID NO: 3108324 - RNA, 14 nt, Molluscum contagiosum virus
cccgagcgcgcgug

SEQ ID NO: 3108325 - RNA, 22 nt, Molluscum contagiosum virus
cccgccgaguaccgcgcgcacg

SEQ ID NO: 3108326 - RNA, 20 nt, Molluscum contagiosum virus
cccgagcugcggcgcgugcu

SEQ ID NO: 3108327 - RNA, 15 nt, Molluscum contagiosum virus
cccgagcugcgugug

SEQ ID NO: 3108328 - RNA, 17 nt, Molluscum contagiosum virus
cccgagcugcgugugcc

SEQ ID NO: 3108329 - RNA, 22 nt, Molluscum contagiosum virus
cccgaggacgagccccgcgccg

SEQ ID NO: 3108330 - RNA, 12 nt, Molluscum contagiosum virus
cccgaggacgcg

SEQ ID NO: 3108331 - RNA, 16 nt, Molluscum contagiosum virus
cccgaggacgcgggcg

SEQ ID NO: 3108332 - RNA, 21 nt, Molluscum contagiosum virus
cccgaggacgcgggcgugucc

SEQ ID NO: 3108333 - RNA, 17 nt, Molluscum contagiosum virus
cccgaggagagcggcgc

SEQ ID NO: 3108334 - RNA, 23 nt, Molluscum contagiosum virus
cccgagggcgcgaccggcgugcc

SEQ ID NO: 3108335 - RNA, 13 nt, Molluscum contagiosum virus
cccgacucgcagc

SEQ ID NO: 3108336 - RNA, 19 nt, Molluscum contagiosum virus
cccgacuucucgcgcgacu

SEQ ID NO: 3108337 - RNA, 16 nt, Molluscum contagiosum virus
cccgacuuuucgcgcc

SEQ ID NO: 3108338 - RNA, 22 nt, Molluscum contagiosum virus
cccgacacguugcacugcgcgg

SEQ ID NO: 3108339 - RNA, 17 nt, Molluscum contagiosum virus
cccuacgcgcgcgugcu

SEQ ID NO: 3108340 - RNA, 16 nt, Molluscum contagiosum virus
cccgugugcgggcacg

SEQ ID NO: 3108341 - RNA, 17 nt, Molluscum contagiosum virus
cccguguucgcggagcu

SEQ ID NO: 3108342 - RNA, 22 nt, Molluscum contagiosum virus
cccguggugggccgcggcgcgg

SEQ ID NO: 3108343 - RNA, 19 nt, Molluscum contagiosum virus
cccucgcgcgcgcgcggcg

SEQ ID NO: 3108344 - RNA, 14 nt, Molluscum contagiosum virus
cccucggcgcgccg

SEQ ID NO: 3108345 - RNA, 17 nt, Molluscum contagiosum virus
cccucguccggcgcucg

SEQ ID NO: 3108346 - RNA, 16 nt, Molluscum contagiosum virus
cccucgucgcgcuucc

SEQ ID NO: 3108347 - RNA, 17 nt, Molluscum contagiosum virus
cccucguguacgagaag

SEQ ID NO: 3108348 - RNA, 20 nt, Molluscum contagiosum virus
cccggguuugugcccgagcu

SEQ ID NO: 3108349 - RNA, 13 nt, Molluscum contagiosum virus
cccgccgggcacc

SEQ ID NO: 3108350 - RNA, 13 nt, Molluscum contagiosum virus
cccgccgcgugcc

SEQ ID NO: 3108351 - RNA, 17 nt, Molluscum contagiosum virus
cccgccagaagugaaau

SEQ ID NO: 3108352 - RNA, 17 nt, Molluscum contagiosum virus
cccguccucgcucgugc

SEQ ID NO: 3108353 - RNA, 20 nt, Molluscum contagiosum virus
cccguggcgcgccggcgcgg

SEQ ID NO: 3108354 - RNA, 14 nt, Molluscum contagiosum virus
cccgugcgcgcgcu

SEQ ID NO: 3108355 - RNA, 16 nt, Molluscum contagiosum virus
cccgugcuugcgcacg

SEQ ID NO: 3108356 - RNA, 20 nt, Molluscum contagiosum virus
cccucacaccuagagcacga

SEQ ID NO: 3108357 - RNA, 18 nt, Molluscum contagiosum virus
cccugcccgcgcgagacu

SEQ ID NO: 3108358 - RNA, 13 nt, Molluscum contagiosum virus
cccugcgcgagca

SEQ ID NO: 3108359 - RNA, 20 nt, Molluscum contagiosum virus
cccugcuaguccgcguacag

SEQ ID NO: 3108360 - RNA, 13 nt, Molluscum contagiosum virus
cccuggacgacgu

SEQ ID NO: 3108361 - RNA, 20 nt, Molluscum contagiosum virus
cccuggcugcugcgcgaccg

SEQ ID NO: 3108362 - RNA, 15 nt, Molluscum contagiosum virus
ccgaacugcucugcg

SEQ ID NO: 3108363 - RNA, 15 nt, Molluscum contagiosum virus
ccgaagucgcagcag

SEQ ID NO: 3108364 - RNA, 20 nt, Molluscum contagiosum virus
ccgacaccggacgaaagguc

SEQ ID NO: 3108365 - RNA, 14 nt, Molluscum contagiosum virus
ccgacacgcgcccg

SEQ ID NO: 3108366 - RNA, 15 nt, Molluscum contagiosum virus
ccuccccagcgccgc

SEQ ID NO: 3108367 - RNA, 16 nt, Molluscum contagiosum virus
ccuccgagcgcgcgug

SEQ ID NO: 3108368 - RNA, 20 nt, Molluscum contagiosum virus
ccucgaaggcgugcgccgug

SEQ ID NO: 3108369 - RNA, 16 nt, Molluscum contagiosum virus
ccucgcguagcagcgc

SEQ ID NO: 3108370 - RNA, 20 nt, Molluscum contagiosum virus
ccucgcguagcagcgccugc

SEQ ID NO: 3108371 - RNA, 12 nt, Molluscum contagiosum virus
ccucgcgcacag

SEQ ID NO: 3108372 - RNA, 19 nt, Molluscum contagiosum virus
ccucgcgcgcagcacaccg

SEQ ID NO: 3108373 - RNA, 14 nt, Molluscum contagiosum virus
ccucgaccugcacg

SEQ ID NO: 3108374 - RNA, 15 nt, Molluscum contagiosum virus
ccucgaccugcacga

SEQ ID NO: 3108375 - RNA, 12 nt, Molluscum contagiosum virus
ccucgagcacgc

SEQ ID NO: 3108376 - RNA, 13 nt, Molluscum contagiosum virus
ccucgagcgccgc

SEQ ID NO: 3108377 - RNA, 19 nt, Molluscum contagiosum virus
ccuccuagcccagcacgcg

SEQ ID NO: 3108378 - RNA, 23 nt, Molluscum contagiosum virus
ccucgcaggcgaggucacacucg

SEQ ID NO: 3108379 - RNA, 21 nt, Molluscum contagiosum virus
ccugugcccgaccccgccguc

SEQ ID NO: 3108380 - RNA, 17 nt, Molluscum contagiosum virus
ccugugcuacgcgagca

SEQ ID NO: 3108381 - RNA, 20 nt, Molluscum contagiosum virus
ccugugcugugcagaacuuc

SEQ ID NO: 3108382 - RNA, 17 nt, Molluscum contagiosum virus
ccuguggcgcacacgcg

SEQ ID NO: 3108383 - RNA, 16 nt, Molluscum contagiosum virus
ccuguguugcgcgcgc

SEQ ID NO: 3108384 - RNA, 18 nt, Molluscum contagiosum virus
ccuguucuuucagcgcgc

SEQ ID NO: 3108385 - RNA, 12 nt, Molluscum contagiosum virus
ccugacggcagc

SEQ ID NO: 3108386 - RNA, 19 nt, Molluscum contagiosum virus
ccugagauccacgcgugcu

SEQ ID NO: 3108387 - RNA, 19 nt, Molluscum contagiosum virus
ccugaaccugggcgcgcac

SEQ ID NO: 3108388 - RNA, 18 nt, Molluscum contagiosum virus
ccucggcacucgcguccg

SEQ ID NO: 3108389 - RNA, 13 nt, Molluscum contagiosum virus
ccucggcgcacac

SEQ ID NO: 3108390 - RNA, 13 nt, Molluscum contagiosum virus
ccucggcgcgccg

SEQ ID NO: 3108391 - RNA, 19 nt, Molluscum contagiosum virus
ccucgggccgcagccgcgc

SEQ ID NO: 3108392 - RNA, 15 nt, Molluscum contagiosum virus
ccucgugcugggccu

SEQ ID NO: 3108393 - RNA, 22 nt, Molluscum contagiosum virus
ccucgugggauaggcacacacg

SEQ ID NO: 3108394 - RNA, 20 nt, Molluscum contagiosum virus
ccucguggucgccgcggccg

SEQ ID NO: 3108395 - RNA, 19 nt, Molluscum contagiosum virus
ccucucgaggccggcacga

SEQ ID NO: 3108396 - RNA, 16 nt, Molluscum contagiosum virus
ccucucgugcgucgug

SEQ ID NO: 3108397 - RNA, 18 nt, Molluscum contagiosum virus
ccucgucguccacaggcg

SEQ ID NO: 3108398 - RNA, 12 nt, Molluscum contagiosum virus
ccucugcgagcg

SEQ ID NO: 3108399 - RNA, 14 nt, Molluscum contagiosum virus
ccucugcgcggccc

SEQ ID NO: 3108400 - RNA, 22 nt, Molluscum contagiosum virus
ccucugcuucacgcugcucgug

SEQ ID NO: 3108401 - RNA, 17 nt, Molluscum contagiosum virus
ccuucgcggagcgcacg

SEQ ID NO: 3108402 - RNA, 14 nt, Molluscum contagiosum virus
ccuucccggcgucc

SEQ ID NO: 3108403 - RNA, 23 nt, Molluscum contagiosum virus
ccuuccggagacaccagcuccgc

SEQ ID NO: 3108404 - RNA, 23 nt, Molluscum contagiosum virus
ccuucgacguugacgagcgcgug

SEQ ID NO: 3108405 - RNA, 22 nt, Molluscum contagiosum virus
ccuucuuccugcgcgugcgucc

SEQ ID NO: 3108406 - RNA, 15 nt, Molluscum contagiosum virus
ccuugaagggcacaa

SEQ ID NO: 3108407 - RNA, 14 nt, Molluscum contagiosum virus
ccuugagcgcgccg

SEQ ID NO: 3108408 - RNA, 15 nt, Molluscum contagiosum virus
ccuugcacucgcgcu

SEQ ID NO: 3108409 - RNA, 13 nt, Molluscum contagiosum virus
ccuugcagcgcag

SEQ ID NO: 3108410 - RNA, 14 nt, Molluscum contagiosum virus
ccuugcagcgcagc

SEQ ID NO: 3108411 - RNA, 18 nt, Molluscum contagiosum virus
ccuugcuacaggacgucc

SEQ ID NO: 3108412 - RNA, 18 nt, Molluscum contagiosum virus
ccuugcucgcuugccgcu

SEQ ID NO: 3108413 - RNA, 17 nt, Molluscum contagiosum virus
ccuugcuggcacgcgag

SEQ ID NO: 3108414 - RNA, 23 nt, Molluscum contagiosum virus
ccuuggcaacgcaaacgcacgcg

SEQ ID NO: 3108415 - RNA, 22 nt, Molluscum contagiosum virus
ccuugcccgaggagagcggcgc

SEQ ID NO: 3108416 - RNA, 22 nt, Molluscum contagiosum virus
cgaacaagacgcuagcugugcg

SEQ ID NO: 3108417 - RNA, 17 nt, Molluscum contagiosum virus
cgaacacggcgcggauc

SEQ ID NO: 3108418 - RNA, 12 nt, Molluscum contagiosum virus
cgaacagagcgc

SEQ ID NO: 3108419 - RNA, 16 nt, Molluscum contagiosum virus
cgaacagagcgccagc

SEQ ID NO: 3108420 - RNA, 16 nt, Molluscum contagiosum virus
ccuuuccccggcgucc

SEQ ID NO: 3108421 - RNA, 22 nt, Molluscum contagiosum virus
ccuuuguucuuagcagcgccgc

SEQ ID NO: 3108422 - RNA, 13 nt, Molluscum contagiosum virus
ccuuggcgcgccg

SEQ ID NO: 3108423 - RNA, 16 nt, Molluscum contagiosum virus
ccuuggcgcugcacag

SEQ ID NO: 3108424 - RNA, 18 nt, Molluscum contagiosum virus
ccuuggcggugcgcaaag

SEQ ID NO: 3108425 - RNA, 15 nt, Molluscum contagiosum virus
ccuuguggacgcgcg

SEQ ID NO: 3108426 - RNA, 17 nt, Molluscum contagiosum virus
cgaacgagaaaugcgca

SEQ ID NO: 3108427 - RNA, 18 nt, Molluscum contagiosum virus
cgaacuccaggcgcaccu

SEQ ID NO: 3108428 - RNA, 18 nt, Molluscum contagiosum virus
cgaacucgugcgccgcgc

SEQ ID NO: 3108429 - RNA, 20 nt, Molluscum contagiosum virus
cgaacucucaucgagcaccu

SEQ ID NO: 3108430 - RNA, 23 nt, Molluscum contagiosum virus
cgacggcgccucgagcgcgcugg

SEQ ID NO: 3108431 - RNA, 19 nt, Molluscum contagiosum virus
cgacgcguucuagcagcgu

SEQ ID NO: 3108432 - RNA, 19 nt, Molluscum contagiosum virus
cgacgcuuucguccgccgc

SEQ ID NO: 3108433 - RNA, 21 nt, Molluscum contagiosum virus
cgacggaacgagccugccgcg

SEQ ID NO: 3108434 - RNA, 20 nt, Molluscum contagiosum virus
cgacggucuuccaggucuuc

SEQ ID NO: 3108435 - RNA, 15 nt, Molluscum contagiosum virus
cgacguacgagugcu

SEQ ID NO: 3108436 - RNA, 13 nt, Molluscum contagiosum virus
cgacggcugcucg

SEQ ID NO: 3108437 - RNA, 21 nt, Molluscum contagiosum virus
cgagcgcgagauucuggcgcg

SEQ ID NO: 3108438 - RNA, 16 nt, Molluscum contagiosum virus
cgagcgcgccgcgcgc

SEQ ID NO: 3108439 - RNA, 13 nt, Molluscum contagiosum virus
cgagcgcgcgcgc

SEQ ID NO: 3108440 - RNA, 16 nt, Molluscum contagiosum virus
cgagcgcgcgugcucg

SEQ ID NO: 3108441 - RNA, 18 nt, Molluscum contagiosum virus
cgagcgcgcuggacuugc

SEQ ID NO: 3108442 - RNA, 21 nt, Molluscum contagiosum virus
cgacgucaaccgggcucucgc

SEQ ID NO: 3108443 - RNA, 20 nt, Molluscum contagiosum virus
cgacgucacgcuggucacgc

SEQ ID NO: 3108444 - RNA, 17 nt, Molluscum contagiosum virus
cgacgugaucgcgcagg

SEQ ID NO: 3108445 - RNA, 17 nt, Molluscum contagiosum virus
cgagcgccgccagcucc

SEQ ID NO: 3108446 - RNA, 21 nt, Molluscum contagiosum virus
cgagcgccgccagcuccgcgc

SEQ ID NO: 3108447 - RNA, 15 nt, Molluscum contagiosum virus
cgagcgccgcgugcg

SEQ ID NO: 3108448 - RNA, 17 nt, Molluscum contagiosum virus
cgagcgccgcgugcgcg

SEQ ID NO: 3108449 - RNA, 15 nt, Molluscum contagiosum virus
cgagcgccgcucgca

SEQ ID NO: 3108450 - RNA, 14 nt, Molluscum contagiosum virus
cgagcgccugcgag

SEQ ID NO: 3108451 - RNA, 16 nt, Molluscum contagiosum virus
cgagcgccugcgagca

SEQ ID NO: 3108452 - RNA, 21 nt, Molluscum contagiosum virus
cgacgcgcguggagcgcgcgg

SEQ ID NO: 3108453 - RNA, 14 nt, Molluscum contagiosum virus
cgacgcgcugcucu

SEQ ID NO: 3108454 - RNA, 17 nt, Molluscum contagiosum virus
cgacgcggaggucgagc

SEQ ID NO: 3108455 - RNA, 22 nt, Molluscum contagiosum virus
cgacgcgcgcggcaagcagcgu

SEQ ID NO: 3108456 - RNA, 18 nt, Molluscum contagiosum virus
cgacgcgcggcagacgcc

SEQ ID NO: 3108457 - RNA, 20 nt, Molluscum contagiosum virus
cgacgccuuguucaccaucc

SEQ ID NO: 3108458 - RNA, 19 nt, Molluscum contagiosum virus
cgacgcgagaaagaccuug

SEQ ID NO: 3108459 - RNA, 22 nt, Molluscum contagiosum virus
cgacgcgaucuuccgcgacgag

SEQ ID NO: 3108460 - RNA, 15 nt, Molluscum contagiosum virus
cgacgccaucaggaa

SEQ ID NO: 3108461 - RNA, 18 nt, Molluscum contagiosum virus
cgacgccccggcgcgaaa

SEQ ID NO: 3108462 - RNA, 14 nt, Molluscum contagiosum virus
cgacgccgagcccg

SEQ ID NO: 3108463 - RNA, 15 nt, Molluscum contagiosum virus
cgacgccgagcccga

SEQ ID NO: 3108464 - RNA, 17 nt, Molluscum contagiosum virus
cgacgccguccgcgcag

SEQ ID NO: 3108465 - RNA, 13 nt, Molluscum contagiosum virus
cgacgacacgcgu

SEQ ID NO: 3108466 - RNA, 17 nt, Molluscum contagiosum virus
cgacgacagcgacgaga

SEQ ID NO: 3108467 - RNA, 16 nt, Molluscum contagiosum virus
cgaccuacgaggugcu

SEQ ID NO: 3108468 - RNA, 18 nt, Molluscum contagiosum virus
cgacgaggccuacagcgc

SEQ ID NO: 3108469 - RNA, 13 nt, Molluscum contagiosum virus
cgacgagggcgcc

SEQ ID NO: 3108470 - RNA, 14 nt, Molluscum contagiosum virus
cgacgaggugcgcg

SEQ ID NO: 3108471 - RNA, 15 nt, Molluscum contagiosum virus
cgacgagugcgccgc

SEQ ID NO: 3108472 - RNA, 16 nt, Molluscum contagiosum virus
cgacgagugcgccgcg

SEQ ID NO: 3108473 - RNA, 14 nt, Molluscum contagiosum virus
cgacgauggccacg

SEQ ID NO: 3108474 - RNA, 22 nt, Molluscum contagiosum virus
cgagcucuuccccgcgggccgc

SEQ ID NO: 3108475 - RNA, 14 nt, Molluscum contagiosum virus
cgagcugcggcgcg

SEQ ID NO: 3108476 - RNA, 15 nt, Molluscum contagiosum virus
cgagcugcgggcgcg

SEQ ID NO: 3108477 - RNA, 16 nt, Molluscum contagiosum virus
cgagcugcuagcggca

SEQ ID NO: 3108478 - RNA, 14 nt, Molluscum contagiosum virus
cgagcugcugcgcg

SEQ ID NO: 3108479 - RNA, 15 nt, Molluscum contagiosum virus
cgagcugcugcgcgc

SEQ ID NO: 3108480 - RNA, 16 nt, Molluscum contagiosum virus
cgagcugcuguacucg

SEQ ID NO: 3108481 - RNA, 11 nt, Molluscum contagiosum virus
cgagcugugcg

SEQ ID NO: 3108482 - RNA, 23 nt, Molluscum contagiosum virus
cgagcuuccucaaggcgcacgag

SEQ ID NO: 3108483 - RNA, 23 nt, Molluscum contagiosum virus
cgagcuuugugcgaccugcugcg

SEQ ID NO: 3108484 - RNA, 14 nt, Molluscum contagiosum virus
cgaggaaacgcagc

SEQ ID NO: 3108485 - RNA, 23 nt, Molluscum contagiosum virus
cgagcgcugccgcuucgugcgcg

SEQ ID NO: 3108486 - RNA, 15 nt, Molluscum contagiosum virus
cgagcgcuucuuccg

SEQ ID NO: 3108487 - RNA, 17 nt, Molluscum contagiosum virus
cgagcggagcgggcacg

SEQ ID NO: 3108488 - RNA, 14 nt, Molluscum contagiosum virus
cgagcggcgcgcgc

SEQ ID NO: 3108489 - RNA, 14 nt, Molluscum contagiosum virus
cgagcgcgggcgcc

SEQ ID NO: 3108490 - RNA, 14 nt, Molluscum contagiosum virus
cgagcgcgggcgcg

SEQ ID NO: 3108491 - RNA, 20 nt, Molluscum contagiosum virus
cgagcgcguccaugagcauc

SEQ ID NO: 3108492 - RNA, 13 nt, Molluscum contagiosum virus
cgagcgcgugcuc

SEQ ID NO: 3108493 - RNA, 18 nt, Molluscum contagiosum virus
cgaggaccucgcgcgccg

SEQ ID NO: 3108494 - RNA, 17 nt, Molluscum contagiosum virus
cgaggacgacgccgagc

SEQ ID NO: 3108495 - RNA, 20 nt, Molluscum contagiosum virus
cgaggacgagccccgcgccg

SEQ ID NO: 3108496 - RNA, 20 nt, Molluscum contagiosum virus
cgaggacgcgggcguguccg

SEQ ID NO: 3108497 - RNA, 17 nt, Molluscum contagiosum virus
cgagcuaaauggacgcg

SEQ ID NO: 3108498 - RNA, 14 nt, Molluscum contagiosum virus
cgagcuacugcgcg

SEQ ID NO: 3108499 - RNA, 15 nt, Molluscum contagiosum virus
cgagcuacugcgcgc

SEQ ID NO: 3108500 - RNA, 22 nt, Molluscum contagiosum virus
cgagcucgccuccuugcccgag

SEQ ID NO: 3108501 - RNA, 17 nt, Molluscum contagiosum virus
cgagcucgcgcgccagc

SEQ ID NO: 3108502 - RNA, 14 nt, Molluscum contagiosum virus
cgagcggcugcucg

SEQ ID NO: 3108503 - RNA, 22 nt, Molluscum contagiosum virus
cgagcgugaccagugcgugcuc

SEQ ID NO: 3108504 - RNA, 17 nt, Molluscum contagiosum virus
cgaggacuuccgcgcgc

SEQ ID NO: 3108505 - RNA, 14 nt, Molluscum contagiosum virus
cgaggcaccgcccg

SEQ ID NO: 3108506 - RNA, 20 nt, Molluscum contagiosum virus
cgaggcagccgcggcgcccg

SEQ ID NO: 3108507 - RNA, 16 nt, Molluscum contagiosum virus
cgaggccuacgugcug

SEQ ID NO: 3108508 - RNA, 23 nt, Molluscum contagiosum virus
cgaggccugcguggacagcaucc

SEQ ID NO: 3108509 - RNA, 17 nt, Molluscum contagiosum virus
cgaggccuucgcgcccg

SEQ ID NO: 3108510 - RNA, 13 nt, Molluscum contagiosum virus
cgaggcgcgcacg

SEQ ID NO: 3108511 - RNA, 22 nt, Molluscum contagiosum virus
cgcacgcuugccuuggcgcccg

SEQ ID NO: 3108512 - RNA, 16 nt, Molluscum contagiosum virus
cgcacgcuuguccgcg

SEQ ID NO: 3108513 - RNA, 20 nt, Molluscum contagiosum virus
cgcacgcuuguccgcggacg

SEQ ID NO: 3108514 - RNA, 15 nt, Molluscum contagiosum virus
cgcacggcagcggcg

SEQ ID NO: 3108515 - RNA, 16 nt, Molluscum contagiosum virus
cgcacggcagcggcga

SEQ ID NO: 3108516 - RNA, 14 nt, Molluscum contagiosum virus
cgcacggccugcgg

SEQ ID NO: 3108517 - RNA, 19 nt, Molluscum contagiosum virus
cgcacggcuaggcgcggcg

SEQ ID NO: 3108518 - RNA, 16 nt, Molluscum contagiosum virus
cgcacgggccugcgcg

SEQ ID NO: 3108519 - RNA, 12 nt, Molluscum contagiosum virus
cgcacgggcgca

SEQ ID NO: 3108520 - RNA, 20 nt, Molluscum contagiosum virus
cgcacgcgaacgccuacgcg

SEQ ID NO: 3108521 - RNA, 13 nt, Molluscum contagiosum virus
cgcacgcgagcac

SEQ ID NO: 3108522 - RNA, 16 nt, Molluscum contagiosum virus
cgcacgcgagcacgcc

SEQ ID NO: 3108523 - RNA, 11 nt, Molluscum contagiosum virus
cgcacgcgcac

SEQ ID NO: 3108524 - RNA, 12 nt, Molluscum contagiosum virus
cgcacgcgcccu

SEQ ID NO: 3108525 - RNA, 14 nt, Molluscum contagiosum virus
cgcacgcgcgagca

SEQ ID NO: 3108526 - RNA, 13 nt, Molluscum contagiosum virus
cgcacgcgggacg

SEQ ID NO: 3108527 - RNA, 20 nt, Molluscum contagiosum virus
cgcacgcuagcgagcgcccg

SEQ ID NO: 3108528 - RNA, 23 nt, Molluscum contagiosum virus
cgcacgagcugcugcccgccuuc

SEQ ID NO: 3108529 - RNA, 13 nt, Molluscum contagiosum virus
cgcacgaggagcc

SEQ ID NO: 3108530 - RNA, 15 nt, Molluscum contagiosum virus
cgcacgauguacucc

SEQ ID NO: 3108531 - RNA, 17 nt, Molluscum contagiosum virus
cgcacgcacggagcaca

SEQ ID NO: 3108532 - RNA, 14 nt, Molluscum contagiosum virus
cgcacgcagcaggc

SEQ ID NO: 3108533 - RNA, 22 nt, Molluscum contagiosum virus
cgcacgcagcaggcacgacgcc

SEQ ID NO: 3108534 - RNA, 19 nt, Molluscum contagiosum virus
cgaggaggcgcccucgcgc

SEQ ID NO: 3108535 - RNA, 15 nt, Molluscum contagiosum virus
cgaggagggcguccg

SEQ ID NO: 3108536 - RNA, 19 nt, Molluscum contagiosum virus
cgcaccuugacgccgcgcg

SEQ ID NO: 3108537 - RNA, 20 nt, Molluscum contagiosum virus
cgcacgaagacuacggcacu

SEQ ID NO: 3108538 - RNA, 19 nt, Molluscum contagiosum virus
cgcacgaccacgugcagga

SEQ ID NO: 3108539 - RNA, 19 nt, Molluscum contagiosum virus
cggacacguugcagcagca

SEQ ID NO: 3108540 - RNA, 16 nt, Molluscum contagiosum virus
cggacgaagagacgcc

SEQ ID NO: 3108541 - RNA, 17 nt, Molluscum contagiosum virus
cggacgccggcgcccgc

SEQ ID NO: 3108542 - RNA, 12 nt, Molluscum contagiosum virus
cggacgcgcagc

SEQ ID NO: 3108543 - RNA, 13 nt, Molluscum contagiosum virus
cggacgcgcagcu

SEQ ID NO: 3108544 - RNA, 23 nt, Molluscum contagiosum virus
cggacgcgcgagugugcgugucu

SEQ ID NO: 3108545 - RNA, 19 nt, Molluscum contagiosum virus
cggacgcggugaccggagc

SEQ ID NO: 3108546 - RNA, 15 nt, Molluscum contagiosum virus
cggacggcgcgcagc

SEQ ID NO: 3108547 - RNA, 17 nt, Molluscum contagiosum virus
cggacggcgcgcagcgc

SEQ ID NO: 3108548 - RNA, 16 nt, Molluscum contagiosum virus
cgcuuucgcccgccgc

SEQ ID NO: 3108549 - RNA, 16 nt, Molluscum contagiosum virus
cgcuuucguccgccgc

SEQ ID NO: 3108550 - RNA, 12 nt, Molluscum contagiosum virus
cgcuuugcgcgg

SEQ ID NO: 3108551 - RNA, 22 nt, Molluscum contagiosum virus
cggaaaaaaacugcgcacgcgg

SEQ ID NO: 3108552 - RNA, 16 nt, Molluscum contagiosum virus
cgcuucugccugcucc

SEQ ID NO: 3108553 - RNA, 19 nt, Molluscum contagiosum virus
cgcuugcccggagccggcg

SEQ ID NO: 3108554 - RNA, 19 nt, Molluscum contagiosum virus
cgcuugccuuggcgcccgu

SEQ ID NO: 3108555 - RNA, 14 nt, Molluscum contagiosum virus
cgcuugcucgaagu

SEQ ID NO: 3108556 - RNA, 15 nt, Molluscum contagiosum virus
cgcuuggcgagcgcu

SEQ ID NO: 3108557 - RNA, 15 nt, Molluscum contagiosum virus
cgcuuguccgcggac

SEQ ID NO: 3108558 - RNA, 14 nt, Molluscum contagiosum virus
cgcuucgagcacgc

SEQ ID NO: 3108559 - RNA, 15 nt, Molluscum contagiosum virus
cgcuucgggcucagc

SEQ ID NO: 3108560 - RNA, 16 nt, Molluscum contagiosum virus
cgcuucuagcucgcgc

SEQ ID NO: 3108561 - RNA, 16 nt, Molluscum contagiosum virus
cgcuuccggcggcucc

SEQ ID NO: 3108562 - RNA, 15 nt, Molluscum contagiosum virus
cgcuuagcacacgcg

SEQ ID NO: 3108563 - RNA, 21 nt, Molluscum contagiosum virus
cggacagcaccccgaagacgu

SEQ ID NO: 3108564 - RNA, 18 nt, Molluscum contagiosum virus
cggacagcagcucgccgu

SEQ ID NO: 3108565 - RNA, 20 nt, Molluscum contagiosum virus
cggacagugccuccgcggac

SEQ ID NO: 3108566 - RNA, 21 nt, Molluscum contagiosum virus
cggacagugccuccgcggacg

SEQ ID NO: 3108567 - RNA, 22 nt, Molluscum contagiosum virus
cggacagugccuccgcggacgc

SEQ ID NO: 3108568 - RNA, 13 nt, Molluscum contagiosum virus
cggaacucgaaga

SEQ ID NO: 3108569 - RNA, 13 nt, Molluscum contagiosum virus
cggaacuggacgc

SEQ ID NO: 3108570 - RNA, 18 nt, Molluscum contagiosum virus
cggaagacgcgagcggcu

SEQ ID NO: 3108571 - RNA, 14 nt, Molluscum contagiosum virus
cggaagcccgccuc

SEQ ID NO: 3108572 - RNA, 13 nt, Molluscum contagiosum virus
cggaagcgcccgu

SEQ ID NO: 3108573 - RNA, 17 nt, Molluscum contagiosum virus
cggaaacgaacgcugca

SEQ ID NO: 3108574 - RNA, 15 nt, Molluscum contagiosum virus
cggaaaacgcccgag

SEQ ID NO: 3108575 - RNA, 14 nt, Molluscum contagiosum virus
cggaaccguggugc

SEQ ID NO: 3108576 - RNA, 21 nt, Molluscum contagiosum virus
cggaacgcgugaggaggcggc

SEQ ID NO: 3108577 - RNA, 14 nt, Molluscum contagiosum virus
cggaaagagcgcgc

SEQ ID NO: 3108578 - RNA, 20 nt, Molluscum contagiosum virus
cggaaagagcgcgcgaagca

SEQ ID NO: 3108579 - RNA, 14 nt, Molluscum contagiosum virus
cgcguacagcgcgc

SEQ ID NO: 3108580 - RNA, 20 nt, Molluscum contagiosum virus
cgcguacagcgcgcgugccg

SEQ ID NO: 3108581 - RNA, 14 nt, Molluscum contagiosum virus
cgcguacauccgcg

SEQ ID NO: 3108582 - RNA, 17 nt, Molluscum contagiosum virus
cgcguacauccgcgagc

SEQ ID NO: 3108583 - RNA, 18 nt, Molluscum contagiosum virus
cgcguacauccgcgagca

SEQ ID NO: 3108584 - RNA, 15 nt, Molluscum contagiosum virus
cgcguaccagcgccu

SEQ ID NO: 3108585 - RNA, 18 nt, Molluscum contagiosum virus
cgcguaccuacucgccgu

SEQ ID NO: 3108586 - RNA, 13 nt, Molluscum contagiosum virus
cgcguacgaagag

SEQ ID NO: 3108587 - RNA, 16 nt, Molluscum contagiosum virus
cgcgguaacgcgcgcg

SEQ ID NO: 3108588 - RNA, 17 nt, Molluscum contagiosum virus
cgcgguugagcgccgug

SEQ ID NO: 3108589 - RNA, 16 nt, Molluscum contagiosum virus
cgcguaaagagcgucc

SEQ ID NO: 3108590 - RNA, 17 nt, Molluscum contagiosum virus
cgcguaguacgcuacgc

SEQ ID NO: 3108591 - RNA, 18 nt, Molluscum contagiosum virus
cgcgucaucgcugcacgc

SEQ ID NO: 3108592 - RNA, 20 nt, Molluscum contagiosum virus
cgcgucaucgcugcacgcga

SEQ ID NO: 3108593 - RNA, 22 nt, Molluscum contagiosum virus
cgcguccacgaacgacagcgcc

SEQ ID NO: 3108594 - RNA, 12 nt, Molluscum contagiosum virus
cgcguccacgca

SEQ ID NO: 3108595 - RNA, 22 nt, Molluscum contagiosum virus
cgcguccacggguagcagcgcc

SEQ ID NO: 3108596 - RNA, 13 nt, Molluscum contagiosum virus
cgcguccgcgcag

SEQ ID NO: 3108597 - RNA, 15 nt, Molluscum contagiosum virus
cgcguacucgcgccg

SEQ ID NO: 3108598 - RNA, 13 nt, Molluscum contagiosum virus
cgcguagcagcgc

SEQ ID NO: 3108599 - RNA, 14 nt, Molluscum contagiosum virus
cgcguagcagcgcc

SEQ ID NO: 3108600 - RNA, 16 nt, Molluscum contagiosum virus
cgcgugacacaccgcg

SEQ ID NO: 3108601 - RNA, 15 nt, Molluscum contagiosum virus
cgcgugagagccauu

SEQ ID NO: 3108602 - RNA, 23 nt, Molluscum contagiosum virus
cgcgugaggaggcggcacugcua

SEQ ID NO: 3108603 - RNA, 15 nt, Molluscum contagiosum virus
cgcgugaguccgcgg

SEQ ID NO: 3108604 - RNA, 17 nt, Molluscum contagiosum virus
cgcgugaguccgcggcg

SEQ ID NO: 3108605 - RNA, 19 nt, Molluscum contagiosum virus
cgcgucguagacgcgcccg

SEQ ID NO: 3108606 - RNA, 20 nt, Molluscum contagiosum virus
cgcgucguagacgcgcccgu

SEQ ID NO: 3108607 - RNA, 14 nt, Molluscum contagiosum virus
cgcgucgucgccgu

SEQ ID NO: 3108608 - RNA, 12 nt, Molluscum contagiosum virus
cgcgucgcgcag

SEQ ID NO: 3108609 - RNA, 14 nt, Molluscum contagiosum virus
cgcgucgcgcgccg

SEQ ID NO: 3108610 - RNA, 16 nt, Molluscum contagiosum virus
cgcgucgcgcgccgcg

SEQ ID NO: 3108611 - RNA, 12 nt, Molluscum contagiosum virus
cgcgucgcggag

SEQ ID NO: 3108612 - RNA, 14 nt, Molluscum contagiosum virus
cgcgucgcggaggg

SEQ ID NO: 3108613 - RNA, 19 nt, Molluscum contagiosum virus
cgcgucgcggucgcggagc

SEQ ID NO: 3108614 - RNA, 22 nt, Molluscum contagiosum virus
cgcgugccuguggcgcacacgc

SEQ ID NO: 3108615 - RNA, 21 nt, Molluscum contagiosum virus
cgcgugcgagcggcgcgcgcu

SEQ ID NO: 3108616 - RNA, 22 nt, Molluscum contagiosum virus
cgcgugcgccgccgcaggcccg

SEQ ID NO: 3108617 - RNA, 14 nt, Molluscum contagiosum virus
cgcgugcgcgccag

SEQ ID NO: 3108618 - RNA, 12 nt, Molluscum contagiosum virus
cgcgugcgcgug

SEQ ID NO: 3108619 - RNA, 20 nt, Molluscum contagiosum virus
cgcgugcggcggcgcgugcu

SEQ ID NO: 3108620 - RNA, 15 nt, Molluscum contagiosum virus
cgcgugcucgcgagc

SEQ ID NO: 3108621 - RNA, 23 nt, Molluscum contagiosum virus
cgcgugcucugcuccgcggaggc

SEQ ID NO: 3108622 - RNA, 15 nt, Molluscum contagiosum virus
cgcugucgcgcgucg

SEQ ID NO: 3108623 - RNA, 14 nt, Molluscum contagiosum virus
cgcgugcauggcac

SEQ ID NO: 3108624 - RNA, 18 nt, Molluscum contagiosum virus
cgcgugcauggcacgcga

SEQ ID NO: 3108625 - RNA, 19 nt, Molluscum contagiosum virus
cgcgugccagucgcgcgag

SEQ ID NO: 3108626 - RNA, 15 nt, Molluscum contagiosum virus
cgcgugccgcccgag

SEQ ID NO: 3108627 - RNA, 19 nt, Molluscum contagiosum virus
cgcgugccgcugcgcggag

SEQ ID NO: 3108628 - RNA, 18 nt, Molluscum contagiosum virus
cgcgugccucugccagcc

SEQ ID NO: 3108629 - RNA, 15 nt, Molluscum contagiosum virus
cgcagcccgagcgcg

SEQ ID NO: 3108630 - RNA, 21 nt, Molluscum contagiosum virus
cgcagcccgagcgcgcgugcg

SEQ ID NO: 3108631 - RNA, 16 nt, Molluscum contagiosum virus
cgccgacgugcgcgug

SEQ ID NO: 3108632 - RNA, 15 nt, Molluscum contagiosum virus
cgcagaucaggagca

SEQ ID NO: 3108633 - RNA, 20 nt, Molluscum contagiosum virus
cgcagcacaugcaggccgag

SEQ ID NO: 3108634 - RNA, 15 nt, Molluscum contagiosum virus
cgcacuucacggcgu

SEQ ID NO: 3108635 - RNA, 20 nt, Molluscum contagiosum virus
cgcagcaggugcacgugcug

SEQ ID NO: 3108636 - RNA, 18 nt, Molluscum contagiosum virus
cgcagcauucccggcgcg

SEQ ID NO: 3108637 - RNA, 18 nt, Molluscum contagiosum virus
cgcagcccacgugccagc

SEQ ID NO: 3108638 - RNA, 21 nt, Molluscum contagiosum virus
cgcacgcugcgcacgggcgcg

SEQ ID NO: 3108639 - RNA, 16 nt, Molluscum contagiosum virus
cgcacguaggggacgc

SEQ ID NO: 3108640 - RNA, 21 nt, Molluscum contagiosum virus
cgcacgucuucgccgugugcg

SEQ ID NO: 3108641 - RNA, 15 nt, Molluscum contagiosum virus
cgcacgugcgcgccg

SEQ ID NO: 3108642 - RNA, 18 nt, Molluscum contagiosum virus
cgcagacgcagcgcgagc

SEQ ID NO: 3108643 - RNA, 16 nt, Molluscum contagiosum virus
cgcagacgcgcguccg

SEQ ID NO: 3108644 - RNA, 15 nt, Molluscum contagiosum virus
cgcagagccagcgcg

SEQ ID NO: 3108645 - RNA, 22 nt, Molluscum contagiosum virus
cgcagagcuccccgcgcgcagc

SEQ ID NO: 3108646 - RNA, 22 nt, Molluscum contagiosum virus
cgcagaggcgcguccgcggccg

SEQ ID NO: 3108647 - RNA, 17 nt, Molluscum contagiosum virus
cgcagaacugcugcgcg

SEQ ID NO: 3108648 - RNA, 19 nt, Molluscum contagiosum virus
cgcagaacugcugcgcgcu

SEQ ID NO: 3108649 - RNA, 17 nt, Molluscum contagiosum virus
cgcagaaguggcgcugu

SEQ ID NO: 3108650 - RNA, 20 nt, Molluscum contagiosum virus
cgcagaaguggcgcugugcg

SEQ ID NO: 3108651 - RNA, 20 nt, Molluscum contagiosum virus
cgccgcgcaauagcgcccgu

SEQ ID NO: 3108652 - RNA, 21 nt, Molluscum contagiosum virus
cgccgccagcgucgcgcgccg

SEQ ID NO: 3108653 - RNA, 15 nt, Molluscum contagiosum virus
cgccgccagcuccgc

SEQ ID NO: 3108654 - RNA, 17 nt, Molluscum contagiosum virus
cgccgccaugcugcgcg

SEQ ID NO: 3108655 - RNA, 19 nt, Molluscum contagiosum virus
cgccgccaugcugcgcgag

SEQ ID NO: 3108656 - RNA, 13 nt, Molluscum contagiosum virus
cgccgccgcgccg

SEQ ID NO: 3108657 - RNA, 18 nt, Molluscum contagiosum virus
cgccgaucuccacgucga

SEQ ID NO: 3108658 - RNA, 23 nt, Molluscum contagiosum virus
cgccgaucuccacgucgaucagc

SEQ ID NO: 3108659 - RNA, 16 nt, Molluscum contagiosum virus
cgccgcaaauuccguc

SEQ ID NO: 3108660 - RNA, 13 nt, Molluscum contagiosum virus
cgccgagcccgag

SEQ ID NO: 3108661 - RNA, 23 nt, Molluscum contagiosum virus
cgccgaggacuaccuggcggcgc

SEQ ID NO: 3108662 - RNA, 14 nt, Molluscum contagiosum virus
cgccgacugccgcc

SEQ ID NO: 3108663 - RNA, 22 nt, Molluscum contagiosum virus
cgccgacugccgccgccgcgag

SEQ ID NO: 3108664 - RNA, 23 nt, Molluscum contagiosum virus
cgccgagauggagcucacgcuca

SEQ ID NO: 3108665 - RNA, 18 nt, Molluscum contagiosum virus
cgccgcucggaauuccuu

SEQ ID NO: 3108666 - RNA, 13 nt, Molluscum contagiosum virus
cgcgggccgccgc

SEQ ID NO: 3108667 - RNA, 17 nt, Molluscum contagiosum virus
cgcgggccuguccgcgg

SEQ ID NO: 3108668 - RNA, 22 nt, Molluscum contagiosum virus
cgcgggccuguccgcgggcgca

SEQ ID NO: 3108669 - RNA, 22 nt, Molluscum contagiosum virus
cgcgggccuguccgcgggcgcg

SEQ ID NO: 3108670 - RNA, 16 nt, Molluscum contagiosum virus
cgcggcgggggcagca

SEQ ID NO: 3108671 - RNA, 22 nt, Molluscum contagiosum virus
cgcggcgguugcccgccugccg

SEQ ID NO: 3108672 - RNA, 14 nt, Molluscum contagiosum virus
cgcggcgugcccgu

SEQ ID NO: 3108673 - RNA, 17 nt, Molluscum contagiosum virus
cgcggcgugugcgggcu

SEQ ID NO: 3108674 - RNA, 15 nt, Molluscum contagiosum virus
cgcggcguucccgcu

SEQ ID NO: 3108675 - RNA, 23 nt, Molluscum contagiosum virus
cgcggcuaccacgggcccgcgcg

SEQ ID NO: 3108676 - RNA, 12 nt, Molluscum contagiosum virus
cgcggcgcggcg

SEQ ID NO: 3108677 - RNA, 20 nt, Molluscum contagiosum virus
cgcggcgcguacucgcgccg

SEQ ID NO: 3108678 - RNA, 21 nt, Molluscum contagiosum virus
cgcggcgcuuucgcccgccgc

SEQ ID NO: 3108679 - RNA, 22 nt, Molluscum contagiosum virus
cgcggcggagaugacgggcacg

SEQ ID NO: 3108680 - RNA, 23 nt, Molluscum contagiosum virus
cgcggcggagaugacgggcacgc

SEQ ID NO: 3108681 - RNA, 14 nt, Molluscum contagiosum virus
cgccgcgcgccgcg

SEQ ID NO: 3108682 - RNA, 16 nt, Molluscum contagiosum virus
cgccgcgcgcgccagc

SEQ ID NO: 3108683 - RNA, 14 nt, Molluscum contagiosum virus
cgccgcgcgcgccg

SEQ ID NO: 3108684 - RNA, 14 nt, Molluscum contagiosum virus
cgccgcgcgcggcu

SEQ ID NO: 3108685 - RNA, 13 nt, Molluscum contagiosum virus
cgccgcgggcaca

SEQ ID NO: 3108686 - RNA, 15 nt, Molluscum contagiosum virus
cgccgcggccgcgag

SEQ ID NO: 3108687 - RNA, 16 nt, Molluscum contagiosum virus
cgccgcggcgguugcc

SEQ ID NO: 3108688 - RNA, 18 nt, Molluscum contagiosum virus
cgccgcguacaugcgugc

SEQ ID NO: 3108689 - RNA, 16 nt, Molluscum contagiosum virus
cgccgcguacgcgccg

SEQ ID NO: 3108690 - RNA, 17 nt, Molluscum contagiosum virus
cgccgcguacgcgccgg

SEQ ID NO: 3108691 - RNA, 14 nt, Molluscum contagiosum virus
cgccgcgugcccgu

SEQ ID NO: 3108692 - RNA, 18 nt, Molluscum contagiosum virus
cgccgcugcccgcgcacg

SEQ ID NO: 3108693 - RNA, 15 nt, Molluscum contagiosum virus
cgccgcugccgcgcg

SEQ ID NO: 3108694 - RNA, 12 nt, Molluscum contagiosum virus
cgccgcugcgcc

SEQ ID NO: 3108695 - RNA, 14 nt, Molluscum contagiosum virus
cgccgcugcgccgg

SEQ ID NO: 3108696 - RNA, 13 nt, Molluscum contagiosum virus
cgcggcgcgccgg

SEQ ID NO: 3108697 - RNA, 14 nt, Molluscum contagiosum virus
cgcggcgcgccggc

SEQ ID NO: 3108698 - RNA, 19 nt, Molluscum contagiosum virus
cgcgggcucaagucgcccu

SEQ ID NO: 3108699 - RNA, 17 nt, Molluscum contagiosum virus
cgcggcuuacacacgca

SEQ ID NO: 3108700 - RNA, 16 nt, Molluscum contagiosum virus
cgcgggcggcggcccg

SEQ ID NO: 3108701 - RNA, 17 nt, Molluscum contagiosum virus
cgcgggcguguccgcgg

SEQ ID NO: 3108702 - RNA, 19 nt, Molluscum contagiosum virus
cgcgggcguguccgcgggc

SEQ ID NO: 3108703 - RNA, 12 nt, Molluscum contagiosum virus
cgcgggcgcacg

SEQ ID NO: 3108704 - RNA, 13 nt, Molluscum contagiosum virus
cgcgggcgcagag

SEQ ID NO: 3108705 - RNA, 18 nt, Molluscum contagiosum virus
cgcgggcgccggcguccg

SEQ ID NO: 3108706 - RNA, 14 nt, Molluscum contagiosum virus
cgcgggcgcgcccg

SEQ ID NO: 3108707 - RNA, 14 nt, Molluscum contagiosum virus
cgcgggcgcgcgcg

SEQ ID NO: 3108708 - RNA, 13 nt, Molluscum contagiosum virus
cgcgggcgcggag

SEQ ID NO: 3108709 - RNA, 17 nt, Molluscum contagiosum virus
cgcgguccuguccgcgg

SEQ ID NO: 3108710 - RNA, 19 nt, Molluscum contagiosum virus
cgcgguccuguccgcggac

SEQ ID NO: 3108711 - RNA, 22 nt, Molluscum contagiosum virus
cgcggucgacgagugcgccgcg

SEQ ID NO: 3108712 - RNA, 16 nt, Molluscum contagiosum virus
cgcggucgcccgccga

SEQ ID NO: 3108713 - RNA, 17 nt, Molluscum contagiosum virus
cgcggucgcccgccgag

SEQ ID NO: 3108714 - RNA, 18 nt, Molluscum contagiosum virus
cgcggucgcccgccgagc

SEQ ID NO: 3108715 - RNA, 13 nt, Molluscum contagiosum virus
cgcggucgcggag

SEQ ID NO: 3108716 - RNA, 21 nt, Molluscum contagiosum virus
cgcggucgggccccugcgcga

SEQ ID NO: 3108717 - RNA, 18 nt, Molluscum contagiosum virus
cgcggugagugcgcgcac

SEQ ID NO: 3108718 - RNA, 19 nt, Molluscum contagiosum virus
cgcggugagugcgcgcacg

SEQ ID NO: 3108719 - RNA, 17 nt, Molluscum contagiosum virus
cgcggugcgcgcgugcg

SEQ ID NO: 3108720 - RNA, 15 nt, Molluscum contagiosum virus
cgcggugcgggcgcg

SEQ ID NO: 3108721 - RNA, 16 nt, Molluscum contagiosum virus
cgcggugcugcgccag

SEQ ID NO: 3108722 - RNA, 16 nt, Molluscum contagiosum virus
cgcgguggccgcgccg

SEQ ID NO: 3108723 - RNA, 17 nt, Molluscum contagiosum virus
cgcgguggccgcgccgg

SEQ ID NO: 3108724 - RNA, 22 nt, Molluscum contagiosum virus
aaaaacgcgcccccguccgugc

SEQ ID NO: 3108725 - RNA, 22 nt, Human
cuccgcuuucuacccagcgagc

SEQ ID NO: 3108726 - RNA, 21 nt, Human
cuccgcuuucuacccagcgag

SEQ ID NO: 3108727 - RNA, 20 nt, Human
cuccgcuuucuacccagcga

SEQ ID NO: 3108728 - RNA, 15 nt, Human
cucccucuuucccuc

SEQ ID NO: 3108729 - RNA, 16 nt, Human
cucccucccucuuucc

SEQ ID NO: 3108730 - RNA, 19 nt, Human
cucccucuuucccucccuu

SEQ ID NO: 3108731 - RNA, 14 nt, Human
cucccaccucagcc

SEQ ID NO: 3108732 - RNA, 16 nt, Human
cucccaccucagccuc

SEQ ID NO: 3108733 - RNA, 17 nt, Human
cucccaccucagccucc

SEQ ID NO: 3108734 - RNA, 13 nt, Human
cucccaccucagc

SEQ ID NO: 3108735 - RNA, 18 nt, Human
cuccaggugcacaagcuc

SEQ ID NO: 3108736 - RNA, 20 nt, Human
cuccaggugcacaagcucca

SEQ ID NO: 3108737 - RNA, 19 nt, Human
cuccaggugcacaagcucc

SEQ ID NO: 3108738 - RNA, 23 nt, Human
cuccaggcuguaucccaugagcc

SEQ ID NO: 3108739 - RNA, 22 nt, Human
cuccaggcuguaucccaugagc

SEQ ID NO: 3108740 - RNA, 21 nt, Human
cuccagaauuucccaaagcag

SEQ ID NO: 3108741 - RNA, 16 nt, Human
cucagaaucucaaaua

SEQ ID NO: 3108742 - RNA, 17 nt, Human
cucagaaucucaaauaa

SEQ ID NO: 3108743 - RNA, 11 nt, Human
cuccagacaca

SEQ ID NO: 3108744 - RNA, 22 nt, Human
cuccagaauuucccaaagcagu

SEQ ID NO: 3108745 - RNA, 16 nt, Human
cucugcacaagcugca

SEQ ID NO: 3108746 - RNA, 16 nt, Human
cucuccgaccagacac

SEQ ID NO: 3108747 - RNA, 20 nt, Human
cucuccuccuuuucacaguu

SEQ ID NO: 3108748 - RNA, 13 nt, Human
cucuccuccuuuu

SEQ ID NO: 3108749 - RNA, 13 nt, Human
cucucccuuggau

SEQ ID NO: 3108750 - RNA, 10 nt, Human
cucuccucug

SEQ ID NO: 3108751 - RNA, 23 nt, Human
cucgguguggagaagcggcuggc

SEQ ID NO: 3108752 - RNA, 11 nt, Human
cucggugccuu

SEQ ID NO: 3108753 - RNA, 24 nt, Human
cuccuuuucacaguucucuccuuc

SEQ ID NO: 3108754 - RNA, 23 nt, Human
cuccuuugugaggaagccgcugg

SEQ ID NO: 3108755 - RNA, 22 nt, Human
cuccuuuagcgcccaguugggu

SEQ ID NO: 3108756 - RNA, 16 nt, Human
cuccuuuagcgcccag

SEQ ID NO: 3108757 - RNA, 17 nt, Human
cuccuuuagcgcccagu

SEQ ID NO: 3108758 - RNA, 22 nt, Human
cuccuagccugugccucuggga

SEQ ID NO: 3108759 - RNA, 13 nt, Human
cugacacacagcu

SEQ ID NO: 3108760 - RNA, 15 nt, Human
cugacacacagcucu

SEQ ID NO: 3108761 - RNA, 16 nt, Human
cugacacacagcucug

SEQ ID NO: 3108762 - RNA, 17 nt, Human
cugacacacagcucugu

SEQ ID NO: 3108763 - RNA, 18 nt, Human
cugacacacagcucuguc

SEQ ID NO: 3108764 - RNA, 19 nt, Human
cugacacacagcucugucc

SEQ ID NO: 3108765 - RNA, 20 nt, Human
cugacacacagcucuguccu

SEQ ID NO: 3108766 - RNA, 21 nt, Human
cugacacacagcucuguccug

SEQ ID NO: 3108767 - RNA, 22 nt, Human
cugacacacagcucuguccugg

SEQ ID NO: 3108768 - RNA, 23 nt, Human
cugacacacagcucuguccuggg

SEQ ID NO: 3108769 - RNA, 14 nt, Human
cucuugagccuggg

SEQ ID NO: 3108770 - RNA, 13 nt, Human
cucuugagccugg

SEQ ID NO: 3108771 - RNA, 23 nt, Human
cucuugagccuugaacuuugacc

SEQ ID NO: 3108772 - RNA, 15 nt, Human
cucuugagccuggga

SEQ ID NO: 3108773 - RNA, 22 nt, Human
cucuugauucauaaugacuuaa

SEQ ID NO: 3108774 - RNA, 24 nt, Human
cucuugauucauaaugacuuaagc

SEQ ID NO: 3108775 - RNA, 18 nt, Human
cucugcacaagcugcacc

SEQ ID NO: 3108776 - RNA, 17 nt, Human
cucugcacaagcugcac

SEQ ID NO: 3108777 - RNA, 22 nt, Human
cugagcugggaugauuggaggg

SEQ ID NO: 3108778 - RNA, 12 nt, Human
cugagcugggau

SEQ ID NO: 3108779 - RNA, 19 nt, Human
cugacccugcuucaaauau

SEQ ID NO: 3108780 - RNA, 21 nt, Human
cugaggaauccagacccggcu

SEQ ID NO: 3108781 - RNA, 14 nt, Human
cugaggggccucuu

SEQ ID NO: 3108782 - RNA, 23 nt, Human
cugaggaauccagacccggcugc

SEQ ID NO: 3108783 - RNA, 12 nt, Human
cugaggugggag

SEQ ID NO: 3108784 - RNA, 13 nt, Human
cugaggugggagg

SEQ ID NO: 3108785 - RNA, 22 nt, Human
cugaggugggaggaucucuuga

SEQ ID NO: 3108786 - RNA, 14 nt, Human
cugaucucucguga

SEQ ID NO: 3108787 - RNA, 18 nt, Human
cugaucucucgugauuga

SEQ ID NO: 3108788 - RNA, 17 nt, Human
cugaucucucgugauug

SEQ ID NO: 3108789 - RNA, 16 nt, Human
cuauguugcccaggca

SEQ ID NO: 3108790 - RNA, 17 nt, Human
cuauguugcccaggcag

SEQ ID NO: 3108791 - RNA, 17 nt, Human
cucaaaaaaagaaaaag

SEQ ID NO: 3108792 - RNA, 18 nt, Human
cucaaaaaaagaaaaaga

SEQ ID NO: 3108793 - RNA, 14 nt, Human
cuauguugcccagg

SEQ ID NO: 3108794 - RNA, 15 nt, Human
cuauguugcccaggc

SEQ ID NO: 3108795 - RNA, 22 nt, Human
cuauguguagggcgggaggaug

SEQ ID NO: 3108796 - RNA, 16 nt, Human
cuauguaucaaugagu

SEQ ID NO: 3108797 - RNA, 17 nt, Human
cuaugugagcacaaagg

SEQ ID NO: 3108798 - RNA, 18 nt, Human
cuaucucccccagcccca

SEQ ID NO: 3108799 - RNA, 19 nt, Human
cuauguaucaaugaguaac

SEQ ID NO: 3108800 - RNA, 20 nt, Human
cuaucucccccagccccauc

SEQ ID NO: 3108801 - RNA, 12 nt, Human
cucaaauaacua

SEQ ID NO: 3108802 - RNA, 14 nt, Human
cucacaaaggaugc

SEQ ID NO: 3108803 - RNA, 21 nt, Human
cucacacaugagcaucaggcc

SEQ ID NO: 3108804 - RNA, 14 nt, Human
cucacacaugagca

SEQ ID NO: 3108805 - RNA, 13 nt, Human
cucaccucucccu

SEQ ID NO: 3108806 - RNA, 17 nt, Human
cucaccucucccuugga

SEQ ID NO: 3108807 - RNA, 16 nt, Human
cucaccucucccuugg

SEQ ID NO: 3108808 - RNA, 15 nt, Human
cucaccucucccuug

SEQ ID NO: 3108809 - RNA, 14 nt, Human
cucaccucucccuu

SEQ ID NO: 3108810 - RNA, 13 nt, Human
cucaccugccccu

SEQ ID NO: 3108811 - RNA, 18 nt, Human
cucaccugccccucaacu

SEQ ID NO: 3108812 - RNA, 16 nt, Human
cucaccugccccucaa

SEQ ID NO: 3108813 - RNA, 14 nt, Human
cucaccugccccuc

SEQ ID NO: 3108814 - RNA, 17 nt, Human
cuagccagaggagagag

SEQ ID NO: 3108815 - RNA, 19 nt, Human
cuagccagaggagagagga

SEQ ID NO: 3108816 - RNA, 13 nt, Human
cuaggccuggcca

SEQ ID NO: 3108817 - RNA, 13 nt, Human
cuaggccugggga

SEQ ID NO: 3108818 - RNA, 12 nt, Human
cuaggccugggg

SEQ ID NO: 3108819 - RNA, 14 nt, Human
cuaggccuggccag

SEQ ID NO: 3108820 - RNA, 15 nt, Human
cuaggccuggccaga

SEQ ID NO: 3108821 - RNA, 18 nt, Human
cuaggccuggccagaugc

SEQ ID NO: 3108822 - RNA, 19 nt, Human
cuaggccuggccagaugca

SEQ ID NO: 3108823 - RNA, 16 nt, Human
cuagcauacguacaca

SEQ ID NO: 3108824 - RNA, 18 nt, Human
cuagcauacguacacauu

SEQ ID NO: 3108825 - RNA, 19 nt, Human
cuagcauacguacacauuu

SEQ ID NO: 3108826 - RNA, 15 nt, Human
cuaguuugauuaaau

SEQ ID NO: 3108827 - RNA, 20 nt, Human
cuaguuugauuaaauucuug

SEQ ID NO: 3108828 - RNA, 17 nt, Human
cuaguuugauuaaauuc

SEQ ID NO: 3108829 - RNA, 19 nt, Human
cuaguuugauuaaauucuu

SEQ ID NO: 3108830 - RNA, 14 nt, Human
cuagggaagauaau

SEQ ID NO: 3108831 - RNA, 23 nt, Human
cuaccugaggggccucuuauggg

SEQ ID NO: 3108832 - RNA, 19 nt, Human
cuaccugaggggccucuua

SEQ ID NO: 3108833 - RNA, 16 nt, Human
cuaccugaggggccuc

SEQ ID NO: 3108834 - RNA, 15 nt, Human
cuaccugaggggccu

SEQ ID NO: 3108835 - RNA, 22 nt, Human
cuaaaguguauuuuuuuacuaa

SEQ ID NO: 3108836 - RNA, 17 nt, Human
cuaaaggcuaccuuugu

SEQ ID NO: 3108837 - RNA, 19 nt, Human
cuaaaggcuaccuuuguau

SEQ ID NO: 3108838 - RNA, 19 nt, Human
cuaaaguguauuuuuuuac

SEQ ID NO: 3108839 - RNA, 14 nt, Human
cuaaagcugccagc

SEQ ID NO: 3108840 - RNA, 15 nt, Human
cuaaaggcuaccuuu

SEQ ID NO: 3108841 - RNA, 16 nt, Human
cuaaaggcuaccuuug

SEQ ID NO: 3108842 - RNA, 15 nt, Human
cuaaagcugccagcc

SEQ ID NO: 3108843 - RNA, 13 nt, Human
cguuaaaauacca

SEQ ID NO: 3108844 - RNA, 13 nt, Human
cguacacauuuua

SEQ ID NO: 3108845 - RNA, 16 nt, Human
cgccuuaaggauguuc

SEQ ID NO: 3108846 - RNA, 18 nt, Human
cgcugccccuggcagccc

SEQ ID NO: 3108847 - RNA, 19 nt, Human
cgcuggaccuugaacuggg

SEQ ID NO: 3108848 - RNA, 23 nt, Human
cgcuggaccuugaacuggguacu

SEQ ID NO: 3108849 - RNA, 13 nt, Human
cgcugccccuggc

SEQ ID NO: 3108850 - RNA, 17 nt, Human
cgcugccccuggcagcc

SEQ ID NO: 3108851 - RNA, 16 nt, Human
cgcugccccuggcagc

SEQ ID NO: 3108852 - RNA, 17 nt, Human
cgcuggggccaguuggu

SEQ ID NO: 3108853 - RNA, 20 nt, Human
cgcuggggccaguugguccc

SEQ ID NO: 3108854 - RNA, 17 nt, Human
cggagaaaggaagggcu

SEQ ID NO: 3108855 - RNA, 18 nt, Human
ccaugaguccccuguuug

SEQ ID NO: 3108856 - RNA, 23 nt, Human
ccaugaggaacaaggcaaggcug

SEQ ID NO: 3108857 - RNA, 20 nt, Human
ccaugaggaacaaggcaagg

SEQ ID NO: 3108858 - RNA, 23 nt, Human
ccaguuggguggaugccuggugg

SEQ ID NO: 3108859 - RNA, 13 nt, Human
ccaguuggucccc

SEQ ID NO: 3108860 - RNA, 20 nt, Human
ccaguuggucccccuuccau

SEQ ID NO: 3108861 - RNA, 18 nt, Human
ccaguuggucccccuucc

SEQ ID NO: 3108862 - RNA, 18 nt, Human
ccauccagguucagcuug

SEQ ID NO: 3108863 - RNA, 19 nt, Human
ccauccagguucagcuugu

SEQ ID NO: 3108864 - RNA, 20 nt, Human
ccaucccauaugccugggca

SEQ ID NO: 3108865 - RNA, 19 nt, Human
ccaucccauaugccugggc

SEQ ID NO: 3108866 - RNA, 21 nt, Human
ccaucccauaugccugggcag

SEQ ID NO: 3108867 - RNA, 22 nt, Human
ccauccccuguagagugggagc

SEQ ID NO: 3108868 - RNA, 13 nt, Human
cccaagcucugcu

SEQ ID NO: 3108869 - RNA, 14 nt, Human
cccaagcucugcuc

SEQ ID NO: 3108870 - RNA, 12 nt, Human
cccaagcucugc

SEQ ID NO: 3108871 - RNA, 20 nt, Human
cccaacucaccccagcccca

SEQ ID NO: 3108872 - RNA, 17 nt, Human
cccaacucaccccagcc

SEQ ID NO: 3108873 - RNA, 12 nt, Human
cccacucccugc

SEQ ID NO: 3108874 - RNA, 13 nt, Human
cccacucccugca

SEQ ID NO: 3108875 - RNA, 23 nt, Human
cccacugcuuuuggucuguguga

SEQ ID NO: 3108876 - RNA, 22 nt, Human
cccacugcuuuuggucugugug

SEQ ID NO: 3108877 - RNA, 16 nt, Human
cccaacucaccccagc

SEQ ID NO: 3108878 - RNA, 15 nt, Human
cccaacucaccccag

SEQ ID NO: 3108879 - RNA, 17 nt, Human
ccagccccauccucugu

SEQ ID NO: 3108880 - RNA, 15 nt, Human
ccagccccauccucu

SEQ ID NO: 3108881 - RNA, 17 nt, Human
ccagccccagugcccac

SEQ ID NO: 3108882 - RNA, 14 nt, Human
ccagcagagcaccu

SEQ ID NO: 3108883 - RNA, 13 nt, Human
ccagcagagcacc

SEQ ID NO: 3108884 - RNA, 12 nt, Human
ccagcagagcac

SEQ ID NO: 3108885 - RNA, 24 nt, Human
ccagccccuucugacccaugcugc

SEQ ID NO: 3108886 - RNA, 23 nt, Human
ccagccccuucugacccaugcug

SEQ ID NO: 3108887 - RNA, 21 nt, Human
ccaggggaaaaucagccugcu

SEQ ID NO: 3108888 - RNA, 12 nt, Human
ccaggcuggcgu

SEQ ID NO: 3108889 - RNA, 23 nt, Human
ccaggcaggucuugaacuccugg

SEQ ID NO: 3108890 - RNA, 12 nt, Human
ccaggcaggucu

SEQ ID NO: 3108891 - RNA, 14 nt, Human
ccaggcaggucuug

SEQ ID NO: 3108892 - RNA, 23 nt, Human
cccagcaagugagagcugggugu

SEQ ID NO: 3108893 - RNA, 16 nt, Human
cccaggaaaggcucca

SEQ ID NO: 3108894 - RNA, 15 nt, Human
cccaggaaaggcucc

SEQ ID NO: 3108895 - RNA, 22 nt, Human
cccaggcuuagucacugagaca

SEQ ID NO: 3108896 - RNA, 20 nt, Human
cccaggcuuagucacugaga

SEQ ID NO: 3108897 - RNA, 18 nt, Human
cccaggaaaggcuccagg

SEQ ID NO: 3108898 - RNA, 17 nt, Human
cccaggaaaggcuccag

SEQ ID NO: 3108899 - RNA, 20 nt, Human
cccauccucuguacagagcc

SEQ ID NO: 3108900 - RNA, 22 nt, Human
cccauccucuguacagagccca

SEQ ID NO: 3108901 - RNA, 21 nt, Human
cccauccucuguacagagccc

SEQ ID NO: 3108902 - RNA, 15 nt, Human
ccccagauugcaaca

SEQ ID NO: 3108903 - RNA, 20 nt, Human
ccccagauugcaacaggcug

SEQ ID NO: 3108904 - RNA, 15 nt, Human
cccauuugcuccuuu

SEQ ID NO: 3108905 - RNA, 13 nt, Human
cccauucugccug

SEQ ID NO: 3108906 - RNA, 19 nt, Human
cccauucugccugcccagg

SEQ ID NO: 3108907 - RNA, 14 nt, Human
cccauucugccugc

SEQ ID NO: 3108908 - RNA, 15 nt, Human
cccauucugccugcc

SEQ ID NO: 3108909 - RNA, 23 nt, Human
ccccgaggccuucucugaaggac

SEQ ID NO: 3108910 - RNA, 14 nt, Human
ccccgcacugggcu

SEQ ID NO: 3108911 - RNA, 16 nt, Human
cccggccccugcuggu

SEQ ID NO: 3108912 - RNA, 15 nt, Human
cccggccccugcugg

SEQ ID NO: 3108913 - RNA, 12 nt, Human
cccgggaagggg

SEQ ID NO: 3108914 - RNA, 15 nt, Human
cccgggaagggggcu

SEQ ID NO: 3108915 - RNA, 13 nt, Human
ccccuucugaccc

SEQ ID NO: 3108916 - RNA, 14 nt, Human
ccccuucugaccca

SEQ ID NO: 3108917 - RNA, 16 nt, Human
cccgaauagcugggac

SEQ ID NO: 3108918 - RNA, 17 nt, Human
cccgaauagcugggacu

SEQ ID NO: 3108919 - RNA, 18 nt, Human
cccgaauagcugggacua

SEQ ID NO: 3108920 - RNA, 17 nt, Human
cccggccaccugcggug

SEQ ID NO: 3108921 - RNA, 16 nt, Human
cccucaacucuccucc

SEQ ID NO: 3108922 - RNA, 16 nt, Human
cccucaacaccucugc

SEQ ID NO: 3108923 - RNA, 21 nt, Human
cccgggaagggggcugggaca

SEQ ID NO: 3108924 - RNA, 18 nt, Human
cccgggaagggggcuggg

SEQ ID NO: 3108925 - RNA, 15 nt, Human
ccccugacaacacuc

SEQ ID NO: 3108926 - RNA, 14 nt, Human
ccccugccacccug

SEQ ID NO: 3108927 - RNA, 16 nt, Human
ccccugccacccuggg

SEQ ID NO: 3108928 - RNA, 16 nt, Human
ccucuuucccucccuu

SEQ ID NO: 3108929 - RNA, 19 nt, Human
ccucuuucccucccuuccu

SEQ ID NO: 3108930 - RNA, 15 nt, Human
ccucuuugagugaag

SEQ ID NO: 3108931 - RNA, 14 nt, Human
ccugcaggcagcca

SEQ ID NO: 3108932 - RNA, 13 nt, Human
ccugcaggcagcc

SEQ ID NO: 3108933 - RNA, 12 nt, Human
ccugcaggcagc

SEQ ID NO: 3108934 - RNA, 17 nt, Human
ccugcccaccuggccuc

SEQ ID NO: 3108935 - RNA, 15 nt, Human
ccugcccaccuggcc

SEQ ID NO: 3108936 - RNA, 16 nt, Human
ccugccucagccuccc

SEQ ID NO: 3108937 - RNA, 15 nt, Human
ccugccucagccucc

SEQ ID NO: 3108938 - RNA, 21 nt, Human
ccugcccaggccccugccacc

SEQ ID NO: 3108939 - RNA, 18 nt, Human
ccugcccaggccccugcc

SEQ ID NO: 3108940 - RNA, 19 nt, Human
ccugcccaggccccugcca

SEQ ID NO: 3108941 - RNA, 19 nt, Human
ccugcccaccuggccucug

SEQ ID NO: 3108942 - RNA, 18 nt, Human
ccugcccaccuggccucu

SEQ ID NO: 3108943 - RNA, 20 nt, Human
ccuggccugagcugggauga

SEQ ID NO: 3108944 - RNA, 22 nt, Human
ccuggccucaagugauucuccu

SEQ ID NO: 3108945 - RNA, 21 nt, Human
ccuggccccucagggucccug

SEQ ID NO: 3108946 - RNA, 20 nt, Human
ccuggccccucagggucccu

SEQ ID NO: 3108947 - RNA, 18 nt, Human
ccuggccccucagggucc

SEQ ID NO: 3108948 - RNA, 16 nt, Human
ccuggccccucagggu

SEQ ID NO: 3108949 - RNA, 18 nt, Human
ccuggauggggcugcacc

SEQ ID NO: 3108950 - RNA, 17 nt, Human
ccuggauggggcugcac

SEQ ID NO: 3108951 - RNA, 15 nt, Human
ccuggauggggcugc

SEQ ID NO: 3108952 - RNA, 15 nt, Human
ccuggggagaaagua

SEQ ID NO: 3108953 - RNA, 18 nt, Human
ccugguggcagugggagc

SEQ ID NO: 3108954 - RNA, 19 nt, Human
ccugguggcagugggagcu

SEQ ID NO: 3108955 - RNA, 20 nt, Human
ccugguggcagugggagcug

SEQ ID NO: 3108956 - RNA, 15 nt, Human
ccugguggcaguggg

SEQ ID NO: 3108957 - RNA, 13 nt, Human
ccugguguggaag

SEQ ID NO: 3108958 - RNA, 18 nt, Human
ccgcagcccugcagaggg

SEQ ID NO: 3108959 - RNA, 14 nt, Human
ccgcagcccugcag

SEQ ID NO: 3108960 - RNA, 14 nt, Human
cccuccuuucacca

SEQ ID NO: 3108961 - RNA, 21 nt, Human
cccugugaguacuacaguccu

SEQ ID NO: 3108962 - RNA, 15 nt, Human
cccugugauggggcc

SEQ ID NO: 3108963 - RNA, 23 nt, Human
cccugugaguacuacaguccucc

SEQ ID NO: 3108964 - RNA, 23 nt, Human
cccuuuuuuggcugcugaaggcu

SEQ ID NO: 3108965 - RNA, 22 nt, Human
cccuuuuuuggcugcugaaggc

SEQ ID NO: 3108966 - RNA, 21 nt, Human
cccuuuuuuggcugcugaagg

SEQ ID NO: 3108967 - RNA, 19 nt, Human
cccuucucuccagccccug

SEQ ID NO: 3108968 - RNA, 14 nt, Human
cccuucucuccagc

SEQ ID NO: 3108969 - RNA, 17 nt, Human
ccggccaccugcggugc

SEQ ID NO: 3108970 - RNA, 18 nt, Human
ccggccaccugcggugcu

SEQ ID NO: 3108971 - RNA, 22 nt, Human
ccuagccuuagaagucacacag

SEQ ID NO: 3108972 - RNA, 19 nt, Human
ccuagccuuagaagucaca

SEQ ID NO: 3108973 - RNA, 23 nt, Human
ccuagccugugccucugggacug

SEQ ID NO: 3108974 - RNA, 21 nt, Human
ccuagcauacguacacauuuu

SEQ ID NO: 3108975 - RNA, 12 nt, Human
ccucccaucacc

SEQ ID NO: 3108976 - RNA, 16 nt, Human
ccuccaagaccuucuc

SEQ ID NO: 3108977 - RNA, 19 nt, Human
ccuccaagaccuucuccuu

SEQ ID NO: 3108978 - RNA, 17 nt, Human
ccuccaagaccuucucc

SEQ ID NO: 3108979 - RNA, 17 nt, Human
ccucccaucacccgcua

SEQ ID NO: 3108980 - RNA, 23 nt, Human
ccucaagugauucuccugccuca

SEQ ID NO: 3108981 - RNA, 20 nt, Human
ccucaagugauucuccugcc

SEQ ID NO: 3108982 - RNA, 18 nt, Human
ccucaggcaggugggaug

SEQ ID NO: 3108983 - RNA, 12 nt, Human
ccucaggcaggu

SEQ ID NO: 3108984 - RNA, 18 nt, Human
ccucauuagcauuuugcu

SEQ ID NO: 3108985 - RNA, 15 nt, Human
ccucaaccuccuggg

SEQ ID NO: 3108986 - RNA, 19 nt, Human
ccucaacucuccuccagag

SEQ ID NO: 3108987 - RNA, 23 nt, Human
ccucaacucuccuccagagucag

SEQ ID NO: 3108988 - RNA, 21 nt, Human
ccucaacucuccuccagaguc

SEQ ID NO: 3108989 - RNA, 16 nt, Human
ccucaacaccucugca

SEQ ID NO: 3108990 - RNA, 20 nt, Human
ccuccuuugugaggaagccg

SEQ ID NO: 3108991 - RNA, 23 nt, Human
ccuccuuugugaggaagccgcug

SEQ ID NO: 3108992 - RNA, 18 nt, Human
ccuccuuuucacaguucu

SEQ ID NO: 3108993 - RNA, 13 nt, Human
ccuccgccucuug

SEQ ID NO: 3108994 - RNA, 14 nt, Human
ccuccgccucuugg

SEQ ID NO: 3108995 - RNA, 18 nt, Human
auugcuugagcucaggag

SEQ ID NO: 3108996 - RNA, 16 nt, Human
auuuaaugaaagacug

SEQ ID NO: 3108997 - RNA, 15 nt, Human
auuuaaugaaagacu

SEQ ID NO: 3108998 - RNA, 20 nt, Human
auuuaaugaaagacuguaca

SEQ ID NO: 3108999 - RNA, 21 nt, Human
auuuaaugaaagacuguacaa

SEQ ID NO: 3109000 - RNA, 14 nt, Human
auuucacucuccuu

SEQ ID NO: 3109001 - RNA, 17 nt, Human
auucuccuuguguuacu

SEQ ID NO: 3109002 - RNA, 18 nt, Human
auucuccuuguguuacua

SEQ ID NO: 3109003 - RNA, 19 nt, Human
auucuccuuguguuacuaa

SEQ ID NO: 3109004 - RNA, 21 nt, Human
auucuccuuguguuacuaagu

SEQ ID NO: 3109005 - RNA, 22 nt, Human
auucuccuuguguuacuaaguu

SEQ ID NO: 3109006 - RNA, 17 nt, Human
auucucuaguuugauua

SEQ ID NO: 3109007 - RNA, 18 nt, Human
auucucuaguuugauuaa

SEQ ID NO: 3109008 - RNA, 19 nt, Human
auucuucugcuucagccuc

SEQ ID NO: 3109009 - RNA, 20 nt, Human
auucuucugcuucagccucc

SEQ ID NO: 3109010 - RNA, 22 nt, Human
auucuucuguacgucugacagg

SEQ ID NO: 3109011 - RNA, 14 nt, Human
auucuucugcuuca

SEQ ID NO: 3109012 - RNA, 14 nt, Human
auucuugcaaagua

SEQ ID NO: 3109013 - RNA, 15 nt, Human
auucuugcaaaguau

SEQ ID NO: 3109014 - RNA, 16 nt, Human
auucuugcaaaguauc

SEQ ID NO: 3109015 - RNA, 18 nt, Human
auucaacagguuuuccug

SEQ ID NO: 3109016 - RNA, 19 nt, Human
auuaaaugcccagccccuu

SEQ ID NO: 3109017 - RNA, 17 nt, Human
auuaaaugcccagcccc

SEQ ID NO: 3109018 - RNA, 23 nt, Human
auuaugcaugaaguaauaugcac

SEQ ID NO: 3109019 - RNA, 18 nt, Human
caacucaccccagcccca

SEQ ID NO: 3109020 - RNA, 17 nt, Human
caacucaccccagcccc

SEQ ID NO: 3109021 - RNA, 22 nt, Human
caagaauugaagcaggacuaaa

SEQ ID NO: 3109022 - RNA, 14 nt, Human
caacucuccuccag

SEQ ID NO: 3109023 - RNA, 16 nt, Human
caagaccacguuucua

SEQ ID NO: 3109024 - RNA, 17 nt, Human
caagaccacguuucuaa

SEQ ID NO: 3109025 - RNA, 18 nt, Human
caagaccacguuucuaaa

SEQ ID NO: 3109026 - RNA, 21 nt, Human
caaaucugcuuuuuaaagaau

SEQ ID NO: 3109027 - RNA, 21 nt, Human
caaagcagugcaugcuguccc

SEQ ID NO: 3109028 - RNA, 18 nt, Human
caaagcagugcaugcugu

SEQ ID NO: 3109029 - RNA, 14 nt, Human
caaagauauuuugc

SEQ ID NO: 3109030 - RNA, 16 nt, Human
caaagauauuuugcuu

SEQ ID NO: 3109031 - RNA, 22 nt, Human
caaagcagugcaugcugucccu

SEQ ID NO: 3109032 - RNA, 19 nt, Human
caaaguaucccuacuguaa

SEQ ID NO: 3109033 - RNA, 21 nt, Human
caaaguaucccuacuguaauu

SEQ ID NO: 3109034 - RNA, 22 nt, Human
caaaguagaagucuuagaugua

SEQ ID NO: 3109035 - RNA, 19 nt, Human
caaaagcugggcagguugg

SEQ ID NO: 3109036 - RNA, 17 nt, Human
auuuuuuuuuccuucag

SEQ ID NO: 3109037 - RNA, 22 nt, Human
auuuuuuuuuccuucagugccu

SEQ ID NO: 3109038 - RNA, 20 nt, Human
auuuuuuuuuccuucagugc

SEQ ID NO: 3109039 - RNA, 16 nt, Human
auuuuuuugagacaga

SEQ ID NO: 3109040 - RNA, 18 nt, Human
auuuuuuuuuccuucagu

SEQ ID NO: 3109041 - RNA, 14 nt, Human
auuuuuagacagag

SEQ ID NO: 3109042 - RNA, 16 nt, Human
auuuuuaagugcugca

SEQ ID NO: 3109043 - RNA, 18 nt, Human
auuuuuaagugcugcauu

SEQ ID NO: 3109044 - RNA, 19 nt, Human
auuuuuaagugcugcauuu

SEQ ID NO: 3109045 - RNA, 16 nt, Human
caaggcaaggcuguca

SEQ ID NO: 3109046 - RNA, 17 nt, Human
caaggcaaggcugucaa

SEQ ID NO: 3109047 - RNA, 18 nt, Human
caaggcaaggcugucaau

SEQ ID NO: 3109048 - RNA, 21 nt, Human
caaggccaaaggaagcacaug

SEQ ID NO: 3109049 - RNA, 20 nt, Human
caaggccaaaggaagcacau

SEQ ID NO: 3109050 - RNA, 19 nt, Human
caaggccaaaggaagcaca

SEQ ID NO: 3109051 - RNA, 15 nt, Human
caaugggagcucaug

SEQ ID NO: 3109052 - RNA, 19 nt, Human
cacaagagcccaggccucc

SEQ ID NO: 3109053 - RNA, 18 nt, Human
cacaagagcccaggccuc

SEQ ID NO: 3109054 - RNA, 19 nt, Human
cacaagcuccaagcuccca

SEQ ID NO: 3109055 - RNA, 18 nt, Human
cacaagcuccaagcuccc

SEQ ID NO: 3109056 - RNA, 20 nt, Human
cacaagagcccaggccuccu

SEQ ID NO: 3109057 - RNA, 17 nt, Human
cacaagagcccaggccu

SEQ ID NO: 3109058 - RNA, 16 nt, Human
caauggcagccuuggc

SEQ ID NO: 3109059 - RNA, 12 nt, Human
caaugcuggcug

SEQ ID NO: 3109060 - RNA, 20 nt, Human
caaugcuggcuguuggcugg

SEQ ID NO: 3109061 - RNA, 21 nt, Human
caaugcuggcuguuggcuggg

SEQ ID NO: 3109062 - RNA, 13 nt, Human
caaugcuggcugu

SEQ ID NO: 3109063 - RNA, 20 nt, Human
cacaagcuccaagcucccag

SEQ ID NO: 3109064 - RNA, 16 nt, Human
cacccaggagccccga

SEQ ID NO: 3109065 - RNA, 18 nt, Human
cacccaccucagccuccc

SEQ ID NO: 3109066 - RNA, 13 nt, Human
caccagccccagu

SEQ ID NO: 3109067 - RNA, 17 nt, Human
cacccaccucagccucc

SEQ ID NO: 3109068 - RNA, 19 nt, Human
cacauuuuauuuuauuaug

SEQ ID NO: 3109069 - RNA, 20 nt, Human
cacauuuuauuuuauuaugc

SEQ ID NO: 3109070 - RNA, 17 nt, Human
cacauuuuauuuuauua

SEQ ID NO: 3109071 - RNA, 14 nt, Human
caccaacgucugug

SEQ ID NO: 3109072 - RNA, 14 nt, Human
cacagacccugccc

SEQ ID NO: 3109073 - RNA, 17 nt, Human
cacagacccugcccugu

SEQ ID NO: 3109074 - RNA, 16 nt, Human
cacagacccugcccug

SEQ ID NO: 3109075 - RNA, 11 nt, Human
cacagcucugu

SEQ ID NO: 3109076 - RNA, 14 nt, Human
cacagcucuguccu

SEQ ID NO: 3109077 - RNA, 17 nt, Human
cacagcucuucuccagg

SEQ ID NO: 3109078 - RNA, 14 nt, Human
cacagcucuucucc

SEQ ID NO: 3109079 - RNA, 15 nt, Human
cacagcucuucucca

SEQ ID NO: 3109080 - RNA, 15 nt, Human
cacagcucuguccug

SEQ ID NO: 3109081 - RNA, 16 nt, Human
cacagcucuguccugg

SEQ ID NO: 3109082 - RNA, 18 nt, Human
cacagcucuguccuggga

SEQ ID NO: 3109083 - RNA, 10 nt, Human
cacagcucuu

SEQ ID NO: 3109084 - RNA, 10 nt, Human
cacacauuuu

SEQ ID NO: 3109085 - RNA, 11 nt, Human
cacacauuuuu

SEQ ID NO: 3109086 - RNA, 12 nt, Human
cacacauuuuuu

SEQ ID NO: 3109087 - RNA, 16 nt, Human
cacacauuuuuuaaau

SEQ ID NO: 3109088 - RNA, 19 nt, Human
cacacauuuuuuaaaugca

SEQ ID NO: 3109089 - RNA, 20 nt, Human
cacacauuuuuuaaaugcac

SEQ ID NO: 3109090 - RNA, 14 nt, Human
caccuuucccaucu

SEQ ID NO: 3109091 - RNA, 17 nt, Human
caccuuuguccccaccg

SEQ ID NO: 3109092 - RNA, 18 nt, Human
caccuuggcugcagggag

SEQ ID NO: 3109093 - RNA, 15 nt, Human
caccuuggcugcagg

SEQ ID NO: 3109094 - RNA, 16 nt, Human
caccuuggcugcaggg

SEQ ID NO: 3109095 - RNA, 20 nt, Human
cacucuuauugcccacgcug

SEQ ID NO: 3109096 - RNA, 21 nt, Human
cacucuuauugcccacgcugg

SEQ ID NO: 3109097 - RNA, 22 nt, Human
cacucuuauugcccacgcugga

SEQ ID NO: 3109098 - RNA, 14 nt, Human
cacggcucacugca

SEQ ID NO: 3109099 - RNA, 17 nt, Human
cacggccaggccagagg

SEQ ID NO: 3109100 - RNA, 12 nt, Human
cacggccaggcc

SEQ ID NO: 3109101 - RNA, 13 nt, Human
cacggccaggcca

SEQ ID NO: 3109102 - RNA, 20 nt, Human
cacucugucgcccagucugg

SEQ ID NO: 3109103 - RNA, 13 nt, Human
cacuccagccugg

SEQ ID NO: 3109104 - RNA, 14 nt, Human
cacuccagccuggg

SEQ ID NO: 3109105 - RNA, 16 nt, Human
cacuacauucuguuaa

SEQ ID NO: 3109106 - RNA, 17 nt, Human
cacuacauucuguuaau

SEQ ID NO: 3109107 - RNA, 21 nt, Human
cacuacauucuguuaaucauu

SEQ ID NO: 3109108 - RNA, 13 nt, Human
cacuuucuagcca

SEQ ID NO: 3109109 - RNA, 17 nt, Human
cacuuucuagccagagg

SEQ ID NO: 3109110 - RNA, 16 nt, Human
cacuuucuagccagag

SEQ ID NO: 3109111 - RNA, 18 nt, Human
cacuuguguuaugaagca

SEQ ID NO: 3109112 - RNA, 17 nt, Human
cacugccaugccagcuu

SEQ ID NO: 3109113 - RNA, 20 nt, Human
cacugcagccucaaccuccu

SEQ ID NO: 3109114 - RNA, 21 nt, Human
cacugcagccucaaccuccug

SEQ ID NO: 3109115 - RNA, 22 nt, Human
cacugcagccucaaccuccugg

SEQ ID NO: 3109116 - RNA, 23 nt, Human
cacugcagccucaaccuccuggg

SEQ ID NO: 3109117 - RNA, 19 nt, Human
cacugcagccucaaccucc

SEQ ID NO: 3109118 - RNA, 14 nt, Human
cacugcagccucaa

SEQ ID NO: 3109119 - RNA, 17 nt, Human
cacuguugcccaggcug

SEQ ID NO: 3109120 - RNA, 23 nt, Human
cacuguugcccaggcuggcgugc

SEQ ID NO: 3109121 - RNA, 18 nt, Human
cacuguugcccaggcugg

SEQ ID NO: 3109122 - RNA, 19 nt, Human
cacuguugcccaggcuggc

SEQ ID NO: 3109123 - RNA, 16 nt, Human
cagaaauguacagcaa

SEQ ID NO: 3109124 - RNA, 16 nt, Human
cagaaguuucugccgc

SEQ ID NO: 3109125 - RNA, 14 nt, Human
cagaaguuucugcc

SEQ ID NO: 3109126 - RNA, 15 nt, Human
cagugccaaaaacaa

SEQ ID NO: 3109127 - RNA, 11 nt, Human
cagugggagcu

SEQ ID NO: 3109128 - RNA, 12 nt, Human
cagugcccacag

SEQ ID NO: 3109129 - RNA, 19 nt, Human
cagucugauucccaagcuc

SEQ ID NO: 3109130 - RNA, 20 nt, Human
cagucugauucccaagcucu

SEQ ID NO: 3109131 - RNA, 19 nt, Human
cagugcaugcugucccuua

SEQ ID NO: 3109132 - RNA, 23 nt, Human
cagugcaugcugucccuuacgug

SEQ ID NO: 3109133 - RNA, 22 nt, Human
cagugcaugcugucccuuacgu

SEQ ID NO: 3109134 - RNA, 21 nt, Human
cagggucucacucugucgccc

SEQ ID NO: 3109135 - RNA, 17 nt, Human
cagggucucacucuguc

SEQ ID NO: 3109136 - RNA, 18 nt, Human
cagggucucacucugucg

SEQ ID NO: 3109137 - RNA, 14 nt, Human
caggugcgaaagga

SEQ ID NO: 3109138 - RNA, 20 nt, Human
caggugcuaggaacacuccu

SEQ ID NO: 3109139 - RNA, 18 nt, Human
caggugcuaggaacacuc

SEQ ID NO: 3109140 - RNA, 14 nt, Human
cagguugguggggg

SEQ ID NO: 3109141 - RNA, 12 nt, Human
caggguuggccc

SEQ ID NO: 3109142 - RNA, 16 nt, Human
caggugauccacccac

SEQ ID NO: 3109143 - RNA, 17 nt, Human
caggugauccacccacc

SEQ ID NO: 3109144 - RNA, 22 nt, Human
caggugcacaagcuccaagcuc

SEQ ID NO: 3109145 - RNA, 19 nt, Human
cagucaccccggccaccug

SEQ ID NO: 3109146 - RNA, 20 nt, Human
cagucaccccggccaccugc

SEQ ID NO: 3109147 - RNA, 22 nt, Human
cagucaccccggccaccugcgg

SEQ ID NO: 3109148 - RNA, 16 nt, Human
cagguuuaagcuguua

SEQ ID NO: 3109149 - RNA, 18 nt, Human
cagguuuaagcuguuacu

SEQ ID NO: 3109150 - RNA, 22 nt, Human
cagggaguccgaaagggacuug

SEQ ID NO: 3109151 - RNA, 18 nt, Human
cagggaggugaccccagg

SEQ ID NO: 3109152 - RNA, 16 nt, Human
caggcugggcuucagu

SEQ ID NO: 3109153 - RNA, 15 nt, Human
caggcugggcuucag

SEQ ID NO: 3109154 - RNA, 17 nt, Human
caggcugggcuucagug

SEQ ID NO: 3109155 - RNA, 19 nt, Human
caggcugggcuucaguggc

SEQ ID NO: 3109156 - RNA, 16 nt, Human
caggccagagggagug

SEQ ID NO: 3109157 - RNA, 19 nt, Human
caggccagagggagugaca

SEQ ID NO: 3109158 - RNA, 21 nt, Human
caggccagagggagugacaga

SEQ ID NO: 3109159 - RNA, 16 nt, Human
caggaggccagccuug

SEQ ID NO: 3109160 - RNA, 15 nt, Human
caggaggccagccuu

SEQ ID NO: 3109161 - RNA, 14 nt, Human
caggaggccagccu

SEQ ID NO: 3109162 - RNA, 17 nt, Human
caggaggccagccuuga

SEQ ID NO: 3109163 - RNA, 22 nt, Human
caggcacccaccaucaugucug

SEQ ID NO: 3109164 - RNA, 23 nt, Human
caggcacccaccaucaugucugg

SEQ ID NO: 3109165 - RNA, 18 nt, Human
caggcacccaccaucaug

SEQ ID NO: 3109166 - RNA, 15 nt, Human
cagcggggacagcuc

SEQ ID NO: 3109167 - RNA, 14 nt, Human
cagcggggacagcu

SEQ ID NO: 3109168 - RNA, 16 nt, Human
cagcggggacagcucc

SEQ ID NO: 3109169 - RNA, 17 nt, Human
cagcggggacagcuccu

SEQ ID NO: 3109170 - RNA, 15 nt, Human
cagcccuuagcaggg

SEQ ID NO: 3109171 - RNA, 16 nt, Human
cagcccuuagcaggga

SEQ ID NO: 3109172 - RNA, 21 nt, Human
cagcccuuagcagggaaacag

SEQ ID NO: 3109173 - RNA, 21 nt, Human
cagccccuggaugcagccuca

SEQ ID NO: 3109174 - RNA, 19 nt, Human
cagccccuggaugcagccu

SEQ ID NO: 3109175 - RNA, 18 nt, Human
cagccccuggaugcagcc

SEQ ID NO: 3109176 - RNA, 17 nt, Human
cagccccuggaugcagc

SEQ ID NO: 3109177 - RNA, 14 nt, Human
cagccccuggaugc

SEQ ID NO: 3109178 - RNA, 13 nt, Human
cagccccuggaug

SEQ ID NO: 3109179 - RNA, 12 nt, Human
cagccccuggau

SEQ ID NO: 3109180 - RNA, 21 nt, Human
cagccgagauagccaaggcca

SEQ ID NO: 3109181 - RNA, 20 nt, Human
cagccgagauagccaaggcc

SEQ ID NO: 3109182 - RNA, 22 nt, Human
cagcuccagcucaccagcccca

SEQ ID NO: 3109183 - RNA, 16 nt, Human
cagcuccagcucacca

SEQ ID NO: 3109184 - RNA, 17 nt, Human
cagcuccagcucaccag

SEQ ID NO: 3109185 - RNA, 18 nt, Human
cagcuccagcucaccagc

SEQ ID NO: 3109186 - RNA, 20 nt, Human
cagcuccagcucaccagccc

SEQ ID NO: 3109187 - RNA, 13 nt, Human
cagcuccagcuca

SEQ ID NO: 3109188 - RNA, 14 nt, Human
cagcuccagcucac

SEQ ID NO: 3109189 - RNA, 15 nt, Human
cagcuccagcucacc

SEQ ID NO: 3109190 - RNA, 18 nt, Human
cagcugugcucuggacag

SEQ ID NO: 3109191 - RNA, 15 nt, Human
cagcuucauuuccug

SEQ ID NO: 3109192 - RNA, 18 nt, Human
cagcuucauuuccugugu

SEQ ID NO: 3109193 - RNA, 15 nt, Human
caggaaaggcuccag

SEQ ID NO: 3109194 - RNA, 14 nt, Human
caggaaaggcucca

SEQ ID NO: 3109195 - RNA, 20 nt, Human
cagagucagaaguuucugcc

SEQ ID NO: 3109196 - RNA, 20 nt, Human
cagaggggguggccucccaa

SEQ ID NO: 3109197 - RNA, 19 nt, Human
cagaggggguggccuccca

SEQ ID NO: 3109198 - RNA, 17 nt, Human
cagaggggguggccucc

SEQ ID NO: 3109199 - RNA, 18 nt, Human
cagaggggguggccuccc

SEQ ID NO: 3109200 - RNA, 22 nt, Human
cagagggccugcaagggaguga

SEQ ID NO: 3109201 - RNA, 18 nt, Human
cagagcugccaccugccu

SEQ ID NO: 3109202 - RNA, 16 nt, Human
cagagcugccaccugc

SEQ ID NO: 3109203 - RNA, 22 nt, Human
cagaaguuugagaucagccugg

SEQ ID NO: 3109204 - RNA, 23 nt, Human
cagaaguuucugccgcagcccug

SEQ ID NO: 3109205 - RNA, 20 nt, Human
cagaaguuugagaucagccu

SEQ ID NO: 3109206 - RNA, 13 nt, Human
cagccaggccaca

SEQ ID NO: 3109207 - RNA, 12 nt, Human
cagccaggccac

SEQ ID NO: 3109208 - RNA, 23 nt, Human
cagcauauucaggaagcucaggg

SEQ ID NO: 3109209 - RNA, 22 nt, Human
cagcauauucaggaagcucagg

SEQ ID NO: 3109210 - RNA, 19 nt, Human
cagcauauucaggaagcuc

SEQ ID NO: 3109211 - RNA, 15 nt, Human
cauauucaggaagcu

SEQ ID NO: 3109212 - RNA, 14 nt, Human
cauauucaggaagc

SEQ ID NO: 3109213 - RNA, 20 nt, Human
cauauucaggaagcucaggg

SEQ ID NO: 3109214 - RNA, 20 nt, Human
cauaugccugggcagaagga

SEQ ID NO: 3109215 - RNA, 15 nt, Human
cauaugccugggcag

SEQ ID NO: 3109216 - RNA, 13 nt, Human
cauaugccugggc

SEQ ID NO: 3109217 - RNA, 22 nt, Human
cauaugccugggcagaaggaag

SEQ ID NO: 3109218 - RNA, 19 nt, Human
cauagcagagaaugaaagg

SEQ ID NO: 3109219 - RNA, 22 nt, Human
cauagcagagaaugaaagggcc

SEQ ID NO: 3109220 - RNA, 14 nt, Human
cauccccuguagag

SEQ ID NO: 3109221 - RNA, 19 nt, Human
caucccauaugccugggca

SEQ ID NO: 3109222 - RNA, 15 nt, Human
caucaggccaggccc

SEQ ID NO: 3109223 - RNA, 19 nt, Human
caucaggccaggcccucug

SEQ ID NO: 3109224 - RNA, 16 nt, Human
caucaggccaggcccu

SEQ ID NO: 3109225 - RNA, 14 nt, Human
caucaggccaggcc

SEQ ID NO: 3109226 - RNA, 17 nt, Human
caucccagccccaauga

SEQ ID NO: 3109227 - RNA, 22 nt, Human
cauuaggugugacugaauuucu

SEQ ID NO: 3109228 - RNA, 23 nt, Human
cauuaucuagauacuguaucaug

SEQ ID NO: 3109229 - RNA, 12 nt, Human
cauguuggccag

SEQ ID NO: 3109230 - RNA, 13 nt, Human
cauguuggccagg

SEQ ID NO: 3109231 - RNA, 16 nt, Human
cauguccaagaagccc

SEQ ID NO: 3109232 - RNA, 18 nt, Human
cauguccaagaagcccag

SEQ ID NO: 3109233 - RNA, 20 nt, Human
cauguccaagaagcccagga

SEQ ID NO: 3109234 - RNA, 19 nt, Human
cauguccaagaagcccagg

SEQ ID NO: 3109235 - RNA, 12 nt, Human
cauuccuguucc

SEQ ID NO: 3109236 - RNA, 15 nt, Human
caugcugcccuguga

SEQ ID NO: 3109237 - RNA, 14 nt, Human
caugcugcccugug

SEQ ID NO: 3109238 - RNA, 23 nt, Human
caugacacgaauauugcugaugg

SEQ ID NO: 3109239 - RNA, 21 nt, Human
caugacacgaauauugcugau

SEQ ID NO: 3109240 - RNA, 15 nt, Human
caugaaguaauaugc

SEQ ID NO: 3109241 - RNA, 19 nt, Human
caugaaguaauaugcacac

SEQ ID NO: 3109242 - RNA, 22 nt, Human
caugaaguaauaugcacacauu

SEQ ID NO: 3109243 - RNA, 23 nt, Human
caugaaguaauaugcacacauuu

SEQ ID NO: 3109244 - RNA, 16 nt, Human
caugcacgugugugca

SEQ ID NO: 3109245 - RNA, 13 nt, Human
caugcuccuggcc

SEQ ID NO: 3109246 - RNA, 13 nt, Human
caugcugcccugu

SEQ ID NO: 3109247 - RNA, 12 nt, Human
caugcugcccug

SEQ ID NO: 3109248 - RNA, 23 nt, Human
caugauuaaccacuucagcugac

SEQ ID NO: 3109249 - RNA, 22 nt, Human
caugauuaaccacuucagcuga

SEQ ID NO: 3109250 - RNA, 24 nt, Human
caugauuaaccacuucagcugacu

SEQ ID NO: 3109251 - RNA, 22 nt, Human
ccacagagaaaguacuucucca

SEQ ID NO: 3109252 - RNA, 18 nt, Human
ccacgcuggaccuugaac

SEQ ID NO: 3109253 - RNA, 18 nt, Human
ccaccuuggcugcaggga

SEQ ID NO: 3109254 - RNA, 19 nt, Human
ccaccuuggcugcagggag

SEQ ID NO: 3109255 - RNA, 12 nt, Human
ccaccuuggcug

SEQ ID NO: 3109256 - RNA, 14 nt, Human
ccaccuuggcugca

SEQ ID NO: 3109257 - RNA, 15 nt, Human
ccaccuuggcugcag

SEQ ID NO: 3109258 - RNA, 16 nt, Human
ccaccuuggcugcagg

SEQ ID NO: 3109259 - RNA, 19 nt, Human
ccaccaucaugucuggcua

SEQ ID NO: 3109260 - RNA, 18 nt, Human
ccaccaucaccagacagg

SEQ ID NO: 3109261 - RNA, 18 nt, Human
ccaccaucaugucuggcu

SEQ ID NO: 3109262 - RNA, 12 nt, Human
ccaagcuggucc

SEQ ID NO: 3109263 - RNA, 19 nt, Human
ccaagcuggucccacucag

SEQ ID NO: 3109264 - RNA, 14 nt, Human
ccaagaagcccagg

SEQ ID NO: 3109265 - RNA, 15 nt, Human
ccaaggccaaaggaa

SEQ ID NO: 3109266 - RNA, 22 nt, Human
ccaaauggaaaugggcagagca

SEQ ID NO: 3109267 - RNA, 15 nt, Human
ccaacgucugugcca

SEQ ID NO: 3109268 - RNA, 13 nt, Human
ccaacgucugugc

SEQ ID NO: 3109269 - RNA, 13 nt, Human
ccaagaagcccag

SEQ ID NO: 3109270 - RNA, 16 nt, Human
ccaaggccaaaggaag

SEQ ID NO: 3109271 - RNA, 19 nt, Human
cauuuuuuaaaugcaccug

SEQ ID NO: 3109272 - RNA, 15 nt, Human
cauuuuuuaaaugca

SEQ ID NO: 3109273 - RNA, 16 nt, Human
cauuuuuuaaaugcac

SEQ ID NO: 3109274 - RNA, 14 nt, Human
cauuuauucugcuc

SEQ ID NO: 3109275 - RNA, 17 nt, Human
cauuugucacacacuuu

SEQ ID NO: 3109276 - RNA, 15 nt, Human
cauuuggauuggaug

SEQ ID NO: 3109277 - RNA, 22 nt, Human
ggcagccccuguucuggcagag

SEQ ID NO: 3109278 - RNA, 20 nt, Human
ggcaguggugguuuucuguu

SEQ ID NO: 3109279 - RNA, 21 nt, Human
ggcaguggugguuuucuguuc

SEQ ID NO: 3109280 - RNA, 19 nt, Human
ggcacagaaaauggaagac

SEQ ID NO: 3109281 - RNA, 21 nt, Human
ggcacagaaaauggaagacag

SEQ ID NO: 3109282 - RNA, 20 nt, Human
ggcacagaaaauggaagaca

SEQ ID NO: 3109283 - RNA, 23 nt, Human
ggcacagaaaauggaagacagcu

SEQ ID NO: 3109284 - RNA, 23 nt, Human
ggcacucagaagacacugauggg

SEQ ID NO: 3109285 - RNA, 20 nt, Human
ggcacucagaagacacugau

SEQ ID NO: 3109286 - RNA, 13 nt, Human
ggcacaucagcac

SEQ ID NO: 3109287 - RNA, 23 nt, Human
ggcagccccauucugccugccca

SEQ ID NO: 3109288 - RNA, 11 nt, Human
ggcagccccug

SEQ ID NO: 3109289 - RNA, 16 nt, Human
ggagagaagagaaugc

SEQ ID NO: 3109290 - RNA, 13 nt, Human
ggccccugcuggu

SEQ ID NO: 3109291 - RNA, 14 nt, Human
ggccccugcugguu

SEQ ID NO: 3109292 - RNA, 13 nt, Human
ggcccggcuccag

SEQ ID NO: 3109293 - RNA, 23 nt, Human
ggccccugcugguucaggguugg

SEQ ID NO: 3109294 - RNA, 15 nt, Human
ggcccggcuccaggc

SEQ ID NO: 3109295 - RNA, 21 nt, Human
ggcccuucucuccagccccug

SEQ ID NO: 3109296 - RNA, 20 nt, Human
ggcccuucucuccagccccu

SEQ ID NO: 3109297 - RNA, 19 nt, Human
ggcccuucucuccagcccc

SEQ ID NO: 3109298 - RNA, 23 nt, Human
ggcccuucucuccagccccugga

SEQ ID NO: 3109299 - RNA, 22 nt, Human
ggcccuucucuccagccccugg

SEQ ID NO: 3109300 - RNA, 23 nt, Human
ggccucaagugauucuccugccu

SEQ ID NO: 3109301 - RNA, 17 nt, Human
ggccaguuggucccccu

SEQ ID NO: 3109302 - RNA, 14 nt, Human
ggccaguugguccc

SEQ ID NO: 3109303 - RNA, 20 nt, Human
ggccagugugacaaggauug

SEQ ID NO: 3109304 - RNA, 18 nt, Human
ggcucagcggggacagcu

SEQ ID NO: 3109305 - RNA, 20 nt, Human
ggcucagguggggucacucu

SEQ ID NO: 3109306 - RNA, 19 nt, Human
ggcucagguggggucacuc

SEQ ID NO: 3109307 - RNA, 19 nt, Human
ggcucagcggggacagcuc

SEQ ID NO: 3109308 - RNA, 20 nt, Human
ggcucagcggggacagcucc

SEQ ID NO: 3109309 - RNA, 11 nt, Human
ggcucucaggc

SEQ ID NO: 3109310 - RNA, 13 nt, Human
ggcucucaggcca

SEQ ID NO: 3109311 - RNA, 12 nt, Human
ggcucuuccagg

SEQ ID NO: 3109312 - RNA, 22 nt, Human
ggcugcaugcgggcuuccuccu

SEQ ID NO: 3109313 - RNA, 20 nt, Human
ggcugccaaugggagcucau

SEQ ID NO: 3109314 - RNA, 19 nt, Human
ggcugccaaugggagcuca

SEQ ID NO: 3109315 - RNA, 22 nt, Human
ggcugcggaaugaaccacaucu

SEQ ID NO: 3109316 - RNA, 16 nt, Human
ggcugggagagccuuc

SEQ ID NO: 3109317 - RNA, 15 nt, Human
ggcugggagagccuu

SEQ ID NO: 3109318 - RNA, 14 nt, Human
ggcugggagagccu

SEQ ID NO: 3109319 - RNA, 13 nt, Human
ggcugggagagcc

SEQ ID NO: 3109320 - RNA, 21 nt, Human
ggcuuccuccugguguggaag

SEQ ID NO: 3109321 - RNA, 18 nt, Human
gggaagaagcucucuccu

SEQ ID NO: 3109322 - RNA, 12 nt, Human
gggacagcuccu

SEQ ID NO: 3109323 - RNA, 13 nt, Human
gggacagcuccuu

SEQ ID NO: 3109324 - RNA, 15 nt, Human
gggacagcuccuucu

SEQ ID NO: 3109325 - RNA, 15 nt, Human
ggcugggggccucag

SEQ ID NO: 3109326 - RNA, 16 nt, Human
ggcugggggccucagu

SEQ ID NO: 3109327 - RNA, 17 nt, Human
ggcugggggccucagug

SEQ ID NO: 3109328 - RNA, 19 nt, Human
ggcugggggccucagugcc

SEQ ID NO: 3109329 - RNA, 19 nt, Human
ggcuggguggcaccagcag

SEQ ID NO: 3109330 - RNA, 21 nt, Human
ggcuggguucuacccaggugc

SEQ ID NO: 3109331 - RNA, 19 nt, Human
ggcuggguucuacccaggu

SEQ ID NO: 3109332 - RNA, 18 nt, Human
ggcuucaguggcagcugc

SEQ ID NO: 3109333 - RNA, 17 nt, Human
ggcuucaguggcagcug

SEQ ID NO: 3109334 - RNA, 19 nt, Human
ggcuucaguggcagcugcu

SEQ ID NO: 3109335 - RNA, 20 nt, Human
ggcuucaguggcagcugcuu

SEQ ID NO: 3109336 - RNA, 18 nt, Human
ggcuguaucccaugagcc

SEQ ID NO: 3109337 - RNA, 16 nt, Human
ggcuuccucauaguau

SEQ ID NO: 3109338 - RNA, 18 nt, Human
ggcuucauccuccucaga

SEQ ID NO: 3109339 - RNA, 22 nt, Human
ggcuucauccuccucagaucuu

SEQ ID NO: 3109340 - RNA, 13 nt, Human
aaaacaugcuaca

SEQ ID NO: 3109341 - RNA, 14 nt, Human
aaaacaugcuacac

SEQ ID NO: 3109342 - RNA, 12 nt, Human
aaaacccaagug

SEQ ID NO: 3109343 - RNA, 20 nt, Human
gggaccagagcugccaccug

SEQ ID NO: 3109344 - RNA, 14 nt, Human
gggaccagagcugc

SEQ ID NO: 3109345 - RNA, 18 nt, Human
aaaacucuccucugcugc

SEQ ID NO: 3109346 - RNA, 23 nt, Human
gggagcaggcucgggcuccccag

SEQ ID NO: 3109347 - RNA, 19 nt, Human
gggagagccuuccaggggu

SEQ ID NO: 3109348 - RNA, 15 nt, Human
gggagagccuuccag

SEQ ID NO: 3109349 - RNA, 16 nt, Human
gggagggagggcucca

SEQ ID NO: 3109350 - RNA, 15 nt, Human
gggagggagggcucc

SEQ ID NO: 3109351 - RNA, 18 nt, Human
gggaggucaaggcugcag

SEQ ID NO: 3109352 - RNA, 21 nt, Human
gggagaaccaaaaagaggcua

SEQ ID NO: 3109353 - RNA, 15 nt, Human
gggacuuggaagcuc

SEQ ID NO: 3109354 - RNA, 17 nt, Human
gggacuuggaagcuccg

SEQ ID NO: 3109355 - RNA, 18 nt, Human
gggacuuggaagcuccgc

SEQ ID NO: 3109356 - RNA, 23 nt, Human
gggacuuggaagcuccgcuuucu

SEQ ID NO: 3109357 - RNA, 13 nt, Human
gguggaugccugg

SEQ ID NO: 3109358 - RNA, 12 nt, Human
ggugcaaugacc

SEQ ID NO: 3109359 - RNA, 13 nt, Human
ggugcaaugaccu

SEQ ID NO: 3109360 - RNA, 18 nt, Human
ggugauccacccaccuca

SEQ ID NO: 3109361 - RNA, 23 nt, Human
ggugauccacccaccucagccuc

SEQ ID NO: 3109362 - RNA, 24 nt, Human
ggugauccacccaccucagccucc

SEQ ID NO: 3109363 - RNA, 13 nt, Human
ggucgaggcagga

SEQ ID NO: 3109364 - RNA, 13 nt, Human
ggugaacagaaca

SEQ ID NO: 3109365 - RNA, 15 nt, Human
aaagcuuguuaagau

SEQ ID NO: 3109366 - RNA, 13 nt, Human
aaagcugcugaca

SEQ ID NO: 3109367 - RNA, 22 nt, Human
aaagcugccagccgagauagcc

SEQ ID NO: 3109368 - RNA, 22 nt, Human
aaaggaaagagggagguaagga

SEQ ID NO: 3109369 - RNA, 17 nt, Human
aaaggagauuggaagga

SEQ ID NO: 3109370 - RNA, 17 nt, Human
aaaggagagcuagcagc

SEQ ID NO: 3109371 - RNA, 21 nt, Human
aaaggagagcuagcagcaggg

SEQ ID NO: 3109372 - RNA, 22 nt, Human
aaagggacuuggaagcuccgcu

SEQ ID NO: 3109373 - RNA, 11 nt, Human
gguccugcugc

SEQ ID NO: 3109374 - RNA, 12 nt, Human
gguccugcugca

SEQ ID NO: 3109375 - RNA, 19 nt, Human
aaagaugcuucucacugcc

SEQ ID NO: 3109376 - RNA, 14 nt, Human
aaagaugcuucuca

SEQ ID NO: 3109377 - RNA, 17 nt, Human
aaagaugcuucucacug

SEQ ID NO: 3109378 - RNA, 23 nt, Human
aaagacugaguacguugugcauu

SEQ ID NO: 3109379 - RNA, 13 nt, Human
aaagacuguacaa

SEQ ID NO: 3109380 - RNA, 23 nt, Human
aaaccaagucaagugaaaaagga

SEQ ID NO: 3109381 - RNA, 15 nt, Human
aaacgggcucagcaa

SEQ ID NO: 3109382 - RNA, 19 nt, Human
ggguggcaccagcagccug

SEQ ID NO: 3109383 - RNA, 17 nt, Human
aaacuuaaucuaaaugg

SEQ ID NO: 3109384 - RNA, 18 nt, Human
aaacuuaaucuaaaugga

SEQ ID NO: 3109385 - RNA, 16 nt, Human
aaacuuaaucuaaaug

SEQ ID NO: 3109386 - RNA, 14 nt, Human
aaacuuaaucuaaa

SEQ ID NO: 3109387 - RNA, 11 nt, Human
aaacacauuuu

SEQ ID NO: 3109388 - RNA, 20 nt, Human
aaaauuuugauguuuuaagg

SEQ ID NO: 3109389 - RNA, 19 nt, Human
aaaauuuagaaauauaauu

SEQ ID NO: 3109390 - RNA, 13 nt, Human
gggaugagaaagg

SEQ ID NO: 3109391 - RNA, 18 nt, Human
ggggaauguuugccucug

SEQ ID NO: 3109392 - RNA, 22 nt, Human
ggggaauguuugccucugccuc

SEQ ID NO: 3109393 - RNA, 15 nt, Human
ggggaccagagcugc

SEQ ID NO: 3109394 - RNA, 16 nt, Human
ggggaccagagcugcc

SEQ ID NO: 3109395 - RNA, 12 nt, Human
gggggccucagu

SEQ ID NO: 3109396 - RNA, 15 nt, Human
gggggccucagugcc

SEQ ID NO: 3109397 - RNA, 17 nt, Human
gggggccucagugccac

SEQ ID NO: 3109398 - RNA, 18 nt, Human
gggggccucagugccacu

SEQ ID NO: 3109399 - RNA, 20 nt, Human
aaaguacacuguuucaaacu

SEQ ID NO: 3109400 - RNA, 19 nt, Human
aaaguacuucuccacccug

SEQ ID NO: 3109401 - RNA, 23 nt, Human
aaaguacuucuccacccugcucu

SEQ ID NO: 3109402 - RNA, 20 nt, Human
aaaguacuucuccacccugc

SEQ ID NO: 3109403 - RNA, 21 nt, Human
aaaguacuucuccacccugcu

SEQ ID NO: 3109404 - RNA, 18 nt, Human
aaaguaucccuacuguaa

SEQ ID NO: 3109405 - RNA, 14 nt, Human
aaauauaauugaca

SEQ ID NO: 3109406 - RNA, 18 nt, Human
aaauaccagccaguaaau

SEQ ID NO: 3109407 - RNA, 17 nt, Human
aaauacagauagauaua

SEQ ID NO: 3109408 - RNA, 14 nt, Human
guaauaugcacaca

SEQ ID NO: 3109409 - RNA, 16 nt, Human
guaauaugcacacauu

SEQ ID NO: 3109410 - RNA, 17 nt, Human
guaauaugcacacauuu

SEQ ID NO: 3109411 - RNA, 18 nt, Human
guaauaugcacacauuuu

SEQ ID NO: 3109412 - RNA, 22 nt, Human
guaauuugugauacaaugcugu

SEQ ID NO: 3109413 - RNA, 19 nt, Human
aaauauuaagaaagacuau

SEQ ID NO: 3109414 - RNA, 16 nt, Human
aaaucagcugcuacua

SEQ ID NO: 3109415 - RNA, 18 nt, Human
aaaucagccugcuccagc

SEQ ID NO: 3109416 - RNA, 12 nt, Human
aaaucagccugc

SEQ ID NO: 3109417 - RNA, 19 nt, Human
aaaucagccguguaaccau

SEQ ID NO: 3109418 - RNA, 19 nt, Human
guacauggaauaacaugua

SEQ ID NO: 3109419 - RNA, 17 nt, Human
guacaugaaaacacauu

SEQ ID NO: 3109420 - RNA, 18 nt, Human
guacaugaaaacacauuu

SEQ ID NO: 3109421 - RNA, 19 nt, Human
guacaugaaaacacauuuu

SEQ ID NO: 3109422 - RNA, 20 nt, Human
guacaugaaaacacauuuuu

SEQ ID NO: 3109423 - RNA, 14 nt, Human
guacaugaaaacac

SEQ ID NO: 3109424 - RNA, 15 nt, Human
guacaugaaaacaca

SEQ ID NO: 3109425 - RNA, 16 nt, Human
guacaugaaaacacau

SEQ ID NO: 3109426 - RNA, 12 nt, Human
guacccacugcu

SEQ ID NO: 3109427 - RNA, 18 nt, Human
guagaagcccuucuaccu

SEQ ID NO: 3109428 - RNA, 21 nt, Human
guagaagucuuagauguauau

SEQ ID NO: 3109429 - RNA, 20 nt, Human
guagaaauaucugaaaaugu

SEQ ID NO: 3109430 - RNA, 21 nt, Human
guagaaauaucugaaaaugua

SEQ ID NO: 3109431 - RNA, 23 nt, Human
guagaaauaucugaaaauguaug

SEQ ID NO: 3109432 - RNA, 11 nt, Human
guagagacagg

SEQ ID NO: 3109433 - RNA, 12 nt, Human
guagagacaggg

SEQ ID NO: 3109434 - RNA, 15 nt, Human
guagagccagggucu

SEQ ID NO: 3109435 - RNA, 13 nt, Human
guagagacagggu

SEQ ID NO: 3109436 - RNA, 10 nt, Human
guagagccag

SEQ ID NO: 3109437 - RNA, 11 nt, Human
guagagccagg

SEQ ID NO: 3109438 - RNA, 15 nt, Human
guacuauguaucaau

SEQ ID NO: 3109439 - RNA, 17 nt, Human
guacuauguaucaauga

SEQ ID NO: 3109440 - RNA, 17 nt, Human
guacuacaguccuccca

SEQ ID NO: 3109441 - RNA, 13 nt, Human
guacuauguauca

SEQ ID NO: 3109442 - RNA, 13 nt, Human
guacccacugcuc

SEQ ID NO: 3109443 - RNA, 14 nt, Human
guacccacugcucu

SEQ ID NO: 3109444 - RNA, 19 nt, Human
guacuacaguccucccauc

SEQ ID NO: 3109445 - RNA, 18 nt, Human
guacuacaguccucccau

SEQ ID NO: 3109446 - RNA, 16 nt, Human
guacuggagaaaaugg

SEQ ID NO: 3109447 - RNA, 15 nt, Human
ggaagccgcuggggc

SEQ ID NO: 3109448 - RNA, 22 nt, Human
ggaagcucagggccuggcucag

SEQ ID NO: 3109449 - RNA, 11 nt, Human
ggaagcuccgc

SEQ ID NO: 3109450 - RNA, 23 nt, Human
ggaagcucagggccuggcucagg

SEQ ID NO: 3109451 - RNA, 15 nt, Human
ggaagcucagggccu

SEQ ID NO: 3109452 - RNA, 16 nt, Human
ggaaggaaacccagcu

SEQ ID NO: 3109453 - RNA, 20 nt, Human
ggaaggaaacccagcucugg

SEQ ID NO: 3109454 - RNA, 19 nt, Human
ggaaggaaacccagcucug

SEQ ID NO: 3109455 - RNA, 17 nt, Human
ggacacuaaccacgcug

SEQ ID NO: 3109456 - RNA, 19 nt, Human
ggacagcuccuucuguccu

SEQ ID NO: 3109457 - RNA, 20 nt, Human
ggacagcuccuucuguccua

SEQ ID NO: 3109458 - RNA, 17 nt, Human
ggacagcuccuucuguc

SEQ ID NO: 3109459 - RNA, 14 nt, Human
ggacacagcucuuc

SEQ ID NO: 3109460 - RNA, 15 nt, Human
ggacacagcucuucu

SEQ ID NO: 3109461 - RNA, 18 nt, Human
ggacacagcucuucucca

SEQ ID NO: 3109462 - RNA, 16 nt, Human
ggaauccagacccggc

SEQ ID NO: 3109463 - RNA, 18 nt, Human
ggaauaacauguaauuaa

SEQ ID NO: 3109464 - RNA, 13 nt, Human
ggacaagagcagg

SEQ ID NO: 3109465 - RNA, 23 nt, Human
ggacaaggaugaucuaggaagac

SEQ ID NO: 3109466 - RNA, 22 nt, Human
ggacaaggaugaucuaggaaga

SEQ ID NO: 3109467 - RNA, 15 nt, Human
ggaagagaaaaaaua

SEQ ID NO: 3109468 - RNA, 18 nt, Human
ggaagacuuuggaaagag

SEQ ID NO: 3109469 - RNA, 13 nt, Human
ggaagagaaaaaa

SEQ ID NO: 3109470 - RNA, 22 nt, Human
ggaagacaaugugaaaagaaaa

SEQ ID NO: 3109471 - RNA, 14 nt, Human
ggaagacagcucuu

SEQ ID NO: 3109472 - RNA, 13 nt, Human
ggaagacagcucu

SEQ ID NO: 3109473 - RNA, 12 nt, Human
ggaagacuuugg

SEQ ID NO: 3109474 - RNA, 17 nt, Human
ggaagacuuuggaaaga

SEQ ID NO: 3109475 - RNA, 13 nt, Human
ggaagacuuugga

SEQ ID NO: 3109476 - RNA, 19 nt, Human
ggaacacuccuucacagau

SEQ ID NO: 3109477 - RNA, 14 nt, Human
ggaacacucugaga

SEQ ID NO: 3109478 - RNA, 12 nt, Human
ggaacacucuga

SEQ ID NO: 3109479 - RNA, 16 nt, Human
ggaacacucugagacu

SEQ ID NO: 3109480 - RNA, 15 nt, Human
ggaacacucugagac

SEQ ID NO: 3109481 - RNA, 12 nt, Human
ggacccccugaa

SEQ ID NO: 3109482 - RNA, 11 nt, Human
ggacccugagg

SEQ ID NO: 3109483 - RNA, 19 nt, Human
ggacccugaggcccagagg

SEQ ID NO: 3109484 - RNA, 13 nt, Human
ggacccugaggcc

SEQ ID NO: 3109485 - RNA, 12 nt, Human
ggacccugaggc

SEQ ID NO: 3109486 - RNA, 12 nt, Human
ggaccucaggcc

SEQ ID NO: 3109487 - RNA, 13 nt, Human
ggaccucaggccu

SEQ ID NO: 3109488 - RNA, 20 nt, Human
ggacguguuaugacuccaga

SEQ ID NO: 3109489 - RNA, 15 nt, Human
ggaccucaggccugg

SEQ ID NO: 3109490 - RNA, 14 nt, Human
ggaccucaggccug

SEQ ID NO: 3109491 - RNA, 20 nt, Human
ggacuaacuugucuuuggac

SEQ ID NO: 3109492 - RNA, 15 nt, Human
ggacucaaugcacug

SEQ ID NO: 3109493 - RNA, 14 nt, Human
ggacuacaggugug

SEQ ID NO: 3109494 - RNA, 24 nt, Human
ggacuaacuugucuuuggacccug

SEQ ID NO: 3109495 - RNA, 16 nt, Human
ggacucaaugcacuga

SEQ ID NO: 3109496 - RNA, 16 nt, Human
ggagaaaggaagggcu

SEQ ID NO: 3109497 - RNA, 14 nt, Human
ggacuuggaagcuc

SEQ ID NO: 3109498 - RNA, 23 nt, Human
gcuggguggcaccagcagccugg

SEQ ID NO: 3109499 - RNA, 22 nt, Human
gcuggguggcaccagcagccug

SEQ ID NO: 3109500 - RNA, 21 nt, Human
gcuggguggcaccagcagccu

SEQ ID NO: 3109501 - RNA, 15 nt, Human
gcuggcuguuggcug

SEQ ID NO: 3109502 - RNA, 16 nt, Human
gcuggcuguuggcugg

SEQ ID NO: 3109503 - RNA, 23 nt, Human
gcugggguggggaccucaggccu

SEQ ID NO: 3109504 - RNA, 20 nt, Human
gcuggcgugcaguggugcga

SEQ ID NO: 3109505 - RNA, 18 nt, Human
gcuggagugcagugagcc

SEQ ID NO: 3109506 - RNA, 17 nt, Human
gcuggagugcagugagc

SEQ ID NO: 3109507 - RNA, 22 nt, Human
gcuggagugcagugagccgaga

SEQ ID NO: 3109508 - RNA, 20 nt, Human
gcuggccuggccccucaggg

SEQ ID NO: 3109509 - RNA, 13 nt, Human
gcugcuggcuggu

SEQ ID NO: 3109510 - RNA, 16 nt, Human
gcucugguccauagag

SEQ ID NO: 3109511 - RNA, 15 nt, Human
gcucugguccauaga

SEQ ID NO: 3109512 - RNA, 15 nt, Human
gcugcugaaggcucg

SEQ ID NO: 3109513 - RNA, 14 nt, Human
gcugcugaaggcuc

SEQ ID NO: 3109514 - RNA, 13 nt, Human
gcugcugaaggcu

SEQ ID NO: 3109515 - RNA, 12 nt, Human
gcugcugaaggc

SEQ ID NO: 3109516 - RNA, 22 nt, Human
gcuuccucauaguaugguggcu

SEQ ID NO: 3109517 - RNA, 23 nt, Human
gcuucuucagagacuccugcagg

SEQ ID NO: 3109518 - RNA, 20 nt, Human
gcuuguaaauagcucaggug

SEQ ID NO: 3109519 - RNA, 14 nt, Human
gcuugagcucagga

SEQ ID NO: 3109520 - RNA, 22 nt, Human
gcuugaccuuuaagagaaauga

SEQ ID NO: 3109521 - RNA, 12 nt, Human
gcuuguacauaa

SEQ ID NO: 3109522 - RNA, 12 nt, Human
gcuucagccucc

SEQ ID NO: 3109523 - RNA, 18 nt, Human
gcuucacggaagagccuu

SEQ ID NO: 3109524 - RNA, 18 nt, Human
gcuucaaggauccugagc

SEQ ID NO: 3109525 - RNA, 19 nt, Human
gcuucaaggauccugagcc

SEQ ID NO: 3109526 - RNA, 21 nt, Human
gcuucaaggauccugagccag

SEQ ID NO: 3109527 - RNA, 20 nt, Human
gcuucaaggauccugagcca

SEQ ID NO: 3109528 - RNA, 15 nt, Human
gcuucacggaagagc

SEQ ID NO: 3109529 - RNA, 17 nt, Human
gcuucacggaagagccu

SEQ ID NO: 3109530 - RNA, 12 nt, Human
gcccccacuggu

SEQ ID NO: 3109531 - RNA, 17 nt, Human
gccccugccacccuggg

SEQ ID NO: 3109532 - RNA, 16 nt, Human
gccccugccacccugg

SEQ ID NO: 3109533 - RNA, 23 nt, Human
gcccgggcucugccucccaucac

SEQ ID NO: 3109534 - RNA, 16 nt, Human
gcccugcagagggcac

SEQ ID NO: 3109535 - RNA, 18 nt, Human
gcccugcagagggcacag

SEQ ID NO: 3109536 - RNA, 15 nt, Human
gcccugcccaccugg

SEQ ID NO: 3109537 - RNA, 11 nt, Human
gcccugccucc

SEQ ID NO: 3109538 - RNA, 22 nt, Human
gcccugcccaccuggccucugc

SEQ ID NO: 3109539 - RNA, 21 nt, Human
gcccugcccaccuggccucug

SEQ ID NO: 3109540 - RNA, 20 nt, Human
gcccugcccaccuggccucu

SEQ ID NO: 3109541 - RNA, 17 nt, Human
gcccugcccaccuggcc

SEQ ID NO: 3109542 - RNA, 19 nt, Human
gccgcagcccugcagaggg

SEQ ID NO: 3109543 - RNA, 20 nt, Human
gccgcagcccugcagagggc

SEQ ID NO: 3109544 - RNA, 22 nt, Human
gcccuuagcagggaaacagcua

SEQ ID NO: 3109545 - RNA, 13 nt, Human
gcccugccuccuu

SEQ ID NO: 3109546 - RNA, 12 nt, Human
gcccugccuccu

SEQ ID NO: 3109547 - RNA, 19 nt, Human
gcccuuagcagggaaacag

SEQ ID NO: 3109548 - RNA, 20 nt, Human
gcccuuagcagggaaacagc

SEQ ID NO: 3109549 - RNA, 20 nt, Human
gccuaggugacagagugaga

SEQ ID NO: 3109550 - RNA, 19 nt, Human
gccuagcauacguacacau

SEQ ID NO: 3109551 - RNA, 23 nt, Human
gccuagcauacguacacauuuua

SEQ ID NO: 3109552 - RNA, 21 nt, Human
gccuagcauacguacacauuu

SEQ ID NO: 3109553 - RNA, 22 nt, Human
gccuagcauacguacacauuuu

SEQ ID NO: 3109554 - RNA, 20 nt, Human
gccuagcauacguacacauu

SEQ ID NO: 3109555 - RNA, 13 nt, Human
gccuaggugacag

SEQ ID NO: 3109556 - RNA, 14 nt, Human
gccuaggugacaga

SEQ ID NO: 3109557 - RNA, 15 nt, Human
gccuaggugacagag

SEQ ID NO: 3109558 - RNA, 17 nt, Human
gccucgaacuggcugca

SEQ ID NO: 3109559 - RNA, 19 nt, Human
gccuccugugugugcgccu

SEQ ID NO: 3109560 - RNA, 23 nt, Human
gccuccugugugugcgccuacag

SEQ ID NO: 3109561 - RNA, 16 nt, Human
gccucccaaagugcug

SEQ ID NO: 3109562 - RNA, 13 nt, Human
gccuccugugugu

SEQ ID NO: 3109563 - RNA, 17 nt, Human
gccucccaaagugcugg

SEQ ID NO: 3109564 - RNA, 13 nt, Human
gccugcccaggcc

SEQ ID NO: 3109565 - RNA, 14 nt, Human
gccugcccaggccc

SEQ ID NO: 3109566 - RNA, 14 nt, Human
gccucuuggguuca

SEQ ID NO: 3109567 - RNA, 21 nt, Human
gccucuuaugggcuggguucu

SEQ ID NO: 3109568 - RNA, 16 nt, Human
gccucuuaugggcugg

SEQ ID NO: 3109569 - RNA, 18 nt, Human
gccucuuaugggcugggu

SEQ ID NO: 3109570 - RNA, 17 nt, Human
gccucuuaugggcuggg

SEQ ID NO: 3109571 - RNA, 20 nt, Human
gccucgaacuggcugcaaag

SEQ ID NO: 3109572 - RNA, 22 nt, Human
gccucgaacuggcugcaaaggg

SEQ ID NO: 3109573 - RNA, 22 nt, Human
gccugcccaggccccugccacc

SEQ ID NO: 3109574 - RNA, 12 nt, Human
gccugcccaggc

SEQ ID NO: 3109575 - RNA, 15 nt, Human
gccugcccaggcccc

SEQ ID NO: 3109576 - RNA, 20 nt, Human
gccugcccaggccccugcca

SEQ ID NO: 3109577 - RNA, 13 nt, Human
gccuggccugagc

SEQ ID NO: 3109578 - RNA, 18 nt, Human
gccuggccugagcuggga

SEQ ID NO: 3109579 - RNA, 14 nt, Human
gccuggccugagcu

SEQ ID NO: 3109580 - RNA, 20 nt, Human
gccuggccugagcugggaug

SEQ ID NO: 3109581 - RNA, 18 nt, Human
gccugugccucugggacu

SEQ ID NO: 3109582 - RNA, 13 nt, Human
gccuggcucaggu

SEQ ID NO: 3109583 - RNA, 16 nt, Human
gccugugccucuggga

SEQ ID NO: 3109584 - RNA, 17 nt, Human
gccugugccucugggac

SEQ ID NO: 3109585 - RNA, 14 nt, Human
gccuguugggccag

SEQ ID NO: 3109586 - RNA, 20 nt, Human
gccuguugggccaggagccu

SEQ ID NO: 3109587 - RNA, 18 nt, Human
gccuguugggccaggagc

SEQ ID NO: 3109588 - RNA, 16 nt, Human
gccuguugggccagga

SEQ ID NO: 3109589 - RNA, 15 nt, Human
gccuguugggccagg

SEQ ID NO: 3109590 - RNA, 22 nt, Human
gcgaucuggguucacugcaacc

SEQ ID NO: 3109591 - RNA, 17 nt, Human
gcgagcccugguggcag

SEQ ID NO: 3109592 - RNA, 15 nt, Human
gcgagcccugguggc

SEQ ID NO: 3109593 - RNA, 20 nt, Human
gccuugaccauucuccaccu

SEQ ID NO: 3109594 - RNA, 19 nt, Human
gccuugaccauucuccacc

SEQ ID NO: 3109595 - RNA, 17 nt, Human
gccuugaccauucucca

SEQ ID NO: 3109596 - RNA, 16 nt, Human
gccuugaccauucucc

SEQ ID NO: 3109597 - RNA, 20 nt, Human
gcuccagcucaccagcccca

SEQ ID NO: 3109598 - RNA, 21 nt, Human
gcuccagcucaccagccccag

SEQ ID NO: 3109599 - RNA, 17 nt, Human
gcuccagcucaccagcc

SEQ ID NO: 3109600 - RNA, 18 nt, Human
gcuccagcucaccagccc

SEQ ID NO: 3109601 - RNA, 15 nt, Human
gcuccuggcccacug

SEQ ID NO: 3109602 - RNA, 14 nt, Human
gcuccuggcccacu

SEQ ID NO: 3109603 - RNA, 20 nt, Human
gcuccuggcccacugcaucg

SEQ ID NO: 3109604 - RNA, 19 nt, Human
gcuccuggcccacugcauc

SEQ ID NO: 3109605 - RNA, 18 nt, Human
gcuccuggcccacugcau

SEQ ID NO: 3109606 - RNA, 23 nt, Human
gcucugaucauccacugugccau

SEQ ID NO: 3109607 - RNA, 17 nt, Human
gcucugaucauccacug

SEQ ID NO: 3109608 - RNA, 23 nt, Human
gcucugcaagaauugaagcagga

SEQ ID NO: 3109609 - RNA, 11 nt, Human
gcucugcccuu

SEQ ID NO: 3109610 - RNA, 16 nt, Human
gcuaggccuggccaga

SEQ ID NO: 3109611 - RNA, 17 nt, Human
gcuaggccuggccagau

SEQ ID NO: 3109612 - RNA, 23 nt, Human
gcuaggccuggccagaugcacca

SEQ ID NO: 3109613 - RNA, 19 nt, Human
gcuauucaguaauaacucu

SEQ ID NO: 3109614 - RNA, 13 nt, Human
gcuaugcauuuga

SEQ ID NO: 3109615 - RNA, 22 nt, Human
gcuagugugguguuuccuggca

SEQ ID NO: 3109616 - RNA, 21 nt, Human
gcuagugugguguuuccuggc

SEQ ID NO: 3109617 - RNA, 12 nt, Human
gcuaugcauuug

SEQ ID NO: 3109618 - RNA, 17 nt, Human
gcucacugcagccucaa

SEQ ID NO: 3109619 - RNA, 15 nt, Human
gcucacugcagccuc

SEQ ID NO: 3109620 - RNA, 16 nt, Human
gcucacugcagccuca

SEQ ID NO: 3109621 - RNA, 11 nt, Human
gcucacugcag

SEQ ID NO: 3109622 - RNA, 12 nt, Human
gcucacugcagc

SEQ ID NO: 3109623 - RNA, 13 nt, Human
gcucacugcagcc

SEQ ID NO: 3109624 - RNA, 14 nt, Human
gcucacugcagccu

SEQ ID NO: 3109625 - RNA, 18 nt, Human
gcuauucaguaauaacuc

SEQ ID NO: 3109626 - RNA, 20 nt, Human
gcuauucaguaauaacucua

SEQ ID NO: 3109627 - RNA, 16 nt, Human
gcucaggugucccugc

SEQ ID NO: 3109628 - RNA, 14 nt, Human
gcucaggugucccu

SEQ ID NO: 3109629 - RNA, 23 nt, Human
gcucagguggggucacucuggca

SEQ ID NO: 3109630 - RNA, 13 nt, Human
gcucagagagggu

SEQ ID NO: 3109631 - RNA, 14 nt, Human
gcucagagagggug

SEQ ID NO: 3109632 - RNA, 20 nt, Human
gcgggaggauguucugggac

SEQ ID NO: 3109633 - RNA, 20 nt, Human
gcgugcacacaccagagccc

SEQ ID NO: 3109634 - RNA, 21 nt, Human
gcgggaggauguucugggaca

SEQ ID NO: 3109635 - RNA, 22 nt, Human
gcgggaggauguucugggacac

SEQ ID NO: 3109636 - RNA, 19 nt, Human
gcgugcacacaccagagcc

SEQ ID NO: 3109637 - RNA, 23 nt, Human
gcgugcacacaccagagcccacc

SEQ ID NO: 3109638 - RNA, 18 nt, Human
gcguuucuaugacacaug

SEQ ID NO: 3109639 - RNA, 13 nt, Human
gcuaaugggacac

SEQ ID NO: 3109640 - RNA, 15 nt, Human
gcuaaugggacacua

SEQ ID NO: 3109641 - RNA, 23 nt, Human
gcuaagugauccucccaccucag

SEQ ID NO: 3109642 - RNA, 21 nt, Human
gaugaugaaaugaggucagag

SEQ ID NO: 3109643 - RNA, 14 nt, Human
gaugcuuguacaua

SEQ ID NO: 3109644 - RNA, 16 nt, Human
gaugcuuguacauaau

SEQ ID NO: 3109645 - RNA, 20 nt, Human
gaucuggguucacugcaacc

SEQ ID NO: 3109646 - RNA, 18 nt, Human
gaucuggguucacugcaa

SEQ ID NO: 3109647 - RNA, 19 nt, Human
gauucuccugccucagccu

SEQ ID NO: 3109648 - RNA, 20 nt, Human
gauucuccugccucagccuc

SEQ ID NO: 3109649 - RNA, 21 nt, Human
gauucuccugccucagccucc

SEQ ID NO: 3109650 - RNA, 20 nt, Human
gauuuaacagaaauguacag

SEQ ID NO: 3109651 - RNA, 23 nt, Human
gauuuaacagaaauguacagcaa

SEQ ID NO: 3109652 - RNA, 21 nt, Human
gauucuucugcuucagccucc

SEQ ID NO: 3109653 - RNA, 20 nt, Human
gauucuucugcuucagccuc

SEQ ID NO: 3109654 - RNA, 23 nt, Human
gauucuuauggacaaugacccag

SEQ ID NO: 3109655 - RNA, 22 nt, Human
gauuuuuuuuuccuucagugcc

SEQ ID NO: 3109656 - RNA, 23 nt, Human
gauuuuuuuuuccuucagugccu

SEQ ID NO: 3109657 - RNA, 16 nt, Human
gauuucacucuccuug

SEQ ID NO: 3109658 - RNA, 13 nt, Human
gauuucacucucc

SEQ ID NO: 3109659 - RNA, 19 nt, Human
gauuuaacagaaauguaca

SEQ ID NO: 3109660 - RNA, 18 nt, Human
gauuucacucuccuuggu

SEQ ID NO: 3109661 - RNA, 17 nt, Human
gauuucacucuccuugg

SEQ ID NO: 3109662 - RNA, 12 nt, Human
gcaccuccugcc

SEQ ID NO: 3109663 - RNA, 16 nt, Human
gcaccggcuggccugg

SEQ ID NO: 3109664 - RNA, 15 nt, Human
gcaccggcuggccug

SEQ ID NO: 3109665 - RNA, 17 nt, Human
gcaccggcuggccuggc

SEQ ID NO: 3109666 - RNA, 11 nt, Human
gcacacauuuu

SEQ ID NO: 3109667 - RNA, 12 nt, Human
gcacacauuuuu

SEQ ID NO: 3109668 - RNA, 20 nt, Human
gcacacaccagagcccaccu

SEQ ID NO: 3109669 - RNA, 15 nt, Human
gcacuccagccuggg

SEQ ID NO: 3109670 - RNA, 17 nt, Human
gcacuccagccugggug

SEQ ID NO: 3109671 - RNA, 22 nt, Human
gcacuauaauguaagcucuacu

SEQ ID NO: 3109672 - RNA, 22 nt, Human
gcacuauagccuaggugacaga

SEQ ID NO: 3109673 - RNA, 11 nt, Human
gcaauaaagca

SEQ ID NO: 3109674 - RNA, 23 nt, Human
gcaauaaggggagaguaacccug

SEQ ID NO: 3109675 - RNA, 12 nt, Human
gcacacaccaga

SEQ ID NO: 3109676 - RNA, 14 nt, Human
gcacacaccagagc

SEQ ID NO: 3109677 - RNA, 15 nt, Human
gcacacaccagagcc

SEQ ID NO: 3109678 - RNA, 16 nt, Human
gcacacaccagagccc

SEQ ID NO: 3109679 - RNA, 17 nt, Human
gcacacaccagagccca

SEQ ID NO: 3109680 - RNA, 18 nt, Human
gcacacaccagagcccac

SEQ ID NO: 3109681 - RNA, 19 nt, Human
gcacacaccagagcccacc

SEQ ID NO: 3109682 - RNA, 18 nt, Human
gcaaccuccgccucuugg

SEQ ID NO: 3109683 - RNA, 22 nt, Human
gcaacccuggugaccagcacca

SEQ ID NO: 3109684 - RNA, 17 nt, Human
gcaacccccagccugcu

SEQ ID NO: 3109685 - RNA, 16 nt, Human
gcaaaagaugcuucuc

SEQ ID NO: 3109686 - RNA, 18 nt, Human
gcaacccccagccugcua

SEQ ID NO: 3109687 - RNA, 15 nt, Human
gcaaaagaugcuucu

SEQ ID NO: 3109688 - RNA, 17 nt, Human
gcauccuggcacccggc

SEQ ID NO: 3109689 - RNA, 21 nt, Human
gcauccuggcacccggccccu

SEQ ID NO: 3109690 - RNA, 14 nt, Human
gcauccuggcaccc

SEQ ID NO: 3109691 - RNA, 22 nt, Human
gcauccuggcacccggccccug

SEQ ID NO: 3109692 - RNA, 23 nt, Human
gcauccuggcacccggccccugc

SEQ ID NO: 3109693 - RNA, 19 nt, Human
gcaugggaaugaaugucag

SEQ ID NO: 3109694 - RNA, 16 nt, Human
gcaugggaaugaaugu

SEQ ID NO: 3109695 - RNA, 13 nt, Human
gcaugggaaugaa

SEQ ID NO: 3109696 - RNA, 17 nt, Human
gcaugugaugagaggaa

SEQ ID NO: 3109697 - RNA, 14 nt, Human
gcauuugaaaauuu

SEQ ID NO: 3109698 - RNA, 16 nt, Human
gcauuugaaaauuuug

SEQ ID NO: 3109699 - RNA, 12 nt, Human
gcauuuaaaaga

SEQ ID NO: 3109700 - RNA, 15 nt, Human
gcauuuaaaagauac

SEQ ID NO: 3109701 - RNA, 18 nt, Human
gccaagaauucuuaaaua

SEQ ID NO: 3109702 - RNA, 14 nt, Human
gccaagaauucuua

SEQ ID NO: 3109703 - RNA, 11 nt, Human
gccaaggccaa

SEQ ID NO: 3109704 - RNA, 17 nt, Human
gccaaggccaaaggaag

SEQ ID NO: 3109705 - RNA, 15 nt, Human
gcauaccacuuuugu

SEQ ID NO: 3109706 - RNA, 15 nt, Human
gcauaaaaauuagcc

SEQ ID NO: 3109707 - RNA, 23 nt, Human
gcaguugccagucaccccggcca

SEQ ID NO: 3109708 - RNA, 14 nt, Human
gcaguugccaguca

SEQ ID NO: 3109709 - RNA, 19 nt, Human
gcagcugcgguccacccag

SEQ ID NO: 3109710 - RNA, 22 nt, Human
gcagcugcgguccacccaggag

SEQ ID NO: 3109711 - RNA, 23 nt, Human
gcagcugcgguccacccaggagc

SEQ ID NO: 3109712 - RNA, 13 nt, Human
gcagcugcuuuug

SEQ ID NO: 3109713 - RNA, 20 nt, Human
gcagcugcuuuugucuaugg

SEQ ID NO: 3109714 - RNA, 16 nt, Human
gcagcuugaggguugg

SEQ ID NO: 3109715 - RNA, 17 nt, Human
gcaggcucucaggccag

SEQ ID NO: 3109716 - RNA, 13 nt, Human
gcagggaaacagc

SEQ ID NO: 3109717 - RNA, 22 nt, Human
gcagggaaacagcuaaugggac

SEQ ID NO: 3109718 - RNA, 19 nt, Human
gcagcuugaggguugggcu

SEQ ID NO: 3109719 - RNA, 21 nt, Human
gcagcuugaggguugggcugg

SEQ ID NO: 3109720 - RNA, 12 nt, Human
gcaggcucucag

SEQ ID NO: 3109721 - RNA, 22 nt, Human
gcaggcucgggcuccccagccc

SEQ ID NO: 3109722 - RNA, 16 nt, Human
gcaggcucucaggcca

SEQ ID NO: 3109723 - RNA, 15 nt, Human
gcaggcucucaggcc

SEQ ID NO: 3109724 - RNA, 14 nt, Human
gcaggcucucaggc

SEQ ID NO: 3109725 - RNA, 13 nt, Human
gcaggcucucagg

SEQ ID NO: 3109726 - RNA, 16 nt, Human
gcacuuuguucuggcu

SEQ ID NO: 3109727 - RNA, 15 nt, Human
gagcugccuguucag

SEQ ID NO: 3109728 - RNA, 16 nt, Human
gagcugccuguucagc

SEQ ID NO: 3109729 - RNA, 19 nt, Human
gagcugccuguucagcucc

SEQ ID NO: 3109730 - RNA, 17 nt, Human
gagcaucaggccaggcc

SEQ ID NO: 3109731 - RNA, 13 nt, Human
gagccuuccaggg

SEQ ID NO: 3109732 - RNA, 12 nt, Human
gagccuuccagg

SEQ ID NO: 3109733 - RNA, 22 nt, Human
gagcaucaggccaggcccucug

SEQ ID NO: 3109734 - RNA, 20 nt, Human
gagcaucaggccaggcccuc

SEQ ID NO: 3109735 - RNA, 19 nt, Human
gaggccagagacacaagcc

SEQ ID NO: 3109736 - RNA, 20 nt, Human
gaggccagagacacaagccu

SEQ ID NO: 3109737 - RNA, 14 nt, Human
gaggcucugcccuu

SEQ ID NO: 3109738 - RNA, 13 nt, Human
gaggcucugcccu

SEQ ID NO: 3109739 - RNA, 12 nt, Human
gaggcucugccc

SEQ ID NO: 3109740 - RNA, 17 nt, Human
gaggcucugcccuuggu

SEQ ID NO: 3109741 - RNA, 15 nt, Human
gaggcucugcccuug

SEQ ID NO: 3109742 - RNA, 12 nt, Human
gaggggaacaga

SEQ ID NO: 3109743 - RNA, 15 nt, Human
gagggcuccagacac

SEQ ID NO: 3109744 - RNA, 14 nt, Human
gagggcuccagaca

SEQ ID NO: 3109745 - RNA, 13 nt, Human
gagggcuccagac

SEQ ID NO: 3109746 - RNA, 12 nt, Human
gagggcuccaga

SEQ ID NO: 3109747 - RNA, 13 nt, Human
gaggugggauccu

SEQ ID NO: 3109748 - RNA, 16 nt, Human
gaggugggauccucca

SEQ ID NO: 3109749 - RNA, 15 nt, Human
gaggugggauccucc

SEQ ID NO: 3109750 - RNA, 17 nt, Human
gaggugggauccuccag

SEQ ID NO: 3109751 - RNA, 21 nt, Human
gagucacuggaacacuaauga

SEQ ID NO: 3109752 - RNA, 14 nt, Human
gagucacuggaaca

SEQ ID NO: 3109753 - RNA, 19 nt, Human
gaguugauacuacaguuug

SEQ ID NO: 3109754 - RNA, 21 nt, Human
gaguugauagcacagacccug

SEQ ID NO: 3109755 - RNA, 22 nt, Human
gaguugauacuacaguuuguua

SEQ ID NO: 3109756 - RNA, 13 nt, Human
gagugcagugagc

SEQ ID NO: 3109757 - RNA, 18 nt, Human
gagugcagugagccgaga

SEQ ID NO: 3109758 - RNA, 18 nt, Human
gagucagaaguuucugcc

SEQ ID NO: 3109759 - RNA, 14 nt, Human
gagugagacucugu

SEQ ID NO: 3109760 - RNA, 18 nt, Human
gagugagacucugucuca

SEQ ID NO: 3109761 - RNA, 15 nt, Human
gaccaucccugaagg

SEQ ID NO: 3109762 - RNA, 14 nt, Human
gaccaucccugaag

SEQ ID NO: 3109763 - RNA, 16 nt, Human
gaccauucuccaccug

SEQ ID NO: 3109764 - RNA, 17 nt, Human
gaccaucccugaaggcc

SEQ ID NO: 3109765 - RNA, 16 nt, Human
gaccaucccugaaggc

SEQ ID NO: 3109766 - RNA, 12 nt, Human
gacccggcugcg

SEQ ID NO: 3109767 - RNA, 13 nt, Human
gacccggcugcgu

SEQ ID NO: 3109768 - RNA, 16 nt, Human
gacccuauugcugcuu

SEQ ID NO: 3109769 - RNA, 13 nt, Human
gacagcuccuucu

SEQ ID NO: 3109770 - RNA, 14 nt, Human
gacagcuccuucug

SEQ ID NO: 3109771 - RNA, 15 nt, Human
gacagcuccuucugu

SEQ ID NO: 3109772 - RNA, 21 nt, Human
gacuuuucuguccgagcuuug

SEQ ID NO: 3109773 - RNA, 20 nt, Human
gacuuuuccaacccucauca

SEQ ID NO: 3109774 - RNA, 22 nt, Human
gacuuuguuaguuucuccaagc

SEQ ID NO: 3109775 - RNA, 14 nt, Human
gacuuuggaaagag

SEQ ID NO: 3109776 - RNA, 14 nt, Human
gacuuuggaaagac

SEQ ID NO: 3109777 - RNA, 18 nt, Human
gacuguuuucucuugaga

SEQ ID NO: 3109778 - RNA, 16 nt, Human
gacuguuuucucuuga

SEQ ID NO: 3109779 - RNA, 22 nt, Human
gacuguacaaaguagaagucuu

SEQ ID NO: 3109780 - RNA, 17 nt, Human
gacucaaugcacugaca

SEQ ID NO: 3109781 - RNA, 14 nt, Human
gacucaaugcacug

SEQ ID NO: 3109782 - RNA, 16 nt, Human
gagaagcggcuggcag

SEQ ID NO: 3109783 - RNA, 17 nt, Human
gagaagcggcuggcagc

SEQ ID NO: 3109784 - RNA, 13 nt, Human
gacgcugugcugc

SEQ ID NO: 3109785 - RNA, 12 nt, Human
gacgcugugcug

SEQ ID NO: 3109786 - RNA, 18 nt, Human
gaaccaccacacccagcc

SEQ ID NO: 3109787 - RNA, 20 nt, Human
gaaccaccacacccagccca

SEQ ID NO: 3109788 - RNA, 21 nt, Human
gaaccaccacacccagcccac

SEQ ID NO: 3109789 - RNA, 22 nt, Human
gaaccaccacacccagcccacu

SEQ ID NO: 3109790 - RNA, 16 nt, Human
gaagacacugaugggc

SEQ ID NO: 3109791 - RNA, 21 nt, Human
gaagacacugaugggcaaccc

SEQ ID NO: 3109792 - RNA, 13 nt, Human
gaagacagcucuu

SEQ ID NO: 3109793 - RNA, 12 nt, Human
gaagacagcucu

SEQ ID NO: 3109794 - RNA, 15 nt, Human
gaagacagagcuaca

SEQ ID NO: 3109795 - RNA, 13 nt, Human
gaagacagagcua

SEQ ID NO: 3109796 - RNA, 15 nt, Human
gaagacagcucuuau

SEQ ID NO: 3109797 - RNA, 14 nt, Human
gaagacagcucuua

SEQ ID NO: 3109798 - RNA, 21 nt, Human
gaagcacaugccucucucagg

SEQ ID NO: 3109799 - RNA, 16 nt, Human
gaagcaccauaacuuu

SEQ ID NO: 3109800 - RNA, 13 nt, Human
gaagcacagcuuc

SEQ ID NO: 3109801 - RNA, 14 nt, Human
gaagcacagcuuca

SEQ ID NO: 3109802 - RNA, 22 nt, Human
gaagcacaugccucucucaggc

SEQ ID NO: 3109803 - RNA, 17 nt, Human
gaagacucauucuucug

SEQ ID NO: 3109804 - RNA, 18 nt, Human
gaagacucauucuucugu

SEQ ID NO: 3109805 - RNA, 16 nt, Human
gaagacucauucuucu

SEQ ID NO: 3109806 - RNA, 23 nt, Human
gaaccaccacacccagcccacuu

SEQ ID NO: 3109807 - RNA, 22 nt, Human
gaaccauggucggaaaacaugc

SEQ ID NO: 3109808 - RNA, 14 nt, Human
gaacuccuggccuc

SEQ ID NO: 3109809 - RNA, 13 nt, Human
gaacuccuggccu

SEQ ID NO: 3109810 - RNA, 15 nt, Human
gaaagggcccagaga

SEQ ID NO: 3109811 - RNA, 16 nt, Human
gaaagggcccagagag

SEQ ID NO: 3109812 - RNA, 13 nt, Human
gaaacuggauuaa

SEQ ID NO: 3109813 - RNA, 17 nt, Human
gaaacuggauuaaacuu

SEQ ID NO: 3109814 - RNA, 13 nt, Human
gaaagggcccaga

SEQ ID NO: 3109815 - RNA, 12 nt, Human
gaaaggcuccag

SEQ ID NO: 3109816 - RNA, 13 nt, Human
gaaaggcuccagg

SEQ ID NO: 3109817 - RNA, 15 nt, Human
gaaaggcuccaggag

SEQ ID NO: 3109818 - RNA, 14 nt, Human
gaaaggcuccagga

SEQ ID NO: 3109819 - RNA, 23 nt, Human
gaaaagaaaaaugagccuggcaa

SEQ ID NO: 3109820 - RNA, 20 nt, Human
cuuucacccuuuucuguuug

SEQ ID NO: 3109821 - RNA, 15 nt, Human
cuuucacccuuuucu

SEQ ID NO: 3109822 - RNA, 14 nt, Human
cuuucacccuuuuc

SEQ ID NO: 3109823 - RNA, 23 nt, Human
cuuuaaugucacaggcaggucca

SEQ ID NO: 3109824 - RNA, 22 nt, Human
cuugguagaagcccuucuaccu

SEQ ID NO: 3109825 - RNA, 14 nt, Human
cuugguccugcugc

SEQ ID NO: 3109826 - RNA, 18 nt, Human
cuugucuuuggacccuga

SEQ ID NO: 3109827 - RNA, 15 nt, Human
cuugucuuuggaccc

SEQ ID NO: 3109828 - RNA, 13 nt, Human
cuugucuuuggac

SEQ ID NO: 3109829 - RNA, 19 nt, Human
cuuggugucgggcaugaca

SEQ ID NO: 3109830 - RNA, 15 nt, Human
cuuucuacccagcga

SEQ ID NO: 3109831 - RNA, 16 nt, Human
cuuucuacccagcgag

SEQ ID NO: 3109832 - RNA, 17 nt, Human
cuuugacgccaucccag

SEQ ID NO: 3109833 - RNA, 16 nt, Human
cuuugacgccauccca

SEQ ID NO: 3109834 - RNA, 19 nt, Human
cuuuuauaaacuuuaccuu

SEQ ID NO: 3109835 - RNA, 22 nt, Human
cuuuguauucucuccuguaccu

SEQ ID NO: 3109836 - RNA, 20 nt, Human
cuuuuauaaacuuuaccuuu

SEQ ID NO: 3109837 - RNA, 21 nt, Human
cuuuuauaaacuuuaccuuuu

SEQ ID NO: 3109838 - RNA, 17 nt, Human
cuuuguauucucuccug

SEQ ID NO: 3109839 - RNA, 22 nt, Human
cuuggauuguccccgacccuug

SEQ ID NO: 3109840 - RNA, 24 nt, Human
cuuggauuguccccgacccuugcc

SEQ ID NO: 3109841 - RNA, 23 nt, Human
cuuggauuguccccgacccuugc

SEQ ID NO: 3109842 - RNA, 12 nt, Human
cuugcaaaguau

SEQ ID NO: 3109843 - RNA, 20 nt, Human
cuugacagggcacaccgggc

SEQ ID NO: 3109844 - RNA, 16 nt, Human
cuugacaucaacugca

SEQ ID NO: 3109845 - RNA, 23 nt, Human
cuugaaugaugccaugaggaaca

SEQ ID NO: 3109846 - RNA, 17 nt, Human
cuugauauccucuuuga

SEQ ID NO: 3109847 - RNA, 22 nt, Human
cuugauauccucuuugagugaa

SEQ ID NO: 3109848 - RNA, 18 nt, Human
cuugauguguuaucucuu

SEQ ID NO: 3109849 - RNA, 15 nt, Human
cuugauguguuaucu

SEQ ID NO: 3109850 - RNA, 13 nt, Human
cuuccuccuggug

SEQ ID NO: 3109851 - RNA, 22 nt, Human
cuuccucuuuccaucuacccuc

SEQ ID NO: 3109852 - RNA, 21 nt, Human
cuuccucuuuccaucuacccu

SEQ ID NO: 3109853 - RNA, 14 nt, Human
cuucuucagagacu

SEQ ID NO: 3109854 - RNA, 13 nt, Human
cuucuucagagac

SEQ ID NO: 3109855 - RNA, 23 nt, Human
cuucugaacuuggcgcugccccu

SEQ ID NO: 3109856 - RNA, 15 nt, Human
cugccucucccauca

SEQ ID NO: 3109857 - RNA, 22 nt, Human
cugccucucccaucacuucccu

SEQ ID NO: 3109858 - RNA, 23 nt, Human
cugccucucccaucacuucccua

SEQ ID NO: 3109859 - RNA, 17 nt, Human
cugccuguucagcucca

SEQ ID NO: 3109860 - RNA, 18 nt, Human
cugccuguucagcuccag

SEQ ID NO: 3109861 - RNA, 19 nt, Human
cugccuguucagcuccagc

SEQ ID NO: 3109862 - RNA, 20 nt, Human
cugccuguugggccaggagc

SEQ ID NO: 3109863 - RNA, 21 nt, Human
cugcugacuguuuucucuuga

SEQ ID NO: 3109864 - RNA, 18 nt, Human
cugcugacuguuuucucu

SEQ ID NO: 3109865 - RNA, 15 nt, Human
cugccuguucagcuc

SEQ ID NO: 3109866 - RNA, 22 nt, Human
cugccuguugggccaggagccu

SEQ ID NO: 3109867 - RNA, 21 nt, Human
cugccuguugggccaggagcc

SEQ ID NO: 3109868 - RNA, 19 nt, Human
cugcuuuugucuaugggac

SEQ ID NO: 3109869 - RNA, 21 nt, Human
cugcuuuugucuaugggacuc

SEQ ID NO: 3109870 - RNA, 14 nt, Human
cugcuucaaauauu

SEQ ID NO: 3109871 - RNA, 20 nt, Human
cugcuucaaggauccugagc

SEQ ID NO: 3109872 - RNA, 20 nt, Human
cugcuuuugucuaugggacu

SEQ ID NO: 3109873 - RNA, 23 nt, Human
cugcuucaaggauccugagccag

SEQ ID NO: 3109874 - RNA, 22 nt, Human
cugcuucaaggauccugagcca

SEQ ID NO: 3109875 - RNA, 21 nt, Human
cugcuucaaggauccugagcc

SEQ ID NO: 3109876 - RNA, 12 nt, Human
cugcuucaagga

SEQ ID NO: 3109877 - RNA, 19 nt, Human
cugcuucaaauauuucccu

SEQ ID NO: 3109878 - RNA, 15 nt, Human
cugggcagaaggaag

SEQ ID NO: 3109879 - RNA, 12 nt, Human
cugggcagaagg

SEQ ID NO: 3109880 - RNA, 14 nt, Human
cuggggagaaagua

SEQ ID NO: 3109881 - RNA, 18 nt, Human
cuggguucacugcaaccu

SEQ ID NO: 3109882 - RNA, 20 nt, Human
cuggguucacugcaaccucc

SEQ ID NO: 3109883 - RNA, 15 nt, Human
cuggguucacugcaa

SEQ ID NO: 3109884 - RNA, 22 nt, Human
cuggccccucagggucccuggu

SEQ ID NO: 3109885 - RNA, 18 nt, Human
cuggcagaguugaagaca

SEQ ID NO: 3109886 - RNA, 17 nt, Human
cuggcagaguugaagac

SEQ ID NO: 3109887 - RNA, 12 nt, Human
cuggcagccccu

SEQ ID NO: 3109888 - RNA, 11 nt, Human
cuggcagccca

SEQ ID NO: 3109889 - RNA, 12 nt, Human
cugugcugcccu

SEQ ID NO: 3109890 - RNA, 14 nt, Human
cugugcugcccugc

SEQ ID NO: 3109891 - RNA, 13 nt, Human
cugugcugcccug

SEQ ID NO: 3109892 - RNA, 18 nt, Human
cugugccucugggacugg

SEQ ID NO: 3109893 - RNA, 19 nt, Human
cugugucagcauagaagua

SEQ ID NO: 3109894 - RNA, 17 nt, Human
cugugucagcauagaag

SEQ ID NO: 3109895 - RNA, 19 nt, Human
cugugcugcccugcccacc

SEQ ID NO: 3109896 - RNA, 18 nt, Human
cugugcugcccugcccac

SEQ ID NO: 3109897 - RNA, 17 nt, Human
cugugcugcccugccca

SEQ ID NO: 3109898 - RNA, 15 nt, Human
cugugcugcccugcc

SEQ ID NO: 3109899 - RNA, 13 nt, Human
cuguagaguggga

SEQ ID NO: 3109900 - RNA, 15 nt, Human
cugucgcccagucug

SEQ ID NO: 3109901 - RNA, 16 nt, Human
cugucgcccagucugg

SEQ ID NO: 3109902 - RNA, 21 nt, Human
cuguccugggagugagcuggu

SEQ ID NO: 3109903 - RNA, 20 nt, Human
cugucaauuacaggaaguac

SEQ ID NO: 3109904 - RNA, 19 nt, Human
cugucaauuacaggaagua

SEQ ID NO: 3109905 - RNA, 23 nt, Human
cugucaauuacaggaaguacugg

SEQ ID NO: 3109906 - RNA, 14 nt, Human
cuuaaaacaacacu

SEQ ID NO: 3109907 - RNA, 15 nt, Human
cuuaccagcagagca

SEQ ID NO: 3109908 - RNA, 14 nt, Human
cuguuggcuggggg

SEQ ID NO: 3109909 - RNA, 15 nt, Human
cuguuggccagugug

SEQ ID NO: 3109910 - RNA, 19 nt, Human
cuguuggcugggggccuca

SEQ ID NO: 3109911 - RNA, 22 nt, Human
cuguuggcugggggccucagug

SEQ ID NO: 3109912 - RNA, 21 nt, Human
cuuagggaaggauacaaaagc

SEQ ID NO: 3109913 - RNA, 19 nt, Human
cuuagggaaggauacaaaa

SEQ ID NO: 3109914 - RNA, 21 nt, Human
cuuagcagggaaacagcuaau

SEQ ID NO: 3109915 - RNA, 16 nt, Human
cuuaccagcagagcac

SEQ ID NO: 3109916 - RNA, 22 nt, Human
cuuagcucauucuccuuguguu

SEQ ID NO: 3109917 - RNA, 23 nt, Human
cuuagcucauucuccuuguguua

SEQ ID NO: 3109918 - RNA, 15 nt, Human
auguauguguaagua

SEQ ID NO: 3109919 - RNA, 16 nt, Human
auguauguguaaguau

SEQ ID NO: 3109920 - RNA, 13 nt, Human
augucagugugac

SEQ ID NO: 3109921 - RNA, 12 nt, Human
augucaguguga

SEQ ID NO: 3109922 - RNA, 23 nt, Human
augugcacaugcacgugugugca

SEQ ID NO: 3109923 - RNA, 19 nt, Human
augugaugagaggaaauca

SEQ ID NO: 3109924 - RNA, 17 nt, Human
augugaugagaggaaau

SEQ ID NO: 3109925 - RNA, 16 nt, Human
augugaugagaggaaa

SEQ ID NO: 3109926 - RNA, 15 nt, Human
augugaugagaggaa

SEQ ID NO: 3109927 - RNA, 22 nt, Human
uuugauguucuuucacccuuuu

SEQ ID NO: 3109928 - RNA, 13 nt, Human
uuugauuaaauuc

SEQ ID NO: 3109929 - RNA, 18 nt, Human
uuugauuaaauucuugca

SEQ ID NO: 3109930 - RNA, 21 nt, Human
uuugauuaaauucuugcaaag

SEQ ID NO: 3109931 - RNA, 21 nt, Human
uuugauucagacagcugccug

SEQ ID NO: 3109932 - RNA, 18 nt, Human
uuugauucagacagcugc

SEQ ID NO: 3109933 - RNA, 20 nt, Human
uuugacgccaucccagcccc

SEQ ID NO: 3109934 - RNA, 19 nt, Human
uuugacgccaucccagccc

SEQ ID NO: 3109935 - RNA, 16 nt, Human
uuugacgccaucccag

SEQ ID NO: 3109936 - RNA, 14 nt, Human
uuugacgccauccc

SEQ ID NO: 3109937 - RNA, 13 nt, Human
uuugacgccaucc

SEQ ID NO: 3109938 - RNA, 22 nt, Human
uuugauucagacagcugccugg

SEQ ID NO: 3109939 - RNA, 15 nt, Human
uuugccguuauuaaa

SEQ ID NO: 3109940 - RNA, 13 nt, Human
uuugccucugccu

SEQ ID NO: 3109941 - RNA, 12 nt, Human
uuugaccucugc

SEQ ID NO: 3109942 - RNA, 19 nt, Human
uuucugcagccacuauugu

SEQ ID NO: 3109943 - RNA, 15 nt, Human
uuucuggcuaugcau

SEQ ID NO: 3109944 - RNA, 16 nt, Human
uuucuggcuaugcauu

SEQ ID NO: 3109945 - RNA, 18 nt, Human
uuucuggcuaugcauuug

SEQ ID NO: 3109946 - RNA, 19 nt, Human
uuucuggcuaugcauuuga

SEQ ID NO: 3109947 - RNA, 15 nt, Human
augggauccuggagu

SEQ ID NO: 3109948 - RNA, 15 nt, Human
augggggugcauuug

SEQ ID NO: 3109949 - RNA, 14 nt, Human
augggggugcauuu

SEQ ID NO: 3109950 - RNA, 24 nt, Human
auggggcugcaccggcuggccugg

SEQ ID NO: 3109951 - RNA, 12 nt, Human
auggggcugcac

SEQ ID NO: 3109952 - RNA, 18 nt, Human
augggccuccugugugug

SEQ ID NO: 3109953 - RNA, 17 nt, Human
augggccuccugugugu

SEQ ID NO: 3109954 - RNA, 20 nt, Human
augggcuggguucuacccag

SEQ ID NO: 3109955 - RNA, 20 nt, Human
auggugagggauacccaucc

SEQ ID NO: 3109956 - RNA, 15 nt, Human
augggugcuuggagg

SEQ ID NO: 3109957 - RNA, 15 nt, Human
auggugcaaugaccu

SEQ ID NO: 3109958 - RNA, 13 nt, Human
auggugcaaugac

SEQ ID NO: 3109959 - RNA, 12 nt, Human
auggugcaauga

SEQ ID NO: 3109960 - RNA, 17 nt, Human
auggugcaaugaccuuu

SEQ ID NO: 3109961 - RNA, 16 nt, Human
auggugcaaugaccuu

SEQ ID NO: 3109962 - RNA, 19 nt, Human
auggugcaaugaccuuuca

SEQ ID NO: 3109963 - RNA, 12 nt, Human
augguggcuggg

SEQ ID NO: 3109964 - RNA, 13 nt, Human
augguggcugggu

SEQ ID NO: 3109965 - RNA, 15 nt, Human
augguggcuggguug

SEQ ID NO: 3109966 - RNA, 17 nt, Human
augguggcuggguugga

SEQ ID NO: 3109967 - RNA, 14 nt, Human
augguuuucuugug

SEQ ID NO: 3109968 - RNA, 16 nt, Human
augguuuucaaaauaa

SEQ ID NO: 3109969 - RNA, 14 nt, Human
augguuuucaaaau

SEQ ID NO: 3109970 - RNA, 15 nt, Human
augguuuucaaaaua

SEQ ID NO: 3109971 - RNA, 11 nt, Human
augcccagccc

SEQ ID NO: 3109972 - RNA, 23 nt, Human
augcagugguaugaucacggcuc

SEQ ID NO: 3109973 - RNA, 13 nt, Human
augcagugcuucc

SEQ ID NO: 3109974 - RNA, 14 nt, Human
augcccagccccuu

SEQ ID NO: 3109975 - RNA, 13 nt, Human
augcccagccccu

SEQ ID NO: 3109976 - RNA, 12 nt, Human
augcccagcccc

SEQ ID NO: 3109977 - RNA, 19 nt, Human
uuuaauuuuuuugagacag

SEQ ID NO: 3109978 - RNA, 18 nt, Human
augcagccucacaguccu

SEQ ID NO: 3109979 - RNA, 17 nt, Human
augcagccucacagucc

SEQ ID NO: 3109980 - RNA, 22 nt, Human
augcaccagcccuuagcaggga

SEQ ID NO: 3109981 - RNA, 13 nt, Human
augcaccuggaau

SEQ ID NO: 3109982 - RNA, 14 nt, Human
augcaccagcccuu

SEQ ID NO: 3109983 - RNA, 16 nt, Human
augcacuuuguucugg

SEQ ID NO: 3109984 - RNA, 17 nt, Human
augcacuuuguucuggc

SEQ ID NO: 3109985 - RNA, 20 nt, Human
augcacuuuguucuggcucu

SEQ ID NO: 3109986 - RNA, 19 nt, Human
augcacuuuguucuggcuc

SEQ ID NO: 3109987 - RNA, 13 nt, Human
uuuaaagaaugcu

SEQ ID NO: 3109988 - RNA, 23 nt, Human
uuuaaaaauacagauagauauau

SEQ ID NO: 3109989 - RNA, 20 nt, Human
uuguucuugguuuguaaauu

SEQ ID NO: 3109990 - RNA, 13 nt, Human
uuguguuacuaag

SEQ ID NO: 3109991 - RNA, 15 nt, Human
uuguguuacuaaguu

SEQ ID NO: 3109992 - RNA, 20 nt, Human
uuguguuacuaaguuuuuau

SEQ ID NO: 3109993 - RNA, 21 nt, Human
uuguuccacaaguuaaauaaa

SEQ ID NO: 3109994 - RNA, 15 nt, Human
augaucuaggaagac

SEQ ID NO: 3109995 - RNA, 20 nt, Human
augaucuaggaagacuuugg

SEQ ID NO: 3109996 - RNA, 17 nt, Human
augaucuaggaagacuu

SEQ ID NO: 3109997 - RNA, 22 nt, Human
augcugugcccuaaaguguauu

SEQ ID NO: 3109998 - RNA, 13 nt, Human
augcuucucacug

SEQ ID NO: 3109999 - RNA, 15 nt, Human
uuucaaacuuuacua

SEQ ID NO: 3110000 - RNA, 22 nt, Human
uuucaaacuuuacuauggcccu

SEQ ID NO: 3110001 - RNA, 16 nt, Human
uuucaaacuuuacuau

SEQ ID NO: 3110002 - RNA, 15 nt, Human
augggagagaagaga

SEQ ID NO: 3110003 - RNA, 19 nt, Human
augggagagaagagaaugc

SEQ ID NO: 3110004 - RNA, 19 nt, Human
auggacuaacuugucuuug

SEQ ID NO: 3110005 - RNA, 12 nt, Human
auggacuuuguu

SEQ ID NO: 3110006 - RNA, 11 nt, Human
auggacuuugu

SEQ ID NO: 3110007 - RNA, 18 nt, Human
uuuccaugaguccccugu

SEQ ID NO: 3110008 - RNA, 17 nt, Human
uuuccaugaguccccug

SEQ ID NO: 3110009 - RNA, 19 nt, Human
aucaggugcugccauccag

SEQ ID NO: 3110010 - RNA, 21 nt, Human
uucuccuuguguuacuaaguu

SEQ ID NO: 3110011 - RNA, 15 nt, Human
uucucuaguuugauu

SEQ ID NO: 3110012 - RNA, 17 nt, Human
uucucuaguuugauuaa

SEQ ID NO: 3110013 - RNA, 17 nt, Human
uucuggcucuuccaggc

SEQ ID NO: 3110014 - RNA, 16 nt, Human
uucuggcucuuccagg

SEQ ID NO: 3110015 - RNA, 21 nt, Human
uucugccugcccaggccccug

SEQ ID NO: 3110016 - RNA, 15 nt, Human
uucuggcucuuccag

SEQ ID NO: 3110017 - RNA, 17 nt, Human
uucugccugcccaggcc

SEQ ID NO: 3110018 - RNA, 18 nt, Human
uucugccugcccaggccc

SEQ ID NO: 3110019 - RNA, 22 nt, Human
uucugaacuuggcgcugccccu

SEQ ID NO: 3110020 - RNA, 19 nt, Human
uucugaacuuggcgcugcc

SEQ ID NO: 3110021 - RNA, 15 nt, Human
uucugccauauucug

SEQ ID NO: 3110022 - RNA, 18 nt, Human
aucccauaugccugggca

SEQ ID NO: 3110023 - RNA, 12 nt, Human
aucccagcccca

SEQ ID NO: 3110024 - RNA, 20 nt, Human
aucccaaacccuucagugcc

SEQ ID NO: 3110025 - RNA, 19 nt, Human
aucccaaacccuucagugc

SEQ ID NO: 3110026 - RNA, 21 nt, Human
auccaguaucuugaagacuuu

SEQ ID NO: 3110027 - RNA, 18 nt, Human
auccaagcuggucccacu

SEQ ID NO: 3110028 - RNA, 13 nt, Human
auccacccaccuc

SEQ ID NO: 3110029 - RNA, 15 nt, Human
auccacccaccucag

SEQ ID NO: 3110030 - RNA, 16 nt, Human
auccaguaucuugaag

SEQ ID NO: 3110031 - RNA, 15 nt, Human
auccaguaucuugaa

SEQ ID NO: 3110032 - RNA, 12 nt, Human
auccuaagcuau

SEQ ID NO: 3110033 - RNA, 14 nt, Human
auccuccucagauc

SEQ ID NO: 3110034 - RNA, 16 nt, Human
auccuccucagaucuu

SEQ ID NO: 3110035 - RNA, 16 nt, Human
auccuaggcauuugcu

SEQ ID NO: 3110036 - RNA, 13 nt, Human
uucuucugcuuca

SEQ ID NO: 3110037 - RNA, 15 nt, Human
uucuucugcuucagc

SEQ ID NO: 3110038 - RNA, 14 nt, Human
uucuucucccucag

SEQ ID NO: 3110039 - RNA, 11 nt, Human
uucuucucccu

SEQ ID NO: 3110040 - RNA, 13 nt, Human
uucuucucccuca

SEQ ID NO: 3110041 - RNA, 24 nt, Human
aucccauaugccugggcagaagga

SEQ ID NO: 3110042 - RNA, 14 nt, Human
aucccucauccuca

SEQ ID NO: 3110043 - RNA, 23 nt, Human
aucccucauccucauacccaccc

SEQ ID NO: 3110044 - RNA, 21 nt, Human
aucccucauccucauacccac

SEQ ID NO: 3110045 - RNA, 13 nt, Human
aucccucauccuc

SEQ ID NO: 3110046 - RNA, 20 nt, Human
uucuucugcuucagccuccc

SEQ ID NO: 3110047 - RNA, 18 nt, Human
aucacggcucacugcagc

SEQ ID NO: 3110048 - RNA, 13 nt, Human
aucacgccacugc

SEQ ID NO: 3110049 - RNA, 15 nt, Human
aucacggcucacugc

SEQ ID NO: 3110050 - RNA, 14 nt, Human
aucaaugaguaaca

SEQ ID NO: 3110051 - RNA, 21 nt, Human
aucaagaugugacauguuuua

SEQ ID NO: 3110052 - RNA, 17 nt, Human
uuccuaauccucuagga

SEQ ID NO: 3110053 - RNA, 14 nt, Human
uuccugaaccgaug

SEQ ID NO: 3110054 - RNA, 17 nt, Human
uuccucuuuccaucuac

SEQ ID NO: 3110055 - RNA, 22 nt, Human
uuccucuuuccaucuacccucc

SEQ ID NO: 3110056 - RNA, 13 nt, Human
uuccucuuuccau

SEQ ID NO: 3110057 - RNA, 20 nt, Human
uucccucaccuuucccaucu

SEQ ID NO: 3110058 - RNA, 15 nt, Human
uucccuauuagagaa

SEQ ID NO: 3110059 - RNA, 14 nt, Human
uuccguuaaaauac

SEQ ID NO: 3110060 - RNA, 16 nt, Human
uuccguuaaaauacca

SEQ ID NO: 3110061 - RNA, 11 nt, Human
aucagaauucu

SEQ ID NO: 3110062 - RNA, 12 nt, Human
aucagaauucuc

SEQ ID NO: 3110063 - RNA, 18 nt, Human
aucaggccaggcccucug

SEQ ID NO: 3110064 - RNA, 16 nt, Human
aucaggccaggcccuc

SEQ ID NO: 3110065 - RNA, 15 nt, Human
aucaggccaggcccu

SEQ ID NO: 3110066 - RNA, 13 nt, Human
aucagcacgauuu

SEQ ID NO: 3110067 - RNA, 14 nt, Human
aucaggccaggccc

SEQ ID NO: 3110068 - RNA, 13 nt, Human
uucgcuccugugu

SEQ ID NO: 3110069 - RNA, 15 nt, Human
uucgcuccugugucu

SEQ ID NO: 3110070 - RNA, 19 nt, Human
uucgcuccugugucuugca

SEQ ID NO: 3110071 - RNA, 21 nt, Human
uucuaaaucuccaaaauaaaa

SEQ ID NO: 3110072 - RNA, 19 nt, Human
uucuaaaucuccaaaauaa

SEQ ID NO: 3110073 - RNA, 19 nt, Human
uucuaaaggcuaccuuugu

SEQ ID NO: 3110074 - RNA, 20 nt, Human
uucuaaaggcuaccuuugua

SEQ ID NO: 3110075 - RNA, 21 nt, Human
uucuaaaggcuaccuuuguau

SEQ ID NO: 3110076 - RNA, 16 nt, Human
uucuagcauggcugcc

SEQ ID NO: 3110077 - RNA, 18 nt, Human
uuggggaccagagcugcc

SEQ ID NO: 3110078 - RNA, 14 nt, Human
augaaaugagguca

SEQ ID NO: 3110079 - RNA, 19 nt, Human
augaaagggcccagagagg

SEQ ID NO: 3110080 - RNA, 15 nt, Human
augaaagggcccaga

SEQ ID NO: 3110081 - RNA, 18 nt, Human
augaaagggcccagagag

SEQ ID NO: 3110082 - RNA, 17 nt, Human
aucuuugcagacaggca

SEQ ID NO: 3110083 - RNA, 22 nt, Human
aucuuuucauuuaggugaggaa

SEQ ID NO: 3110084 - RNA, 23 nt, Human
uuggcuauuagagaucaaccccu

SEQ ID NO: 3110085 - RNA, 18 nt, Human
uuggccccugcccggcug

SEQ ID NO: 3110086 - RNA, 16 nt, Human
uuggagggugucccaa

SEQ ID NO: 3110087 - RNA, 22 nt, Human
aucugucauuugagcagggcuc

SEQ ID NO: 3110088 - RNA, 17 nt, Human
aucugugaaaggaaaga

SEQ ID NO: 3110089 - RNA, 10 nt, Human
aucuggugac

SEQ ID NO: 3110090 - RNA, 17 nt, Human
aucuggugacuuuccuc

SEQ ID NO: 3110091 - RNA, 16 nt, Human
aucuggugacuuuccu

SEQ ID NO: 3110092 - RNA, 18 nt, Human
aucugugaaaggaaagag

SEQ ID NO: 3110093 - RNA, 13 nt, Human
aucuugcucugcu

SEQ ID NO: 3110094 - RNA, 20 nt, Human
aucuuggucagauuugaacu

SEQ ID NO: 3110095 - RNA, 20 nt, Human
uugaguugauucagcucugc

SEQ ID NO: 3110096 - RNA, 20 nt, Human
uugagugaagcugggagaac

SEQ ID NO: 3110097 - RNA, 18 nt, Human
aucuaauauguaacaagc

SEQ ID NO: 3110098 - RNA, 12 nt, Human
uugagacagagu

SEQ ID NO: 3110099 - RNA, 15 nt, Human
uugagaucagccugg

SEQ ID NO: 3110100 - RNA, 16 nt, Human
uugagaucagccuggg

SEQ ID NO: 3110101 - RNA, 17 nt, Human
auccucuguacagagcc

SEQ ID NO: 3110102 - RNA, 16 nt, Human
auccucuguacagagc

SEQ ID NO: 3110103 - RNA, 17 nt, Human
aucuaaauggaaccacu

SEQ ID NO: 3110104 - RNA, 18 nt, Human
aucuaaauggaaccacuc

SEQ ID NO: 3110105 - RNA, 13 nt, Human
aucuaaauggaac

SEQ ID NO: 3110106 - RNA, 15 nt, Human
aucucuugagccugg

SEQ ID NO: 3110107 - RNA, 14 nt, Human
aucugaaaauguau

SEQ ID NO: 3110108 - RNA, 16 nt, Human
aucugaaaauguaugu

SEQ ID NO: 3110109 - RNA, 19 nt, Human
aucugaaaauguaugugua

SEQ ID NO: 3110110 - RNA, 20 nt, Human
aucugaaaauguauguguaa

SEQ ID NO: 3110111 - RNA, 22 nt, Human
aucugaaaauguauguguaagu

SEQ ID NO: 3110112 - RNA, 15 nt, Human
aucucccccagcccc

SEQ ID NO: 3110113 - RNA, 14 nt, Human
aucucccccagccc

SEQ ID NO: 3110114 - RNA, 17 nt, Human
aucucccccagccccau

SEQ ID NO: 3110115 - RNA, 16 nt, Human
aucucccccagcccca

SEQ ID NO: 3110116 - RNA, 16 nt, Human
aucucagggccugguc

SEQ ID NO: 3110117 - RNA, 14 nt, Human
aucucagggccugg

SEQ ID NO: 3110118 - RNA, 14 nt, Human
aucuccaaaauaaa

SEQ ID NO: 3110119 - RNA, 17 nt, Human
aucuccaaaauaaaacu

SEQ ID NO: 3110120 - RNA, 20 nt, Human
aucuccaaaauaaaacuuuu

SEQ ID NO: 3110121 - RNA, 21 nt, Human
aucuccaaaauaaaacuuuuu

SEQ ID NO: 3110122 - RNA, 13 nt, Human
aucuccaaaauaa

SEQ ID NO: 3110123 - RNA, 16 nt, Human
uugcaauggcagccuu

SEQ ID NO: 3110124 - RNA, 17 nt, Human
uugcaauggcagccuug

SEQ ID NO: 3110125 - RNA, 19 nt, Human
uugcaauggcagccuuggc

SEQ ID NO: 3110126 - RNA, 18 nt, Human
uugcaccacugcacucca

SEQ ID NO: 3110127 - RNA, 16 nt, Human
uugcaccacugcacuc

SEQ ID NO: 3110128 - RNA, 15 nt, Human
uugcaccacugcacu

SEQ ID NO: 3110129 - RNA, 14 nt, Human
uugcaccacugcac

SEQ ID NO: 3110130 - RNA, 12 nt, Human
aucugaaaaugu

SEQ ID NO: 3110131 - RNA, 23 nt, Human
aucugaaaauguauguguaagua

SEQ ID NO: 3110132 - RNA, 13 nt, Human
uugauuaaauucu

SEQ ID NO: 3110133 - RNA, 23 nt, Human
uugauguuuuaaggaugcuugua

SEQ ID NO: 3110134 - RNA, 14 nt, Human
uugauuaaauucuu

SEQ ID NO: 3110135 - RNA, 21 nt, Human
uugauuaaauucuugcaaagu

SEQ ID NO: 3110136 - RNA, 22 nt, Human
auuuuaaaaauacagauagaua

SEQ ID NO: 3110137 - RNA, 12 nt, Human
auuuauuuaaau

SEQ ID NO: 3110138 - RNA, 14 nt, Human
auuuauuuaaauuu

SEQ ID NO: 3110139 - RNA, 19 nt, Human
auuucccaaagcagugcau

SEQ ID NO: 3110140 - RNA, 23 nt, Human
auuucuuccacaagagcccaggc

SEQ ID NO: 3110141 - RNA, 20 nt, Human
auuucuuccacaagagccca

SEQ ID NO: 3110142 - RNA, 16 nt, Human
auuugaaaauuuugau

SEQ ID NO: 3110143 - RNA, 15 nt, Human
auuugaaaauuuuga

SEQ ID NO: 3110144 - RNA, 16 nt, Human
auuucuuccacaagag

SEQ ID NO: 3110145 - RNA, 17 nt, Human
auuuaaaagauacaguu

SEQ ID NO: 3110146 - RNA, 14 nt, Human
auuuaaaagauaca

SEQ ID NO: 3110147 - RNA, 16 nt, Human
auuuaaaagauacagu

SEQ ID NO: 3110148 - RNA, 13 nt, Human
auuuaaaagauac

SEQ ID NO: 3110149 - RNA, 21 nt, Human
auuguuuggggaugagaaagg

SEQ ID NO: 3110150 - RNA, 13 nt, Human
auugugggaaggg

SEQ ID NO: 3110151 - RNA, 14 nt, Human
auugugggaagggg

SEQ ID NO: 3110152 - RNA, 16 nt, Human
auugucaaagugguga

SEQ ID NO: 3110153 - RNA, 23 nt, Human
auugucaaaguggugagaggcau

SEQ ID NO: 3110154 - RNA, 21 nt, Human
auugauuuccguuaaaauacc

SEQ ID NO: 3110155 - RNA, 16 nt, Human
auuuuccugccaggca

SEQ ID NO: 3110156 - RNA, 19 nt, Human
auuuucccuauuagagaag

SEQ ID NO: 3110157 - RNA, 18 nt, Human
auuuugauccaagcuggu

SEQ ID NO: 3110158 - RNA, 19 nt, Human
auuuugauccaagcugguc

SEQ ID NO: 3110159 - RNA, 15 nt, Human
auuuugauguuuuaa

SEQ ID NO: 3110160 - RNA, 17 nt, Human
auuuugauguuuuaagg

SEQ ID NO: 3110161 - RNA, 20 nt, Human
auuuugcuaaaugugaauga

SEQ ID NO: 3110162 - RNA, 21 nt, Human
auuuugcugucccuuuuccuu

SEQ ID NO: 3110163 - RNA, 20 nt, Human
auuuuggaaaauaaauuauu

SEQ ID NO: 3110164 - RNA, 14 nt, Human
auuuuggaaaauaa

SEQ ID NO: 3110165 - RNA, 19 nt, Human
auuuuggaaaauaaauuau

SEQ ID NO: 3110166 - RNA, 18 nt, Human
auuuugcuuugugauuuu

SEQ ID NO: 3110167 - RNA, 20 nt, Human
auuuugcuuugugauuuuug

SEQ ID NO: 3110168 - RNA, 12 nt, Human
auuuugcuuugu

SEQ ID NO: 3110169 - RNA, 19 nt, Human
auuuugugcccccauguaa

SEQ ID NO: 3110170 - RNA, 23 nt, Human
auuuugucauauaagauucauau

SEQ ID NO: 3110171 - RNA, 13 nt, Human
auuuuuuaaaugc

SEQ ID NO: 3110172 - RNA, 14 nt, Human
auuuuuuaaaugca

SEQ ID NO: 3110173 - RNA, 19 nt, Human
auuuuuguagagccagggu

SEQ ID NO: 3110174 - RNA, 12 nt, Human
auuuuuguaauu

SEQ ID NO: 3110175 - RNA, 21 nt, Human
auuuuucuuagggaaggauac

SEQ ID NO: 3110176 - RNA, 22 nt, Human
auuuuucuuagggaaggauaca

SEQ ID NO: 3110177 - RNA, 17 nt, Human
auugaccugaggcccuu

SEQ ID NO: 3110178 - RNA, 14 nt, Human
auucuuaaauaugu

SEQ ID NO: 3110179 - RNA, 12 nt, Human
auugaaaucuuu

SEQ ID NO: 3110180 - RNA, 20 nt, Human
auugaaaucuuuuugcuuug

SEQ ID NO: 3110181 - RNA, 18 nt, Human
auugaaaucuuuuugcuu

SEQ ID NO: 3110182 - RNA, 17 nt, Human
auugaaaucuuuuugcu

SEQ ID NO: 3110183 - RNA, 18 nt, Human
auucugcucacauaucug

SEQ ID NO: 3110184 - RNA, 20 nt, Human
auucugccugcccaggcccc

SEQ ID NO: 3110185 - RNA, 21 nt, Human
auucugccugcccaggccccu

SEQ ID NO: 3110186 - RNA, 19 nt, Human
auucugcucacauaucugu

SEQ ID NO: 3110187 - RNA, 20 nt, Human
auucugcucacauaucuguc

SEQ ID NO: 3110188 - RNA, 21 nt, Human
auucugcucacauaucuguca

SEQ ID NO: 3110189 - RNA, 22 nt, Human
auucugcucacauaucugucau

SEQ ID NO: 3110190 - RNA, 19 nt, Human
auucuguuggccaguguga

SEQ ID NO: 3110191 - RNA, 21 nt, Human
auucuguuggccagugugaca

SEQ ID NO: 3110192 - RNA, 14 nt, Human
auucuguuggccag

SEQ ID NO: 3110193 - RNA, 11 nt, Human
auucugccugc

SEQ ID NO: 3110194 - RNA, 13 nt, Human
auucugccugccc

SEQ ID NO: 3110195 - RNA, 14 nt, Human
auucugccugccca

SEQ ID NO: 3110196 - RNA, 15 nt, Human
auucugccugcccag

SEQ ID NO: 3110197 - RNA, 16 nt, Human
auucugccugcccagg

SEQ ID NO: 3110198 - RNA, 17 nt, Human
auucugccugcccaggc

SEQ ID NO: 3110199 - RNA, 18 nt, Human
auucugccugcccaggcc

SEQ ID NO: 3110200 - RNA, 19 nt, Human
auucugccugcccaggccc

SEQ ID NO: 3110201 - RNA, 17 nt, Human
auucucauuugucacac

SEQ ID NO: 3110202 - RNA, 13 nt, Human
auucaggaagcuc

SEQ ID NO: 3110203 - RNA, 12 nt, Human
auucaggaagcu

SEQ ID NO: 3110204 - RNA, 18 nt, Human
auucagacagcugccugg

SEQ ID NO: 3110205 - RNA, 17 nt, Human
auucagacagcugccug

SEQ ID NO: 3110206 - RNA, 16 nt, Human
auucagacagcugccu

SEQ ID NO: 3110207 - RNA, 15 nt, Human
auucagacagcugcc

SEQ ID NO: 3110208 - RNA, 14 nt, Human
auucagacagcugc

SEQ ID NO: 3110209 - RNA, 13 nt, Human
auucagacagcug

SEQ ID NO: 3110210 - RNA, 12 nt, Human
auucagacagcu

SEQ ID NO: 3110211 - RNA, 11 nt, Human
auucagacagc

SEQ ID NO: 3110212 - RNA, 14 nt, Human
auuaucuagauacu

SEQ ID NO: 3110213 - RNA, 18 nt, Human
auuaucuagauacuguau

SEQ ID NO: 3110214 - RNA, 13 nt, Human
ugcgaaaggauga

SEQ ID NO: 3110215 - RNA, 19 nt, Human
ugcgaaaggaugaaaguga

SEQ ID NO: 3110216 - RNA, 18 nt, Human
ugcggacagccacggcca

SEQ ID NO: 3110217 - RNA, 17 nt, Human
ugcggacagccacggcc

SEQ ID NO: 3110218 - RNA, 15 nt, Human
ugccuguucagcucc

SEQ ID NO: 3110219 - RNA, 16 nt, Human
ugccuguucagcucca

SEQ ID NO: 3110220 - RNA, 22 nt, Human
ugccucugacacacagcucugu

SEQ ID NO: 3110221 - RNA, 19 nt, Human
agcugccugggaucccuca

SEQ ID NO: 3110222 - RNA, 13 nt, Human
agcugccugggau

SEQ ID NO: 3110223 - RNA, 21 nt, Human
agcugccugggaucccucauc

SEQ ID NO: 3110224 - RNA, 23 nt, Human
agcugggaugauuggagggggga

SEQ ID NO: 3110225 - RNA, 17 nt, Human
agcugggacuacaggug

SEQ ID NO: 3110226 - RNA, 19 nt, Human
agcugggacuacaggugug

SEQ ID NO: 3110227 - RNA, 14 nt, Human
agcugggcagguug

SEQ ID NO: 3110228 - RNA, 17 nt, Human
agcugcacccucaggca

SEQ ID NO: 3110229 - RNA, 13 nt, Human
agcugcacccuca

SEQ ID NO: 3110230 - RNA, 22 nt, Human
agcugcacccucaggcaggugg

SEQ ID NO: 3110231 - RNA, 20 nt, Human
agcugcacccucaggcaggu

SEQ ID NO: 3110232 - RNA, 19 nt, Human
agcugcacccucaggcagg

SEQ ID NO: 3110233 - RNA, 18 nt, Human
agcugcacccucaggcag

SEQ ID NO: 3110234 - RNA, 18 nt, Human
agcucuucuccaggcugu

SEQ ID NO: 3110235 - RNA, 17 nt, Human
agcucuucuccaggcug

SEQ ID NO: 3110236 - RNA, 12 nt, Human
agcucuguccug

SEQ ID NO: 3110237 - RNA, 12 nt, Human
agcucugcuccu

SEQ ID NO: 3110238 - RNA, 22 nt, Human
agcucugcuccucuccccagca

SEQ ID NO: 3110239 - RNA, 20 nt, Human
agcucugguccauagagagc

SEQ ID NO: 3110240 - RNA, 22 nt, Human
ugcccuccaagaccuucuccuu

SEQ ID NO: 3110241 - RNA, 20 nt, Human
ugcccuccaagaccuucucc

SEQ ID NO: 3110242 - RNA, 19 nt, Human
ugcccuccaagaccuucuc

SEQ ID NO: 3110243 - RNA, 13 nt, Human
agcugccaccugc

SEQ ID NO: 3110244 - RNA, 14 nt, Human
ugccucucucaggc

SEQ ID NO: 3110245 - RNA, 13 nt, Human
ugccucucucagg

SEQ ID NO: 3110246 - RNA, 19 nt, Human
ugccucccaucacccgcua

SEQ ID NO: 3110247 - RNA, 14 nt, Human
ugccucccaucacc

SEQ ID NO: 3110248 - RNA, 13 nt, Human
ugccucccaucac

SEQ ID NO: 3110249 - RNA, 15 nt, Human
ugccucucucaggcc

SEQ ID NO: 3110250 - RNA, 20 nt, Human
ugccucugacacacagcucu

SEQ ID NO: 3110251 - RNA, 21 nt, Human
ugccucugacacacagcucug

SEQ ID NO: 3110252 - RNA, 15 nt, Human
agcuuaucucagggg

SEQ ID NO: 3110253 - RNA, 14 nt, Human
agcuuaucucaggg

SEQ ID NO: 3110254 - RNA, 12 nt, Human
agcuuaucucag

SEQ ID NO: 3110255 - RNA, 20 nt, Human
ugcggacagccacggccagg

SEQ ID NO: 3110256 - RNA, 18 nt, Human
agcuuguaaauagcucag

SEQ ID NO: 3110257 - RNA, 19 nt, Human
agcuuguaaauagcucagg

SEQ ID NO: 3110258 - RNA, 20 nt, Human
agcuuguaaauagcucaggu

SEQ ID NO: 3110259 - RNA, 21 nt, Human
agcuuguaaauagcucaggug

SEQ ID NO: 3110260 - RNA, 13 nt, Human
aggaaagaggcuc

SEQ ID NO: 3110261 - RNA, 12 nt, Human
aggaaagaggcu

SEQ ID NO: 3110262 - RNA, 17 nt, Human
aggaaagcaaaggagau

SEQ ID NO: 3110263 - RNA, 16 nt, Human
aggaaagaggcucugg

SEQ ID NO: 3110264 - RNA, 19 nt, Human
agcuuugaaaauucagugg

SEQ ID NO: 3110265 - RNA, 18 nt, Human
agcuuugaaaauucagug

SEQ ID NO: 3110266 - RNA, 16 nt, Human
agcuuugaaaauucag

SEQ ID NO: 3110267 - RNA, 12 nt, Human
agcuuugaaaau

SEQ ID NO: 3110268 - RNA, 16 nt, Human
aggaaaagcugcugac

SEQ ID NO: 3110269 - RNA, 15 nt, Human
aggaaacccagcucu

SEQ ID NO: 3110270 - RNA, 17 nt, Human
aggaaacccagcucugg

SEQ ID NO: 3110271 - RNA, 16 nt, Human
aggaaacccagcucug

SEQ ID NO: 3110272 - RNA, 20 nt, Human
aggaaacccagcucuggucc

SEQ ID NO: 3110273 - RNA, 18 nt, Human
aggaaacccagcucuggu

SEQ ID NO: 3110274 - RNA, 21 nt, Human
aggaaacccagcucuggucca

SEQ ID NO: 3110275 - RNA, 19 nt, Human
aggaaagcaaaggagauug

SEQ ID NO: 3110276 - RNA, 16 nt, Human
ugcugacuguuuucuc

SEQ ID NO: 3110277 - RNA, 24 nt, Human
ugcugacuguuuucucuugagagg

SEQ ID NO: 3110278 - RNA, 21 nt, Human
ugcugacuguuuucucuugag

SEQ ID NO: 3110279 - RNA, 20 nt, Human
aggaaaggcuccaggagcag

SEQ ID NO: 3110280 - RNA, 18 nt, Human
aggaaaggcuccaggagc

SEQ ID NO: 3110281 - RNA, 16 nt, Human
aggaaaggcuccagga

SEQ ID NO: 3110282 - RNA, 22 nt, Human
aggaaaggcuccaggagcagcc

SEQ ID NO: 3110283 - RNA, 19 nt, Human
ugcucugaucauccacugu

SEQ ID NO: 3110284 - RNA, 22 nt, Human
ugcucugaucauccacugugcc

SEQ ID NO: 3110285 - RNA, 17 nt, Human
ugcucuggacaggcaug

SEQ ID NO: 3110286 - RNA, 15 nt, Human
ugcucugcauguuac

SEQ ID NO: 3110287 - RNA, 18 nt, Human
ugcucugcauguuacaua

SEQ ID NO: 3110288 - RNA, 17 nt, Human
ugcugacuguuuucucu

SEQ ID NO: 3110289 - RNA, 17 nt, Human
aggaagcucagggccug

SEQ ID NO: 3110290 - RNA, 22 nt, Human
aggaagcucagggccuggcuca

SEQ ID NO: 3110291 - RNA, 18 nt, Human
aggaagcucagggccugg

SEQ ID NO: 3110292 - RNA, 14 nt, Human
aggaagagaaaaaa

SEQ ID NO: 3110293 - RNA, 15 nt, Human
aggaagacuuuggaa

SEQ ID NO: 3110294 - RNA, 23 nt, Human
aggaauccagacccggcugcgug

SEQ ID NO: 3110295 - RNA, 20 nt, Human
aggaauccagacccggcugc

SEQ ID NO: 3110296 - RNA, 16 nt, Human
aggaagcucagggccu

SEQ ID NO: 3110297 - RNA, 21 nt, Human
ugcugccauccagguucagcu

SEQ ID NO: 3110298 - RNA, 22 nt, Human
ugcugccauccagguucagcuu

SEQ ID NO: 3110299 - RNA, 12 nt, Human
ugcugccaucca

SEQ ID NO: 3110300 - RNA, 13 nt, Human
ugcugccauccag

SEQ ID NO: 3110301 - RNA, 14 nt, Human
ugcugccauccagg

SEQ ID NO: 3110302 - RNA, 15 nt, Human
ugcugccauccaggu

SEQ ID NO: 3110303 - RNA, 11 nt, Human
ugcugccaucc

SEQ ID NO: 3110304 - RNA, 15 nt, Human
agccucaaccuccug

SEQ ID NO: 3110305 - RNA, 15 nt, Human
agccuaggugacaga

SEQ ID NO: 3110306 - RNA, 17 nt, Human
agccuaggugacagagu

SEQ ID NO: 3110307 - RNA, 19 nt, Human
ugcagacucuacagaggcc

SEQ ID NO: 3110308 - RNA, 20 nt, Human
ugcagacucuacagaggcca

SEQ ID NO: 3110309 - RNA, 18 nt, Human
ugcagacucuacagaggc

SEQ ID NO: 3110310 - RNA, 20 nt, Human
ugcacuuuguucuggcucuu

SEQ ID NO: 3110311 - RNA, 15 nt, Human
ugcacuccccugcug

SEQ ID NO: 3110312 - RNA, 22 nt, Human
ugcagacucuacagaggccaug

SEQ ID NO: 3110313 - RNA, 15 nt, Human
ugcacacaccagagc

SEQ ID NO: 3110314 - RNA, 16 nt, Human
ugcacaagcuccaagc

SEQ ID NO: 3110315 - RNA, 15 nt, Human
ugcacaagcuccaag

SEQ ID NO: 3110316 - RNA, 23 nt, Human
ugcacaagcuccaagcucccagg

SEQ ID NO: 3110317 - RNA, 22 nt, Human
ugcacaagcuccaagcucccag

SEQ ID NO: 3110318 - RNA, 20 nt, Human
ugcacaagcuccaagcuccc

SEQ ID NO: 3110319 - RNA, 18 nt, Human
ugcacaagcuccaagcuc

SEQ ID NO: 3110320 - RNA, 13 nt, Human
ugcacuccccugc

SEQ ID NO: 3110321 - RNA, 12 nt, Human
ugcacuccccug

SEQ ID NO: 3110322 - RNA, 14 nt, Human
ugcaccacugcacu

SEQ ID NO: 3110323 - RNA, 19 nt, Human
ugcacguacacacacauac

SEQ ID NO: 3110324 - RNA, 18 nt, Human
ugcagccucaaccuccug

SEQ ID NO: 3110325 - RNA, 19 nt, Human
ugcagccucaaccuccugg

SEQ ID NO: 3110326 - RNA, 17 nt, Human
agccucaaccuccuggg

SEQ ID NO: 3110327 - RNA, 18 nt, Human
agccucaaccuccugggc

SEQ ID NO: 3110328 - RNA, 13 nt, Human
agccucagcaucc

SEQ ID NO: 3110329 - RNA, 14 nt, Human
agccucagcauccu

SEQ ID NO: 3110330 - RNA, 15 nt, Human
agccucagcauccug

SEQ ID NO: 3110331 - RNA, 14 nt, Human
ugcagugagccgag

SEQ ID NO: 3110332 - RNA, 13 nt, Human
ugcaugcuguccc

SEQ ID NO: 3110333 - RNA, 15 nt, Human
ugcaugcugucccuu

SEQ ID NO: 3110334 - RNA, 14 nt, Human
ugcaugcugucccu

SEQ ID NO: 3110335 - RNA, 21 nt, Human
ugcaugaggcuaguguggugu

SEQ ID NO: 3110336 - RNA, 22 nt, Human
ugcaugaaguaauaugcacaca

SEQ ID NO: 3110337 - RNA, 20 nt, Human
ugcaugaaguaauaugcaca

SEQ ID NO: 3110338 - RNA, 21 nt, Human
ugcauaccacuuuuguucuug

SEQ ID NO: 3110339 - RNA, 22 nt, Human
ugcauaccacuuuuguucuugg

SEQ ID NO: 3110340 - RNA, 16 nt, Human
ugcaugcugucccuua

SEQ ID NO: 3110341 - RNA, 23 nt, Human
agccugcaguuauuaacacuaac

SEQ ID NO: 3110342 - RNA, 19 nt, Human
agccugccucuucucuacu

SEQ ID NO: 3110343 - RNA, 16 nt, Human
agccugccucuucucu

SEQ ID NO: 3110344 - RNA, 21 nt, Human
ugccauguuggccaggcuggu

SEQ ID NO: 3110345 - RNA, 20 nt, Human
ugccauguuggccaggcugg

SEQ ID NO: 3110346 - RNA, 17 nt, Human
ugccauguuggccaggc

SEQ ID NO: 3110347 - RNA, 17 nt, Human
agcucagggccuggcuc

SEQ ID NO: 3110348 - RNA, 18 nt, Human
ugccauguuggccaggcu

SEQ ID NO: 3110349 - RNA, 19 nt, Human
ugccauguuggccaggcug

SEQ ID NO: 3110350 - RNA, 16 nt, Human
agcucagggccuggcu

SEQ ID NO: 3110351 - RNA, 15 nt, Human
agcucagggccuggc

SEQ ID NO: 3110352 - RNA, 14 nt, Human
agcucagggccugg

SEQ ID NO: 3110353 - RNA, 12 nt, Human
ugcccaggcccc

SEQ ID NO: 3110354 - RNA, 20 nt, Human
ugcccaggccccugccaccc

SEQ ID NO: 3110355 - RNA, 22 nt, Human
ugcccaggccccugccacccug

SEQ ID NO: 3110356 - RNA, 16 nt, Human
ugcccaggcaggucuu

SEQ ID NO: 3110357 - RNA, 17 nt, Human
ugcccaggcaggucuug

SEQ ID NO: 3110358 - RNA, 20 nt, Human
ugcccaggcaggucuugaac

SEQ ID NO: 3110359 - RNA, 11 nt, Human
ugcccaggccc

SEQ ID NO: 3110360 - RNA, 14 nt, Human
ugcccacaggauca

SEQ ID NO: 3110361 - RNA, 15 nt, Human
ugcccaggcaggucu

SEQ ID NO: 3110362 - RNA, 23 nt, Human
ugccagucaccccggccaccugc

SEQ ID NO: 3110363 - RNA, 22 nt, Human
ugccagucaccccggccaccug

SEQ ID NO: 3110364 - RNA, 16 nt, Human
ugccauauucuguugg

SEQ ID NO: 3110365 - RNA, 17 nt, Human
ugccauauucuguuggc

SEQ ID NO: 3110366 - RNA, 15 nt, Human
ugccauauucuguug

SEQ ID NO: 3110367 - RNA, 20 nt, Human
ugccagucaccccggccacc

SEQ ID NO: 3110368 - RNA, 18 nt, Human
ugccagucaccccggcca

SEQ ID NO: 3110369 - RNA, 16 nt, Human
ugccagucaccccggc

SEQ ID NO: 3110370 - RNA, 15 nt, Human
ugccagucaccccgg

SEQ ID NO: 3110371 - RNA, 13 nt, Human
agcgugagccacu

SEQ ID NO: 3110372 - RNA, 15 nt, Human
agcgugagccacugc

SEQ ID NO: 3110373 - RNA, 16 nt, Human
agcggggacagcuccu

SEQ ID NO: 3110374 - RNA, 17 nt, Human
agcggggacagcuccuu

SEQ ID NO: 3110375 - RNA, 15 nt, Human
agcggggacagcucc

SEQ ID NO: 3110376 - RNA, 20 nt, Human
ugccauauucuguuggccag

SEQ ID NO: 3110377 - RNA, 21 nt, Human
ugccauauucuguuggccagu

SEQ ID NO: 3110378 - RNA, 16 nt, Human
agcgugagccacugca

SEQ ID NO: 3110379 - RNA, 17 nt, Human
agcgugagccacugcac

SEQ ID NO: 3110380 - RNA, 20 nt, Human
agcgugguggacaugcacag

SEQ ID NO: 3110381 - RNA, 23 nt, Human
agcgugguggacaugcacagcua

SEQ ID NO: 3110382 - RNA, 14 nt, Human
agcgcccaguuggg

SEQ ID NO: 3110383 - RNA, 22 nt, Human
agcgcccaguuggguggaugcc

SEQ ID NO: 3110384 - RNA, 19 nt, Human
ugcauuugaaaauuuugau

SEQ ID NO: 3110385 - RNA, 23 nt, Human
ugcauuugaaaauuuugauguuu

SEQ ID NO: 3110386 - RNA, 17 nt, Human
uggcuaauguacugcau

SEQ ID NO: 3110387 - RNA, 19 nt, Human
uggcuaauguacugcauau

SEQ ID NO: 3110388 - RNA, 14 nt, Human
uggcuaaauucaug

SEQ ID NO: 3110389 - RNA, 23 nt, Human
aggcuccaggagcagccacauuc

SEQ ID NO: 3110390 - RNA, 19 nt, Human
aggcuccaggagcagccac

SEQ ID NO: 3110391 - RNA, 18 nt, Human
aggcuccaggagcagcca

SEQ ID NO: 3110392 - RNA, 17 nt, Human
aggcuccaggagcagcc

SEQ ID NO: 3110393 - RNA, 13 nt, Human
uggcucacgccug

SEQ ID NO: 3110394 - RNA, 23 nt, Human
uggcuguuggcugggggccucag

SEQ ID NO: 3110395 - RNA, 14 nt, Human
uggcuucacggaag

SEQ ID NO: 3110396 - RNA, 16 nt, Human
uggcuguuggcugggg

SEQ ID NO: 3110397 - RNA, 18 nt, Human
uggcuguuggcugggggc

SEQ ID NO: 3110398 - RNA, 23 nt, Human
uggcugcaaaggguaucaggugc

SEQ ID NO: 3110399 - RNA, 15 nt, Human
uggcuuuugugcauu

SEQ ID NO: 3110400 - RNA, 16 nt, Human
uggcuuuugugcauua

SEQ ID NO: 3110401 - RNA, 20 nt, Human
uggcuucacggaagagccuu

SEQ ID NO: 3110402 - RNA, 17 nt, Human
uggcuucacggaagagc

SEQ ID NO: 3110403 - RNA, 21 nt, Human
uggcuuuugugcauuaucuag

SEQ ID NO: 3110404 - RNA, 13 nt, Human
aggcugggcuccc

SEQ ID NO: 3110405 - RNA, 18 nt, Human
aggcugggcucccuuccc

SEQ ID NO: 3110406 - RNA, 14 nt, Human
aggcugggcucccu

SEQ ID NO: 3110407 - RNA, 14 nt, Human
aggcugggcuucag

SEQ ID NO: 3110408 - RNA, 23 nt, Human
aggcugggcucccuucccaccuc

SEQ ID NO: 3110409 - RNA, 21 nt, Human
aggcugggcucccuucccacc

SEQ ID NO: 3110410 - RNA, 22 nt, Human
aggcugggagagccuuccaggg

SEQ ID NO: 3110411 - RNA, 21 nt, Human
aggcugggagagccuuccagg

SEQ ID NO: 3110412 - RNA, 20 nt, Human
aggcugggagagccuuccag

SEQ ID NO: 3110413 - RNA, 16 nt, Human
aggcugggagagccuu

SEQ ID NO: 3110414 - RNA, 19 nt, Human
aggcugggagagccuucca

SEQ ID NO: 3110415 - RNA, 17 nt, Human
aggcugggggaagaagc

SEQ ID NO: 3110416 - RNA, 22 nt, Human
aggcugggcuucaguggcagcu

SEQ ID NO: 3110417 - RNA, 23 nt, Human
aggcugggcuucaguggcagcug

SEQ ID NO: 3110418 - RNA, 18 nt, Human
aggcugggcuucaguggc

SEQ ID NO: 3110419 - RNA, 19 nt, Human
aggcugggcuucaguggca

SEQ ID NO: 3110420 - RNA, 20 nt, Human
aggcugggcuucaguggcag

SEQ ID NO: 3110421 - RNA, 21 nt, Human
aggcugggcuucaguggcagc

SEQ ID NO: 3110422 - RNA, 22 nt, Human
aggcugggggaagaagcucucu

SEQ ID NO: 3110423 - RNA, 17 nt, Human
aggcuggguucugaucc

SEQ ID NO: 3110424 - RNA, 14 nt, Human
aggcuggguucuga

SEQ ID NO: 3110425 - RNA, 23 nt, Human
aggcuuagucacugagacagccc

SEQ ID NO: 3110426 - RNA, 22 nt, Human
aggcuuagucacugagacagcc

SEQ ID NO: 3110427 - RNA, 21 nt, Human
aggcuuagucacugagacagc

SEQ ID NO: 3110428 - RNA, 12 nt, Human
agggcccagaga

SEQ ID NO: 3110429 - RNA, 13 nt, Human
agggcccagagag

SEQ ID NO: 3110430 - RNA, 23 nt, Human
agggaguccgaaagggacuugga

SEQ ID NO: 3110431 - RNA, 20 nt, Human
agggagugacagaggcagcc

SEQ ID NO: 3110432 - RNA, 20 nt, Human
agggagugaguugauagcac

SEQ ID NO: 3110433 - RNA, 20 nt, Human
agggaguccgaaagggacuu

SEQ ID NO: 3110434 - RNA, 22 nt, Human
agggagggcuccagacacaugu

SEQ ID NO: 3110435 - RNA, 17 nt, Human
agggagggagggcucca

SEQ ID NO: 3110436 - RNA, 12 nt, Human
agggagggcucc

SEQ ID NO: 3110437 - RNA, 19 nt, Human
agggagggcuccagacaca

SEQ ID NO: 3110438 - RNA, 17 nt, Human
agggagggcuccagaca

SEQ ID NO: 3110439 - RNA, 14 nt, Human
agggcccagagagg

SEQ ID NO: 3110440 - RNA, 15 nt, Human
agggcuccagacaca

SEQ ID NO: 3110441 - RNA, 20 nt, Human
agggcuccagacacaugucc

SEQ ID NO: 3110442 - RNA, 21 nt, Human
ugggcucccuucccaccucuc

SEQ ID NO: 3110443 - RNA, 14 nt, Human
ugggcucccuuccc

SEQ ID NO: 3110444 - RNA, 21 nt, Human
ugggaggauugcuugagcuca

SEQ ID NO: 3110445 - RNA, 18 nt, Human
ugggaggauugcuugagc

SEQ ID NO: 3110446 - RNA, 22 nt, Human
ugggaggauugcuugagcucag

SEQ ID NO: 3110447 - RNA, 22 nt, Human
ugggaggaucucuugagccugg

SEQ ID NO: 3110448 - RNA, 21 nt, Human
ugggagaaccaaaaagaggcu

SEQ ID NO: 3110449 - RNA, 13 nt, Human
ugggcagaaggaa

SEQ ID NO: 3110450 - RNA, 20 nt, Human
ugggcagaaggaagacuuca

SEQ ID NO: 3110451 - RNA, 16 nt, Human
ugggcagaaggaagac

SEQ ID NO: 3110452 - RNA, 21 nt, Human
ugggcaacccccagccugcua

SEQ ID NO: 3110453 - RNA, 18 nt, Human
agggacuuggaagcuccg

SEQ ID NO: 3110454 - RNA, 19 nt, Human
agggacuuggaagcuccgc

SEQ ID NO: 3110455 - RNA, 15 nt, Human
agggacuuggaagcu

SEQ ID NO: 3110456 - RNA, 20 nt, Human
agggacuuggaagcuccgcu

SEQ ID NO: 3110457 - RNA, 18 nt, Human
ugggacuacaggcaccca

SEQ ID NO: 3110458 - RNA, 16 nt, Human
ugggacuacaggugug

SEQ ID NO: 3110459 - RNA, 22 nt, Human
uggcaugggaaugaaugucagu

SEQ ID NO: 3110460 - RNA, 19 nt, Human
uggcccacgcacuucggga

SEQ ID NO: 3110461 - RNA, 13 nt, Human
uggcccacgcacu

SEQ ID NO: 3110462 - RNA, 14 nt, Human
uggcccacugcauc

SEQ ID NO: 3110463 - RNA, 13 nt, Human
uggcccacugcau

SEQ ID NO: 3110464 - RNA, 18 nt, Human
uggccugagcugggauga

SEQ ID NO: 3110465 - RNA, 20 nt, Human
uggccucugcacuccccugc

SEQ ID NO: 3110466 - RNA, 18 nt, Human
uggccucugcacuccccu

SEQ ID NO: 3110467 - RNA, 19 nt, Human
uggccucugcacuccccug

SEQ ID NO: 3110468 - RNA, 17 nt, Human
aggccuucucugaagga

SEQ ID NO: 3110469 - RNA, 18 nt, Human
aggccuucucugaaggac

SEQ ID NO: 3110470 - RNA, 13 nt, Human
aggcuccaggagc

SEQ ID NO: 3110471 - RNA, 16 nt, Human
aggcuccaggagcagc

SEQ ID NO: 3110472 - RNA, 14 nt, Human
aggcuccaggagca

SEQ ID NO: 3110473 - RNA, 15 nt, Human
uggcagcucagagag

SEQ ID NO: 3110474 - RNA, 14 nt, Human
uggcagcucagaga

SEQ ID NO: 3110475 - RNA, 18 nt, Human
aggccagagacacaagcc

SEQ ID NO: 3110476 - RNA, 13 nt, Human
aggccagagacac

SEQ ID NO: 3110477 - RNA, 16 nt, Human
uggcagcucagagagg

SEQ ID NO: 3110478 - RNA, 12 nt, Human
aggccagagaca

SEQ ID NO: 3110479 - RNA, 17 nt, Human
aggccaugggccuccug

SEQ ID NO: 3110480 - RNA, 18 nt, Human
aggccaugggccuccugu

SEQ ID NO: 3110481 - RNA, 23 nt, Human
aggccagagacacaagccuucgg

SEQ ID NO: 3110482 - RNA, 13 nt, Human
uggcagcucagag

SEQ ID NO: 3110483 - RNA, 16 nt, Human
aggcccagagggccug

SEQ ID NO: 3110484 - RNA, 15 nt, Human
aggcccagagggccu

SEQ ID NO: 3110485 - RNA, 17 nt, Human
uggcaccagcagccugg

SEQ ID NO: 3110486 - RNA, 16 nt, Human
uggcaccagcagccug

SEQ ID NO: 3110487 - RNA, 13 nt, Human
aggccccugccac

SEQ ID NO: 3110488 - RNA, 15 nt, Human
aggccccugccaccc

SEQ ID NO: 3110489 - RNA, 20 nt, Human
aggcccagagggccugcaag

SEQ ID NO: 3110490 - RNA, 19 nt, Human
aggcccagagggccugcaa

SEQ ID NO: 3110491 - RNA, 17 nt, Human
aggccccugccacccug

SEQ ID NO: 3110492 - RNA, 18 nt, Human
aggccccugccacccugg

SEQ ID NO: 3110493 - RNA, 12 nt, Human
aggccccugcca

SEQ ID NO: 3110494 - RNA, 21 nt, Human
aggccccugccacccugggga

SEQ ID NO: 3110495 - RNA, 14 nt, Human
aggcccggcuccag

SEQ ID NO: 3110496 - RNA, 15 nt, Human
aggcccggcuccagg

SEQ ID NO: 3110497 - RNA, 16 nt, Human
aggcccggcuccaggc

SEQ ID NO: 3110498 - RNA, 13 nt, Human
aggccuggccaga

SEQ ID NO: 3110499 - RNA, 12 nt, Human
aggccuggccag

SEQ ID NO: 3110500 - RNA, 19 nt, Human
aggcagggucucacucugu

SEQ ID NO: 3110501 - RNA, 18 nt, Human
aggcagggucucacucug

SEQ ID NO: 3110502 - RNA, 20 nt, Human
aggcagggucucacucuguc

SEQ ID NO: 3110503 - RNA, 21 nt, Human
aggcagggucucacucugucg

SEQ ID NO: 3110504 - RNA, 22 nt, Human
aggcagggucucacucugucgc

SEQ ID NO: 3110505 - RNA, 14 nt, Human
aggcagguccaggg

SEQ ID NO: 3110506 - RNA, 21 nt, Human
aggcaggucuugaacuccugg

SEQ ID NO: 3110507 - RNA, 22 nt, Human
aggcagccccauucugccugcc

SEQ ID NO: 3110508 - RNA, 19 nt, Human
aggcagccccauucugccu

SEQ ID NO: 3110509 - RNA, 20 nt, Human
aggcagccccauucugccug

SEQ ID NO: 3110510 - RNA, 21 nt, Human
aggcagccccauucugccugc

SEQ ID NO: 3110511 - RNA, 12 nt, Human
aggcaggauggc

SEQ ID NO: 3110512 - RNA, 22 nt, Human
uggacuuuguuaguuucuccaa

SEQ ID NO: 3110513 - RNA, 11 nt, Human
uggacuuuguu

SEQ ID NO: 3110514 - RNA, 24 nt, Human
uggacuuuguuaguuucuccaagc

SEQ ID NO: 3110515 - RNA, 15 nt, Human
aggcaaugcuggcug

SEQ ID NO: 3110516 - RNA, 16 nt, Human
aggcaaugcuggcugu

SEQ ID NO: 3110517 - RNA, 22 nt, Human
aggauugcuacuguccuaccca

SEQ ID NO: 3110518 - RNA, 18 nt, Human
aggaugcuuguacauaau

SEQ ID NO: 3110519 - RNA, 21 nt, Human
aggauccugagccagauuuca

SEQ ID NO: 3110520 - RNA, 15 nt, Human
aggaugcuuguacau

SEQ ID NO: 3110521 - RNA, 16 nt, Human
aggaugcuuguacaua

SEQ ID NO: 3110522 - RNA, 14 nt, Human
aggcaagcaccucc

SEQ ID NO: 3110523 - RNA, 19 nt, Human
aggcaacugcauuggcuuu

SEQ ID NO: 3110524 - RNA, 18 nt, Human
uggaaguacuauaauuua

SEQ ID NO: 3110525 - RNA, 20 nt, Human
uggaaguacuauaauuuacc

SEQ ID NO: 3110526 - RNA, 13 nt, Human
uggaagcuccgcu

SEQ ID NO: 3110527 - RNA, 12 nt, Human
uggaacacucug

SEQ ID NO: 3110528 - RNA, 10 nt, Human
ugcugcccug

SEQ ID NO: 3110529 - RNA, 15 nt, Human
aggaggccagccuug

SEQ ID NO: 3110530 - RNA, 21 nt, Human
aggaguuugagaccaaccugg

SEQ ID NO: 3110531 - RNA, 16 nt, Human
agugaggaugaaaaaa

SEQ ID NO: 3110532 - RNA, 13 nt, Human
agugaggcucugc

SEQ ID NO: 3110533 - RNA, 12 nt, Human
agugaggcucug

SEQ ID NO: 3110534 - RNA, 17 nt, Human
agugcagugagccgaga

SEQ ID NO: 3110535 - RNA, 16 nt, Human
agugcaugcugucccu

SEQ ID NO: 3110536 - RNA, 14 nt, Human
agugcaugcugucc

SEQ ID NO: 3110537 - RNA, 20 nt, Human
ugugcugcccugcccaccug

SEQ ID NO: 3110538 - RNA, 19 nt, Human
ugugcugcccugcccaccu

SEQ ID NO: 3110539 - RNA, 18 nt, Human
ugugcugcccugcccacc

SEQ ID NO: 3110540 - RNA, 23 nt, Human
agugagcugguuuuuagcggaga

SEQ ID NO: 3110541 - RNA, 22 nt, Human
uguggauuuaacagaaauguac

SEQ ID NO: 3110542 - RNA, 19 nt, Human
uguggauuuaacagaaaug

SEQ ID NO: 3110543 - RNA, 20 nt, Human
uguggauuuaacagaaaugu

SEQ ID NO: 3110544 - RNA, 14 nt, Human
uguggaugauaaaa

SEQ ID NO: 3110545 - RNA, 19 nt, Human
ugugcugagucugaaggcu

SEQ ID NO: 3110546 - RNA, 18 nt, Human
ugugcugagucugaaggc

SEQ ID NO: 3110547 - RNA, 11 nt, Human
ugugaggaagc

SEQ ID NO: 3110548 - RNA, 16 nt, Human
ugugacugaucucucg

SEQ ID NO: 3110549 - RNA, 17 nt, Human
agucucuugauucauaa

SEQ ID NO: 3110550 - RNA, 16 nt, Human
agucucuugauucaua

SEQ ID NO: 3110551 - RNA, 14 nt, Human
agucuuagauguau

SEQ ID NO: 3110552 - RNA, 16 nt, Human
agucuuagauguauau

SEQ ID NO: 3110553 - RNA, 13 nt, Human
agucuuagaugua

SEQ ID NO: 3110554 - RNA, 18 nt, Human
ugugaugagaggaaauca

SEQ ID NO: 3110555 - RNA, 19 nt, Human
ugugaugagaggaaaucac

SEQ ID NO: 3110556 - RNA, 22 nt, Human
ugugaugaugaaaugaggucag

SEQ ID NO: 3110557 - RNA, 12 nt, Human
agugagcugguu

SEQ ID NO: 3110558 - RNA, 14 nt, Human
agugagcacuaagg

SEQ ID NO: 3110559 - RNA, 21 nt, Human
agugacugauggcuaauguac

SEQ ID NO: 3110560 - RNA, 16 nt, Human
agugaacuugggccac

SEQ ID NO: 3110561 - RNA, 20 nt, Human
agugugacugaucucucgug

SEQ ID NO: 3110562 - RNA, 20 nt, Human
agugugccugaagucccaga

SEQ ID NO: 3110563 - RNA, 21 nt, Human
agugugccugaagucccagau

SEQ ID NO: 3110564 - RNA, 20 nt, Human
agugugguguuuccuggcac

SEQ ID NO: 3110565 - RNA, 13 nt, Human
uguuaugacucca

SEQ ID NO: 3110566 - RNA, 17 nt, Human
uguuaugacuccagaau

SEQ ID NO: 3110567 - RNA, 22 nt, Human
agugugguguuuccuggcacug

SEQ ID NO: 3110568 - RNA, 13 nt, Human
aguuacucagaau

SEQ ID NO: 3110569 - RNA, 19 nt, Human
aguguuguggauuuaacag

SEQ ID NO: 3110570 - RNA, 20 nt, Human
aguguuguggauuuaacaga

SEQ ID NO: 3110571 - RNA, 16 nt, Human
aguguuguggauuuaa

SEQ ID NO: 3110572 - RNA, 23 nt, Human
uguugcccaggcuggcgugcagu

SEQ ID NO: 3110573 - RNA, 20 nt, Human
uguugcccaggcuggcgugc

SEQ ID NO: 3110574 - RNA, 22 nt, Human
uguguuaucacccagaagaaaa

SEQ ID NO: 3110575 - RNA, 22 nt, Human
agugggcccaaugcacuuuguu

SEQ ID NO: 3110576 - RNA, 18 nt, Human
agugggggaucacagccu

SEQ ID NO: 3110577 - RNA, 22 nt, Human
ugugucucuugguccugcugca

SEQ ID NO: 3110578 - RNA, 20 nt, Human
ugugucagguggggcagcuu

SEQ ID NO: 3110579 - RNA, 16 nt, Human
uguaggguuauaauaa

SEQ ID NO: 3110580 - RNA, 17 nt, Human
uguaggguuauaauaau

SEQ ID NO: 3110581 - RNA, 18 nt, Human
uguauauauuuccuauau

SEQ ID NO: 3110582 - RNA, 22 nt, Human
uguauauauuuccuauauuguu

SEQ ID NO: 3110583 - RNA, 21 nt, Human
aguacacuguuucaaacuuua

SEQ ID NO: 3110584 - RNA, 20 nt, Human
aguacacuguuucaaacuuu

SEQ ID NO: 3110585 - RNA, 23 nt, Human
aguacacuguuucaaacuuuacu

SEQ ID NO: 3110586 - RNA, 21 nt, Human
uguacauggaauaacauguaa

SEQ ID NO: 3110587 - RNA, 20 nt, Human
uguacaugaaaacacauuuu

SEQ ID NO: 3110588 - RNA, 16 nt, Human
uguacaugaaaacaca

SEQ ID NO: 3110589 - RNA, 14 nt, Human
uguacaugaaaaca

SEQ ID NO: 3110590 - RNA, 20 nt, Human
uguaauuuuuuuaucgucac

SEQ ID NO: 3110591 - RNA, 19 nt, Human
uguacauaaugcgugcaua

SEQ ID NO: 3110592 - RNA, 20 nt, Human
uguacauaaugcgugcauac

SEQ ID NO: 3110593 - RNA, 20 nt, Human
agguuggcaaaaaggcagga

SEQ ID NO: 3110594 - RNA, 17 nt, Human
uguaauuaaguacuaug

SEQ ID NO: 3110595 - RNA, 18 nt, Human
uguaauuaaguacuaugu

SEQ ID NO: 3110596 - RNA, 19 nt, Human
uguaauuaaguacuaugua

SEQ ID NO: 3110597 - RNA, 21 nt, Human
uguaauuaaguacuauguauc

SEQ ID NO: 3110598 - RNA, 12 nt, Human
aggugggaggau

SEQ ID NO: 3110599 - RNA, 20 nt, Human
aggugugagucaccaagccc

SEQ ID NO: 3110600 - RNA, 16 nt, Human
aggugucccugcacuu

SEQ ID NO: 3110601 - RNA, 21 nt, Human
aggugugagucaccaagccca

SEQ ID NO: 3110602 - RNA, 22 nt, Human
aggugugagucaccaagcccag

SEQ ID NO: 3110603 - RNA, 14 nt, Human
agguugaagcacca

SEQ ID NO: 3110604 - RNA, 14 nt, Human
ugucccugcacuug

SEQ ID NO: 3110605 - RNA, 23 nt, Human
ugucccuuacgugaguccuggca

SEQ ID NO: 3110606 - RNA, 19 nt, Human
ugucccuuacgugaguccu

SEQ ID NO: 3110607 - RNA, 18 nt, Human
agucccaccuuggcugca

SEQ ID NO: 3110608 - RNA, 19 nt, Human
agucccaccuuggcugcag

SEQ ID NO: 3110609 - RNA, 15 nt, Human
agucccaccuuggcu

SEQ ID NO: 3110610 - RNA, 16 nt, Human
agucccaccuuggcug

SEQ ID NO: 3110611 - RNA, 23 nt, Human
agucucacuguugcccaggcugg

SEQ ID NO: 3110612 - RNA, 21 nt, Human
agucucacuguugcccaggcu

SEQ ID NO: 3110613 - RNA, 16 nt, Human
aguccucccaucucac

SEQ ID NO: 3110614 - RNA, 14 nt, Human
aguccucccaucuc

SEQ ID NO: 3110615 - RNA, 22 nt, Human
uguccaagaagcccaggaaagg

SEQ ID NO: 3110616 - RNA, 18 nt, Human
uguccaagaagcccagga

SEQ ID NO: 3110617 - RNA, 17 nt, Human
uguccaagaagcccagg

SEQ ID NO: 3110618 - RNA, 16 nt, Human
uguccaagaagcccag

SEQ ID NO: 3110619 - RNA, 20 nt, Human
ugucccugcacuugcagacu

SEQ ID NO: 3110620 - RNA, 22 nt, Human
ugucccugcacuugcagacucu

SEQ ID NO: 3110621 - RNA, 23 nt, Human
ugucccugcacuugcagacucua

SEQ ID NO: 3110622 - RNA, 16 nt, Human
ugucagguggggcagc

SEQ ID NO: 3110623 - RNA, 15 nt, Human
uguccaagaagccca

SEQ ID NO: 3110624 - RNA, 14 nt, Human
uguccaagaagccc

SEQ ID NO: 3110625 - RNA, 17 nt, Human
ugucagguggggcagcu

SEQ ID NO: 3110626 - RNA, 18 nt, Human
ugucagguggggcagcuu

SEQ ID NO: 3110627 - RNA, 20 nt, Human
ugucagguggggcagcuuga

SEQ ID NO: 3110628 - RNA, 20 nt, Human
ugucauuugagcagggcuca

SEQ ID NO: 3110629 - RNA, 21 nt, Human
ugucauuugagcagggcucag

SEQ ID NO: 3110630 - RNA, 22 nt, Human
ugucauuugagcagggcucagc

SEQ ID NO: 3110631 - RNA, 14 nt, Human
agucaccaagccca

SEQ ID NO: 3110632 - RNA, 15 nt, Human
agucaccaagcccag

SEQ ID NO: 3110633 - RNA, 17 nt, Human
agucaccccggccaccu

SEQ ID NO: 3110634 - RNA, 19 nt, Human
aguauucuuauuuaaugaa

SEQ ID NO: 3110635 - RNA, 11 nt, Human
auacucccauc

SEQ ID NO: 3110636 - RNA, 14 nt, Human
auacucccaucugu

SEQ ID NO: 3110637 - RNA, 16 nt, Human
auacucugcuuagaau

SEQ ID NO: 3110638 - RNA, 13 nt, Human
uuauuaugcauga

SEQ ID NO: 3110639 - RNA, 12 nt, Human
uuauuaugcaug

SEQ ID NO: 3110640 - RNA, 23 nt, Human
auagacaauuuauuauggcacau

SEQ ID NO: 3110641 - RNA, 16 nt, Human
auagacaauuuauuau

SEQ ID NO: 3110642 - RNA, 22 nt, Human
auagacaauuuauuauggcaca

SEQ ID NO: 3110643 - RNA, 14 nt, Human
auagagagagacca

SEQ ID NO: 3110644 - RNA, 11 nt, Human
uuaugacucca

SEQ ID NO: 3110645 - RNA, 17 nt, Human
uuaucacccagaagaaa

SEQ ID NO: 3110646 - RNA, 18 nt, Human
uuaucacccagaagaaaa

SEQ ID NO: 3110647 - RNA, 19 nt, Human
uuaucacccagaagaaaau

SEQ ID NO: 3110648 - RNA, 21 nt, Human
uuaucacccagaagaaaauag

SEQ ID NO: 3110649 - RNA, 22 nt, Human
uuaugggcuggguucuacccag

SEQ ID NO: 3110650 - RNA, 13 nt, Human
uuaugggcugggu

SEQ ID NO: 3110651 - RNA, 19 nt, Human
uuauggcuuuugugcauua

SEQ ID NO: 3110652 - RNA, 18 nt, Human
uuauggcuuuugugcauu

SEQ ID NO: 3110653 - RNA, 17 nt, Human
auacagaggcaacugca

SEQ ID NO: 3110654 - RNA, 16 nt, Human
auacagaggcaacugc

SEQ ID NO: 3110655 - RNA, 17 nt, Human
uuauaaacuuuaccuuu

SEQ ID NO: 3110656 - RNA, 18 nt, Human
uuauaaacuuuaccuuuu

SEQ ID NO: 3110657 - RNA, 20 nt, Human
auacauaaacaagaccacgu

SEQ ID NO: 3110658 - RNA, 20 nt, Human
auacaguuacucagaauucu

SEQ ID NO: 3110659 - RNA, 23 nt, Human
auacagauagauauaugcucugc

SEQ ID NO: 3110660 - RNA, 22 nt, Human
auacaggaaaagcugcugacag

SEQ ID NO: 3110661 - RNA, 23 nt, Human
auacaggaaaagcugcugacagu

SEQ ID NO: 3110662 - RNA, 18 nt, Human
auacaguuacucagaauu

SEQ ID NO: 3110663 - RNA, 13 nt, Human
auacuaaccagca

SEQ ID NO: 3110664 - RNA, 19 nt, Human
auacuaaccagcagaaaug

SEQ ID NO: 3110665 - RNA, 20 nt, Human
auacuaaccagcagaaaugc

SEQ ID NO: 3110666 - RNA, 14 nt, Human
auaccuuuuuuaga

SEQ ID NO: 3110667 - RNA, 17 nt, Human
auaccacuuuuguucuu

SEQ ID NO: 3110668 - RNA, 18 nt, Human
auaccacuuuuguucuug

SEQ ID NO: 3110669 - RNA, 14 nt, Human
auacguacacauuu

SEQ ID NO: 3110670 - RNA, 15 nt, Human
auacguacacauuuu

SEQ ID NO: 3110671 - RNA, 16 nt, Human
auacguacacauuuua

SEQ ID NO: 3110672 - RNA, 13 nt, Human
auacguacacauu

SEQ ID NO: 3110673 - RNA, 23 nt, Human
uuaacuuuuauaaacuuuaccuu

SEQ ID NO: 3110674 - RNA, 22 nt, Human
uuaacuuuuauaaacuuuaccu

SEQ ID NO: 3110675 - RNA, 18 nt, Human
uuaacuuuuauaaacuuu

SEQ ID NO: 3110676 - RNA, 15 nt, Human
uuaaucuaaauggaa

SEQ ID NO: 3110677 - RNA, 17 nt, Human
uuaaaaaucucaaauuu

SEQ ID NO: 3110678 - RNA, 20 nt, Human
uuaaaaaucucaaauuucua

SEQ ID NO: 3110679 - RNA, 19 nt, Human
uuaaaaaucucaaauuucu

SEQ ID NO: 3110680 - RNA, 12 nt, Human
uuaacagaaaug

SEQ ID NO: 3110681 - RNA, 13 nt, Human
uuaacagaaaugu

SEQ ID NO: 3110682 - RNA, 14 nt, Human
uuaacagaaaugua

SEQ ID NO: 3110683 - RNA, 14 nt, Human
aguuucucuuuuca

SEQ ID NO: 3110684 - RNA, 21 nt, Human
aguuucuccaagcaggacaug

SEQ ID NO: 3110685 - RNA, 15 nt, Human
aguuucugccgcagc

SEQ ID NO: 3110686 - RNA, 22 nt, Human
aguuuguuaguaugaggcauuu

SEQ ID NO: 3110687 - RNA, 19 nt, Human
aguuucugccgcagcccug

SEQ ID NO: 3110688 - RNA, 18 nt, Human
auaauuuaccugaagucu

SEQ ID NO: 3110689 - RNA, 22 nt, Human
auaagccaaaaaaugcuugcuu

SEQ ID NO: 3110690 - RNA, 21 nt, Human
auaagauucauauuuacuucu

SEQ ID NO: 3110691 - RNA, 21 nt, Human
uuaggugugacugaauuucuu

SEQ ID NO: 3110692 - RNA, 19 nt, Human
uuaggugugggggaagcac

SEQ ID NO: 3110693 - RNA, 13 nt, Human
uuaguagagacag

SEQ ID NO: 3110694 - RNA, 14 nt, Human
uuaguagagacagg

SEQ ID NO: 3110695 - RNA, 13 nt, Human
uuauaaacuuuac

SEQ ID NO: 3110696 - RNA, 14 nt, Human
uuacaggugugaac

SEQ ID NO: 3110697 - RNA, 19 nt, Human
uuaccagcagagcaccuua

SEQ ID NO: 3110698 - RNA, 14 nt, Human
uuaccagcagagca

SEQ ID NO: 3110699 - RNA, 14 nt, Human
auaagauucauauu

SEQ ID NO: 3110700 - RNA, 16 nt, Human
uuagaagucacacagu

SEQ ID NO: 3110701 - RNA, 15 nt, Human
uuacugcagcuuugu

SEQ ID NO: 3110702 - RNA, 13 nt, Human
uuacuguacauga

SEQ ID NO: 3110703 - RNA, 14 nt, Human
uuacuguacaugaa

SEQ ID NO: 3110704 - RNA, 22 nt, Human
uuacuguacaugaaaacacauu

SEQ ID NO: 3110705 - RNA, 23 nt, Human
uuacuguacaugaaaacacauuu

SEQ ID NO: 3110706 - RNA, 12 nt, Human
uuacuguacaug

SEQ ID NO: 3110707 - RNA, 11 nt, Human
agaaauguguu

SEQ ID NO: 3110708 - RNA, 17 nt, Human
agaaauguacagcaagg

SEQ ID NO: 3110709 - RNA, 16 nt, Human
agaaauguacagcaag

SEQ ID NO: 3110710 - RNA, 19 nt, Human
ucugacccugcuucaaaua

SEQ ID NO: 3110711 - RNA, 18 nt, Human
ucugauucccaagcucug

SEQ ID NO: 3110712 - RNA, 19 nt, Human
ucugauucccaagcucugc

SEQ ID NO: 3110713 - RNA, 20 nt, Human
ucugauucccaagcucugcu

SEQ ID NO: 3110714 - RNA, 21 nt, Human
ucugauucccaagcucugcuc

SEQ ID NO: 3110715 - RNA, 22 nt, Human
ucugcacuccccugcugggugu

SEQ ID NO: 3110716 - RNA, 23 nt, Human
ucugccgcagcccugcagagggc

SEQ ID NO: 3110717 - RNA, 14 nt, Human
ucugcccuccaaga

SEQ ID NO: 3110718 - RNA, 16 nt, Human
ucugcucacauaucug

SEQ ID NO: 3110719 - RNA, 16 nt, Human
agaagcggcuggcagc

SEQ ID NO: 3110720 - RNA, 15 nt, Human
agaagcggcuggcag

SEQ ID NO: 3110721 - RNA, 18 nt, Human
ucuggagguacgaaaaga

SEQ ID NO: 3110722 - RNA, 23 nt, Human
ucugcuuuuuaaagaaugcucuu

SEQ ID NO: 3110723 - RNA, 15 nt, Human
ucuggcagcucagag

SEQ ID NO: 3110724 - RNA, 14 nt, Human
ucuggcagcucaga

SEQ ID NO: 3110725 - RNA, 15 nt, Human
ucucuugagccuggg

SEQ ID NO: 3110726 - RNA, 14 nt, Human
ucucuugagccugg

SEQ ID NO: 3110727 - RNA, 13 nt, Human
ucucuugagccug

SEQ ID NO: 3110728 - RNA, 22 nt, Human
ucucuuuaaugucacaggcagg

SEQ ID NO: 3110729 - RNA, 18 nt, Human
agaaaaaggaugcacaga

SEQ ID NO: 3110730 - RNA, 17 nt, Human
ucucuccuguaccucuu

SEQ ID NO: 3110731 - RNA, 15 nt, Human
ucucuccagccccug

SEQ ID NO: 3110732 - RNA, 20 nt, Human
ucucuccuguaccucuugag

SEQ ID NO: 3110733 - RNA, 22 nt, Human
ucucuccuguaccucuugagcc

SEQ ID NO: 3110734 - RNA, 18 nt, Human
ucuccuucaccuuugucc

SEQ ID NO: 3110735 - RNA, 20 nt, Human
ucuccuucaccuuugucccc

SEQ ID NO: 3110736 - RNA, 14 nt, Human
ucucuccagccccu

SEQ ID NO: 3110737 - RNA, 13 nt, Human
ucucuccagcccc

SEQ ID NO: 3110738 - RNA, 14 nt, Human
ucucuugagagggu

SEQ ID NO: 3110739 - RNA, 12 nt, Human
ucuccucugcug

SEQ ID NO: 3110740 - RNA, 19 nt, Human
ucucccuuggauugucccc

SEQ ID NO: 3110741 - RNA, 14 nt, Human
ucuccucugcugcu

SEQ ID NO: 3110742 - RNA, 13 nt, Human
ucuccucugcugc

SEQ ID NO: 3110743 - RNA, 18 nt, Human
ucucccuuggauuguccc

SEQ ID NO: 3110744 - RNA, 11 nt, Human
ucucccuugga

SEQ ID NO: 3110745 - RNA, 23 nt, Human
acuuugaccucugcagcaauaaa

SEQ ID NO: 3110746 - RNA, 19 nt, Human
acuuugaccucugcagcaa

SEQ ID NO: 3110747 - RNA, 19 nt, Human
acuuuaccuuuuuuauaca

SEQ ID NO: 3110748 - RNA, 22 nt, Human
acuuuaccuuuuuuauacauaa

SEQ ID NO: 3110749 - RNA, 18 nt, Human
acuuuaccuuuuuuauac

SEQ ID NO: 3110750 - RNA, 12 nt, Human
acuuuggaaaga

SEQ ID NO: 3110751 - RNA, 14 nt, Human
acuuuggaaagacu

SEQ ID NO: 3110752 - RNA, 13 nt, Human
acuuuggaaagac

SEQ ID NO: 3110753 - RNA, 17 nt, Human
acuuuggaaagacuuuu

SEQ ID NO: 3110754 - RNA, 23 nt, Human
agacccuuguggucccaccccac

SEQ ID NO: 3110755 - RNA, 22 nt, Human
agacccuuguggucccacccca

SEQ ID NO: 3110756 - RNA, 20 nt, Human
agacccuuguggucccaccc

SEQ ID NO: 3110757 - RNA, 19 nt, Human
agacccuuguggucccacc

SEQ ID NO: 3110758 - RNA, 15 nt, Human
agacccuuguggucc

SEQ ID NO: 3110759 - RNA, 13 nt, Human
agacccuuguggu

SEQ ID NO: 3110760 - RNA, 23 nt, Human
agacccugcccugugggccccca

SEQ ID NO: 3110761 - RNA, 21 nt, Human
agacccugcccugugggcccc

SEQ ID NO: 3110762 - RNA, 19 nt, Human
agacccugcccugugggcc

SEQ ID NO: 3110763 - RNA, 16 nt, Human
agacccugcccugugg

SEQ ID NO: 3110764 - RNA, 12 nt, Human
agacccugcccu

SEQ ID NO: 3110765 - RNA, 14 nt, Human
agacccugcccugu

SEQ ID NO: 3110766 - RNA, 13 nt, Human
agacccugcccug

SEQ ID NO: 3110767 - RNA, 15 nt, Human
agacuaucuaaaugu

SEQ ID NO: 3110768 - RNA, 19 nt, Human
agacuaucuaaauguugaa

SEQ ID NO: 3110769 - RNA, 17 nt, Human
agacuaucuaaauguug

SEQ ID NO: 3110770 - RNA, 18 nt, Human
agacuaucuaaauguuga

SEQ ID NO: 3110771 - RNA, 18 nt, Human
agacucauucuucuguac

SEQ ID NO: 3110772 - RNA, 17 nt, Human
agacucauucuucugua

SEQ ID NO: 3110773 - RNA, 15 nt, Human
agacucauucuucug

SEQ ID NO: 3110774 - RNA, 17 nt, Human
ucuugcaauggcagccu

SEQ ID NO: 3110775 - RNA, 13 nt, Human
ucuugcaauggca

SEQ ID NO: 3110776 - RNA, 16 nt, Human
ucuugcaauggcagcc

SEQ ID NO: 3110777 - RNA, 18 nt, Human
agagaaugaaagggccca

SEQ ID NO: 3110778 - RNA, 14 nt, Human
agacuuuggaaaga

SEQ ID NO: 3110779 - RNA, 12 nt, Human
agacuuuggaaa

SEQ ID NO: 3110780 - RNA, 15 nt, Human
agagaccaucccuga

SEQ ID NO: 3110781 - RNA, 14 nt, Human
agagaccaucccug

SEQ ID NO: 3110782 - RNA, 13 nt, Human
agagaccaucccu

SEQ ID NO: 3110783 - RNA, 17 nt, Human
agacuucaucccucugg

SEQ ID NO: 3110784 - RNA, 14 nt, Human
agacuucaucccuc

SEQ ID NO: 3110785 - RNA, 19 nt, Human
agacucuacagaggccaug

SEQ ID NO: 3110786 - RNA, 17 nt, Human
agacucuacagaggcca

SEQ ID NO: 3110787 - RNA, 21 nt, Human
agacucgcgacaaugcaaacc

SEQ ID NO: 3110788 - RNA, 20 nt, Human
agacuccugcaggcagccag

SEQ ID NO: 3110789 - RNA, 19 nt, Human
agacuccugcaggcagcca

SEQ ID NO: 3110790 - RNA, 18 nt, Human
agacuccugcaggcagcc

SEQ ID NO: 3110791 - RNA, 17 nt, Human
agacuccugcaggcagc

SEQ ID NO: 3110792 - RNA, 16 nt, Human
agacuccugcaggcag

SEQ ID NO: 3110793 - RNA, 15 nt, Human
agacuccugcaggca

SEQ ID NO: 3110794 - RNA, 14 nt, Human
agacuccugcaggc

SEQ ID NO: 3110795 - RNA, 12 nt, Human
ucuuuccugagg

SEQ ID NO: 3110796 - RNA, 15 nt, Human
ucuuuccugaggcug

SEQ ID NO: 3110797 - RNA, 14 nt, Human
ucuuuccugaggcu

SEQ ID NO: 3110798 - RNA, 13 nt, Human
ucuuuccugaggc

SEQ ID NO: 3110799 - RNA, 15 nt, Human
ucuuuacuucaugga

SEQ ID NO: 3110800 - RNA, 22 nt, Human
ucuucccuacaguugaaaaaca

SEQ ID NO: 3110801 - RNA, 21 nt, Human
ucuuccaggcugggagagccu

SEQ ID NO: 3110802 - RNA, 22 nt, Human
ucuuccaggcugggagagccuu

SEQ ID NO: 3110803 - RNA, 14 nt, Human
ucuuauugcccacg

SEQ ID NO: 3110804 - RNA, 18 nt, Human
ucuuauugcccacgcugg

SEQ ID NO: 3110805 - RNA, 22 nt, Human
ucuuauugcccacgcuggagug

SEQ ID NO: 3110806 - RNA, 14 nt, Human
ucuuaugggcuggg

SEQ ID NO: 3110807 - RNA, 13 nt, Human
ucuuaugggcugg

SEQ ID NO: 3110808 - RNA, 16 nt, Human
ucuuaugggcuggguu

SEQ ID NO: 3110809 - RNA, 15 nt, Human
ucuuaugggcugggu

SEQ ID NO: 3110810 - RNA, 23 nt, Human
agacaggcaagcaccuccugccu

SEQ ID NO: 3110811 - RNA, 22 nt, Human
agacaggcaagcaccuccugcc

SEQ ID NO: 3110812 - RNA, 15 nt, Human
agacaggaccaggga

SEQ ID NO: 3110813 - RNA, 21 nt, Human
agacaggguuuugccauguug

SEQ ID NO: 3110814 - RNA, 15 nt, Human
agacagucccugcca

SEQ ID NO: 3110815 - RNA, 17 nt, Human
agacagucccugccaau

SEQ ID NO: 3110816 - RNA, 16 nt, Human
agacagucccugccaa

SEQ ID NO: 3110817 - RNA, 14 nt, Human
agacagucccugcc

SEQ ID NO: 3110818 - RNA, 11 nt, Human
ucuggggcugu

SEQ ID NO: 3110819 - RNA, 14 nt, Human
ucuggguucacugc

SEQ ID NO: 3110820 - RNA, 16 nt, Human
ucuggguucacugcaa

SEQ ID NO: 3110821 - RNA, 18 nt, Human
ucugguccauagagagca

SEQ ID NO: 3110822 - RNA, 20 nt, Human
ucugucauuugagcagggcu

SEQ ID NO: 3110823 - RNA, 23 nt, Human
ucugucauuugagcagggcucag

SEQ ID NO: 3110824 - RNA, 15 nt, Human
ucugucauuugagca

SEQ ID NO: 3110825 - RNA, 21 nt, Human
ucugugaaaggaaagagggag

SEQ ID NO: 3110826 - RNA, 15 nt, Human
ucugugaaaggaaag

SEQ ID NO: 3110827 - RNA, 18 nt, Human
ucuguuggccagugugac

SEQ ID NO: 3110828 - RNA, 19 nt, Human
ucuguuggccagugugaca

SEQ ID NO: 3110829 - RNA, 20 nt, Human
ucuguuggccagugugacaa

SEQ ID NO: 3110830 - RNA, 18 nt, Human
agaauuucccaaagcagu

SEQ ID NO: 3110831 - RNA, 17 nt, Human
agaauuucccaaagcag

SEQ ID NO: 3110832 - RNA, 23 nt, Human
agaauuucccaaagcagugcaug

SEQ ID NO: 3110833 - RNA, 22 nt, Human
agauauuuugcuuugugauuuu

SEQ ID NO: 3110834 - RNA, 19 nt, Human
agauacaggaaaagcugcu

SEQ ID NO: 3110835 - RNA, 14 nt, Human
agaucaaccccuuc

SEQ ID NO: 3110836 - RNA, 19 nt, Human
agaucaaccccuucgcucc

SEQ ID NO: 3110837 - RNA, 21 nt, Human
agaucaaccccuucgcuccug

SEQ ID NO: 3110838 - RNA, 17 nt, Human
agauaaggguaucuggu

SEQ ID NO: 3110839 - RNA, 19 nt, Human
agauaaggguaucugguga

SEQ ID NO: 3110840 - RNA, 19 nt, Human
agagugagacucugucuca

SEQ ID NO: 3110841 - RNA, 14 nt, Human
ugaaugucagugug

SEQ ID NO: 3110842 - RNA, 18 nt, Human
ugaaugucagugugacug

SEQ ID NO: 3110843 - RNA, 15 nt, Human
ugaaugucaguguga

SEQ ID NO: 3110844 - RNA, 20 nt, Human
agagucucacuguugcccag

SEQ ID NO: 3110845 - RNA, 15 nt, Human
agagugagacucugu

SEQ ID NO: 3110846 - RNA, 16 nt, Human
agagugagacucuguc

SEQ ID NO: 3110847 - RNA, 19 nt, Human
agagcugggugucaagagg

SEQ ID NO: 3110848 - RNA, 19 nt, Human
agaggaaagcaaaggagau

SEQ ID NO: 3110849 - RNA, 18 nt, Human
agaggaaagcaaaggaga

SEQ ID NO: 3110850 - RNA, 16 nt, Human
agaggaaagcaaagga

SEQ ID NO: 3110851 - RNA, 12 nt, Human
agaggaaagcaa

SEQ ID NO: 3110852 - RNA, 12 nt, Human
agaggaaaucac

SEQ ID NO: 3110853 - RNA, 11 nt, Human
agaggaaauca

SEQ ID NO: 3110854 - RNA, 18 nt, Human
agaggcaacugcauuggc

SEQ ID NO: 3110855 - RNA, 16 nt, Human
ugaacuuugaccucug

SEQ ID NO: 3110856 - RNA, 13 nt, Human
ugaagacaaugac

SEQ ID NO: 3110857 - RNA, 17 nt, Human
ugaagacaaugacuuac

SEQ ID NO: 3110858 - RNA, 11 nt, Human
ugaagacaaug

SEQ ID NO: 3110859 - RNA, 11 nt, Human
ugaacuuugac

SEQ ID NO: 3110860 - RNA, 21 nt, Human
ucuuuggucuacacugugcug

SEQ ID NO: 3110861 - RNA, 14 nt, Human
ucuuuggucuacac

SEQ ID NO: 3110862 - RNA, 20 nt, Human
agagggagggagggcuccag

SEQ ID NO: 3110863 - RNA, 21 nt, Human
agagggagggagggcuccaga

SEQ ID NO: 3110864 - RNA, 22 nt, Human
agagggagggagggcuccagac

SEQ ID NO: 3110865 - RNA, 16 nt, Human
agaugcuucucacugc

SEQ ID NO: 3110866 - RNA, 18 nt, Human
agaugcuucucacugcca

SEQ ID NO: 3110867 - RNA, 12 nt, Human
ugaccugaggcc

SEQ ID NO: 3110868 - RNA, 14 nt, Human
ugaccucugccuga

SEQ ID NO: 3110869 - RNA, 13 nt, Human
ugaccucugccug

SEQ ID NO: 3110870 - RNA, 15 nt, Human
ugaccugaggcccuu

SEQ ID NO: 3110871 - RNA, 14 nt, Human
ugaccugaggcccu

SEQ ID NO: 3110872 - RNA, 19 nt, Human
ugacuccagaauuucccaa

SEQ ID NO: 3110873 - RNA, 17 nt, Human
ugacuccagaauuuccc

SEQ ID NO: 3110874 - RNA, 23 nt, Human
ugacuccagaauuucccaaagca

SEQ ID NO: 3110875 - RNA, 20 nt, Human
ugacuccagaauuucccaaa

SEQ ID NO: 3110876 - RNA, 14 nt, Human
agauuucacucucc

SEQ ID NO: 3110877 - RNA, 13 nt, Human
agauuucacucuc

SEQ ID NO: 3110878 - RNA, 17 nt, Human
agauuugaacucuucaa

SEQ ID NO: 3110879 - RNA, 24 nt, Human
ugagcaucaggccaggcccucugc

SEQ ID NO: 3110880 - RNA, 22 nt, Human
ugagcaucaggccaggcccucu

SEQ ID NO: 3110881 - RNA, 21 nt, Human
ugagcaucaggccaggcccuc

SEQ ID NO: 3110882 - RNA, 21 nt, Human
ugagccacugcaccgggccac

SEQ ID NO: 3110883 - RNA, 18 nt, Human
ugagccacugcaccgggc

SEQ ID NO: 3110884 - RNA, 23 nt, Human
ugagccacugcaccgggccacag

SEQ ID NO: 3110885 - RNA, 13 nt, Human
ugagccagauuuc

SEQ ID NO: 3110886 - RNA, 16 nt, Human
ugagccagauuucacu

SEQ ID NO: 3110887 - RNA, 14 nt, Human
ugagccagauuuca

SEQ ID NO: 3110888 - RNA, 20 nt, Human
ugagcacuaaggugugcucu

SEQ ID NO: 3110889 - RNA, 21 nt, Human
ugagcacuaaggugugcucug

SEQ ID NO: 3110890 - RNA, 22 nt, Human
ugagcacuaaggugugcucuga

SEQ ID NO: 3110891 - RNA, 23 nt, Human
ugagcacuaaggugugcucugau

SEQ ID NO: 3110892 - RNA, 15 nt, Human
ugagcaauccugcaa

SEQ ID NO: 3110893 - RNA, 16 nt, Human
agcacagcuucauuuc

SEQ ID NO: 3110894 - RNA, 22 nt, Human
agcaccaaaagcuuaccaaggg

SEQ ID NO: 3110895 - RNA, 14 nt, Human
agcacaugccucuc

SEQ ID NO: 3110896 - RNA, 13 nt, Human
agcacaugccucu

SEQ ID NO: 3110897 - RNA, 22 nt, Human
agcaagugagagcuggguguca

SEQ ID NO: 3110898 - RNA, 18 nt, Human
agcaagugagagcugggu

SEQ ID NO: 3110899 - RNA, 14 nt, Human
agcaagugagagcu

SEQ ID NO: 3110900 - RNA, 20 nt, Human
agcaagugagacccugucuc

SEQ ID NO: 3110901 - RNA, 13 nt, Human
agcaagugagagc

SEQ ID NO: 3110902 - RNA, 21 nt, Human
ugagccagauuucacucuccu

SEQ ID NO: 3110903 - RNA, 22 nt, Human
ugagccagauuucacucuccuu

SEQ ID NO: 3110904 - RNA, 17 nt, Human
ugagccagauuucacuc

SEQ ID NO: 3110905 - RNA, 10 nt, Human
ugagccuggc

SEQ ID NO: 3110906 - RNA, 16 nt, Human
agcagagaccaucccu

SEQ ID NO: 3110907 - RNA, 15 nt, Human
agcagagaccauccc

SEQ ID NO: 3110908 - RNA, 22 nt, Human
agcagagaaugaaagggcccag

SEQ ID NO: 3110909 - RNA, 23 nt, Human
agcagagaaugaaagggcccaga

SEQ ID NO: 3110910 - RNA, 14 nt, Human
agcagagaauucuc

SEQ ID NO: 3110911 - RNA, 21 nt, Human
agcagagaauucucuuaucca

SEQ ID NO: 3110912 - RNA, 21 nt, Human
agcagagaaugaaagggccca

SEQ ID NO: 3110913 - RNA, 14 nt, Human
ugagccugggaggu

SEQ ID NO: 3110914 - RNA, 16 nt, Human
ugagccuggcaagaau

SEQ ID NO: 3110915 - RNA, 11 nt, Human
ugagccuggca

SEQ ID NO: 3110916 - RNA, 14 nt, Human
ugagccuugaacuu

SEQ ID NO: 3110917 - RNA, 22 nt, Human
ugagccugggaggucaaggcug

SEQ ID NO: 3110918 - RNA, 19 nt, Human
ugagccugggaggucaagg

SEQ ID NO: 3110919 - RNA, 15 nt, Human
ugagccuugaacuuu

SEQ ID NO: 3110920 - RNA, 17 nt, Human
ugagccuugaacuuuga

SEQ ID NO: 3110921 - RNA, 18 nt, Human
ugagccuugaacuuugac

SEQ ID NO: 3110922 - RNA, 19 nt, Human
ugagccuugaacuuugacc

SEQ ID NO: 3110923 - RNA, 22 nt, Human
agcaccuuagacagucccugcc

SEQ ID NO: 3110924 - RNA, 21 nt, Human
agcaccuuagacagucccugc

SEQ ID NO: 3110925 - RNA, 20 nt, Human
agcaccuuagacagucccug

SEQ ID NO: 3110926 - RNA, 19 nt, Human
agcaccuuagacagucccu

SEQ ID NO: 3110927 - RNA, 13 nt, Human
agcacgauuucug

SEQ ID NO: 3110928 - RNA, 23 nt, Human
agcaccuuagacagucccugcca

SEQ ID NO: 3110929 - RNA, 16 nt, Human
agcacgauuucuguuu

SEQ ID NO: 3110930 - RNA, 14 nt, Human
agcacgauuucugu

SEQ ID NO: 3110931 - RNA, 15 nt, Human
agcacgauuucuguu

SEQ ID NO: 3110932 - RNA, 22 nt, Human
agcacuuugggaggccaaggug

SEQ ID NO: 3110933 - RNA, 23 nt, Human
agcacuuugggaggccaaggugg

SEQ ID NO: 3110934 - RNA, 12 nt, Human
agcagaaaugcc

SEQ ID NO: 3110935 - RNA, 13 nt, Human
agcagaaaugccu

SEQ ID NO: 3110936 - RNA, 19 nt, Human
agcagaaaugccuuacccu

SEQ ID NO: 3110937 - RNA, 19 nt, Human
ugagggauacccaucccau

SEQ ID NO: 3110938 - RNA, 16 nt, Human
ugaggcccuucucucc

SEQ ID NO: 3110939 - RNA, 19 nt, Human
ugaggcccuucucuccagc

SEQ ID NO: 3110940 - RNA, 18 nt, Human
ugaggcccuucucuccag

SEQ ID NO: 3110941 - RNA, 24 nt, Human
ugaggcccuucucuccagccccug

SEQ ID NO: 3110942 - RNA, 23 nt, Human
ugaggcccuucucuccagccccu

SEQ ID NO: 3110943 - RNA, 22 nt, Human
ugaggcccuucucuccagcccc

SEQ ID NO: 3110944 - RNA, 20 nt, Human
ugaggcccuucucuccagcc

SEQ ID NO: 3110945 - RNA, 12 nt, Human
ugaggggccucu

SEQ ID NO: 3110946 - RNA, 13 nt, Human
ugaggggccucuu

SEQ ID NO: 3110947 - RNA, 17 nt, Human
agcagaggaaggagagg

SEQ ID NO: 3110948 - RNA, 19 nt, Human
agcagauggagaccccuug

SEQ ID NO: 3110949 - RNA, 20 nt, Human
agcagagaccaucccugaag

SEQ ID NO: 3110950 - RNA, 20 nt, Human
agcagagcaccuuagacagu

SEQ ID NO: 3110951 - RNA, 17 nt, Human
ugaggucagagccugca

SEQ ID NO: 3110952 - RNA, 17 nt, Human
agcagagaccaucccug

SEQ ID NO: 3110953 - RNA, 19 nt, Human
agcagagaccaucccugaa

SEQ ID NO: 3110954 - RNA, 18 nt, Human
agcagagaccaucccuga

SEQ ID NO: 3110955 - RNA, 14 nt, Human
ugaggucagagccu

SEQ ID NO: 3110956 - RNA, 16 nt, Human
ugaggucagagccugc

SEQ ID NO: 3110957 - RNA, 13 nt, Human
ugaggucagagcc

SEQ ID NO: 3110958 - RNA, 20 nt, Human
ugaggguugggcugguguca

SEQ ID NO: 3110959 - RNA, 13 nt, Human
ugaggcccagagg

SEQ ID NO: 3110960 - RNA, 12 nt, Human
ugaggcccagag

SEQ ID NO: 3110961 - RNA, 16 nt, Human
ugaggccagagacaca

SEQ ID NO: 3110962 - RNA, 14 nt, Human
ugaggccagagaca

SEQ ID NO: 3110963 - RNA, 20 nt, Human
ugaggccagagacacaagcc

SEQ ID NO: 3110964 - RNA, 20 nt, Human
ugaggcccagagggccugca

SEQ ID NO: 3110965 - RNA, 18 nt, Human
ugaggcccagagggccug

SEQ ID NO: 3110966 - RNA, 17 nt, Human
ugaggcccagagggccu

SEQ ID NO: 3110967 - RNA, 15 nt, Human
ugaggcccagagggc

SEQ ID NO: 3110968 - RNA, 22 nt, Human
ugaggcccagagggccugcaag

SEQ ID NO: 3110969 - RNA, 21 nt, Human
ugaggcccagagggccugcaa

SEQ ID NO: 3110970 - RNA, 23 nt, Human
ugaggcccagagggccugcaagg

SEQ ID NO: 3110971 - RNA, 21 nt, Human
ugaggaauccagacccggcug

SEQ ID NO: 3110972 - RNA, 22 nt, Human
ugaggaauccagacccggcugc

SEQ ID NO: 3110973 - RNA, 12 nt, Human
ugaggccagaga

SEQ ID NO: 3110974 - RNA, 23 nt, Human
ugaggcauuuguuugaacugaua

SEQ ID NO: 3110975 - RNA, 21 nt, Human
ugaggacacuaaccacgcugg

SEQ ID NO: 3110976 - RNA, 15 nt, Human
ugaggaagcaaaagc

SEQ ID NO: 3110977 - RNA, 18 nt, Human
ugaggaagccgcuggggc

SEQ ID NO: 3110978 - RNA, 17 nt, Human
ugaggaagccgcugggg

SEQ ID NO: 3110979 - RNA, 14 nt, Human
ugaggaagccgcug

SEQ ID NO: 3110980 - RNA, 22 nt, Human
ugaggaagcaaaagcaucuaug

SEQ ID NO: 3110981 - RNA, 21 nt, Human
ugaggaagccgcuggggccag

SEQ ID NO: 3110982 - RNA, 19 nt, Human
ugaggaagccgcuggggcc

SEQ ID NO: 3110983 - RNA, 11 nt, Human
uccaagcuggu

SEQ ID NO: 3110984 - RNA, 16 nt, Human
uccaagcucccaggca

SEQ ID NO: 3110985 - RNA, 15 nt, Human
uccaagcucccaggc

SEQ ID NO: 3110986 - RNA, 14 nt, Human
uccaagcucccagg

SEQ ID NO: 3110987 - RNA, 13 nt, Human
uccaagcucccag

SEQ ID NO: 3110988 - RNA, 12 nt, Human
uccaagcuccca

SEQ ID NO: 3110989 - RNA, 19 nt, Human
ucauuugagcagggcucag

SEQ ID NO: 3110990 - RNA, 14 nt, Human
accuggaauauaua

SEQ ID NO: 3110991 - RNA, 23 nt, Human
accugcggugcuaucucccccag

SEQ ID NO: 3110992 - RNA, 22 nt, Human
accugcggugcuaucuccccca

SEQ ID NO: 3110993 - RNA, 19 nt, Human
accugcggugcuaucuccc

SEQ ID NO: 3110994 - RNA, 22 nt, Human
accugaagucuuuguacagaca

SEQ ID NO: 3110995 - RNA, 15 nt, Human
accugaagucuuugu

SEQ ID NO: 3110996 - RNA, 18 nt, Human
accugcggugcuaucucc

SEQ ID NO: 3110997 - RNA, 21 nt, Human
ucauuugagcagggcucagcg

SEQ ID NO: 3110998 - RNA, 13 nt, Human
ucauuuuuuuuaa

SEQ ID NO: 3110999 - RNA, 14 nt, Human
uccagccccuggau

SEQ ID NO: 3111000 - RNA, 15 nt, Human
uccagccccuggaug

SEQ ID NO: 3111001 - RNA, 21 nt, Human
uccagccccuggaugcagccu

SEQ ID NO: 3111002 - RNA, 19 nt, Human
uccagccccuggaugcagc

SEQ ID NO: 3111003 - RNA, 17 nt, Human
uccagccccuggaugca

SEQ ID NO: 3111004 - RNA, 16 nt, Human
uccagccccuggaugc

SEQ ID NO: 3111005 - RNA, 11 nt, Human
uccagccuggg

SEQ ID NO: 3111006 - RNA, 22 nt, Human
uccagccccuggaugcagccuc

SEQ ID NO: 3111007 - RNA, 22 nt, Human
uccagaaguuugagaucagccu

SEQ ID NO: 3111008 - RNA, 23 nt, Human
accuuuguauucucuccuguacc

SEQ ID NO: 3111009 - RNA, 15 nt, Human
accuuuguauucucu

SEQ ID NO: 3111010 - RNA, 19 nt, Human
accuuuguauucucuccug

SEQ ID NO: 3111011 - RNA, 17 nt, Human
accuuagacagucccug

SEQ ID NO: 3111012 - RNA, 15 nt, Human
uccaccaucaagcca

SEQ ID NO: 3111013 - RNA, 15 nt, Human
accuugacagggcac

SEQ ID NO: 3111014 - RNA, 14 nt, Human
accuugacagggca

SEQ ID NO: 3111015 - RNA, 15 nt, Human
accuugaaugaugcc

SEQ ID NO: 3111016 - RNA, 13 nt, Human
accuucuccuuca

SEQ ID NO: 3111017 - RNA, 12 nt, Human
accuucuccuuc

SEQ ID NO: 3111018 - RNA, 13 nt, Human
accuagccuuaga

SEQ ID NO: 3111019 - RNA, 18 nt, Human
ucauccacugugccaugu

SEQ ID NO: 3111020 - RNA, 20 nt, Human
accuccgccucuuggguuca

SEQ ID NO: 3111021 - RNA, 17 nt, Human
accgcagacaggaccag

SEQ ID NO: 3111022 - RNA, 17 nt, Human
accgccaaggcuggggg

SEQ ID NO: 3111023 - RNA, 20 nt, Human
accgcagacaggaccaggga

SEQ ID NO: 3111024 - RNA, 20 nt, Human
ucauauuuacuucuuauaca

SEQ ID NO: 3111025 - RNA, 21 nt, Human
ucauauuuacuucuuauacau

SEQ ID NO: 3111026 - RNA, 22 nt, Human
ucauauuuacuucuuauacauu

SEQ ID NO: 3111027 - RNA, 16 nt, Human
ucauauuuacuucuua

SEQ ID NO: 3111028 - RNA, 10 nt, Human
acccuuuucu

SEQ ID NO: 3111029 - RNA, 19 nt, Human
ucaugacaaagacugagua

SEQ ID NO: 3111030 - RNA, 19 nt, Human
ucauccacugugccaugug

SEQ ID NO: 3111031 - RNA, 21 nt, Human
ucauccacugugccaugugcc

SEQ ID NO: 3111032 - RNA, 23 nt, Human
ucauccacugugccaugugccag

SEQ ID NO: 3111033 - RNA, 11 nt, Human
ucauguucuua

SEQ ID NO: 3111034 - RNA, 17 nt, Human
ucauguucuuaauucuu

SEQ ID NO: 3111035 - RNA, 13 nt, Human
ucaugucuggcua

SEQ ID NO: 3111036 - RNA, 19 nt, Human
ucauugaccugaggcccuu

SEQ ID NO: 3111037 - RNA, 21 nt, Human
ucauucuccuuguguuacuaa

SEQ ID NO: 3111038 - RNA, 22 nt, Human
ucauugaccugaggcccuucuc

SEQ ID NO: 3111039 - RNA, 17 nt, Human
accucggugccuuccuc

SEQ ID NO: 3111040 - RNA, 15 nt, Human
accucucccuuggau

SEQ ID NO: 3111041 - RNA, 14 nt, Human
accucucccuugga

SEQ ID NO: 3111042 - RNA, 13 nt, Human
accucucccuugg

SEQ ID NO: 3111043 - RNA, 19 nt, Human
accucucucacuccuugaa

SEQ ID NO: 3111044 - RNA, 14 nt, Human
accucucucacucc

SEQ ID NO: 3111045 - RNA, 23 nt, Human
accucucccuuggauuguccccg

SEQ ID NO: 3111046 - RNA, 12 nt, Human
accucugcacaa

SEQ ID NO: 3111047 - RNA, 15 nt, Human
acccagcucuggucc

SEQ ID NO: 3111048 - RNA, 13 nt, Human
acccagcucuggu

SEQ ID NO: 3111049 - RNA, 13 nt, Human
ucagaucuucugu

SEQ ID NO: 3111050 - RNA, 13 nt, Human
ucagaagacacug

SEQ ID NO: 3111051 - RNA, 12 nt, Human
ucagccugggca

SEQ ID NO: 3111052 - RNA, 10 nt, Human
ucagccuggg

SEQ ID NO: 3111053 - RNA, 15 nt, Human
acccccagccugcua

SEQ ID NO: 3111054 - RNA, 14 nt, Human
acccccagccugcu

SEQ ID NO: 3111055 - RNA, 20 nt, Human
ucaggaagcucagggccugg

SEQ ID NO: 3111056 - RNA, 19 nt, Human
ucaggaagcucagggccug

SEQ ID NO: 3111057 - RNA, 17 nt, Human
ucaggaagcucagggcc

SEQ ID NO: 3111058 - RNA, 16 nt, Human
ucaggaagcucagggc

SEQ ID NO: 3111059 - RNA, 23 nt, Human
ucaggccaaacucaccugccccu

SEQ ID NO: 3111060 - RNA, 20 nt, Human
ucaggccaaacucaccugcc

SEQ ID NO: 3111061 - RNA, 15 nt, Human
ucagcggggacagcu

SEQ ID NO: 3111062 - RNA, 16 nt, Human
ucagcggggacagcuc

SEQ ID NO: 3111063 - RNA, 17 nt, Human
ucagcggggacagcucc

SEQ ID NO: 3111064 - RNA, 13 nt, Human
ucagggucccugg

SEQ ID NO: 3111065 - RNA, 23 nt, Human
ucaggggugugcggccuuuggcu

SEQ ID NO: 3111066 - RNA, 18 nt, Human
ucagggucccugguggca

SEQ ID NO: 3111067 - RNA, 14 nt, Human
ucagggucccuggu

SEQ ID NO: 3111068 - RNA, 13 nt, Human
ucagguaacaggc

SEQ ID NO: 3111069 - RNA, 15 nt, Human
ucagguaacaggcag

SEQ ID NO: 3111070 - RNA, 16 nt, Human
ucagguaacaggcaga

SEQ ID NO: 3111071 - RNA, 19 nt, Human
accccuucgcuccuguguc

SEQ ID NO: 3111072 - RNA, 14 nt, Human
ucaggccagcugcu

SEQ ID NO: 3111073 - RNA, 11 nt, Human
ucaggccaggc

SEQ ID NO: 3111074 - RNA, 20 nt, Human
ucaggccagcugcuugggcu

SEQ ID NO: 3111075 - RNA, 15 nt, Human
ucaggccagcugcuu

SEQ ID NO: 3111076 - RNA, 14 nt, Human
acccucuuagaaaa

SEQ ID NO: 3111077 - RNA, 13 nt, Human
acccugcccugug

SEQ ID NO: 3111078 - RNA, 12 nt, Human
acccugcccugu

SEQ ID NO: 3111079 - RNA, 11 nt, Human
acccugcccug

SEQ ID NO: 3111080 - RNA, 15 nt, Human
acccuugugguccca

SEQ ID NO: 3111081 - RNA, 19 nt, Human
acccuuguggucccacccc

SEQ ID NO: 3111082 - RNA, 17 nt, Human
acccuuguggucccacc

SEQ ID NO: 3111083 - RNA, 16 nt, Human
acccuuguggucccac

SEQ ID NO: 3111084 - RNA, 23 nt, Human
ucaggguuggccccugcccggcu

SEQ ID NO: 3111085 - RNA, 20 nt, Human
accccuucgcuccugugucu

SEQ ID NO: 3111086 - RNA, 20 nt, Human
accacucuaucaaguauuau

SEQ ID NO: 3111087 - RNA, 20 nt, Human
accacaucuugcucugcuga

SEQ ID NO: 3111088 - RNA, 21 nt, Human
accacaucuugcucugcugac

SEQ ID NO: 3111089 - RNA, 24 nt, Human
accacaucuugcucugcugacaga

SEQ ID NO: 3111090 - RNA, 15 nt, Human
accacuucagcugac

SEQ ID NO: 3111091 - RNA, 14 nt, Human
accacuucagcuga

SEQ ID NO: 3111092 - RNA, 13 nt, Human
accacuucagcug

SEQ ID NO: 3111093 - RNA, 21 nt, Human
accacagacauacuaaccagc

SEQ ID NO: 3111094 - RNA, 22 nt, Human
accacagacauacuaaccagca

SEQ ID NO: 3111095 - RNA, 14 nt, Human
accacaucuugcuc

SEQ ID NO: 3111096 - RNA, 23 nt, Human
ucaccugaagacucauucuucug

SEQ ID NO: 3111097 - RNA, 16 nt, Human
ucaccugaagacucau

SEQ ID NO: 3111098 - RNA, 19 nt, Human
ucaccugaagacucauucu

SEQ ID NO: 3111099 - RNA, 19 nt, Human
accagagcccaccuuggcu

SEQ ID NO: 3111100 - RNA, 22 nt, Human
accagagcccaccuuggcucaa

SEQ ID NO: 3111101 - RNA, 17 nt, Human
accagagcccaccuugg

SEQ ID NO: 3111102 - RNA, 17 nt, Human
accagacaccuugacag

SEQ ID NO: 3111103 - RNA, 12 nt, Human
accacuuuuguu

SEQ ID NO: 3111104 - RNA, 22 nt, Human
accagacaccuugacagggcac

SEQ ID NO: 3111105 - RNA, 23 nt, Human
accagacaccuugacagggcaca

SEQ ID NO: 3111106 - RNA, 12 nt, Human
ucacugcagccu

SEQ ID NO: 3111107 - RNA, 16 nt, Human
ucacuguugcccaggc

SEQ ID NO: 3111108 - RNA, 13 nt, Human
ucacugagacagc

SEQ ID NO: 3111109 - RNA, 15 nt, Human
ucacugagacagccc

SEQ ID NO: 3111110 - RNA, 14 nt, Human
ucacugagacagcc

SEQ ID NO: 3111111 - RNA, 16 nt, Human
ucaccugccccucaac

SEQ ID NO: 3111112 - RNA, 17 nt, Human
ucacuguugcccaggcu

SEQ ID NO: 3111113 - RNA, 18 nt, Human
ucacuguugcccaggcug

SEQ ID NO: 3111114 - RNA, 21 nt, Human
accaguguuguggauuuaaca

SEQ ID NO: 3111115 - RNA, 18 nt, Human
accaguguuguggauuua

SEQ ID NO: 3111116 - RNA, 23 nt, Human
accaugauuaaccacuucagcug

SEQ ID NO: 3111117 - RNA, 22 nt, Human
accaugauuaaccacuucagcu

SEQ ID NO: 3111118 - RNA, 16 nt, Human
accauucuccaccugc

SEQ ID NO: 3111119 - RNA, 13 nt, Human
accauucuccacc

SEQ ID NO: 3111120 - RNA, 22 nt, Human
accauuuugggguacccacugc

SEQ ID NO: 3111121 - RNA, 23 nt, Human
accauuuugggguacccacugcu

SEQ ID NO: 3111122 - RNA, 16 nt, Human
acccagcccacuucug

SEQ ID NO: 3111123 - RNA, 17 nt, Human
acccagcccacuucugc

SEQ ID NO: 3111124 - RNA, 15 nt, Human
acccagcccacuucu

SEQ ID NO: 3111125 - RNA, 18 nt, Human
acccagcccacuucugcc

SEQ ID NO: 3111126 - RNA, 16 nt, Human
acccagaagaaaauag

SEQ ID NO: 3111127 - RNA, 19 nt, Human
uccuguucccaugagauga

SEQ ID NO: 3111128 - RNA, 18 nt, Human
uccugugugugcgccuac

SEQ ID NO: 3111129 - RNA, 13 nt, Human
uccugugugugcg

SEQ ID NO: 3111130 - RNA, 14 nt, Human
uccugugugugcgc

SEQ ID NO: 3111131 - RNA, 23 nt, Human
uccugugucuugcaauggcagcc

SEQ ID NO: 3111132 - RNA, 24 nt, Human
uccugugucuugcaauggcagccu

SEQ ID NO: 3111133 - RNA, 19 nt, Human
acugcagccucaaccuccu

SEQ ID NO: 3111134 - RNA, 21 nt, Human
acugcagccucaaccuccugg

SEQ ID NO: 3111135 - RNA, 22 nt, Human
acugcagccucaaccuccuggg

SEQ ID NO: 3111136 - RNA, 13 nt, Human
acugcacuguuuu

SEQ ID NO: 3111137 - RNA, 23 nt, Human
acugcagccucaaccuccugggc

SEQ ID NO: 3111138 - RNA, 13 nt, Human
uccugcugcaguu

SEQ ID NO: 3111139 - RNA, 17 nt, Human
uccugccucagccuccc

SEQ ID NO: 3111140 - RNA, 20 nt, Human
uccugccucgaacuggcugc

SEQ ID NO: 3111141 - RNA, 22 nt, Human
uccugcaggcagccaggccaca

SEQ ID NO: 3111142 - RNA, 19 nt, Human
uccugccucagccucccaa

SEQ ID NO: 3111143 - RNA, 20 nt, Human
uccugcaggcagccaggcca

SEQ ID NO: 3111144 - RNA, 19 nt, Human
uccugcaggcagccaggcc

SEQ ID NO: 3111145 - RNA, 17 nt, Human
uccugcaggcagccagg

SEQ ID NO: 3111146 - RNA, 16 nt, Human
uccugcaggcagccag

SEQ ID NO: 3111147 - RNA, 15 nt, Human
uccugcaggcagcca

SEQ ID NO: 3111148 - RNA, 22 nt, Human
acugaguacguugugcauuugg

SEQ ID NO: 3111149 - RNA, 23 nt, Human
acugaguacguugugcauuuggu

SEQ ID NO: 3111150 - RNA, 18 nt, Human
acugaguacguugugcau

SEQ ID NO: 3111151 - RNA, 19 nt, Human
acugaguacguugugcauu

SEQ ID NO: 3111152 - RNA, 21 nt, Human
acugaguacguugugcauuug

SEQ ID NO: 3111153 - RNA, 13 nt, Human
acugcaaccuccg

SEQ ID NO: 3111154 - RNA, 14 nt, Human
acugcaaccuccgc

SEQ ID NO: 3111155 - RNA, 16 nt, Human
acugcaaccuccgccu

SEQ ID NO: 3111156 - RNA, 22 nt, Human
acugcaaccuccgccucuuggg

SEQ ID NO: 3111157 - RNA, 15 nt, Human
uccucuccccagcaa

SEQ ID NO: 3111158 - RNA, 12 nt, Human
uccuucagugcc

SEQ ID NO: 3111159 - RNA, 11 nt, Human
uccuucagugc

SEQ ID NO: 3111160 - RNA, 22 nt, Human
uccuucagugccuuauggaaca

SEQ ID NO: 3111161 - RNA, 20 nt, Human
uccuucagugccuuauggaa

SEQ ID NO: 3111162 - RNA, 13 nt, Human
uccuucagugccu

SEQ ID NO: 3111163 - RNA, 22 nt, Human
acuggcugcaaaggguaucagg

SEQ ID NO: 3111164 - RNA, 23 nt, Human
acugcuuccagugaggcucugcc

SEQ ID NO: 3111165 - RNA, 22 nt, Human
acugcuuccagugaggcucugc

SEQ ID NO: 3111166 - RNA, 21 nt, Human
acugcuuccagugaggcucug

SEQ ID NO: 3111167 - RNA, 18 nt, Human
acugcuuccagugaggcu

SEQ ID NO: 3111168 - RNA, 22 nt, Human
acuggauuaaacuuaaucuaaa

SEQ ID NO: 3111169 - RNA, 17 nt, Human
acugcuuccagugaggc

SEQ ID NO: 3111170 - RNA, 15 nt, Human
uccuuucaccacaug

SEQ ID NO: 3111171 - RNA, 23 nt, Human
uccuuuagcgcccaguugggugg

SEQ ID NO: 3111172 - RNA, 15 nt, Human
ucgaacuggcugcaa

SEQ ID NO: 3111173 - RNA, 14 nt, Human
ucgaacuggcugca

SEQ ID NO: 3111174 - RNA, 13 nt, Human
ucgaacuggcugc

SEQ ID NO: 3111175 - RNA, 14 nt, Human
ucgaggacagggag

SEQ ID NO: 3111176 - RNA, 17 nt, Human
ucgaggacagggaggug

SEQ ID NO: 3111177 - RNA, 13 nt, Human
ucgcgacaaugca

SEQ ID NO: 3111178 - RNA, 13 nt, Human
ucgaggacaggga

SEQ ID NO: 3111179 - RNA, 14 nt, Human
ucgagcaugccugg

SEQ ID NO: 3111180 - RNA, 19 nt, Human
acuggguacuuguggacac

SEQ ID NO: 3111181 - RNA, 20 nt, Human
acuggguacuuguggacaca

SEQ ID NO: 3111182 - RNA, 23 nt, Human
acuggguacuuguggacacagcu

SEQ ID NO: 3111183 - RNA, 18 nt, Human
acuggguacuuguggaca

SEQ ID NO: 3111184 - RNA, 22 nt, Human
acugggcuuggggaccagagcu

SEQ ID NO: 3111185 - RNA, 12 nt, Human
ucgcuccugugu

SEQ ID NO: 3111186 - RNA, 13 nt, Human
ucgcuccuguguc

SEQ ID NO: 3111187 - RNA, 23 nt, Human
acuguacaugaaaacacauuuuu

SEQ ID NO: 3111188 - RNA, 13 nt, Human
acuguacaugaaa

SEQ ID NO: 3111189 - RNA, 14 nt, Human
acuguacaugaaaa

SEQ ID NO: 3111190 - RNA, 19 nt, Human
acuguaauuugugauacaa

SEQ ID NO: 3111191 - RNA, 13 nt, Human
acuguacaaagua

SEQ ID NO: 3111192 - RNA, 14 nt, Human
acuguacaaaguag

SEQ ID NO: 3111193 - RNA, 15 nt, Human
acuguacaaaguaga

SEQ ID NO: 3111194 - RNA, 18 nt, Human
uccucauacccaccccca

SEQ ID NO: 3111195 - RNA, 14 nt, Human
uccucauacccacc

SEQ ID NO: 3111196 - RNA, 12 nt, Human
uccucuccccag

SEQ ID NO: 3111197 - RNA, 19 nt, Human
uccucccucccucuuuccc

SEQ ID NO: 3111198 - RNA, 17 nt, Human
uccucccucccucuuuc

SEQ ID NO: 3111199 - RNA, 15 nt, Human
uccucccucccucuu

SEQ ID NO: 3111200 - RNA, 16 nt, Human
acucuuauugcccacg

SEQ ID NO: 3111201 - RNA, 19 nt, Human
acucuuauugcccacgcug

SEQ ID NO: 3111202 - RNA, 20 nt, Human
uccucagaucuucugugggu

SEQ ID NO: 3111203 - RNA, 17 nt, Human
acucgcgacaaugcaaa

SEQ ID NO: 3111204 - RNA, 23 nt, Human
acucgcgacaaugcaaaccauca

SEQ ID NO: 3111205 - RNA, 20 nt, Human
acucgcgacaaugcaaacca

SEQ ID NO: 3111206 - RNA, 19 nt, Human
uccuaggcauuugcugaau

SEQ ID NO: 3111207 - RNA, 18 nt, Human
acucgcgacaaugcaaac

SEQ ID NO: 3111208 - RNA, 17 nt, Human
acucuccucugcugcug

SEQ ID NO: 3111209 - RNA, 16 nt, Human
acucuccucugcugcu

SEQ ID NO: 3111210 - RNA, 19 nt, Human
acucuccucugcugcuggc

SEQ ID NO: 3111211 - RNA, 18 nt, Human
acucuccucugcugcugg

SEQ ID NO: 3111212 - RNA, 14 nt, Human
uccuaggcauuugc

SEQ ID NO: 3111213 - RNA, 21 nt, Human
ucccuuugacgccaucccagc

SEQ ID NO: 3111214 - RNA, 23 nt, Human
ucccuuugacgccaucccagccc

SEQ ID NO: 3111215 - RNA, 22 nt, Human
ucccuuugacgccaucccagcc

SEQ ID NO: 3111216 - RNA, 23 nt, Human
ucccugguggcagcucaccucuc

SEQ ID NO: 3111217 - RNA, 22 nt, Human
ucccuuacgugaguccuggcau

SEQ ID NO: 3111218 - RNA, 18 nt, Human
ucccuuacgugaguccug

SEQ ID NO: 3111219 - RNA, 22 nt, Human
ucccuuuccaaaugcccagcuu

SEQ ID NO: 3111220 - RNA, 22 nt, Human
acucauugaccugaggcccuuc

SEQ ID NO: 3111221 - RNA, 20 nt, Human
ucccucagucuggcccuucc

SEQ ID NO: 3111222 - RNA, 21 nt, Human
ucccucagucuggcccuuccu

SEQ ID NO: 3111223 - RNA, 22 nt, Human
ucccucauccucauacccaccc

SEQ ID NO: 3111224 - RNA, 16 nt, Human
ucccuauuagagaaga

SEQ ID NO: 3111225 - RNA, 18 nt, Human
ucccuauuagagaagaga

SEQ ID NO: 3111226 - RNA, 20 nt, Human
ucccgaguagcugggacuac

SEQ ID NO: 3111227 - RNA, 15 nt, Human
ucccgaauagcuggg

SEQ ID NO: 3111228 - RNA, 16 nt, Human
ucccgaauagcuggga

SEQ ID NO: 3111229 - RNA, 17 nt, Human
acuauagccuaggugac

SEQ ID NO: 3111230 - RNA, 21 nt, Human
acuauaauguaagcucuacug

SEQ ID NO: 3111231 - RNA, 23 nt, Human
acuauaauuuaccugaagucuuu

SEQ ID NO: 3111232 - RNA, 24 nt, Human
uccccaccgcagacaggaccaggg

SEQ ID NO: 3111233 - RNA, 23 nt, Human
uccccaggaggccagccuugacc

SEQ ID NO: 3111234 - RNA, 23 nt, Human
acuauguugcccaggcaggucuu

SEQ ID NO: 3111235 - RNA, 19 nt, Human
acuauguugcccaggcagg

SEQ ID NO: 3111236 - RNA, 20 nt, Human
acuauguugcccaggcaggu

SEQ ID NO: 3111237 - RNA, 17 nt, Human
acuauguugcccaggca

SEQ ID NO: 3111238 - RNA, 18 nt, Human
acuauguugcccaggcag

SEQ ID NO: 3111239 - RNA, 15 nt, Human
acuacaguccuccca

SEQ ID NO: 3111240 - RNA, 23 nt, Human
acuacaggugugagucaccaagc

SEQ ID NO: 3111241 - RNA, 17 nt, Human
acuaaccagcagaaaug

SEQ ID NO: 3111242 - RNA, 13 nt, Human
acuaaccacgcug

SEQ ID NO: 3111243 - RNA, 16 nt, Human
acuaaccagcagaaau

SEQ ID NO: 3111244 - RNA, 12 nt, Human
acuaaccacgcu

SEQ ID NO: 3111245 - RNA, 13 nt, Human
uccagccugggug

SEQ ID NO: 3111246 - RNA, 24 nt, Human
uccagccugggugacagagcaagu

SEQ ID NO: 3111247 - RNA, 14 nt, Human
uccagcucaccagc

SEQ ID NO: 3111248 - RNA, 12 nt, Human
acguuucuaaag

SEQ ID NO: 3111249 - RNA, 14 nt, Human
acguuucuaaaggc

SEQ ID NO: 3111250 - RNA, 22 nt, Human
uccccaccgcagacaggaccag

SEQ ID NO: 3111251 - RNA, 15 nt, Human
ucccauaugccuggg

SEQ ID NO: 3111252 - RNA, 13 nt, Human
ucccaucucacac

SEQ ID NO: 3111253 - RNA, 19 nt, Human
ucccaucucacacaugagc

SEQ ID NO: 3111254 - RNA, 14 nt, Human
ucccaucucacaca

SEQ ID NO: 3111255 - RNA, 16 nt, Human
acuacaguccucccau

SEQ ID NO: 3111256 - RNA, 22 nt, Human
ucccagugccgagaaggaagcc

SEQ ID NO: 3111257 - RNA, 19 nt, Human
ucccagugccgagaaggaa

SEQ ID NO: 3111258 - RNA, 18 nt, Human
uaaaccgccaaggcuggg

SEQ ID NO: 3111259 - RNA, 16 nt, Human
uaaaccgccaaggcug

SEQ ID NO: 3111260 - RNA, 19 nt, Human
uaaaggcuaccuuuguauu

SEQ ID NO: 3111261 - RNA, 21 nt, Human
uaaaggcuaccuuuguauucu

SEQ ID NO: 3111262 - RNA, 12 nt, Human
aaguuaaauaaa

SEQ ID NO: 3111263 - RNA, 14 nt, Human
aaguuaaauaaauc

SEQ ID NO: 3111264 - RNA, 13 nt, Human
uaaagucaggggu

SEQ ID NO: 3111265 - RNA, 14 nt, Human
uaaaguguauuuuu

SEQ ID NO: 3111266 - RNA, 15 nt, Human
uaaaguguauuuuuu

SEQ ID NO: 3111267 - RNA, 19 nt, Human
uaaaguguauuuuuuuacu

SEQ ID NO: 3111268 - RNA, 14 nt, Human
aauaaaguaauuau

SEQ ID NO: 3111269 - RNA, 15 nt, Human
aauaacuaaaaggua

SEQ ID NO: 3111270 - RNA, 12 nt, Human
aauaaauuauuu

SEQ ID NO: 3111271 - RNA, 12 nt, Human
aauaacauguaa

SEQ ID NO: 3111272 - RNA, 19 nt, Human
aauaacauguaauuaagua

SEQ ID NO: 3111273 - RNA, 16 nt, Human
aauacaccacuacauu

SEQ ID NO: 3111274 - RNA, 18 nt, Human
aauacaccacuacauucu

SEQ ID NO: 3111275 - RNA, 20 nt, Human
aauacaccacuacauucugu

SEQ ID NO: 3111276 - RNA, 15 nt, Human
aauacaccacuacau

SEQ ID NO: 3111277 - RNA, 19 nt, Human
uaaaucuccaaaauaaaac

SEQ ID NO: 3111278 - RNA, 13 nt, Human
uaacaagccaccc

SEQ ID NO: 3111279 - RNA, 18 nt, Human
uaaaucuccaaaauaaaa

SEQ ID NO: 3111280 - RNA, 20 nt, Human
uaaaucuccaaaauaaaacu

SEQ ID NO: 3111281 - RNA, 21 nt, Human
uaaaucuccaaaauaaaacuu

SEQ ID NO: 3111282 - RNA, 22 nt, Human
uaaauuaacuuuuauaaacuuu

SEQ ID NO: 3111283 - RNA, 14 nt, Human
guucucugaggaca

SEQ ID NO: 3111284 - RNA, 16 nt, Human
guucucugaggacacu

SEQ ID NO: 3111285 - RNA, 11 nt, Human
guucucugccc

SEQ ID NO: 3111286 - RNA, 12 nt, Human
guucucugcccu

SEQ ID NO: 3111287 - RNA, 22 nt, Human
guugauagcacagacccugccc

SEQ ID NO: 3111288 - RNA, 23 nt, Human
guugauagcacagacccugcccu

SEQ ID NO: 3111289 - RNA, 13 nt, Human
aagcucugcuccu

SEQ ID NO: 3111290 - RNA, 18 nt, Human
aagcuguuacugucuuca

SEQ ID NO: 3111291 - RNA, 21 nt, Human
aagcucuacugaggugcuaug

SEQ ID NO: 3111292 - RNA, 23 nt, Human
aagcucccaggcauuccccagga

SEQ ID NO: 3111293 - RNA, 22 nt, Human
aagcucccaggcauuccccagg

SEQ ID NO: 3111294 - RNA, 12 nt, Human
aagcucccaggc

SEQ ID NO: 3111295 - RNA, 11 nt, Human
aagcucccagg

SEQ ID NO: 3111296 - RNA, 13 nt, Human
guguuuauuguca

SEQ ID NO: 3111297 - RNA, 20 nt, Human
aaggaggaagagaaaaaaua

SEQ ID NO: 3111298 - RNA, 22 nt, Human
aaggauccugagccagauuuca

SEQ ID NO: 3111299 - RNA, 20 nt, Human
aaggauccugagccagauuu

SEQ ID NO: 3111300 - RNA, 12 nt, Human
aaggauccugag

SEQ ID NO: 3111301 - RNA, 11 nt, Human
aaggauccuga

SEQ ID NO: 3111302 - RNA, 18 nt, Human
aaggagauuuacaacugg

SEQ ID NO: 3111303 - RNA, 17 nt, Human
aaggagauuuacaacug

SEQ ID NO: 3111304 - RNA, 15 nt, Human
aaggaaacccagcuc

SEQ ID NO: 3111305 - RNA, 13 nt, Human
aaggcuaccuuug

SEQ ID NO: 3111306 - RNA, 14 nt, Human
guugcccaggcugg

SEQ ID NO: 3111307 - RNA, 15 nt, Human
aaggcuaccuuugua

SEQ ID NO: 3111308 - RNA, 19 nt, Human
aaggccccgcccaggcuua

SEQ ID NO: 3111309 - RNA, 16 nt, Human
aaggccccgcccaggc

SEQ ID NO: 3111310 - RNA, 14 nt, Human
aaggccccgcccag

SEQ ID NO: 3111311 - RNA, 24 nt, Human
aaggaugcacagaguuguuacauu

SEQ ID NO: 3111312 - RNA, 22 nt, Human
aaggaugcacagaguuguuaca

SEQ ID NO: 3111313 - RNA, 14 nt, Human
aaggaugcccaaag

SEQ ID NO: 3111314 - RNA, 16 nt, Human
guugcccaggcuggcg

SEQ ID NO: 3111315 - RNA, 15 nt, Human
guugcccaggcuggc

SEQ ID NO: 3111316 - RNA, 23 nt, Human
guuggcugggggccucagugcca

SEQ ID NO: 3111317 - RNA, 15 nt, Human
guugggcugguguca

SEQ ID NO: 3111318 - RNA, 17 nt, Human
guugggcuggugucacc

SEQ ID NO: 3111319 - RNA, 18 nt, Human
guuuuucuaggccugggg

SEQ ID NO: 3111320 - RNA, 18 nt, Human
aagucuuagauguauaua

SEQ ID NO: 3111321 - RNA, 19 nt, Human
aagucuuagauguauauau

SEQ ID NO: 3111322 - RNA, 17 nt, Human
aagucuuagauguauau

SEQ ID NO: 3111323 - RNA, 16 nt, Human
guuuuugucuuaaaaa

SEQ ID NO: 3111324 - RNA, 21 nt, Human
aagucaagugaaaaaggagga

SEQ ID NO: 3111325 - RNA, 24 nt, Human
aagucacacaguauuacuucugcu

SEQ ID NO: 3111326 - RNA, 18 nt, Human
aaguauucuuauuuaaug

SEQ ID NO: 3111327 - RNA, 13 nt, Human
aagucacacagug

SEQ ID NO: 3111328 - RNA, 21 nt, Human
aaguacuucuccacccugcuc

SEQ ID NO: 3111329 - RNA, 15 nt, Human
aaguacuggagaaaa

SEQ ID NO: 3111330 - RNA, 16 nt, Human
aaguacuauguaucaa

SEQ ID NO: 3111331 - RNA, 15 nt, Human
aaguacuauguauca

SEQ ID NO: 3111332 - RNA, 22 nt, Human
aaguacuucuccacccugcucu

SEQ ID NO: 3111333 - RNA, 23 nt, Human
aaguacuucuccacccugcucuc

SEQ ID NO: 3111334 - RNA, 20 nt, Human
aaguacuucuccacccugcu

SEQ ID NO: 3111335 - RNA, 14 nt, Human
guuuuaagaggcag

SEQ ID NO: 3111336 - RNA, 16 nt, Human
guuuuaagaggcaggg

SEQ ID NO: 3111337 - RNA, 15 nt, Human
guuuuacugcagcuu

SEQ ID NO: 3111338 - RNA, 18 nt, Human
guuuuacugcagcuuugu

SEQ ID NO: 3111339 - RNA, 16 nt, Human
guuuuacugcagcuuu

SEQ ID NO: 3111340 - RNA, 22 nt, Human
guuucugccgcagcccugcaga

SEQ ID NO: 3111341 - RNA, 18 nt, Human
guuucugccgcagcccug

SEQ ID NO: 3111342 - RNA, 17 nt, Human
guuugccucugccucug

SEQ ID NO: 3111343 - RNA, 13 nt, Human
guuugcuaaguga

SEQ ID NO: 3111344 - RNA, 17 nt, Human
aaggguaucaggugcug

SEQ ID NO: 3111345 - RNA, 14 nt, Human
aaggggcaguggug

SEQ ID NO: 3111346 - RNA, 19 nt, Human
aaggguaucaggugcugcc

SEQ ID NO: 3111347 - RNA, 16 nt, Human
aaggguaucuggugac

SEQ ID NO: 3111348 - RNA, 15 nt, Human
aagggcccagagagg

SEQ ID NO: 3111349 - RNA, 13 nt, Human
aagggcccagaga

SEQ ID NO: 3111350 - RNA, 23 nt, Human
aaccaucauugaaaucuuuuugc

SEQ ID NO: 3111351 - RNA, 13 nt, Human
aaccacaucuugc

SEQ ID NO: 3111352 - RNA, 19 nt, Human
gucucaaaaaaagaaaaag

SEQ ID NO: 3111353 - RNA, 22 nt, Human
gucucaaacucuugaccucagg

SEQ ID NO: 3111354 - RNA, 14 nt, Human
gucuaugggacuca

SEQ ID NO: 3111355 - RNA, 16 nt, Human
guccugcugcaguugc

SEQ ID NO: 3111356 - RNA, 13 nt, Human
guccugcugcagu

SEQ ID NO: 3111357 - RNA, 14 nt, Human
gucgaggacaggga

SEQ ID NO: 3111358 - RNA, 13 nt, Human
gucgcccagucug

SEQ ID NO: 3111359 - RNA, 14 nt, Human
gucgcccagucugg

SEQ ID NO: 3111360 - RNA, 20 nt, Human
gucuaccugaggggccucuu

SEQ ID NO: 3111361 - RNA, 23 nt, Human
gucgcccagucuggaaugcagug

SEQ ID NO: 3111362 - RNA, 23 nt, Human
guccccuguuuguuucugaaagg

SEQ ID NO: 3111363 - RNA, 16 nt, Human
guccccgcacugggcu

SEQ ID NO: 3111364 - RNA, 15 nt, Human
guccccgcacugggc

SEQ ID NO: 3111365 - RNA, 13 nt, Human
gucccccugacaa

SEQ ID NO: 3111366 - RNA, 22 nt, Human
guccgaaagggacuuggaagcu

SEQ ID NO: 3111367 - RNA, 21 nt, Human
guccgaaagggacuuggaagc

SEQ ID NO: 3111368 - RNA, 13 nt, Human
gucccuuuuccuu

SEQ ID NO: 3111369 - RNA, 19 nt, Human
gucccaccuuggcugcagg

SEQ ID NO: 3111370 - RNA, 17 nt, Human
gucccaccuuggcugca

SEQ ID NO: 3111371 - RNA, 18 nt, Human
gucccaccuuggcugcag

SEQ ID NO: 3111372 - RNA, 13 nt, Human
guccuacccaccc

SEQ ID NO: 3111373 - RNA, 20 nt, Human
aacagacuggaagcacagcu

SEQ ID NO: 3111374 - RNA, 22 nt, Human
aacauguuuuucuucucccuca

SEQ ID NO: 3111375 - RNA, 16 nt, Human
aacauacucccaucug

SEQ ID NO: 3111376 - RNA, 18 nt, Human
aacauacucccaucugug

SEQ ID NO: 3111377 - RNA, 20 nt, Human
aacauacucccaucugugaa

SEQ ID NO: 3111378 - RNA, 18 nt, Human
gucucuuuaaugucacag

SEQ ID NO: 3111379 - RNA, 19 nt, Human
gucucuuuaaugucacagg

SEQ ID NO: 3111380 - RNA, 20 nt, Human
gucucuuuaaugucacaggc

SEQ ID NO: 3111381 - RNA, 14 nt, Human
gucugaaggcuggg

SEQ ID NO: 3111382 - RNA, 19 nt, Human
gucugaaggcuggguucug

SEQ ID NO: 3111383 - RNA, 22 nt, Human
gucucuuuaaugucacaggcag

SEQ ID NO: 3111384 - RNA, 17 nt, Human
gucucuugguccugcug

SEQ ID NO: 3111385 - RNA, 19 nt, Human
gucucuugguccugcugca

SEQ ID NO: 3111386 - RNA, 18 nt, Human
gucucuugguccugcugc

SEQ ID NO: 3111387 - RNA, 20 nt, Human
gucucuugguccugcugcag

SEQ ID NO: 3111388 - RNA, 13 nt, Human
gucucuugguccu

SEQ ID NO: 3111389 - RNA, 18 nt, Human
gucuggaaugcaguggua

SEQ ID NO: 3111390 - RNA, 21 nt, Human
gucugacaggcaaugcuggcu

SEQ ID NO: 3111391 - RNA, 22 nt, Human
gucugacaggcaaugcuggcug

SEQ ID NO: 3111392 - RNA, 23 nt, Human
gucugacaggcaaugcuggcugu

SEQ ID NO: 3111393 - RNA, 18 nt, Human
aaccugauugugucucuu

SEQ ID NO: 3111394 - RNA, 19 nt, Human
aaccugauugugucucuug

SEQ ID NO: 3111395 - RNA, 12 nt, Human
aaccugugucuc

SEQ ID NO: 3111396 - RNA, 16 nt, Human
gucuuuguacagacaa

SEQ ID NO: 3111397 - RNA, 15 nt, Human
gucuuuguacagaca

SEQ ID NO: 3111398 - RNA, 16 nt, Human
gucuucaguaagccgu

SEQ ID NO: 3111399 - RNA, 23 nt, Human
aacguggcugcuucaaggauccu

SEQ ID NO: 3111400 - RNA, 18 nt, Human
gugaccauguuuuguuua

SEQ ID NO: 3111401 - RNA, 21 nt, Human
gugaccagcaccaucucuccu

SEQ ID NO: 3111402 - RNA, 18 nt, Human
gugaccagcaccaucucu

SEQ ID NO: 3111403 - RNA, 17 nt, Human
gugaccaaugaugguca

SEQ ID NO: 3111404 - RNA, 16 nt, Human
gugacagaggcagccc

SEQ ID NO: 3111405 - RNA, 18 nt, Human
gugacagaggcagcccca

SEQ ID NO: 3111406 - RNA, 19 nt, Human
gugacagaggcagccccau

SEQ ID NO: 3111407 - RNA, 23 nt, Human
gugaagacaaugacuuacuguac

SEQ ID NO: 3111408 - RNA, 14 nt, Human
gugaagugaagaca

SEQ ID NO: 3111409 - RNA, 20 nt, Human
gugaguccuggcaugggaau

SEQ ID NO: 3111410 - RNA, 17 nt, Human
gugaguccuggcauggg

SEQ ID NO: 3111411 - RNA, 19 nt, Human
gugaguacuacaguccucc

SEQ ID NO: 3111412 - RNA, 12 nt, Human
gugagagcuggg

SEQ ID NO: 3111413 - RNA, 12 nt, Human
gugaccccaggu

SEQ ID NO: 3111414 - RNA, 15 nt, Human
gugagcaauccugca

SEQ ID NO: 3111415 - RNA, 13 nt, Human
gugagagcugggu

SEQ ID NO: 3111416 - RNA, 16 nt, Human
gugagaggggaacaga

SEQ ID NO: 3111417 - RNA, 21 nt, Human
gugagcacuaaggugugcucu

SEQ ID NO: 3111418 - RNA, 17 nt, Human
gugaguacuacaguccu

SEQ ID NO: 3111419 - RNA, 22 nt, Human
aagauauuuugcuuugugauuu

SEQ ID NO: 3111420 - RNA, 17 nt, Human
aagauauuuugcuuugu

SEQ ID NO: 3111421 - RNA, 20 nt, Human
aagauauuuugcuuugugau

SEQ ID NO: 3111422 - RNA, 15 nt, Human
aagauauuuugcuuu

SEQ ID NO: 3111423 - RNA, 19 nt, Human
aagaguaggaagacuuugg

SEQ ID NO: 3111424 - RNA, 18 nt, Human
aagaguaggaagacuuug

SEQ ID NO: 3111425 - RNA, 16 nt, Human
aagaguaggaagacuu

SEQ ID NO: 3111426 - RNA, 19 nt, Human
gugguguuuccuggcacug

SEQ ID NO: 3111427 - RNA, 18 nt, Human
gugguuauggagagggug

SEQ ID NO: 3111428 - RNA, 14 nt, Human
aagaguaggaagac

SEQ ID NO: 3111429 - RNA, 21 nt, Human
gugucuugcaauggcagccuu

SEQ ID NO: 3111430 - RNA, 13 nt, Human
gugugagucacca

SEQ ID NO: 3111431 - RNA, 18 nt, Human
gugugagucaccaagccc

SEQ ID NO: 3111432 - RNA, 15 nt, Human
gugugguguuuccug

SEQ ID NO: 3111433 - RNA, 19 nt, Human
gugucuugcaauggcagcc

SEQ ID NO: 3111434 - RNA, 20 nt, Human
gugucccaaaaagaaaggag

SEQ ID NO: 3111435 - RNA, 19 nt, Human
gugugguguuuccuggcac

SEQ ID NO: 3111436 - RNA, 17 nt, Human
aagacucauucuucugu

SEQ ID NO: 3111437 - RNA, 22 nt, Human
aagacgcugugcugcccugccc

SEQ ID NO: 3111438 - RNA, 21 nt, Human
aagacgcugugcugcccugcc

SEQ ID NO: 3111439 - RNA, 20 nt, Human
aagacgcugugcugcccugc

SEQ ID NO: 3111440 - RNA, 23 nt, Human
aagacgcugugcugcccugccca

SEQ ID NO: 3111441 - RNA, 16 nt, Human
aagagcccaggccucc

SEQ ID NO: 3111442 - RNA, 14 nt, Human
aagagcccaggccu

SEQ ID NO: 3111443 - RNA, 12 nt, Human
aagagcccaggc

SEQ ID NO: 3111444 - RNA, 19 nt, Human
aagagauugugguuucauu

SEQ ID NO: 3111445 - RNA, 16 nt, Human
aagagauugugguuuc

SEQ ID NO: 3111446 - RNA, 12 nt, Human
gugggagcugag

SEQ ID NO: 3111447 - RNA, 18 nt, Human
gugggauccuccaggugc

SEQ ID NO: 3111448 - RNA, 15 nt, Human
gugggauccuccagg

SEQ ID NO: 3111449 - RNA, 13 nt, Human
gugggauccucca

SEQ ID NO: 3111450 - RNA, 14 nt, Human
guggccucccaacu

SEQ ID NO: 3111451 - RNA, 13 nt, Human
guggccucccaac

SEQ ID NO: 3111452 - RNA, 20 nt, Human
guggugguuuucuguucuuu

SEQ ID NO: 3111453 - RNA, 16 nt, Human
gugguguuuccuggca

SEQ ID NO: 3111454 - RNA, 15 nt, Human
gugguguuuccuggc

SEQ ID NO: 3111455 - RNA, 14 nt, Human
aacuuggcgcugcc

SEQ ID NO: 3111456 - RNA, 22 nt, Human
aacuugucuuuggacccugagg

SEQ ID NO: 3111457 - RNA, 23 nt, Human
aacuugguucccauuugcuccuu

SEQ ID NO: 3111458 - RNA, 14 nt, Human
gugccucugggacu

SEQ ID NO: 3111459 - RNA, 15 nt, Human
gugccucugggacug

SEQ ID NO: 3111460 - RNA, 23 nt, Human
gugcacaagcuccaagcucccag

SEQ ID NO: 3111461 - RNA, 17 nt, Human
gugcacacaccagagcc

SEQ ID NO: 3111462 - RNA, 18 nt, Human
gugcacguacacacacau

SEQ ID NO: 3111463 - RNA, 12 nt, Human
gugcacacacca

SEQ ID NO: 3111464 - RNA, 14 nt, Human
gugcacacaccaga

SEQ ID NO: 3111465 - RNA, 14 nt, Human
gugccaagcagagg

SEQ ID NO: 3111466 - RNA, 15 nt, Human
gugcauuuggugguu

SEQ ID NO: 3111467 - RNA, 20 nt, Human
gugcauuugaggucuguucu

SEQ ID NO: 3111468 - RNA, 21 nt, Human
gugcauuugaggucuguucuu

SEQ ID NO: 3111469 - RNA, 22 nt, Human
gugcauuugaggucuguucuuu

SEQ ID NO: 3111470 - RNA, 22 nt, Human
aagaaaaaggaugcacagaguu

SEQ ID NO: 3111471 - RNA, 19 nt, Human
aagaaaaaggaugcacaga

SEQ ID NO: 3111472 - RNA, 20 nt, Human
aagaaaaaggaugcacagag

SEQ ID NO: 3111473 - RNA, 15 nt, Human
aagaagcucucuccu

SEQ ID NO: 3111474 - RNA, 14 nt, Human
aagaagcucucucc

SEQ ID NO: 3111475 - RNA, 17 nt, Human
aagaagcccaggaaagg

SEQ ID NO: 3111476 - RNA, 16 nt, Human
aagaagcccaggaaag

SEQ ID NO: 3111477 - RNA, 21 nt, Human
guggauuuaacagaaauguac

SEQ ID NO: 3111478 - RNA, 20 nt, Human
guggauuuaacagaaaugua

SEQ ID NO: 3111479 - RNA, 23 nt, Human
guggauuuaacagaaauguacag

SEQ ID NO: 3111480 - RNA, 14 nt, Human
guggcagcugcggu

SEQ ID NO: 3111481 - RNA, 22 nt, Human
guggcagcucaccucucccuug

SEQ ID NO: 3111482 - RNA, 14 nt, Human
guggcaccagcagc

SEQ ID NO: 3111483 - RNA, 13 nt, Human
guggcaccagcag

SEQ ID NO: 3111484 - RNA, 17 nt, Human
guggcagcugcggucca

SEQ ID NO: 3111485 - RNA, 20 nt, Human
guggcagcucaccucucccu

SEQ ID NO: 3111486 - RNA, 18 nt, Human
gugcugcccugcccaccu

SEQ ID NO: 3111487 - RNA, 20 nt, Human
gugcugcccugcccaccugg

SEQ ID NO: 3111488 - RNA, 19 nt, Human
gugcugcccugcccaccug

SEQ ID NO: 3111489 - RNA, 21 nt, Human
gugcugcccugcccaccuggc

SEQ ID NO: 3111490 - RNA, 14 nt, Human
guggacacagcucu

SEQ ID NO: 3111491 - RNA, 15 nt, Human
guggacacagcucuu

SEQ ID NO: 3111492 - RNA, 24 nt, Human
guggacacagcucuucuccaggcu

SEQ ID NO: 3111493 - RNA, 21 nt, Human
uagucaggugccucaagagaa

SEQ ID NO: 3111494 - RNA, 23 nt, Human
acaagcugcacccucaggcaggu

SEQ ID NO: 3111495 - RNA, 22 nt, Human
acaagcugcacccucaggcagg

SEQ ID NO: 3111496 - RNA, 21 nt, Human
acaagcugcacccucaggcag

SEQ ID NO: 3111497 - RNA, 19 nt, Human
acaagcugcacccucaggc

SEQ ID NO: 3111498 - RNA, 20 nt, Human
uaguuccucauuagcauuuu

SEQ ID NO: 3111499 - RNA, 11 nt, Human
acacccuguga

SEQ ID NO: 3111500 - RNA, 18 nt, Human
acacccugugauggggcc

SEQ ID NO: 3111501 - RNA, 12 nt, Human
acacccugugau

SEQ ID NO: 3111502 - RNA, 19 nt, Human
acacccagcccacuucugc

SEQ ID NO: 3111503 - RNA, 20 nt, Human
acacccagcccacuucugcc

SEQ ID NO: 3111504 - RNA, 21 nt, Human
acacccagcccacuucugcca

SEQ ID NO: 3111505 - RNA, 21 nt, Human
acacaugcaaggucauuuuuu

SEQ ID NO: 3111506 - RNA, 18 nt, Human
acacaugcaaggucauuu

SEQ ID NO: 3111507 - RNA, 19 nt, Human
acacaugcaaggucauuuu

SEQ ID NO: 3111508 - RNA, 20 nt, Human
acacaugcaaggucauuuuu

SEQ ID NO: 3111509 - RNA, 13 nt, Human
uauacauaaacaa

SEQ ID NO: 3111510 - RNA, 14 nt, Human
uauacauaaacaag

SEQ ID NO: 3111511 - RNA, 14 nt, Human
uauacauuugauaa

SEQ ID NO: 3111512 - RNA, 21 nt, Human
uauaauuuaccugaagucuuu

SEQ ID NO: 3111513 - RNA, 18 nt, Human
uauagccuaggugacaga

SEQ ID NO: 3111514 - RNA, 20 nt, Human
uauagccuaggugacagagu

SEQ ID NO: 3111515 - RNA, 23 nt, Human
acacucauugaccugaggcccuu

SEQ ID NO: 3111516 - RNA, 21 nt, Human
acacucauugaccugaggccc

SEQ ID NO: 3111517 - RNA, 19 nt, Human
acacucauugaccugaggc

SEQ ID NO: 3111518 - RNA, 17 nt, Human
acagcuaacauggaagu

SEQ ID NO: 3111519 - RNA, 15 nt, Human
acagcuaacauggaa

SEQ ID NO: 3111520 - RNA, 14 nt, Human
acagcuaacaugga

SEQ ID NO: 3111521 - RNA, 10 nt, Human
uaugggagag

SEQ ID NO: 3111522 - RNA, 16 nt, Human
uauggcuuuugugcau

SEQ ID NO: 3111523 - RNA, 18 nt, Human
uaugcucugcauguuaca

SEQ ID NO: 3111524 - RNA, 14 nt, Human
uaugcucugcaugu

SEQ ID NO: 3111525 - RNA, 19 nt, Human
uaugcucugcauguuacau

SEQ ID NO: 3111526 - RNA, 22 nt, Human
uauggcccuggccuagcauacg

SEQ ID NO: 3111527 - RNA, 14 nt, Human
uaugaucacggcuc

SEQ ID NO: 3111528 - RNA, 21 nt, Human
uaugaucacggcucacugcag

SEQ ID NO: 3111529 - RNA, 23 nt, Human
uaugaucacggcucacugcagcc

SEQ ID NO: 3111530 - RNA, 15 nt, Human
uaucuugaagacuuu

SEQ ID NO: 3111531 - RNA, 23 nt, Human
uaugaggcauuuguuugaacuga

SEQ ID NO: 3111532 - RNA, 13 nt, Human
uaugaggcauuug

SEQ ID NO: 3111533 - RNA, 20 nt, Human
acagaguuuucacucuuauu

SEQ ID NO: 3111534 - RNA, 18 nt, Human
acagaguuuucacucuua

SEQ ID NO: 3111535 - RNA, 14 nt, Human
uaucuugaagacuu

SEQ ID NO: 3111536 - RNA, 22 nt, Human
acagacuggaagcacagcuuca

SEQ ID NO: 3111537 - RNA, 20 nt, Human
acagagcccacgcccccacu

SEQ ID NO: 3111538 - RNA, 16 nt, Human
acagagcuacacaggg

SEQ ID NO: 3111539 - RNA, 21 nt, Human
acagagugagacucugucuca

SEQ ID NO: 3111540 - RNA, 15 nt, Human
uaucuagauacugua

SEQ ID NO: 3111541 - RNA, 16 nt, Human
uaucuagauacuguau

SEQ ID NO: 3111542 - RNA, 17 nt, Human
uaucucccccagcccca

SEQ ID NO: 3111543 - RNA, 18 nt, Human
uaucucccccagccccau

SEQ ID NO: 3111544 - RNA, 16 nt, Human
uaucucccccagcccc

SEQ ID NO: 3111545 - RNA, 19 nt, Human
uaucuagauacuguaucau

SEQ ID NO: 3111546 - RNA, 18 nt, Human
uaucacccagaagaaaau

SEQ ID NO: 3111547 - RNA, 21 nt, Human
uaucaaguauuauaccuuuuu

SEQ ID NO: 3111548 - RNA, 18 nt, Human
uaucaaguauuauaccuu

SEQ ID NO: 3111549 - RNA, 23 nt, Human
acagacacaggcccggcuccagg

SEQ ID NO: 3111550 - RNA, 11 nt, Human
acacuccuuca

SEQ ID NO: 3111551 - RNA, 16 nt, Human
acagacccugcccugu

SEQ ID NO: 3111552 - RNA, 17 nt, Human
acagacccugcccugug

SEQ ID NO: 3111553 - RNA, 20 nt, Human
acagacccugcccugugggc

SEQ ID NO: 3111554 - RNA, 18 nt, Human
acagacccugcccugugg

SEQ ID NO: 3111555 - RNA, 14 nt, Human
acagacuggaagca

SEQ ID NO: 3111556 - RNA, 22 nt, Human
acagggcacaccgggcacucag

SEQ ID NO: 3111557 - RNA, 22 nt, Human
acagguuuuccugaagaauuga

SEQ ID NO: 3111558 - RNA, 12 nt, Human
acaggcugggcu

SEQ ID NO: 3111559 - RNA, 20 nt, Human
acagggcacaccgggcacuc

SEQ ID NO: 3111560 - RNA, 21 nt, Human
acaggcugggcuucaguggca

SEQ ID NO: 3111561 - RNA, 14 nt, Human
acaggcugggcuuc

SEQ ID NO: 3111562 - RNA, 17 nt, Human
acaggcugggcuucagu

SEQ ID NO: 3111563 - RNA, 17 nt, Human
acaguccucccaucuca

SEQ ID NO: 3111564 - RNA, 20 nt, Human
acaguccuuaccagcagagc

SEQ ID NO: 3111565 - RNA, 18 nt, Human
acaguccuuaccagcaga

SEQ ID NO: 3111566 - RNA, 15 nt, Human
acaguccucccaucu

SEQ ID NO: 3111567 - RNA, 14 nt, Human
acaguccucccauc

SEQ ID NO: 3111568 - RNA, 13 nt, Human
acaguccucccau

SEQ ID NO: 3111569 - RNA, 15 nt, Human
acagucccugccaau

SEQ ID NO: 3111570 - RNA, 15 nt, Human
acaguauuacuucug

SEQ ID NO: 3111571 - RNA, 16 nt, Human
acaguauuacuucugc

SEQ ID NO: 3111572 - RNA, 17 nt, Human
acaguauuacuucugcu

SEQ ID NO: 3111573 - RNA, 19 nt, Human
acaguauuacuucugcuac

SEQ ID NO: 3111574 - RNA, 13 nt, Human
acagucccugcca

SEQ ID NO: 3111575 - RNA, 12 nt, Human
acagucccugcc

SEQ ID NO: 3111576 - RNA, 15 nt, Human
acaguuaagagaaau

SEQ ID NO: 3111577 - RNA, 22 nt, Human
acaguccuuaccagcagagcac

SEQ ID NO: 3111578 - RNA, 21 nt, Human
acaguccuuaccagcagagca

SEQ ID NO: 3111579 - RNA, 12 nt, Human
uauuagagaaga

SEQ ID NO: 3111580 - RNA, 16 nt, Human
uauuaccacagacaua

SEQ ID NO: 3111581 - RNA, 16 nt, Human
uauucaggaagcucag

SEQ ID NO: 3111582 - RNA, 22 nt, Human
uauucaggaagcucagggccug

SEQ ID NO: 3111583 - RNA, 18 nt, Human
uauucaggaagcucaggg

SEQ ID NO: 3111584 - RNA, 23 nt, Human
uauuaaaaaucucaaauuucuaa

SEQ ID NO: 3111585 - RNA, 16 nt, Human
uauuaaaaaucucaaa

SEQ ID NO: 3111586 - RNA, 18 nt, Human
uauuaaaaaucucaaauu

SEQ ID NO: 3111587 - RNA, 20 nt, Human
uauuaaaaaucucaaauuuc

SEQ ID NO: 3111588 - RNA, 22 nt, Human
uauuaaaaaucucaaauuucua

SEQ ID NO: 3111589 - RNA, 17 nt, Human
uauguuuuaagaggcag

SEQ ID NO: 3111590 - RNA, 19 nt, Human
uauguuuuaagaggcaggg

SEQ ID NO: 3111591 - RNA, 15 nt, Human
uauuuaaugaaagac

SEQ ID NO: 3111592 - RNA, 21 nt, Human
uauuuaaugaaagacuguaca

SEQ ID NO: 3111593 - RNA, 17 nt, Human
uauugucaaagugguga

SEQ ID NO: 3111594 - RNA, 13 nt, Human
uauugucaaagug

SEQ ID NO: 3111595 - RNA, 14 nt, Human
uauuuauuuaaauu

SEQ ID NO: 3111596 - RNA, 13 nt, Human
uauuuauuuaaau

SEQ ID NO: 3111597 - RNA, 18 nt, Human
uauuuacuucuuauacau

SEQ ID NO: 3111598 - RNA, 23 nt, Human
uauuuaauuuuuuugagacagag

SEQ ID NO: 3111599 - RNA, 15 nt, Human
uauucuuauuuaaug

SEQ ID NO: 3111600 - RNA, 16 nt, Human
uauucuguuggccagu

SEQ ID NO: 3111601 - RNA, 17 nt, Human
acaguucucuccuucuu

SEQ ID NO: 3111602 - RNA, 18 nt, Human
uauucucuccuguaccuc

SEQ ID NO: 3111603 - RNA, 20 nt, Human
uauucucuccuguaccucuu

SEQ ID NO: 3111604 - RNA, 24 nt, Human
uauucucuccuguaccucuugagc

SEQ ID NO: 3111605 - RNA, 13 nt, Human
acaguuacucaga

SEQ ID NO: 3111606 - RNA, 20 nt, Human
acaguuacucagaauucucu

SEQ ID NO: 3111607 - RNA, 20 nt, Human
acaguucaauucucauuugu

SEQ ID NO: 3111608 - RNA, 16 nt, Human
acaguucucuccuucu

SEQ ID NO: 3111609 - RNA, 16 nt, Human
uacuauguaucaauga

SEQ ID NO: 3111610 - RNA, 16 nt, Human
uacuauaauuuaccug

SEQ ID NO: 3111611 - RNA, 13 nt, Human
uacguugugcauu

SEQ ID NO: 3111612 - RNA, 14 nt, Human
uacgucugacaggc

SEQ ID NO: 3111613 - RNA, 21 nt, Human
uacucugugucagguggggca

SEQ ID NO: 3111614 - RNA, 13 nt, Human
aauucuuaaauau

SEQ ID NO: 3111615 - RNA, 14 nt, Human
aauucuugcaaagu

SEQ ID NO: 3111616 - RNA, 20 nt, Human
aauucuugcaaaguaucccu

SEQ ID NO: 3111617 - RNA, 22 nt, Human
aauucuucuccacuuucuagcc

SEQ ID NO: 3111618 - RNA, 15 nt, Human
uacguacacauuuua

SEQ ID NO: 3111619 - RNA, 14 nt, Human
uacguacacauuuu

SEQ ID NO: 3111620 - RNA, 15 nt, Human
aauuuacauacucug

SEQ ID NO: 3111621 - RNA, 19 nt, Human
aauuuacauacucugcuua

SEQ ID NO: 3111622 - RNA, 13 nt, Human
aauuuaaaagucu

SEQ ID NO: 3111623 - RNA, 22 nt, Human
aauuguuuggggaugagaaagg

SEQ ID NO: 3111624 - RNA, 17 nt, Human
aauuuagaaauauaauu

SEQ ID NO: 3111625 - RNA, 13 nt, Human
aauuucuaaaucu

SEQ ID NO: 3111626 - RNA, 21 nt, Human
aauuucuaaaucuccaaaaua

SEQ ID NO: 3111627 - RNA, 22 nt, Human
uagauuuuagacccuauugcug

SEQ ID NO: 3111628 - RNA, 19 nt, Human
uagcacagacccugcccug

SEQ ID NO: 3111629 - RNA, 18 nt, Human
uagcacagacccugcccu

SEQ ID NO: 3111630 - RNA, 17 nt, Human
uagcacagacccugccc

SEQ ID NO: 3111631 - RNA, 16 nt, Human
uagcacagacccugcc

SEQ ID NO: 3111632 - RNA, 24 nt, Human
uagcacagacccugcccugugggc

SEQ ID NO: 3111633 - RNA, 12 nt, Human
acaacacucaca

SEQ ID NO: 3111634 - RNA, 15 nt, Human
acaacaacaaaauga

SEQ ID NO: 3111635 - RNA, 18 nt, Human
acaagcgugagccacugc

SEQ ID NO: 3111636 - RNA, 13 nt, Human
acaagcugcaccc

SEQ ID NO: 3111637 - RNA, 20 nt, Human
acaagcgugagccacugcac

SEQ ID NO: 3111638 - RNA, 21 nt, Human
acaagcgugagccacugcacc

SEQ ID NO: 3111639 - RNA, 12 nt, Human
acaagccacccc

SEQ ID NO: 3111640 - RNA, 17 nt, Human
acaagagcccaggccuc

SEQ ID NO: 3111641 - RNA, 21 nt, Human
uagacagagucucacuguugc

SEQ ID NO: 3111642 - RNA, 16 nt, Human
uagacaauuuauuaug

SEQ ID NO: 3111643 - RNA, 16 nt, Human
uagaagucacacagua

SEQ ID NO: 3111644 - RNA, 16 nt, Human
uagaagucuuagaugu

SEQ ID NO: 3111645 - RNA, 17 nt, Human
uagaagucuuagaugua

SEQ ID NO: 3111646 - RNA, 18 nt, Human
uagaagucuuagauguau

SEQ ID NO: 3111647 - RNA, 19 nt, Human
uagaagucuuagauguaua

SEQ ID NO: 3111648 - RNA, 15 nt, Human
uagaagucacacagu

SEQ ID NO: 3111649 - RNA, 14 nt, Human
uagacagucccugc

SEQ ID NO: 3111650 - RNA, 12 nt, Human
uagacagucccu

SEQ ID NO: 3111651 - RNA, 17 nt, Human
aauuuuuauuaaauuau

SEQ ID NO: 3111652 - RNA, 18 nt, Human
aauuuuuauuaaauuaug

SEQ ID NO: 3111653 - RNA, 22 nt, Human
aauuuuuuuaucgucacugcuu

SEQ ID NO: 3111654 - RNA, 17 nt, Human
aauuuuuuugagacaga

SEQ ID NO: 3111655 - RNA, 20 nt, Human
aauacaguaucucagggccu

SEQ ID NO: 3111656 - RNA, 23 nt, Human
uaauacaccacuacauucuguua

SEQ ID NO: 3111657 - RNA, 22 nt, Human
uaauacaccacuacauucuguu

SEQ ID NO: 3111658 - RNA, 21 nt, Human
uaauacaccacuacauucugu

SEQ ID NO: 3111659 - RNA, 21 nt, Human
uaauauugauaugcuuauaca

SEQ ID NO: 3111660 - RNA, 23 nt, Human
aaucuucugaacuuggcgcugcc

SEQ ID NO: 3111661 - RNA, 14 nt, Human
aaugaaugaaacau

SEQ ID NO: 3111662 - RNA, 14 nt, Human
aaugaaugucagug

SEQ ID NO: 3111663 - RNA, 15 nt, Human
aaugaaugucagugu

SEQ ID NO: 3111664 - RNA, 12 nt, Human
uaaugugaaacu

SEQ ID NO: 3111665 - RNA, 20 nt, Human
uaaugugaaacuggauuaaa

SEQ ID NO: 3111666 - RNA, 22 nt, Human
uaaugugaaacuggauuaaacu

SEQ ID NO: 3111667 - RNA, 23 nt, Human
uaaugugaaacuggauuaaacuu

SEQ ID NO: 3111668 - RNA, 16 nt, Human
uaaugucacaggcagg

SEQ ID NO: 3111669 - RNA, 17 nt, Human
uaaugucacaggcaggu

SEQ ID NO: 3111670 - RNA, 15 nt, Human
uaaugucacaggcag

SEQ ID NO: 3111671 - RNA, 16 nt, Human
uaauguaagcucuacu

SEQ ID NO: 3111672 - RNA, 17 nt, Human
uaauguaagcucuacug

SEQ ID NO: 3111673 - RNA, 23 nt, Human
uaauuaguuccucauuagcauuu

SEQ ID NO: 3111674 - RNA, 20 nt, Human
aaugcacuuuguucuggcuc

SEQ ID NO: 3111675 - RNA, 19 nt, Human
aaugcacuuuguucuggcu

SEQ ID NO: 3111676 - RNA, 16 nt, Human
aaugcacuuuguucug

SEQ ID NO: 3111677 - RNA, 13 nt, Human
aaugcacuuuguu

SEQ ID NO: 3111678 - RNA, 20 nt, Human
aaugcacaaacagaggccgc

SEQ ID NO: 3111679 - RNA, 19 nt, Human
aaugcacaaacagaggccg

SEQ ID NO: 3111680 - RNA, 23 nt, Human
aaugcaaaccaucauugaaaucu

SEQ ID NO: 3111681 - RNA, 22 nt, Human
aaugcaaaccaucauugaaauc

SEQ ID NO: 3111682 - RNA, 18 nt, Human
aaugcacaaacagaggcc

SEQ ID NO: 3111683 - RNA, 21 nt, Human
aaugaaugucagugugacuga

SEQ ID NO: 3111684 - RNA, 20 nt, Human
aaugaaugucagugugacug

SEQ ID NO: 3111685 - RNA, 16 nt, Human
aaugcaaaccaucauu

SEQ ID NO: 3111686 - RNA, 14 nt, Human
aaugcaaaccauca

SEQ ID NO: 3111687 - RNA, 14 nt, Human
aaugaccuuucaau

SEQ ID NO: 3111688 - RNA, 13 nt, Human
aaugaccuuucaa

SEQ ID NO: 3111689 - RNA, 16 nt, Human
uacaagcgugagccac

SEQ ID NO: 3111690 - RNA, 18 nt, Human
uacaagcgugagccacug

SEQ ID NO: 3111691 - RNA, 19 nt, Human
uacaagcgugagccacugc

SEQ ID NO: 3111692 - RNA, 20 nt, Human
uacaagcgugagccacugca

SEQ ID NO: 3111693 - RNA, 18 nt, Human
uaauuuaccugaagucuu

SEQ ID NO: 3111694 - RNA, 17 nt, Human
uaauuuaccugaagucu

SEQ ID NO: 3111695 - RNA, 20 nt, Human
uacccgggaagggggcuggg

SEQ ID NO: 3111696 - RNA, 15 nt, Human
uacccucauguucuu

SEQ ID NO: 3111697 - RNA, 16 nt, Human
uacccucauguucuua

SEQ ID NO: 3111698 - RNA, 20 nt, Human
uacccuggcacuauaaugua

SEQ ID NO: 3111699 - RNA, 22 nt, Human
uacccuggcacuauaauguaag

SEQ ID NO: 3111700 - RNA, 17 nt, Human
uaccacuuuuguucuug

SEQ ID NO: 3111701 - RNA, 17 nt, Human
uaccauccccuguagag

SEQ ID NO: 3111702 - RNA, 16 nt, Human
aauuaacuuuuauaaa

SEQ ID NO: 3111703 - RNA, 18 nt, Human
aauuaacuuuuauaaacu

SEQ ID NO: 3111704 - RNA, 20 nt, Human
aauuaacuuuuauaaacuuu

SEQ ID NO: 3111705 - RNA, 22 nt, Human
aauuaacuuuuauaaacuuuac

SEQ ID NO: 3111706 - RNA, 21 nt, Human
aauguacagcaaggagauuua

SEQ ID NO: 3111707 - RNA, 23 nt, Human
aauguacagcaaggagauuuaca

SEQ ID NO: 3111708 - RNA, 22 nt, Human
uacagcaaggagauuuacaacu

SEQ ID NO: 3111709 - RNA, 16 nt, Human
aaugguuuucuugugu

SEQ ID NO: 3111710 - RNA, 22 nt, Human
aaugguuuucuuguguguuuau

SEQ ID NO: 3111711 - RNA, 18 nt, Human
aaugguuuucuugugugu

SEQ ID NO: 3111712 - RNA, 17 nt, Human
aaugguuuucuugugug

SEQ ID NO: 3111713 - RNA, 13 nt, Human
aauguaagcucua

SEQ ID NO: 3111714 - RNA, 15 nt, Human
aauguaagcucuacu

SEQ ID NO: 3111715 - RNA, 18 nt, Human
uacaguccucccaucuca

SEQ ID NO: 3111716 - RNA, 17 nt, Human
uacaguccucccaucuc

SEQ ID NO: 3111717 - RNA, 15 nt, Human
uacaguccucccauc

SEQ ID NO: 3111718 - RNA, 12 nt, Human
uacaguccuccc

SEQ ID NO: 3111719 - RNA, 18 nt, Human
uacaguaucucagggccu

SEQ ID NO: 3111720 - RNA, 13 nt, Human
aaugucacaggca

SEQ ID NO: 3111721 - RNA, 14 nt, Human
aaugucacaggcag

SEQ ID NO: 3111722 - RNA, 22 nt, Human
aaugugaaacuggauuaaacuu

SEQ ID NO: 3111723 - RNA, 15 nt, Human
aaaaaauauuuuccu

SEQ ID NO: 3111724 - RNA, 16 nt, Human
aaaggcuccaggagca

SEQ ID NO: 3111725 - RNA, 15 nt, Human
aaaggcuccaggagc

SEQ ID NO: 3111726 - RNA, 20 nt, Human
aaaggcuccaggagcagcca

SEQ ID NO: 3111727 - RNA, 19 nt, Human
aaaggcuccaggagcagcc

SEQ ID NO: 3111728 - RNA, 13 nt, Human
aaaguggaaaaau

SEQ ID NO: 3111729 - RNA, 13 nt, Human
aaauaaaacuuuu

SEQ ID NO: 3111730 - RNA, 16 nt, Human
aaauaaaacuuuuuaa

SEQ ID NO: 3111731 - RNA, 19 nt, Human
aaauaaaacuuuuuaaaau

SEQ ID NO: 3111732 - RNA, 19 nt, Human
aaauaguggugugauuugg

SEQ ID NO: 3111733 - RNA, 24 nt, Human
aaauagcucaggugucccugcacu

SEQ ID NO: 3111734 - RNA, 18 nt, Human
aaaucugcuuuuuaaaga

SEQ ID NO: 3111735 - RNA, 15 nt, Human
aaaaagaaaggaggg

SEQ ID NO: 3111736 - RNA, 16 nt, Human
aaaauaaaacuuuuua

SEQ ID NO: 3111737 - RNA, 17 nt, Human
aaaauaaaacuuuuuaa

SEQ ID NO: 3111738 - RNA, 22 nt, Human
aaaaucccuuaccucggugccu

SEQ ID NO: 3111739 - RNA, 19 nt, Human
aaaaucucaaauuucuaaa

SEQ ID NO: 3111740 - RNA, 22 nt, Human
aaaaucucaaauuucuaaaucu

SEQ ID NO: 3111741 - RNA, 16 nt, Human
aaacacuguucucugc

SEQ ID NO: 3111742 - RNA, 13 nt, Human
aaacucuccucug

SEQ ID NO: 3111743 - RNA, 18 nt, Human
aaacucuccucugcugcu

SEQ ID NO: 3111744 - RNA, 18 nt, Human
aaaccaucauugaaaucu

SEQ ID NO: 3111745 - RNA, 12 nt, Human
aaagauauuuug

SEQ ID NO: 3111746 - RNA, 16 nt, Human
aaagauauuuugcuuu

SEQ ID NO: 3111747 - RNA, 17 nt, Human
aaagauauuuugcuuug

SEQ ID NO: 3111748 - RNA, 14 nt, Human
aaagaguaggaaga

SEQ ID NO: 3111749 - RNA, 14 nt, Human
aacugauaaagaug

SEQ ID NO: 3111750 - RNA, 19 nt, Human
aacuuaaauaaugugaaac

SEQ ID NO: 3111751 - RNA, 18 nt, Human
aacuuaaucuaaauggaa

SEQ ID NO: 3111752 - RNA, 15 nt, Human
aacuuaaucuaaaug

SEQ ID NO: 3111753 - RNA, 16 nt, Human
aacuuaaucuaaaugg

SEQ ID NO: 3111754 - RNA, 21 nt, Human
aaauucuugcaaaguaucccu

SEQ ID NO: 3111755 - RNA, 18 nt, Human
aaauucuugcaaaguauc

SEQ ID NO: 3111756 - RNA, 23 nt, Human
aaaugccuuacccucauguucuu

SEQ ID NO: 3111757 - RNA, 15 nt, Human
aaccacuucagcuga

SEQ ID NO: 3111758 - RNA, 13 nt, Human
aaccacgcuggac

SEQ ID NO: 3111759 - RNA, 22 nt, Human
aauacucuacccucuuagaaaa

SEQ ID NO: 3111760 - RNA, 20 nt, Human
aauacucuacccucuuagaa

SEQ ID NO: 3111761 - RNA, 13 nt, Human
aauagacaauuua

SEQ ID NO: 3111762 - RNA, 14 nt, Human
aaucaccgaaaacg

SEQ ID NO: 3111763 - RNA, 16 nt, Human
aaugauuaauuaaaac

SEQ ID NO: 3111764 - RNA, 17 nt, Human
aaucucaaauuucuaaa

SEQ ID NO: 3111765 - RNA, 18 nt, Human
aaucucaaauuucuaaau

SEQ ID NO: 3111766 - RNA, 19 nt, Human
aauccagacccggcugcgu

SEQ ID NO: 3111767 - RNA, 17 nt, Human
aauccagacccggcugc

SEQ ID NO: 3111768 - RNA, 16 nt, Human
aaucucaaauuucuaa

SEQ ID NO: 3111769 - RNA, 15 nt, Human
aaucucaaauuucua

SEQ ID NO: 3111770 - RNA, 23 nt, Human
aaugccuuacccucauguucuua

SEQ ID NO: 3111771 - RNA, 18 nt, Human
aaugcgugcauaccacuu

SEQ ID NO: 3111772 - RNA, 19 nt, Human
aaugcgugcauaccacuuu

SEQ ID NO: 3111773 - RNA, 15 nt, Human
aaugugaaaagaaaa

SEQ ID NO: 3111774 - RNA, 15 nt, Human
aauguuugccucugc

SEQ ID NO: 3111775 - RNA, 21 nt, Human
aaguggaaaaauagccugccu

SEQ ID NO: 3111776 - RNA, 19 nt, Human
aaguggaaaaauagccugc

SEQ ID NO: 3111777 - RNA, 18 nt, Human
aaggucauuuuuuuuaag

SEQ ID NO: 3111778 - RNA, 19 nt, Human
aaggucauuuuuuuuaaga

SEQ ID NO: 3111779 - RNA, 18 nt, Human
aaguccucuuuucugaga

SEQ ID NO: 3111780 - RNA, 22 nt, Human
aaguccucuuuucugagaggac

SEQ ID NO: 3111781 - RNA, 17 nt, Human
aaguaucccuacuguaa

SEQ ID NO: 3111782 - RNA, 18 nt, Human
aaguaucccuacuguaau

SEQ ID NO: 3111783 - RNA, 23 nt, Human
aaguaucccuacuguaauuugug

SEQ ID NO: 3111784 - RNA, 21 nt, Human
aaguagaagucuuagauguau

SEQ ID NO: 3111785 - RNA, 19 nt, Human
aaguagaagucuuagaugu

SEQ ID NO: 3111786 - RNA, 20 nt, Human
aaguagaagucuuagaugua

SEQ ID NO: 3111787 - RNA, 21 nt, Human
aagcgauucuucugcuucagc

SEQ ID NO: 3111788 - RNA, 17 nt, Human
aagcgauucuucugcuu

SEQ ID NO: 3111789 - RNA, 15 nt, Human
aaggauguucuagca

SEQ ID NO: 3111790 - RNA, 15 nt, Human
aaggauugcuacugu

SEQ ID NO: 3111791 - RNA, 13 nt, Human
aaggacacuagaa

SEQ ID NO: 3111792 - RNA, 15 nt, Human
aagcugggcagguug

SEQ ID NO: 3111793 - RNA, 18 nt, Human
aagcuggucccacucagu

SEQ ID NO: 3111794 - RNA, 21 nt, Human
aagcuggucccacucagucca

SEQ ID NO: 3111795 - RNA, 12 nt, Human
aagauaaaugug

SEQ ID NO: 3111796 - RNA, 23 nt, Human
aagauacaguuacucagaauucu

SEQ ID NO: 3111797 - RNA, 13 nt, Human
aagauaaaugugc

SEQ ID NO: 3111798 - RNA, 23 nt, Human
aagccagcaggcucucaggccag

SEQ ID NO: 3111799 - RNA, 20 nt, Human
aagccagcaggcucucaggc

SEQ ID NO: 3111800 - RNA, 21 nt, Human
aagcagcguuucuaugacaca

SEQ ID NO: 3111801 - RNA, 22 nt, Human
aagcagcguuucuaugacacau

SEQ ID NO: 3111802 - RNA, 19 nt, Human
aagccagcaggcucucagg

SEQ ID NO: 3111803 - RNA, 17 nt, Human
aagcagcguuucuauga

SEQ ID NO: 3111804 - RNA, 20 nt, Human
aagcagcguuucuaugacac

SEQ ID NO: 3111805 - RNA, 14 nt, Human
aagcagcguuucua

SEQ ID NO: 3111806 - RNA, 13 nt, Human
acucaaaagcugg

SEQ ID NO: 3111807 - RNA, 19 nt, Human
acucaguccauagcagaga

SEQ ID NO: 3111808 - RNA, 19 nt, Human
acucugucgcccagucugg

SEQ ID NO: 3111809 - RNA, 21 nt, Human
acucuaucaaguauuauaccu

SEQ ID NO: 3111810 - RNA, 23 nt, Human
acucuaucaaguauuauaccuuu

SEQ ID NO: 3111811 - RNA, 17 nt, Human
acucuagggaaaaacca

SEQ ID NO: 3111812 - RNA, 15 nt, Human
acucuagggaaaaac

SEQ ID NO: 3111813 - RNA, 11 nt, Human
acgugaguccu

SEQ ID NO: 3111814 - RNA, 13 nt, Human
acgucugacaggc

SEQ ID NO: 3111815 - RNA, 14 nt, Human
acgucugacaggca

SEQ ID NO: 3111816 - RNA, 11 nt, Human
acgcugugcug

SEQ ID NO: 3111817 - RNA, 14 nt, Human
acgcugugcugccc

SEQ ID NO: 3111818 - RNA, 12 nt, Human
acgcugugcugc

SEQ ID NO: 3111819 - RNA, 21 nt, Human
accucugcagcaauaaagcag

SEQ ID NO: 3111820 - RNA, 23 nt, Human
accucugccugaagucacacagu

SEQ ID NO: 3111821 - RNA, 18 nt, Human
accucugcagcaauaaag

SEQ ID NO: 3111822 - RNA, 20 nt, Human
accucugcagcaauaaagca

SEQ ID NO: 3111823 - RNA, 15 nt, Human
accucugcagcaaua

SEQ ID NO: 3111824 - RNA, 18 nt, Human
accuuggcugcagggagu

SEQ ID NO: 3111825 - RNA, 14 nt, Human
accuuggcugcagg

SEQ ID NO: 3111826 - RNA, 17 nt, Human
accuuggcugcagggag

SEQ ID NO: 3111827 - RNA, 13 nt, Human
accuuucccaucu

SEQ ID NO: 3111828 - RNA, 18 nt, Human
accuuucccaucuuccaa

SEQ ID NO: 3111829 - RNA, 15 nt, Human
accuuuaagagaaau

SEQ ID NO: 3111830 - RNA, 16 nt, Human
accugucccccugaca

SEQ ID NO: 3111831 - RNA, 15 nt, Human
accugucccccugac

SEQ ID NO: 3111832 - RNA, 12 nt, Human
accugucccccu

SEQ ID NO: 3111833 - RNA, 23 nt, Human
acuucacauauugauuuccguua

SEQ ID NO: 3111834 - RNA, 16 nt, Human
acuugguuuuuaaaaa

SEQ ID NO: 3111835 - RNA, 18 nt, Human
acuucuuauacauuugau

SEQ ID NO: 3111836 - RNA, 15 nt, Human
acuugggccacugug

SEQ ID NO: 3111837 - RNA, 14 nt, Human
acuugggccacugu

SEQ ID NO: 3111838 - RNA, 20 nt, Human
acugugcugagucugaaggc

SEQ ID NO: 3111839 - RNA, 16 nt, Human
acuggaagcacagcuu

SEQ ID NO: 3111840 - RNA, 19 nt, Human
acuggaagcacagcuucau

SEQ ID NO: 3111841 - RNA, 17 nt, Human
acuggaagcacagcuuc

SEQ ID NO: 3111842 - RNA, 15 nt, Human
acuggagaaaaugga

SEQ ID NO: 3111843 - RNA, 14 nt, Human
acuggagaaaaugg

SEQ ID NO: 3111844 - RNA, 18 nt, Human
acugguuccauggccucu

SEQ ID NO: 3111845 - RNA, 16 nt, Human
acugugaagagaacca

SEQ ID NO: 3111846 - RNA, 19 nt, Human
agaaaauaguggugugauu

SEQ ID NO: 3111847 - RNA, 14 nt, Human
acuuuucuuugugg

SEQ ID NO: 3111848 - RNA, 16 nt, Human
acuuuucuuucagcca

SEQ ID NO: 3111849 - RNA, 20 nt, Human
acuuuucauaaccuagccuu

SEQ ID NO: 3111850 - RNA, 19 nt, Human
acuuuguucuggcucuucc

SEQ ID NO: 3111851 - RNA, 13 nt, Human
acuuuuauaaacu

SEQ ID NO: 3111852 - RNA, 17 nt, Human
acuuuguucuggcucuu

SEQ ID NO: 3111853 - RNA, 16 nt, Human
acuuuguucuggcucu

SEQ ID NO: 3111854 - RNA, 22 nt, Human
agaaaguacuucuccacccugc

SEQ ID NO: 3111855 - RNA, 23 nt, Human
agaaaguacuucuccacccugcu

SEQ ID NO: 3111856 - RNA, 20 nt, Human
acacagcucuguccugggag

SEQ ID NO: 3111857 - RNA, 14 nt, Human
acacagcucugucc

SEQ ID NO: 3111858 - RNA, 19 nt, Human
acacagaggcugccucucc

SEQ ID NO: 3111859 - RNA, 21 nt, Human
acacauuuuauuuuauuaugc

SEQ ID NO: 3111860 - RNA, 22 nt, Human
acacauuuuauuuuauuaugca

SEQ ID NO: 3111861 - RNA, 11 nt, Human
acacagcucuu

SEQ ID NO: 3111862 - RNA, 13 nt, Human
acacagcucuucu

SEQ ID NO: 3111863 - RNA, 20 nt, Human
acacauuuuuuaaaugcacc

SEQ ID NO: 3111864 - RNA, 22 nt, Human
acacauuuuuuaaaugcaccug

SEQ ID NO: 3111865 - RNA, 19 nt, Human
acacauuuuuuaaaugcac

SEQ ID NO: 3111866 - RNA, 15 nt, Human
acacgcgugcacaca

SEQ ID NO: 3111867 - RNA, 17 nt, Human
acacgcgugcacacacc

SEQ ID NO: 3111868 - RNA, 20 nt, Human
acaaggcaaggcugucaauu

SEQ ID NO: 3111869 - RNA, 17 nt, Human
acaaggauugcuacugu

SEQ ID NO: 3111870 - RNA, 14 nt, Human
acaaggcaaggcug

SEQ ID NO: 3111871 - RNA, 12 nt, Human
acaaggcaaggc

SEQ ID NO: 3111872 - RNA, 22 nt, Human
acaaaauguaggguuauaauaa

SEQ ID NO: 3111873 - RNA, 20 nt, Human
acaaaauguaggguuauaau

SEQ ID NO: 3111874 - RNA, 16 nt, Human
aauuuugugcccccau

SEQ ID NO: 3111875 - RNA, 14 nt, Human
acacugcauguuug

SEQ ID NO: 3111876 - RNA, 15 nt, Human
acacugcauguuugu

SEQ ID NO: 3111877 - RNA, 19 nt, Human
acagaggcagccccauucu

SEQ ID NO: 3111878 - RNA, 23 nt, Human
acagaggccaugggccuccugug

SEQ ID NO: 3111879 - RNA, 13 nt, Human
acagacacaggcc

SEQ ID NO: 3111880 - RNA, 14 nt, Human
acagacacaggccc

SEQ ID NO: 3111881 - RNA, 14 nt, Human
acagaggcagcccc

SEQ ID NO: 3111882 - RNA, 15 nt, Human
acagaggcagcccca

SEQ ID NO: 3111883 - RNA, 15 nt, Human
acacuguacugcaau

SEQ ID NO: 3111884 - RNA, 11 nt, Human
acagacacagg

SEQ ID NO: 3111885 - RNA, 23 nt, Human
acagagucucacuguugcccagg

SEQ ID NO: 3111886 - RNA, 15 nt, Human
acagagugagacucu

SEQ ID NO: 3111887 - RNA, 19 nt, Human
acagagugagacucugucu

SEQ ID NO: 3111888 - RNA, 18 nt, Human
acagccacggccaggcca

SEQ ID NO: 3111889 - RNA, 16 nt, Human
acagccacggccaggc

SEQ ID NO: 3111890 - RNA, 17 nt, Human
acagccacggccaggcc

SEQ ID NO: 3111891 - RNA, 15 nt, Human
acagccacggccagg

SEQ ID NO: 3111892 - RNA, 17 nt, Human
acagcucuguccuggga

SEQ ID NO: 3111893 - RNA, 16 nt, Human
acagcucuucuccagg

SEQ ID NO: 3111894 - RNA, 17 nt, Human
acagcucuucuccaggc

SEQ ID NO: 3111895 - RNA, 15 nt, Human
acaggaucagucuga

SEQ ID NO: 3111896 - RNA, 18 nt, Human
acaggcaaugcuggcugu

SEQ ID NO: 3111897 - RNA, 12 nt, Human
acaggcaagcac

SEQ ID NO: 3111898 - RNA, 14 nt, Human
acaggauuauugga

SEQ ID NO: 3111899 - RNA, 16 nt, Human
acccaccucagccucc

SEQ ID NO: 3111900 - RNA, 11 nt, Human
acccccugaau

SEQ ID NO: 3111901 - RNA, 20 nt, Human
accauauuaccacagacaua

SEQ ID NO: 3111902 - RNA, 18 nt, Human
acccaagggccuggccug

SEQ ID NO: 3111903 - RNA, 22 nt, Human
acccaagggccuggccugagcu

SEQ ID NO: 3111904 - RNA, 19 nt, Human
acccaagggccuggccuga

SEQ ID NO: 3111905 - RNA, 13 nt, Human
acccaccucagcc

SEQ ID NO: 3111906 - RNA, 14 nt, Human
acccaccucagccu

SEQ ID NO: 3111907 - RNA, 15 nt, Human
acccaccucagccuc

SEQ ID NO: 3111908 - RNA, 14 nt, Human
accauauuaccaca

SEQ ID NO: 3111909 - RNA, 16 nt, Human
accauauuaccacaga

SEQ ID NO: 3111910 - RNA, 16 nt, Human
accccuccaugugggc

SEQ ID NO: 3111911 - RNA, 19 nt, Human
accccuccaugugggcuag

SEQ ID NO: 3111912 - RNA, 20 nt, Human
accccucaacaccucugcac

SEQ ID NO: 3111913 - RNA, 23 nt, Human
acauaaugcgugcauaccacuuu

SEQ ID NO: 3111914 - RNA, 22 nt, Human
acauaaugcgugcauaccacuu

SEQ ID NO: 3111915 - RNA, 21 nt, Human
acauaaugcgugcauaccacu

SEQ ID NO: 3111916 - RNA, 19 nt, Human
acaggguuuugccauguug

SEQ ID NO: 3111917 - RNA, 19 nt, Human
acaggcaaugcuggcuguu

SEQ ID NO: 3111918 - RNA, 23 nt, Human
acaggcaaugcuggcuguuggcu

SEQ ID NO: 3111919 - RNA, 19 nt, Human
acaugaucuucuuuauaau

SEQ ID NO: 3111920 - RNA, 18 nt, Human
acaucagcacgauuucug

SEQ ID NO: 3111921 - RNA, 15 nt, Human
acaucagcacgauuu

SEQ ID NO: 3111922 - RNA, 17 nt, Human
acaucagcacgauuucu

SEQ ID NO: 3111923 - RNA, 16 nt, Human
acaugugcacaugcac

SEQ ID NO: 3111924 - RNA, 18 nt, Human
acaugugcacaugcacgu

SEQ ID NO: 3111925 - RNA, 14 nt, Human
acauuuauucugcu

SEQ ID NO: 3111926 - RNA, 15 nt, Human
acauuuauucugcuc

SEQ ID NO: 3111927 - RNA, 13 nt, Human
accagcagaaaug

SEQ ID NO: 3111928 - RNA, 17 nt, Human
accagccaguaaauggg

SEQ ID NO: 3111929 - RNA, 19 nt, Human
accagagcugccaccugcc

SEQ ID NO: 3111930 - RNA, 23 nt, Human
agcugcgguccacccaggagccc

SEQ ID NO: 3111931 - RNA, 13 nt, Human
agcuccuucuguc

SEQ ID NO: 3111932 - RNA, 12 nt, Human
agcuccuucugu

SEQ ID NO: 3111933 - RNA, 20 nt, Human
agcuccgcuuucuacccagc

SEQ ID NO: 3111934 - RNA, 21 nt, Human
agcuccgcuuucuacccagcg

SEQ ID NO: 3111935 - RNA, 23 nt, Human
agcuccgcuuucuacccagcgag

SEQ ID NO: 3111936 - RNA, 21 nt, Human
agcugcgguccacccaggagc

SEQ ID NO: 3111937 - RNA, 17 nt, Human
aggaauccagacccggc

SEQ ID NO: 3111938 - RNA, 21 nt, Human
aggaaucaugugccaagcaga

SEQ ID NO: 3111939 - RNA, 14 nt, Human
aggauuauuggaaa

SEQ ID NO: 3111940 - RNA, 15 nt, Human
aggauguucugggac

SEQ ID NO: 3111941 - RNA, 16 nt, Human
aggauguucugggaca

SEQ ID NO: 3111942 - RNA, 22 nt, Human
aggauguucuagcauggcugcc

SEQ ID NO: 3111943 - RNA, 13 nt, Human
aggaccucaggug

SEQ ID NO: 3111944 - RNA, 21 nt, Human
aggaugcuuguacauaaugcg

SEQ ID NO: 3111945 - RNA, 23 nt, Human
aggaugcuuguacauaaugcgug

SEQ ID NO: 3111946 - RNA, 23 nt, Human
agggacagaggggguggccuccc

SEQ ID NO: 3111947 - RNA, 21 nt, Human
aggcugucaauuacaggaagu

SEQ ID NO: 3111948 - RNA, 22 nt, Human
agggacagaggggguggccucc

SEQ ID NO: 3111949 - RNA, 13 nt, Human
aggcuguauccca

SEQ ID NO: 3111950 - RNA, 18 nt, Human
aggcuguaucccaugagc

SEQ ID NO: 3111951 - RNA, 19 nt, Human
aggcugucaauuacaggaa

SEQ ID NO: 3111952 - RNA, 20 nt, Human
aggcugucaauuacaggaag

SEQ ID NO: 3111953 - RNA, 23 nt, Human
aggcccuucucuccagccccugg

SEQ ID NO: 3111954 - RNA, 22 nt, Human
aggcccuucucuccagccccug

SEQ ID NO: 3111955 - RNA, 21 nt, Human
aggcccuucucuccagccccu

SEQ ID NO: 3111956 - RNA, 20 nt, Human
aggcccuucucuccagcccc

SEQ ID NO: 3111957 - RNA, 11 nt, Human
agggucccugg

SEQ ID NO: 3111958 - RNA, 19 nt, Human
aggguaucaggugcugcca

SEQ ID NO: 3111959 - RNA, 18 nt, Human
aggguaucaggugcugcc

SEQ ID NO: 3111960 - RNA, 21 nt, Human
aggguaucaggugcugccauc

SEQ ID NO: 3111961 - RNA, 21 nt, Human
aggggccucuuaugggcuggg

SEQ ID NO: 3111962 - RNA, 20 nt, Human
aggggccucuuaugggcugg

SEQ ID NO: 3111963 - RNA, 19 nt, Human
aggggccucuuaugggcug

SEQ ID NO: 3111964 - RNA, 23 nt, Human
agguucccuuugacgccauccca

SEQ ID NO: 3111965 - RNA, 14 nt, Human
agguucaaagauau

SEQ ID NO: 3111966 - RNA, 13 nt, Human
agguucccuuuga

SEQ ID NO: 3111967 - RNA, 22 nt, Human
agguucccuuugacgccauccc

SEQ ID NO: 3111968 - RNA, 22 nt, Human
aggugcuaggaacacuccuuca

SEQ ID NO: 3111969 - RNA, 19 nt, Human
aggugcuaggaacacuccu

SEQ ID NO: 3111970 - RNA, 23 nt, Human
aggugcuaggaacacuccuucac

SEQ ID NO: 3111971 - RNA, 22 nt, Human
aggucuguucuuuccaaaguac

SEQ ID NO: 3111972 - RNA, 23 nt, Human
aggucuguucuuuccaaaguaca

SEQ ID NO: 3111973 - RNA, 18 nt, Human
aggucuguucuuuccaaa

SEQ ID NO: 3111974 - RNA, 23 nt, Human
aggguuuugccauguuggccagg

SEQ ID NO: 3111975 - RNA, 13 nt, Human
agccccauucugc

SEQ ID NO: 3111976 - RNA, 16 nt, Human
agccccauucugccug

SEQ ID NO: 3111977 - RNA, 21 nt, Human
agcccgggcucugccucccau

SEQ ID NO: 3111978 - RNA, 13 nt, Human
agccccagugccc

SEQ ID NO: 3111979 - RNA, 14 nt, Human
agccccagugccca

SEQ ID NO: 3111980 - RNA, 15 nt, Human
agccccagugcccac

SEQ ID NO: 3111981 - RNA, 20 nt, Human
agccagcaggcucucaggcc

SEQ ID NO: 3111982 - RNA, 17 nt, Human
agccagcaggcucucag

SEQ ID NO: 3111983 - RNA, 19 nt, Human
agccagcaggcucucaggc

SEQ ID NO: 3111984 - RNA, 18 nt, Human
agccagcaggcucucagg

SEQ ID NO: 3111985 - RNA, 22 nt, Human
agccucccacgacugcccggca

SEQ ID NO: 3111986 - RNA, 21 nt, Human
agccucccaaagugcugggau

SEQ ID NO: 3111987 - RNA, 20 nt, Human
agccucccaaagugcuggga

SEQ ID NO: 3111988 - RNA, 14 nt, Human
agccuccuccagcc

SEQ ID NO: 3111989 - RNA, 20 nt, Human
agccucccgaguagcuggga

SEQ ID NO: 3111990 - RNA, 18 nt, Human
agccucccgaguagcugg

SEQ ID NO: 3111991 - RNA, 19 nt, Human
agccucccgaguagcuggg

SEQ ID NO: 3111992 - RNA, 21 nt, Human
agccgccaugcuccuggccca

SEQ ID NO: 3111993 - RNA, 13 nt, Human
agccgcuggggcc

SEQ ID NO: 3111994 - RNA, 13 nt, Human
agcagcguuucua

SEQ ID NO: 3111995 - RNA, 20 nt, Human
agcagugcaugcugucccuu

SEQ ID NO: 3111996 - RNA, 19 nt, Human
agcagugcaugcugucccu

SEQ ID NO: 3111997 - RNA, 18 nt, Human
agcagugcaugcuguccc

SEQ ID NO: 3111998 - RNA, 23 nt, Human
agcacacuugacaucaacugcau

SEQ ID NO: 3111999 - RNA, 17 nt, Human
agcacagacccugcccu

SEQ ID NO: 3112000 - RNA, 20 nt, Human
agcacagacccugcccugug

SEQ ID NO: 3112001 - RNA, 19 nt, Human
agcacagacccugcccugu

SEQ ID NO: 3112002 - RNA, 18 nt, Human
agcacagacccugcccug

SEQ ID NO: 3112003 - RNA, 18 nt, Human
agcauccuggcacccggc

SEQ ID NO: 3112004 - RNA, 22 nt, Human
agcauccuggcacccggccccu

SEQ ID NO: 3112005 - RNA, 23 nt, Human
agcauccuggcacccggccccug

SEQ ID NO: 3112006 - RNA, 23 nt, Human
agcaugccuggauggggcugcac

SEQ ID NO: 3112007 - RNA, 20 nt, Human
agcaugccuggauggggcug

SEQ ID NO: 3112008 - RNA, 23 nt, Human
agccaagugugguagagugugcc

SEQ ID NO: 3112009 - RNA, 19 nt, Human
agacuggaagcacagcuuc

SEQ ID NO: 3112010 - RNA, 17 nt, Human
agacuggaagcacagcu

SEQ ID NO: 3112011 - RNA, 16 nt, Human
agacuggaagcacagc

SEQ ID NO: 3112012 - RNA, 19 nt, Human
agagcccaccuuggcucaa

SEQ ID NO: 3112013 - RNA, 13 nt, Human
agagcccacgccc

SEQ ID NO: 3112014 - RNA, 16 nt, Human
agagcccacgccccca

SEQ ID NO: 3112015 - RNA, 13 nt, Human
agagcccaccuug

SEQ ID NO: 3112016 - RNA, 22 nt, Human
agagaggguggugaccucugcc

SEQ ID NO: 3112017 - RNA, 20 nt, Human
agagaggguggugaccucug

SEQ ID NO: 3112018 - RNA, 21 nt, Human
agagaggguggugaccucugc

SEQ ID NO: 3112019 - RNA, 23 nt, Human
agagagcaagacgcugugcugcc

SEQ ID NO: 3112020 - RNA, 23 nt, Human
agacagagucucacuguugccca

SEQ ID NO: 3112021 - RNA, 15 nt, Human
agacagcccgggcuc

SEQ ID NO: 3112022 - RNA, 14 nt, Human
agacagcccgggcu

SEQ ID NO: 3112023 - RNA, 12 nt, Human
agacagcugccu

SEQ ID NO: 3112024 - RNA, 12 nt, Human
agacagcucuua

SEQ ID NO: 3112025 - RNA, 11 nt, Human
agacagcucuu

SEQ ID NO: 3112026 - RNA, 21 nt, Human
agacgcugugcugcccugccc

SEQ ID NO: 3112027 - RNA, 22 nt, Human
agacgcugugcugcccugccca

SEQ ID NO: 3112028 - RNA, 20 nt, Human
agacgcugugcugcccugcc

SEQ ID NO: 3112029 - RNA, 19 nt, Human
agauauaugcucugcaugu

SEQ ID NO: 3112030 - RNA, 14 nt, Human
agaucuucuguggg

SEQ ID NO: 3112031 - RNA, 14 nt, Human
agagcccaggccuc

SEQ ID NO: 3112032 - RNA, 13 nt, Human
agagcccaggccu

SEQ ID NO: 3112033 - RNA, 15 nt, Human
agagcccaggccucc

SEQ ID NO: 3112034 - RNA, 16 nt, Human
agaggaaggagaggag

SEQ ID NO: 3112035 - RNA, 21 nt, Human
agaggaaaucaccgaaaacgu

SEQ ID NO: 3112036 - RNA, 23 nt, Human
agaggacuuuucuuuguggcuuc

SEQ ID NO: 3112037 - RNA, 16 nt, Human
agaggagagaggaccc

SEQ ID NO: 3112038 - RNA, 15 nt, Human
agaggagagaggacc

SEQ ID NO: 3112039 - RNA, 11 nt, Human
agagugggagc

SEQ ID NO: 3112040 - RNA, 19 nt, Human
agaguggggauaugauuua

SEQ ID NO: 3112041 - RNA, 14 nt, Human
agagugugccugaa

SEQ ID NO: 3112042 - RNA, 19 nt, Human
agaggguggugaccucugc

SEQ ID NO: 3112043 - RNA, 20 nt, Human
agaggguggugaccucugcc

SEQ ID NO: 3112044 - RNA, 22 nt, Human
agaggguggugaccucugccug

SEQ ID NO: 3112045 - RNA, 12 nt, Human
agagggcacaga

SEQ ID NO: 3112046 - RNA, 23 nt, Human
augaccuuucaauaggaaaaacu

SEQ ID NO: 3112047 - RNA, 22 nt, Human
augaccuuucaauaggaaaaac

SEQ ID NO: 3112048 - RNA, 18 nt, Human
augaccuuucaauaggaa

SEQ ID NO: 3112049 - RNA, 21 nt, Human
augaccuuucaauaggaaaaa

SEQ ID NO: 3112050 - RNA, 13 nt, Human
augaaagacugua

SEQ ID NO: 3112051 - RNA, 16 nt, Human
augaaagacuguacaa

SEQ ID NO: 3112052 - RNA, 17 nt, Human
augaaagacuguacaaa

SEQ ID NO: 3112053 - RNA, 22 nt, Human
aucugcuuuuuaaagaaugcuc

SEQ ID NO: 3112054 - RNA, 21 nt, Human
aucucccccagccccauccuc

SEQ ID NO: 3112055 - RNA, 14 nt, Human
aucuucuuuauaau

SEQ ID NO: 3112056 - RNA, 18 nt, Human
aucuugaagacuuuucuu

SEQ ID NO: 3112057 - RNA, 22 nt, Human
aucuucugaacuuggcgcugcc

SEQ ID NO: 3112058 - RNA, 20 nt, Human
auccucccaccucagccucc

SEQ ID NO: 3112059 - RNA, 18 nt, Human
auccucccaccucagccu

SEQ ID NO: 3112060 - RNA, 19 nt, Human
auccucccaccucagccuc

SEQ ID NO: 3112061 - RNA, 15 nt, Human
auccccuguagagug

SEQ ID NO: 3112062 - RNA, 15 nt, Human
auccucccaccucag

SEQ ID NO: 3112063 - RNA, 23 nt, Human
auccuccaggugcacaagcucca

SEQ ID NO: 3112064 - RNA, 23 nt, Human
auccucauacccacccccaccca

SEQ ID NO: 3112065 - RNA, 11 nt, Human
auccuccaggu

SEQ ID NO: 3112066 - RNA, 15 nt, Human
aucccauuuaaaaaa

SEQ ID NO: 3112067 - RNA, 14 nt, Human
aucccauuuaaaaa

SEQ ID NO: 3112068 - RNA, 15 nt, Human
auccagacccggcug

SEQ ID NO: 3112069 - RNA, 13 nt, Human
aucacagccucug

SEQ ID NO: 3112070 - RNA, 21 nt, Human
aucacagccucugaaaaccaa

SEQ ID NO: 3112071 - RNA, 18 nt, Human
aucaccaacgucugugcc

SEQ ID NO: 3112072 - RNA, 23 nt, Human
aucacccgcuaagagggagggag

SEQ ID NO: 3112073 - RNA, 19 nt, Human
aucaccaacgucugugcca

SEQ ID NO: 3112074 - RNA, 23 nt, Human
aucagcacgauuucuguuuagau

SEQ ID NO: 3112075 - RNA, 19 nt, Human
aucagcacgauuucuguuu

SEQ ID NO: 3112076 - RNA, 20 nt, Human
aucagcacgauuucuguuua

SEQ ID NO: 3112077 - RNA, 14 nt, Human
aucaccgaaaacgu

SEQ ID NO: 3112078 - RNA, 21 nt, Human
aucaccgaaaacguggcugcu

SEQ ID NO: 3112079 - RNA, 19 nt, Human
aucaccgaaaacguggcug

SEQ ID NO: 3112080 - RNA, 18 nt, Human
aucagccugcuccagcug

SEQ ID NO: 3112081 - RNA, 17 nt, Human
aucagccugcuccagcu

SEQ ID NO: 3112082 - RNA, 19 nt, Human
aucagccugcuccagcugu

SEQ ID NO: 3112083 - RNA, 11 nt, Human
augcugcccug

SEQ ID NO: 3112084 - RNA, 16 nt, Human
augcucuuuacuucau

SEQ ID NO: 3112085 - RNA, 12 nt, Human
augcuuguacau

SEQ ID NO: 3112086 - RNA, 13 nt, Human
augcuuguacaua

SEQ ID NO: 3112087 - RNA, 14 nt, Human
augcuuguacauaa

SEQ ID NO: 3112088 - RNA, 15 nt, Human
auggauuuccagcca

SEQ ID NO: 3112089 - RNA, 15 nt, Human
augcacaaacagagg

SEQ ID NO: 3112090 - RNA, 24 nt, Human
augauguuuuccaugaguccccug

SEQ ID NO: 3112091 - RNA, 17 nt, Human
augaugccaugaggaac

SEQ ID NO: 3112092 - RNA, 16 nt, Human
augaugccaugaggaa

SEQ ID NO: 3112093 - RNA, 23 nt, Human
augcacacauuuuuuaaaugcac

SEQ ID NO: 3112094 - RNA, 16 nt, Human
augcacagaguuguua

SEQ ID NO: 3112095 - RNA, 17 nt, Human
augcacaaacagaggcc

SEQ ID NO: 3112096 - RNA, 16 nt, Human
augcacaaacagaggc

SEQ ID NO: 3112097 - RNA, 17 nt, Human
augcacagaguuguuac

SEQ ID NO: 3112098 - RNA, 19 nt, Human
augccucucucaggccaaa

SEQ ID NO: 3112099 - RNA, 16 nt, Human
augcaugaaguaauau

SEQ ID NO: 3112100 - RNA, 17 nt, Human
augccucucucaggcca

SEQ ID NO: 3112101 - RNA, 19 nt, Human
auggucaccaaaucagcug

SEQ ID NO: 3112102 - RNA, 15 nt, Human
auguaauuaaguacu

SEQ ID NO: 3112103 - RNA, 17 nt, Human
auguaauuaaguacuau

SEQ ID NO: 3112104 - RNA, 14 nt, Human
augucuuuucuugc

SEQ ID NO: 3112105 - RNA, 22 nt, Human
augugaaacuggauuaaacuua

SEQ ID NO: 3112106 - RNA, 11 nt, Human
auguucuggga

SEQ ID NO: 3112107 - RNA, 12 nt, Human
auguucugggac

SEQ ID NO: 3112108 - RNA, 19 nt, Human
auguuugccucugccucug

SEQ ID NO: 3112109 - RNA, 22 nt, Human
auguuugccucugccucugaca

SEQ ID NO: 3112110 - RNA, 18 nt, Human
auguuugccucugccucu

SEQ ID NO: 3112111 - RNA, 13 nt, Human
auguucugggaca

SEQ ID NO: 3112112 - RNA, 15 nt, Human
auaaaacuuuuuaaa

SEQ ID NO: 3112113 - RNA, 11 nt, Human
auaaaacuuuu

SEQ ID NO: 3112114 - RNA, 17 nt, Human
auaaaacuuuuuaaaau

SEQ ID NO: 3112115 - RNA, 21 nt, Human
auaaacuuuaccuuuuuuaua

SEQ ID NO: 3112116 - RNA, 16 nt, Human
auaaacuuuaccuuuu

SEQ ID NO: 3112117 - RNA, 24 nt, Human
auaaacuuuaccuuuuuuauacau

SEQ ID NO: 3112118 - RNA, 13 nt, Human
auaaagcagcguu

SEQ ID NO: 3112119 - RNA, 14 nt, Human
auaaagcagcguuu

SEQ ID NO: 3112120 - RNA, 18 nt, Human
auaaagcagcguuucuau

SEQ ID NO: 3112121 - RNA, 19 nt, Human
auaaagcagcguuucuaug

SEQ ID NO: 3112122 - RNA, 20 nt, Human
auaaagcagcguuucuauga

SEQ ID NO: 3112123 - RNA, 17 nt, Human
auaccugucccccugac

SEQ ID NO: 3112124 - RNA, 18 nt, Human
auaccugucccccugaca

SEQ ID NO: 3112125 - RNA, 11 nt, Human
auacccacccc

SEQ ID NO: 3112126 - RNA, 12 nt, Human
auacccaccccc

SEQ ID NO: 3112127 - RNA, 14 nt, Human
auaauguaagcucu

SEQ ID NO: 3112128 - RNA, 21 nt, Human
auaaugcgugcauaccacuuu

SEQ ID NO: 3112129 - RNA, 20 nt, Human
auaaugcgugcauaccacuu

SEQ ID NO: 3112130 - RNA, 21 nt, Human
auacaccacuacauucuguua

SEQ ID NO: 3112131 - RNA, 19 nt, Human
auacaccacuacauucugu

SEQ ID NO: 3112132 - RNA, 20 nt, Human
auacaccacuacauucuguu

SEQ ID NO: 3112133 - RNA, 18 nt, Human
auacaccacuacauucug

SEQ ID NO: 3112134 - RNA, 15 nt, Human
auaauguaagcucua

SEQ ID NO: 3112135 - RNA, 21 nt, Human
auagccaaggccaaaggaagc

SEQ ID NO: 3112136 - RNA, 15 nt, Human
auagccaaggccaaa

SEQ ID NO: 3112137 - RNA, 17 nt, Human
auaguaugguggcuggg

SEQ ID NO: 3112138 - RNA, 18 nt, Human
auaguaugguggcugggu

SEQ ID NO: 3112139 - RNA, 19 nt, Human
auauuaccacagacauacu

SEQ ID NO: 3112140 - RNA, 22 nt, Human
auauuaccacagacauacuaac

SEQ ID NO: 3112141 - RNA, 21 nt, Human
auaugcuuauacacuuacacu

SEQ ID NO: 3112142 - RNA, 19 nt, Human
auauuuacuucuuauacau

SEQ ID NO: 3112143 - RNA, 15 nt, Human
agugggagcugccug

SEQ ID NO: 3112144 - RNA, 14 nt, Human
agugggagcugccu

SEQ ID NO: 3112145 - RNA, 17 nt, Human
aguguauuuuuuuacua

SEQ ID NO: 3112146 - RNA, 18 nt, Human
aguguauuuuuuuacuaa

SEQ ID NO: 3112147 - RNA, 23 nt, Human
aguggcuuaaaacaacacucaca

SEQ ID NO: 3112148 - RNA, 12 nt, Human
aguuaaauaaau

SEQ ID NO: 3112149 - RNA, 18 nt, Human
aguuacacuaaaagguga

SEQ ID NO: 3112150 - RNA, 16 nt, Human
aguuacagacaaagcg

SEQ ID NO: 3112151 - RNA, 14 nt, Human
aguuacagacaaag

SEQ ID NO: 3112152 - RNA, 22 nt, Human
aguucaucuugaauuguaagga

SEQ ID NO: 3112153 - RNA, 20 nt, Human
aguucagguaacaggcagau

SEQ ID NO: 3112154 - RNA, 18 nt, Human
aguucagguaacaggcag

SEQ ID NO: 3112155 - RNA, 19 nt, Human
aguucagguaacaggcaga

SEQ ID NO: 3112156 - RNA, 20 nt, Human
aguuguuugauucagacagc

SEQ ID NO: 3112157 - RNA, 14 nt, Human
aguugaagacagag

SEQ ID NO: 3112158 - RNA, 15 nt, Human
aguaucucagggccu

SEQ ID NO: 3112159 - RNA, 15 nt, Human
aguaucuugaagacu

SEQ ID NO: 3112160 - RNA, 12 nt, Human
aguaucuugaag

SEQ ID NO: 3112161 - RNA, 11 nt, Human
aguaucuugaa

SEQ ID NO: 3112162 - RNA, 15 nt, Human
aguaugaggcauuug

SEQ ID NO: 3112163 - RNA, 16 nt, Human
aguaugaggcauuugu

SEQ ID NO: 3112164 - RNA, 14 nt, Human
agugaagacaauga

SEQ ID NO: 3112165 - RNA, 16 nt, Human
agugaagacaaugacu

SEQ ID NO: 3112166 - RNA, 16 nt, Human
agucugauucccaagc

SEQ ID NO: 3112167 - RNA, 18 nt, Human
agucugauucccaagcuc

SEQ ID NO: 3112168 - RNA, 17 nt, Human
agucuggaaugcagugg

SEQ ID NO: 3112169 - RNA, 20 nt, Human
agugaacuugggccacugug

SEQ ID NO: 3112170 - RNA, 22 nt, Human
aguccuggcaugggaaugaaug

SEQ ID NO: 3112171 - RNA, 21 nt, Human
aguccuggcaugggaaugaau

SEQ ID NO: 3112172 - RNA, 20 nt, Human
aguccuggcaugggaaugaa

SEQ ID NO: 3112173 - RNA, 15 nt, Human
agucugaaggcuggg

SEQ ID NO: 3112174 - RNA, 13 nt, Human
agucugaaggcug

SEQ ID NO: 3112175 - RNA, 16 nt, Human
agucugaaggcugggu

SEQ ID NO: 3112176 - RNA, 12 nt, Human
agucugaaggcu

SEQ ID NO: 3112177 - RNA, 17 nt, Human
caccccggccaccugcg

SEQ ID NO: 3112178 - RNA, 16 nt, Human
caccccggccaccugc

SEQ ID NO: 3112179 - RNA, 15 nt, Human
caccccggccaccug

SEQ ID NO: 3112180 - RNA, 14 nt, Human
caccccggccaccu

SEQ ID NO: 3112181 - RNA, 22 nt, Human
cacccccacccaagggccuggc

SEQ ID NO: 3112182 - RNA, 13 nt, Human
caccccagcccca

SEQ ID NO: 3112183 - RNA, 12 nt, Human
caccccagcccc

SEQ ID NO: 3112184 - RNA, 12 nt, Human
cacccaccucag

SEQ ID NO: 3112185 - RNA, 13 nt, Human
cacccaccucagc

SEQ ID NO: 3112186 - RNA, 14 nt, Human
cacccaccucagcc

SEQ ID NO: 3112187 - RNA, 16 nt, Human
cacccaccucagccuc

SEQ ID NO: 3112188 - RNA, 20 nt, Human
cacccaccaucaugucuggc

SEQ ID NO: 3112189 - RNA, 22 nt, Human
cacccaccaucaugucuggcua

SEQ ID NO: 3112190 - RNA, 23 nt, Human
cacccaagggccuggccugagcu

SEQ ID NO: 3112191 - RNA, 21 nt, Human
cacccaagggccuggccugag

SEQ ID NO: 3112192 - RNA, 20 nt, Human
cacccaagggccuggccuga

SEQ ID NO: 3112193 - RNA, 19 nt, Human
cacccaagggccuggccug

SEQ ID NO: 3112194 - RNA, 18 nt, Human
cacccaagggccuggccu

SEQ ID NO: 3112195 - RNA, 17 nt, Human
cacccaagggccuggcc

SEQ ID NO: 3112196 - RNA, 16 nt, Human
cacccaagggccuggc

SEQ ID NO: 3112197 - RNA, 21 nt, Human
cacacuugacaucaacugcau

SEQ ID NO: 3112198 - RNA, 22 nt, Human
cacagacccugcccugugggcc

SEQ ID NO: 3112199 - RNA, 16 nt, Human
cacagaguuguuacau

SEQ ID NO: 3112200 - RNA, 17 nt, Human
cacagaguuguuacauu

SEQ ID NO: 3112201 - RNA, 21 nt, Human
cacagagaaaguacuucucca

SEQ ID NO: 3112202 - RNA, 15 nt, Human
cacaccagagcccac

SEQ ID NO: 3112203 - RNA, 12 nt, Human
cacaccagagcc

SEQ ID NO: 3112204 - RNA, 13 nt, Human
cacaccagagccc

SEQ ID NO: 3112205 - RNA, 19 nt, Human
cacacagaggcugccucuc

SEQ ID NO: 3112206 - RNA, 12 nt, Human
cacacagcucug

SEQ ID NO: 3112207 - RNA, 14 nt, Human
cacacaccagagcc

SEQ ID NO: 3112208 - RNA, 18 nt, Human
caauaggaaaaacugauu

SEQ ID NO: 3112209 - RNA, 20 nt, Human
caauaggaaaaacugauuuu

SEQ ID NO: 3112210 - RNA, 21 nt, Human
caauaggaaaaacugauuuuu

SEQ ID NO: 3112211 - RNA, 18 nt, Human
caaugcaaaccaucauug

SEQ ID NO: 3112212 - RNA, 17 nt, Human
caaugcaaaccaucauu

SEQ ID NO: 3112213 - RNA, 14 nt, Human
caaugcaaaccauc

SEQ ID NO: 3112214 - RNA, 23 nt, Human
caaugcacuuuguucuggcucuu

SEQ ID NO: 3112215 - RNA, 22 nt, Human
caaugcacuuuguucuggcucu

SEQ ID NO: 3112216 - RNA, 19 nt, Human
caaugcaaaccaucauuga

SEQ ID NO: 3112217 - RNA, 16 nt, Human
cacaaaaguuucucuu

SEQ ID NO: 3112218 - RNA, 18 nt, Human
cacaaaaguuucucuuuu

SEQ ID NO: 3112219 - RNA, 20 nt, Human
cacagaguuguuacauuuuu

SEQ ID NO: 3112220 - RNA, 18 nt, Human
cacagaugggugcuugga

SEQ ID NO: 3112221 - RNA, 14 nt, Human
cacagaugggugcu

SEQ ID NO: 3112222 - RNA, 20 nt, Human
cacagaugggugcuuggagg

SEQ ID NO: 3112223 - RNA, 16 nt, Human
cacaggcccggcucca

SEQ ID NO: 3112224 - RNA, 17 nt, Human
cacaggcccggcuccag

SEQ ID NO: 3112225 - RNA, 18 nt, Human
cacaggcccggcuccagg

SEQ ID NO: 3112226 - RNA, 19 nt, Human
cacaggcccggcuccaggc

SEQ ID NO: 3112227 - RNA, 10 nt, Human
cacaggcagg

SEQ ID NO: 3112228 - RNA, 12 nt, Human
cacaggaucagu

SEQ ID NO: 3112229 - RNA, 15 nt, Human
cacaggaucagucug

SEQ ID NO: 3112230 - RNA, 16 nt, Human
cacaggaucagucuga

SEQ ID NO: 3112231 - RNA, 19 nt, Human
cacagugagucgaggacag

SEQ ID NO: 3112232 - RNA, 20 nt, Human
cacagugagucgaggacagg

SEQ ID NO: 3112233 - RNA, 18 nt, Human
cacagugagucgaggaca

SEQ ID NO: 3112234 - RNA, 20 nt, Human
cacaggcccggcuccaggcu

SEQ ID NO: 3112235 - RNA, 23 nt, Human
cacaggcccggcuccaggcuccu

SEQ ID NO: 3112236 - RNA, 17 nt, Human
cacauacacacacacgc

SEQ ID NO: 3112237 - RNA, 19 nt, Human
caccacaugugcacaugca

SEQ ID NO: 3112238 - RNA, 15 nt, Human
caccacaugugcaca

SEQ ID NO: 3112239 - RNA, 18 nt, Human
caccacaugugcacaugc

SEQ ID NO: 3112240 - RNA, 19 nt, Human
caccacuacauucuguuaa

SEQ ID NO: 3112241 - RNA, 20 nt, Human
caccacuacauucuguuaau

SEQ ID NO: 3112242 - RNA, 14 nt, Human
caccaccucuuugg

SEQ ID NO: 3112243 - RNA, 16 nt, Human
caccacuacauucugu

SEQ ID NO: 3112244 - RNA, 17 nt, Human
caccacuacauucuguu

SEQ ID NO: 3112245 - RNA, 18 nt, Human
caccacuacauucuguua

SEQ ID NO: 3112246 - RNA, 15 nt, Human
caccaagcccaguua

SEQ ID NO: 3112247 - RNA, 13 nt, Human
caccacacccagc

SEQ ID NO: 3112248 - RNA, 15 nt, Human
caccacacccagccc

SEQ ID NO: 3112249 - RNA, 16 nt, Human
cacauuccugaugcuu

SEQ ID NO: 3112250 - RNA, 17 nt, Human
cacaugugcacaugcac

SEQ ID NO: 3112251 - RNA, 14 nt, Human
cacaugugcacaug

SEQ ID NO: 3112252 - RNA, 15 nt, Human
cacaugugcacaugc

SEQ ID NO: 3112253 - RNA, 20 nt, Human
cacauauugauuuccguuaa

SEQ ID NO: 3112254 - RNA, 12 nt, Human
cacauaucuguc

SEQ ID NO: 3112255 - RNA, 18 nt, Human
cacaucagcacgauuucu

SEQ ID NO: 3112256 - RNA, 18 nt, Human
cacaugccucucucaggc

SEQ ID NO: 3112257 - RNA, 17 nt, Human
cacaugccucucucagg

SEQ ID NO: 3112258 - RNA, 13 nt, Human
cacaugccucucu

SEQ ID NO: 3112259 - RNA, 19 nt, Human
cacaugccucucucaggcc

SEQ ID NO: 3112260 - RNA, 23 nt, Human
cacauguccaagaagcccaggaa

SEQ ID NO: 3112261 - RNA, 22 nt, Human
caaauucugcuugcuugcuuuu

SEQ ID NO: 3112262 - RNA, 16 nt, Human
caaaucagcugcuacu

SEQ ID NO: 3112263 - RNA, 13 nt, Human
caaaucagcugcu

SEQ ID NO: 3112264 - RNA, 21 nt, Human
caaaggaugcccaaagaugca

SEQ ID NO: 3112265 - RNA, 16 nt, Human
caaagcuuguuaagau

SEQ ID NO: 3112266 - RNA, 16 nt, Human
caaagcuaggccuggc

SEQ ID NO: 3112267 - RNA, 17 nt, Human
caaagcuaggccuggcc

SEQ ID NO: 3112268 - RNA, 20 nt, Human
caaagccaaagcuaggccug

SEQ ID NO: 3112269 - RNA, 21 nt, Human
caaagccaaagcuaggccugg

SEQ ID NO: 3112270 - RNA, 15 nt, Human
caaagcuaggccugg

SEQ ID NO: 3112271 - RNA, 18 nt, Human
auuuuuuuacuaauagac

SEQ ID NO: 3112272 - RNA, 15 nt, Human
caaggauugcuacug

SEQ ID NO: 3112273 - RNA, 16 nt, Human
caagggccuggccuga

SEQ ID NO: 3112274 - RNA, 19 nt, Human
caagggccuggccugagcu

SEQ ID NO: 3112275 - RNA, 12 nt, Human
caaggugggagg

SEQ ID NO: 3112276 - RNA, 23 nt, Human
caaggugggaggauugcuugagc

SEQ ID NO: 3112277 - RNA, 22 nt, Human
caagugugguagagugugccug

SEQ ID NO: 3112278 - RNA, 22 nt, Human
caagugauucuccugccucagc

SEQ ID NO: 3112279 - RNA, 21 nt, Human
caagugauucuccugccucag

SEQ ID NO: 3112280 - RNA, 19 nt, Human
caagugaaaaaggaggaag

SEQ ID NO: 3112281 - RNA, 16 nt, Human
caagugauucuccugc

SEQ ID NO: 3112282 - RNA, 17 nt, Human
caagugauucuccugcc

SEQ ID NO: 3112283 - RNA, 17 nt, Human
caagcgugagccacugc

SEQ ID NO: 3112284 - RNA, 22 nt, Human
caaggauccugagccagauuuc

SEQ ID NO: 3112285 - RNA, 21 nt, Human
caaggaugaucuaggaagacu

SEQ ID NO: 3112286 - RNA, 13 nt, Human
caaggauccugag

SEQ ID NO: 3112287 - RNA, 16 nt, Human
caagcgugagccacug

SEQ ID NO: 3112288 - RNA, 21 nt, Human
caagccaccaacauacuccca

SEQ ID NO: 3112289 - RNA, 18 nt, Human
caagcaccuccugccucg

SEQ ID NO: 3112290 - RNA, 19 nt, Human
caacucuccuccagaguca

SEQ ID NO: 3112291 - RNA, 16 nt, Human
caaccugauugugucu

SEQ ID NO: 3112292 - RNA, 15 nt, Human
caacccucaucacca

SEQ ID NO: 3112293 - RNA, 12 nt, Human
caacccucauca

SEQ ID NO: 3112294 - RNA, 16 nt, Human
caacugcauuggcuuu

SEQ ID NO: 3112295 - RNA, 20 nt, Human
caacucuccuccagagucag

SEQ ID NO: 3112296 - RNA, 21 nt, Human
caaccccuucgcuccuguguc

SEQ ID NO: 3112297 - RNA, 18 nt, Human
caaccccuucgcuccugu

SEQ ID NO: 3112298 - RNA, 19 nt, Human
caaccccuucgcuccugug

SEQ ID NO: 3112299 - RNA, 22 nt, Human
caacaucuuggucagauuugaa

SEQ ID NO: 3112300 - RNA, 15 nt, Human
caacagguuuuccug

SEQ ID NO: 3112301 - RNA, 18 nt, Human
caacaggguuuuuuucca

SEQ ID NO: 3112302 - RNA, 19 nt, Human
caacagguuuuccugaaga

SEQ ID NO: 3112303 - RNA, 24 nt, Human
caacaggcugggcuucaguggcag

SEQ ID NO: 3112304 - RNA, 23 nt, Human
caacaggcugggcuucaguggca

SEQ ID NO: 3112305 - RNA, 23 nt, Human
uugcagacaggcaagcaccuccu

SEQ ID NO: 3112306 - RNA, 22 nt, Human
uugcagacaggcaagcaccucc

SEQ ID NO: 3112307 - RNA, 17 nt, Human
uugauucauaaugacuu

SEQ ID NO: 3112308 - RNA, 13 nt, Human
uugauucauaaug

SEQ ID NO: 3112309 - RNA, 16 nt, Human
uugccauguuggccag

SEQ ID NO: 3112310 - RNA, 17 nt, Human
uugccauguuggccagg

SEQ ID NO: 3112311 - RNA, 18 nt, Human
uugccauguuggccaggc

SEQ ID NO: 3112312 - RNA, 19 nt, Human
uugccauguuggccaggcu

SEQ ID NO: 3112313 - RNA, 19 nt, Human
uugagccuugaacuuugac

SEQ ID NO: 3112314 - RNA, 15 nt, Human
uugagccuugaacuu

SEQ ID NO: 3112315 - RNA, 16 nt, Human
uugagccuugaacuuu

SEQ ID NO: 3112316 - RNA, 14 nt, Human
uugagccuugaacu

SEQ ID NO: 3112317 - RNA, 14 nt, Human
uugagccugggagg

SEQ ID NO: 3112318 - RNA, 16 nt, Human
uugauaugcuuauaca

SEQ ID NO: 3112319 - RNA, 21 nt, Human
uugauucagacagcugccugg

SEQ ID NO: 3112320 - RNA, 17 nt, Human
uugauucagacagcugc

SEQ ID NO: 3112321 - RNA, 23 nt, Human
uugauucagacagcugccuggga

SEQ ID NO: 3112322 - RNA, 16 nt, Human
uugauucagcucugca

SEQ ID NO: 3112323 - RNA, 13 nt, Human
uucuucagagacu

SEQ ID NO: 3112324 - RNA, 17 nt, Human
uucuuagggaaggauac

SEQ ID NO: 3112325 - RNA, 20 nt, Human
uucuggcagaguugaagaca

SEQ ID NO: 3112326 - RNA, 13 nt, Human
uugaacuuugacc

SEQ ID NO: 3112327 - RNA, 17 nt, Human
uugaacuuugaccucug

SEQ ID NO: 3112328 - RNA, 18 nt, Human
uugaacuuugaccucugc

SEQ ID NO: 3112329 - RNA, 16 nt, Human
uugaaugaugccauga

SEQ ID NO: 3112330 - RNA, 12 nt, Human
uugaaugaugcc

SEQ ID NO: 3112331 - RNA, 21 nt, Human
uucuuuccugaggcugggcuc

SEQ ID NO: 3112332 - RNA, 15 nt, Human
uugaacuuugaccuc

SEQ ID NO: 3112333 - RNA, 20 nt, Human
uuguauuuuacuaauaaaau

SEQ ID NO: 3112334 - RNA, 14 nt, Human
uugucuaugggacu

SEQ ID NO: 3112335 - RNA, 22 nt, Human
uugucaaaguggugagaggcau

SEQ ID NO: 3112336 - RNA, 22 nt, Human
uugucuuaaaaaguggaaaaau

SEQ ID NO: 3112337 - RNA, 20 nt, Human
uugucuaugggacucaaugc

SEQ ID NO: 3112338 - RNA, 13 nt, Human
uugguccugcugc

SEQ ID NO: 3112339 - RNA, 20 nt, Human
uuggucugacccacugcuuu

SEQ ID NO: 3112340 - RNA, 23 nt, Human
uuggcuucacggaagagccuugc

SEQ ID NO: 3112341 - RNA, 16 nt, Human
uugcugcuugaggcaa

SEQ ID NO: 3112342 - RNA, 14 nt, Human
uugcugcuugaggc

SEQ ID NO: 3112343 - RNA, 16 nt, Human
uugcugucccuuuucc

SEQ ID NO: 3112344 - RNA, 18 nt, Human
uugcugucccuuuuccuu

SEQ ID NO: 3112345 - RNA, 20 nt, Human
uugccauguuggccaggcug

SEQ ID NO: 3112346 - RNA, 21 nt, Human
uugccauguuggccaggcugg

SEQ ID NO: 3112347 - RNA, 19 nt, Human
uuggaagcuccgcuuucua

SEQ ID NO: 3112348 - RNA, 21 nt, Human
uuggacccugaggcccagagg

SEQ ID NO: 3112349 - RNA, 19 nt, Human
uuggacccugaggcccaga

SEQ ID NO: 3112350 - RNA, 18 nt, Human
uuggacccugaggcccag

SEQ ID NO: 3112351 - RNA, 15 nt, Human
uuggacccugaggcc

SEQ ID NO: 3112352 - RNA, 15 nt, Human
uuggauuguccccga

SEQ ID NO: 3112353 - RNA, 14 nt, Human
uuggauuguccccg

SEQ ID NO: 3112354 - RNA, 17 nt, Human
uuucagccaagaauucu

SEQ ID NO: 3112355 - RNA, 16 nt, Human
uuucagccaagaauuc

SEQ ID NO: 3112356 - RNA, 22 nt, Human
uuucuacccagcgagcccuggu

SEQ ID NO: 3112357 - RNA, 15 nt, Human
uuucuacccagcgag

SEQ ID NO: 3112358 - RNA, 18 nt, Human
uuucuacccagcgagccc

SEQ ID NO: 3112359 - RNA, 23 nt, Human
uuuccuggcacugcuuccaguga

SEQ ID NO: 3112360 - RNA, 19 nt, Human
uuuccuggcacugcuucca

SEQ ID NO: 3112361 - RNA, 19 nt, Human
uuucuaaaucuccaaaaua

SEQ ID NO: 3112362 - RNA, 13 nt, Human
uuuggacccugag

SEQ ID NO: 3112363 - RNA, 19 nt, Human
uuuggacccugaggcccag

SEQ ID NO: 3112364 - RNA, 15 nt, Human
uuuggacccugaggc

SEQ ID NO: 3112365 - RNA, 19 nt, Human
uuucuuguguguuuauugu

SEQ ID NO: 3112366 - RNA, 17 nt, Human
uuugagaucagccuggg

SEQ ID NO: 3112367 - RNA, 16 nt, Human
uuugagaucagccugg

SEQ ID NO: 3112368 - RNA, 14 nt, Human
uuuaacagaaaugu

SEQ ID NO: 3112369 - RNA, 15 nt, Human
uuuaacagaaaugua

SEQ ID NO: 3112370 - RNA, 18 nt, Human
uuuauaaacuuuaccuuu

SEQ ID NO: 3112371 - RNA, 19 nt, Human
uuuagacccuauugcugcu

SEQ ID NO: 3112372 - RNA, 22 nt, Human
uuuagacccuauugcugcuuga

SEQ ID NO: 3112373 - RNA, 12 nt, Human
uuuauacauaaa

SEQ ID NO: 3112374 - RNA, 20 nt, Human
uuuauacauaaacaagacca

SEQ ID NO: 3112375 - RNA, 20 nt, Human
uuguuuggggaugagaaagg

SEQ ID NO: 3112376 - RNA, 24 nt, Human
uugucuuuggacccugaggcccag

SEQ ID NO: 3112377 - RNA, 20 nt, Human
uugucuuuggacccugaggc

SEQ ID NO: 3112378 - RNA, 15 nt, Human
uugucuuuggacccu

SEQ ID NO: 3112379 - RNA, 13 nt, Human
uuuaaaagauaca

SEQ ID NO: 3112380 - RNA, 13 nt, Human
uuuaacagaaaug

SEQ ID NO: 3112381 - RNA, 15 nt, Human
uuauugcccacgcug

SEQ ID NO: 3112382 - RNA, 11 nt, Human
uuauucugcuc

SEQ ID NO: 3112383 - RNA, 23 nt, Human
uuauuaaaaaucucaaauuucua

SEQ ID NO: 3112384 - RNA, 16 nt, Human
uuaugcaugaaguaau

SEQ ID NO: 3112385 - RNA, 22 nt, Human
uuaugcaugaaguaauaugcac

SEQ ID NO: 3112386 - RNA, 14 nt, Human
uuauggcacaucag

SEQ ID NO: 3112387 - RNA, 17 nt, Human
uuaucuagauacuguau

SEQ ID NO: 3112388 - RNA, 14 nt, Human
uuaucuagauacug

SEQ ID NO: 3112389 - RNA, 16 nt, Human
uuaucuagauacugua

SEQ ID NO: 3112390 - RNA, 14 nt, Human
uuaguuccuugagu

SEQ ID NO: 3112391 - RNA, 16 nt, Human
uuaguuccucauuagc

SEQ ID NO: 3112392 - RNA, 18 nt, Human
uucaauaggaaaaacuga

SEQ ID NO: 3112393 - RNA, 15 nt, Human
uucaauaggaaaaac

SEQ ID NO: 3112394 - RNA, 13 nt, Human
uucaauaggaaaa

SEQ ID NO: 3112395 - RNA, 18 nt, Human
uucacggaagagccuugc

SEQ ID NO: 3112396 - RNA, 15 nt, Human
uucacgugguccuaa

SEQ ID NO: 3112397 - RNA, 13 nt, Human
uucacucuccuug

SEQ ID NO: 3112398 - RNA, 19 nt, Human
uucagagacuccugcaggc

SEQ ID NO: 3112399 - RNA, 21 nt, Human
uucagacagcugccugggauc

SEQ ID NO: 3112400 - RNA, 17 nt, Human
uuauugucaaaguggug

SEQ ID NO: 3112401 - RNA, 18 nt, Human
uuauugucaaagugguga

SEQ ID NO: 3112402 - RNA, 17 nt, Human
uuauuuuaauucaguug

SEQ ID NO: 3112403 - RNA, 16 nt, Human
uuccccaggaggccag

SEQ ID NO: 3112404 - RNA, 15 nt, Human
uuccccaggaggcca

SEQ ID NO: 3112405 - RNA, 16 nt, Human
uucccauuugcuccuu

SEQ ID NO: 3112406 - RNA, 11 nt, Human
uucccucccuu

SEQ ID NO: 3112407 - RNA, 17 nt, Human
uucccucccuuccucuu

SEQ ID NO: 3112408 - RNA, 20 nt, Human
uucccucccuuccucuuucc

SEQ ID NO: 3112409 - RNA, 21 nt, Human
uuccccaggaggccagccuug

SEQ ID NO: 3112410 - RNA, 20 nt, Human
uuccccaggaggccagccuu

SEQ ID NO: 3112411 - RNA, 19 nt, Human
uuccccaggaggccagccu

SEQ ID NO: 3112412 - RNA, 18 nt, Human
uuccccaggaggccagcc

SEQ ID NO: 3112413 - RNA, 17 nt, Human
uuccccaggaggccagc

SEQ ID NO: 3112414 - RNA, 21 nt, Human
uucaucuugaauuguaaggaa

SEQ ID NO: 3112415 - RNA, 17 nt, Human
uucaucuugaauuguaa

SEQ ID NO: 3112416 - RNA, 13 nt, Human
uucaggaagcuca

SEQ ID NO: 3112417 - RNA, 11 nt, Human
uucaggaagcu

SEQ ID NO: 3112418 - RNA, 15 nt, Human
uucauuuccuguguc

SEQ ID NO: 3112419 - RNA, 16 nt, Human
uucauuuccugugucu

SEQ ID NO: 3112420 - RNA, 15 nt, Human
uuccaaauucugcuu

SEQ ID NO: 3112421 - RNA, 14 nt, Human
uuccuggcacugcu

SEQ ID NO: 3112422 - RNA, 17 nt, Human
uuccugccaggcauggu

SEQ ID NO: 3112423 - RNA, 15 nt, Human
uuccugaugcuucuu

SEQ ID NO: 3112424 - RNA, 19 nt, Human
uuccugaugcuucuucaga

SEQ ID NO: 3112425 - RNA, 18 nt, Human
uuccugaugcuucuucag

SEQ ID NO: 3112426 - RNA, 17 nt, Human
uucuaaagcugccagcc

SEQ ID NO: 3112427 - RNA, 13 nt, Human
uucuaaagcugcc

SEQ ID NO: 3112428 - RNA, 20 nt, Human
uucgggaggucgaggcagga

SEQ ID NO: 3112429 - RNA, 13 nt, Human
uuccucauuagca

SEQ ID NO: 3112430 - RNA, 22 nt, Human
uucccuuugacgccaucccagc

SEQ ID NO: 3112431 - RNA, 21 nt, Human
uucccuuugacgccaucccag

SEQ ID NO: 3112432 - RNA, 20 nt, Human
uucccuuugacgccauccca

SEQ ID NO: 3112433 - RNA, 17 nt, Human
uuacuuuaaaaggagcc

SEQ ID NO: 3112434 - RNA, 18 nt, Human
uuacuuuaaaaggagcca

SEQ ID NO: 3112435 - RNA, 14 nt, Human
uuacuuuguguuca

SEQ ID NO: 3112436 - RNA, 15 nt, Human
uuagacagucccugc

SEQ ID NO: 3112437 - RNA, 14 nt, Human
uuagacagucccug

SEQ ID NO: 3112438 - RNA, 18 nt, Human
uuagacagucccugccaa

SEQ ID NO: 3112439 - RNA, 17 nt, Human
uuagacagucccugcca

SEQ ID NO: 3112440 - RNA, 16 nt, Human
uuagacagucccugcc

SEQ ID NO: 3112441 - RNA, 13 nt, Human
uuacuaaguuuuu

SEQ ID NO: 3112442 - RNA, 14 nt, Human
uuacuaaguuuuua

SEQ ID NO: 3112443 - RNA, 16 nt, Human
uuacuaauagacaauu

SEQ ID NO: 3112444 - RNA, 18 nt, Human
uuacuuagguguggggga

SEQ ID NO: 3112445 - RNA, 11 nt, Human
uuacuucugcu

SEQ ID NO: 3112446 - RNA, 12 nt, Human
uuacuucugcua

SEQ ID NO: 3112447 - RNA, 23 nt, Human
uuacuucuuauacauuugauaaa

SEQ ID NO: 3112448 - RNA, 21 nt, Human
uuacuuaaaccgccaaggcug

SEQ ID NO: 3112449 - RNA, 22 nt, Human
uuagauaauacaccacuacauu

SEQ ID NO: 3112450 - RNA, 14 nt, Human
uuagcggagacgga

SEQ ID NO: 3112451 - RNA, 14 nt, Human
uuagaguugauacu

SEQ ID NO: 3112452 - RNA, 17 nt, Human
uuaguagagacaggguu

SEQ ID NO: 3112453 - RNA, 18 nt, Human
uuaguaugaggcauuugu

SEQ ID NO: 3112454 - RNA, 16 nt, Human
uuaguaugaggcauuu

SEQ ID NO: 3112455 - RNA, 21 nt, Human
uuacaagcgugagccacugca

SEQ ID NO: 3112456 - RNA, 20 nt, Human
uuacaagcgugagccacugc

SEQ ID NO: 3112457 - RNA, 17 nt, Human
uuaagcuguuacugucu

SEQ ID NO: 3112458 - RNA, 18 nt, Human
uuaauauugauaugcuua

SEQ ID NO: 3112459 - RNA, 22 nt, Human
uuaauauugauaugcuuauaca

SEQ ID NO: 3112460 - RNA, 15 nt, Human
uuaacuuuuauaaac

SEQ ID NO: 3112461 - RNA, 16 nt, Human
uuaacuucacauauug

SEQ ID NO: 3112462 - RNA, 16 nt, Human
uuaacuuuuauaaacu

SEQ ID NO: 3112463 - RNA, 17 nt, Human
uuaacuuuuauaaacuu

SEQ ID NO: 3112464 - RNA, 14 nt, Human
uuaacuuuuauaaa

SEQ ID NO: 3112465 - RNA, 17 nt, Human
uuaaccacuucagcuga

SEQ ID NO: 3112466 - RNA, 19 nt, Human
uguuuggggaugagaaagg

SEQ ID NO: 3112467 - RNA, 23 nt, Human
uguuuccuggcacugcuuccagu

SEQ ID NO: 3112468 - RNA, 13 nt, Human
uguuugugauuga

SEQ ID NO: 3112469 - RNA, 20 nt, Human
uguuuuaagaggcagggucu

SEQ ID NO: 3112470 - RNA, 15 nt, Human
uguuucaaacuuuac

SEQ ID NO: 3112471 - RNA, 16 nt, Human
uguuuagauaauacac

SEQ ID NO: 3112472 - RNA, 22 nt, Human
uguuuuaagaggcagggucuca

SEQ ID NO: 3112473 - RNA, 18 nt, Human
uguuuuaaggaugcuugu

SEQ ID NO: 3112474 - RNA, 14 nt, Human
uuaaaagauacagu

SEQ ID NO: 3112475 - RNA, 17 nt, Human
uuaaaagauacaguuac

SEQ ID NO: 3112476 - RNA, 21 nt, Human
uuaaaauaccagccaguaaau

SEQ ID NO: 3112477 - RNA, 21 nt, Human
uauguugcccaggcaggucuu

SEQ ID NO: 3112478 - RNA, 22 nt, Human
uauguucuuaguggauguucug

SEQ ID NO: 3112479 - RNA, 15 nt, Human
uauuaaaugcccagc

SEQ ID NO: 3112480 - RNA, 19 nt, Human
uauuaaaugcccagccccu

SEQ ID NO: 3112481 - RNA, 17 nt, Human
uauuaaaugcccagccc

SEQ ID NO: 3112482 - RNA, 16 nt, Human
uauuaagaaagacuau

SEQ ID NO: 3112483 - RNA, 12 nt, Human
uauuauaccuuu

SEQ ID NO: 3112484 - RNA, 13 nt, Human
uauuauaccuuuu

SEQ ID NO: 3112485 - RNA, 14 nt, Human
uauuaaggaagaca

SEQ ID NO: 3112486 - RNA, 14 nt, Human
uauuauaccuuuuu

SEQ ID NO: 3112487 - RNA, 20 nt, Human
uauugauaugcuuauacacu

SEQ ID NO: 3112488 - RNA, 22 nt, Human
uauugcugauggugcaaugacc

SEQ ID NO: 3112489 - RNA, 23 nt, Human
uauugcugauggugcaaugaccu

SEQ ID NO: 3112490 - RNA, 13 nt, Human
uauugcccacgcu

SEQ ID NO: 3112491 - RNA, 14 nt, Human
uauugcccacgcug

SEQ ID NO: 3112492 - RNA, 15 nt, Human
uauugcccacgcugg

SEQ ID NO: 3112493 - RNA, 17 nt, Human
uauuuaugggauccugg

SEQ ID NO: 3112494 - RNA, 22 nt, Human
uauuuauuaaaugcccagcccc

SEQ ID NO: 3112495 - RNA, 15 nt, Human
ucacacacuuuggcu

SEQ ID NO: 3112496 - RNA, 23 nt, Human
ucacacaugagcaucaggccagg

SEQ ID NO: 3112497 - RNA, 22 nt, Human
ucacacaugagcaucaggccag

SEQ ID NO: 3112498 - RNA, 23 nt, Human
ucaccgaaaacguggcugcuuca

SEQ ID NO: 3112499 - RNA, 22 nt, Human
ucaccgaaaacguggcugcuuc

SEQ ID NO: 3112500 - RNA, 21 nt, Human
ucaccgaaaacguggcugcuu

SEQ ID NO: 3112501 - RNA, 20 nt, Human
ucaccgaaaacguggcugcu

SEQ ID NO: 3112502 - RNA, 19 nt, Human
ucaccgaaaacguggcugc

SEQ ID NO: 3112503 - RNA, 15 nt, Human
ucaccgaaaacgugg

SEQ ID NO: 3112504 - RNA, 19 nt, Human
ucacccgcuaagagggagg

SEQ ID NO: 3112505 - RNA, 14 nt, Human
ucaccgaaaacgug

SEQ ID NO: 3112506 - RNA, 12 nt, Human
ucacccuuuucu

SEQ ID NO: 3112507 - RNA, 18 nt, Human
ucacccgcuaagagggag

SEQ ID NO: 3112508 - RNA, 16 nt, Human
ucaccacaugugcaca

SEQ ID NO: 3112509 - RNA, 13 nt, Human
ucaccaagcccag

SEQ ID NO: 3112510 - RNA, 14 nt, Human
ucacauuuauucug

SEQ ID NO: 3112511 - RNA, 21 nt, Human
ucaccaaaucagcugcuacua

SEQ ID NO: 3112512 - RNA, 18 nt, Human
ucaccaacgucugugcca

SEQ ID NO: 3112513 - RNA, 17 nt, Human
ucaccaacgucugugcc

SEQ ID NO: 3112514 - RNA, 17 nt, Human
ucaagcgauucuucugc

SEQ ID NO: 3112515 - RNA, 20 nt, Human
ucaagccaccaacauacucc

SEQ ID NO: 3112516 - RNA, 12 nt, Human
ucaagccaccaa

SEQ ID NO: 3112517 - RNA, 18 nt, Human
ucaagcgauucuucugcu

SEQ ID NO: 3112518 - RNA, 19 nt, Human
ucaagcgauucuucugcuu

SEQ ID NO: 3112519 - RNA, 14 nt, Human
ucaaggauccugag

SEQ ID NO: 3112520 - RNA, 13 nt, Human
ucaaggauccuga

SEQ ID NO: 3112521 - RNA, 16 nt, Human
ucaaggauccugagcc

SEQ ID NO: 3112522 - RNA, 15 nt, Human
ucaaggauccugagc

SEQ ID NO: 3112523 - RNA, 16 nt, Human
ucaaccuccugggcua

SEQ ID NO: 3112524 - RNA, 20 nt, Human
ucaaccccuucgcuccugug

SEQ ID NO: 3112525 - RNA, 15 nt, Human
ucaaccuccugggcu

SEQ ID NO: 3112526 - RNA, 18 nt, Human
ucaaccccuucgcuccug

SEQ ID NO: 3112527 - RNA, 19 nt, Human
ucaaccccuucgcuccugu

SEQ ID NO: 3112528 - RNA, 20 nt, Human
ucaacucuccuccagaguca

SEQ ID NO: 3112529 - RNA, 23 nt, Human
ucaaagagguuuuaaaaaaaucc

SEQ ID NO: 3112530 - RNA, 12 nt, Human
ucaaagagguuu

SEQ ID NO: 3112531 - RNA, 12 nt, Human
uaugacacaugc

SEQ ID NO: 3112532 - RNA, 22 nt, Human
uaugacacaugcaaggucauuu

SEQ ID NO: 3112533 - RNA, 20 nt, Human
uaucugucauuugagcaggg

SEQ ID NO: 3112534 - RNA, 21 nt, Human
uaucugucauuugagcagggc

SEQ ID NO: 3112535 - RNA, 23 nt, Human
uaucugucauuugagcagggcuc

SEQ ID NO: 3112536 - RNA, 21 nt, Human
uaucuaauauguaacaagcca

SEQ ID NO: 3112537 - RNA, 19 nt, Human
uauauguuuuaagaggcag

SEQ ID NO: 3112538 - RNA, 16 nt, Human
uaucuaaauguugaaa

SEQ ID NO: 3112539 - RNA, 17 nt, Human
uauggacaaugacccag

SEQ ID NO: 3112540 - RNA, 19 nt, Human
uauggaacacucugagacu

SEQ ID NO: 3112541 - RNA, 18 nt, Human
uauggaacacucugagac

SEQ ID NO: 3112542 - RNA, 17 nt, Human
uauggaacacucugaga

SEQ ID NO: 3112543 - RNA, 16 nt, Human
uauggaacacucugag

SEQ ID NO: 3112544 - RNA, 13 nt, Human
uauggaacacucu

SEQ ID NO: 3112545 - RNA, 13 nt, Human
uaugcaugaagua

SEQ ID NO: 3112546 - RNA, 22 nt, Human
uaugcuuauacacuuacacuuu

SEQ ID NO: 3112547 - RNA, 13 nt, Human
uaugcacacauuu

SEQ ID NO: 3112548 - RNA, 14 nt, Human
uaugcacacauuuu

SEQ ID NO: 3112549 - RNA, 18 nt, Human
uaugcaaucaaaucugcu

SEQ ID NO: 3112550 - RNA, 23 nt, Human
uaugacuccagaauuucccaaag

SEQ ID NO: 3112551 - RNA, 17 nt, Human
uaugacuccagaauuuc

SEQ ID NO: 3112552 - RNA, 16 nt, Human
uaugacuccagaauuu

SEQ ID NO: 3112553 - RNA, 11 nt, Human
uagggaaaaac

SEQ ID NO: 3112554 - RNA, 19 nt, Human
uagggaaaaaccagcgugu

SEQ ID NO: 3112555 - RNA, 21 nt, Human
uagggaaaaaccagcguguga

SEQ ID NO: 3112556 - RNA, 20 nt, Human
uagggaaaaaccagcgugug

SEQ ID NO: 3112557 - RNA, 18 nt, Human
uaggccuggccagaugca

SEQ ID NO: 3112558 - RNA, 15 nt, Human
uaggccuggccagau

SEQ ID NO: 3112559 - RNA, 23 nt, Human
uaggugacagagugagacucugu

SEQ ID NO: 3112560 - RNA, 20 nt, Human
uauaugcucugcauguuaca

SEQ ID NO: 3112561 - RNA, 21 nt, Human
uauaugcucugcauguuacau

SEQ ID NO: 3112562 - RNA, 18 nt, Human
uauaaacuuuaccuuuuu

SEQ ID NO: 3112563 - RNA, 21 nt, Human
uccugagccagauuucacucu

SEQ ID NO: 3112564 - RNA, 14 nt, Human
uccugccaggcaug

SEQ ID NO: 3112565 - RNA, 13 nt, Human
uccugccaggcau

SEQ ID NO: 3112566 - RNA, 20 nt, Human
uccugcccuuaccugccagg

SEQ ID NO: 3112567 - RNA, 17 nt, Human
uccugcccuuaccugcc

SEQ ID NO: 3112568 - RNA, 14 nt, Human
uccuggaguucugg

SEQ ID NO: 3112569 - RNA, 23 nt, Human
uccuggcacccggccccugcugg

SEQ ID NO: 3112570 - RNA, 22 nt, Human
uccuggcacccggccccugcug

SEQ ID NO: 3112571 - RNA, 16 nt, Human
uccuggcacugcuucc

SEQ ID NO: 3112572 - RNA, 13 nt, Human
uccuggcacugcu

SEQ ID NO: 3112573 - RNA, 12 nt, Human
uccuggccucaa

SEQ ID NO: 3112574 - RNA, 22 nt, Human
uccuguaccucuugagccuuga

SEQ ID NO: 3112575 - RNA, 11 nt, Human
uccuguagccc

SEQ ID NO: 3112576 - RNA, 13 nt, Human
uccuguagcccua

SEQ ID NO: 3112577 - RNA, 15 nt, Human
ucccccuuccaugga

SEQ ID NO: 3112578 - RNA, 15 nt, Human
ucccuuccucuuucc

SEQ ID NO: 3112579 - RNA, 16 nt, Human
ucccuuccucuuucca

SEQ ID NO: 3112580 - RNA, 14 nt, Human
uccgccucuugggu

SEQ ID NO: 3112581 - RNA, 16 nt, Human
uccgcuuucuacccag

SEQ ID NO: 3112582 - RNA, 18 nt, Human
uccgcuuucuacccagcg

SEQ ID NO: 3112583 - RNA, 20 nt, Human
uccgcuuucuacccagcgag

SEQ ID NO: 3112584 - RNA, 18 nt, Human
uccuaagcuauucaguaa

SEQ ID NO: 3112585 - RNA, 20 nt, Human
uccuaagcuauucaguaaua

SEQ ID NO: 3112586 - RNA, 21 nt, Human
uccuaagcuauucaguaauaa

SEQ ID NO: 3112587 - RNA, 17 nt, Human
uccucauuagcauuuug

SEQ ID NO: 3112588 - RNA, 18 nt, Human
uccucauuagcauuuugc

SEQ ID NO: 3112589 - RNA, 12 nt, Human
uccucccaccuc

SEQ ID NO: 3112590 - RNA, 10 nt, Human
uccuccaggu

SEQ ID NO: 3112591 - RNA, 23 nt, Human
uccuauauuguuuucaguguaca

SEQ ID NO: 3112592 - RNA, 21 nt, Human
uccuauauuguuuucagugua

SEQ ID NO: 3112593 - RNA, 16 nt, Human
ucucauacucaccuca

SEQ ID NO: 3112594 - RNA, 18 nt, Human
ucucauacucaccucacc

SEQ ID NO: 3112595 - RNA, 19 nt, Human
ucuaugggacucaaugcac

SEQ ID NO: 3112596 - RNA, 12 nt, Human
ucuaugggacuc

SEQ ID NO: 3112597 - RNA, 13 nt, Human
ucuaugggacuca

SEQ ID NO: 3112598 - RNA, 13 nt, Human
ucuccacccugcu

SEQ ID NO: 3112599 - RNA, 12 nt, Human
ucuccacccugc

SEQ ID NO: 3112600 - RNA, 17 nt, Human
ucuccacccugcucucc

SEQ ID NO: 3112601 - RNA, 14 nt, Human
ucuccacccugcuc

SEQ ID NO: 3112602 - RNA, 16 nt, Human
ucuccacccugcucuc

SEQ ID NO: 3112603 - RNA, 22 nt, Human
ucuccaccugccagggacagag

SEQ ID NO: 3112604 - RNA, 19 nt, Human
ucuccaccugccagggaca

SEQ ID NO: 3112605 - RNA, 17 nt, Human
ucuccaccugccaggga

SEQ ID NO: 3112606 - RNA, 16 nt, Human
ucuccaccugccaggg

SEQ ID NO: 3112607 - RNA, 15 nt, Human
ucuccaccugccagg

SEQ ID NO: 3112608 - RNA, 14 nt, Human
ucuccaccugccag

SEQ ID NO: 3112609 - RNA, 15 nt, Human
ucuccagccccugga

SEQ ID NO: 3112610 - RNA, 14 nt, Human
ucuccagccccugg

SEQ ID NO: 3112611 - RNA, 13 nt, Human
ucuccagccccug

SEQ ID NO: 3112612 - RNA, 12 nt, Human
ucuccagccccu

SEQ ID NO: 3112613 - RNA, 18 nt, Human
ucuccagccccuggaugc

SEQ ID NO: 3112614 - RNA, 16 nt, Human
ucuccagccccuggau

SEQ ID NO: 3112615 - RNA, 22 nt, Human
ucuccagccccuggaugcagcc

SEQ ID NO: 3112616 - RNA, 12 nt, Human
ucucccccagcc

SEQ ID NO: 3112617 - RNA, 18 nt, Human
ucucccucagucuggccc

SEQ ID NO: 3112618 - RNA, 23 nt, Human
ucucccucagucuggcccuuccu

SEQ ID NO: 3112619 - RNA, 13 nt, Human
ucgugacaacacu

SEQ ID NO: 3112620 - RNA, 18 nt, Human
ucuaaaggcuaccuuugu

SEQ ID NO: 3112621 - RNA, 17 nt, Human
ucuaaaggcuaccuuug

SEQ ID NO: 3112622 - RNA, 19 nt, Human
ucuaaaggcuaccuuugua

SEQ ID NO: 3112623 - RNA, 20 nt, Human
ucuaaaggcuaccuuuguau

SEQ ID NO: 3112624 - RNA, 16 nt, Human
ucuaggaagacuuugg

SEQ ID NO: 3112625 - RNA, 15 nt, Human
ucuaggaagacuuug

SEQ ID NO: 3112626 - RNA, 19 nt, Human
ucuaggaagacuuuggaaa

SEQ ID NO: 3112627 - RNA, 12 nt, Human
ucuaggaagacu

SEQ ID NO: 3112628 - RNA, 22 nt, Human
ucuaucaaguauuauaccuuuu

SEQ ID NO: 3112629 - RNA, 14 nt, Human
ucuaugacacaugc

SEQ ID NO: 3112630 - RNA, 17 nt, Human
ucuaugacacaugcaag

SEQ ID NO: 3112631 - RNA, 21 nt, Human
ucuacacugugcugagucuga

SEQ ID NO: 3112632 - RNA, 15 nt, Human
ucuacagaggccaug

SEQ ID NO: 3112633 - RNA, 14 nt, Human
ucuaccuuccugca

SEQ ID NO: 3112634 - RNA, 14 nt, Human
ucaucauccuaagc

SEQ ID NO: 3112635 - RNA, 20 nt, Human
ucaguguacauggaauaaca

SEQ ID NO: 3112636 - RNA, 11 nt, Human
ucaguguacau

SEQ ID NO: 3112637 - RNA, 14 nt, Human
ucauccacugugcc

SEQ ID NO: 3112638 - RNA, 17 nt, Human
ucauccacugugccaug

SEQ ID NO: 3112639 - RNA, 19 nt, Human
ucaucuugaauuguaagga

SEQ ID NO: 3112640 - RNA, 13 nt, Human
uccaaaguacacu

SEQ ID NO: 3112641 - RNA, 23 nt, Human
ucagcuccagcucaccagcccca

SEQ ID NO: 3112642 - RNA, 24 nt, Human
ucagcuccagcucaccagccccag

SEQ ID NO: 3112643 - RNA, 22 nt, Human
ucagcuccagcucaccagcccc

SEQ ID NO: 3112644 - RNA, 23 nt, Human
ucagcucugcaagaauugaagca

SEQ ID NO: 3112645 - RNA, 23 nt, Human
ucaggaagcucagggccuggcuc

SEQ ID NO: 3112646 - RNA, 21 nt, Human
ucaggccugggggcugggcag

SEQ ID NO: 3112647 - RNA, 16 nt, Human
ucaggugauccaccca

SEQ ID NO: 3112648 - RNA, 23 nt, Human
ucaggugagaagcagaggaagga

SEQ ID NO: 3112649 - RNA, 23 nt, Human
ucaggugauccacccaccucagc

SEQ ID NO: 3112650 - RNA, 17 nt, Human
ucagguggggcagcuug

SEQ ID NO: 3112651 - RNA, 18 nt, Human
ucagguggggcagcuuga

SEQ ID NO: 3112652 - RNA, 19 nt, Human
ucagguggggcagcuugag

SEQ ID NO: 3112653 - RNA, 20 nt, Human
ucagguggggcagcuugagg

SEQ ID NO: 3112654 - RNA, 19 nt, Human
ucagucugauucccaagcu

SEQ ID NO: 3112655 - RNA, 21 nt, Human
ucagucugauucccaagcucu

SEQ ID NO: 3112656 - RNA, 22 nt, Human
ucagucugauucccaagcucug

SEQ ID NO: 3112657 - RNA, 23 nt, Human
ucagucugauucccaagcucugc

SEQ ID NO: 3112658 - RNA, 13 nt, Human
ucccaccuuggcu

SEQ ID NO: 3112659 - RNA, 16 nt, Human
ucccaccuuggcugca

SEQ ID NO: 3112660 - RNA, 17 nt, Human
ucccaccuuggcugcag

SEQ ID NO: 3112661 - RNA, 20 nt, Human
ucccagcugugcucuggaca

SEQ ID NO: 3112662 - RNA, 22 nt, Human
ucccaccucucucacuccuuga

SEQ ID NO: 3112663 - RNA, 20 nt, Human
uccaugugggcuaguugggc

SEQ ID NO: 3112664 - RNA, 24 nt, Human
ucccaggcauuccccaggaggcca

SEQ ID NO: 3112665 - RNA, 23 nt, Human
ucccaggcauuccccaggaggcc

SEQ ID NO: 3112666 - RNA, 23 nt, Human
ucccagcugugcucuggacaggc

SEQ ID NO: 3112667 - RNA, 21 nt, Human
ucccagcugugcucuggacag

SEQ ID NO: 3112668 - RNA, 22 nt, Human
ucccagcugugcucuggacagg

SEQ ID NO: 3112669 - RNA, 15 nt, Human
ucccaucuuccaagg

SEQ ID NO: 3112670 - RNA, 21 nt, Human
ucccaucugugaaaggaaaga

SEQ ID NO: 3112671 - RNA, 18 nt, Human
ucccaugagccucagcau

SEQ ID NO: 3112672 - RNA, 19 nt, Human
ucccaugagccucagcauc

SEQ ID NO: 3112673 - RNA, 14 nt, Human
uccccaggaggcca

SEQ ID NO: 3112674 - RNA, 21 nt, Human
ucccccagccccauccucugu

SEQ ID NO: 3112675 - RNA, 20 nt, Human
ucccccagccccauccucug

SEQ ID NO: 3112676 - RNA, 16 nt, Human
uccccaggaggccagc

SEQ ID NO: 3112677 - RNA, 15 nt, Human
uccccaggaggccag

SEQ ID NO: 3112678 - RNA, 17 nt, Human
ucccccagccccauccu

SEQ ID NO: 3112679 - RNA, 13 nt, Human
uccccaggaggcc

SEQ ID NO: 3112680 - RNA, 19 nt, Human
uccccagauugcaacaggc

SEQ ID NO: 3112681 - RNA, 20 nt, Human
uccccagauugcaacaggcu

SEQ ID NO: 3112682 - RNA, 22 nt, Human
uccccagauugcaacaggcugg

SEQ ID NO: 3112683 - RNA, 23 nt, Human
uccccagauugcaacaggcuggg

SEQ ID NO: 3112684 - RNA, 20 nt, Human
uccccagcaagugagagcug

SEQ ID NO: 3112685 - RNA, 21 nt, Human
uccccagcaagugagagcugg

SEQ ID NO: 3112686 - RNA, 22 nt, Human
uccccagcaagugagagcuggg

SEQ ID NO: 3112687 - RNA, 17 nt, Human
ucccaugagccucagca

SEQ ID NO: 3112688 - RNA, 20 nt, Human
ucccaugagccucagcaucc

SEQ ID NO: 3112689 - RNA, 13 nt, Human
uccccagauugca

SEQ ID NO: 3112690 - RNA, 18 nt, Human
uccccagauugcaacagg

SEQ ID NO: 3112691 - RNA, 19 nt, Human
uccacuuucuagccagagg

SEQ ID NO: 3112692 - RNA, 21 nt, Human
uccacuuucuagccagaggag

SEQ ID NO: 3112693 - RNA, 20 nt, Human
uccacuuucuagccagagga

SEQ ID NO: 3112694 - RNA, 14 nt, Human
uccaaaguacacug

SEQ ID NO: 3112695 - RNA, 16 nt, Human
uccaaaguacacuguu

SEQ ID NO: 3112696 - RNA, 20 nt, Human
uccaggggugggacacccug

SEQ ID NO: 3112697 - RNA, 19 nt, Human
uccaggggugggacacccu

SEQ ID NO: 3112698 - RNA, 15 nt, Human
uccaggagcagccac

SEQ ID NO: 3112699 - RNA, 14 nt, Human
uccaggagcagcca

SEQ ID NO: 3112700 - RNA, 13 nt, Human
uccaggagcagcc

SEQ ID NO: 3112701 - RNA, 12 nt, Human
uccaggagcagc

SEQ ID NO: 3112702 - RNA, 18 nt, Human
uccagguuuaagcuguua

SEQ ID NO: 3112703 - RNA, 20 nt, Human
uccagguuuaagcuguuacu

SEQ ID NO: 3112704 - RNA, 14 nt, Human
uccauagagagcaa

SEQ ID NO: 3112705 - RNA, 19 nt, Human
ugagcagggcucagcgggg

SEQ ID NO: 3112706 - RNA, 16 nt, Human
ugagcagggcucagcg

SEQ ID NO: 3112707 - RNA, 17 nt, Human
ugagcagggcucagcgg

SEQ ID NO: 3112708 - RNA, 16 nt, Human
ugagcaucaggccagg

SEQ ID NO: 3112709 - RNA, 20 nt, Human
ugagcaucaggccaggcccu

SEQ ID NO: 3112710 - RNA, 19 nt, Human
ugagcaucaggccaggccc

SEQ ID NO: 3112711 - RNA, 18 nt, Human
ugagcaucaggccaggcc

SEQ ID NO: 3112712 - RNA, 22 nt, Human
ugagccucagcauccuggcacc

SEQ ID NO: 3112713 - RNA, 18 nt, Human
ugagccucagcauccugg

SEQ ID NO: 3112714 - RNA, 21 nt, Human
ugagccucagcauccuggcac

SEQ ID NO: 3112715 - RNA, 19 nt, Human
ugagccgagaucacgccac

SEQ ID NO: 3112716 - RNA, 21 nt, Human
ugagccgagaucacgccacug

SEQ ID NO: 3112717 - RNA, 17 nt, Human
ugagccucagcauccug

SEQ ID NO: 3112718 - RNA, 15 nt, Human
ugagccucagcaucc

SEQ ID NO: 3112719 - RNA, 12 nt, Human
ugagcagggcuc

SEQ ID NO: 3112720 - RNA, 13 nt, Human
ugagcagggcuca

SEQ ID NO: 3112721 - RNA, 14 nt, Human
ugagcagggcucag

SEQ ID NO: 3112722 - RNA, 15 nt, Human
ugagcagggcucagc

SEQ ID NO: 3112723 - RNA, 14 nt, Human
ugagaucagccugg

SEQ ID NO: 3112724 - RNA, 15 nt, Human
ugagaucaaaacggu

SEQ ID NO: 3112725 - RNA, 23 nt, Human
ugagacucgcgacaaugcaaacc

SEQ ID NO: 3112726 - RNA, 22 nt, Human
ugagacucgcgacaaugcaaac

SEQ ID NO: 3112727 - RNA, 21 nt, Human
ugagacucgcgacaaugcaaa

SEQ ID NO: 3112728 - RNA, 20 nt, Human
ugagacucgcgacaaugcaa

SEQ ID NO: 3112729 - RNA, 20 nt, Human
ugaccucaggugauccaccc

SEQ ID NO: 3112730 - RNA, 21 nt, Human
ugaccucaggugauccaccca

SEQ ID NO: 3112731 - RNA, 19 nt, Human
ugagacucgcgacaaugca

SEQ ID NO: 3112732 - RNA, 17 nt, Human
ugagggaacagagaggu

SEQ ID NO: 3112733 - RNA, 14 nt, Human
ugaggcucugcccu

SEQ ID NO: 3112734 - RNA, 13 nt, Human
ugaggcucugccc

SEQ ID NO: 3112735 - RNA, 13 nt, Human
ugaggugggagga

SEQ ID NO: 3112736 - RNA, 12 nt, Human
ugaggugggagg

SEQ ID NO: 3112737 - RNA, 12 nt, Human
ugaggcauuugu

SEQ ID NO: 3112738 - RNA, 19 nt, Human
ugaggcauuuguuugaacu

SEQ ID NO: 3112739 - RNA, 20 nt, Human
ugaggcauuuguuugaacug

SEQ ID NO: 3112740 - RNA, 23 nt, Human
ugaggcuagugugguguuuccug

SEQ ID NO: 3112741 - RNA, 17 nt, Human
ugaggcuaguguggugu

SEQ ID NO: 3112742 - RNA, 21 nt, Human
ugaggcauuuguuugaacuga

SEQ ID NO: 3112743 - RNA, 13 nt, Human
ugagcugggauga

SEQ ID NO: 3112744 - RNA, 19 nt, Human
ugaguccagaaguuugaga

SEQ ID NO: 3112745 - RNA, 13 nt, Human
ugaguccagaagu

SEQ ID NO: 3112746 - RNA, 18 nt, Human
ugagucgaggacagggag

SEQ ID NO: 3112747 - RNA, 19 nt, Human
ugagucgaggacagggagg

SEQ ID NO: 3112748 - RNA, 18 nt, Human
ugagucugaaggcugggu

SEQ ID NO: 3112749 - RNA, 17 nt, Human
ugagucugaaggcuggg

SEQ ID NO: 3112750 - RNA, 15 nt, Human
ugagucugaaggcug

SEQ ID NO: 3112751 - RNA, 13 nt, Human
ugagucugaaggc

SEQ ID NO: 3112752 - RNA, 20 nt, Human
ugaguugauagcacagaccc

SEQ ID NO: 3112753 - RNA, 16 nt, Human
ugaguugauagcacag

SEQ ID NO: 3112754 - RNA, 13 nt, Human
ugauagcacagac

SEQ ID NO: 3112755 - RNA, 13 nt, Human
ugauccaagcugg

SEQ ID NO: 3112756 - RNA, 14 nt, Human
ugauccaagcuggu

SEQ ID NO: 3112757 - RNA, 15 nt, Human
ugauccaagcugguc

SEQ ID NO: 3112758 - RNA, 16 nt, Human
ugauccacccaccuca

SEQ ID NO: 3112759 - RNA, 17 nt, Human
ugauccacccaccucag

SEQ ID NO: 3112760 - RNA, 18 nt, Human
ugauccacccaccucagc

SEQ ID NO: 3112761 - RNA, 20 nt, Human
ugaucuucuuuauaauucua

SEQ ID NO: 3112762 - RNA, 17 nt, Human
ugaugcuucuucagaga

SEQ ID NO: 3112763 - RNA, 16 nt, Human
ugaugcuucuucagag

SEQ ID NO: 3112764 - RNA, 16 nt, Human
ugauguguuaucucuu

SEQ ID NO: 3112765 - RNA, 16 nt, Human
ugaucuuugcagacag

SEQ ID NO: 3112766 - RNA, 21 nt, Human
ugauuggaggggggagguggg

SEQ ID NO: 3112767 - RNA, 13 nt, Human
ugauuggaggggg

SEQ ID NO: 3112768 - RNA, 16 nt, Human
ugauugugucucuugg

SEQ ID NO: 3112769 - RNA, 21 nt, Human
ugauucuccugccucagccuc

SEQ ID NO: 3112770 - RNA, 23 nt, Human
ugauucagacagcugccugggau

SEQ ID NO: 3112771 - RNA, 21 nt, Human
ugauucagacagcugccuggg

SEQ ID NO: 3112772 - RNA, 20 nt, Human
ugauucagacagcugccugg

SEQ ID NO: 3112773 - RNA, 19 nt, Human
ugauucagacagcugccug

SEQ ID NO: 3112774 - RNA, 18 nt, Human
ugauucagacagcugccu

SEQ ID NO: 3112775 - RNA, 16 nt, Human
ugauucagacagcugc

SEQ ID NO: 3112776 - RNA, 15 nt, Human
ugauucagacagcug

SEQ ID NO: 3112777 - RNA, 14 nt, Human
ugauucagacagcu

SEQ ID NO: 3112778 - RNA, 13 nt, Human
ugauucagacagc

SEQ ID NO: 3112779 - RNA, 20 nt, Human
ugauucaacagguuuuccug

SEQ ID NO: 3112780 - RNA, 20 nt, Human
ugauguucuuucacccuuuu

SEQ ID NO: 3112781 - RNA, 13 nt, Human
ugaaagggcccag

SEQ ID NO: 3112782 - RNA, 18 nt, Human
ugaaagggcccagagagg

SEQ ID NO: 3112783 - RNA, 18 nt, Human
ugaaagcccugagcuuuc

SEQ ID NO: 3112784 - RNA, 19 nt, Human
ugaaaauuuugauguuuua

SEQ ID NO: 3112785 - RNA, 21 nt, Human
ugaaaauuuugauguuuuaag

SEQ ID NO: 3112786 - RNA, 12 nt, Human
ugaaaauuuuga

SEQ ID NO: 3112787 - RNA, 13 nt, Human
ugaaaauuuugau

SEQ ID NO: 3112788 - RNA, 14 nt, Human
ugaaacauuuuguc

SEQ ID NO: 3112789 - RNA, 22 nt, Human
ugaaccaagaacuuuccaggaa

SEQ ID NO: 3112790 - RNA, 23 nt, Human
ugaaccacaucuugcucugcuga

SEQ ID NO: 3112791 - RNA, 17 nt, Human
ugaaccaccacacccag

SEQ ID NO: 3112792 - RNA, 20 nt, Human
ugaaccaccacacccagccc

SEQ ID NO: 3112793 - RNA, 16 nt, Human
ugaacuccuggccuca

SEQ ID NO: 3112794 - RNA, 13 nt, Human
ucuuuccaaagua

SEQ ID NO: 3112795 - RNA, 14 nt, Human
ucuuuccaaaguac

SEQ ID NO: 3112796 - RNA, 21 nt, Human
ucuuucagccaagaauucuua

SEQ ID NO: 3112797 - RNA, 20 nt, Human
ucuuucagccaagaauucuu

SEQ ID NO: 3112798 - RNA, 19 nt, Human
ucuuucagccaagaauucu

SEQ ID NO: 3112799 - RNA, 16 nt, Human
ucuuucagccaagaau

SEQ ID NO: 3112800 - RNA, 17 nt, Human
ucuuuggacacucacac

SEQ ID NO: 3112801 - RNA, 23 nt, Human
ucuugcaauggcagccuuggcaa

SEQ ID NO: 3112802 - RNA, 20 nt, Human
ucuccucugcugcuggcugg

SEQ ID NO: 3112803 - RNA, 16 nt, Human
ucucccuucauccuuc

SEQ ID NO: 3112804 - RNA, 21 nt, Human
ucuuguguguuuauugucaaa

SEQ ID NO: 3112805 - RNA, 16 nt, Human
ucuuguguguuuauug

SEQ ID NO: 3112806 - RNA, 23 nt, Human
ucuuucacccuuuucuguuugcu

SEQ ID NO: 3112807 - RNA, 17 nt, Human
ugaaggccccgcccagg

SEQ ID NO: 3112808 - RNA, 17 nt, Human
ugaacuccuggccucaa

SEQ ID NO: 3112809 - RNA, 16 nt, Human
ugaaggccccgcccag

SEQ ID NO: 3112810 - RNA, 15 nt, Human
ugaaggccccgccca

SEQ ID NO: 3112811 - RNA, 22 nt, Human
ugaaggacauugcggacagcca

SEQ ID NO: 3112812 - RNA, 19 nt, Human
ugaaggacauugcggacag

SEQ ID NO: 3112813 - RNA, 20 nt, Human
ugaaggacauugcggacagc

SEQ ID NO: 3112814 - RNA, 16 nt, Human
ugaccauucuccaccu

SEQ ID NO: 3112815 - RNA, 18 nt, Human
ugaccauucuccaccugc

SEQ ID NO: 3112816 - RNA, 17 nt, Human
ugaccauucuccaccug

SEQ ID NO: 3112817 - RNA, 20 nt, Human
ugaccgugaggccagagaca

SEQ ID NO: 3112818 - RNA, 16 nt, Human
ugaccgugaggccaga

SEQ ID NO: 3112819 - RNA, 14 nt, Human
ugaccgugaggcca

SEQ ID NO: 3112820 - RNA, 13 nt, Human
ugaccgugaggcc

SEQ ID NO: 3112821 - RNA, 14 nt, Human
ugaccauucuccac

SEQ ID NO: 3112822 - RNA, 13 nt, Human
ugacaugucuuuu

SEQ ID NO: 3112823 - RNA, 15 nt, Human
ugacaugucuuuucu

SEQ ID NO: 3112824 - RNA, 19 nt, Human
ugaccagcaccaucucucc

SEQ ID NO: 3112825 - RNA, 18 nt, Human
ugacaaggauugcuacug

SEQ ID NO: 3112826 - RNA, 13 nt, Human
ugacagaggcagc

SEQ ID NO: 3112827 - RNA, 20 nt, Human
ugacagacacaggcccggcu

SEQ ID NO: 3112828 - RNA, 23 nt, Human
ugacagacacaggcccggcucca

SEQ ID NO: 3112829 - RNA, 14 nt, Human
ugacagaggcagcc

SEQ ID NO: 3112830 - RNA, 15 nt, Human
ugacagaggcagccc

SEQ ID NO: 3112831 - RNA, 16 nt, Human
ugacagaggcagcccc

SEQ ID NO: 3112832 - RNA, 17 nt, Human
ugacagaggcagcccca

SEQ ID NO: 3112833 - RNA, 18 nt, Human
ugacagaggcagccccau

SEQ ID NO: 3112834 - RNA, 23 nt, Human
ugacagaggcagccccauucugc

SEQ ID NO: 3112835 - RNA, 14 nt, Human
ugacagagugagac

SEQ ID NO: 3112836 - RNA, 17 nt, Human
ugacagagugagacucu

SEQ ID NO: 3112837 - RNA, 19 nt, Human
ugacagagugagacucugu

SEQ ID NO: 3112838 - RNA, 23 nt, Human
uggacaggcauguucucugagga

SEQ ID NO: 3112839 - RNA, 15 nt, Human
uggcacuauaaugua

SEQ ID NO: 3112840 - RNA, 16 nt, Human
uggcacuauaauguaa

SEQ ID NO: 3112841 - RNA, 16 nt, Human
uggcaaaaaggcagga

SEQ ID NO: 3112842 - RNA, 12 nt, Human
uggcaaaaaggc

SEQ ID NO: 3112843 - RNA, 23 nt, Human
uggaggaaggaaacccagcucug

SEQ ID NO: 3112844 - RNA, 21 nt, Human
uggaggaaggaaacccagcuc

SEQ ID NO: 3112845 - RNA, 14 nt, Human
uggccccugcccgg

SEQ ID NO: 3112846 - RNA, 15 nt, Human
uggccccugcccggc

SEQ ID NO: 3112847 - RNA, 16 nt, Human
uggccccugcccggcu

SEQ ID NO: 3112848 - RNA, 13 nt, Human
uggccaggcuggu

SEQ ID NO: 3112849 - RNA, 17 nt, Human
uggccagaugcaccagc

SEQ ID NO: 3112850 - RNA, 18 nt, Human
uggccagaugcaccagcc

SEQ ID NO: 3112851 - RNA, 19 nt, Human
uggcagaguugaagacaga

SEQ ID NO: 3112852 - RNA, 17 nt, Human
uggcagaguugaagaca

SEQ ID NO: 3112853 - RNA, 21 nt, Human
uggcagaguggauucuugaac

SEQ ID NO: 3112854 - RNA, 15 nt, Human
uggcagaguugaaga

SEQ ID NO: 3112855 - RNA, 19 nt, Human
uggccagaugcaccagccc

SEQ ID NO: 3112856 - RNA, 23 nt, Human
uggccucccaacucaccccagcc

SEQ ID NO: 3112857 - RNA, 23 nt, Human
uggcgcagcauauucaggaagcu

SEQ ID NO: 3112858 - RNA, 22 nt, Human
uggcgcagcauauucaggaagc

SEQ ID NO: 3112859 - RNA, 16 nt, Human
uggcgcugccccuggc

SEQ ID NO: 3112860 - RNA, 23 nt, Human
uggcgcugccccuggcagccccu

SEQ ID NO: 3112861 - RNA, 15 nt, Human
uggcgcugccccugg

SEQ ID NO: 3112862 - RNA, 11 nt, Human
uggcugcuuca

SEQ ID NO: 3112863 - RNA, 15 nt, Human
uggcugggggccuca

SEQ ID NO: 3112864 - RNA, 15 nt, Human
uggcugcuucaagga

SEQ ID NO: 3112865 - RNA, 22 nt, Human
ugggcuucauccuccucagauc

SEQ ID NO: 3112866 - RNA, 20 nt, Human
uggggccaguuggucccccu

SEQ ID NO: 3112867 - RNA, 15 nt, Human
uggggaugagaaagg

SEQ ID NO: 3112868 - RNA, 23 nt, Human
uggggaugagaaagguugaagca

SEQ ID NO: 3112869 - RNA, 17 nt, Human
uggguacuuguggacac

SEQ ID NO: 3112870 - RNA, 18 nt, Human
uggguacuuguggacaca

SEQ ID NO: 3112871 - RNA, 16 nt, Human
ugggggaguggccaca

SEQ ID NO: 3112872 - RNA, 23 nt, Human
ugggcagagcagagaccaucccu

SEQ ID NO: 3112873 - RNA, 14 nt, Human
ugggccuggcuccc

SEQ ID NO: 3112874 - RNA, 13 nt, Human
ugggauccuccag

SEQ ID NO: 3112875 - RNA, 12 nt, Human
ugggauccucca

SEQ ID NO: 3112876 - RNA, 22 nt, Human
ugggauuacaagcgugagccac

SEQ ID NO: 3112877 - RNA, 18 nt, Human
ugggcagagcagagacca

SEQ ID NO: 3112878 - RNA, 22 nt, Human
ugggcagagcagagaccauccc

SEQ ID NO: 3112879 - RNA, 16 nt, Human
uggcugggggccucag

SEQ ID NO: 3112880 - RNA, 17 nt, Human
uggcugggggccucagu

SEQ ID NO: 3112881 - RNA, 20 nt, Human
uggcugggggccucagugcc

SEQ ID NO: 3112882 - RNA, 16 nt, Human
ugggagugggcccaau

SEQ ID NO: 3112883 - RNA, 14 nt, Human
ugggagugggccca

SEQ ID NO: 3112884 - RNA, 13 nt, Human
uggucccacucag

SEQ ID NO: 3112885 - RNA, 14 nt, Human
uggucccccuucca

SEQ ID NO: 3112886 - RNA, 18 nt, Human
ugguaugaucacggcuca

SEQ ID NO: 3112887 - RNA, 23 nt, Human
uggucccccuuccauggacuuug

SEQ ID NO: 3112888 - RNA, 18 nt, Human
uggucccccuuccaugga

SEQ ID NO: 3112889 - RNA, 16 nt, Human
uggucccccuuccaug

SEQ ID NO: 3112890 - RNA, 15 nt, Human
uggucccccuuccau

SEQ ID NO: 3112891 - RNA, 23 nt, Human
ugguccugcugcaguugccaguc

SEQ ID NO: 3112892 - RNA, 15 nt, Human
ugguccugcugcagu

SEQ ID NO: 3112893 - RNA, 13 nt, Human
ugguccugcugca

SEQ ID NO: 3112894 - RNA, 19 nt, Human
ugguccuaaucuucugaac

SEQ ID NO: 3112895 - RNA, 17 nt, Human
ugguccuaaucuucuga

SEQ ID NO: 3112896 - RNA, 14 nt, Human
uggucggaaaacau

SEQ ID NO: 3112897 - RNA, 17 nt, Human
uggucggaaaacaugcu

SEQ ID NO: 3112898 - RNA, 13 nt, Human
uggugaccucugc

SEQ ID NO: 3112899 - RNA, 14 nt, Human
uggugaccucugcc

SEQ ID NO: 3112900 - RNA, 18 nt, Human
uggucuacacugugcuga

SEQ ID NO: 3112901 - RNA, 17 nt, Human
uggucuacacugugcug

SEQ ID NO: 3112902 - RNA, 16 nt, Human
uggucuacacugugcu

SEQ ID NO: 3112903 - RNA, 15 nt, Human
uggucuacacugugc

SEQ ID NO: 3112904 - RNA, 20 nt, Human
uggugcaaugaccuuucaau

SEQ ID NO: 3112905 - RNA, 21 nt, Human
uggugcaaugaccuuucaaua

SEQ ID NO: 3112906 - RNA, 15 nt, Human
uggugaccucugccu

SEQ ID NO: 3112907 - RNA, 16 nt, Human
uggugaccucugccug

SEQ ID NO: 3112908 - RNA, 17 nt, Human
uggugaccucugccuga

SEQ ID NO: 3112909 - RNA, 22 nt, Human
uggugaccucugccugaaguca

SEQ ID NO: 3112910 - RNA, 19 nt, Human
uggugacuuuccucuuugg

SEQ ID NO: 3112911 - RNA, 17 nt, Human
ugcugggcuugucugua

SEQ ID NO: 3112912 - RNA, 13 nt, Human
ugcuggguguggc

SEQ ID NO: 3112913 - RNA, 12 nt, Human
ugcugcuugagg

SEQ ID NO: 3112914 - RNA, 20 nt, Human
ugcugggauuacagguguga

SEQ ID NO: 3112915 - RNA, 19 nt, Human
ugcugcuugaggcaacuca

SEQ ID NO: 3112916 - RNA, 14 nt, Human
ugcugcauuuaaaa

SEQ ID NO: 3112917 - RNA, 23 nt, Human
ugcugcauuuaaaagauacaguu

SEQ ID NO: 3112918 - RNA, 17 nt, Human
ugcugcauuuaaaagau

SEQ ID NO: 3112919 - RNA, 18 nt, Human
ugcugcauuuaaaagaua

SEQ ID NO: 3112920 - RNA, 19 nt, Human
ugcugcauuuaaaagauac

SEQ ID NO: 3112921 - RNA, 21 nt, Human
ugcuacuguccuacccacccu

SEQ ID NO: 3112922 - RNA, 22 nt, Human
ugcuacuguccuacccacccuc

SEQ ID NO: 3112923 - RNA, 22 nt, Human
ugcuaggaacacuccuucacag

SEQ ID NO: 3112924 - RNA, 20 nt, Human
ugcuaggaacacuccuucac

SEQ ID NO: 3112925 - RNA, 21 nt, Human
ugcuaggaacacuccuucaca

SEQ ID NO: 3112926 - RNA, 17 nt, Human
ugcucacauaucuguca

SEQ ID NO: 3112927 - RNA, 23 nt, Human
ugcucuccgaccagacaccuuga

SEQ ID NO: 3112928 - RNA, 14 nt, Human
ugcccugcccaccu

SEQ ID NO: 3112929 - RNA, 15 nt, Human
ugcccugcccaccug

SEQ ID NO: 3112930 - RNA, 20 nt, Human
ugcccugcccaccuggccuc

SEQ ID NO: 3112931 - RNA, 16 nt, Human
ugcccugcccaccugg

SEQ ID NO: 3112932 - RNA, 14 nt, Human
ugccucaagagaag

SEQ ID NO: 3112933 - RNA, 15 nt, Human
ugccucaagagaagg

SEQ ID NO: 3112934 - RNA, 16 nt, Human
ugccccuggcagcccc

SEQ ID NO: 3112935 - RNA, 12 nt, Human
ugcccggcugcg

SEQ ID NO: 3112936 - RNA, 14 nt, Human
ugcccggcugcgga

SEQ ID NO: 3112937 - RNA, 13 nt, Human
ugcccaggcuggc

SEQ ID NO: 3112938 - RNA, 20 nt, Human
ugcccaggcuggcgugcagu

SEQ ID NO: 3112939 - RNA, 18 nt, Human
ugcccaggcuggcgugca

SEQ ID NO: 3112940 - RNA, 19 nt, Human
ugcccaggcuggcgugcag

SEQ ID NO: 3112941 - RNA, 20 nt, Human
ugccacccuggggagaaagu

SEQ ID NO: 3112942 - RNA, 14 nt, Human
ugccaggcauggug

SEQ ID NO: 3112943 - RNA, 10 nt, Human
ugccaggcau

SEQ ID NO: 3112944 - RNA, 22 nt, Human
ugccaggaagccagcaggcucu

SEQ ID NO: 3112945 - RNA, 20 nt, Human
ugccaggaagccagcaggcu

SEQ ID NO: 3112946 - RNA, 23 nt, Human
ugcauuuggugguuucagaaaug

SEQ ID NO: 3112947 - RNA, 21 nt, Human
ugcauuuggugguuucagaaa

SEQ ID NO: 3112948 - RNA, 13 nt, Human
ugcagggaguccg

SEQ ID NO: 3112949 - RNA, 20 nt, Human
ugcaguggugcgaucugggu

SEQ ID NO: 3112950 - RNA, 21 nt, Human
ugcaguggugcgaucuggguu

SEQ ID NO: 3112951 - RNA, 21 nt, Human
ugcaguuacacuaaaagguga

SEQ ID NO: 3112952 - RNA, 15 nt, Human
ugcaguugccaguca

SEQ ID NO: 3112953 - RNA, 16 nt, Human
ugcaguugccagucac

SEQ ID NO: 3112954 - RNA, 19 nt, Human
ugcaucaagaugugacaug

SEQ ID NO: 3112955 - RNA, 11 nt, Human
gugaggaagcc

SEQ ID NO: 3112956 - RNA, 19 nt, Human
gugaggaagccgcuggggc

SEQ ID NO: 3112957 - RNA, 16 nt, Human
gugaggaagccgcugg

SEQ ID NO: 3112958 - RNA, 13 nt, Human
gugagccacugca

SEQ ID NO: 3112959 - RNA, 17 nt, Human
gugacugaucucucgug

SEQ ID NO: 3112960 - RNA, 15 nt, Human
gugaccucugccuga

SEQ ID NO: 3112961 - RNA, 16 nt, Human
gugacaacacuugugu

SEQ ID NO: 3112962 - RNA, 16 nt, Human
gugacugaauuucuuu

SEQ ID NO: 3112963 - RNA, 18 nt, Human
gugacugaauuucuuuug

SEQ ID NO: 3112964 - RNA, 15 nt, Human
gugacugaauuucuu

SEQ ID NO: 3112965 - RNA, 12 nt, Human
gugaaacuggau

SEQ ID NO: 3112966 - RNA, 23 nt, Human
gugaaaagaaaaaugagccuggc

SEQ ID NO: 3112967 - RNA, 14 nt, Human
gugaaaagaaaaau

SEQ ID NO: 3112968 - RNA, 19 nt, Human
gugaaaggaaagagggagg

SEQ ID NO: 3112969 - RNA, 20 nt, Human
gugccagguuuuuggucuga

SEQ ID NO: 3112970 - RNA, 22 nt, Human
gugccagguuuuuggucugacc

SEQ ID NO: 3112971 - RNA, 13 nt, Human
gugcauaccacuu

SEQ ID NO: 3112972 - RNA, 14 nt, Human
gugcauaccacuuu

SEQ ID NO: 3112973 - RNA, 19 nt, Human
gugcauaaguuaacuucca

SEQ ID NO: 3112974 - RNA, 20 nt, Human
gugcccacaggaucagucug

SEQ ID NO: 3112975 - RNA, 14 nt, Human
gugauucuccugcc

SEQ ID NO: 3112976 - RNA, 16 nt, Human
gugauucuccugccuc

SEQ ID NO: 3112977 - RNA, 17 nt, Human
gugauucuccugccuca

SEQ ID NO: 3112978 - RNA, 18 nt, Human
gugauucuccugccucag

SEQ ID NO: 3112979 - RNA, 19 nt, Human
gugauucuccugccucagc

SEQ ID NO: 3112980 - RNA, 20 nt, Human
gugauucuccugccucagcc

SEQ ID NO: 3112981 - RNA, 22 nt, Human
gugauucuccugccucagccuc

SEQ ID NO: 3112982 - RNA, 23 nt, Human
gugauucuccugccucagccucc

SEQ ID NO: 3112983 - RNA, 12 nt, Human
gugauuuucauu

SEQ ID NO: 3112984 - RNA, 20 nt, Human
gugauccucccaccucagcc

SEQ ID NO: 3112985 - RNA, 22 nt, Human
gugauccucccaccucagccuc

SEQ ID NO: 3112986 - RNA, 14 nt, Human
gugauccucccacc

SEQ ID NO: 3112987 - RNA, 15 nt, Human
gugauccucccaccu

SEQ ID NO: 3112988 - RNA, 18 nt, Human
gugauccucccaccucag

SEQ ID NO: 3112989 - RNA, 15 nt, Human
gugauccacccaccu

SEQ ID NO: 3112990 - RNA, 18 nt, Human
gugauccacccaccucag

SEQ ID NO: 3112991 - RNA, 20 nt, Human
gugauccacccaccucagcc

SEQ ID NO: 3112992 - RNA, 11 nt, Human
gugaggccaga

SEQ ID NO: 3112993 - RNA, 22 nt, Human
gugcugccauccagguucagcu

SEQ ID NO: 3112994 - RNA, 11 nt, Human
gugcugcccug

SEQ ID NO: 3112995 - RNA, 12 nt, Human
gugcuuggagga

SEQ ID NO: 3112996 - RNA, 15 nt, Human
gugcuuggaggaagg

SEQ ID NO: 3112997 - RNA, 13 nt, Human
gugcuuggaggaa

SEQ ID NO: 3112998 - RNA, 18 nt, Human
guggaaaaauagccugcc

SEQ ID NO: 3112999 - RNA, 12 nt, Human
gugcugcauuua

SEQ ID NO: 3113000 - RNA, 19 nt, Human
gugcugcauuuaaaagaua

SEQ ID NO: 3113001 - RNA, 20 nt, Human
gugcugcauuuaaaagauac

SEQ ID NO: 3113002 - RNA, 15 nt, Human
gugcugccauccagg

SEQ ID NO: 3113003 - RNA, 18 nt, Human
gugcugccauccagguuc

SEQ ID NO: 3113004 - RNA, 19 nt, Human
gugcugccauccagguuca

SEQ ID NO: 3113005 - RNA, 12 nt, Human
gugcugagucug

SEQ ID NO: 3113006 - RNA, 19 nt, Human
gugcugagucugaaggcug

SEQ ID NO: 3113007 - RNA, 18 nt, Human
gugcugagucugaaggcu

SEQ ID NO: 3113008 - RNA, 17 nt, Human
gugcugagucugaaggc

SEQ ID NO: 3113009 - RNA, 16 nt, Human
gugcugagucugaagg

SEQ ID NO: 3113010 - RNA, 17 nt, Human
gugcucuggacaggcau

SEQ ID NO: 3113011 - RNA, 18 nt, Human
gugcucuggacaggcaug

SEQ ID NO: 3113012 - RNA, 19 nt, Human
gugcugaaugguuuucaaa

SEQ ID NO: 3113013 - RNA, 20 nt, Human
gugcugaaugguuuucaaaa

SEQ ID NO: 3113014 - RNA, 23 nt, Human
gugcugaaugguuuucaaaauaa

SEQ ID NO: 3113015 - RNA, 21 nt, Human
gugccuuggggacaagagcag

SEQ ID NO: 3113016 - RNA, 15 nt, Human
gugcucuggacaggc

SEQ ID NO: 3113017 - RNA, 16 nt, Human
gugcucuggacaggca

SEQ ID NO: 3113018 - RNA, 20 nt, Human
guggagaagcggcuggcagc

SEQ ID NO: 3113019 - RNA, 16 nt, Human
guggaugccugguggc

SEQ ID NO: 3113020 - RNA, 18 nt, Human
guggaugccugguggcag

SEQ ID NO: 3113021 - RNA, 17 nt, Human
guggaguucaucuugaa

SEQ ID NO: 3113022 - RNA, 19 nt, Human
guggcagugggagcugccu

SEQ ID NO: 3113023 - RNA, 21 nt, Human
guggcagugggagcugccugu

SEQ ID NO: 3113024 - RNA, 19 nt, Human
guggcagcugcgguccacc

SEQ ID NO: 3113025 - RNA, 20 nt, Human
guggaugccugguggcagcu

SEQ ID NO: 3113026 - RNA, 21 nt, Human
guggcagcugcgguccaccca

SEQ ID NO: 3113027 - RNA, 22 nt, Human
guggcagcugcgguccacccag

SEQ ID NO: 3113028 - RNA, 23 nt, Human
guggcagcugcgguccacccagg

SEQ ID NO: 3113029 - RNA, 12 nt, Human
guggcagcugcu

SEQ ID NO: 3113030 - RNA, 13 nt, Human
guggcagcugcuu

SEQ ID NO: 3113031 - RNA, 19 nt, Human
guggcagcugcuuuugucu

SEQ ID NO: 3113032 - RNA, 16 nt, Human
guggcagugggagcug

SEQ ID NO: 3113033 - RNA, 17 nt, Human
guggcagugggagcugc

SEQ ID NO: 3113034 - RNA, 15 nt, Human
guggcagugggagcu

SEQ ID NO: 3113035 - RNA, 21 nt, Human
gucauauaagauucauauuua

SEQ ID NO: 3113036 - RNA, 14 nt, Human
guccacccaggagc

SEQ ID NO: 3113037 - RNA, 13 nt, Human
guccacccaggag

SEQ ID NO: 3113038 - RNA, 15 nt, Human
guccacccaggagcc

SEQ ID NO: 3113039 - RNA, 16 nt, Human
guccacccaggagccc

SEQ ID NO: 3113040 - RNA, 15 nt, Human
gucccacucagucca

SEQ ID NO: 3113041 - RNA, 14 nt, Human
gucccacucagucc

SEQ ID NO: 3113042 - RNA, 17 nt, Human
gucccagauacuugggg

SEQ ID NO: 3113043 - RNA, 16 nt, Human
gucaauuacaggaagu

SEQ ID NO: 3113044 - RNA, 15 nt, Human
gucaauuacaggaag

SEQ ID NO: 3113045 - RNA, 13 nt, Human
gucaauuacagga

SEQ ID NO: 3113046 - RNA, 13 nt, Human
gucaccccggcca

SEQ ID NO: 3113047 - RNA, 20 nt, Human
gucaccugaagacucauucu

SEQ ID NO: 3113048 - RNA, 18 nt, Human
gucaagagggucugagga

SEQ ID NO: 3113049 - RNA, 19 nt, Human
gucaagagggucugaggaa

SEQ ID NO: 3113050 - RNA, 19 nt, Human
gucaagugaaaaaggagga

SEQ ID NO: 3113051 - RNA, 18 nt, Human
gucaagugaaaaaggagg

SEQ ID NO: 3113052 - RNA, 16 nt, Human
gucaagugaaaaagga

SEQ ID NO: 3113053 - RNA, 13 nt, Human
guagagugggagc

SEQ ID NO: 3113054 - RNA, 15 nt, Human
guagagugggagcug

SEQ ID NO: 3113055 - RNA, 13 nt, Human
guauuacuucugc

SEQ ID NO: 3113056 - RNA, 14 nt, Human
guauuacuucugcu

SEQ ID NO: 3113057 - RNA, 15 nt, Human
guauuacuucugcua

SEQ ID NO: 3113058 - RNA, 14 nt, Human
guauuauaccuuuu

SEQ ID NO: 3113059 - RNA, 19 nt, Human
guccugggagugagcuggu

SEQ ID NO: 3113060 - RNA, 17 nt, Human
guccugggagugagcug

SEQ ID NO: 3113061 - RNA, 18 nt, Human
guccugggagugagcugg

SEQ ID NO: 3113062 - RNA, 15 nt, Human
guccugggagugagc

SEQ ID NO: 3113063 - RNA, 16 nt, Human
guccugggagugagcu

SEQ ID NO: 3113064 - RNA, 17 nt, Human
guccuggcaugggaaug

SEQ ID NO: 3113065 - RNA, 12 nt, Human
guccucccaucu

SEQ ID NO: 3113066 - RNA, 14 nt, Human
guccucccaucuca

SEQ ID NO: 3113067 - RNA, 13 nt, Human
guccucccaucuc

SEQ ID NO: 3113068 - RNA, 23 nt, Human
guccucccaucucacacaugagc

SEQ ID NO: 3113069 - RNA, 13 nt, Human
guccuacucugug

SEQ ID NO: 3113070 - RNA, 17 nt, Human
gucccugguggcagcuc

SEQ ID NO: 3113071 - RNA, 16 nt, Human
gucccugguggcagcu

SEQ ID NO: 3113072 - RNA, 15 nt, Human
guccuacucuguguc

SEQ ID NO: 3113073 - RNA, 23 nt, Human
guccuacucugugucaggugggg

SEQ ID NO: 3113074 - RNA, 23 nt, Human
guccuagaaauuccccacccuga

SEQ ID NO: 3113075 - RNA, 12 nt, Human
gucccagugccg

SEQ ID NO: 3113076 - RNA, 17 nt, Human
gucugauucccaagcuc

SEQ ID NO: 3113077 - RNA, 18 nt, Human
gucugauucccaagcucu

SEQ ID NO: 3113078 - RNA, 19 nt, Human
gucugauucccaagcucug

SEQ ID NO: 3113079 - RNA, 21 nt, Human
gucugaggaauccagacccgg

SEQ ID NO: 3113080 - RNA, 20 nt, Human
gucugauucccaagcucugc

SEQ ID NO: 3113081 - RNA, 21 nt, Human
gucugauucccaagcucugcu

SEQ ID NO: 3113082 - RNA, 13 nt, Human
gucugacccacug

SEQ ID NO: 3113083 - RNA, 14 nt, Human
gucugacccacugc

SEQ ID NO: 3113084 - RNA, 15 nt, Human
gucugacccacugcu

SEQ ID NO: 3113085 - RNA, 18 nt, Human
gucugaggaauccagacc

SEQ ID NO: 3113086 - RNA, 19 nt, Human
gucugaggaauccagaccc

SEQ ID NO: 3113087 - RNA, 20 nt, Human
gucucacuauguugcccagg

SEQ ID NO: 3113088 - RNA, 21 nt, Human
gucucacuauguugcccaggc

SEQ ID NO: 3113089 - RNA, 13 nt, Human
gucucacuguugc

SEQ ID NO: 3113090 - RNA, 23 nt, Human
gucucacuauguugcccaggcag

SEQ ID NO: 3113091 - RNA, 16 nt, Human
gucucacuguugccca

SEQ ID NO: 3113092 - RNA, 17 nt, Human
gucucacuguugcccag

SEQ ID NO: 3113093 - RNA, 18 nt, Human
gucucacuguugcccagg

SEQ ID NO: 3113094 - RNA, 19 nt, Human
gucucacuguugcccaggc

SEQ ID NO: 3113095 - RNA, 20 nt, Human
gucucacuguugcccaggcu

SEQ ID NO: 3113096 - RNA, 21 nt, Human
gucucacuguugcccaggcug

SEQ ID NO: 3113097 - RNA, 22 nt, Human
gucucacuguugcccaggcugg

SEQ ID NO: 3113098 - RNA, 23 nt, Human
gucucacuguugcccaggcuggc

SEQ ID NO: 3113099 - RNA, 15 nt, Human
guccuuaccagcaga

SEQ ID NO: 3113100 - RNA, 17 nt, Human
guccuuaccagcagagc

SEQ ID NO: 3113101 - RNA, 16 nt, Human
guccuuaccagcagag

SEQ ID NO: 3113102 - RNA, 15 nt, Human
gucuacacugugcug

SEQ ID NO: 3113103 - RNA, 14 nt, Human
gggcuucaguggca

SEQ ID NO: 3113104 - RNA, 14 nt, Human
gggcugcaccggcu

SEQ ID NO: 3113105 - RNA, 16 nt, Human
gggcugaggugggagg

SEQ ID NO: 3113106 - RNA, 13 nt, Human
gggcucugccucc

SEQ ID NO: 3113107 - RNA, 20 nt, Human
gggcucugccucccaucacc

SEQ ID NO: 3113108 - RNA, 17 nt, Human
gggcucugccucccauc

SEQ ID NO: 3113109 - RNA, 16 nt, Human
gggcucugccucccau

SEQ ID NO: 3113110 - RNA, 15 nt, Human
gggcucugccuccca

SEQ ID NO: 3113111 - RNA, 19 nt, Human
gggccuggccugagcuggg

SEQ ID NO: 3113112 - RNA, 12 nt, Human
gggccuggcuca

SEQ ID NO: 3113113 - RNA, 16 nt, Human
gggccuggcucaggug

SEQ ID NO: 3113114 - RNA, 14 nt, Human
gggccuggcucagg

SEQ ID NO: 3113115 - RNA, 18 nt, Human
gggccuggucguuuucaa

SEQ ID NO: 3113116 - RNA, 23 nt, Human
gggcucccuucccaccucucuca

SEQ ID NO: 3113117 - RNA, 18 nt, Human
gggcucccuucccaccuc

SEQ ID NO: 3113118 - RNA, 17 nt, Human
gggcucccuucccaccu

SEQ ID NO: 3113119 - RNA, 14 nt, Human
gggcucccuuccca

SEQ ID NO: 3113120 - RNA, 13 nt, Human
gggcucccuuccc

SEQ ID NO: 3113121 - RNA, 16 nt, Human
gggcgcgguggcucac

SEQ ID NO: 3113122 - RNA, 23 nt, Human
ggggcugcaccggcuggccuggc

SEQ ID NO: 3113123 - RNA, 17 nt, Human
ggggcugggcagaggaa

SEQ ID NO: 3113124 - RNA, 16 nt, Human
ggggcugggcagagga

SEQ ID NO: 3113125 - RNA, 13 nt, Human
ggggcugggacau

SEQ ID NO: 3113126 - RNA, 23 nt, Human
gggguucccuuuuuuggcugcug

SEQ ID NO: 3113127 - RNA, 19 nt, Human
ggguacuuguggacacagc

SEQ ID NO: 3113128 - RNA, 22 nt, Human
ggguacuuguggacacagcucu

SEQ ID NO: 3113129 - RNA, 23 nt, Human
ggguacuuguggacacagcucuu

SEQ ID NO: 3113130 - RNA, 23 nt, Human
ggguagagcggagaaaggaaggg

SEQ ID NO: 3113131 - RNA, 13 nt, Human
ggguacccacugc

SEQ ID NO: 3113132 - RNA, 15 nt, Human
ggguacccacugcuc

SEQ ID NO: 3113133 - RNA, 18 nt, Human
ggguacccacugcucugg

SEQ ID NO: 3113134 - RNA, 11 nt, Human
ggggagaaagu

SEQ ID NO: 3113135 - RNA, 21 nt, Human
gggcuuggggaccagagcugc

SEQ ID NO: 3113136 - RNA, 13 nt, Human
ggggaguggccac

SEQ ID NO: 3113137 - RNA, 17 nt, Human
ggggaucacagccucug

SEQ ID NO: 3113138 - RNA, 15 nt, Human
gggcuucaguggcag

SEQ ID NO: 3113139 - RNA, 16 nt, Human
gggcuucaguggcagc

SEQ ID NO: 3113140 - RNA, 17 nt, Human
gggcuucaguggcagcu

SEQ ID NO: 3113141 - RNA, 18 nt, Human
gggcuucaguggcagcug

SEQ ID NO: 3113142 - RNA, 19 nt, Human
gggcuucaguggcagcugc

SEQ ID NO: 3113143 - RNA, 20 nt, Human
gggcuucaguggcagcugcu

SEQ ID NO: 3113144 - RNA, 19 nt, Human
gggcuucauccuccucaga

SEQ ID NO: 3113145 - RNA, 20 nt, Human
gggcuuggggaccagagcug

SEQ ID NO: 3113146 - RNA, 20 nt, Human
gggcuucauccuccucagau

SEQ ID NO: 3113147 - RNA, 15 nt, Human
gguggcagcugcggu

SEQ ID NO: 3113148 - RNA, 23 nt, Human
gguggcagcugcgguccacccag

SEQ ID NO: 3113149 - RNA, 11 nt, Human
gguggcagcug

SEQ ID NO: 3113150 - RNA, 13 nt, Human
gguggcagcucac

SEQ ID NO: 3113151 - RNA, 12 nt, Human
gguggcagcugc

SEQ ID NO: 3113152 - RNA, 13 nt, Human
gguggcagcugcg

SEQ ID NO: 3113153 - RNA, 22 nt, Human
ggugcuaucucccccagcccca

SEQ ID NO: 3113154 - RNA, 21 nt, Human
ggugcuaucucccccagcccc

SEQ ID NO: 3113155 - RNA, 23 nt, Human
ggugcuaucucccccagccccau

SEQ ID NO: 3113156 - RNA, 15 nt, Human
ggugcgaucuggguu

SEQ ID NO: 3113157 - RNA, 16 nt, Human
ggugaccucugccuga

SEQ ID NO: 3113158 - RNA, 14 nt, Human
ggugaccucugccu

SEQ ID NO: 3113159 - RNA, 15 nt, Human
ggucugacccacugc

SEQ ID NO: 3113160 - RNA, 16 nt, Human
ggucugacccacugcu

SEQ ID NO: 3113161 - RNA, 21 nt, Human
ggucucacuauguugcccagg

SEQ ID NO: 3113162 - RNA, 12 nt, Human
ggucucacucug

SEQ ID NO: 3113163 - RNA, 19 nt, Human
ggucugaggaauccagacc

SEQ ID NO: 3113164 - RNA, 16 nt, Human
ggugaacuugguuccc

SEQ ID NO: 3113165 - RNA, 18 nt, Human
ggugaagugaagacaaug

SEQ ID NO: 3113166 - RNA, 22 nt, Human
ggucucacuauguugcccaggc

SEQ ID NO: 3113167 - RNA, 22 nt, Human
ggucccugguggcagcucaccu

SEQ ID NO: 3113168 - RNA, 14 nt, Human
ggucccugguggca

SEQ ID NO: 3113169 - RNA, 17 nt, Human
gguacccacugcucugg

SEQ ID NO: 3113170 - RNA, 16 nt, Human
gguacccacugcucug

SEQ ID NO: 3113171 - RNA, 15 nt, Human
ggguugggcuggugu

SEQ ID NO: 3113172 - RNA, 20 nt, Human
gguacuuguggacacagcuc

SEQ ID NO: 3113173 - RNA, 22 nt, Human
gguacuuguggacacagcucuu

SEQ ID NO: 3113174 - RNA, 21 nt, Human
gguacuuguggacacagcucu

SEQ ID NO: 3113175 - RNA, 23 nt, Human
ggguucccuuuuuuggcugcuga

SEQ ID NO: 3113176 - RNA, 22 nt, Human
ggguucuacccaggugcuagga

SEQ ID NO: 3113177 - RNA, 17 nt, Human
ggguucuacccaggugc

SEQ ID NO: 3113178 - RNA, 16 nt, Human
ggguuggccccugccc

SEQ ID NO: 3113179 - RNA, 19 nt, Human
ggguuggccccugcccggc

SEQ ID NO: 3113180 - RNA, 12 nt, Human
ggucacucuggc

SEQ ID NO: 3113181 - RNA, 12 nt, Human
ggucagagccug

SEQ ID NO: 3113182 - RNA, 22 nt, Human
ggucacucuggcagcucagaga

SEQ ID NO: 3113183 - RNA, 20 nt, Human
ggucacucuggcagcucaga

SEQ ID NO: 3113184 - RNA, 16 nt, Human
ggucacucuggcagcu

SEQ ID NO: 3113185 - RNA, 13 nt, Human
ggucagagccugc

SEQ ID NO: 3113186 - RNA, 14 nt, Human
ggucagagccugca

SEQ ID NO: 3113187 - RNA, 15 nt, Human
ggucagagccugcag

SEQ ID NO: 3113188 - RNA, 16 nt, Human
ggucagagccugcagu

SEQ ID NO: 3113189 - RNA, 13 nt, Human
ggucccccuucca

SEQ ID NO: 3113190 - RNA, 23 nt, Human
ggucccccuuccauggacuuugu

SEQ ID NO: 3113191 - RNA, 18 nt, Human
ggucccccuuccauggac

SEQ ID NO: 3113192 - RNA, 22 nt, Human
ggucccacucaguccauagcag

SEQ ID NO: 3113193 - RNA, 12 nt, Human
ggucccacucag

SEQ ID NO: 3113194 - RNA, 14 nt, Human
ggucccacucaguc

SEQ ID NO: 3113195 - RNA, 22 nt, Human
ggucccaccccacacacgccag

SEQ ID NO: 3113196 - RNA, 11 nt, Human
ggucagagccu

SEQ ID NO: 3113197 - RNA, 23 nt, Human
guaaauuaacuuuuauaaacuuu

SEQ ID NO: 3113198 - RNA, 18 nt, Human
guaaggaauaccuguccc

SEQ ID NO: 3113199 - RNA, 13 nt, Human
guaaggaaugauu

SEQ ID NO: 3113200 - RNA, 23 nt, Human
guaaggaauaccugucccccuga

SEQ ID NO: 3113201 - RNA, 21 nt, Human
guaaggaauaccugucccccu

SEQ ID NO: 3113202 - RNA, 20 nt, Human
guaaggaauaccuguccccc

SEQ ID NO: 3113203 - RNA, 22 nt, Human
guaaguauucuuauuuaaugaa

SEQ ID NO: 3113204 - RNA, 15 nt, Human
guaaauuaacuuuua

SEQ ID NO: 3113205 - RNA, 16 nt, Human
guaaauuaacuuuuau

SEQ ID NO: 3113206 - RNA, 17 nt, Human
guaaauuaacuuuuaua

SEQ ID NO: 3113207 - RNA, 21 nt, Human
guaaauuaacuuuuauaaacu

SEQ ID NO: 3113208 - RNA, 22 nt, Human
guaaauuaacuuuuauaaacuu

SEQ ID NO: 3113209 - RNA, 18 nt, Human
guaaaugggggugcauuu

SEQ ID NO: 3113210 - RNA, 19 nt, Human
guaaaugggggugcauuug

SEQ ID NO: 3113211 - RNA, 20 nt, Human
guaaaugggggugcauuuga

SEQ ID NO: 3113212 - RNA, 13 nt, Human
gguuggugggggc

SEQ ID NO: 3113213 - RNA, 13 nt, Human
gguuuaagcuguu

SEQ ID NO: 3113214 - RNA, 14 nt, Human
gguugggcuggugu

SEQ ID NO: 3113215 - RNA, 13 nt, Human
gguggccucccaa

SEQ ID NO: 3113216 - RNA, 21 nt, Human
gguucaagcgauucuucugcu

SEQ ID NO: 3113217 - RNA, 17 nt, Human
gguggccucccaacuca

SEQ ID NO: 3113218 - RNA, 20 nt, Human
gguucacugcaaccuccgcc

SEQ ID NO: 3113219 - RNA, 22 nt, Human
gguucaagcgauucuucugcuu

SEQ ID NO: 3113220 - RNA, 23 nt, Human
gguucaagcgauucuucugcuuc

SEQ ID NO: 3113221 - RNA, 14 nt, Human
gguugaagcaccaa

SEQ ID NO: 3113222 - RNA, 23 nt, Human
gguuuugccauguuggccaggcu

SEQ ID NO: 3113223 - RNA, 15 nt, Human
gguuuucuguucuuu

SEQ ID NO: 3113224 - RNA, 12 nt, Human
gguuuucuguuc

SEQ ID NO: 3113225 - RNA, 13 nt, Human
gguuuucuguucu

SEQ ID NO: 3113226 - RNA, 16 nt, Human
guacuucuccacccug

SEQ ID NO: 3113227 - RNA, 17 nt, Human
guacuucuccacccugc

SEQ ID NO: 3113228 - RNA, 18 nt, Human
guacuucuccacccugcu

SEQ ID NO: 3113229 - RNA, 19 nt, Human
guacuucuccacccugcuc

SEQ ID NO: 3113230 - RNA, 20 nt, Human
guacuucuccacccugcucu

SEQ ID NO: 3113231 - RNA, 21 nt, Human
guacuucuccacccugcucuc

SEQ ID NO: 3113232 - RNA, 16 nt, Human
guacuuguggacacag

SEQ ID NO: 3113233 - RNA, 20 nt, Human
guacuuguggacacagcucu

SEQ ID NO: 3113234 - RNA, 16 nt, Human
guagagcggagaaagg

SEQ ID NO: 3113235 - RNA, 18 nt, Human
guagagccagggucucac

SEQ ID NO: 3113236 - RNA, 21 nt, Human
guacuuguggacacagcucuu

SEQ ID NO: 3113237 - RNA, 13 nt, Human
guaccucuugagc

SEQ ID NO: 3113238 - RNA, 21 nt, Human
guaccucuugagccuugaacu

SEQ ID NO: 3113239 - RNA, 22 nt, Human
guaccucuugagccuugaacuu

SEQ ID NO: 3113240 - RNA, 16 nt, Human
guacccacugcucugg

SEQ ID NO: 3113241 - RNA, 14 nt, Human
guacuucuccaccc

SEQ ID NO: 3113242 - RNA, 15 nt, Human
guacuucuccacccu

SEQ ID NO: 3113243 - RNA, 17 nt, Human
guacguugugcauuugg

SEQ ID NO: 3113244 - RNA, 15 nt, Human
guacuaaggaaucuu

SEQ ID NO: 3113245 - RNA, 23 nt, Human
guacuaaggaaucuuucugcuuu

SEQ ID NO: 3113246 - RNA, 17 nt, Human
guacgucugacaggcaa

SEQ ID NO: 3113247 - RNA, 14 nt, Human
guacguugugcauu

SEQ ID NO: 3113248 - RNA, 15 nt, Human
guacguugugcauuu

SEQ ID NO: 3113249 - RNA, 16 nt, Human
guacguugugcauuug

SEQ ID NO: 3113250 - RNA, 14 nt, Human
guacgucugacagg

SEQ ID NO: 3113251 - RNA, 15 nt, Human
guacgucugacaggc

SEQ ID NO: 3113252 - RNA, 14 nt, Human
guaauuaaguacua

SEQ ID NO: 3113253 - RNA, 17 nt, Human
guaauuaaguacuaugu

SEQ ID NO: 3113254 - RNA, 20 nt, Human
guaauuaaguacuauguauc

SEQ ID NO: 3113255 - RNA, 21 nt, Human
guaauuaaguacuauguauca

SEQ ID NO: 3113256 - RNA, 18 nt, Human
guacacuguuucaaacuu

SEQ ID NO: 3113257 - RNA, 15 nt, Human
guacccacugcucug

SEQ ID NO: 3113258 - RNA, 20 nt, Human
guacauaaugcgugcauacc

SEQ ID NO: 3113259 - RNA, 20 nt, Human
guacagcaaggagauuuaca

SEQ ID NO: 3113260 - RNA, 22 nt, Human
guacagagcccacgcccccacu

SEQ ID NO: 3113261 - RNA, 18 nt, Human
guacagagcccacgcccc

SEQ ID NO: 3113262 - RNA, 12 nt, Human
guacagagccca

SEQ ID NO: 3113263 - RNA, 21 nt, Human
guacacuguuucaaacuuuac

SEQ ID NO: 3113264 - RNA, 19 nt, Human
guacacuguuucaaacuuu

SEQ ID NO: 3113265 - RNA, 20 nt, Human
guacacuguuucaaacuuua

SEQ ID NO: 3113266 - RNA, 16 nt, Human
guacagacaacaaacc

SEQ ID NO: 3113267 - RNA, 18 nt, Human
gcuugaggguugggcugg

SEQ ID NO: 3113268 - RNA, 20 nt, Human
gcuugaggguugggcuggug

SEQ ID NO: 3113269 - RNA, 15 nt, Human
gcuuugugauuuuug

SEQ ID NO: 3113270 - RNA, 21 nt, Human
gcuuuguuuguugucagcuga

SEQ ID NO: 3113271 - RNA, 18 nt, Human
ggaaaacaugcuacacac

SEQ ID NO: 3113272 - RNA, 18 nt, Human
ggaaaagcugcugacagu

SEQ ID NO: 3113273 - RNA, 20 nt, Human
ggaaaagcugcugacagugu

SEQ ID NO: 3113274 - RNA, 14 nt, Human
ggaaaagcugcuga

SEQ ID NO: 3113275 - RNA, 22 nt, Human
ggaaaggcuccaggagcagcca

SEQ ID NO: 3113276 - RNA, 21 nt, Human
ggaaaggcuccaggagcagcc

SEQ ID NO: 3113277 - RNA, 20 nt, Human
ggaaaggcuccaggagcagc

SEQ ID NO: 3113278 - RNA, 19 nt, Human
ggaaaggcuccaggagcag

SEQ ID NO: 3113279 - RNA, 17 nt, Human
ggaaaggcuccaggagc

SEQ ID NO: 3113280 - RNA, 12 nt, Human
ggaaaggcucca

SEQ ID NO: 3113281 - RNA, 14 nt, Human
ggaaaggcuccagg

SEQ ID NO: 3113282 - RNA, 13 nt, Human
ggaaaggcuccag

SEQ ID NO: 3113283 - RNA, 19 nt, Human
ggaaaaucagccugcucca

SEQ ID NO: 3113284 - RNA, 23 nt, Human
ggaaaaucagccugcuccagcug

SEQ ID NO: 3113285 - RNA, 21 nt, Human
ggaaaucaccgaaaacguggc

SEQ ID NO: 3113286 - RNA, 14 nt, Human
ggaaaucaccgaaa

SEQ ID NO: 3113287 - RNA, 15 nt, Human
gcugccaaugggagc

SEQ ID NO: 3113288 - RNA, 19 nt, Human
gcugccaaugggagcucau

SEQ ID NO: 3113289 - RNA, 16 nt, Human
gcugccaaugggagcu

SEQ ID NO: 3113290 - RNA, 13 nt, Human
gcuguucagcugg

SEQ ID NO: 3113291 - RNA, 14 nt, Human
gcuguucagcuggu

SEQ ID NO: 3113292 - RNA, 17 nt, Human
gcuuagucacugagaca

SEQ ID NO: 3113293 - RNA, 15 nt, Human
gcuuagucacugaga

SEQ ID NO: 3113294 - RNA, 20 nt, Human
gcuuagucacugagacagcc

SEQ ID NO: 3113295 - RNA, 19 nt, Human
gcuuagucacugagacagc

SEQ ID NO: 3113296 - RNA, 21 nt, Human
gcuuagucacugagacagccc

SEQ ID NO: 3113297 - RNA, 16 nt, Human
gcuugaggguugggcu

SEQ ID NO: 3113298 - RNA, 15 nt, Human
gcuuccagugaggcu

SEQ ID NO: 3113299 - RNA, 17 nt, Human
gcuucauuuccuguguc

SEQ ID NO: 3113300 - RNA, 16 nt, Human
gcuuccagugaggcuc

SEQ ID NO: 3113301 - RNA, 16 nt, Human
gcuucaguggcagcug

SEQ ID NO: 3113302 - RNA, 15 nt, Human
gcuucaguggcagcu

SEQ ID NO: 3113303 - RNA, 19 nt, Human
gcuuaucucaggggugugc

SEQ ID NO: 3113304 - RNA, 13 nt, Human
gcuuaucucaggg

SEQ ID NO: 3113305 - RNA, 12 nt, Human
gcuuauacacuu

SEQ ID NO: 3113306 - RNA, 13 nt, Human
gcuucauuuccug

SEQ ID NO: 3113307 - RNA, 16 nt, Human
gcuucauuuccugugu

SEQ ID NO: 3113308 - RNA, 15 nt, Human
gcuucauccuccuca

SEQ ID NO: 3113309 - RNA, 12 nt, Human
gcuucauccucc

SEQ ID NO: 3113310 - RNA, 17 nt, Human
gcuucaguggcagcugc

SEQ ID NO: 3113311 - RNA, 18 nt, Human
gcuucaguggcagcugcu

SEQ ID NO: 3113312 - RNA, 23 nt, Human
ggaaggggagauaaggguaucug

SEQ ID NO: 3113313 - RNA, 18 nt, Human
ggaaguacuggagaaaau

SEQ ID NO: 3113314 - RNA, 16 nt, Human
ggaaguacuggagaaa

SEQ ID NO: 3113315 - RNA, 12 nt, Human
ggaaguacugga

SEQ ID NO: 3113316 - RNA, 14 nt, Human
ggaaugauuaauua

SEQ ID NO: 3113317 - RNA, 19 nt, Human
ggaauguuugccucugccu

SEQ ID NO: 3113318 - RNA, 12 nt, Human
ggaaugcagugg

SEQ ID NO: 3113319 - RNA, 24 nt, Human
ggaaugauuaauuaaaacacaaca

SEQ ID NO: 3113320 - RNA, 22 nt, Human
ggacacuaaccacgcuggaccu

SEQ ID NO: 3113321 - RNA, 13 nt, Human
ggaccagagcugc

SEQ ID NO: 3113322 - RNA, 23 nt, Human
ggaccucaggugagaagcagagg

SEQ ID NO: 3113323 - RNA, 20 nt, Human
ggaccucaggccugggggcu

SEQ ID NO: 3113324 - RNA, 19 nt, Human
ggaccucaggugagaagca

SEQ ID NO: 3113325 - RNA, 15 nt, Human
ggaccuugaacuggg

SEQ ID NO: 3113326 - RNA, 17 nt, Human
ggaccuugaacugggua

SEQ ID NO: 3113327 - RNA, 17 nt, Human
ggacgcuacccgggaag

SEQ ID NO: 3113328 - RNA, 20 nt, Human
ggacgcuacccgggaagggg

SEQ ID NO: 3113329 - RNA, 19 nt, Human
ggacgcuacccgggaaggg

SEQ ID NO: 3113330 - RNA, 17 nt, Human
ggacacucaaaagcugg

SEQ ID NO: 3113331 - RNA, 20 nt, Human
ggacagaggggguggccucc

SEQ ID NO: 3113332 - RNA, 15 nt, Human
ggacagccacggcca

SEQ ID NO: 3113333 - RNA, 19 nt, Human
ggacagccacggccaggcc

SEQ ID NO: 3113334 - RNA, 20 nt, Human
ggacagccacggccaggcca

SEQ ID NO: 3113335 - RNA, 21 nt, Human
ggacagccacggccaggccag

SEQ ID NO: 3113336 - RNA, 14 nt, Human
ggacauggacaagg

SEQ ID NO: 3113337 - RNA, 20 nt, Human
ggacauugcggacagccacg

SEQ ID NO: 3113338 - RNA, 18 nt, Human
ggagaagcggcuggcagc

SEQ ID NO: 3113339 - RNA, 17 nt, Human
ggagaagcggcuggcag

SEQ ID NO: 3113340 - RNA, 16 nt, Human
ggcauuccccaggagg

SEQ ID NO: 3113341 - RNA, 19 nt, Human
ggcauuccccaggaggcca

SEQ ID NO: 3113342 - RNA, 18 nt, Human
ggcauuccccaggaggcc

SEQ ID NO: 3113343 - RNA, 18 nt, Human
ggcaugggaaugaauguc

SEQ ID NO: 3113344 - RNA, 17 nt, Human
ggcauuccccaggaggc

SEQ ID NO: 3113345 - RNA, 22 nt, Human
ggcaugggaaugaaugucagug

SEQ ID NO: 3113346 - RNA, 20 nt, Human
ggccagccuugaccauucuc

SEQ ID NO: 3113347 - RNA, 17 nt, Human
ggccagcugcuugggcu

SEQ ID NO: 3113348 - RNA, 22 nt, Human
ggccagccuugaccauucucca

SEQ ID NO: 3113349 - RNA, 18 nt, Human
ggccaggcccucugccca

SEQ ID NO: 3113350 - RNA, 23 nt, Human
ggccagcugcuugggcuucaucc

SEQ ID NO: 3113351 - RNA, 16 nt, Human
ggccaugggccuccug

SEQ ID NO: 3113352 - RNA, 18 nt, Human
ggcaugacacgaauauug

SEQ ID NO: 3113353 - RNA, 19 nt, Human
ggcagggucucacucuguc

SEQ ID NO: 3113354 - RNA, 20 nt, Human
ggcagggucucacucugucg

SEQ ID NO: 3113355 - RNA, 13 nt, Human
ggcagugggagcu

SEQ ID NO: 3113356 - RNA, 14 nt, Human
ggcagugggagcug

SEQ ID NO: 3113357 - RNA, 16 nt, Human
ggcagugggagcugcc

SEQ ID NO: 3113358 - RNA, 14 nt, Human
ggcagcucaccucu

SEQ ID NO: 3113359 - RNA, 12 nt, Human
ggcagcucaccu

SEQ ID NO: 3113360 - RNA, 22 nt, Human
ggcagcugcuuuugucuauggg

SEQ ID NO: 3113361 - RNA, 17 nt, Human
ggcagcuugaggguugg

SEQ ID NO: 3113362 - RNA, 21 nt, Human
ggcagcucagagaggguggga

SEQ ID NO: 3113363 - RNA, 13 nt, Human
ggcagcucagaga

SEQ ID NO: 3113364 - RNA, 20 nt, Human
ggcacccaccaucaugucug

SEQ ID NO: 3113365 - RNA, 23 nt, Human
ggcacccaccaucaugucuggcu

SEQ ID NO: 3113366 - RNA, 22 nt, Human
ggcacccggccccugcugguuc

SEQ ID NO: 3113367 - RNA, 14 nt, Human
ggcaaugcuggcug

SEQ ID NO: 3113368 - RNA, 15 nt, Human
ggcaaugcuggcugu

SEQ ID NO: 3113369 - RNA, 23 nt, Human
ggcaaugcuggcuguuggcuggg

SEQ ID NO: 3113370 - RNA, 18 nt, Human
ggcaacccccagccugcu

SEQ ID NO: 3113371 - RNA, 16 nt, Human
ggauucuuauggacaa

SEQ ID NO: 3113372 - RNA, 23 nt, Human
ggauuacaagcgugagccacugc

SEQ ID NO: 3113373 - RNA, 16 nt, Human
ggcaacccccagccug

SEQ ID NO: 3113374 - RNA, 17 nt, Human
ggcaacccccagccugc

SEQ ID NO: 3113375 - RNA, 17 nt, Human
ggauugcuacuguccua

SEQ ID NO: 3113376 - RNA, 18 nt, Human
ggauacaaaagcauguga

SEQ ID NO: 3113377 - RNA, 14 nt, Human
ggagugcagugagc

SEQ ID NO: 3113378 - RNA, 12 nt, Human
ggagugcaguga

SEQ ID NO: 3113379 - RNA, 23 nt, Human
ggagugaguugauagcacagacc

SEQ ID NO: 3113380 - RNA, 17 nt, Human
ggaucccucauccucau

SEQ ID NO: 3113381 - RNA, 13 nt, Human
ggaucccucaucc

SEQ ID NO: 3113382 - RNA, 22 nt, Human
ggaucccucauccucauaccca

SEQ ID NO: 3113383 - RNA, 17 nt, Human
ggaugcagccucacagu

SEQ ID NO: 3113384 - RNA, 16 nt, Human
ggaugcagccucacag

SEQ ID NO: 3113385 - RNA, 21 nt, Human
ggaugauuggaggggggaggu

SEQ ID NO: 3113386 - RNA, 23 nt, Human
ggaugcacagaguuguuacauuu

SEQ ID NO: 3113387 - RNA, 13 nt, Human
ggauccuccaggu

SEQ ID NO: 3113388 - RNA, 12 nt, Human
ggauccuccagg

SEQ ID NO: 3113389 - RNA, 15 nt, Human
ggaugcuuguacaua

SEQ ID NO: 3113390 - RNA, 19 nt, Human
ggauuacaagcgugagcca

SEQ ID NO: 3113391 - RNA, 19 nt, Human
ggaugcagccucacagucc

SEQ ID NO: 3113392 - RNA, 11 nt, Human
ggcccagagag

SEQ ID NO: 3113393 - RNA, 17 nt, Human
ggcccucugcccacucc

SEQ ID NO: 3113394 - RNA, 16 nt, Human
ggcccucugcccacuc

SEQ ID NO: 3113395 - RNA, 15 nt, Human
ggcccucugcccacu

SEQ ID NO: 3113396 - RNA, 13 nt, Human
ggcccucugccca

SEQ ID NO: 3113397 - RNA, 20 nt, Human
ggcccucugcccacucccug

SEQ ID NO: 3113398 - RNA, 19 nt, Human
ggcccucugcccacucccu

SEQ ID NO: 3113399 - RNA, 21 nt, Human
ggcccucugcccacucccugc

SEQ ID NO: 3113400 - RNA, 15 nt, Human
ggcccugccuccuuu

SEQ ID NO: 3113401 - RNA, 14 nt, Human
ggcccugccuccuu

SEQ ID NO: 3113402 - RNA, 13 nt, Human
ggcccugccuccu

SEQ ID NO: 3113403 - RNA, 17 nt, Human
ggccucuuaugggcugg

SEQ ID NO: 3113404 - RNA, 18 nt, Human
ggccucuuaugggcuggg

SEQ ID NO: 3113405 - RNA, 15 nt, Human
ggccucugcacuccc

SEQ ID NO: 3113406 - RNA, 14 nt, Human
ggccucugcacucc

SEQ ID NO: 3113407 - RNA, 13 nt, Human
ggccucugcacuc

SEQ ID NO: 3113408 - RNA, 23 nt, Human
ggccuagcauacguacacauuuu

SEQ ID NO: 3113409 - RNA, 22 nt, Human
ggcuagagguucaaagauauuu

SEQ ID NO: 3113410 - RNA, 17 nt, Human
ggcuagagguucaaaga

SEQ ID NO: 3113411 - RNA, 16 nt, Human
ggcuagagguucaaag

SEQ ID NO: 3113412 - RNA, 16 nt, Human
ggcuaggaccccucca

SEQ ID NO: 3113413 - RNA, 22 nt, Human
ggcuaggaccccuccauguggg

SEQ ID NO: 3113414 - RNA, 14 nt, Human
ggcuaugcauuuga

SEQ ID NO: 3113415 - RNA, 16 nt, Human
ggcuaguugggcuucc

SEQ ID NO: 3113416 - RNA, 15 nt, Human
ggcuaguugggcuuc

SEQ ID NO: 3113417 - RNA, 23 nt, Human
ggcuagugugguguuuccuggca

SEQ ID NO: 3113418 - RNA, 15 nt, Human
ggcuaugcauuugaa

SEQ ID NO: 3113419 - RNA, 15 nt, Human
ggcucaaguccucuu

SEQ ID NO: 3113420 - RNA, 21 nt, Human
ggcucaaguccucuuuucuga

SEQ ID NO: 3113421 - RNA, 12 nt, Human
ggcuccaggagc

SEQ ID NO: 3113422 - RNA, 19 nt, Human
ggcuccaggagcagccaca

SEQ ID NO: 3113423 - RNA, 16 nt, Human
ggcuccaggcuccuuu

SEQ ID NO: 3113424 - RNA, 18 nt, Human
ggcuccaggagcagccac

SEQ ID NO: 3113425 - RNA, 11 nt, Human
ggcuccaggcu

SEQ ID NO: 3113426 - RNA, 15 nt, Human
ggcuccaggcuccuu

SEQ ID NO: 3113427 - RNA, 23 nt, Human
ggcgcugccccuggcagccccug

SEQ ID NO: 3113428 - RNA, 21 nt, Human
ggcgcugccccuggcagcccc

SEQ ID NO: 3113429 - RNA, 19 nt, Human
ggcgcugccccuggcagcc

SEQ ID NO: 3113430 - RNA, 18 nt, Human
ggcgcugccccuggcagc

SEQ ID NO: 3113431 - RNA, 19 nt, Human
ggccuggccugagcuggga

SEQ ID NO: 3113432 - RNA, 22 nt, Human
ggccugggggcugggcagagga

SEQ ID NO: 3113433 - RNA, 20 nt, Human
ggccugggggcugggcagag

SEQ ID NO: 3113434 - RNA, 14 nt, Human
ggccugggggcugg

SEQ ID NO: 3113435 - RNA, 16 nt, Human
gccgagaucacgccac

SEQ ID NO: 3113436 - RNA, 18 nt, Human
gccgagaucacgccacug

SEQ ID NO: 3113437 - RNA, 17 nt, Human
gccgagauugcaccacu

SEQ ID NO: 3113438 - RNA, 18 nt, Human
gccgagauugcaccacug

SEQ ID NO: 3113439 - RNA, 22 nt, Human
gcccuucucuccagccccugga

SEQ ID NO: 3113440 - RNA, 21 nt, Human
gcccuucucuccagccccugg

SEQ ID NO: 3113441 - RNA, 19 nt, Human
gcccuucucuccagccccu

SEQ ID NO: 3113442 - RNA, 18 nt, Human
gcccuucucuccagcccc

SEQ ID NO: 3113443 - RNA, 14 nt, Human
gcccugguggcagu

SEQ ID NO: 3113444 - RNA, 17 nt, Human
gcccugguggcaguggg

SEQ ID NO: 3113445 - RNA, 18 nt, Human
gcccugguggcaguggga

SEQ ID NO: 3113446 - RNA, 19 nt, Human
gcccugguggcagugggag

SEQ ID NO: 3113447 - RNA, 20 nt, Human
gcccugguggcagugggagc

SEQ ID NO: 3113448 - RNA, 21 nt, Human
gcccugguggcagugggagcu

SEQ ID NO: 3113449 - RNA, 22 nt, Human
gcccugguggcagugggagcug

SEQ ID NO: 3113450 - RNA, 23 nt, Human
gcccugguggcagugggagcugc

SEQ ID NO: 3113451 - RNA, 15 nt, Human
gcccggcuccaggcu

SEQ ID NO: 3113452 - RNA, 16 nt, Human
gcccggcuccaggcuc

SEQ ID NO: 3113453 - RNA, 13 nt, Human
gccccugccaccc

SEQ ID NO: 3113454 - RNA, 14 nt, Human
gccccugccacccu

SEQ ID NO: 3113455 - RNA, 15 nt, Human
gccccugccacccug

SEQ ID NO: 3113456 - RNA, 17 nt, Human
gccccuguucuggcaga

SEQ ID NO: 3113457 - RNA, 21 nt, Human
gccccuguucuggcagaguug

SEQ ID NO: 3113458 - RNA, 15 nt, Human
gcagacucuacagag

SEQ ID NO: 3113459 - RNA, 17 nt, Human
gcccggcuccaggcucc

SEQ ID NO: 3113460 - RNA, 18 nt, Human
gcccggcuccaggcuccu

SEQ ID NO: 3113461 - RNA, 14 nt, Human
gcccugagcuuucu

SEQ ID NO: 3113462 - RNA, 16 nt, Human
gcccugagcuuucugc

SEQ ID NO: 3113463 - RNA, 12 nt, Human
gcccucugccca

SEQ ID NO: 3113464 - RNA, 15 nt, Human
gccugcuccagcugu

SEQ ID NO: 3113465 - RNA, 18 nt, Human
gccugcuccagcuguuca

SEQ ID NO: 3113466 - RNA, 16 nt, Human
gccugcuccagcuguu

SEQ ID NO: 3113467 - RNA, 22 nt, Human
gccugaagucacacagugaguc

SEQ ID NO: 3113468 - RNA, 18 nt, Human
gccucugccucugacaca

SEQ ID NO: 3113469 - RNA, 20 nt, Human
gccugggggcugggcagagg

SEQ ID NO: 3113470 - RNA, 17 nt, Human
gccugggcagaaggaag

SEQ ID NO: 3113471 - RNA, 16 nt, Human
gccugggcagaaggaa

SEQ ID NO: 3113472 - RNA, 14 nt, Human
gccuggauggggcu

SEQ ID NO: 3113473 - RNA, 15 nt, Human
gccuggauggggcug

SEQ ID NO: 3113474 - RNA, 15 nt, Human
gccugggcagaagga

SEQ ID NO: 3113475 - RNA, 14 nt, Human
gccuggccagaugc

SEQ ID NO: 3113476 - RNA, 15 nt, Human
gccuggccagaugca

SEQ ID NO: 3113477 - RNA, 22 nt, Human
gccuggccagaugcaccagccc

SEQ ID NO: 3113478 - RNA, 19 nt, Human
gccgagauagccaaggcca

SEQ ID NO: 3113479 - RNA, 14 nt, Human
gccucaaccuccug

SEQ ID NO: 3113480 - RNA, 16 nt, Human
gccucaaccuccuggg

SEQ ID NO: 3113481 - RNA, 19 nt, Human
gccucaagugauucuccug

SEQ ID NO: 3113482 - RNA, 20 nt, Human
gccucaagugauucuccugc

SEQ ID NO: 3113483 - RNA, 21 nt, Human
gccucaagugauucuccugcc

SEQ ID NO: 3113484 - RNA, 12 nt, Human
gccucagugcca

SEQ ID NO: 3113485 - RNA, 14 nt, Human
gccucagugccacu

SEQ ID NO: 3113486 - RNA, 23 nt, Human
gccucagccucccaaagugcugg

SEQ ID NO: 3113487 - RNA, 22 nt, Human
gccucagccucccaaagugcug

SEQ ID NO: 3113488 - RNA, 21 nt, Human
gccucacaguccuuaccagca

SEQ ID NO: 3113489 - RNA, 15 nt, Human
gccucagugccacua

SEQ ID NO: 3113490 - RNA, 21 nt, Human
gccucccaacucaccccagcc

SEQ ID NO: 3113491 - RNA, 23 nt, Human
gccucccaacucaccccagcccc

SEQ ID NO: 3113492 - RNA, 22 nt, Human
gccucccaacucaccccagccc

SEQ ID NO: 3113493 - RNA, 21 nt, Human
gccucccgaauagcugggacu

SEQ ID NO: 3113494 - RNA, 14 nt, Human
gccucccacgacug

SEQ ID NO: 3113495 - RNA, 21 nt, Human
gccucccacgacugcccggca

SEQ ID NO: 3113496 - RNA, 23 nt, Human
gccucccgaauagcugggacuac

SEQ ID NO: 3113497 - RNA, 15 nt, Human
gccucccgaguagcu

SEQ ID NO: 3113498 - RNA, 13 nt, Human
gcuccaagcuccc

SEQ ID NO: 3113499 - RNA, 15 nt, Human
gcuccaagcucccag

SEQ ID NO: 3113500 - RNA, 14 nt, Human
gcuccaagcuccca

SEQ ID NO: 3113501 - RNA, 21 nt, Human
gcuccaagcucccaggcauuc

SEQ ID NO: 3113502 - RNA, 19 nt, Human
gcuccaagcucccaggcau

SEQ ID NO: 3113503 - RNA, 18 nt, Human
gcuccaagcucccaggca

SEQ ID NO: 3113504 - RNA, 17 nt, Human
gcuccaagcucccaggc

SEQ ID NO: 3113505 - RNA, 16 nt, Human
gcuccaagcucccagg

SEQ ID NO: 3113506 - RNA, 13 nt, Human
gcuccaggcuccu

SEQ ID NO: 3113507 - RNA, 11 nt, Human
gcuccagcugu

SEQ ID NO: 3113508 - RNA, 16 nt, Human
gcuccaggcuccuuua

SEQ ID NO: 3113509 - RNA, 23 nt, Human
gcuccaggcuccuuuagcgccca

SEQ ID NO: 3113510 - RNA, 23 nt, Human
gcucagcaaaagaugcuucucac

SEQ ID NO: 3113511 - RNA, 22 nt, Human
gcucagcaaaagaugcuucuca

SEQ ID NO: 3113512 - RNA, 20 nt, Human
gcucagcaaaagaugcuucu

SEQ ID NO: 3113513 - RNA, 17 nt, Human
gcucagcaaaagaugcu

SEQ ID NO: 3113514 - RNA, 20 nt, Human
gcucaccagccccagugccc

SEQ ID NO: 3113515 - RNA, 23 nt, Human
gcucaccagccccagugcccaca

SEQ ID NO: 3113516 - RNA, 19 nt, Human
gcucaccagccccagugcc

SEQ ID NO: 3113517 - RNA, 18 nt, Human
gcucaccagccccagugc

SEQ ID NO: 3113518 - RNA, 21 nt, Human
gcucagcggggacagcuccuu

SEQ ID NO: 3113519 - RNA, 22 nt, Human
gcucagcggggacagcuccuuc

SEQ ID NO: 3113520 - RNA, 18 nt, Human
gcucaggugucccugcac

SEQ ID NO: 3113521 - RNA, 17 nt, Human
gcucaggugucccugca

SEQ ID NO: 3113522 - RNA, 20 nt, Human
gcucagcggggacagcuccu

SEQ ID NO: 3113523 - RNA, 19 nt, Human
gcucagcggggacagcucc

SEQ ID NO: 3113524 - RNA, 15 nt, Human
gcucagcggggacag

SEQ ID NO: 3113525 - RNA, 19 nt, Human
gcucaggugucccugcacu

SEQ ID NO: 3113526 - RNA, 15 nt, Human
gcuaucucccccagc

SEQ ID NO: 3113527 - RNA, 23 nt, Human
gcuaucucccccagccccauccu

SEQ ID NO: 3113528 - RNA, 22 nt, Human
gcuaucucccccagccccaucc

SEQ ID NO: 3113529 - RNA, 21 nt, Human
gcuaucucccccagccccauc

SEQ ID NO: 3113530 - RNA, 20 nt, Human
gcuaucucccccagccccau

SEQ ID NO: 3113531 - RNA, 19 nt, Human
gcuaucucccccagcccca

SEQ ID NO: 3113532 - RNA, 22 nt, Human
gcuagcagcagggagggcuucu

SEQ ID NO: 3113533 - RNA, 18 nt, Human
gcuaucucccccagcccc

SEQ ID NO: 3113534 - RNA, 17 nt, Human
gcuaucucccccagccc

SEQ ID NO: 3113535 - RNA, 16 nt, Human
gcuaucucccccagcc

SEQ ID NO: 3113536 - RNA, 20 nt, Human
gcuaccuuuguauucucucc

SEQ ID NO: 3113537 - RNA, 21 nt, Human
gcuacccgggaagggggcugg

SEQ ID NO: 3113538 - RNA, 19 nt, Human
gcuagagguucaaagauau

SEQ ID NO: 3113539 - RNA, 21 nt, Human
gcuagagguucaaagauauuu

SEQ ID NO: 3113540 - RNA, 18 nt, Human
gcuagagguucaaagaua

SEQ ID NO: 3113541 - RNA, 15 nt, Human
gcuacccgggaaggg

SEQ ID NO: 3113542 - RNA, 14 nt, Human
gcuacccgggaagg

SEQ ID NO: 3113543 - RNA, 23 nt, Human
gcuaagagggagggagggcucca

SEQ ID NO: 3113544 - RNA, 16 nt, Human
gcuaaaugugaaugau

SEQ ID NO: 3113545 - RNA, 13 nt, Human
gcuaaaugugaau

SEQ ID NO: 3113546 - RNA, 22 nt, Human
gcuaagagggagggagggcucc

SEQ ID NO: 3113547 - RNA, 21 nt, Human
gcuaagagggagggagggcuc

SEQ ID NO: 3113548 - RNA, 16 nt, Human
gcgugagccacugcac

SEQ ID NO: 3113549 - RNA, 18 nt, Human
gcgugagccacugcaccg

SEQ ID NO: 3113550 - RNA, 23 nt, Human
gcgugagccacugcaccgggcca

SEQ ID NO: 3113551 - RNA, 18 nt, Human
gcgguccacccaggagcc

SEQ ID NO: 3113552 - RNA, 19 nt, Human
gcgguccacccaggagccc

SEQ ID NO: 3113553 - RNA, 12 nt, Human
gcggggacagcu

SEQ ID NO: 3113554 - RNA, 15 nt, Human
gcgggcuuccuccug

SEQ ID NO: 3113555 - RNA, 13 nt, Human
gcggggacagcuc

SEQ ID NO: 3113556 - RNA, 16 nt, Human
gcgguccacccaggag

SEQ ID NO: 3113557 - RNA, 14 nt, Human
gcucuggacaggca

SEQ ID NO: 3113558 - RNA, 15 nt, Human
gcucuggacaggcau

SEQ ID NO: 3113559 - RNA, 16 nt, Human
gcucuggacaggcaug

SEQ ID NO: 3113560 - RNA, 21 nt, Human
gcucuggacaggcauguucuc

SEQ ID NO: 3113561 - RNA, 22 nt, Human
gcucuggacaggcauguucucu

SEQ ID NO: 3113562 - RNA, 19 nt, Human
gcucugcuccucuccccag

SEQ ID NO: 3113563 - RNA, 21 nt, Human
gcucugcuccucuccccagca

SEQ ID NO: 3113564 - RNA, 13 nt, Human
gcucugcugacag

SEQ ID NO: 3113565 - RNA, 14 nt, Human
gcucugcugacaga

SEQ ID NO: 3113566 - RNA, 18 nt, Human
gcucugcugacagacaca

SEQ ID NO: 3113567 - RNA, 19 nt, Human
gcucugcugacagacacag

SEQ ID NO: 3113568 - RNA, 20 nt, Human
gcucugcugacagacacagg

SEQ ID NO: 3113569 - RNA, 23 nt, Human
gcucugcugacagacacaggccc

SEQ ID NO: 3113570 - RNA, 13 nt, Human
gcucugcuccucu

SEQ ID NO: 3113571 - RNA, 14 nt, Human
gcucugcuccucuc

SEQ ID NO: 3113572 - RNA, 22 nt, Human
gcucugccucccaucacccgcu

SEQ ID NO: 3113573 - RNA, 15 nt, Human
gcucugccucccauc

SEQ ID NO: 3113574 - RNA, 14 nt, Human
gcucugccucccau

SEQ ID NO: 3113575 - RNA, 13 nt, Human
gcucugccuccca

SEQ ID NO: 3113576 - RNA, 14 nt, Human
gcucugcccuuggu

SEQ ID NO: 3113577 - RNA, 13 nt, Human
gcucugcccuugg

SEQ ID NO: 3113578 - RNA, 11 nt, Human
gcucugccucc

SEQ ID NO: 3113579 - RNA, 23 nt, Human
gcucugcccuugguuaggcauug

SEQ ID NO: 3113580 - RNA, 16 nt, Human
gcucgagcaugccugg

SEQ ID NO: 3113581 - RNA, 15 nt, Human
gcucccuucccaccu

SEQ ID NO: 3113582 - RNA, 18 nt, Human
gcucccuucccaccucuc

SEQ ID NO: 3113583 - RNA, 16 nt, Human
gcucccuucccaccuc

SEQ ID NO: 3113584 - RNA, 15 nt, Human
gcuccuucuguccua

SEQ ID NO: 3113585 - RNA, 21 nt, Human
gcuccuucuguccuacucugu

SEQ ID NO: 3113586 - RNA, 19 nt, Human
gcucuccgaccagacaccu

SEQ ID NO: 3113587 - RNA, 13 nt, Human
gcucuccgaccag

SEQ ID NO: 3113588 - RNA, 17 nt, Human
gcucuccgaccagacac

SEQ ID NO: 3113589 - RNA, 17 nt, Human
gcugcaguugccaguca

SEQ ID NO: 3113590 - RNA, 21 nt, Human
gcugcaguugccagucacccc

SEQ ID NO: 3113591 - RNA, 20 nt, Human
gcugcaguugccagucaccc

SEQ ID NO: 3113592 - RNA, 18 nt, Human
gcugcaguugccagucac

SEQ ID NO: 3113593 - RNA, 21 nt, Human
gcugauggugcaaugaccuuu

SEQ ID NO: 3113594 - RNA, 18 nt, Human
gcugauggugcaaugacc

SEQ ID NO: 3113595 - RNA, 23 nt, Human
gcugagugggggaucacagccuc

SEQ ID NO: 3113596 - RNA, 22 nt, Human
gcugagugggggaucacagccu

SEQ ID NO: 3113597 - RNA, 16 nt, Human
gcugauggugcaauga

SEQ ID NO: 3113598 - RNA, 15 nt, Human
gcugauggugcaaug

SEQ ID NO: 3113599 - RNA, 15 nt, Human
gcugagucugaaggc

SEQ ID NO: 3113600 - RNA, 18 nt, Human
gcugagucugaaggcugg

SEQ ID NO: 3113601 - RNA, 16 nt, Human
gcugagucugaaggcu

SEQ ID NO: 3113602 - RNA, 19 nt, Human
gcugagucugaaggcuggg

SEQ ID NO: 3113603 - RNA, 22 nt, Human
gcucuuccaggcugggagagcc

SEQ ID NO: 3113604 - RNA, 12 nt, Human
gcucuucuccag

SEQ ID NO: 3113605 - RNA, 18 nt, Human
gcucuuccaggcugggag

SEQ ID NO: 3113606 - RNA, 19 nt, Human
gcucuuccaggcugggaga

SEQ ID NO: 3113607 - RNA, 14 nt, Human
gcucuucuccaggc

SEQ ID NO: 3113608 - RNA, 16 nt, Human
gcucuucuccaggcug

SEQ ID NO: 3113609 - RNA, 21 nt, Human
gcugacagacacaggcccggc

SEQ ID NO: 3113610 - RNA, 20 nt, Human
gcugacagacacaggcccgg

SEQ ID NO: 3113611 - RNA, 14 nt, Human
gagccagggucuca

SEQ ID NO: 3113612 - RNA, 23 nt, Human
gagccagauuucacucuccuugg

SEQ ID NO: 3113613 - RNA, 19 nt, Human
gagccagggucucacuaug

SEQ ID NO: 3113614 - RNA, 18 nt, Human
gagcccugguggcagugg

SEQ ID NO: 3113615 - RNA, 16 nt, Human
gagcagagaauucucu

SEQ ID NO: 3113616 - RNA, 12 nt, Human
gagcagagacca

SEQ ID NO: 3113617 - RNA, 19 nt, Human
gagccaauuuaaagaaaac

SEQ ID NO: 3113618 - RNA, 20 nt, Human
gagccagauuucacucuccu

SEQ ID NO: 3113619 - RNA, 23 nt, Human
gagcaagacgcugugcugcccug

SEQ ID NO: 3113620 - RNA, 20 nt, Human
gagcaccuuagacagucccu

SEQ ID NO: 3113621 - RNA, 21 nt, Human
gagcacuaaggugugcucuga

SEQ ID NO: 3113622 - RNA, 19 nt, Human
gagcaccuuagacaguccc

SEQ ID NO: 3113623 - RNA, 15 nt, Human
gagcacuaaggugug

SEQ ID NO: 3113624 - RNA, 22 nt, Human
gagcaccuuagacagucccugc

SEQ ID NO: 3113625 - RNA, 21 nt, Human
gagcaccuuagacagucccug

SEQ ID NO: 3113626 - RNA, 19 nt, Human
gagaucacgccacugcacu

SEQ ID NO: 3113627 - RNA, 18 nt, Human
gagaucacgccacugcac

SEQ ID NO: 3113628 - RNA, 14 nt, Human
gagauagccaaggc

SEQ ID NO: 3113629 - RNA, 23 nt, Human
gagaucaaccccuucgcuccugu

SEQ ID NO: 3113630 - RNA, 16 nt, Human
gagauagccaaggcca

SEQ ID NO: 3113631 - RNA, 19 nt, Human
gagaggggaacagacugga

SEQ ID NO: 3113632 - RNA, 18 nt, Human
gagaggggaacagacugg

SEQ ID NO: 3113633 - RNA, 13 nt, Human
gagaggggcacag

SEQ ID NO: 3113634 - RNA, 16 nt, Human
gagagggugggagugg

SEQ ID NO: 3113635 - RNA, 14 nt, Human
gagagggugggagu

SEQ ID NO: 3113636 - RNA, 18 nt, Human
gagacuccugcaggcagc

SEQ ID NO: 3113637 - RNA, 19 nt, Human
gagacuccugcaggcagcc

SEQ ID NO: 3113638 - RNA, 21 nt, Human
gagacuccugcaggcagccag

SEQ ID NO: 3113639 - RNA, 20 nt, Human
gagacuccugcaggcagcca

SEQ ID NO: 3113640 - RNA, 18 nt, Human
gagacucgcgacaaugca

SEQ ID NO: 3113641 - RNA, 21 nt, Human
gagacucgcgacaaugcaaac

SEQ ID NO: 3113642 - RNA, 20 nt, Human
gagacucgcgacaaugcaaa

SEQ ID NO: 3113643 - RNA, 22 nt, Human
gagacaggguuuugccauguug

SEQ ID NO: 3113644 - RNA, 12 nt, Human
gagaccaucccu

SEQ ID NO: 3113645 - RNA, 14 nt, Human
gagaccaucccuga

SEQ ID NO: 3113646 - RNA, 21 nt, Human
gagaccaucccugaaggcccc

SEQ ID NO: 3113647 - RNA, 18 nt, Human
gagaccaucccugaaggc

SEQ ID NO: 3113648 - RNA, 22 nt, Human
gagaaugcacaaacagaggccg

SEQ ID NO: 3113649 - RNA, 23 nt, Human
gagaaugcacaaacagaggccgc

SEQ ID NO: 3113650 - RNA, 13 nt, Human
gacuacaggugug

SEQ ID NO: 3113651 - RNA, 18 nt, Human
gacuacaggugugaguca

SEQ ID NO: 3113652 - RNA, 21 nt, Human
gacuacaggugugagucacca

SEQ ID NO: 3113653 - RNA, 14 nt, Human
gacucauucuucug

SEQ ID NO: 3113654 - RNA, 15 nt, Human
gacucauucuucugu

SEQ ID NO: 3113655 - RNA, 13 nt, Human
gacucgcgacaau

SEQ ID NO: 3113656 - RNA, 21 nt, Human
gacuccugcaggcagccaggc

SEQ ID NO: 3113657 - RNA, 13 nt, Human
gacuccugcaggc

SEQ ID NO: 3113658 - RNA, 12 nt, Human
gacuccugcagg

SEQ ID NO: 3113659 - RNA, 14 nt, Human
gacuggaagcacag

SEQ ID NO: 3113660 - RNA, 15 nt, Human
gacuggaagcacagc

SEQ ID NO: 3113661 - RNA, 16 nt, Human
gacuggaagcacagcu

SEQ ID NO: 3113662 - RNA, 18 nt, Human
gacuggaagcacagcuuc

SEQ ID NO: 3113663 - RNA, 17 nt, Human
gacucgcgacaaugcaa

SEQ ID NO: 3113664 - RNA, 21 nt, Human
gacugaguacguugugcauuu

SEQ ID NO: 3113665 - RNA, 22 nt, Human
gacugaguacguugugcauuug

SEQ ID NO: 3113666 - RNA, 18 nt, Human
gacugaguacguugugca

SEQ ID NO: 3113667 - RNA, 13 nt, Human
gacugcccggcag

SEQ ID NO: 3113668 - RNA, 15 nt, Human
gacugcccggcaggg

SEQ ID NO: 3113669 - RNA, 23 nt, Human
gacugaguacguugugcauuugg

SEQ ID NO: 3113670 - RNA, 19 nt, Human
gacuuaagcacacuugaca

SEQ ID NO: 3113671 - RNA, 14 nt, Human
gagaagagaaugca

SEQ ID NO: 3113672 - RNA, 16 nt, Human
gagaagcagaggaagg

SEQ ID NO: 3113673 - RNA, 16 nt, Human
gagaagagaaugcaca

SEQ ID NO: 3113674 - RNA, 16 nt, Human
gagaaagguugaagca

SEQ ID NO: 3113675 - RNA, 14 nt, Human
gagaaaugagcuug

SEQ ID NO: 3113676 - RNA, 23 nt, Human
gacagggcacaccgggcacucag

SEQ ID NO: 3113677 - RNA, 16 nt, Human
gacagggaggugaccc

SEQ ID NO: 3113678 - RNA, 14 nt, Human
gacaguuaagagaa

SEQ ID NO: 3113679 - RNA, 24 nt, Human
gacagggcacaccgggcacucaga

SEQ ID NO: 3113680 - RNA, 14 nt, Human
gacaggaccaggga

SEQ ID NO: 3113681 - RNA, 23 nt, Human
gacaggaccagggauuuccauga

SEQ ID NO: 3113682 - RNA, 15 nt, Human
gacaggaccagggau

SEQ ID NO: 3113683 - RNA, 14 nt, Human
gacaugaucuucuu

SEQ ID NO: 3113684 - RNA, 14 nt, Human
gacaugggaaaggg

SEQ ID NO: 3113685 - RNA, 13 nt, Human
gacagccacggcc

SEQ ID NO: 3113686 - RNA, 13 nt, Human
gacagagggggug

SEQ ID NO: 3113687 - RNA, 20 nt, Human
gacagagugagacucugucu

SEQ ID NO: 3113688 - RNA, 22 nt, Human
gacagagugagacucugucuca

SEQ ID NO: 3113689 - RNA, 14 nt, Human
gacagccacggcca

SEQ ID NO: 3113690 - RNA, 17 nt, Human
gacagccacggccaggc

SEQ ID NO: 3113691 - RNA, 18 nt, Human
gacagccacggccaggcc

SEQ ID NO: 3113692 - RNA, 19 nt, Human
gacagccacggccaggcca

SEQ ID NO: 3113693 - RNA, 18 nt, Human
gacagcugccugggaucc

SEQ ID NO: 3113694 - RNA, 20 nt, Human
gacagccacggccaggccag

SEQ ID NO: 3113695 - RNA, 21 nt, Human
gacagccacggccaggccaga

SEQ ID NO: 3113696 - RNA, 17 nt, Human
gacagcugccugggauc

SEQ ID NO: 3113697 - RNA, 16 nt, Human
gacagcugccugggau

SEQ ID NO: 3113698 - RNA, 17 nt, Human
gacagaggcagccccau

SEQ ID NO: 3113699 - RNA, 15 nt, Human
gacagaggggguggc

SEQ ID NO: 3113700 - RNA, 19 nt, Human
gacagaggggguggccucc

SEQ ID NO: 3113701 - RNA, 18 nt, Human
gacagaggggguggccuc

SEQ ID NO: 3113702 - RNA, 23 nt, Human
gacagaggggguggccucccaac

SEQ ID NO: 3113703 - RNA, 19 nt, Human
gacagagugagacucuguc

SEQ ID NO: 3113704 - RNA, 22 nt, Human
gacagaggggguggccucccaa

SEQ ID NO: 3113705 - RNA, 21 nt, Human
gacagaggggguggccuccca

SEQ ID NO: 3113706 - RNA, 12 nt, Human
gacagaggcagc

SEQ ID NO: 3113707 - RNA, 14 nt, Human
gacagaggcagccc

SEQ ID NO: 3113708 - RNA, 16 nt, Human
gacagaggcagcccca

SEQ ID NO: 3113709 - RNA, 21 nt, Human
gacagagcaagugagacccug

SEQ ID NO: 3113710 - RNA, 12 nt, Human
gacccugucuca

SEQ ID NO: 3113711 - RNA, 20 nt, Human
gacccuuguggucccacccc

SEQ ID NO: 3113712 - RNA, 19 nt, Human
gacccuuguggucccaccc

SEQ ID NO: 3113713 - RNA, 21 nt, Human
gacccuuguggucccacccca

SEQ ID NO: 3113714 - RNA, 15 nt, Human
gacccuugugguccc

SEQ ID NO: 3113715 - RNA, 17 nt, Human
gaccgugaggccagaga

SEQ ID NO: 3113716 - RNA, 16 nt, Human
gaccgugaggccagag

SEQ ID NO: 3113717 - RNA, 18 nt, Human
gaccgugaggccagagac

SEQ ID NO: 3113718 - RNA, 15 nt, Human
gaccgugaggccaga

SEQ ID NO: 3113719 - RNA, 23 nt, Human
gacccugaggcccagagggccug

SEQ ID NO: 3113720 - RNA, 14 nt, Human
gaccccuccaugug

SEQ ID NO: 3113721 - RNA, 18 nt, Human
gaccccuccaugugggcu

SEQ ID NO: 3113722 - RNA, 21 nt, Human
gaccccuccaugugggcuagu

SEQ ID NO: 3113723 - RNA, 22 nt, Human
gacccugaggcccagagggccu

SEQ ID NO: 3113724 - RNA, 18 nt, Human
gacaugggaaaggggaag

SEQ ID NO: 3113725 - RNA, 24 nt, Human
gaccagacaccuugacagggcaca

SEQ ID NO: 3113726 - RNA, 11 nt, Human
gaccagagcug

SEQ ID NO: 3113727 - RNA, 14 nt, Human
gaccacguuucuaa

SEQ ID NO: 3113728 - RNA, 18 nt, Human
gaccagagcugccaccug

SEQ ID NO: 3113729 - RNA, 17 nt, Human
gaccagagcugccaccu

SEQ ID NO: 3113730 - RNA, 15 nt, Human
gaccagagcugccac

SEQ ID NO: 3113731 - RNA, 14 nt, Human
gaccagagcugcca

SEQ ID NO: 3113732 - RNA, 13 nt, Human
gaccagagcugcc

SEQ ID NO: 3113733 - RNA, 17 nt, Human
gaccauucuccaccugc

SEQ ID NO: 3113734 - RNA, 22 nt, Human
gaccauucuccaccugccaggg

SEQ ID NO: 3113735 - RNA, 21 nt, Human
gaccauucuccaccugccagg

SEQ ID NO: 3113736 - RNA, 20 nt, Human
gaccauucuccaccugccag

SEQ ID NO: 3113737 - RNA, 19 nt, Human
gaccauucuccaccugcca

SEQ ID NO: 3113738 - RNA, 23 nt, Human
gacacauguccaagaagcccagg

SEQ ID NO: 3113739 - RNA, 20 nt, Human
gacacauguccaagaagccc

SEQ ID NO: 3113740 - RNA, 15 nt, Human
gacacauguccaaga

SEQ ID NO: 3113741 - RNA, 19 nt, Human
gacacaugcaaggucauuu

SEQ ID NO: 3113742 - RNA, 14 nt, Human
gacacaugcaaggu

SEQ ID NO: 3113743 - RNA, 20 nt, Human
gacacaggcccggcuccagg

SEQ ID NO: 3113744 - RNA, 21 nt, Human
gacacaggcccggcuccaggc

SEQ ID NO: 3113745 - RNA, 16 nt, Human
gacacaagccuucggc

SEQ ID NO: 3113746 - RNA, 19 nt, Human
gacacaggcccggcuccag

SEQ ID NO: 3113747 - RNA, 20 nt, Human
gacaaugugaaaagaaaaau

SEQ ID NO: 3113748 - RNA, 19 nt, Human
gacaaugugaaaagaaaaa

SEQ ID NO: 3113749 - RNA, 22 nt, Human
gacaaugcaaaccaucauugaa

SEQ ID NO: 3113750 - RNA, 18 nt, Human
gacaaugugaaaagaaaa

SEQ ID NO: 3113751 - RNA, 12 nt, Human
gacaaugugaaa

SEQ ID NO: 3113752 - RNA, 18 nt, Human
gacaaggauugcuacugu

SEQ ID NO: 3113753 - RNA, 21 nt, Human
gacaaggaugaucuaggaaga

SEQ ID NO: 3113754 - RNA, 19 nt, Human
gacaaggauugcuacuguc

SEQ ID NO: 3113755 - RNA, 23 nt, Human
gacaacacucauugaccugaggc

SEQ ID NO: 3113756 - RNA, 22 nt, Human
gacaacacucauugaccugagg

SEQ ID NO: 3113757 - RNA, 22 nt, Human
gaauuucuuuugccguuauuaa

SEQ ID NO: 3113758 - RNA, 21 nt, Human
gaaugcacaaacagaggccgc

SEQ ID NO: 3113759 - RNA, 20 nt, Human
gaaugcacaaacagaggccg

SEQ ID NO: 3113760 - RNA, 21 nt, Human
gaaugaaagggcccagagagg

SEQ ID NO: 3113761 - RNA, 18 nt, Human
gaauccagacccggcugc

SEQ ID NO: 3113762 - RNA, 20 nt, Human
gaauccagacccggcugcgu

SEQ ID NO: 3113763 - RNA, 14 nt, Human
gaauugaagcagga

SEQ ID NO: 3113764 - RNA, 14 nt, Human
gagucugaaggcug

SEQ ID NO: 3113765 - RNA, 13 nt, Human
gagucugaaggcu

SEQ ID NO: 3113766 - RNA, 12 nt, Human
gagucugaaggc

SEQ ID NO: 3113767 - RNA, 14 nt, Human
gagugacagaggca

SEQ ID NO: 3113768 - RNA, 15 nt, Human
gagugacagaggcag

SEQ ID NO: 3113769 - RNA, 16 nt, Human
gagugacagaggcagc

SEQ ID NO: 3113770 - RNA, 17 nt, Human
gagugaagcugggagaa

SEQ ID NO: 3113771 - RNA, 15 nt, Human
gagucgaggacaggg

SEQ ID NO: 3113772 - RNA, 19 nt, Human
gaguccgaaagggacuugg

SEQ ID NO: 3113773 - RNA, 14 nt, Human
gagucgaggacagg

SEQ ID NO: 3113774 - RNA, 19 nt, Human
gaguaggaagacuuuggaa

SEQ ID NO: 3113775 - RNA, 18 nt, Human
gaguaggaagacuuugga

SEQ ID NO: 3113776 - RNA, 11 nt, Human
gaguauauguc

SEQ ID NO: 3113777 - RNA, 17 nt, Human
gaggucagagccugcag

SEQ ID NO: 3113778 - RNA, 20 nt, Human
gaggucagagccugcaguua

SEQ ID NO: 3113779 - RNA, 17 nt, Human
gagguugggaggccauu

SEQ ID NO: 3113780 - RNA, 15 nt, Human
gagguugggaggcca

SEQ ID NO: 3113781 - RNA, 16 nt, Human
gagguuucaaaccucc

SEQ ID NO: 3113782 - RNA, 19 nt, Human
gaguagcugggacuacagg

SEQ ID NO: 3113783 - RNA, 22 nt, Human
gaguagcugggacuacaggcac

SEQ ID NO: 3113784 - RNA, 12 nt, Human
gaguaggaagac

SEQ ID NO: 3113785 - RNA, 17 nt, Human
gaguaggaagacuuugg

SEQ ID NO: 3113786 - RNA, 13 nt, Human
gaguaggaagacu

SEQ ID NO: 3113787 - RNA, 23 nt, Human
gaguacuacaguccucccaucuc

SEQ ID NO: 3113788 - RNA, 21 nt, Human
gaguacuacaguccucccauc

SEQ ID NO: 3113789 - RNA, 20 nt, Human
gaguacuacaguccucccau

SEQ ID NO: 3113790 - RNA, 18 nt, Human
gaucacggcucacugcag

SEQ ID NO: 3113791 - RNA, 15 nt, Human
gaucacggcucacug

SEQ ID NO: 3113792 - RNA, 16 nt, Human
gaucacggcucacugc

SEQ ID NO: 3113793 - RNA, 15 nt, Human
gauagcacagacccu

SEQ ID NO: 3113794 - RNA, 14 nt, Human
gauagccaaggcca

SEQ ID NO: 3113795 - RNA, 22 nt, Human
gauagccaaggccaaaggaagc

SEQ ID NO: 3113796 - RNA, 20 nt, Human
gauacaggaaaagcugcuga

SEQ ID NO: 3113797 - RNA, 22 nt, Human
gauaagaaccuuuugagugccu

SEQ ID NO: 3113798 - RNA, 21 nt, Human
gauacaggaaaagcugcugac

SEQ ID NO: 3113799 - RNA, 19 nt, Human
gauacaggaaaagcugcug

SEQ ID NO: 3113800 - RNA, 14 nt, Human
gaguugaagacaga

SEQ ID NO: 3113801 - RNA, 21 nt, Human
gaguugaagacagagcuacac

SEQ ID NO: 3113802 - RNA, 17 nt, Human
gaguugaagacagagcu

SEQ ID NO: 3113803 - RNA, 15 nt, Human
gaguugaagacagag

SEQ ID NO: 3113804 - RNA, 20 nt, Human
gaguucauacccuguuacca

SEQ ID NO: 3113805 - RNA, 14 nt, Human
gaguucaucuugaa

SEQ ID NO: 3113806 - RNA, 19 nt, Human
gaguucaucuugaauugua

SEQ ID NO: 3113807 - RNA, 15 nt, Human
gaguuacagacaaag

SEQ ID NO: 3113808 - RNA, 13 nt, Human
gaguuacagacaa

SEQ ID NO: 3113809 - RNA, 12 nt, Human
gaguuacagaca

SEQ ID NO: 3113810 - RNA, 20 nt, Human
gagugugccugaagucccag

SEQ ID NO: 3113811 - RNA, 17 nt, Human
gagugugccugaagucc

SEQ ID NO: 3113812 - RNA, 13 nt, Human
gagugggugaaua

SEQ ID NO: 3113813 - RNA, 23 nt, Human
gagugggggaucacagccucuga

SEQ ID NO: 3113814 - RNA, 17 nt, Human
gagugacagaggcagcc

SEQ ID NO: 3113815 - RNA, 13 nt, Human
gaggaucucuuga

SEQ ID NO: 3113816 - RNA, 22 nt, Human
gaggaucucuugagccugggag

SEQ ID NO: 3113817 - RNA, 19 nt, Human
gaggaucucuugagccugg

SEQ ID NO: 3113818 - RNA, 16 nt, Human
gaggaucucuugagcc

SEQ ID NO: 3113819 - RNA, 20 nt, Human
gaggauugcuugagcucagg

SEQ ID NO: 3113820 - RNA, 16 nt, Human
gaggauugcuugagcu

SEQ ID NO: 3113821 - RNA, 14 nt, Human
gaggccaugggccu

SEQ ID NO: 3113822 - RNA, 17 nt, Human
gaggccaugggccuccu

SEQ ID NO: 3113823 - RNA, 18 nt, Human
gaggccaugggccuccug

SEQ ID NO: 3113824 - RNA, 20 nt, Human
gaggccaugggccuccugug

SEQ ID NO: 3113825 - RNA, 21 nt, Human
gaggccaugggccuccugugu

SEQ ID NO: 3113826 - RNA, 23 nt, Human
gaggccaugggccuccugugugu

SEQ ID NO: 3113827 - RNA, 19 nt, Human
gaggcagccccauucugcc

SEQ ID NO: 3113828 - RNA, 18 nt, Human
gaggcagccccauucugc

SEQ ID NO: 3113829 - RNA, 20 nt, Human
gaggcagccccauucugccu

SEQ ID NO: 3113830 - RNA, 9 nt, Human
gaggcaggg

SEQ ID NO: 3113831 - RNA, 14 nt, Human
gaggcccuucucuc

SEQ ID NO: 3113832 - RNA, 20 nt, Human
gaggcccuucucuccagccc

SEQ ID NO: 3113833 - RNA, 15 nt, Human
gaggcccuucucucc

SEQ ID NO: 3113834 - RNA, 21 nt, Human
gaggcccuucucuccagcccc

SEQ ID NO: 3113835 - RNA, 16 nt, Human
gaggcccagagggccu

SEQ ID NO: 3113836 - RNA, 15 nt, Human
gaggcccagagggcc

SEQ ID NO: 3113837 - RNA, 19 nt, Human
gaggcccagagggccugca

SEQ ID NO: 3113838 - RNA, 14 nt, Human
gaggcccagagggc

SEQ ID NO: 3113839 - RNA, 13 nt, Human
gaggcccagaggg

SEQ ID NO: 3113840 - RNA, 11 nt, Human
gaggcccagag

SEQ ID NO: 3113841 - RNA, 16 nt, Human
gaggcugggcucccuu

SEQ ID NO: 3113842 - RNA, 14 nt, Human
gaggcugccucucc

SEQ ID NO: 3113843 - RNA, 18 nt, Human
gaggccuucucugaagga

SEQ ID NO: 3113844 - RNA, 19 nt, Human
gaggccuucucugaaggac

SEQ ID NO: 3113845 - RNA, 16 nt, Human
gaggccuucucugaag

SEQ ID NO: 3113846 - RNA, 24 nt, Human
gagguaaggaauaccugucccccu

SEQ ID NO: 3113847 - RNA, 21 nt, Human
gagguaaggaauaccuguccc

SEQ ID NO: 3113848 - RNA, 15 nt, Human
gaggguugggcuggu

SEQ ID NO: 3113849 - RNA, 14 nt, Human
gaggguugggcugg

SEQ ID NO: 3113850 - RNA, 12 nt, Human
gaggucagagcc

SEQ ID NO: 3113851 - RNA, 13 nt, Human
gaggucagagccu

SEQ ID NO: 3113852 - RNA, 17 nt, Human
gaggucaaggcugcagu

SEQ ID NO: 3113853 - RNA, 12 nt, Human
gaggguggaaua

SEQ ID NO: 3113854 - RNA, 21 nt, Human
gagggugaagugaagacaaug

SEQ ID NO: 3113855 - RNA, 14 nt, Human
gaggguggugaccu

SEQ ID NO: 3113856 - RNA, 15 nt, Human
gagggugggaguggg

SEQ ID NO: 3113857 - RNA, 21 nt, Human
gaggguggugaccucugccug

SEQ ID NO: 3113858 - RNA, 22 nt, Human
gagggugucccaaaaagaaagg

SEQ ID NO: 3113859 - RNA, 13 nt, Human
gagggucugagga

SEQ ID NO: 3113860 - RNA, 14 nt, Human
gagggucugaggaa

SEQ ID NO: 3113861 - RNA, 21 nt, Human
gagggagugacagaggcagcc

SEQ ID NO: 3113862 - RNA, 22 nt, Human
gagggagugacagaggcagccc

SEQ ID NO: 3113863 - RNA, 18 nt, Human
gagggagugacagaggca

SEQ ID NO: 3113864 - RNA, 16 nt, Human
gagggagugacagagg

SEQ ID NO: 3113865 - RNA, 16 nt, Human
gagggagggcuccaga

SEQ ID NO: 3113866 - RNA, 20 nt, Human
gagggagggcuccagacaca

SEQ ID NO: 3113867 - RNA, 20 nt, Human
gaggcugggcucccuuccca

SEQ ID NO: 3113868 - RNA, 19 nt, Human
gagggagggcuccagacac

SEQ ID NO: 3113869 - RNA, 13 nt, Human
gaggguaaggcug

SEQ ID NO: 3113870 - RNA, 17 nt, Human
gaggggguggccuccca

SEQ ID NO: 3113871 - RNA, 15 nt, Human
gaggggguggccucc

SEQ ID NO: 3113872 - RNA, 18 nt, Human
gcagaaggaagacuucau

SEQ ID NO: 3113873 - RNA, 13 nt, Human
gcagacaggcaag

SEQ ID NO: 3113874 - RNA, 12 nt, Human
gcagacaggcaa

SEQ ID NO: 3113875 - RNA, 18 nt, Human
gcagacaggaccagggau

SEQ ID NO: 3113876 - RNA, 16 nt, Human
gcacgauuucuguuua

SEQ ID NO: 3113877 - RNA, 22 nt, Human
gcacugcuuccagugaggcucu

SEQ ID NO: 3113878 - RNA, 23 nt, Human
gcacugcuuccagugaggcucug

SEQ ID NO: 3113879 - RNA, 22 nt, Human
gcacagaguuguuacauuuuua

SEQ ID NO: 3113880 - RNA, 16 nt, Human
gcacagaguuguuaca

SEQ ID NO: 3113881 - RNA, 18 nt, Human
gcacagaguuguuacauu

SEQ ID NO: 3113882 - RNA, 19 nt, Human
gcacagaguuguuacauuu

SEQ ID NO: 3113883 - RNA, 21 nt, Human
gcacagaguuguuacauuuuu

SEQ ID NO: 3113884 - RNA, 19 nt, Human
gcaccuuagacagucccug

SEQ ID NO: 3113885 - RNA, 13 nt, Human
gcacgauuucugu

SEQ ID NO: 3113886 - RNA, 15 nt, Human
gcacgauuucuguuu

SEQ ID NO: 3113887 - RNA, 21 nt, Human
gcaccuuagacagucccugcc

SEQ ID NO: 3113888 - RNA, 20 nt, Human
gcaccuuagacagucccugc

SEQ ID NO: 3113889 - RNA, 12 nt, Human
gcaccauaacuu

SEQ ID NO: 3113890 - RNA, 23 nt, Human
gcacagaaaauggaagacagcuc

SEQ ID NO: 3113891 - RNA, 22 nt, Human
gcacagaaaauggaagacagcu

SEQ ID NO: 3113892 - RNA, 21 nt, Human
gcacagaaaauggaagacagc

SEQ ID NO: 3113893 - RNA, 17 nt, Human
gcacagacccugcccug

SEQ ID NO: 3113894 - RNA, 16 nt, Human
gcacagacccugcccu

SEQ ID NO: 3113895 - RNA, 15 nt, Human
gcacagacccugccc

SEQ ID NO: 3113896 - RNA, 14 nt, Human
gcacagacccugcc

SEQ ID NO: 3113897 - RNA, 21 nt, Human
gcacagacccugcccuguggg

SEQ ID NO: 3113898 - RNA, 20 nt, Human
gcacagacccugcccugugg

SEQ ID NO: 3113899 - RNA, 19 nt, Human
gcacagacccugcccugug

SEQ ID NO: 3113900 - RNA, 18 nt, Human
gcacagacccugcccugu

SEQ ID NO: 3113901 - RNA, 15 nt, Human
gcacagaguuguuac

SEQ ID NO: 3113902 - RNA, 22 nt, Human
gcacagacccugcccugugggc

SEQ ID NO: 3113903 - RNA, 20 nt, Human
gcacagaaaauggaagacag

SEQ ID NO: 3113904 - RNA, 20 nt, Human
gcacaccgggcacucagaag

SEQ ID NO: 3113905 - RNA, 17 nt, Human
gcacaagcuccaagcuc

SEQ ID NO: 3113906 - RNA, 15 nt, Human
gcacaagcuccaagc

SEQ ID NO: 3113907 - RNA, 18 nt, Human
gcacaagcuccaagcucc

SEQ ID NO: 3113908 - RNA, 16 nt, Human
gcacaaacagaggccg

SEQ ID NO: 3113909 - RNA, 15 nt, Human
gcacaaacagaggcc

SEQ ID NO: 3113910 - RNA, 14 nt, Human
gcacaaacagaggc

SEQ ID NO: 3113911 - RNA, 15 nt, Human
gcaauggcagccuug

SEQ ID NO: 3113912 - RNA, 14 nt, Human
gcaacucaucuuag

SEQ ID NO: 3113913 - RNA, 14 nt, Human
gcaaugugauaaaa

SEQ ID NO: 3113914 - RNA, 19 nt, Human
gaugcccaaagaugcagcc

SEQ ID NO: 3113915 - RNA, 20 nt, Human
gaugcccaaagaugcagccg

SEQ ID NO: 3113916 - RNA, 22 nt, Human
gauggccgggcgcgguggcuca

SEQ ID NO: 3113917 - RNA, 20 nt, Human
gaugggcaacccccagccug

SEQ ID NO: 3113918 - RNA, 21 nt, Human
gaugggcaacccccagccugc

SEQ ID NO: 3113919 - RNA, 24 nt, Human
gauggggcccugccuccuuuguga

SEQ ID NO: 3113920 - RNA, 13 nt, Human
gauggggcugcac

SEQ ID NO: 3113921 - RNA, 15 nt, Human
gauggggcugcaccg

SEQ ID NO: 3113922 - RNA, 19 nt, Human
gaugggugcuuggaggaag

SEQ ID NO: 3113923 - RNA, 14 nt, Human
gauggugcaaugac

SEQ ID NO: 3113924 - RNA, 12 nt, Human
gauggugcaaug

SEQ ID NO: 3113925 - RNA, 16 nt, Human
gauggugcaaugaccu

SEQ ID NO: 3113926 - RNA, 15 nt, Human
gauggugcaaugacc

SEQ ID NO: 3113927 - RNA, 17 nt, Human
gauggugcaaugaccuu

SEQ ID NO: 3113928 - RNA, 22 nt, Human
gauuacaagcgugagccacugc

SEQ ID NO: 3113929 - RNA, 15 nt, Human
gauuaaacuuaaucu

SEQ ID NO: 3113930 - RNA, 23 nt, Human
gauuacaagcgugagccacugca

SEQ ID NO: 3113931 - RNA, 19 nt, Human
gauuuugauccaagcuggu

SEQ ID NO: 3113932 - RNA, 21 nt, Human
gauuuugaaauuuuuauuaaa

SEQ ID NO: 3113933 - RNA, 12 nt, Human
gcaaaccaucau

SEQ ID NO: 3113934 - RNA, 18 nt, Human
gauuuccguuaaaauacc

SEQ ID NO: 3113935 - RNA, 15 nt, Human
gauuuaacagaaaug

SEQ ID NO: 3113936 - RNA, 22 nt, Human
gauuuccguuaaaauaccagcc

SEQ ID NO: 3113937 - RNA, 12 nt, Human
gauuuaaaucag

SEQ ID NO: 3113938 - RNA, 13 nt, Human
gauuuaacagaaa

SEQ ID NO: 3113939 - RNA, 14 nt, Human
gauuuaacagaaau

SEQ ID NO: 3113940 - RNA, 14 nt, Human
cuggccagaugcac

SEQ ID NO: 3113941 - RNA, 15 nt, Human
cuggcccacugcauc

SEQ ID NO: 3113942 - RNA, 18 nt, Human
cuggcacugcuuccagug

SEQ ID NO: 3113943 - RNA, 23 nt, Human
cuggcacugcuuccagugaggcu

SEQ ID NO: 3113944 - RNA, 20 nt, Human
cuggcacugcuuccagugag

SEQ ID NO: 3113945 - RNA, 19 nt, Human
cuggcacugcuuccaguga

SEQ ID NO: 3113946 - RNA, 20 nt, Human
cuggcacccggccccugcug

SEQ ID NO: 3113947 - RNA, 21 nt, Human
cuggcacccggccccugcugg

SEQ ID NO: 3113948 - RNA, 19 nt, Human
cuggcacccggccccugcu

SEQ ID NO: 3113949 - RNA, 20 nt, Human
cuggagugcagugagccgag

SEQ ID NO: 3113950 - RNA, 16 nt, Human
cuggccucugcacucc

SEQ ID NO: 3113951 - RNA, 21 nt, Human
cuggccucugcacuccccugc

SEQ ID NO: 3113952 - RNA, 20 nt, Human
cuggccucugcacuccccug

SEQ ID NO: 3113953 - RNA, 18 nt, Human
cuggccucugcacucccc

SEQ ID NO: 3113954 - RNA, 19 nt, Human
cuggccuggccccucaggg

SEQ ID NO: 3113955 - RNA, 24 nt, Human
cuggccuggccccucagggucccu

SEQ ID NO: 3113956 - RNA, 14 nt, Human
cuggcgugcagugg

SEQ ID NO: 3113957 - RNA, 15 nt, Human
cuggcgugcaguggu

SEQ ID NO: 3113958 - RNA, 22 nt, Human
cuggcucuuccaggcugggaga

SEQ ID NO: 3113959 - RNA, 21 nt, Human
cuggcucuuccaggcugggag

SEQ ID NO: 3113960 - RNA, 24 nt, Human
cuggcucuuccaggcugggagagc

SEQ ID NO: 3113961 - RNA, 20 nt, Human
cuggcucuuccaggcuggga

SEQ ID NO: 3113962 - RNA, 16 nt, Human
cuggaccuugaacugg

SEQ ID NO: 3113963 - RNA, 15 nt, Human
cuggacccuguggau

SEQ ID NO: 3113964 - RNA, 21 nt, Human
cuggaccuugaacuggguacu

SEQ ID NO: 3113965 - RNA, 17 nt, Human
cuggaccuugaacuggg

SEQ ID NO: 3113966 - RNA, 20 nt, Human
cuggaccuugaacuggguac

SEQ ID NO: 3113967 - RNA, 23 nt, Human
cuggacaggcauguucucugagg

SEQ ID NO: 3113968 - RNA, 14 nt, Human
cuggacaggcaugu

SEQ ID NO: 3113969 - RNA, 17 nt, Human
cuggacaggcauguucu

SEQ ID NO: 3113970 - RNA, 22 nt, Human
cuggagguacgaaaagagggga

SEQ ID NO: 3113971 - RNA, 17 nt, Human
cuggagguacgaaaaga

SEQ ID NO: 3113972 - RNA, 14 nt, Human
cuggagugcaguga

SEQ ID NO: 3113973 - RNA, 15 nt, Human
cuggagugcagugag

SEQ ID NO: 3113974 - RNA, 16 nt, Human
cuggagugcagugagc

SEQ ID NO: 3113975 - RNA, 17 nt, Human
cuggagugcagugagcc

SEQ ID NO: 3113976 - RNA, 12 nt, Human
cugcccuccaag

SEQ ID NO: 3113977 - RNA, 17 nt, Human
cucccuucccaccucuc

SEQ ID NO: 3113978 - RNA, 16 nt, Human
cucccuucccaccucu

SEQ ID NO: 3113979 - RNA, 15 nt, Human
cucccuucccaccuc

SEQ ID NO: 3113980 - RNA, 14 nt, Human
cucccuucccaccu

SEQ ID NO: 3113981 - RNA, 18 nt, Human
cugccgcagcccugcaga

SEQ ID NO: 3113982 - RNA, 17 nt, Human
cugccgcagcccugcag

SEQ ID NO: 3113983 - RNA, 15 nt, Human
cugccgcagcccugc

SEQ ID NO: 3113984 - RNA, 14 nt, Human
cugccgcagcccug

SEQ ID NO: 3113985 - RNA, 11 nt, Human
cugccucccau

SEQ ID NO: 3113986 - RNA, 19 nt, Human
cugccucccaucacccgcu

SEQ ID NO: 3113987 - RNA, 16 nt, Human
cugccucccaucaccc

SEQ ID NO: 3113988 - RNA, 14 nt, Human
cugccucccaucac

SEQ ID NO: 3113989 - RNA, 12 nt, Human
cugccucccauc

SEQ ID NO: 3113990 - RNA, 22 nt, Human
cugccucugacacacagcucug

SEQ ID NO: 3113991 - RNA, 23 nt, Human
cugccucugacacacagcucugu

SEQ ID NO: 3113992 - RNA, 20 nt, Human
cugccugcccaggccccugc

SEQ ID NO: 3113993 - RNA, 21 nt, Human
cugccugggaucccucauccu

SEQ ID NO: 3113994 - RNA, 15 nt, Human
cugccugaagucaca

SEQ ID NO: 3113995 - RNA, 15 nt, Human
cugccugcccaggcc

SEQ ID NO: 3113996 - RNA, 16 nt, Human
cugccugcccaggccc

SEQ ID NO: 3113997 - RNA, 17 nt, Human
cugccugcccaggcccc

SEQ ID NO: 3113998 - RNA, 14 nt, Human
cugccucuucucua

SEQ ID NO: 3113999 - RNA, 15 nt, Human
cugccucuucucuac

SEQ ID NO: 3114000 - RNA, 19 nt, Human
cugcgaccacaagaaggau

SEQ ID NO: 3114001 - RNA, 15 nt, Human
cugcuccagcuguuc

SEQ ID NO: 3114002 - RNA, 20 nt, Human
cugcuccagcuguucagcug

SEQ ID NO: 3114003 - RNA, 19 nt, Human
cugcuccagcuguucagcu

SEQ ID NO: 3114004 - RNA, 19 nt, Human
cugcucuccgaccagacac

SEQ ID NO: 3114005 - RNA, 15 nt, Human
cugcugcaguugcca

SEQ ID NO: 3114006 - RNA, 11 nt, Human
cugcugaaggc

SEQ ID NO: 3114007 - RNA, 15 nt, Human
cugcugcuggcuggu

SEQ ID NO: 3114008 - RNA, 14 nt, Human
cugcugcuggcugg

SEQ ID NO: 3114009 - RNA, 15 nt, Human
cugcuuccagugagg

SEQ ID NO: 3114010 - RNA, 18 nt, Human
cugcuuccagugaggcuc

SEQ ID NO: 3114011 - RNA, 16 nt, Human
cugcuuccagugaggc

SEQ ID NO: 3114012 - RNA, 23 nt, Human
cugcuuccagugaggcucugccc

SEQ ID NO: 3114013 - RNA, 21 nt, Human
cugcuuccagugaggcucugc

SEQ ID NO: 3114014 - RNA, 20 nt, Human
cugcuuccagugaggcucug

SEQ ID NO: 3114015 - RNA, 19 nt, Human
cugcuuccagugaggcucu

SEQ ID NO: 3114016 - RNA, 13 nt, Human
cugcugguucagg

SEQ ID NO: 3114017 - RNA, 15 nt, Human
cugcugguucagggu

SEQ ID NO: 3114018 - RNA, 23 nt, Human
cugcugguucaggguuggccccu

SEQ ID NO: 3114019 - RNA, 23 nt, Human
cuguaucccaugagccucagcau

SEQ ID NO: 3114020 - RNA, 22 nt, Human
cuguaucccaugagccucagca

SEQ ID NO: 3114021 - RNA, 13 nt, Human
cuguacagagccc

SEQ ID NO: 3114022 - RNA, 20 nt, Human
cugucccuuacgugaguccu

SEQ ID NO: 3114023 - RNA, 14 nt, Human
cuguccgagcuuug

SEQ ID NO: 3114024 - RNA, 22 nt, Human
cuguccccgcacugggcuuggg

SEQ ID NO: 3114025 - RNA, 19 nt, Human
cuguccccgcacugggcuu

SEQ ID NO: 3114026 - RNA, 18 nt, Human
cuguccccgcacugggcu

SEQ ID NO: 3114027 - RNA, 17 nt, Human
cuguccccgcacugggc

SEQ ID NO: 3114028 - RNA, 23 nt, Human
cugucucaaaaaaacacaaaagu

SEQ ID NO: 3114029 - RNA, 16 nt, Human
cugucucaaaaaaaga

SEQ ID NO: 3114030 - RNA, 18 nt, Human
cugucucaaaaaaagaaa

SEQ ID NO: 3114031 - RNA, 14 nt, Human
cuguccuacccacc

SEQ ID NO: 3114032 - RNA, 15 nt, Human
cuguccgagcuuuga

SEQ ID NO: 3114033 - RNA, 17 nt, Human
cuggguucuacccaggu

SEQ ID NO: 3114034 - RNA, 16 nt, Human
cuggguucuacccagg

SEQ ID NO: 3114035 - RNA, 15 nt, Human
cuggguucuacccag

SEQ ID NO: 3114036 - RNA, 14 nt, Human
cuggguucuaccca

SEQ ID NO: 3114037 - RNA, 20 nt, Human
cuggguaacuagggaagaua

SEQ ID NO: 3114038 - RNA, 22 nt, Human
cuggguaacuagggaagauaau

SEQ ID NO: 3114039 - RNA, 13 nt, Human
cugggggaagaag

SEQ ID NO: 3114040 - RNA, 23 nt, Human
cugggcuucaguggcagcugcuu

SEQ ID NO: 3114041 - RNA, 24 nt, Human
cugggcuucaguggcagcugcuuu

SEQ ID NO: 3114042 - RNA, 15 nt, Human
cugggggaagaagcu

SEQ ID NO: 3114043 - RNA, 19 nt, Human
cugggggcugggcagagga

SEQ ID NO: 3114044 - RNA, 18 nt, Human
cugggggcugggcagagg

SEQ ID NO: 3114045 - RNA, 23 nt, Human
cugguggcagcucaccucucccu

SEQ ID NO: 3114046 - RNA, 21 nt, Human
cugguggcagcucaccucucc

SEQ ID NO: 3114047 - RNA, 13 nt, Human
cugguggcagcug

SEQ ID NO: 3114048 - RNA, 14 nt, Human
cugguggcagcugc

SEQ ID NO: 3114049 - RNA, 19 nt, Human
cuguaauccuagcacuuug

SEQ ID NO: 3114050 - RNA, 20 nt, Human
cuguaauccuagcacuuugg

SEQ ID NO: 3114051 - RNA, 15 nt, Human
cuguacaaaguagaa

SEQ ID NO: 3114052 - RNA, 22 nt, Human
cuguaauuugugauacaaugcu

SEQ ID NO: 3114053 - RNA, 13 nt, Human
cuguacaaaguag

SEQ ID NO: 3114054 - RNA, 16 nt, Human
cugguuccauggccuc

SEQ ID NO: 3114055 - RNA, 17 nt, Human
cuguggaugauaaaaca

SEQ ID NO: 3114056 - RNA, 14 nt, Human
cugugggcccccaa

SEQ ID NO: 3114057 - RNA, 22 nt, Human
cugugcugcccugcccaccugg

SEQ ID NO: 3114058 - RNA, 17 nt, Human
cugugccucugggacug

SEQ ID NO: 3114059 - RNA, 21 nt, Human
cugugcugcccugcccaccug

SEQ ID NO: 3114060 - RNA, 14 nt, Human
cugugccucuggga

SEQ ID NO: 3114061 - RNA, 16 nt, Human
cugugccucugggacu

SEQ ID NO: 3114062 - RNA, 20 nt, Human
cugugauggggcccugccuc

SEQ ID NO: 3114063 - RNA, 19 nt, Human
cugugauggggcccugccu

SEQ ID NO: 3114064 - RNA, 14 nt, Human
cugugccauuuugu

SEQ ID NO: 3114065 - RNA, 16 nt, Human
cugugccaugugccag

SEQ ID NO: 3114066 - RNA, 18 nt, Human
cugugccaugugccaggu

SEQ ID NO: 3114067 - RNA, 23 nt, Human
cugugaguacuacaguccuccca

SEQ ID NO: 3114068 - RNA, 21 nt, Human
cugugaguacuacaguccucc

SEQ ID NO: 3114069 - RNA, 20 nt, Human
cugugaguacuacaguccuc

SEQ ID NO: 3114070 - RNA, 17 nt, Human
cugugauggggcccugc

SEQ ID NO: 3114071 - RNA, 18 nt, Human
cugugauggggcccugcc

SEQ ID NO: 3114072 - RNA, 18 nt, Human
cugucuccauguuugaug

SEQ ID NO: 3114073 - RNA, 13 nt, Human
cuguucucugccc

SEQ ID NO: 3114074 - RNA, 20 nt, Human
cuguucucugcccuccaaga

SEQ ID NO: 3114075 - RNA, 19 nt, Human
cuguucucugcccuccaag

SEQ ID NO: 3114076 - RNA, 18 nt, Human
cuguucucugcccuccaa

SEQ ID NO: 3114077 - RNA, 17 nt, Human
cuguucucugcccucca

SEQ ID NO: 3114078 - RNA, 16 nt, Human
cuguucucugcccucc

SEQ ID NO: 3114079 - RNA, 15 nt, Human
cuguucucugcccuc

SEQ ID NO: 3114080 - RNA, 14 nt, Human
cuguucucugcccu

SEQ ID NO: 3114081 - RNA, 21 nt, Human
cuguucagcugguugagguuu

SEQ ID NO: 3114082 - RNA, 19 nt, Human
cuguucagcugguugaggu

SEQ ID NO: 3114083 - RNA, 18 nt, Human
cuguucagcugguugagg

SEQ ID NO: 3114084 - RNA, 18 nt, Human
cugugugugcgccuacag

SEQ ID NO: 3114085 - RNA, 20 nt, Human
cugugugugcgccuacagga

SEQ ID NO: 3114086 - RNA, 21 nt, Human
cugugucuugcaauggcagcc

SEQ ID NO: 3114087 - RNA, 20 nt, Human
cugugucuugcaauggcagc

SEQ ID NO: 3114088 - RNA, 22 nt, Human
cugugucuugcaauggcagccu

SEQ ID NO: 3114089 - RNA, 16 nt, Human
cuuuccucuuuggucu

SEQ ID NO: 3114090 - RNA, 12 nt, Human
cuuuccugaggc

SEQ ID NO: 3114091 - RNA, 11 nt, Human
cuuucccuccc

SEQ ID NO: 3114092 - RNA, 13 nt, Human
cuuucccucccuu

SEQ ID NO: 3114093 - RNA, 14 nt, Human
cuuucccucccuuc

SEQ ID NO: 3114094 - RNA, 16 nt, Human
cuuucccucccuuccu

SEQ ID NO: 3114095 - RNA, 15 nt, Human
cuuuccaggaaggcu

SEQ ID NO: 3114096 - RNA, 15 nt, Human
cuuuccaucuacccu

SEQ ID NO: 3114097 - RNA, 17 nt, Human
cuuucuggcuaugcauu

SEQ ID NO: 3114098 - RNA, 18 nt, Human
cuuucuggcuaugcauuu

SEQ ID NO: 3114099 - RNA, 19 nt, Human
cuuucuggcuaugcauuug

SEQ ID NO: 3114100 - RNA, 20 nt, Human
cuuucuggcuaugcauuuga

SEQ ID NO: 3114101 - RNA, 15 nt, Human
cuuuccugaggcugg

SEQ ID NO: 3114102 - RNA, 13 nt, Human
cuuuccugaggcu

SEQ ID NO: 3114103 - RNA, 20 nt, Human
cuuugcagacaggcaagcac

SEQ ID NO: 3114104 - RNA, 16 nt, Human
cuuugcagacaggcaa

SEQ ID NO: 3114105 - RNA, 13 nt, Human
cuuugaccucugc

SEQ ID NO: 3114106 - RNA, 14 nt, Human
cuuugaccucugca

SEQ ID NO: 3114107 - RNA, 15 nt, Human
cuuugaccucugcag

SEQ ID NO: 3114108 - RNA, 17 nt, Human
cuuugaccucugcagca

SEQ ID NO: 3114109 - RNA, 18 nt, Human
cuuugaccucugcagcaa

SEQ ID NO: 3114110 - RNA, 20 nt, Human
cuuugaccucugcagcaaua

SEQ ID NO: 3114111 - RNA, 24 nt, Human
cuuugaccucugcagcaauaaagc

SEQ ID NO: 3114112 - RNA, 15 nt, Human
cuuuguccccaccgc

SEQ ID NO: 3114113 - RNA, 15 nt, Human
cuuugugaggaagcc

SEQ ID NO: 3114114 - RNA, 19 nt, Human
cuuugugauuuuuguaauu

SEQ ID NO: 3114115 - RNA, 14 nt, Human
cuuuguccccaccg

SEQ ID NO: 3114116 - RNA, 19 nt, Human
cuuuggcuauuagagauca

SEQ ID NO: 3114117 - RNA, 17 nt, Human
cuuguaaauagcucagg

SEQ ID NO: 3114118 - RNA, 18 nt, Human
cuuguaaauagcucaggu

SEQ ID NO: 3114119 - RNA, 15 nt, Human
cuuguacauaaugcg

SEQ ID NO: 3114120 - RNA, 12 nt, Human
cuuguacauaau

SEQ ID NO: 3114121 - RNA, 22 nt, Human
cuuguacauaaugcgugcauac

SEQ ID NO: 3114122 - RNA, 19 nt, Human
cuuguacauaaugcgugca

SEQ ID NO: 3114123 - RNA, 21 nt, Human
cuuguacauaaugcgugcaua

SEQ ID NO: 3114124 - RNA, 16 nt, Human
cuuguaaauagcucag

SEQ ID NO: 3114125 - RNA, 22 nt, Human
cuuggggggcugaggugggagg

SEQ ID NO: 3114126 - RNA, 23 nt, Human
cuuggggggcugaggugggagga

SEQ ID NO: 3114127 - RNA, 13 nt, Human
cuuuacuauggcc

SEQ ID NO: 3114128 - RNA, 22 nt, Human
cuuuaccuuuuuuauacauaaa

SEQ ID NO: 3114129 - RNA, 15 nt, Human
cuuuaugcacaaaau

SEQ ID NO: 3114130 - RNA, 14 nt, Human
cuuuagcgcccagu

SEQ ID NO: 3114131 - RNA, 13 nt, Human
cuuuauaauucua

SEQ ID NO: 3114132 - RNA, 19 nt, Human
cuuuauaauucuacuuuga

SEQ ID NO: 3114133 - RNA, 17 nt, Human
cuuuuuuggcugcugaa

SEQ ID NO: 3114134 - RNA, 22 nt, Human
cuuuuuuggcugcugaaggcuc

SEQ ID NO: 3114135 - RNA, 20 nt, Human
cuuuuuuggcugcugaaggc

SEQ ID NO: 3114136 - RNA, 16 nt, Human
cuuuuuuggcugcuga

SEQ ID NO: 3114137 - RNA, 15 nt, Human
gaaaaaggaggaaga

SEQ ID NO: 3114138 - RNA, 12 nt, Human
gaaaaaggagga

SEQ ID NO: 3114139 - RNA, 14 nt, Human
gaaaacacauuuuu

SEQ ID NO: 3114140 - RNA, 18 nt, Human
gaaaacacauuuuucuua

SEQ ID NO: 3114141 - RNA, 19 nt, Human
gaaaacacauuuuucuuag

SEQ ID NO: 3114142 - RNA, 11 nt, Human
cuuuuguucuu

SEQ ID NO: 3114143 - RNA, 12 nt, Human
cuuuuguucuug

SEQ ID NO: 3114144 - RNA, 18 nt, Human
cuuuguuaguuucuccaa

SEQ ID NO: 3114145 - RNA, 24 nt, Human
gaaaacacuguucucugcccucca

SEQ ID NO: 3114146 - RNA, 22 nt, Human
gaaaacacuguucucugcccuc

SEQ ID NO: 3114147 - RNA, 19 nt, Human
gaaaagcugcugacagugu

SEQ ID NO: 3114148 - RNA, 19 nt, Human
gaaaacguggcugcuucaa

SEQ ID NO: 3114149 - RNA, 22 nt, Human
gaaaacguggcugcuucaagga

SEQ ID NO: 3114150 - RNA, 20 nt, Human
gaaaacguggcugcuucaag

SEQ ID NO: 3114151 - RNA, 22 nt, Human
gaaaaucagccugcuccagcug

SEQ ID NO: 3114152 - RNA, 20 nt, Human
gaaaaucagccugcuccagc

SEQ ID NO: 3114153 - RNA, 23 nt, Human
gaaacccagcucugguccauaga

SEQ ID NO: 3114154 - RNA, 14 nt, Human
gaaacccagcucug

SEQ ID NO: 3114155 - RNA, 13 nt, Human
gaaacccagcucu

SEQ ID NO: 3114156 - RNA, 19 nt, Human
gaaacccagcucuggucca

SEQ ID NO: 3114157 - RNA, 18 nt, Human
gaaacccagcucuggucc

SEQ ID NO: 3114158 - RNA, 16 nt, Human
gaaacccagcucuggu

SEQ ID NO: 3114159 - RNA, 15 nt, Human
gaaacccagcucugg

SEQ ID NO: 3114160 - RNA, 17 nt, Human
gaaagcccugagcuuuc

SEQ ID NO: 3114161 - RNA, 22 nt, Human
gaaagcccugagcuuucugcua

SEQ ID NO: 3114162 - RNA, 21 nt, Human
gaaagcccugagcuuucugcu

SEQ ID NO: 3114163 - RNA, 17 nt, Human
gaaagacuguacaaagu

SEQ ID NO: 3114164 - RNA, 19 nt, Human
gaaagacuuuuccaacccu

SEQ ID NO: 3114165 - RNA, 15 nt, Human
gaaagaguaggaaga

SEQ ID NO: 3114166 - RNA, 12 nt, Human
cuucuccaggcu

SEQ ID NO: 3114167 - RNA, 13 nt, Human
cuucuccaggcug

SEQ ID NO: 3114168 - RNA, 20 nt, Human
cuucuccacuuucuagccag

SEQ ID NO: 3114169 - RNA, 11 nt, Human
cuucuccacuu

SEQ ID NO: 3114170 - RNA, 12 nt, Human
cuucucuccagc

SEQ ID NO: 3114171 - RNA, 19 nt, Human
cuucucuccagccccugga

SEQ ID NO: 3114172 - RNA, 17 nt, Human
cuucucuccagccccug

SEQ ID NO: 3114173 - RNA, 15 nt, Human
cuucucuccagcccc

SEQ ID NO: 3114174 - RNA, 13 nt, Human
cuucucuccagcc

SEQ ID NO: 3114175 - RNA, 13 nt, Human
cuucucugaagga

SEQ ID NO: 3114176 - RNA, 20 nt, Human
cuucugccauuucugagauc

SEQ ID NO: 3114177 - RNA, 21 nt, Human
cuucuguacgucugacaggca

SEQ ID NO: 3114178 - RNA, 14 nt, Human
cuucuguacgucug

SEQ ID NO: 3114179 - RNA, 15 nt, Human
cuucuguacgucuga

SEQ ID NO: 3114180 - RNA, 18 nt, Human
cuucuguacgucugacag

SEQ ID NO: 3114181 - RNA, 20 nt, Human
cuucuguacgucugacaggc

SEQ ID NO: 3114182 - RNA, 16 nt, Human
cuucuguccuacucug

SEQ ID NO: 3114183 - RNA, 17 nt, Human
cuucuguccuacucugu

SEQ ID NO: 3114184 - RNA, 18 nt, Human
cuucuguccuacucugug

SEQ ID NO: 3114185 - RNA, 19 nt, Human
cuucuguccuacucugugu

SEQ ID NO: 3114186 - RNA, 21 nt, Human
cuucuguccuacucuguguca

SEQ ID NO: 3114187 - RNA, 17 nt, Human
cuugaacuuugaccucu

SEQ ID NO: 3114188 - RNA, 21 nt, Human
cuugaacuuugaccucugcag

SEQ ID NO: 3114189 - RNA, 13 nt, Human
cuugaacuccugg

SEQ ID NO: 3114190 - RNA, 13 nt, Human
cuugaccucaggu

SEQ ID NO: 3114191 - RNA, 21 nt, Human
cuugaccgugaggccagagac

SEQ ID NO: 3114192 - RNA, 20 nt, Human
cuugaccgugaggccagaga

SEQ ID NO: 3114193 - RNA, 18 nt, Human
cuugaccgugaggccaga

SEQ ID NO: 3114194 - RNA, 23 nt, Human
cuugaccauucuccaccugccag

SEQ ID NO: 3114195 - RNA, 22 nt, Human
cuugaccauucuccaccugcca

SEQ ID NO: 3114196 - RNA, 17 nt, Human
cuugaccgugaggccag

SEQ ID NO: 3114197 - RNA, 16 nt, Human
cuugagccugggaggu

SEQ ID NO: 3114198 - RNA, 15 nt, Human
cuugagccuugaacu

SEQ ID NO: 3114199 - RNA, 17 nt, Human
cuugagccuugaacuuu

SEQ ID NO: 3114200 - RNA, 18 nt, Human
cuugagccuugaacuuug

SEQ ID NO: 3114201 - RNA, 13 nt, Human
cuugagcucagga

SEQ ID NO: 3114202 - RNA, 21 nt, Human
cuugaggguugggcugguguc

SEQ ID NO: 3114203 - RNA, 21 nt, Human
cuugaguugauucagcucugc

SEQ ID NO: 3114204 - RNA, 19 nt, Human
cuugaggguugggcuggug

SEQ ID NO: 3114205 - RNA, 20 nt, Human
cuugaggguugggcuggugu

SEQ ID NO: 3114206 - RNA, 13 nt, Human
cuucuguggguuu

SEQ ID NO: 3114207 - RNA, 21 nt, Human
cuucuguggguuucuaaagcu

SEQ ID NO: 3114208 - RNA, 14 nt, Human
cuucuguggguuuc

SEQ ID NO: 3114209 - RNA, 23 nt, Human
cuugaaaacacuguucucugccc

SEQ ID NO: 3114210 - RNA, 14 nt, Human
cuugaaaacacugu

SEQ ID NO: 3114211 - RNA, 14 nt, Human
cuuccaggcuggga

SEQ ID NO: 3114212 - RNA, 12 nt, Human
cuuccaggcugg

SEQ ID NO: 3114213 - RNA, 16 nt, Human
cuuccacaagagccca

SEQ ID NO: 3114214 - RNA, 17 nt, Human
cuuccacaagagcccag

SEQ ID NO: 3114215 - RNA, 21 nt, Human
cuuccacaagagcccaggccu

SEQ ID NO: 3114216 - RNA, 19 nt, Human
cuuccacaagagcccaggc

SEQ ID NO: 3114217 - RNA, 20 nt, Human
cuucauucaacccaccugcg

SEQ ID NO: 3114218 - RNA, 15 nt, Human
cuucaguaagccgug

SEQ ID NO: 3114219 - RNA, 22 nt, Human
cuucagugccuuauggaacacu

SEQ ID NO: 3114220 - RNA, 18 nt, Human
cuucagugccuuauggaa

SEQ ID NO: 3114221 - RNA, 13 nt, Human
cuucaguggcagc

SEQ ID NO: 3114222 - RNA, 14 nt, Human
cuucaguggcagcu

SEQ ID NO: 3114223 - RNA, 15 nt, Human
cuucaguggcagcug

SEQ ID NO: 3114224 - RNA, 16 nt, Human
cuucaguggcagcugc

SEQ ID NO: 3114225 - RNA, 23 nt, Human
cuucaguaagccgugauuuucau

SEQ ID NO: 3114226 - RNA, 16 nt, Human
cuucaguaagccguga

SEQ ID NO: 3114227 - RNA, 17 nt, Human
cuuccaggggugggaca

SEQ ID NO: 3114228 - RNA, 15 nt, Human
cuuccagggguggga

SEQ ID NO: 3114229 - RNA, 14 nt, Human
cuuccagggguggg

SEQ ID NO: 3114230 - RNA, 19 nt, Human
cuuccaggcugggagagcc

SEQ ID NO: 3114231 - RNA, 16 nt, Human
cuuccaggcugggaga

SEQ ID NO: 3114232 - RNA, 15 nt, Human
cuuccaggcugggag

SEQ ID NO: 3114233 - RNA, 17 nt, Human
cuuauuuaaugaaagac

SEQ ID NO: 3114234 - RNA, 18 nt, Human
cuuauuuaaugaaagacu

SEQ ID NO: 3114235 - RNA, 23 nt, Human
cuucacagaugggugcuuggagg

SEQ ID NO: 3114236 - RNA, 10 nt, Human
cuucaaggau

SEQ ID NO: 3114237 - RNA, 15 nt, Human
cuucaaggauccuga

SEQ ID NO: 3114238 - RNA, 13 nt, Human
cuucaaggauccu

SEQ ID NO: 3114239 - RNA, 14 nt, Human
cuuagucacugaga

SEQ ID NO: 3114240 - RNA, 19 nt, Human
cuuagucacugagacagcc

SEQ ID NO: 3114241 - RNA, 18 nt, Human
cuuagucacugagacagc

SEQ ID NO: 3114242 - RNA, 16 nt, Human
cuuagucacugagaca

SEQ ID NO: 3114243 - RNA, 13 nt, Human
cuuagauguauau

SEQ ID NO: 3114244 - RNA, 16 nt, Human
cuguucuggcagaguu

SEQ ID NO: 3114245 - RNA, 15 nt, Human
cuuauacauuugaua

SEQ ID NO: 3114246 - RNA, 19 nt, Human
ccgagcuuugaaaauucag

SEQ ID NO: 3114247 - RNA, 14 nt, Human
ccgaguagcuggga

SEQ ID NO: 3114248 - RNA, 19 nt, Human
ccgcacugggcuuggggac

SEQ ID NO: 3114249 - RNA, 23 nt, Human
ccgcacugggcuuggggaccaga

SEQ ID NO: 3114250 - RNA, 21 nt, Human
ccgagauugcaccacugcacu

SEQ ID NO: 3114251 - RNA, 19 nt, Human
ccgagauugcaccacugca

SEQ ID NO: 3114252 - RNA, 15 nt, Human
ccgagauugcaccac

SEQ ID NO: 3114253 - RNA, 15 nt, Human
ccggcuccaggcucc

SEQ ID NO: 3114254 - RNA, 16 nt, Human
ccggcuccaggcuccu

SEQ ID NO: 3114255 - RNA, 21 nt, Human
ccggcuccaggcuccuuuagc

SEQ ID NO: 3114256 - RNA, 20 nt, Human
ccgggcacucagaagacacu

SEQ ID NO: 3114257 - RNA, 22 nt, Human
ccgggcacucagaagacacuga

SEQ ID NO: 3114258 - RNA, 13 nt, Human
ccgggccacagag

SEQ ID NO: 3114259 - RNA, 15 nt, Human
ccgggcucugccucc

SEQ ID NO: 3114260 - RNA, 14 nt, Human
ccgggcucugccuc

SEQ ID NO: 3114261 - RNA, 13 nt, Human
ccgggcucugccu

SEQ ID NO: 3114262 - RNA, 18 nt, Human
ccgggcucugccucccau

SEQ ID NO: 3114263 - RNA, 18 nt, Human
ccgugaggccagagacac

SEQ ID NO: 3114264 - RNA, 11 nt, Human
ccgcuggggcc

SEQ ID NO: 3114265 - RNA, 14 nt, Human
ccgcuggggccagu

SEQ ID NO: 3114266 - RNA, 23 nt, Human
ccuaggcauuugcugaauacaga

SEQ ID NO: 3114267 - RNA, 18 nt, Human
ccuaggugacagagugag

SEQ ID NO: 3114268 - RNA, 18 nt, Human
ccuacaggagugagcacu

SEQ ID NO: 3114269 - RNA, 23 nt, Human
cccucccucuuucccucccuucc

SEQ ID NO: 3114270 - RNA, 12 nt, Human
cccucuuucccu

SEQ ID NO: 3114271 - RNA, 17 nt, Human
cccucuuucccucccuu

SEQ ID NO: 3114272 - RNA, 20 nt, Human
cccucuuucccucccuuccu

SEQ ID NO: 3114273 - RNA, 19 nt, Human
cccucugcccacucccugc

SEQ ID NO: 3114274 - RNA, 11 nt, Human
cccucugccca

SEQ ID NO: 3114275 - RNA, 18 nt, Human
cccucugcccacucccug

SEQ ID NO: 3114276 - RNA, 15 nt, Human
cccucugcccacucc

SEQ ID NO: 3114277 - RNA, 14 nt, Human
cccugguggcagug

SEQ ID NO: 3114278 - RNA, 21 nt, Human
cccuguagagugggagcugag

SEQ ID NO: 3114279 - RNA, 13 nt, Human
cccugguggcagu

SEQ ID NO: 3114280 - RNA, 21 nt, Human
cccugguggcagcucaccucu

SEQ ID NO: 3114281 - RNA, 21 nt, Human
cccuggugaccagcaccaucu

SEQ ID NO: 3114282 - RNA, 14 nt, Human
cccuguucuggcag

SEQ ID NO: 3114283 - RNA, 13 nt, Human
cccuguucuggca

SEQ ID NO: 3114284 - RNA, 16 nt, Human
cccuguuuguuucuga

SEQ ID NO: 3114285 - RNA, 19 nt, Human
cccuguuuguuucugaaag

SEQ ID NO: 3114286 - RNA, 19 nt, Human
cccuuaccucggugccuuc

SEQ ID NO: 3114287 - RNA, 17 nt, Human
cccuuaccugccaggaa

SEQ ID NO: 3114288 - RNA, 23 nt, Human
cccuuaccugccaggaagccagc

SEQ ID NO: 3114289 - RNA, 20 nt, Human
cccuuaccugccaggaagcc

SEQ ID NO: 3114290 - RNA, 23 nt, Human
cccuuagcagggaaacagcuaau

SEQ ID NO: 3114291 - RNA, 14 nt, Human
cccuuagcagggaa

SEQ ID NO: 3114292 - RNA, 17 nt, Human
cccuuacgugaguccug

SEQ ID NO: 3114293 - RNA, 15 nt, Human
cccuuacgugagucc

SEQ ID NO: 3114294 - RNA, 12 nt, Human
cccuuccaugga

SEQ ID NO: 3114295 - RNA, 22 nt, Human
cccuugccgucuaccugagggg

SEQ ID NO: 3114296 - RNA, 22 nt, Human
cccugcucuccgaccagacacc

SEQ ID NO: 3114297 - RNA, 21 nt, Human
cccugcucuccgaccagacac

SEQ ID NO: 3114298 - RNA, 11 nt, Human
cccugccuccu

SEQ ID NO: 3114299 - RNA, 21 nt, Human
cccugcccugugggcccccaa

SEQ ID NO: 3114300 - RNA, 12 nt, Human
cccugaggccca

SEQ ID NO: 3114301 - RNA, 20 nt, Human
cccugcagagggcacagaaa

SEQ ID NO: 3114302 - RNA, 23 nt, Human
cccgcuaagagggagggagggcu

SEQ ID NO: 3114303 - RNA, 22 nt, Human
cccgcuaagagggagggagggc

SEQ ID NO: 3114304 - RNA, 22 nt, Human
cccgcccaggcuuagucacuga

SEQ ID NO: 3114305 - RNA, 20 nt, Human
cccgcccaggcuuagucacu

SEQ ID NO: 3114306 - RNA, 22 nt, Human
cccgaauagcugggacuacagg

SEQ ID NO: 3114307 - RNA, 20 nt, Human
ccccuuccauggacuuuguu

SEQ ID NO: 3114308 - RNA, 13 nt, Human
ccccuuccaugga

SEQ ID NO: 3114309 - RNA, 15 nt, Human
ccccuggaugcagcc

SEQ ID NO: 3114310 - RNA, 19 nt, Human
ccccuggaugcagccucac

SEQ ID NO: 3114311 - RNA, 18 nt, Human
ccccuggaugcagccuca

SEQ ID NO: 3114312 - RNA, 17 nt, Human
ccccugcuggguguggc

SEQ ID NO: 3114313 - RNA, 14 nt, Human
ccccugcugggugu

SEQ ID NO: 3114314 - RNA, 11 nt, Human
ccccugcuggu

SEQ ID NO: 3114315 - RNA, 13 nt, Human
ccccugcugguuc

SEQ ID NO: 3114316 - RNA, 15 nt, Human
ccccugcugguucag

SEQ ID NO: 3114317 - RNA, 20 nt, Human
ccccugcugguucaggguug

SEQ ID NO: 3114318 - RNA, 17 nt, Human
ccccugcccggcugcgg

SEQ ID NO: 3114319 - RNA, 19 nt, Human
ccccugcccggcugcggaa

SEQ ID NO: 3114320 - RNA, 14 nt, Human
ccccagugcccaca

SEQ ID NO: 3114321 - RNA, 15 nt, Human
ccccagugcccacag

SEQ ID NO: 3114322 - RNA, 16 nt, Human
ccccagugcccacagg

SEQ ID NO: 3114323 - RNA, 20 nt, Human
ccccagugcccacaggauca

SEQ ID NO: 3114324 - RNA, 22 nt, Human
ccccaggugguuauggagaggg

SEQ ID NO: 3114325 - RNA, 13 nt, Human
cccccacugguga

SEQ ID NO: 3114326 - RNA, 11 nt, Human
cccccacuggu

SEQ ID NO: 3114327 - RNA, 15 nt, Human
cccccacuggugaca

SEQ ID NO: 3114328 - RNA, 24 nt, Human
cccccacccaagggccuggccuga

SEQ ID NO: 3114329 - RNA, 13 nt, Human
cccccacccaagg

SEQ ID NO: 3114330 - RNA, 14 nt, Human
ccccauccucugua

SEQ ID NO: 3114331 - RNA, 17 nt, Human
cccccugacaacacuca

SEQ ID NO: 3114332 - RNA, 19 nt, Human
cccccugacaacacucauu

SEQ ID NO: 3114333 - RNA, 12 nt, Human
cccccagccugc

SEQ ID NO: 3114334 - RNA, 23 nt, Human
ccccucaacucuccuccagaguc

SEQ ID NO: 3114335 - RNA, 16 nt, Human
ccccucaacaccucug

SEQ ID NO: 3114336 - RNA, 15 nt, Human
ccccucaacaccucu

SEQ ID NO: 3114337 - RNA, 12 nt, Human
ccccuccaugug

SEQ ID NO: 3114338 - RNA, 16 nt, Human
ccccucagggucccug

SEQ ID NO: 3114339 - RNA, 22 nt, Human
ccccucagggucccugguggca

SEQ ID NO: 3114340 - RNA, 14 nt, Human
ccccacuggugaca

SEQ ID NO: 3114341 - RNA, 19 nt, Human
ccccaccgcagacaggacc

SEQ ID NO: 3114342 - RNA, 15 nt, Human
ccccaccgcagacag

SEQ ID NO: 3114343 - RNA, 21 nt, Human
ccccacccaagggccuggccu

SEQ ID NO: 3114344 - RNA, 14 nt, Human
cccaugagccucag

SEQ ID NO: 3114345 - RNA, 22 nt, Human
cccaugagccucagcauccugg

SEQ ID NO: 3114346 - RNA, 18 nt, Human
cccaugcugcccugugag

SEQ ID NO: 3114347 - RNA, 19 nt, Human
cccaucucuacaaaaagca

SEQ ID NO: 3114348 - RNA, 14 nt, Human
cccaguugggugga

SEQ ID NO: 3114349 - RNA, 15 nt, Human
ccauucugccugccc

SEQ ID NO: 3114350 - RNA, 13 nt, Human
ccauuugcuccuu

SEQ ID NO: 3114351 - RNA, 18 nt, Human
ccauguuuuguuuacggu

SEQ ID NO: 3114352 - RNA, 16 nt, Human
cccaagggccuggccu

SEQ ID NO: 3114353 - RNA, 17 nt, Human
cccacaggaucagucug

SEQ ID NO: 3114354 - RNA, 13 nt, Human
cccacaggaucag

SEQ ID NO: 3114355 - RNA, 14 nt, Human
cccaagggccuggc

SEQ ID NO: 3114356 - RNA, 12 nt, Human
cccaagggccug

SEQ ID NO: 3114357 - RNA, 21 nt, Human
ccauuuuguauuuuacuaaua

SEQ ID NO: 3114358 - RNA, 20 nt, Human
ccauuuugcugucccuuuuc

SEQ ID NO: 3114359 - RNA, 12 nt, Human
cccaccucagcc

SEQ ID NO: 3114360 - RNA, 14 nt, Human
cccaccucagccuc

SEQ ID NO: 3114361 - RNA, 15 nt, Human
cccaccucagccucc

SEQ ID NO: 3114362 - RNA, 12 nt, Human
cccaccuuggcu

SEQ ID NO: 3114363 - RNA, 21 nt, Human
cccaccucagccucccaaagu

SEQ ID NO: 3114364 - RNA, 13 nt, Human
cccaccucucuca

SEQ ID NO: 3114365 - RNA, 17 nt, Human
cccaccucucucacucc

SEQ ID NO: 3114366 - RNA, 14 nt, Human
cccaccucucucac

SEQ ID NO: 3114367 - RNA, 19 nt, Human
cccacgcccccacugguga

SEQ ID NO: 3114368 - RNA, 17 nt, Human
cccacgcccccacuggu

SEQ ID NO: 3114369 - RNA, 15 nt, Human
cccacgcccccacug

SEQ ID NO: 3114370 - RNA, 15 nt, Human
cccaccuuggcucaa

SEQ ID NO: 3114371 - RNA, 22 nt, Human
cccaccuuggcucaaguccucu

SEQ ID NO: 3114372 - RNA, 14 nt, Human
cccaccuuggcugc

SEQ ID NO: 3114373 - RNA, 15 nt, Human
cccaccuuggcugca

SEQ ID NO: 3114374 - RNA, 21 nt, Human
cccacgcuggagugcagugag

SEQ ID NO: 3114375 - RNA, 12 nt, Human
ccaucaugucug

SEQ ID NO: 3114376 - RNA, 13 nt, Human
ccaucaugucugg

SEQ ID NO: 3114377 - RNA, 12 nt, Human
ccaucauugaaa

SEQ ID NO: 3114378 - RNA, 14 nt, Human
ccaucaagccacca

SEQ ID NO: 3114379 - RNA, 13 nt, Human
ccaucaagccacc

SEQ ID NO: 3114380 - RNA, 16 nt, Human
ccaucaagccaccaac

SEQ ID NO: 3114381 - RNA, 15 nt, Human
ccauaugccugggca

SEQ ID NO: 3114382 - RNA, 12 nt, Human
ccaucaagccac

SEQ ID NO: 3114383 - RNA, 13 nt, Human
ccauaugccuggg

SEQ ID NO: 3114384 - RNA, 14 nt, Human
ccagugugacaagg

SEQ ID NO: 3114385 - RNA, 23 nt, Human
ccagugugacaaggauugcuacu

SEQ ID NO: 3114386 - RNA, 15 nt, Human
ccaucucuccuccuu

SEQ ID NO: 3114387 - RNA, 21 nt, Human
ccaucucacacaugagcauca

SEQ ID NO: 3114388 - RNA, 20 nt, Human
ccaucucacacaugagcauc

SEQ ID NO: 3114389 - RNA, 18 nt, Human
ccaucucacacaugagca

SEQ ID NO: 3114390 - RNA, 17 nt, Human
ccaucucacacaugagc

SEQ ID NO: 3114391 - RNA, 15 nt, Human
ccaucucacacauga

SEQ ID NO: 3114392 - RNA, 14 nt, Human
ccaucucacacaug

SEQ ID NO: 3114393 - RNA, 13 nt, Human
ccaucuacccucc

SEQ ID NO: 3114394 - RNA, 17 nt, Human
ccaucauugaaaucuuu

SEQ ID NO: 3114395 - RNA, 16 nt, Human
ccaucauugaaaucuu

SEQ ID NO: 3114396 - RNA, 14 nt, Human
ccaucauugaaauc

SEQ ID NO: 3114397 - RNA, 16 nt, Human
ccagguuucuaugugu

SEQ ID NO: 3114398 - RNA, 13 nt, Human
ccagguuuaagcu

SEQ ID NO: 3114399 - RNA, 20 nt, Human
ccaguaaaugggggugcauu

SEQ ID NO: 3114400 - RNA, 21 nt, Human
ccaguaaaugggggugcauuu

SEQ ID NO: 3114401 - RNA, 22 nt, Human
ccaguaaaugggggugcauuug

SEQ ID NO: 3114402 - RNA, 21 nt, Human
ccaggugcuaggaacacuccu

SEQ ID NO: 3114403 - RNA, 21 nt, Human
ccaggcuuagucacugagaca

SEQ ID NO: 3114404 - RNA, 23 nt, Human
ccaggcuuagucacugagacagc

SEQ ID NO: 3114405 - RNA, 22 nt, Human
ccaggcuuagucacugagacag

SEQ ID NO: 3114406 - RNA, 23 nt, Human
ccaggcugggagagccuuccagg

SEQ ID NO: 3114407 - RNA, 15 nt, Human
ccaggcccucugccc

SEQ ID NO: 3114408 - RNA, 14 nt, Human
ccaggaggccagcc

SEQ ID NO: 3114409 - RNA, 18 nt, Human
ccaggaggccagccuuga

SEQ ID NO: 3114410 - RNA, 15 nt, Human
ccaggaggccagccu

SEQ ID NO: 3114411 - RNA, 20 nt, Human
ccaggaggccagccuugacc

SEQ ID NO: 3114412 - RNA, 21 nt, Human
ccaggccacaagacccuugug

SEQ ID NO: 3114413 - RNA, 14 nt, Human
ccaggccccugcca

SEQ ID NO: 3114414 - RNA, 15 nt, Human
ccaggccccugccac

SEQ ID NO: 3114415 - RNA, 16 nt, Human
ccaggccccugccacc

SEQ ID NO: 3114416 - RNA, 14 nt, Human
ccaggcccucugcc

SEQ ID NO: 3114417 - RNA, 13 nt, Human
ccaggcccucugc

SEQ ID NO: 3114418 - RNA, 15 nt, Human
ccaccugccagggac

SEQ ID NO: 3114419 - RNA, 12 nt, Human
ccaccugccagg

SEQ ID NO: 3114420 - RNA, 14 nt, Human
ccaccugccaggga

SEQ ID NO: 3114421 - RNA, 13 nt, Human
ccaccugccaggg

SEQ ID NO: 3114422 - RNA, 20 nt, Human
ccaccuggccucugcacucc

SEQ ID NO: 3114423 - RNA, 18 nt, Human
ccaccuggccucugcacu

SEQ ID NO: 3114424 - RNA, 13 nt, Human
ccaccuggccucu

SEQ ID NO: 3114425 - RNA, 20 nt, Human
ccaccucucucacuccuuga

SEQ ID NO: 3114426 - RNA, 19 nt, Human
ccaccucucucacuccuug

SEQ ID NO: 3114427 - RNA, 16 nt, Human
ccaccucucucacucc

SEQ ID NO: 3114428 - RNA, 14 nt, Human
ccaccucucucacu

SEQ ID NO: 3114429 - RNA, 11 nt, Human
ccacccugcuc

SEQ ID NO: 3114430 - RNA, 12 nt, Human
ccacccugcucu

SEQ ID NO: 3114431 - RNA, 14 nt, Human
ccacccuccuuuca

SEQ ID NO: 3114432 - RNA, 18 nt, Human
ccacccugaaagcccuga

SEQ ID NO: 3114433 - RNA, 19 nt, Human
ccaccccucaacaccucug

SEQ ID NO: 3114434 - RNA, 19 nt, Human
ccacccccacccaagggcc

SEQ ID NO: 3114435 - RNA, 14 nt, Human
ccagacccggcugc

SEQ ID NO: 3114436 - RNA, 15 nt, Human
ccagacccggcugcg

SEQ ID NO: 3114437 - RNA, 22 nt, Human
ccagacacauguccaagaagcc

SEQ ID NO: 3114438 - RNA, 20 nt, Human
ccagacacauguccaagaag

SEQ ID NO: 3114439 - RNA, 17 nt, Human
ccagacacauguccaag

SEQ ID NO: 3114440 - RNA, 15 nt, Human
ccacugugaagagaa

SEQ ID NO: 3114441 - RNA, 14 nt, Human
ccacugugaagaga

SEQ ID NO: 3114442 - RNA, 23 nt, Human
ccacuggugacaugucuuuucuu

SEQ ID NO: 3114443 - RNA, 22 nt, Human
ccacugcuuuuggucuguguga

SEQ ID NO: 3114444 - RNA, 20 nt, Human
ccacugcuuuuggucugugu

SEQ ID NO: 3114445 - RNA, 11 nt, Human
ccacugcucug

SEQ ID NO: 3114446 - RNA, 12 nt, Human
ccacugcucugg

SEQ ID NO: 3114447 - RNA, 13 nt, Human
ccacugcucuggu

SEQ ID NO: 3114448 - RNA, 15 nt, Human
ccacugcucugguua

SEQ ID NO: 3114449 - RNA, 23 nt, Human
ccacugcaucguuucaucuucca

SEQ ID NO: 3114450 - RNA, 21 nt, Human
ccacugcaucguuucaucuuc

SEQ ID NO: 3114451 - RNA, 22 nt, Human
ccacuuuuguucuugguuugua

SEQ ID NO: 3114452 - RNA, 19 nt, Human
ccacugugccaugugccag

SEQ ID NO: 3114453 - RNA, 15 nt, Human
ccacugugccaugug

SEQ ID NO: 3114454 - RNA, 16 nt, Human
ccacugugccaugugc

SEQ ID NO: 3114455 - RNA, 22 nt, Human
ccagaagaaaauagugguguga

SEQ ID NO: 3114456 - RNA, 17 nt, Human
ccagcaagugagagcug

SEQ ID NO: 3114457 - RNA, 18 nt, Human
ccagcaagugagagcugg

SEQ ID NO: 3114458 - RNA, 19 nt, Human
ccagcaagugagagcuggg

SEQ ID NO: 3114459 - RNA, 16 nt, Human
ccagcaagugagagcu

SEQ ID NO: 3114460 - RNA, 18 nt, Human
ccagcaccaucucuccuc

SEQ ID NO: 3114461 - RNA, 17 nt, Human
ccagcaccaucucuccu

SEQ ID NO: 3114462 - RNA, 16 nt, Human
ccagcaggcucucagg

SEQ ID NO: 3114463 - RNA, 18 nt, Human
ccagcaggcucucaggcc

SEQ ID NO: 3114464 - RNA, 17 nt, Human
ccagcaggcucucaggc

SEQ ID NO: 3114465 - RNA, 14 nt, Human
ccagauugcaacag

SEQ ID NO: 3114466 - RNA, 16 nt, Human
ccagauugcaacaggc

SEQ ID NO: 3114467 - RNA, 14 nt, Human
ccagagcccaccuu

SEQ ID NO: 3114468 - RNA, 23 nt, Human
ccagauugcaacaggcugggcuu

SEQ ID NO: 3114469 - RNA, 22 nt, Human
ccagauugcaacaggcugggcu

SEQ ID NO: 3114470 - RNA, 15 nt, Human
ccagauuucacucuc

SEQ ID NO: 3114471 - RNA, 19 nt, Human
ccagauuucacucuccuug

SEQ ID NO: 3114472 - RNA, 18 nt, Human
ccagauuucacucuccuu

SEQ ID NO: 3114473 - RNA, 13 nt, Human
ccagccuggguga

SEQ ID NO: 3114474 - RNA, 22 nt, Human
ccagccuugaccauucuccacc

SEQ ID NO: 3114475 - RNA, 23 nt, Human
ccagccuugaccauucuccaccu

SEQ ID NO: 3114476 - RNA, 16 nt, Human
ccagcccacuucugcc

SEQ ID NO: 3114477 - RNA, 17 nt, Human
ccagcccacuucugcca

SEQ ID NO: 3114478 - RNA, 23 nt, Human
ccagcaggcucucaggccagcug

SEQ ID NO: 3114479 - RNA, 21 nt, Human
ccagcaggcucucaggccagc

SEQ ID NO: 3114480 - RNA, 20 nt, Human
ccagcaggcucucaggccag

SEQ ID NO: 3114481 - RNA, 19 nt, Human
ccagcaggcucucaggcca

SEQ ID NO: 3114482 - RNA, 19 nt, Human
ccagccgccaugcuccugg

SEQ ID NO: 3114483 - RNA, 17 nt, Human
ccagccgagauagccaa

SEQ ID NO: 3114484 - RNA, 22 nt, Human
ccagccgagauagccaaggcca

SEQ ID NO: 3114485 - RNA, 20 nt, Human
ccagccgagauagccaaggc

SEQ ID NO: 3114486 - RNA, 19 nt, Human
ccagccccaaaacucuccu

SEQ ID NO: 3114487 - RNA, 22 nt, Human
ccugaagucuuuguacagacaa

SEQ ID NO: 3114488 - RNA, 20 nt, Human
ccugaagucacacagugagu

SEQ ID NO: 3114489 - RNA, 19 nt, Human
ccugaagucacacagugag

SEQ ID NO: 3114490 - RNA, 18 nt, Human
ccugagccagauuucacu

SEQ ID NO: 3114491 - RNA, 16 nt, Human
ccugagccagauuuca

SEQ ID NO: 3114492 - RNA, 12 nt, Human
ccugagccagau

SEQ ID NO: 3114493 - RNA, 15 nt, Human
ccugagccagauuuc

SEQ ID NO: 3114494 - RNA, 15 nt, Human
ccugaggcugggcuc

SEQ ID NO: 3114495 - RNA, 14 nt, Human
ccugaggcugggcu

SEQ ID NO: 3114496 - RNA, 13 nt, Human
ccugaggcugggc

SEQ ID NO: 3114497 - RNA, 12 nt, Human
ccugagcuggga

SEQ ID NO: 3114498 - RNA, 17 nt, Human
ccugaggcccagagggc

SEQ ID NO: 3114499 - RNA, 16 nt, Human
ccugaggcccagaggg

SEQ ID NO: 3114500 - RNA, 15 nt, Human
ccugaggcccagagg

SEQ ID NO: 3114501 - RNA, 19 nt, Human
ccugccaauggacuaacuu

SEQ ID NO: 3114502 - RNA, 16 nt, Human
ccugccacccugggga

SEQ ID NO: 3114503 - RNA, 22 nt, Human
ccugccacccuggggagaaagu

SEQ ID NO: 3114504 - RNA, 14 nt, Human
ccugccacccuggg

SEQ ID NO: 3114505 - RNA, 12 nt, Human
ccugccacccug

SEQ ID NO: 3114506 - RNA, 13 nt, Human
ccugccacccugg

SEQ ID NO: 3114507 - RNA, 15 nt, Human
ccugagcugggauga

SEQ ID NO: 3114508 - RNA, 14 nt, Human
ccugaaggccccgc

SEQ ID NO: 3114509 - RNA, 19 nt, Human
ccugaaggccccgcccagg

SEQ ID NO: 3114510 - RNA, 18 nt, Human
ccugaaggccccgcccag

SEQ ID NO: 3114511 - RNA, 21 nt, Human
ccugaaggccccgcccaggcu

SEQ ID NO: 3114512 - RNA, 20 nt, Human
ccugaaggccccgcccaggc

SEQ ID NO: 3114513 - RNA, 22 nt, Human
ccugaaggccccgcccaggcuu

SEQ ID NO: 3114514 - RNA, 14 nt, Human
ccugaaagcccuga

SEQ ID NO: 3114515 - RNA, 13 nt, Human
ccugaaagcccug

SEQ ID NO: 3114516 - RNA, 18 nt, Human
ccugaaagcccugagcuu

SEQ ID NO: 3114517 - RNA, 21 nt, Human
ccugaagacucauucuucugu

SEQ ID NO: 3114518 - RNA, 22 nt, Human
ccugccuguugggccaggagcc

SEQ ID NO: 3114519 - RNA, 22 nt, Human
ccugccagggacagagggggug

SEQ ID NO: 3114520 - RNA, 12 nt, Human
ccugccaggcau

SEQ ID NO: 3114521 - RNA, 14 nt, Human
ccugcccggcugcg

SEQ ID NO: 3114522 - RNA, 16 nt, Human
ccugcccggcugcgga

SEQ ID NO: 3114523 - RNA, 11 nt, Human
ccugcccugug

SEQ ID NO: 3114524 - RNA, 14 nt, Human
ccugcccugugggc

SEQ ID NO: 3114525 - RNA, 12 nt, Human
ccugcccugugg

SEQ ID NO: 3114526 - RNA, 13 nt, Human
ccugccucagccu

SEQ ID NO: 3114527 - RNA, 14 nt, Human
ccugccucagccuc

SEQ ID NO: 3114528 - RNA, 12 nt, Human
ccugccucagcc

SEQ ID NO: 3114529 - RNA, 11 nt, Human
ccugccucagc

SEQ ID NO: 3114530 - RNA, 14 nt, Human
ccugccuguugggc

SEQ ID NO: 3114531 - RNA, 22 nt, Human
ccugcccuuaccugccaggaag

SEQ ID NO: 3114532 - RNA, 21 nt, Human
ccugcccuuaccugccaggaa

SEQ ID NO: 3114533 - RNA, 19 nt, Human
ccugcccuuaccugccagg

SEQ ID NO: 3114534 - RNA, 15 nt, Human
ccugcccugugggcc

SEQ ID NO: 3114535 - RNA, 17 nt, Human
ccugcuaauuccccaga

SEQ ID NO: 3114536 - RNA, 21 nt, Human
ccugcuaauuccccagauugc

SEQ ID NO: 3114537 - RNA, 20 nt, Human
ccugccuguugggccaggag

SEQ ID NO: 3114538 - RNA, 19 nt, Human
ccugccuguugggccagga

SEQ ID NO: 3114539 - RNA, 18 nt, Human
ccugccuguugggccagg

SEQ ID NO: 3114540 - RNA, 19 nt, Human
ccuggcacccggccccugc

SEQ ID NO: 3114541 - RNA, 20 nt, Human
ccuggcacccggccccugcu

SEQ ID NO: 3114542 - RNA, 18 nt, Human
ccuggcacccggccccug

SEQ ID NO: 3114543 - RNA, 22 nt, Human
ccuggcacuauaauguaagcuc

SEQ ID NO: 3114544 - RNA, 12 nt, Human
ccuggcacugcu

SEQ ID NO: 3114545 - RNA, 14 nt, Human
ccuggcccacugca

SEQ ID NO: 3114546 - RNA, 13 nt, Human
ccuggcccacugc

SEQ ID NO: 3114547 - RNA, 21 nt, Human
ccuggccagaugcaccagccc

SEQ ID NO: 3114548 - RNA, 23 nt, Human
ccuggccagaugcaccagcccuu

SEQ ID NO: 3114549 - RNA, 20 nt, Human
ccuggccagaugcaccagcc

SEQ ID NO: 3114550 - RNA, 23 nt, Human
ccuggcaugggaaugaaugucag

SEQ ID NO: 3114551 - RNA, 13 nt, Human
ccuggcaugggaa

SEQ ID NO: 3114552 - RNA, 16 nt, Human
ccuggcacugcuucca

SEQ ID NO: 3114553 - RNA, 13 nt, Human
ccuggcacugcuu

SEQ ID NO: 3114554 - RNA, 16 nt, Human
ccuggcccacugcauc

SEQ ID NO: 3114555 - RNA, 16 nt, Human
ccugggagugagcugg

SEQ ID NO: 3114556 - RNA, 22 nt, Human
ccugggaggucaaggcugcagu

SEQ ID NO: 3114557 - RNA, 16 nt, Human
ccugggcagaaggaag

SEQ ID NO: 3114558 - RNA, 18 nt, Human
ccugggagugagcugguu

SEQ ID NO: 3114559 - RNA, 15 nt, Human
ccugggcagaaggaa

SEQ ID NO: 3114560 - RNA, 18 nt, Human
ccugggggcugggcagag

SEQ ID NO: 3114561 - RNA, 19 nt, Human
ccugggggcugggcagagg

SEQ ID NO: 3114562 - RNA, 21 nt, Human
ccugggggcugggcagaggaa

SEQ ID NO: 3114563 - RNA, 20 nt, Human
ccugggggcugggcagagga

SEQ ID NO: 3114564 - RNA, 10 nt, Human
ccuguaccuc

SEQ ID NO: 3114565 - RNA, 13 nt, Human
ccugguggcagug

SEQ ID NO: 3114566 - RNA, 14 nt, Human
ccugguggcagugg

SEQ ID NO: 3114567 - RNA, 16 nt, Human
ccuguagagugggagc

SEQ ID NO: 3114568 - RNA, 15 nt, Human
ccuguagagugggag

SEQ ID NO: 3114569 - RNA, 13 nt, Human
ccuguagcccuaa

SEQ ID NO: 3114570 - RNA, 12 nt, Human
ccugucccccug

SEQ ID NO: 3114571 - RNA, 15 nt, Human
ccugucccccugaca

SEQ ID NO: 3114572 - RNA, 14 nt, Human
ccugucccccugac

SEQ ID NO: 3114573 - RNA, 13 nt, Human
ccugucccccuga

SEQ ID NO: 3114574 - RNA, 14 nt, Human
ccugguggcagcug

SEQ ID NO: 3114575 - RNA, 22 nt, Human
ccugguggcagcucaccucucc

SEQ ID NO: 3114576 - RNA, 21 nt, Human
ccugguggcagcucaccucuc

SEQ ID NO: 3114577 - RNA, 19 nt, Human
ccugguggcagcucaccuc

SEQ ID NO: 3114578 - RNA, 15 nt, Human
ccugguggcagcugc

SEQ ID NO: 3114579 - RNA, 16 nt, Human
ccugguggcagcugcg

SEQ ID NO: 3114580 - RNA, 17 nt, Human
ccugguggcagcugcgg

SEQ ID NO: 3114581 - RNA, 18 nt, Human
ccugguggcagcugcggu

SEQ ID NO: 3114582 - RNA, 16 nt, Human
cgaggacagggaggug

SEQ ID NO: 3114583 - RNA, 18 nt, Human
cgagcccugguggcagug

SEQ ID NO: 3114584 - RNA, 14 nt, Human
cgaggacagggagg

SEQ ID NO: 3114585 - RNA, 19 nt, Human
cgagcccugguggcagugg

SEQ ID NO: 3114586 - RNA, 17 nt, Human
cgcacugggcuugggga

SEQ ID NO: 3114587 - RNA, 17 nt, Human
cgcagcccugcagaggg

SEQ ID NO: 3114588 - RNA, 15 nt, Human
cgcagcccugcagag

SEQ ID NO: 3114589 - RNA, 20 nt, Human
cgcagcauauucaggaagcu

SEQ ID NO: 3114590 - RNA, 19 nt, Human
cgcagcauauucaggaagc

SEQ ID NO: 3114591 - RNA, 13 nt, Human
cgcacugggcuug

SEQ ID NO: 3114592 - RNA, 12 nt, Human
cggccaggccag

SEQ ID NO: 3114593 - RNA, 20 nt, Human
cggccaggccagagggagug

SEQ ID NO: 3114594 - RNA, 11 nt, Human
cggccaggcca

SEQ ID NO: 3114595 - RNA, 14 nt, Human
cggcuggcagccca

SEQ ID NO: 3114596 - RNA, 13 nt, Human
cggcuggccuggc

SEQ ID NO: 3114597 - RNA, 23 nt, Human
cggcuggcagcccaccccucaac

SEQ ID NO: 3114598 - RNA, 16 nt, Human
cgggaagggggcuggg

SEQ ID NO: 3114599 - RNA, 20 nt, Human
cgggaagggggcugggacau

SEQ ID NO: 3114600 - RNA, 19 nt, Human
cgggaagggggcugggaca

SEQ ID NO: 3114601 - RNA, 18 nt, Human
cgcugugcugcccugccc

SEQ ID NO: 3114602 - RNA, 19 nt, Human
cgcugugcugcccugccca

SEQ ID NO: 3114603 - RNA, 23 nt, Human
cgcugugcugcccugcccaccug

SEQ ID NO: 3114604 - RNA, 21 nt, Human
cgcugugcugcccugcccacc

SEQ ID NO: 3114605 - RNA, 11 nt, Human
cgcugugcugc

SEQ ID NO: 3114606 - RNA, 14 nt, Human
cgcugugcugcccu

SEQ ID NO: 3114607 - RNA, 13 nt, Human
cgcugugcugccc

SEQ ID NO: 3114608 - RNA, 15 nt, Human
cggagaaaggaaggg

SEQ ID NO: 3114609 - RNA, 21 nt, Human
cggacagccacggccaggcca

SEQ ID NO: 3114610 - RNA, 22 nt, Human
cggacagccacggccaggccag

SEQ ID NO: 3114611 - RNA, 14 nt, Human
cgcuuucuacccag

SEQ ID NO: 3114612 - RNA, 16 nt, Human
cgcuuucuacccagcg

SEQ ID NO: 3114613 - RNA, 16 nt, Human
cggaauaguuggcuag

SEQ ID NO: 3114614 - RNA, 17 nt, Human
cggaauaguuggcuagg

SEQ ID NO: 3114615 - RNA, 14 nt, Human
cggaauaguuggcu

SEQ ID NO: 3114616 - RNA, 20 nt, Human
cggacagccacggccaggcc

SEQ ID NO: 3114617 - RNA, 19 nt, Human
cgcagcccugcagagggca

SEQ ID NO: 3114618 - RNA, 18 nt, Human
cgcagcccugcagagggc

SEQ ID NO: 3114619 - RNA, 13 nt, Human
cgcccagucugga

SEQ ID NO: 3114620 - RNA, 19 nt, Human
cgcccagucuggaaugcag

SEQ ID NO: 3114621 - RNA, 21 nt, Human
cgcccagucuggaaugcagug

SEQ ID NO: 3114622 - RNA, 12 nt, Human
cgcccagucugg

SEQ ID NO: 3114623 - RNA, 24 nt, Human
cgcuacccgggaagggggcuggga

SEQ ID NO: 3114624 - RNA, 21 nt, Human
cgcuacccgggaagggggcug

SEQ ID NO: 3114625 - RNA, 18 nt, Human
cgcuacccgggaaggggg

SEQ ID NO: 3114626 - RNA, 17 nt, Human
cgcuacccgggaagggg

SEQ ID NO: 3114627 - RNA, 14 nt, Human
cgcgacaaugcaaa

SEQ ID NO: 3114628 - RNA, 19 nt, Human
cgcgguggcucacgccugu

SEQ ID NO: 3114629 - RNA, 17 nt, Human
cgaauauugcugauggu

SEQ ID NO: 3114630 - RNA, 15 nt, Human
cgaauauugcugaug

SEQ ID NO: 3114631 - RNA, 15 nt, Human
cgaauagcugggacu

SEQ ID NO: 3114632 - RNA, 16 nt, Human
cgaauagcugggacua

SEQ ID NO: 3114633 - RNA, 11 nt, Human
cgaauauugcu

SEQ ID NO: 3114634 - RNA, 14 nt, Human
cgaauauugcugau

SEQ ID NO: 3114635 - RNA, 12 nt, Human
cgaauauugcug

SEQ ID NO: 3114636 - RNA, 23 nt, Human
cgaaagggacuuggaagcuccgc

SEQ ID NO: 3114637 - RNA, 22 nt, Human
ccuuuuuuggcugcugaaggcu

SEQ ID NO: 3114638 - RNA, 20 nt, Human
ccuuuuuuggcugcugaagg

SEQ ID NO: 3114639 - RNA, 18 nt, Human
ccuuuuuuggcugcugaa

SEQ ID NO: 3114640 - RNA, 17 nt, Human
ccuuuuuuggcugcuga

SEQ ID NO: 3114641 - RNA, 21 nt, Human
cgaacauguuuuucuucuccc

SEQ ID NO: 3114642 - RNA, 23 nt, Human
cgaacauguuuuucuucucccuc

SEQ ID NO: 3114643 - RNA, 14 nt, Human
ccuuugugaggaag

SEQ ID NO: 3114644 - RNA, 23 nt, Human
ccuuuguccccaccgcagacagg

SEQ ID NO: 3114645 - RNA, 22 nt, Human
ccuuuguccccaccgcagacag

SEQ ID NO: 3114646 - RNA, 23 nt, Human
ccuuugugaggaagccgcugggg

SEQ ID NO: 3114647 - RNA, 17 nt, Human
ccuuugugaggaagccg

SEQ ID NO: 3114648 - RNA, 16 nt, Human
ccuuugugaggaagcc

SEQ ID NO: 3114649 - RNA, 15 nt, Human
ccuuugugaggaagc

SEQ ID NO: 3114650 - RNA, 19 nt, Human
ccuuuuuuauacauaaaca

SEQ ID NO: 3114651 - RNA, 15 nt, Human
ccuuuuuuggcugcu

SEQ ID NO: 3114652 - RNA, 24 nt, Human
ccuuuguauucucuccuguaccuc

SEQ ID NO: 3114653 - RNA, 22 nt, Human
ccuuuguauucucuccuguacc

SEQ ID NO: 3114654 - RNA, 23 nt, Human
ccuuuguauucucuccuguaccu

SEQ ID NO: 3114655 - RNA, 18 nt, Human
ccuuuguccccaccgcag

SEQ ID NO: 3114656 - RNA, 16 nt, Human
ccuuuguccccaccgc

SEQ ID NO: 3114657 - RNA, 14 nt, Human
ccuuuguccccacc

SEQ ID NO: 3114658 - RNA, 20 nt, Human
ccuuggugucgggcaugaca

SEQ ID NO: 3114659 - RNA, 19 nt, Human
ccuuggugucgggcaugac

SEQ ID NO: 3114660 - RNA, 14 nt, Human
ccuuggcugcaggg

SEQ ID NO: 3114661 - RNA, 16 nt, Human
ccuuggcugcagggag

SEQ ID NO: 3114662 - RNA, 14 nt, Human
ccuuggggagcagg

SEQ ID NO: 3114663 - RNA, 18 nt, Human
ccuugacagggcacaccg

SEQ ID NO: 3114664 - RNA, 21 nt, Human
ccuugacagggcacaccgggc

SEQ ID NO: 3114665 - RNA, 18 nt, Human
ccuucucuccagccccug

SEQ ID NO: 3114666 - RNA, 17 nt, Human
ccuucucuccagccccu

SEQ ID NO: 3114667 - RNA, 22 nt, Human
ccuuggcucaaguccucuuuuc

SEQ ID NO: 3114668 - RNA, 15 nt, Human
ccuuggauugucccc

SEQ ID NO: 3114669 - RNA, 19 nt, Human
ccuucucuccagccccugg

SEQ ID NO: 3114670 - RNA, 16 nt, Human
ccuucucuccagcccc

SEQ ID NO: 3114671 - RNA, 15 nt, Human
ccuucucuccagccc

SEQ ID NO: 3114672 - RNA, 13 nt, Human
ccuucucuccagc

SEQ ID NO: 3114673 - RNA, 12 nt, Human
ccuucucuccag

SEQ ID NO: 3114674 - RNA, 13 nt, Human
ccuuccaggggug

SEQ ID NO: 3114675 - RNA, 22 nt, Human
ccuuccaggggugggacacccu

SEQ ID NO: 3114676 - RNA, 17 nt, Human
ccuuccauggacuuugu

SEQ ID NO: 3114677 - RNA, 20 nt, Human
ccugugggcccccaaaugga

SEQ ID NO: 3114678 - RNA, 20 nt, Human
ccuguggaugauaaaacaca

SEQ ID NO: 3114679 - RNA, 20 nt, Human
ccugugccucugggacugga

SEQ ID NO: 3114680 - RNA, 14 nt, Human
cuccagcucaccag

SEQ ID NO: 3114681 - RNA, 15 nt, Human
cuccagcucaccagc

SEQ ID NO: 3114682 - RNA, 16 nt, Human
cuccagcucaccagcc

SEQ ID NO: 3114683 - RNA, 18 nt, Human
cuccagcucaccagcccc

SEQ ID NO: 3114684 - RNA, 11 nt, Human
cuccagccccu

SEQ ID NO: 3114685 - RNA, 14 nt, Human
cuccagccccugga

SEQ ID NO: 3114686 - RNA, 13 nt, Human
cuccagccccugg

SEQ ID NO: 3114687 - RNA, 16 nt, Human
cuccagagucagaagu

SEQ ID NO: 3114688 - RNA, 18 nt, Human
cuccaaaauaaaacuuuu

SEQ ID NO: 3114689 - RNA, 17 nt, Human
cuccaagcucccaggca

SEQ ID NO: 3114690 - RNA, 21 nt, Human
cucauuugucacacacuuugg

SEQ ID NO: 3114691 - RNA, 18 nt, Human
cucauuugucacacacuu

SEQ ID NO: 3114692 - RNA, 21 nt, Human
cucauugaccugaggcccuuc

SEQ ID NO: 3114693 - RNA, 19 nt, Human
cucauugaccugaggcccu

SEQ ID NO: 3114694 - RNA, 18 nt, Human
cucauucuccuuguguua

SEQ ID NO: 3114695 - RNA, 22 nt, Human
cucauucuccuuguguuacuaa

SEQ ID NO: 3114696 - RNA, 17 nt, Human
cucauugaccugaggcc

SEQ ID NO: 3114697 - RNA, 14 nt, Human
cucccaucacccgc

SEQ ID NO: 3114698 - RNA, 16 nt, Human
cucccaucacuucccu

SEQ ID NO: 3114699 - RNA, 15 nt, Human
cucccacaaaggaga

SEQ ID NO: 3114700 - RNA, 15 nt, Human
cucccaacucacccc

SEQ ID NO: 3114701 - RNA, 14 nt, Human
cucccaacucaccc

SEQ ID NO: 3114702 - RNA, 16 nt, Human
cucccaaagugcuggg

SEQ ID NO: 3114703 - RNA, 23 nt, Human
cucccaaagugcugggauuacag

SEQ ID NO: 3114704 - RNA, 20 nt, Human
cucccgaauagcugggacua

SEQ ID NO: 3114705 - RNA, 23 nt, Human
cucccgaauagcugggacuacag

SEQ ID NO: 3114706 - RNA, 19 nt, Human
cucccgaauagcugggacu

SEQ ID NO: 3114707 - RNA, 15 nt, Human
cucccuucauccuuc

SEQ ID NO: 3114708 - RNA, 23 nt, Human
cuccccugcuggguguggcgcag

SEQ ID NO: 3114709 - RNA, 21 nt, Human
cuccccugcuggguguggcgc

SEQ ID NO: 3114710 - RNA, 14 nt, Human
cuccccugcugggu

SEQ ID NO: 3114711 - RNA, 18 nt, Human
cucagagagggugggagu

SEQ ID NO: 3114712 - RNA, 19 nt, Human
cucagagagggugggagug

SEQ ID NO: 3114713 - RNA, 23 nt, Human
cucagagagggugggagugggcc

SEQ ID NO: 3114714 - RNA, 16 nt, Human
cucacuguugcccagg

SEQ ID NO: 3114715 - RNA, 17 nt, Human
cucacuguugcccaggc

SEQ ID NO: 3114716 - RNA, 18 nt, Human
cucacuguugcccaggcu

SEQ ID NO: 3114717 - RNA, 19 nt, Human
cucacuguugcccaggcug

SEQ ID NO: 3114718 - RNA, 16 nt, Human
cucagaucuucugugg

SEQ ID NO: 3114719 - RNA, 14 nt, Human
cucacuguugccca

SEQ ID NO: 3114720 - RNA, 15 nt, Human
cucacuguugcccag

SEQ ID NO: 3114721 - RNA, 15 nt, Human
cucacugcagccuca

SEQ ID NO: 3114722 - RNA, 16 nt, Human
cucacugcagccucaa

SEQ ID NO: 3114723 - RNA, 14 nt, Human
cucacugcagccuc

SEQ ID NO: 3114724 - RNA, 13 nt, Human
cucagcggggaca

SEQ ID NO: 3114725 - RNA, 23 nt, Human
cucagcggggacagcuccuucug

SEQ ID NO: 3114726 - RNA, 14 nt, Human
cucagcggggacag

SEQ ID NO: 3114727 - RNA, 15 nt, Human
cucagcggggacagc

SEQ ID NO: 3114728 - RNA, 16 nt, Human
cucagcggggacagcu

SEQ ID NO: 3114729 - RNA, 18 nt, Human
cucagcggggacagcucc

SEQ ID NO: 3114730 - RNA, 19 nt, Human
cucagcggggacagcuccu

SEQ ID NO: 3114731 - RNA, 20 nt, Human
cucagcggggacagcuccuu

SEQ ID NO: 3114732 - RNA, 21 nt, Human
cucagcggggacagcuccuuc

SEQ ID NO: 3114733 - RNA, 13 nt, Human
cucagcauccugg

SEQ ID NO: 3114734 - RNA, 21 nt, Human
cucagcauccuggcacccggc

SEQ ID NO: 3114735 - RNA, 22 nt, Human
cucagcauccuggcacccggcc

SEQ ID NO: 3114736 - RNA, 16 nt, Human
cucagcaggggagggu

SEQ ID NO: 3114737 - RNA, 20 nt, Human
cucagcaaaagaugcuucuc

SEQ ID NO: 3114738 - RNA, 19 nt, Human
cucagcaaaagaugcuucu

SEQ ID NO: 3114739 - RNA, 18 nt, Human
cucagggucccugguggc

SEQ ID NO: 3114740 - RNA, 24 nt, Human
cucagggucccugguggcagcuca

SEQ ID NO: 3114741 - RNA, 22 nt, Human
cucagggucccugguggcagcu

SEQ ID NO: 3114742 - RNA, 21 nt, Human
cucagggucccugguggcagc

SEQ ID NO: 3114743 - RNA, 20 nt, Human
cucagggucccugguggcag

SEQ ID NO: 3114744 - RNA, 21 nt, Human
cucagguggggucacucuggc

SEQ ID NO: 3114745 - RNA, 20 nt, Human
cucagguggggucacucugg

SEQ ID NO: 3114746 - RNA, 19 nt, Human
cucagguggggucacucug

SEQ ID NO: 3114747 - RNA, 22 nt, Human
cucaggugauccacccaccuca

SEQ ID NO: 3114748 - RNA, 23 nt, Human
cucaggugauccacccaccucag

SEQ ID NO: 3114749 - RNA, 18 nt, Human
cucagggccuggcucagg

SEQ ID NO: 3114750 - RNA, 20 nt, Human
cucagggccuggcucaggug

SEQ ID NO: 3114751 - RNA, 19 nt, Human
cucagggccuggcucaggu

SEQ ID NO: 3114752 - RNA, 15 nt, Human
cucaggcagguggga

SEQ ID NO: 3114753 - RNA, 18 nt, Human
cucaggcaggugggaugg

SEQ ID NO: 3114754 - RNA, 20 nt, Human
cuacuguccuacccacccuc

SEQ ID NO: 3114755 - RNA, 17 nt, Human
cuagagguucaaagaua

SEQ ID NO: 3114756 - RNA, 18 nt, Human
cuagagguucaaagauau

SEQ ID NO: 3114757 - RNA, 21 nt, Human
cuagagguucaaagauauuuu

SEQ ID NO: 3114758 - RNA, 15 nt, Human
cuagagguucaaaga

SEQ ID NO: 3114759 - RNA, 15 nt, Human
cuacucgaguuacag

SEQ ID NO: 3114760 - RNA, 19 nt, Human
cuacucgaguuacagacaa

SEQ ID NO: 3114761 - RNA, 16 nt, Human
cuacucgaguuacaga

SEQ ID NO: 3114762 - RNA, 12 nt, Human
cuacucuguguc

SEQ ID NO: 3114763 - RNA, 19 nt, Human
cuacuguccuacccacccu

SEQ ID NO: 3114764 - RNA, 21 nt, Human
cuacuguaauuugugauacaa

SEQ ID NO: 3114765 - RNA, 24 nt, Human
cuagauacuguaucaugacaaaga

SEQ ID NO: 3114766 - RNA, 13 nt, Human
cuagauacuguau

SEQ ID NO: 3114767 - RNA, 16 nt, Human
cuagauacuguaucau

SEQ ID NO: 3114768 - RNA, 21 nt, Human
cuagccuuagaagucacacag

SEQ ID NO: 3114769 - RNA, 22 nt, Human
cuagccugugccucugggacug

SEQ ID NO: 3114770 - RNA, 21 nt, Human
cuagccugugccucugggacu

SEQ ID NO: 3114771 - RNA, 19 nt, Human
cuagccugugccucuggga

SEQ ID NO: 3114772 - RNA, 22 nt, Human
cuagccuuagaagucacacagu

SEQ ID NO: 3114773 - RNA, 23 nt, Human
cuagccuuagaagucacacagua

SEQ ID NO: 3114774 - RNA, 19 nt, Human
cuauagccuaggugacaga

SEQ ID NO: 3114775 - RNA, 18 nt, Human
cuauagccuaggugacag

SEQ ID NO: 3114776 - RNA, 20 nt, Human
cuauagccuaggugacagag

SEQ ID NO: 3114777 - RNA, 21 nt, Human
cuauagccuaggugacagagu

SEQ ID NO: 3114778 - RNA, 17 nt, Human
cuaggaagacuuuggaa

SEQ ID NO: 3114779 - RNA, 15 nt, Human
cuaggaagacuuugg

SEQ ID NO: 3114780 - RNA, 20 nt, Human
cuaggaacacuccuucacag

SEQ ID NO: 3114781 - RNA, 21 nt, Human
cuaugcauuugaaaauuuuga

SEQ ID NO: 3114782 - RNA, 23 nt, Human
cuauucaguaauaacucuacccu

SEQ ID NO: 3114783 - RNA, 13 nt, Human
cuauguaucaaug

SEQ ID NO: 3114784 - RNA, 17 nt, Human
cuauucaguaauaacuc

SEQ ID NO: 3114785 - RNA, 16 nt, Human
cuauugcugcuugagg

SEQ ID NO: 3114786 - RNA, 18 nt, Human
cuauuguuagucucuuga

SEQ ID NO: 3114787 - RNA, 18 nt, Human
cucaacucuccuccagag

SEQ ID NO: 3114788 - RNA, 16 nt, Human
cucaacucuccuccag

SEQ ID NO: 3114789 - RNA, 23 nt, Human
cucacacggacacucaaaagcug

SEQ ID NO: 3114790 - RNA, 14 nt, Human
cucaaauuucuaaa

SEQ ID NO: 3114791 - RNA, 14 nt, Human
cucaacucuccucc

SEQ ID NO: 3114792 - RNA, 15 nt, Human
cucaaauuucuaaau

SEQ ID NO: 3114793 - RNA, 17 nt, Human
cucaaauuucuaaaucu

SEQ ID NO: 3114794 - RNA, 13 nt, Human
cucaaauuucuaa

SEQ ID NO: 3114795 - RNA, 16 nt, Human
cuacaggugugaguca

SEQ ID NO: 3114796 - RNA, 14 nt, Human
cuacaggugugagu

SEQ ID NO: 3114797 - RNA, 13 nt, Human
cuacaguccuccc

SEQ ID NO: 3114798 - RNA, 18 nt, Human
cuacauggaguauauguc

SEQ ID NO: 3114799 - RNA, 20 nt, Human
cuacauggaguauaugucaa

SEQ ID NO: 3114800 - RNA, 15 nt, Human
cuacaggcacccacc

SEQ ID NO: 3114801 - RNA, 17 nt, Human
cuacaggcacccaccau

SEQ ID NO: 3114802 - RNA, 14 nt, Human
cuacaggagugagc

SEQ ID NO: 3114803 - RNA, 15 nt, Human
cuacaggagugagca

SEQ ID NO: 3114804 - RNA, 16 nt, Human
cuacaggagugagcac

SEQ ID NO: 3114805 - RNA, 23 nt, Human
cuacagcuugaccgugaggccag

SEQ ID NO: 3114806 - RNA, 22 nt, Human
cuacagcuugaccgugaggcca

SEQ ID NO: 3114807 - RNA, 19 nt, Human
cuacagcuugaccgugagg

SEQ ID NO: 3114808 - RNA, 22 nt, Human
cuacagaggccaugggccuccu

SEQ ID NO: 3114809 - RNA, 18 nt, Human
cuacagaggccaugggcc

SEQ ID NO: 3114810 - RNA, 20 nt, Human
cuacagaggccaugggccuc

SEQ ID NO: 3114811 - RNA, 17 nt, Human
cuacagaggccaugggc

SEQ ID NO: 3114812 - RNA, 17 nt, Human
cuacacugugcugaguc

SEQ ID NO: 3114813 - RNA, 14 nt, Human
cuacacugugcuga

SEQ ID NO: 3114814 - RNA, 13 nt, Human
cuacacugugcug

SEQ ID NO: 3114815 - RNA, 17 nt, Human
cuacccucuuagaaaaa

SEQ ID NO: 3114816 - RNA, 18 nt, Human
cuacccagcgagcccugg

SEQ ID NO: 3114817 - RNA, 13 nt, Human
cuacccaggugcu

SEQ ID NO: 3114818 - RNA, 12 nt, Human
cuacccaggugc

SEQ ID NO: 3114819 - RNA, 15 nt, Human
cuacccagcgagccc

SEQ ID NO: 3114820 - RNA, 17 nt, Human
cuacccagcgagcccug

SEQ ID NO: 3114821 - RNA, 18 nt, Human
cuaccauccccuguagag

SEQ ID NO: 3114822 - RNA, 13 nt, Human
cuacauucuguua

SEQ ID NO: 3114823 - RNA, 14 nt, Human
cuacauucuguuaa

SEQ ID NO: 3114824 - RNA, 22 nt, Human
cuacauuauaaaugucucuuua

SEQ ID NO: 3114825 - RNA, 12 nt, Human
cuaaugggacac

SEQ ID NO: 3114826 - RNA, 13 nt, Human
cuaaugggacacu

SEQ ID NO: 3114827 - RNA, 21 nt, Human
cuacacacugcauguuuguga

SEQ ID NO: 3114828 - RNA, 21 nt, Human
cuacacaggggaaaagaggag

SEQ ID NO: 3114829 - RNA, 17 nt, Human
cuaauagacaauuuauu

SEQ ID NO: 3114830 - RNA, 19 nt, Human
cuaauagacaauuuauuau

SEQ ID NO: 3114831 - RNA, 23 nt, Human
cuaauagacaauuuauuauggca

SEQ ID NO: 3114832 - RNA, 22 nt, Human
cuaagcuauucaguaauaacuc

SEQ ID NO: 3114833 - RNA, 22 nt, Human
cuaaaugaaaaucgugacaaca

SEQ ID NO: 3114834 - RNA, 21 nt, Human
cuaaaucuccaaaauaaaacu

SEQ ID NO: 3114835 - RNA, 20 nt, Human
cuaaaucuccaaaauaaaac

SEQ ID NO: 3114836 - RNA, 23 nt, Human
cgggaggauguucugggacacag

SEQ ID NO: 3114837 - RNA, 21 nt, Human
cgggaggauguucugggacac

SEQ ID NO: 3114838 - RNA, 13 nt, Human
cuaagagggaggg

SEQ ID NO: 3114839 - RNA, 22 nt, Human
cuaagagggagggagggcucca

SEQ ID NO: 3114840 - RNA, 15 nt, Human
cuaagagggagggag

SEQ ID NO: 3114841 - RNA, 23 nt, Human
cuaagagggagggagggcuccag

SEQ ID NO: 3114842 - RNA, 12 nt, Human
cuaaccacgcug

SEQ ID NO: 3114843 - RNA, 14 nt, Human
cuaaccacgcugga

SEQ ID NO: 3114844 - RNA, 16 nt, Human
cuaaauucaugcugcu

SEQ ID NO: 3114845 - RNA, 14 nt, Human
aaaaacacaaaagu

SEQ ID NO: 3114846 - RNA, 15 nt, Human
aaaaacugauuuuuu

SEQ ID NO: 3114847 - RNA, 13 nt, Human
aaaaacugauuuu

SEQ ID NO: 3114848 - RNA, 12 nt, Human
aaaaagaggcua

SEQ ID NO: 3114849 - RNA, 12 nt, Human
aaaacacauuuu

SEQ ID NO: 3114850 - RNA, 22 nt, Human
aucucucgugauugauaagaac

SEQ ID NO: 3114851 - RNA, 19 nt, Human
aucuuccaacucaaacucu

SEQ ID NO: 3114852 - RNA, 17 nt, Human
aucuucuuuauaauucu

SEQ ID NO: 3114853 - RNA, 17 nt, Human
aucuugaagacuuuucu

SEQ ID NO: 3114854 - RNA, 14 nt, Human
augagccuggcaag

SEQ ID NO: 3114855 - RNA, 13 nt, Human
augagccuggcaa

SEQ ID NO: 3114856 - RNA, 12 nt, Human
augacccagugg

SEQ ID NO: 3114857 - RNA, 12 nt, Human
augagccuggca

SEQ ID NO: 3114858 - RNA, 17 nt, Human
augacuccagaauuucc

SEQ ID NO: 3114859 - RNA, 16 nt, Human
augacuccagaauuuc

SEQ ID NO: 3114860 - RNA, 12 nt, Human
augacuccagaa

SEQ ID NO: 3114861 - RNA, 12 nt, Human
aucagcugcuac

SEQ ID NO: 3114862 - RNA, 21 nt, Human
aucagccugggcaaugugaua

SEQ ID NO: 3114863 - RNA, 20 nt, Human
aucagccugggcaaugugau

SEQ ID NO: 3114864 - RNA, 11 nt, Human
aucagccuggg

SEQ ID NO: 3114865 - RNA, 19 nt, Human
aucauggagguuugaagau

SEQ ID NO: 3114866 - RNA, 20 nt, Human
aucagccugcuccagcuguu

SEQ ID NO: 3114867 - RNA, 13 nt, Human
aucagcugcuacu

SEQ ID NO: 3114868 - RNA, 23 nt, Human
aucagcugcuacuacuccuguag

SEQ ID NO: 3114869 - RNA, 15 nt, Human
aucccuacuguaauu

SEQ ID NO: 3114870 - RNA, 22 nt, Human
auccucauacccacccccaccc

SEQ ID NO: 3114871 - RNA, 19 nt, Human
auccucauacccaccccca

SEQ ID NO: 3114872 - RNA, 18 nt, Human
auccucauacccaccccc

SEQ ID NO: 3114873 - RNA, 18 nt, Human
auccacccaccucagccu

SEQ ID NO: 3114874 - RNA, 20 nt, Human
auccacccaccucagccucc

SEQ ID NO: 3114875 - RNA, 16 nt, Human
auccacccaccucagc

SEQ ID NO: 3114876 - RNA, 11 nt, Human
auccuccucag

SEQ ID NO: 3114877 - RNA, 22 nt, Human
auccuccaggugcacaagcucc

SEQ ID NO: 3114878 - RNA, 19 nt, Human
auccuccaggugcacaagc

SEQ ID NO: 3114879 - RNA, 14 nt, Human
auccuccaggugca

SEQ ID NO: 3114880 - RNA, 13 nt, Human
auccuccaggugc

SEQ ID NO: 3114881 - RNA, 13 nt, Human
aucgaugcagugc

SEQ ID NO: 3114882 - RNA, 15 nt, Human
augucacaggcaggu

SEQ ID NO: 3114883 - RNA, 14 nt, Human
augucacaggcagg

SEQ ID NO: 3114884 - RNA, 16 nt, Human
augucacaggcagguc

SEQ ID NO: 3114885 - RNA, 17 nt, Human
auguaagcucuacugag

SEQ ID NO: 3114886 - RNA, 15 nt, Human
auggucggaaaacau

SEQ ID NO: 3114887 - RNA, 20 nt, Human
augugggcuaguugggcuuc

SEQ ID NO: 3114888 - RNA, 14 nt, Human
auguguaaguauuc

SEQ ID NO: 3114889 - RNA, 11 nt, Human
auuaaauuaug

SEQ ID NO: 3114890 - RNA, 16 nt, Human
auuaaaugcccagccc

SEQ ID NO: 3114891 - RNA, 13 nt, Human
auuaaauucuugc

SEQ ID NO: 3114892 - RNA, 15 nt, Human
auuaaaugcccagcc

SEQ ID NO: 3114893 - RNA, 14 nt, Human
auuaaaugcccagc

SEQ ID NO: 3114894 - RNA, 16 nt, Human
auguuuuaagaggcag

SEQ ID NO: 3114895 - RNA, 18 nt, Human
auguuuuaagaggcaggg

SEQ ID NO: 3114896 - RNA, 18 nt, Human
auguucucugaggacacu

SEQ ID NO: 3114897 - RNA, 17 nt, Human
auguucucugaggacac

SEQ ID NO: 3114898 - RNA, 15 nt, Human
auguucuuaauucuu

SEQ ID NO: 3114899 - RNA, 20 nt, Human
auguucuuaguggauguucu

SEQ ID NO: 3114900 - RNA, 22 nt, Human
auguucugacccugcuucaaau

SEQ ID NO: 3114901 - RNA, 14 nt, Human
auguucuuaauucu

SEQ ID NO: 3114902 - RNA, 20 nt, Human
auggaaaugggcagagcaga

SEQ ID NO: 3114903 - RNA, 19 nt, Human
auggaaaugggcagagcag

SEQ ID NO: 3114904 - RNA, 22 nt, Human
augcuucuucagagacuccugc

SEQ ID NO: 3114905 - RNA, 15 nt, Human
augggaaugaauguc

SEQ ID NO: 3114906 - RNA, 23 nt, Human
auggcugccaaugggagcucaug

SEQ ID NO: 3114907 - RNA, 21 nt, Human
augcacagcuaacauggaagu

SEQ ID NO: 3114908 - RNA, 14 nt, Human
augcacagcuaaca

SEQ ID NO: 3114909 - RNA, 23 nt, Human
augcacagaguuguuacauuuuu

SEQ ID NO: 3114910 - RNA, 17 nt, Human
augcacacauuuuuuaa

SEQ ID NO: 3114911 - RNA, 19 nt, Human
augcacacauuuuuuaaau

SEQ ID NO: 3114912 - RNA, 22 nt, Human
augcacacauuuuuuaaaugca

SEQ ID NO: 3114913 - RNA, 20 nt, Human
augcaugaaguaauaugcac

SEQ ID NO: 3114914 - RNA, 23 nt, Human
augcaugaaguaauaugcacaca

SEQ ID NO: 3114915 - RNA, 18 nt, Human
augcauuugaaaauuuug

SEQ ID NO: 3114916 - RNA, 10 nt, Human
augcauuuga

SEQ ID NO: 3114917 - RNA, 12 nt, Human
augcauuugaaa

SEQ ID NO: 3114918 - RNA, 15 nt, Human
augccugguggcagc

SEQ ID NO: 3114919 - RNA, 16 nt, Human
augccugguggcagcu

SEQ ID NO: 3114920 - RNA, 17 nt, Human
augccugguggcagcug

SEQ ID NO: 3114921 - RNA, 17 nt, Human
augccugggcagaagga

SEQ ID NO: 3114922 - RNA, 14 nt, Human
augccugguggcag

SEQ ID NO: 3114923 - RNA, 23 nt, Human
augccuggauggggcugcaccgg

SEQ ID NO: 3114924 - RNA, 21 nt, Human
augccuggauggggcugcacc

SEQ ID NO: 3114925 - RNA, 13 nt, Human
agugauccuccca

SEQ ID NO: 3114926 - RNA, 20 nt, Human
agucaagugaaaaaggagga

SEQ ID NO: 3114927 - RNA, 16 nt, Human
agucaagugaaaaagg

SEQ ID NO: 3114928 - RNA, 13 nt, Human
aguuguuacauuu

SEQ ID NO: 3114929 - RNA, 15 nt, Human
aguuguuacauuuuu

SEQ ID NO: 3114930 - RNA, 16 nt, Human
aguuguuacauuuuua

SEQ ID NO: 3114931 - RNA, 18 nt, Human
aguuacagacaaagcgug

SEQ ID NO: 3114932 - RNA, 17 nt, Human
aguuacagacaaagcgu

SEQ ID NO: 3114933 - RNA, 23 nt, Human
agugugacaaggauugcuacugu

SEQ ID NO: 3114934 - RNA, 12 nt, Human
auaccugucccc

SEQ ID NO: 3114935 - RNA, 19 nt, Human
auaaugugaaacuggauua

SEQ ID NO: 3114936 - RNA, 21 nt, Human
auaaugugaaacuggauuaaa

SEQ ID NO: 3114937 - RNA, 18 nt, Human
auaaugugaaacuggauu

SEQ ID NO: 3114938 - RNA, 13 nt, Human
auauucaggaagc

SEQ ID NO: 3114939 - RNA, 16 nt, Human
auauucaggaagcuca

SEQ ID NO: 3114940 - RNA, 14 nt, Human
auauucaggaagcu

SEQ ID NO: 3114941 - RNA, 19 nt, Human
auaugcuuauacacuuaca

SEQ ID NO: 3114942 - RNA, 14 nt, Human
auaugcuuauacac

SEQ ID NO: 3114943 - RNA, 16 nt, Human
auaugcuuauacacuu

SEQ ID NO: 3114944 - RNA, 22 nt, Human
auaugccugggcagaaggaaga

SEQ ID NO: 3114945 - RNA, 16 nt, Human
auauaggaacuuaaau

SEQ ID NO: 3114946 - RNA, 15 nt, Human
auaguaugguggcug

SEQ ID NO: 3114947 - RNA, 16 nt, Human
auaguaugguggcugg

SEQ ID NO: 3114948 - RNA, 17 nt, Human
agggacgcuacccggga

SEQ ID NO: 3114949 - RNA, 21 nt, Human
agggacgcuacccgggaaggg

SEQ ID NO: 3114950 - RNA, 20 nt, Human
agggacagaggggguggccu

SEQ ID NO: 3114951 - RNA, 13 nt, Human
agggacagagggg

SEQ ID NO: 3114952 - RNA, 12 nt, Human
agggacagaggg

SEQ ID NO: 3114953 - RNA, 18 nt, Human
aggcugccucucccauca

SEQ ID NO: 3114954 - RNA, 23 nt, Human
aggcuagugugguguuuccuggc

SEQ ID NO: 3114955 - RNA, 17 nt, Human
agggcacaccgggcacu

SEQ ID NO: 3114956 - RNA, 20 nt, Human
agggcacaccgggcacucag

SEQ ID NO: 3114957 - RNA, 21 nt, Human
agggcacaccgggcacucaga

SEQ ID NO: 3114958 - RNA, 22 nt, Human
agggcacagaaaauggaagaca

SEQ ID NO: 3114959 - RNA, 17 nt, Human
agggccuggccugagcu

SEQ ID NO: 3114960 - RNA, 16 nt, Human
agggccuggccugagc

SEQ ID NO: 3114961 - RNA, 15 nt, Human
agggccuggccugag

SEQ ID NO: 3114962 - RNA, 14 nt, Human
agggccuggccuga

SEQ ID NO: 3114963 - RNA, 19 nt, Human
agggcgggaggauguucug

SEQ ID NO: 3114964 - RNA, 16 nt, Human
aggggauagagagaga

SEQ ID NO: 3114965 - RNA, 21 nt, Human
aggggauagagagagaccacu

SEQ ID NO: 3114966 - RNA, 15 nt, Human
aggggcacagggucu

SEQ ID NO: 3114967 - RNA, 17 nt, Human
agguaaggaauaccugu

SEQ ID NO: 3114968 - RNA, 17 nt, Human
aggugcugccauccagg

SEQ ID NO: 3114969 - RNA, 16 nt, Human
aggugcugccauccag

SEQ ID NO: 3114970 - RNA, 14 nt, Human
aggucgaggcagga

SEQ ID NO: 3114971 - RNA, 13 nt, Human
agguucagcuugu

SEQ ID NO: 3114972 - RNA, 15 nt, Human
agguuaauaaaguaa

SEQ ID NO: 3114973 - RNA, 15 nt, Human
agguucaaagauauu

SEQ ID NO: 3114974 - RNA, 17 nt, Human
agguucaaagauauuuu

SEQ ID NO: 3114975 - RNA, 14 nt, Human
agguuaauguucau

SEQ ID NO: 3114976 - RNA, 17 nt, Human
agcugggugucaagagg

SEQ ID NO: 3114977 - RNA, 22 nt, Human
agcugggugucaagagggucug

SEQ ID NO: 3114978 - RNA, 21 nt, Human
agcuggucccacucaguccau

SEQ ID NO: 3114979 - RNA, 19 nt, Human
agcuggucccacucagucc

SEQ ID NO: 3114980 - RNA, 15 nt, Human
aggaaaaacugauuu

SEQ ID NO: 3114981 - RNA, 13 nt, Human
aggaaaaacugau

SEQ ID NO: 3114982 - RNA, 17 nt, Human
aggaggggauagagaga

SEQ ID NO: 3114983 - RNA, 18 nt, Human
aggauguucugggacaca

SEQ ID NO: 3114984 - RNA, 20 nt, Human
aggauguucugggacacagu

SEQ ID NO: 3114985 - RNA, 12 nt, Human
aggauucuuccu

SEQ ID NO: 3114986 - RNA, 18 nt, Human
aggagaggggcacagggu

SEQ ID NO: 3114987 - RNA, 16 nt, Human
aggagaggggcacagg

SEQ ID NO: 3114988 - RNA, 14 nt, Human
aggagaggggcaca

SEQ ID NO: 3114989 - RNA, 15 nt, Human
aggagagcuagcagc

SEQ ID NO: 3114990 - RNA, 20 nt, Human
aggaccucaggugagaagca

SEQ ID NO: 3114991 - RNA, 14 nt, Human
aggaccucagguga

SEQ ID NO: 3114992 - RNA, 20 nt, Human
aggaccccuccaugugggcu

SEQ ID NO: 3114993 - RNA, 23 nt, Human
agacugaguacguugugcauuug

SEQ ID NO: 3114994 - RNA, 23 nt, Human
agagaggguggugaccucugccu

SEQ ID NO: 3114995 - RNA, 21 nt, Human
agagaagagauugugguuuca

SEQ ID NO: 3114996 - RNA, 10 nt, Human
agagaagaga

SEQ ID NO: 3114997 - RNA, 13 nt, Human
agacaaugacuua

SEQ ID NO: 3114998 - RNA, 17 nt, Human
agacaaugacuuacugu

SEQ ID NO: 3114999 - RNA, 21 nt, Human
agacaauuuauuauggcacau

SEQ ID NO: 3115000 - RNA, 14 nt, Human
agacaauuuauuau

SEQ ID NO: 3115001 - RNA, 15 nt, Human
agacaauuuauuaug

SEQ ID NO: 3115002 - RNA, 19 nt, Human
agacggagucccaccuugg

SEQ ID NO: 3115003 - RNA, 18 nt, Human
agacggagucccaccuug

SEQ ID NO: 3115004 - RNA, 18 nt, Human
agacgggggcagagaggg

SEQ ID NO: 3115005 - RNA, 13 nt, Human
agaccaucccuga

SEQ ID NO: 3115006 - RNA, 21 nt, Human
agaccaucccugaaggccccg

SEQ ID NO: 3115007 - RNA, 18 nt, Human
agaccaucccugaaggcc

SEQ ID NO: 3115008 - RNA, 17 nt, Human
agaccaucccugaaggc

SEQ ID NO: 3115009 - RNA, 14 nt, Human
agaccaucccugaa

SEQ ID NO: 3115010 - RNA, 20 nt, Human
agacagcccgggcucugccu

SEQ ID NO: 3115011 - RNA, 18 nt, Human
agacagcccgggcucugc

SEQ ID NO: 3115012 - RNA, 17 nt, Human
agacagcccgggcucug

SEQ ID NO: 3115013 - RNA, 16 nt, Human
agacagcccgggcucu

SEQ ID NO: 3115014 - RNA, 13 nt, Human
agauagccaaggc

SEQ ID NO: 3115015 - RNA, 22 nt, Human
agauacuuggggggcugaggug

SEQ ID NO: 3115016 - RNA, 23 nt, Human
agaggguggugaccucugccuga

SEQ ID NO: 3115017 - RNA, 13 nt, Human
agaggagaggggc

SEQ ID NO: 3115018 - RNA, 16 nt, Human
agaggggaagagacuu

SEQ ID NO: 3115019 - RNA, 22 nt, Human
agaggggaacagacuggaagca

SEQ ID NO: 3115020 - RNA, 16 nt, Human
agauagccaaggccaa

SEQ ID NO: 3115021 - RNA, 15 nt, Human
agauagccaaggcca

SEQ ID NO: 3115022 - RNA, 16 nt, Human
agccccagugcccaca

SEQ ID NO: 3115023 - RNA, 11 nt, Human
agccccauccu

SEQ ID NO: 3115024 - RNA, 20 nt, Human
agccccaucccaaacccuuc

SEQ ID NO: 3115025 - RNA, 15 nt, Human
agcccugagcuuucu

SEQ ID NO: 3115026 - RNA, 19 nt, Human
agccgagaucacgccacug

SEQ ID NO: 3115027 - RNA, 20 nt, Human
agccgagaucacgccacugc

SEQ ID NO: 3115028 - RNA, 22 nt, Human
agccucccgaguagcugggacu

SEQ ID NO: 3115029 - RNA, 17 nt, Human
agccucccaaagugcug

SEQ ID NO: 3115030 - RNA, 18 nt, Human
agccucccgaauagcugg

SEQ ID NO: 3115031 - RNA, 19 nt, Human
agccucccgaauagcuggg

SEQ ID NO: 3115032 - RNA, 20 nt, Human
agccucccgaauagcuggga

SEQ ID NO: 3115033 - RNA, 22 nt, Human
agccucccgaauagcugggacu

SEQ ID NO: 3115034 - RNA, 17 nt, Human
agccucccgaguagcug

SEQ ID NO: 3115035 - RNA, 21 nt, Human
agccgagaucacgccacugca

SEQ ID NO: 3115036 - RNA, 19 nt, Human
agccgagauugcaccacug

SEQ ID NO: 3115037 - RNA, 20 nt, Human
agccgagauugcaccacugc

SEQ ID NO: 3115038 - RNA, 18 nt, Human
agccgagaucacgccacu

SEQ ID NO: 3115039 - RNA, 22 nt, Human
agccgcuggggccaguuggucc

SEQ ID NO: 3115040 - RNA, 14 nt, Human
agccgcuggggcca

SEQ ID NO: 3115041 - RNA, 18 nt, Human
agccucccaaagugcugg

SEQ ID NO: 3115042 - RNA, 19 nt, Human
agccucccaaagugcuggg

SEQ ID NO: 3115043 - RNA, 15 nt, Human
agcagccacauuccu

SEQ ID NO: 3115044 - RNA, 21 nt, Human
agcagccacauuccugaugcu

SEQ ID NO: 3115045 - RNA, 19 nt, Human
agcacuaaggugugcucug

SEQ ID NO: 3115046 - RNA, 20 nt, Human
agccaaggccaaaggaagca

SEQ ID NO: 3115047 - RNA, 22 nt, Human
agccaaggccaaaggaagcaca

SEQ ID NO: 3115048 - RNA, 23 nt, Human
agccaaggccaaaggaagcacau

SEQ ID NO: 3115049 - RNA, 20 nt, Human
agccagaggagagaggaccc

SEQ ID NO: 3115050 - RNA, 18 nt, Human
agccagaggagagaggac

SEQ ID NO: 3115051 - RNA, 22 nt, Human
agccagauuucacucuccuugg

SEQ ID NO: 3115052 - RNA, 18 nt, Human
agccaaagcuaggccugg

SEQ ID NO: 3115053 - RNA, 19 nt, Human
agccaaagcuaggccuggc

SEQ ID NO: 3115054 - RNA, 20 nt, Human
agccaaagcuaggccuggcc

SEQ ID NO: 3115055 - RNA, 23 nt, Human
agccaaagcuaggccuggccaga

SEQ ID NO: 3115056 - RNA, 12 nt, Human
agcaugccugga

SEQ ID NO: 3115057 - RNA, 22 nt, Human
accaucccugaaggccccgccc

SEQ ID NO: 3115058 - RNA, 21 nt, Human
accaucccugaaggccccgcc

SEQ ID NO: 3115059 - RNA, 16 nt, Human
accaucaugucuggcu

SEQ ID NO: 3115060 - RNA, 17 nt, Human
accaucaugucuggcua

SEQ ID NO: 3115061 - RNA, 16 nt, Human
accaucccugaaggcc

SEQ ID NO: 3115062 - RNA, 18 nt, Human
accaucccugaaggcccc

SEQ ID NO: 3115063 - RNA, 14 nt, Human
accaucaugucugg

SEQ ID NO: 3115064 - RNA, 16 nt, Human
acccaugcugcccugu

SEQ ID NO: 3115065 - RNA, 19 nt, Human
acccaugcugcccugugag

SEQ ID NO: 3115066 - RNA, 18 nt, Human
acccaugcugcccuguga

SEQ ID NO: 3115067 - RNA, 17 nt, Human
acccaugcugcccugug

SEQ ID NO: 3115068 - RNA, 23 nt, Human
acccaagggccuggccugagcug

SEQ ID NO: 3115069 - RNA, 16 nt, Human
acccaagggccuggcc

SEQ ID NO: 3115070 - RNA, 13 nt, Human
acccaagggccug

SEQ ID NO: 3115071 - RNA, 15 nt, Human
accccggccaccugc

SEQ ID NO: 3115072 - RNA, 19 nt, Human
acauguuuuucuucucccu

SEQ ID NO: 3115073 - RNA, 20 nt, Human
acaugcacagcuaacaugga

SEQ ID NO: 3115074 - RNA, 19 nt, Human
acaugcaaggucauuuuuu

SEQ ID NO: 3115075 - RNA, 18 nt, Human
acaugcaaggucauuuuu

SEQ ID NO: 3115076 - RNA, 21 nt, Human
acauguuuuucuucucccuca

SEQ ID NO: 3115077 - RNA, 19 nt, Human
acaucagcacgauuucugu

SEQ ID NO: 3115078 - RNA, 20 nt, Human
acaucagcacgauuucuguu

SEQ ID NO: 3115079 - RNA, 21 nt, Human
acaucagcacgauuucuguuu

SEQ ID NO: 3115080 - RNA, 22 nt, Human
acaucagcacgauuucuguuua

SEQ ID NO: 3115081 - RNA, 23 nt, Human
acauaaacaagaccacguuucua

SEQ ID NO: 3115082 - RNA, 21 nt, Human
accaacgucugugccauuuug

SEQ ID NO: 3115083 - RNA, 17 nt, Human
accagcagccuggaccc

SEQ ID NO: 3115084 - RNA, 14 nt, Human
accagcagccugga

SEQ ID NO: 3115085 - RNA, 13 nt, Human
accagcagccugg

SEQ ID NO: 3115086 - RNA, 15 nt, Human
accacguuucuaaag

SEQ ID NO: 3115087 - RNA, 19 nt, Human
accacguuucuaaaggcua

SEQ ID NO: 3115088 - RNA, 14 nt, Human
accacuacauucug

SEQ ID NO: 3115089 - RNA, 18 nt, Human
acacaaacgggcucagca

SEQ ID NO: 3115090 - RNA, 16 nt, Human
acaauuuauuauggca

SEQ ID NO: 3115091 - RNA, 14 nt, Human
acaauuuauuaugg

SEQ ID NO: 3115092 - RNA, 15 nt, Human
acaauuuauuauggc

SEQ ID NO: 3115093 - RNA, 15 nt, Human
acacggacacucaaa

SEQ ID NO: 3115094 - RNA, 14 nt, Human
acacuaaccacgcu

SEQ ID NO: 3115095 - RNA, 15 nt, Human
acacuaaccacgcug

SEQ ID NO: 3115096 - RNA, 11 nt, Human
acacagcucug

SEQ ID NO: 3115097 - RNA, 12 nt, Human
acacagcucugu

SEQ ID NO: 3115098 - RNA, 21 nt, Human
acaccacuacauucuguuaau

SEQ ID NO: 3115099 - RNA, 12 nt, Human
acaccagagccc

SEQ ID NO: 3115100 - RNA, 13 nt, Human
acaaagacugagu

SEQ ID NO: 3115101 - RNA, 21 nt, Human
acaaaccuguuucugcagcca

SEQ ID NO: 3115102 - RNA, 15 nt, Human
acaaacgggcucagc

SEQ ID NO: 3115103 - RNA, 12 nt, Human
acagcuccuucu

SEQ ID NO: 3115104 - RNA, 13 nt, Human
acagcuccuucug

SEQ ID NO: 3115105 - RNA, 14 nt, Human
acagcuccuucugu

SEQ ID NO: 3115106 - RNA, 23 nt, Human
acagcuccuucuguccuacucug

SEQ ID NO: 3115107 - RNA, 23 nt, Human
acagcugccugggaucccucauc

SEQ ID NO: 3115108 - RNA, 13 nt, Human
acagcugccuggg

SEQ ID NO: 3115109 - RNA, 14 nt, Human
acagcugccuggga

SEQ ID NO: 3115110 - RNA, 18 nt, Human
acaggcaagcaccuccug

SEQ ID NO: 3115111 - RNA, 15 nt, Human
acaggcaagcaccuc

SEQ ID NO: 3115112 - RNA, 16 nt, Human
acaggcaagcaccucc

SEQ ID NO: 3115113 - RNA, 20 nt, Human
acaggugugaaccaccacac

SEQ ID NO: 3115114 - RNA, 23 nt, Human
acaggugugaaccaccacaccca

SEQ ID NO: 3115115 - RNA, 15 nt, Human
acagccaugauucuu

SEQ ID NO: 3115116 - RNA, 19 nt, Human
acagccacggccaggccag

SEQ ID NO: 3115117 - RNA, 17 nt, Human
acagagucucacuguug

SEQ ID NO: 3115118 - RNA, 19 nt, Human
acagagucucacuguugcc

SEQ ID NO: 3115119 - RNA, 22 nt, Human
acagaggggguggccucccaac

SEQ ID NO: 3115120 - RNA, 12 nt, Human
acagagucucac

SEQ ID NO: 3115121 - RNA, 14 nt, Human
acagagucucacug

SEQ ID NO: 3115122 - RNA, 21 nt, Human
acagaggggguggccucccaa

SEQ ID NO: 3115123 - RNA, 20 nt, Human
accugccccucaacucuccu

SEQ ID NO: 3115124 - RNA, 23 nt, Human
accugccccucaacucuccucca

SEQ ID NO: 3115125 - RNA, 21 nt, Human
accucugcacaagcugcaccc

SEQ ID NO: 3115126 - RNA, 18 nt, Human
accucugcacaagcugca

SEQ ID NO: 3115127 - RNA, 16 nt, Human
accucugcacaagcug

SEQ ID NO: 3115128 - RNA, 23 nt, Human
accuuucaauaggaaaaacugau

SEQ ID NO: 3115129 - RNA, 21 nt, Human
accuuucaauaggaaaaacug

SEQ ID NO: 3115130 - RNA, 17 nt, Human
accuuucaauaggaaaa

SEQ ID NO: 3115131 - RNA, 16 nt, Human
accuuucaauaggaaa

SEQ ID NO: 3115132 - RNA, 12 nt, Human
accuuggcucaa

SEQ ID NO: 3115133 - RNA, 14 nt, Human
accuuggcucaagu

SEQ ID NO: 3115134 - RNA, 12 nt, Human
accuuggcugca

SEQ ID NO: 3115135 - RNA, 12 nt, Human
acgauuucuguu

SEQ ID NO: 3115136 - RNA, 13 nt, Human
acgauuucuguuu

SEQ ID NO: 3115137 - RNA, 18 nt, Human
acgccacugcacuauagc

SEQ ID NO: 3115138 - RNA, 14 nt, Human
acgauuucuguuua

SEQ ID NO: 3115139 - RNA, 17 nt, Human
acgauuucuguuuagau

SEQ ID NO: 3115140 - RNA, 15 nt, Human
acuaaguuuuuaugg

SEQ ID NO: 3115141 - RNA, 22 nt, Human
acuaaguuuuuauggcuuuugu

SEQ ID NO: 3115142 - RNA, 11 nt, Human
acguggcugcu

SEQ ID NO: 3115143 - RNA, 15 nt, Human
acguggcugcuucaa

SEQ ID NO: 3115144 - RNA, 14 nt, Human
acguggcugcuuca

SEQ ID NO: 3115145 - RNA, 13 nt, Human
acguggcugcuuc

SEQ ID NO: 3115146 - RNA, 18 nt, Human
acgcugugcugcccugcc

SEQ ID NO: 3115147 - RNA, 17 nt, Human
acgcugugcugcccugc

SEQ ID NO: 3115148 - RNA, 16 nt, Human
acgcugugcugcccug

SEQ ID NO: 3115149 - RNA, 15 nt, Human
acgcugugcugcccu

SEQ ID NO: 3115150 - RNA, 21 nt, Human
acucuacccucuuagaaaaac

SEQ ID NO: 3115151 - RNA, 18 nt, Human
acucuacccucuuagaaa

SEQ ID NO: 3115152 - RNA, 13 nt, Human
acucuacccucuu

SEQ ID NO: 3115153 - RNA, 14 nt, Human
acucuaucaaguau

SEQ ID NO: 3115154 - RNA, 16 nt, Human
acucuaucaaguauua

SEQ ID NO: 3115155 - RNA, 18 nt, Human
acucuuaaaacccaagug

SEQ ID NO: 3115156 - RNA, 11 nt, Human
acucuuaaaac

SEQ ID NO: 3115157 - RNA, 16 nt, Human
acucugugucaggugg

SEQ ID NO: 3115158 - RNA, 18 nt, Human
acucaaaagcugggcagg

SEQ ID NO: 3115159 - RNA, 16 nt, Human
acucaaacucuuaaaa

SEQ ID NO: 3115160 - RNA, 17 nt, Human
acucaaacucuuaaaac

SEQ ID NO: 3115161 - RNA, 17 nt, Human
acuccccugcugggugu

SEQ ID NO: 3115162 - RNA, 13 nt, Human
acuccccugcugg

SEQ ID NO: 3115163 - RNA, 14 nt, Human
acucccccaggugg

SEQ ID NO: 3115164 - RNA, 20 nt, Human
agaaaggaggggauagagag

SEQ ID NO: 3115165 - RNA, 23 nt, Human
agaaaggaggggauagagagaga

SEQ ID NO: 3115166 - RNA, 15 nt, Human
agaaauaaaguuucu

SEQ ID NO: 3115167 - RNA, 18 nt, Human
agaaauaaaguuucuguu

SEQ ID NO: 3115168 - RNA, 15 nt, Human
acuuuuauaaacuuu

SEQ ID NO: 3115169 - RNA, 19 nt, Human
acuuuuauaaacuuuaccu

SEQ ID NO: 3115170 - RNA, 22 nt, Human
acuuuuauaaacuuuaccuuuu

SEQ ID NO: 3115171 - RNA, 20 nt, Human
agaaaauggacguguuauga

SEQ ID NO: 3115172 - RNA, 15 nt, Human
agaaaauggacgugu

SEQ ID NO: 3115173 - RNA, 23 nt, Human
agaaaauggaagacagcucuuau

SEQ ID NO: 3115174 - RNA, 23 nt, Human
agaaaauggacguguuaugacuc

SEQ ID NO: 3115175 - RNA, 22 nt, Human
agaaaauggacguguuaugacu

SEQ ID NO: 3115176 - RNA, 23 nt, Human
acuuuguucuggcucuuccaggc

SEQ ID NO: 3115177 - RNA, 20 nt, Human
acuuuguucuggcucuucca

SEQ ID NO: 3115178 - RNA, 23 nt, Human
acuuuccuucauucaacccaccu

SEQ ID NO: 3115179 - RNA, 15 nt, Human
acuggaagcacagcu

SEQ ID NO: 3115180 - RNA, 14 nt, Human
acuggaagcacagc

SEQ ID NO: 3115181 - RNA, 12 nt, Human
acugucuucagu

SEQ ID NO: 3115182 - RNA, 18 nt, Human
acuucugccauauucugu

SEQ ID NO: 3115183 - RNA, 19 nt, Human
acuucacauauugauuucc

SEQ ID NO: 3115184 - RNA, 11 nt, Human
aaagagguuuu

SEQ ID NO: 3115185 - RNA, 22 nt, Human
aaacacuguucucugcccucca

SEQ ID NO: 3115186 - RNA, 19 nt, Human
aaacacuguucucugcccu

SEQ ID NO: 3115187 - RNA, 18 nt, Human
aaacacuguucucugccc

SEQ ID NO: 3115188 - RNA, 13 nt, Human
aaaauucagugga

SEQ ID NO: 3115189 - RNA, 13 nt, Human
aaaacacauuuuu

SEQ ID NO: 3115190 - RNA, 15 nt, Human
aaaacacauuuuucu

SEQ ID NO: 3115191 - RNA, 18 nt, Human
aaauggaagacagcucuu

SEQ ID NO: 3115192 - RNA, 16 nt, Human
aaauggaaaugggcag

SEQ ID NO: 3115193 - RNA, 20 nt, Human
aaauggacguguuaugacuc

SEQ ID NO: 3115194 - RNA, 22 nt, Human
aaauggacguguuaugacucca

SEQ ID NO: 3115195 - RNA, 21 nt, Human
aaauggacguguuaugacucc

SEQ ID NO: 3115196 - RNA, 14 nt, Human
aaagugcugggauu

SEQ ID NO: 3115197 - RNA, 11 nt, Human
aaagugcuggg

SEQ ID NO: 3115198 - RNA, 19 nt, Human
aacugauuuuuuuuuccuu

SEQ ID NO: 3115199 - RNA, 17 nt, Human
aacugauuuuuuuuucc

SEQ ID NO: 3115200 - RNA, 17 nt, Human
aacuuaaauaaugugaa

SEQ ID NO: 3115201 - RNA, 16 nt, Human
aacucaccugccccuc

SEQ ID NO: 3115202 - RNA, 15 nt, Human
aacucaccugccccu

SEQ ID NO: 3115203 - RNA, 12 nt, Human
aacucaccccag

SEQ ID NO: 3115204 - RNA, 16 nt, Human
aacuuuuauaaacuuu

SEQ ID NO: 3115205 - RNA, 19 nt, Human
aacuuuuauaaacuuuacc

SEQ ID NO: 3115206 - RNA, 13 nt, Human
aacuuugaccucu

SEQ ID NO: 3115207 - RNA, 14 nt, Human
aacuuugaccucug

SEQ ID NO: 3115208 - RNA, 17 nt, Human
aacuuugaccucugcag

SEQ ID NO: 3115209 - RNA, 12 nt, Human
aacuuuuauaaa

SEQ ID NO: 3115210 - RNA, 15 nt, Human
aacuuuuauaaacuu

SEQ ID NO: 3115211 - RNA, 19 nt, Human
aacuuugaccucugcagca

SEQ ID NO: 3115212 - RNA, 20 nt, Human
aacuuugaccucugcagcaa

SEQ ID NO: 3115213 - RNA, 14 nt, Human
aacccuggugacca

SEQ ID NO: 3115214 - RNA, 22 nt, Human
aaccacucuaucaaguauuaua

SEQ ID NO: 3115215 - RNA, 14 nt, Human
aacauguaauuaag

SEQ ID NO: 3115216 - RNA, 21 nt, Human
aacauguaauuaaguacuaug

SEQ ID NO: 3115217 - RNA, 14 nt, Human
aacaucaacaucuu

SEQ ID NO: 3115218 - RNA, 19 nt, Human
aacacauuuuucuuaggga

SEQ ID NO: 3115219 - RNA, 19 nt, Human
aacaccucugcacaagcug

SEQ ID NO: 3115220 - RNA, 18 nt, Human
aauauaggaacuuaaaua

SEQ ID NO: 3115221 - RNA, 20 nt, Human
aauauaggaacuuaaauaau

SEQ ID NO: 3115222 - RNA, 21 nt, Human
aauauaggaacuuaaauaaug

SEQ ID NO: 3115223 - RNA, 16 nt, Human
aauauaggaacuuaaa

SEQ ID NO: 3115224 - RNA, 19 nt, Human
aaugaugccaugaggaaca

SEQ ID NO: 3115225 - RNA, 22 nt, Human
aaucugcuuuuuaaagaaugcu

SEQ ID NO: 3115226 - RNA, 16 nt, Human
aaugaaccacaucuug

SEQ ID NO: 3115227 - RNA, 17 nt, Human
aaugaaccacaucuugc

SEQ ID NO: 3115228 - RNA, 23 nt, Human
aaugaaccacaucuugcucugcu

SEQ ID NO: 3115229 - RNA, 21 nt, Human
aaugaugauccuaggcauuug

SEQ ID NO: 3115230 - RNA, 14 nt, Human
aaucuccaaaauaa

SEQ ID NO: 3115231 - RNA, 13 nt, Human
aaucuccaaaaua

SEQ ID NO: 3115232 - RNA, 18 nt, Human
aauuaaaacacaacaucu

SEQ ID NO: 3115233 - RNA, 19 nt, Human
aauguuugccucugccucu

SEQ ID NO: 3115234 - RNA, 16 nt, Human
aauguuugccucugcc

SEQ ID NO: 3115235 - RNA, 18 nt, Human
aauguuugccucugccuc

SEQ ID NO: 3115236 - RNA, 13 nt, Human
aaugggcagagca

SEQ ID NO: 3115237 - RNA, 15 nt, Human
aaugggcagagcaga

SEQ ID NO: 3115238 - RNA, 22 nt, Human
aaugucuaguuguaacaccaug

SEQ ID NO: 3115239 - RNA, 21 nt, Human
aaugucagugugacugaucuc

SEQ ID NO: 3115240 - RNA, 17 nt, Human
aaugucagugugacuga

SEQ ID NO: 3115241 - RNA, 20 nt, Human
aaugucucuuuaaugucaca

SEQ ID NO: 3115242 - RNA, 16 nt, Human
aaugucagugugacug

SEQ ID NO: 3115243 - RNA, 15 nt, Human
aaugucagugugacu

SEQ ID NO: 3115244 - RNA, 13 nt, Human
aaugucaguguga

SEQ ID NO: 3115245 - RNA, 16 nt, Human
aaggcaaggcugucaa

SEQ ID NO: 3115246 - RNA, 18 nt, Human
aaggcaaggcugucaauu

SEQ ID NO: 3115247 - RNA, 17 nt, Human
aaggcaaggcugucaau

SEQ ID NO: 3115248 - RNA, 11 nt, Human
aagcugggcag

SEQ ID NO: 3115249 - RNA, 13 nt, Human
aagcugggcaggu

SEQ ID NO: 3115250 - RNA, 18 nt, Human
aaggacauugcggacagc

SEQ ID NO: 3115251 - RNA, 20 nt, Human
aagcugcacccucaggcagg

SEQ ID NO: 3115252 - RNA, 21 nt, Human
aagcugcacccucaggcaggu

SEQ ID NO: 3115253 - RNA, 22 nt, Human
aagcugcacccucaggcaggug

SEQ ID NO: 3115254 - RNA, 12 nt, Human
aagcguggugga

SEQ ID NO: 3115255 - RNA, 21 nt, Human
aagcgugagccacugcaccgg

SEQ ID NO: 3115256 - RNA, 18 nt, Human
aagccauaauuguucuua

SEQ ID NO: 3115257 - RNA, 14 nt, Human
aagcagaggaagga

SEQ ID NO: 3115258 - RNA, 22 nt, Human
aagugcugggauuacaggugug

SEQ ID NO: 3115259 - RNA, 22 nt, Human
aaguuguaggcauaaagucagg

SEQ ID NO: 3115260 - RNA, 20 nt, Human
aagguuaauguucaucaucc

SEQ ID NO: 3115261 - RNA, 15 nt, Human
aagguuaauaaagua

SEQ ID NO: 3115262 - RNA, 16 nt, Human
aagguuaauaaaguaa

SEQ ID NO: 3115263 - RNA, 11 nt, Human
aaggugggagg

SEQ ID NO: 3115264 - RNA, 16 nt, Human
aaguaucccuacugua

SEQ ID NO: 3115265 - RNA, 11 nt, Human
aaguacuucuu

SEQ ID NO: 3115266 - RNA, 16 nt, Human
aagucuuagauguaua

SEQ ID NO: 3115267 - RNA, 16 nt, Human
cuccucugcugcuggc

SEQ ID NO: 3115268 - RNA, 15 nt, Human
cuccucugcugcugg

SEQ ID NO: 3115269 - RNA, 18 nt, Human
cuccucugcugcuggcug

SEQ ID NO: 3115270 - RNA, 18 nt, Human
cuccuggcccacugcauc

SEQ ID NO: 3115271 - RNA, 16 nt, Human
cuccuggcccacugca

SEQ ID NO: 3115272 - RNA, 22 nt, Human
cucccccagccccauccucugu

SEQ ID NO: 3115273 - RNA, 20 nt, Human
cucccccagccccauccucu

SEQ ID NO: 3115274 - RNA, 15 nt, Human
cucccccagccccau

SEQ ID NO: 3115275 - RNA, 15 nt, Human
cucgaacuggcugca

SEQ ID NO: 3115276 - RNA, 13 nt, Human
cucgaacuggcug

SEQ ID NO: 3115277 - RNA, 14 nt, Human
cucgaacuggcugc

SEQ ID NO: 3115278 - RNA, 19 nt, Human
cuccacuuucuagccagag

SEQ ID NO: 3115279 - RNA, 16 nt, Human
cuccacuuucuagcca

SEQ ID NO: 3115280 - RNA, 21 nt, Human
cuccaagaccuucuccuucac

SEQ ID NO: 3115281 - RNA, 22 nt, Human
cuccaagaccuucuccuucacc

SEQ ID NO: 3115282 - RNA, 24 nt, Human
cuccaagcaggacauggacaagga

SEQ ID NO: 3115283 - RNA, 22 nt, Human
cuccaagcaggacauggacaag

SEQ ID NO: 3115284 - RNA, 14 nt, Human
cuccaagcaggaca

SEQ ID NO: 3115285 - RNA, 13 nt, Human
cuccaagcaggac

SEQ ID NO: 3115286 - RNA, 16 nt, Human
cuccaagcucccaggc

SEQ ID NO: 3115287 - RNA, 15 nt, Human
cuccaagcucccagg

SEQ ID NO: 3115288 - RNA, 14 nt, Human
cuccaagcucccag

SEQ ID NO: 3115289 - RNA, 13 nt, Human
cuccaagcuccca

SEQ ID NO: 3115290 - RNA, 14 nt, Human
cucuucaaucucuu

SEQ ID NO: 3115291 - RNA, 18 nt, Human
cucuucagaucucuaacu

SEQ ID NO: 3115292 - RNA, 19 nt, Human
cucuucagaucucuaacuu

SEQ ID NO: 3115293 - RNA, 14 nt, Human
cucuuauugcccac

SEQ ID NO: 3115294 - RNA, 15 nt, Human
cucuuauugcccacg

SEQ ID NO: 3115295 - RNA, 19 nt, Human
cucuuauugcccacgcugg

SEQ ID NO: 3115296 - RNA, 20 nt, Human
cucuuauugcccacgcugga

SEQ ID NO: 3115297 - RNA, 13 nt, Human
cucuuauugccca

SEQ ID NO: 3115298 - RNA, 13 nt, Human
cucugcugacaga

SEQ ID NO: 3115299 - RNA, 14 nt, Human
cucugcugacagac

SEQ ID NO: 3115300 - RNA, 16 nt, Human
cucugcugacagacac

SEQ ID NO: 3115301 - RNA, 14 nt, Human
cucugguccauaga

SEQ ID NO: 3115302 - RNA, 13 nt, Human
cucugcuccucuc

SEQ ID NO: 3115303 - RNA, 18 nt, Human
cucugcuccucuccccag

SEQ ID NO: 3115304 - RNA, 18 nt, Human
cucugcacuccccugcug

SEQ ID NO: 3115305 - RNA, 20 nt, Human
cucugcacuccccugcuggg

SEQ ID NO: 3115306 - RNA, 21 nt, Human
cucugcacuccccugcugggu

SEQ ID NO: 3115307 - RNA, 23 nt, Human
cugacaacacucauugaccugag

SEQ ID NO: 3115308 - RNA, 22 nt, Human
cugacaacacucauugaccuga

SEQ ID NO: 3115309 - RNA, 21 nt, Human
cugaaggccccgcccaggcuu

SEQ ID NO: 3115310 - RNA, 19 nt, Human
cugaaggccccgcccaggc

SEQ ID NO: 3115311 - RNA, 18 nt, Human
cugaaggccccgcccagg

SEQ ID NO: 3115312 - RNA, 23 nt, Human
cugaaggacauugcggacagcca

SEQ ID NO: 3115313 - RNA, 21 nt, Human
cugaaggacauugcggacagc

SEQ ID NO: 3115314 - RNA, 16 nt, Human
cucuugagccugggag

SEQ ID NO: 3115315 - RNA, 18 nt, Human
cucuugagccuugaacuu

SEQ ID NO: 3115316 - RNA, 16 nt, Human
cucuugagccuugaac

SEQ ID NO: 3115317 - RNA, 17 nt, Human
cucuugagccuugaacu

SEQ ID NO: 3115318 - RNA, 22 nt, Human
cugacccaugcugcccugugag

SEQ ID NO: 3115319 - RNA, 21 nt, Human
cugacccaugcugcccuguga

SEQ ID NO: 3115320 - RNA, 20 nt, Human
cugagacucgcgacaaugca

SEQ ID NO: 3115321 - RNA, 21 nt, Human
cugagacucgcgacaaugcaa

SEQ ID NO: 3115322 - RNA, 23 nt, Human
cugagacagcccgggcucugccu

SEQ ID NO: 3115323 - RNA, 22 nt, Human
cugagacucgcgacaaugcaaa

SEQ ID NO: 3115324 - RNA, 17 nt, Human
cugagaguagagucacu

SEQ ID NO: 3115325 - RNA, 21 nt, Human
cugagaggacuuuucuuugug

SEQ ID NO: 3115326 - RNA, 22 nt, Human
cugagaggacuuuucuuugugg

SEQ ID NO: 3115327 - RNA, 21 nt, Human
cugaguacguugugcauuugg

SEQ ID NO: 3115328 - RNA, 18 nt, Human
cugaguacguugugcauu

SEQ ID NO: 3115329 - RNA, 17 nt, Human
cugaguacguugugcau

SEQ ID NO: 3115330 - RNA, 19 nt, Human
cugaguacguugugcauuu

SEQ ID NO: 3115331 - RNA, 20 nt, Human
cugaguacguugugcauuug

SEQ ID NO: 3115332 - RNA, 23 nt, Human
cugaggacacuaaccacgcugga

SEQ ID NO: 3115333 - RNA, 20 nt, Human
cugaggacacuaaccacgcu

SEQ ID NO: 3115334 - RNA, 17 nt, Human
cugaggaauccagaccc

SEQ ID NO: 3115335 - RNA, 20 nt, Human
cugaggaauccagacccggc

SEQ ID NO: 3115336 - RNA, 14 nt, Human
cugaggaauccaga

SEQ ID NO: 3115337 - RNA, 15 nt, Human
cugagcuuucugcua

SEQ ID NO: 3115338 - RNA, 14 nt, Human
cugagcuuucugcu

SEQ ID NO: 3115339 - RNA, 21 nt, Human
cugagaucaaaacgguuuuac

SEQ ID NO: 3115340 - RNA, 17 nt, Human
cgacugcccggcagggu

SEQ ID NO: 3115341 - RNA, 20 nt, Human
cgacccuugccgucuaccug

SEQ ID NO: 3115342 - RNA, 19 nt, Human
cgacccuugccgucuaccu

SEQ ID NO: 3115343 - RNA, 13 nt, Human
cgacaaugcaaac

SEQ ID NO: 3115344 - RNA, 12 nt, Human
cgacaaugcaaa

SEQ ID NO: 3115345 - RNA, 18 nt, Human
ccuuucaauaggaaaaac

SEQ ID NO: 3115346 - RNA, 21 nt, Human
ccuuucaauaggaaaaacuga

SEQ ID NO: 3115347 - RNA, 17 nt, Human
ccuuuugagugccuuac

SEQ ID NO: 3115348 - RNA, 15 nt, Human
ccuuuugagugccuu

SEQ ID NO: 3115349 - RNA, 16 nt, Human
ccuugccgucuaccug

SEQ ID NO: 3115350 - RNA, 14 nt, Human
ccuuuaagagaaau

SEQ ID NO: 3115351 - RNA, 16 nt, Human
cgaguagcugggacua

SEQ ID NO: 3115352 - RNA, 14 nt, Human
cgauagugguggug

SEQ ID NO: 3115353 - RNA, 22 nt, Human
cgcaggauucuuccucccuccc

SEQ ID NO: 3115354 - RNA, 14 nt, Human
cgccuacaggagug

SEQ ID NO: 3115355 - RNA, 16 nt, Human
cggagucccaccuugg

SEQ ID NO: 3115356 - RNA, 12 nt, Human
cgggccacagag

SEQ ID NO: 3115357 - RNA, 14 nt, Human
cgggccacagagaa

SEQ ID NO: 3115358 - RNA, 13 nt, Human
cggcuccaggcuc

SEQ ID NO: 3115359 - RNA, 14 nt, Human
cggcuccaggcucc

SEQ ID NO: 3115360 - RNA, 15 nt, Human
cggcuccaggcuccu

SEQ ID NO: 3115361 - RNA, 16 nt, Human
cggcuccaggcuccuu

SEQ ID NO: 3115362 - RNA, 12 nt, Human
cggcuccaggcu

SEQ ID NO: 3115363 - RNA, 14 nt, Human
cggagucccaccuu

SEQ ID NO: 3115364 - RNA, 16 nt, Human
cggcucacugcagccu

SEQ ID NO: 3115365 - RNA, 18 nt, Human
cggagucccaccuuggcu

SEQ ID NO: 3115366 - RNA, 20 nt, Human
cggagucccaccuuggcugc

SEQ ID NO: 3115367 - RNA, 15 nt, Human
cggcucacugcagcc

SEQ ID NO: 3115368 - RNA, 14 nt, Human
cggcucacugcagc

SEQ ID NO: 3115369 - RNA, 15 nt, Human
cggggacagcuccuu

SEQ ID NO: 3115370 - RNA, 13 nt, Human
cgguguggagaag

SEQ ID NO: 3115371 - RNA, 18 nt, Human
cgguguggagaagcggcu

SEQ ID NO: 3115372 - RNA, 14 nt, Human
cggggacagcuccu

SEQ ID NO: 3115373 - RNA, 17 nt, Human
cgggcucugccucccau

SEQ ID NO: 3115374 - RNA, 13 nt, Human
cgggcucugccuc

SEQ ID NO: 3115375 - RNA, 15 nt, Human
cgggcucagcaaaag

SEQ ID NO: 3115376 - RNA, 16 nt, Human
cgggcucugccuccca

SEQ ID NO: 3115377 - RNA, 14 nt, Human
cgggcucugccucc

SEQ ID NO: 3115378 - RNA, 11 nt, Human
cgggcucagca

SEQ ID NO: 3115379 - RNA, 20 nt, Human
cguguaaccauggacccaau

SEQ ID NO: 3115380 - RNA, 16 nt, Human
cgugaggccagagaca

SEQ ID NO: 3115381 - RNA, 17 nt, Human
cgugaguccuggcaugg

SEQ ID NO: 3115382 - RNA, 16 nt, Human
cgugaguccuggcaug

SEQ ID NO: 3115383 - RNA, 17 nt, Human
cgugaggccagagacac

SEQ ID NO: 3115384 - RNA, 16 nt, Human
cgguuuuacugcagcu

SEQ ID NO: 3115385 - RNA, 20 nt, Human
cuagcauacguacacauuuu

SEQ ID NO: 3115386 - RNA, 21 nt, Human
cuagcauacguacacauuuua

SEQ ID NO: 3115387 - RNA, 23 nt, Human
cuagcauacguacacauuuuauu

SEQ ID NO: 3115388 - RNA, 22 nt, Human
cuagaagauuuugaaauuuuua

SEQ ID NO: 3115389 - RNA, 17 nt, Human
cuaccuuuguauucucu

SEQ ID NO: 3115390 - RNA, 18 nt, Human
cuacaguccucccaucuc

SEQ ID NO: 3115391 - RNA, 20 nt, Human
cuacaguccucccaucucac

SEQ ID NO: 3115392 - RNA, 21 nt, Human
cuacaguugaaaaacagcuga

SEQ ID NO: 3115393 - RNA, 19 nt, Human
cuacaguugaaaaacagcu

SEQ ID NO: 3115394 - RNA, 18 nt, Human
cuacauacaauuccaaac

SEQ ID NO: 3115395 - RNA, 22 nt, Human
cuacaguugaaaaacagcugag

SEQ ID NO: 3115396 - RNA, 19 nt, Human
cuacaguccucccaucuca

SEQ ID NO: 3115397 - RNA, 23 nt, Human
cuaagugauccucccaccucagc

SEQ ID NO: 3115398 - RNA, 21 nt, Human
cuaagugguacuaacuuuccu

SEQ ID NO: 3115399 - RNA, 20 nt, Human
cuaaguuuuuauggcuuuug

SEQ ID NO: 3115400 - RNA, 23 nt, Human
cuaaguuuuuauggcuuuugugc

SEQ ID NO: 3115401 - RNA, 17 nt, Human
cuaucucccccagcccc

SEQ ID NO: 3115402 - RNA, 16 nt, Human
cuaucucccccagccc

SEQ ID NO: 3115403 - RNA, 18 nt, Human
cucaaaagcugggcaggu

SEQ ID NO: 3115404 - RNA, 20 nt, Human
cucaaacucuugaccucagg

SEQ ID NO: 3115405 - RNA, 13 nt, Human
cucaaugcacuga

SEQ ID NO: 3115406 - RNA, 15 nt, Human
cucaaugcacugaca

SEQ ID NO: 3115407 - RNA, 14 nt, Human
cuaucucccccagc

SEQ ID NO: 3115408 - RNA, 15 nt, Human
cuaucucccccagcc

SEQ ID NO: 3115409 - RNA, 14 nt, Human
cuaucuaaauguug

SEQ ID NO: 3115410 - RNA, 21 nt, Human
cuaguuugauuaaauucuugc

SEQ ID NO: 3115411 - RNA, 22 nt, Human
cuaguuugauuaaauucuugca

SEQ ID NO: 3115412 - RNA, 23 nt, Human
cuaguuguuugauucagacagcu

SEQ ID NO: 3115413 - RNA, 22 nt, Human
cuaguuguuugauucagacagc

SEQ ID NO: 3115414 - RNA, 13 nt, Human
cuaguuugauuaa

SEQ ID NO: 3115415 - RNA, 15 nt, Human
cuagccagaggagag

SEQ ID NO: 3115416 - RNA, 13 nt, Human
cuagccagaggag

SEQ ID NO: 3115417 - RNA, 12 nt, Human
cuagccagagga

SEQ ID NO: 3115418 - RNA, 14 nt, Human
cccuucgcuccugu

SEQ ID NO: 3115419 - RNA, 15 nt, Human
cccuucgcuccugug

SEQ ID NO: 3115420 - RNA, 21 nt, Human
cccuucucuccagccccugga

SEQ ID NO: 3115421 - RNA, 23 nt, Human
ccgcagcccugcagagggcacag

SEQ ID NO: 3115422 - RNA, 22 nt, Human
cccuucucuccagccccuggau

SEQ ID NO: 3115423 - RNA, 13 nt, Human
ccggccccugcug

SEQ ID NO: 3115424 - RNA, 17 nt, Human
cccugugauggggcccu

SEQ ID NO: 3115425 - RNA, 13 nt, Human
cccuucgcuccug

SEQ ID NO: 3115426 - RNA, 20 nt, Human
cccugugauggggcccugcc

SEQ ID NO: 3115427 - RNA, 19 nt, Human
cccugugauggggcccugc

SEQ ID NO: 3115428 - RNA, 18 nt, Human
cccugugauggggcccug

SEQ ID NO: 3115429 - RNA, 13 nt, Human
cccugucuaauga

SEQ ID NO: 3115430 - RNA, 16 nt, Human
cccugucuaaugaaac

SEQ ID NO: 3115431 - RNA, 23 nt, Human
cccugucucaaaaaaagaaaaag

SEQ ID NO: 3115432 - RNA, 20 nt, Human
cccugucucaaaaaaagaaa

SEQ ID NO: 3115433 - RNA, 15 nt, Human
ccucccaccucagcc

SEQ ID NO: 3115434 - RNA, 16 nt, Human
ccucccaucucacaca

SEQ ID NO: 3115435 - RNA, 13 nt, Human
ccucccaucucac

SEQ ID NO: 3115436 - RNA, 14 nt, Human
ccggccccugcugg

SEQ ID NO: 3115437 - RNA, 13 nt, Human
ccugcccaggccc

SEQ ID NO: 3115438 - RNA, 13 nt, Human
ccugcccaccugg

SEQ ID NO: 3115439 - RNA, 20 nt, Human
ccugcccaccuggccucugc

SEQ ID NO: 3115440 - RNA, 14 nt, Human
ccugcccaccuggc

SEQ ID NO: 3115441 - RNA, 12 nt, Human
ccugcccaccug

SEQ ID NO: 3115442 - RNA, 20 nt, Human
ccugcugcaguugccaguca

SEQ ID NO: 3115443 - RNA, 19 nt, Human
ccugccucgaacuggcugc

SEQ ID NO: 3115444 - RNA, 21 nt, Human
ccugccucgaacuggcugcaa

SEQ ID NO: 3115445 - RNA, 23 nt, Human
ccugccucgaacuggcugcaaag

SEQ ID NO: 3115446 - RNA, 19 nt, Human
ccugcugcaguugccaguc

SEQ ID NO: 3115447 - RNA, 17 nt, Human
ccugcugcaguugccag

SEQ ID NO: 3115448 - RNA, 18 nt, Human
ccugcacuugcagacucu

SEQ ID NO: 3115449 - RNA, 14 nt, Human
ccugcagagggcac

SEQ ID NO: 3115450 - RNA, 16 nt, Human
ccugcacuugcagacu

SEQ ID NO: 3115451 - RNA, 17 nt, Human
ccugcacuugcagacuc

SEQ ID NO: 3115452 - RNA, 13 nt, Human
ccucuuucccucc

SEQ ID NO: 3115453 - RNA, 11 nt, Human
ccucuuucccu

SEQ ID NO: 3115454 - RNA, 22 nt, Human
ccuggccucugcacuccccugc

SEQ ID NO: 3115455 - RNA, 21 nt, Human
ccuggccucugcacuccccug

SEQ ID NO: 3115456 - RNA, 20 nt, Human
ccuggccucugcacuccccu

SEQ ID NO: 3115457 - RNA, 22 nt, Human
ccuggccuagcauacguacaca

SEQ ID NO: 3115458 - RNA, 16 nt, Human
ccuggccucugcacuc

SEQ ID NO: 3115459 - RNA, 15 nt, Human
ccugucuaaugaaac

SEQ ID NO: 3115460 - RNA, 22 nt, Human
ccugucuaaugaaaccuguguc

SEQ ID NO: 3115461 - RNA, 21 nt, Human
ccugguggcagugggagcugc

SEQ ID NO: 3115462 - RNA, 20 nt, Human
cccucaacucuccuccagag

SEQ ID NO: 3115463 - RNA, 17 nt, Human
ccccuucugacccaugc

SEQ ID NO: 3115464 - RNA, 16 nt, Human
ccccuucugacccaug

SEQ ID NO: 3115465 - RNA, 12 nt, Human
cccggcugcgga

SEQ ID NO: 3115466 - RNA, 15 nt, Human
ccccauucugccugc

SEQ ID NO: 3115467 - RNA, 13 nt, Human
ccccauucugccu

SEQ ID NO: 3115468 - RNA, 14 nt, Human
ccccauucugccug

SEQ ID NO: 3115469 - RNA, 19 nt, Human
ccccuucgcuccugugucu

SEQ ID NO: 3115470 - RNA, 14 nt, Human
ccccuucgcuccug

SEQ ID NO: 3115471 - RNA, 15 nt, Human
ccccuucgcuccugu

SEQ ID NO: 3115472 - RNA, 17 nt, Human
ccccuucgcuccugugu

SEQ ID NO: 3115473 - RNA, 21 nt, Human
ccccagauugcaacaggcugg

SEQ ID NO: 3115474 - RNA, 22 nt, Human
ccccagauugcaacaggcuggg

SEQ ID NO: 3115475 - RNA, 23 nt, Human
ccccagauugcaacaggcugggc

SEQ ID NO: 3115476 - RNA, 17 nt, Human
ccccagcaagugagagc

SEQ ID NO: 3115477 - RNA, 19 nt, Human
ccccagcaagugagagcug

SEQ ID NO: 3115478 - RNA, 20 nt, Human
ccccagcaagugagagcugg

SEQ ID NO: 3115479 - RNA, 17 nt, Human
ccccauccucuguacag

SEQ ID NO: 3115480 - RNA, 22 nt, Human
ccccauccucuguacagagccc

SEQ ID NO: 3115481 - RNA, 21 nt, Human
ccccauccucuguacagagcc

SEQ ID NO: 3115482 - RNA, 19 nt, Human
ccccauccucuguacagag

SEQ ID NO: 3115483 - RNA, 20 nt, Human
cccauucugccugcccaggc

SEQ ID NO: 3115484 - RNA, 21 nt, Human
cccauucugccugcccaggcc

SEQ ID NO: 3115485 - RNA, 22 nt, Human
cccauucugccugcccaggccc

SEQ ID NO: 3115486 - RNA, 14 nt, Human
cccagcccacuucu

SEQ ID NO: 3115487 - RNA, 23 nt, Human
cccaggaaaggcuccaggagcag

SEQ ID NO: 3115488 - RNA, 22 nt, Human
cccaggaaaggcuccaggagca

SEQ ID NO: 3115489 - RNA, 21 nt, Human
cccaggaaaggcuccaggagc

SEQ ID NO: 3115490 - RNA, 21 nt, Human
cccagcugugcucuggacagg

SEQ ID NO: 3115491 - RNA, 23 nt, Human
cccagcugugcucuggacaggca

SEQ ID NO: 3115492 - RNA, 19 nt, Human
cccaggaaaggcuccagga

SEQ ID NO: 3115493 - RNA, 15 nt, Human
cccaggcuuagucac

SEQ ID NO: 3115494 - RNA, 21 nt, Human
cccaggcuggcgugcaguggu

SEQ ID NO: 3115495 - RNA, 14 nt, Human
ccaugggccuccug

SEQ ID NO: 3115496 - RNA, 15 nt, Human
ccaugggccuccugu

SEQ ID NO: 3115497 - RNA, 20 nt, Human
ccaucccaaacccuucagug

SEQ ID NO: 3115498 - RNA, 23 nt, Human
ccaucccaaacccuucagugcca

SEQ ID NO: 3115499 - RNA, 12 nt, Human
ccaucccagccc

SEQ ID NO: 3115500 - RNA, 14 nt, Human
ccaugagccucagc

SEQ ID NO: 3115501 - RNA, 18 nt, Human
ccaugagccucagcaucc

SEQ ID NO: 3115502 - RNA, 19 nt, Human
ccaugagccucagcauccu

SEQ ID NO: 3115503 - RNA, 13 nt, Human
ccaugaguccccu

SEQ ID NO: 3115504 - RNA, 13 nt, Human
ccaugggccuccu

SEQ ID NO: 3115505 - RNA, 16 nt, Human
ccaugaguccccuguu

SEQ ID NO: 3115506 - RNA, 15 nt, Human
ccaugaguccccugu

SEQ ID NO: 3115507 - RNA, 14 nt, Human
ccaugaguccccug

SEQ ID NO: 3115508 - RNA, 16 nt, Human
ccauccccuguagagu

SEQ ID NO: 3115509 - RNA, 20 nt, Human
ccaucccugaaggccccgcc

SEQ ID NO: 3115510 - RNA, 13 nt, Human
ccaugagccucag

SEQ ID NO: 3115511 - RNA, 19 nt, Human
ccagcagagcaccuuagac

SEQ ID NO: 3115512 - RNA, 23 nt, Human
ccagcagagcaccuuagacaguc

SEQ ID NO: 3115513 - RNA, 16 nt, Human
ccagcuuaucucaggg

SEQ ID NO: 3115514 - RNA, 21 nt, Human
ccaggaaaggcuccaggagca

SEQ ID NO: 3115515 - RNA, 23 nt, Human
ccaggaaaggcuccaggagcagc

SEQ ID NO: 3115516 - RNA, 22 nt, Human
ccaggaaaggcuccaggagcag

SEQ ID NO: 3115517 - RNA, 21 nt, Human
ccagccccuggaugcagccuc

SEQ ID NO: 3115518 - RNA, 10 nt, Human
ccagccccuu

SEQ ID NO: 3115519 - RNA, 14 nt, Human
ccagcagccuggac

SEQ ID NO: 3115520 - RNA, 15 nt, Human
ccagcagccuggacc

SEQ ID NO: 3115521 - RNA, 18 nt, Human
ccagccccuggaugcagc

SEQ ID NO: 3115522 - RNA, 19 nt, Human
ccagcagccuggacccugu

SEQ ID NO: 3115523 - RNA, 14 nt, Human
ccaggcugggagag

SEQ ID NO: 3115524 - RNA, 13 nt, Human
ccaggcugggaga

SEQ ID NO: 3115525 - RNA, 21 nt, Human
ccaggcugggagagccuucca

SEQ ID NO: 3115526 - RNA, 18 nt, Human
ccaggcugggagagccuu

SEQ ID NO: 3115527 - RNA, 17 nt, Human
ccaggcugggagagccu

SEQ ID NO: 3115528 - RNA, 15 nt, Human
ccaggcugggagagc

SEQ ID NO: 3115529 - RNA, 22 nt, Human
ccaggcugggagagccuuccag

SEQ ID NO: 3115530 - RNA, 19 nt, Human
ccaggcuggcgugcagugg

SEQ ID NO: 3115531 - RNA, 19 nt, Human
ccagucaccccggccaccu

SEQ ID NO: 3115532 - RNA, 21 nt, Human
ccagucaccccggccaccugc

SEQ ID NO: 3115533 - RNA, 20 nt, Human
ccagucaccccggccaccug

SEQ ID NO: 3115534 - RNA, 12 nt, Human
ccagucaccccg

SEQ ID NO: 3115535 - RNA, 14 nt, Human
auuuaaugaaagac

SEQ ID NO: 3115536 - RNA, 14 nt, Human
auuucuguuuagau

SEQ ID NO: 3115537 - RNA, 16 nt, Human
auuucuguuuagauaa

SEQ ID NO: 3115538 - RNA, 12 nt, Human
auuucuguuuag

SEQ ID NO: 3115539 - RNA, 19 nt, Human
auuguucuuaguuugcagu

SEQ ID NO: 3115540 - RNA, 16 nt, Human
auuguaaggaaugauu

SEQ ID NO: 3115541 - RNA, 15 nt, Human
auuguaaggaaugau

SEQ ID NO: 3115542 - RNA, 20 nt, Human
auucauauuuacuucuuaua

SEQ ID NO: 3115543 - RNA, 18 nt, Human
auucauauuuacuucuua

SEQ ID NO: 3115544 - RNA, 19 nt, Human
auucauauuuacuucuuau

SEQ ID NO: 3115545 - RNA, 14 nt, Human
auuaaauucuugca

SEQ ID NO: 3115546 - RNA, 18 nt, Human
auuaaauucuugcaaagu

SEQ ID NO: 3115547 - RNA, 20 nt, Human
auuaaauucuugcaaaguau

SEQ ID NO: 3115548 - RNA, 22 nt, Human
auucuuuccugaggcugggcuc

SEQ ID NO: 3115549 - RNA, 17 nt, Human
auucuuuccugaggcug

SEQ ID NO: 3115550 - RNA, 13 nt, Human
auucuuuccugag

SEQ ID NO: 3115551 - RNA, 21 nt, Human
auuccugaugcuucuucagag

SEQ ID NO: 3115552 - RNA, 19 nt, Human
auucucuccuguaccucuu

SEQ ID NO: 3115553 - RNA, 21 nt, Human
auucucuccuguaccucuuga

SEQ ID NO: 3115554 - RNA, 16 nt, Human
auucucuccuguaccu

SEQ ID NO: 3115555 - RNA, 20 nt, Human
caacaccuuguuucccucuc

SEQ ID NO: 3115556 - RNA, 22 nt, Human
caacaccucugcacaagcugca

SEQ ID NO: 3115557 - RNA, 20 nt, Human
caacaccucugcacaagcug

SEQ ID NO: 3115558 - RNA, 13 nt, Human
caaagaugcagcc

SEQ ID NO: 3115559 - RNA, 21 nt, Human
caaaguacacuguuucaaacu

SEQ ID NO: 3115560 - RNA, 16 nt, Human
caaaguacacuguuuc

SEQ ID NO: 3115561 - RNA, 20 nt, Human
caaaguacacuguuucaaac

SEQ ID NO: 3115562 - RNA, 17 nt, Human
caaaucagcugcuacua

SEQ ID NO: 3115563 - RNA, 23 nt, Human
caacaaaccuguuucugcagcca

SEQ ID NO: 3115564 - RNA, 18 nt, Human
caaccacugcgaccacaa

SEQ ID NO: 3115565 - RNA, 15 nt, Human
caacucaccccagcc

SEQ ID NO: 3115566 - RNA, 13 nt, Human
caacucaccccag

SEQ ID NO: 3115567 - RNA, 16 nt, Human
caacucaccccagccc

SEQ ID NO: 3115568 - RNA, 22 nt, Human
caagacccuuguggucccaccc

SEQ ID NO: 3115569 - RNA, 19 nt, Human
caagacccuugugguccca

SEQ ID NO: 3115570 - RNA, 18 nt, Human
caagacccuugugguccc

SEQ ID NO: 3115571 - RNA, 15 nt, Human
caacccccagccugc

SEQ ID NO: 3115572 - RNA, 16 nt, Human
caacccccagccugcu

SEQ ID NO: 3115573 - RNA, 17 nt, Human
caacccccagccugcua

SEQ ID NO: 3115574 - RNA, 14 nt, Human
auuuguuugaacug

SEQ ID NO: 3115575 - RNA, 16 nt, Human
auuuguuugaacugau

SEQ ID NO: 3115576 - RNA, 13 nt, Human
auuuguuugaacu

SEQ ID NO: 3115577 - RNA, 15 nt, Human
caaaagcugggcagg

SEQ ID NO: 3115578 - RNA, 12 nt, Human
auuuuuuuuucc

SEQ ID NO: 3115579 - RNA, 16 nt, Human
auuuuuuuuuccuuca

SEQ ID NO: 3115580 - RNA, 13 nt, Human
auuuuuuuuuccu

SEQ ID NO: 3115581 - RNA, 13 nt, Human
auuuuuaagugcu

SEQ ID NO: 3115582 - RNA, 14 nt, Human
cacaagccuucggc

SEQ ID NO: 3115583 - RNA, 16 nt, Human
cacaagacccuugugg

SEQ ID NO: 3115584 - RNA, 14 nt, Human
cacaagacccuugu

SEQ ID NO: 3115585 - RNA, 22 nt, Human
caaugcugugcccuaaagugua

SEQ ID NO: 3115586 - RNA, 22 nt, Human
caaugcuggcuguuggcugggg

SEQ ID NO: 3115587 - RNA, 23 nt, Human
caaugcuggcuguuggcuggggg

SEQ ID NO: 3115588 - RNA, 16 nt, Human
cacaucuugcucugcu

SEQ ID NO: 3115589 - RNA, 17 nt, Human
cacaucuugcucugcug

SEQ ID NO: 3115590 - RNA, 22 nt, Human
cacaucagcacgauuucuguuu

SEQ ID NO: 3115591 - RNA, 19 nt, Human
cacaucagcacgauuucug

SEQ ID NO: 3115592 - RNA, 20 nt, Human
cacaucagcacgauuucugu

SEQ ID NO: 3115593 - RNA, 21 nt, Human
cacaucagcacgauuucuguu

SEQ ID NO: 3115594 - RNA, 18 nt, Human
cacaucuugcucugcuga

SEQ ID NO: 3115595 - RNA, 15 nt, Human
cacauuuuauuuuau

SEQ ID NO: 3115596 - RNA, 21 nt, Human
cacauuuuauuuuauuaugca

SEQ ID NO: 3115597 - RNA, 17 nt, Human
caccaacauacucccau

SEQ ID NO: 3115598 - RNA, 21 nt, Human
caccaacauacucccaucugu

SEQ ID NO: 3115599 - RNA, 20 nt, Human
caccaacauacucccaucug

SEQ ID NO: 3115600 - RNA, 13 nt, Human
cacauuuuucuua

SEQ ID NO: 3115601 - RNA, 14 nt, Human
cacauuuuucuuag

SEQ ID NO: 3115602 - RNA, 17 nt, Human
cacauuuuuuaaaugca

SEQ ID NO: 3115603 - RNA, 21 nt, Human
cacauuuuuuaaaugcaccug

SEQ ID NO: 3115604 - RNA, 24 nt, Human
cacccaggagccccgaggccuucu

SEQ ID NO: 3115605 - RNA, 19 nt, Human
cacccagcccacuucugcc

SEQ ID NO: 3115606 - RNA, 20 nt, Human
cacccaggagccccgaggcc

SEQ ID NO: 3115607 - RNA, 23 nt, Human
cacccaggagccccgaggccuuc

SEQ ID NO: 3115608 - RNA, 21 nt, Human
caccagcccuuagcagggaaa

SEQ ID NO: 3115609 - RNA, 15 nt, Human
caccagcagccugga

SEQ ID NO: 3115610 - RNA, 12 nt, Human
caccagcagccu

SEQ ID NO: 3115611 - RNA, 14 nt, Human
caccagcagccugg

SEQ ID NO: 3115612 - RNA, 23 nt, Human
caccaacauacucccaucuguga

SEQ ID NO: 3115613 - RNA, 16 nt, Human
cacccagcccacuucu

SEQ ID NO: 3115614 - RNA, 17 nt, Human
cacccagcccacuucug

SEQ ID NO: 3115615 - RNA, 22 nt, Human
cacagcuaacauggaaguacua

SEQ ID NO: 3115616 - RNA, 20 nt, Human
cacagcucuguccugggagu

SEQ ID NO: 3115617 - RNA, 23 nt, Human
cacagcucuguccugggagugag

SEQ ID NO: 3115618 - RNA, 19 nt, Human
cacagcucuguccugggag

SEQ ID NO: 3115619 - RNA, 18 nt, Human
cacagacccugcccugug

SEQ ID NO: 3115620 - RNA, 16 nt, Human
cacagcuaacauggaa

SEQ ID NO: 3115621 - RNA, 15 nt, Human
cacagcuaacaugga

SEQ ID NO: 3115622 - RNA, 19 nt, Human
cacagacccugcccugugg

SEQ ID NO: 3115623 - RNA, 21 nt, Human
cacagacccugcccugugggc

SEQ ID NO: 3115624 - RNA, 20 nt, Human
cacagacccugcccuguggg

SEQ ID NO: 3115625 - RNA, 16 nt, Human
cacaguauuacuucug

SEQ ID NO: 3115626 - RNA, 18 nt, Human
cacaguauuacuucugcu

SEQ ID NO: 3115627 - RNA, 19 nt, Human
cacuguuucaaacuuuacu

SEQ ID NO: 3115628 - RNA, 14 nt, Human
cacuguugcccagg

SEQ ID NO: 3115629 - RNA, 15 nt, Human
cacuguugcccaggc

SEQ ID NO: 3115630 - RNA, 16 nt, Human
cacuguugcccaggcu

SEQ ID NO: 3115631 - RNA, 17 nt, Human
cacuggugacaugucuu

SEQ ID NO: 3115632 - RNA, 20 nt, Human
cacugggcuuggggaccaga

SEQ ID NO: 3115633 - RNA, 22 nt, Human
cacugggcuuggggaccagagc

SEQ ID NO: 3115634 - RNA, 23 nt, Human
cacugggcuuggggaccagagcu

SEQ ID NO: 3115635 - RNA, 19 nt, Human
cagaaguuucugccgcagc

SEQ ID NO: 3115636 - RNA, 17 nt, Human
cagaaauguguuaucac

SEQ ID NO: 3115637 - RNA, 21 nt, Human
cagaaguuucugccgcagccc

SEQ ID NO: 3115638 - RNA, 20 nt, Human
cagaaguuucugccgcagcc

SEQ ID NO: 3115639 - RNA, 22 nt, Human
cagaaguuucugccgcagcccu

SEQ ID NO: 3115640 - RNA, 23 nt, Human
cagaaguuugagaucagccuggg

SEQ ID NO: 3115641 - RNA, 18 nt, Human
caccuugacagggcacac

SEQ ID NO: 3115642 - RNA, 19 nt, Human
caccuugacagggcacacc

SEQ ID NO: 3115643 - RNA, 17 nt, Human
caccugccagggacaga

SEQ ID NO: 3115644 - RNA, 13 nt, Human
caccuuggcucaa

SEQ ID NO: 3115645 - RNA, 14 nt, Human
caccuuugaagaag

SEQ ID NO: 3115646 - RNA, 15 nt, Human
caccuuuguccccac

SEQ ID NO: 3115647 - RNA, 14 nt, Human
caccuuugucccca

SEQ ID NO: 3115648 - RNA, 13 nt, Human
caccugccaggga

SEQ ID NO: 3115649 - RNA, 16 nt, Human
caccugccagggacag

SEQ ID NO: 3115650 - RNA, 14 nt, Human
caccugccagggac

SEQ ID NO: 3115651 - RNA, 20 nt, Human
cacggagggugacgggggug

SEQ ID NO: 3115652 - RNA, 14 nt, Human
cacggccaggccag

SEQ ID NO: 3115653 - RNA, 15 nt, Human
cacggccaggccaga

SEQ ID NO: 3115654 - RNA, 16 nt, Human
cacggccaggccagag

SEQ ID NO: 3115655 - RNA, 23 nt, Human
cacuacggaauaguuggcuagga

SEQ ID NO: 3115656 - RNA, 17 nt, Human
cacucuuauugcccacg

SEQ ID NO: 3115657 - RNA, 18 nt, Human
cacucuuauugcccacgc

SEQ ID NO: 3115658 - RNA, 19 nt, Human
cacucuuauugcccacgcu

SEQ ID NO: 3115659 - RNA, 18 nt, Human
cagcggggacagcuccuu

SEQ ID NO: 3115660 - RNA, 19 nt, Human
cagcggggacagcuccuuc

SEQ ID NO: 3115661 - RNA, 21 nt, Human
cagcggggacagcuccuucug

SEQ ID NO: 3115662 - RNA, 19 nt, Human
cagccugcuaauuccccag

SEQ ID NO: 3115663 - RNA, 12 nt, Human
cagccugcucca

SEQ ID NO: 3115664 - RNA, 19 nt, Human
cagccgagauagccaaggc

SEQ ID NO: 3115665 - RNA, 17 nt, Human
cagccucugaaaaccaa

SEQ ID NO: 3115666 - RNA, 18 nt, Human
caggaaaagcugcugaca

SEQ ID NO: 3115667 - RNA, 15 nt, Human
caggaaaagcugcug

SEQ ID NO: 3115668 - RNA, 16 nt, Human
caggaaaagcugcuga

SEQ ID NO: 3115669 - RNA, 19 nt, Human
cagcugagggugagugggu

SEQ ID NO: 3115670 - RNA, 12 nt, Human
cagcugccuggg

SEQ ID NO: 3115671 - RNA, 14 nt, Human
cagcugccugggau

SEQ ID NO: 3115672 - RNA, 13 nt, Human
cagcugccuggga

SEQ ID NO: 3115673 - RNA, 19 nt, Human
cagcugugcucuggacagg

SEQ ID NO: 3115674 - RNA, 20 nt, Human
cagcugugcucuggacaggc

SEQ ID NO: 3115675 - RNA, 24 nt, Human
cagcugugcucuggacaggcaugu

SEQ ID NO: 3115676 - RNA, 19 nt, Human
cagcuguucagcugguuga

SEQ ID NO: 3115677 - RNA, 19 nt, Human
cagauucuuuccugaggcu

SEQ ID NO: 3115678 - RNA, 18 nt, Human
cagauucuuuccugaggc

SEQ ID NO: 3115679 - RNA, 17 nt, Human
cagauucuuuccugagg

SEQ ID NO: 3115680 - RNA, 15 nt, Human
cagauucuuuccuga

SEQ ID NO: 3115681 - RNA, 23 nt, Human
cagaggggguggccucccaacuc

SEQ ID NO: 3115682 - RNA, 22 nt, Human
cagaggggguggccucccaacu

SEQ ID NO: 3115683 - RNA, 20 nt, Human
cagcaucauggagguuugaa

SEQ ID NO: 3115684 - RNA, 17 nt, Human
cagauugcaacaggcug

SEQ ID NO: 3115685 - RNA, 22 nt, Human
cagauucuuuccugaggcuggg

SEQ ID NO: 3115686 - RNA, 20 nt, Human
cagauucuuuccugaggcug

SEQ ID NO: 3115687 - RNA, 16 nt, Human
cagcacgauuucuguu

SEQ ID NO: 3115688 - RNA, 18 nt, Human
cagcacgauuucuguuua

SEQ ID NO: 3115689 - RNA, 19 nt, Human
cagcacgauuucuguuuag

SEQ ID NO: 3115690 - RNA, 14 nt, Human
cagugcaugcuguc

SEQ ID NO: 3115691 - RNA, 13 nt, Human
cagugcaugcugu

SEQ ID NO: 3115692 - RNA, 15 nt, Human
cagucuggaaugcag

SEQ ID NO: 3115693 - RNA, 17 nt, Human
cagucuggaaugcagug

SEQ ID NO: 3115694 - RNA, 13 nt, Human
cagugcccacagg

SEQ ID NO: 3115695 - RNA, 15 nt, Human
cagugcccacaggau

SEQ ID NO: 3115696 - RNA, 17 nt, Human
cagugcaugcugucccu

SEQ ID NO: 3115697 - RNA, 16 nt, Human
cagugcaugcuguccc

SEQ ID NO: 3115698 - RNA, 17 nt, Human
cagugcccacaggauca

SEQ ID NO: 3115699 - RNA, 20 nt, Human
cagugggagcugccuguuca

SEQ ID NO: 3115700 - RNA, 23 nt, Human
cagugggagcugccuguucagcu

SEQ ID NO: 3115701 - RNA, 20 nt, Human
caguggugcgaucuggguuc

SEQ ID NO: 3115702 - RNA, 21 nt, Human
caguggugcgaucuggguuca

SEQ ID NO: 3115703 - RNA, 18 nt, Human
caguggugguuuucuguu

SEQ ID NO: 3115704 - RNA, 15 nt, Human
caggugcacaagcuc

SEQ ID NO: 3115705 - RNA, 22 nt, Human
caggugauccacccaccucagc

SEQ ID NO: 3115706 - RNA, 23 nt, Human
caggugauccacccaccucagcc

SEQ ID NO: 3115707 - RNA, 20 nt, Human
caggugcacaagcuccaagc

SEQ ID NO: 3115708 - RNA, 19 nt, Human
caggugcacaagcuccaag

SEQ ID NO: 3115709 - RNA, 18 nt, Human
caggugcacaagcuccaa

SEQ ID NO: 3115710 - RNA, 17 nt, Human
caggugcacaagcucca

SEQ ID NO: 3115711 - RNA, 21 nt, Human
caggugauccacccaccucag

SEQ ID NO: 3115712 - RNA, 20 nt, Human
caggugauccacccaccuca

SEQ ID NO: 3115713 - RNA, 21 nt, Human
cagguuggugggggccucggu

SEQ ID NO: 3115714 - RNA, 21 nt, Human
caggugcacaagcuccaagcu

SEQ ID NO: 3115715 - RNA, 12 nt, Human
cagguuuuccug

SEQ ID NO: 3115716 - RNA, 14 nt, Human
cagguuuaagcugu

SEQ ID NO: 3115717 - RNA, 16 nt, Human
cagguuuuccugaaga

SEQ ID NO: 3115718 - RNA, 18 nt, Human
caggcagauacaggaaaa

SEQ ID NO: 3115719 - RNA, 13 nt, Human
caggccagaggga

SEQ ID NO: 3115720 - RNA, 15 nt, Human
caggccagagggagu

SEQ ID NO: 3115721 - RNA, 23 nt, Human
caggccagcugcuugggcuucau

SEQ ID NO: 3115722 - RNA, 21 nt, Human
caggccagcugcuugggcuuc

SEQ ID NO: 3115723 - RNA, 19 nt, Human
caggccagcugcuugggcu

SEQ ID NO: 3115724 - RNA, 17 nt, Human
caggccagcugcuuggg

SEQ ID NO: 3115725 - RNA, 18 nt, Human
caggccaggcccucugcc

SEQ ID NO: 3115726 - RNA, 17 nt, Human
caggccaggcccucugc

SEQ ID NO: 3115727 - RNA, 19 nt, Human
caggccaggcccucugccc

SEQ ID NO: 3115728 - RNA, 21 nt, Human
caggcugggcuucaguggcag

SEQ ID NO: 3115729 - RNA, 22 nt, Human
caggcugggcuucaguggcagc

SEQ ID NO: 3115730 - RNA, 20 nt, Human
caggcugggcuucaguggca

SEQ ID NO: 3115731 - RNA, 14 nt, Human
caggcugggagagc

SEQ ID NO: 3115732 - RNA, 12 nt, Human
caggcugggaga

SEQ ID NO: 3115733 - RNA, 21 nt, Human
cagggcucagcggggacagcu

SEQ ID NO: 3115734 - RNA, 23 nt, Human
cagggcucagcggggacagcucc

SEQ ID NO: 3115735 - RNA, 20 nt, Human
cagggcucagcggggacagc

SEQ ID NO: 3115736 - RNA, 20 nt, Human
caggggaaaaucagccugcu

SEQ ID NO: 3115737 - RNA, 17 nt, Human
caggggaaaaucagccu

SEQ ID NO: 3115738 - RNA, 19 nt, Human
caggggaaaaucagccugc

SEQ ID NO: 3115739 - RNA, 14 nt, Human
ccaccaucaagcca

SEQ ID NO: 3115740 - RNA, 13 nt, Human
ccaccaucaagcc

SEQ ID NO: 3115741 - RNA, 17 nt, Human
ccaccacacccagccca

SEQ ID NO: 3115742 - RNA, 13 nt, Human
ccacgcccccacu

SEQ ID NO: 3115743 - RNA, 19 nt, Human
ccacgcccccacuggugac

SEQ ID NO: 3115744 - RNA, 18 nt, Human
ccacgcccccacugguga

SEQ ID NO: 3115745 - RNA, 17 nt, Human
ccacgcccccacuggug

SEQ ID NO: 3115746 - RNA, 16 nt, Human
ccacgcccccacuggu

SEQ ID NO: 3115747 - RNA, 19 nt, Human
ccaccgcagacaggaccag

SEQ ID NO: 3115748 - RNA, 22 nt, Human
ccaccgcagacaggaccaggga

SEQ ID NO: 3115749 - RNA, 21 nt, Human
ccaccuuugaagaaguaagga

SEQ ID NO: 3115750 - RNA, 17 nt, Human
ccacucccugcaaccug

SEQ ID NO: 3115751 - RNA, 21 nt, Human
ccaaaacucuccucugcugcu

SEQ ID NO: 3115752 - RNA, 20 nt, Human
ccaaaacucuccucugcugc

SEQ ID NO: 3115753 - RNA, 17 nt, Human
ccaauauuuaccagacc

SEQ ID NO: 3115754 - RNA, 15 nt, Human
ccaaugauggucacc

SEQ ID NO: 3115755 - RNA, 14 nt, Human
ccaaugcacuuugu

SEQ ID NO: 3115756 - RNA, 18 nt, Human
ccaagcucugcuccucuc

SEQ ID NO: 3115757 - RNA, 12 nt, Human
ccaagcucugcu

SEQ ID NO: 3115758 - RNA, 17 nt, Human
ccaagcucugcuccucu

SEQ ID NO: 3115759 - RNA, 13 nt, Human
ccaagcucugcuc

SEQ ID NO: 3115760 - RNA, 18 nt, Human
ccaacucaccccagcccc

SEQ ID NO: 3115761 - RNA, 17 nt, Human
ccaacucaccccagccc

SEQ ID NO: 3115762 - RNA, 16 nt, Human
ccaacucaccccagcc

SEQ ID NO: 3115763 - RNA, 14 nt, Human
ccaacucaccccag

SEQ ID NO: 3115764 - RNA, 23 nt, Human
ccaaauggaaaugggcagagcag

SEQ ID NO: 3115765 - RNA, 14 nt, Human
ccaaugggagcuca

SEQ ID NO: 3115766 - RNA, 17 nt, Human
ccaaugggagcucaugg

SEQ ID NO: 3115767 - RNA, 22 nt, Human
cauccuggcacccggccccugc

SEQ ID NO: 3115768 - RNA, 21 nt, Human
cauccccuguagagugggagc

SEQ ID NO: 3115769 - RNA, 12 nt, Human
caucacuucccu

SEQ ID NO: 3115770 - RNA, 14 nt, Human
caucacuucccuac

SEQ ID NO: 3115771 - RNA, 15 nt, Human
cauccuggcacccgg

SEQ ID NO: 3115772 - RNA, 22 nt, Human
cauauucaggaagcucagggcc

SEQ ID NO: 3115773 - RNA, 17 nt, Human
cauauucuguuggccag

SEQ ID NO: 3115774 - RNA, 19 nt, Human
caguggugguuuucuguuc

SEQ ID NO: 3115775 - RNA, 20 nt, Human
caguggugguuuucuguucu

SEQ ID NO: 3115776 - RNA, 21 nt, Human
caguggugguuuucuguucuu

SEQ ID NO: 3115777 - RNA, 22 nt, Human
caguggugguuuucuguucuuu

SEQ ID NO: 3115778 - RNA, 13 nt, Human
cauucuccaccug

SEQ ID NO: 3115779 - RNA, 16 nt, Human
cauucuccaccugcca

SEQ ID NO: 3115780 - RNA, 14 nt, Human
cauucuccaccugc

SEQ ID NO: 3115781 - RNA, 19 nt, Human
cauguuggccaggcugguc

SEQ ID NO: 3115782 - RNA, 16 nt, Human
cauguuggccaggcug

SEQ ID NO: 3115783 - RNA, 14 nt, Human
cauguuggccaggc

SEQ ID NO: 3115784 - RNA, 15 nt, Human
cauguuggccaggcu

SEQ ID NO: 3115785 - RNA, 13 nt, Human
caugauguuuucc

SEQ ID NO: 3115786 - RNA, 14 nt, Human
caugcuacacacug

SEQ ID NO: 3115787 - RNA, 20 nt, Human
caugcuacacacugcauguu

SEQ ID NO: 3115788 - RNA, 23 nt, Human
caugcuacacacugcauguuugu

SEQ ID NO: 3115789 - RNA, 20 nt, Human
caugcuccuggcccacugca

SEQ ID NO: 3115790 - RNA, 17 nt, Human
caugggaaugaauguca

SEQ ID NO: 3115791 - RNA, 16 nt, Human
caugggaaugaauguc

SEQ ID NO: 3115792 - RNA, 15 nt, Human
caugggaaugaaugu

SEQ ID NO: 3115793 - RNA, 14 nt, Human
caugggaaugaaug

SEQ ID NO: 3115794 - RNA, 13 nt, Human
cugcccugugagu

SEQ ID NO: 3115795 - RNA, 24 nt, Human
cugcccugugaguacuacaguccu

SEQ ID NO: 3115796 - RNA, 23 nt, Human
cugcccuuaccugccaggaagcc

SEQ ID NO: 3115797 - RNA, 22 nt, Human
cugcccuuaccugccaggaagc

SEQ ID NO: 3115798 - RNA, 11 nt, Human
cugcccugugg

SEQ ID NO: 3115799 - RNA, 12 nt, Human
cugcccuguggg

SEQ ID NO: 3115800 - RNA, 19 nt, Human
cugcccuuaccugccagga

SEQ ID NO: 3115801 - RNA, 14 nt, Human
cugccuccuuugug

SEQ ID NO: 3115802 - RNA, 14 nt, Human
cugccucgaacugg

SEQ ID NO: 3115803 - RNA, 23 nt, Human
cugccuccuuugugaggaagccg

SEQ ID NO: 3115804 - RNA, 21 nt, Human
cugccuccuuugugaggaagc

SEQ ID NO: 3115805 - RNA, 17 nt, Human
cugccuccuuugugagg

SEQ ID NO: 3115806 - RNA, 19 nt, Human
cugccucgaacuggcugca

SEQ ID NO: 3115807 - RNA, 20 nt, Human
cugccucgaacuggcugcaa

SEQ ID NO: 3115808 - RNA, 20 nt, Human
cugccuguucagcuccagcu

SEQ ID NO: 3115809 - RNA, 23 nt, Human
cugccuguucagcuccagcucac

SEQ ID NO: 3115810 - RNA, 17 nt, Human
cugcuaucaaagagguu

SEQ ID NO: 3115811 - RNA, 18 nt, Human
cugcugaaggcucgagca

SEQ ID NO: 3115812 - RNA, 23 nt, Human
cugcugaaggcucgagcaugccu

SEQ ID NO: 3115813 - RNA, 24 nt, Human
cugcugaaggcucgagcaugccug

SEQ ID NO: 3115814 - RNA, 13 nt, Human
cuggcucuuccag

SEQ ID NO: 3115815 - RNA, 15 nt, Human
cuggcucuuccaggc

SEQ ID NO: 3115816 - RNA, 14 nt, Human
cuggcucuuccagg

SEQ ID NO: 3115817 - RNA, 16 nt, Human
cugggacuacaggcac

SEQ ID NO: 3115818 - RNA, 17 nt, Human
cugggacuacaggcacc

SEQ ID NO: 3115819 - RNA, 21 nt, Human
cugggacuacaggcacccacc

SEQ ID NO: 3115820 - RNA, 17 nt, Human
cugggacuacaggugug

SEQ ID NO: 3115821 - RNA, 16 nt, Human
cuggcagcucagagag

SEQ ID NO: 3115822 - RNA, 19 nt, Human
cuggcagcucagagagggu

SEQ ID NO: 3115823 - RNA, 17 nt, Human
cuggcagcucagagagg

SEQ ID NO: 3115824 - RNA, 15 nt, Human
cuggcagcucagaga

SEQ ID NO: 3115825 - RNA, 19 nt, Human
cuggcagaguugaagacag

SEQ ID NO: 3115826 - RNA, 21 nt, Human
cuggcagaguugaagacagag

SEQ ID NO: 3115827 - RNA, 20 nt, Human
cuggcagaguugaagacaga

SEQ ID NO: 3115828 - RNA, 23 nt, Human
cuggcagccccuguucuggcaga

SEQ ID NO: 3115829 - RNA, 22 nt, Human
cuggcagaguugaagacagagc

SEQ ID NO: 3115830 - RNA, 13 nt, Human
cuggcagccccug

SEQ ID NO: 3115831 - RNA, 23 nt, Human
cugcuucagccucccgaguagcu

SEQ ID NO: 3115832 - RNA, 14 nt, Human
cugcuuccagugag

SEQ ID NO: 3115833 - RNA, 16 nt, Human
cugcuucaaggauccu

SEQ ID NO: 3115834 - RNA, 14 nt, Human
cugcuucaaggauc

SEQ ID NO: 3115835 - RNA, 13 nt, Human
cugcuucaaggau

SEQ ID NO: 3115836 - RNA, 19 nt, Human
cugcuucaaggauccugag

SEQ ID NO: 3115837 - RNA, 21 nt, Human
cuggagaaaauggacguguua

SEQ ID NO: 3115838 - RNA, 14 nt, Human
cuggagaaaaugga

SEQ ID NO: 3115839 - RNA, 15 nt, Human
cuggaugcagccuca

SEQ ID NO: 3115840 - RNA, 18 nt, Human
cuggaugcagccucacag

SEQ ID NO: 3115841 - RNA, 17 nt, Human
cuggaugcagccucaca

SEQ ID NO: 3115842 - RNA, 16 nt, Human
cuggaugcagccucac

SEQ ID NO: 3115843 - RNA, 12 nt, Human
cuguucagcugg

SEQ ID NO: 3115844 - RNA, 16 nt, Human
cuguucagcuccagcu

SEQ ID NO: 3115845 - RNA, 18 nt, Human
cuguucagcuccagcuca

SEQ ID NO: 3115846 - RNA, 19 nt, Human
cuguucagcuccagcucac

SEQ ID NO: 3115847 - RNA, 22 nt, Human
cuguucagcuccagcucaccag

SEQ ID NO: 3115848 - RNA, 14 nt, Human
cuguucagcuccag

SEQ ID NO: 3115849 - RNA, 15 nt, Human
cuguucagcuccagc

SEQ ID NO: 3115850 - RNA, 18 nt, Human
cugugcucuggacaggca

SEQ ID NO: 3115851 - RNA, 22 nt, Human
cugugucagguggggcagcuug

SEQ ID NO: 3115852 - RNA, 17 nt, Human
cuguuacugucuucagu

SEQ ID NO: 3115853 - RNA, 13 nt, Human
cuguuacugucuu

SEQ ID NO: 3115854 - RNA, 17 nt, Human
cugugcucuggacaggc

SEQ ID NO: 3115855 - RNA, 15 nt, Human
cugugcucuggacag

SEQ ID NO: 3115856 - RNA, 18 nt, Human
cuguugcccaggcuggcg

SEQ ID NO: 3115857 - RNA, 12 nt, Human
cuguuggccagu

SEQ ID NO: 3115858 - RNA, 13 nt, Human
cuuaaauaaugug

SEQ ID NO: 3115859 - RNA, 14 nt, Human
cuuaaauaauguga

SEQ ID NO: 3115860 - RNA, 16 nt, Human
cuuaaauaaugugaaa

SEQ ID NO: 3115861 - RNA, 19 nt, Human
cuuaaauaaugugaaacug

SEQ ID NO: 3115862 - RNA, 22 nt, Human
cuggugacaugucuuuucuugc

SEQ ID NO: 3115863 - RNA, 15 nt, Human
cuguagagugggagc

SEQ ID NO: 3115864 - RNA, 22 nt, Human
cugucuaaugaaaccugugucu

SEQ ID NO: 3115865 - RNA, 20 nt, Human
cuguccugggagugagcugg

SEQ ID NO: 3115866 - RNA, 13 nt, Human
cuguccugggagu

SEQ ID NO: 3115867 - RNA, 14 nt, Human
cuguccugggagug

SEQ ID NO: 3115868 - RNA, 14 nt, Human
cugucauuugagca

SEQ ID NO: 3115869 - RNA, 18 nt, Human
cuuuugccguuauuaaaa

SEQ ID NO: 3115870 - RNA, 16 nt, Human
cuuuugccguuauuaa

SEQ ID NO: 3115871 - RNA, 15 nt, Human
cuuuuggucugugug

SEQ ID NO: 3115872 - RNA, 16 nt, Human
cuuuuggucuguguga

SEQ ID NO: 3115873 - RNA, 17 nt, Human
cuuuugucuaugggacu

SEQ ID NO: 3115874 - RNA, 14 nt, Human
cuuuugugcauuau

SEQ ID NO: 3115875 - RNA, 18 nt, Human
cuuuugugcauuaucuag

SEQ ID NO: 3115876 - RNA, 21 nt, Human
cuuuuuuuuuuuuuuugacaa

SEQ ID NO: 3115877 - RNA, 19 nt, Human
gaaaaaauauuuuccugcc

SEQ ID NO: 3115878 - RNA, 18 nt, Human
gaaaauuuugauguuuua

SEQ ID NO: 3115879 - RNA, 14 nt, Human
gaaaauuuuaaaaa

SEQ ID NO: 3115880 - RNA, 18 nt, Human
gaaagacuaucuaaaugu

SEQ ID NO: 3115881 - RNA, 16 nt, Human
gaaaggcuccaggagc

SEQ ID NO: 3115882 - RNA, 19 nt, Human
gaaaggcuccaggagcagc

SEQ ID NO: 3115883 - RNA, 18 nt, Human
gaaaggcuccaggagcag

SEQ ID NO: 3115884 - RNA, 17 nt, Human
gaaaggcuccaggagca

SEQ ID NO: 3115885 - RNA, 21 nt, Human
gaaaguacuucuccacccugc

SEQ ID NO: 3115886 - RNA, 18 nt, Human
gaaauuuuuauuaaauua

SEQ ID NO: 3115887 - RNA, 17 nt, Human
gaaaucaccgaaaacgu

SEQ ID NO: 3115888 - RNA, 19 nt, Human
gaaauuuuuauuaaauuau

SEQ ID NO: 3115889 - RNA, 21 nt, Human
gaacaaggcaaggcugucaau

SEQ ID NO: 3115890 - RNA, 18 nt, Human
gaacaaggcaaggcuguc

SEQ ID NO: 3115891 - RNA, 17 nt, Human
gaacaaggcaaggcugu

SEQ ID NO: 3115892 - RNA, 15 nt, Human
gaacaaggcaaggcu

SEQ ID NO: 3115893 - RNA, 14 nt, Human
gaacaaggcaaggc

SEQ ID NO: 3115894 - RNA, 12 nt, Human
cuugauucauaa

SEQ ID NO: 3115895 - RNA, 19 nt, Human
cuugauucauaaugacuua

SEQ ID NO: 3115896 - RNA, 18 nt, Human
cuugccgucuaccugagg

SEQ ID NO: 3115897 - RNA, 22 nt, Human
cuuggcgcugccccuggcagcc

SEQ ID NO: 3115898 - RNA, 21 nt, Human
cuuggcgcugccccuggcagc

SEQ ID NO: 3115899 - RNA, 23 nt, Human
cuuggcgcugccccuggcagccc

SEQ ID NO: 3115900 - RNA, 20 nt, Human
cuuggcgcugccccuggcag

SEQ ID NO: 3115901 - RNA, 14 nt, Human
cuuggauugucccc

SEQ ID NO: 3115902 - RNA, 20 nt, Human
cuuggauuguccccgacccu

SEQ ID NO: 3115903 - RNA, 18 nt, Human
cuuggauuguccccgacc

SEQ ID NO: 3115904 - RNA, 15 nt, Human
cuuggauuguccccg

SEQ ID NO: 3115905 - RNA, 15 nt, Human
cuugguccugcugca

SEQ ID NO: 3115906 - RNA, 20 nt, Human
cuugguccugcugcaguugc

SEQ ID NO: 3115907 - RNA, 18 nt, Human
cuugguccugcugcaguu

SEQ ID NO: 3115908 - RNA, 17 nt, Human
cuugguccugcugcagu

SEQ ID NO: 3115909 - RNA, 16 nt, Human
cuugguccugcugcag

SEQ ID NO: 3115910 - RNA, 13 nt, Human
cuugucuguagau

SEQ ID NO: 3115911 - RNA, 20 nt, Human
cuugucuuuggacccugagg

SEQ ID NO: 3115912 - RNA, 19 nt, Human
cuugucuuuggacccugag

SEQ ID NO: 3115913 - RNA, 20 nt, Human
cuuggugucgggcaugacac

SEQ ID NO: 3115914 - RNA, 22 nt, Human
cuugguccugcugcaguugcca

SEQ ID NO: 3115915 - RNA, 20 nt, Human
cuugguucccauuugcuccu

SEQ ID NO: 3115916 - RNA, 16 nt, Human
cuugguucccauuugc

SEQ ID NO: 3115917 - RNA, 17 nt, Human
cuuucaauaggaaaaac

SEQ ID NO: 3115918 - RNA, 22 nt, Human
cuugucuuuggacccugaggcc

SEQ ID NO: 3115919 - RNA, 21 nt, Human
cuugucuuuggacccugaggc

SEQ ID NO: 3115920 - RNA, 22 nt, Human
cuuuaaugucacaggcaggucc

SEQ ID NO: 3115921 - RNA, 15 nt, Human
cuuucaauaggaaaa

SEQ ID NO: 3115922 - RNA, 14 nt, Human
cuuucaauaggaaa

SEQ ID NO: 3115923 - RNA, 17 nt, Human
cuuuaaugucacaggca

SEQ ID NO: 3115924 - RNA, 18 nt, Human
cuuuaaugucacaggcag

SEQ ID NO: 3115925 - RNA, 19 nt, Human
cuuuaaugucacaggcagg

SEQ ID NO: 3115926 - RNA, 20 nt, Human
cuuuaaugucacaggcaggu

SEQ ID NO: 3115927 - RNA, 12 nt, Human
cuuccucccucc

SEQ ID NO: 3115928 - RNA, 13 nt, Human
cuuccucccuccc

SEQ ID NO: 3115929 - RNA, 14 nt, Human
cuuccucccucccu

SEQ ID NO: 3115930 - RNA, 19 nt, Human
cuucugaacuuggcgcugc

SEQ ID NO: 3115931 - RNA, 22 nt, Human
cuucugaacuuggcgcugcccc

SEQ ID NO: 3115932 - RNA, 15 nt, Human
cuucugacccaugcu

SEQ ID NO: 3115933 - RNA, 13 nt, Human
cuucuuauacauu

SEQ ID NO: 3115934 - RNA, 16 nt, Human
cuucuuauacauuuga

SEQ ID NO: 3115935 - RNA, 17 nt, Human
cuucugacccaugcugc

SEQ ID NO: 3115936 - RNA, 16 nt, Human
cuucugacccaugcug

SEQ ID NO: 3115937 - RNA, 18 nt, Human
cuucugacccaugcugcc

SEQ ID NO: 3115938 - RNA, 17 nt, Human
gacacagcucuucucca

SEQ ID NO: 3115939 - RNA, 21 nt, Human
gacacagcucuucuccaggcu

SEQ ID NO: 3115940 - RNA, 12 nt, Human
gacacagcucuu

SEQ ID NO: 3115941 - RNA, 19 nt, Human
gacacagcucuucuccagg

SEQ ID NO: 3115942 - RNA, 20 nt, Human
gacacagcucuucuccaggc

SEQ ID NO: 3115943 - RNA, 18 nt, Human
gaauguuugccucugccu

SEQ ID NO: 3115944 - RNA, 19 nt, Human
gaauguuugccucugccuc

SEQ ID NO: 3115945 - RNA, 14 nt, Human
gaaugauuaauuaa

SEQ ID NO: 3115946 - RNA, 14 nt, Human
gaaugaugccauga

SEQ ID NO: 3115947 - RNA, 20 nt, Human
gaaugaugauccuaggcauu

SEQ ID NO: 3115948 - RNA, 15 nt, Human
gaauguuugccucug

SEQ ID NO: 3115949 - RNA, 19 nt, Human
gaaugcacaaacagaggcc

SEQ ID NO: 3115950 - RNA, 16 nt, Human
gaauguuugccucugc

SEQ ID NO: 3115951 - RNA, 17 nt, Human
gaauguuugccucugcc

SEQ ID NO: 3115952 - RNA, 18 nt, Human
gaaugcacaaacagaggc

SEQ ID NO: 3115953 - RNA, 23 nt, Human
gaauauugcugauggugcaauga

SEQ ID NO: 3115954 - RNA, 22 nt, Human
gaauauugcugauggugcaaug

SEQ ID NO: 3115955 - RNA, 24 nt, Human
gaauauugcugauggugcaaugac

SEQ ID NO: 3115956 - RNA, 20 nt, Human
gaauauugcugauggugcaa

SEQ ID NO: 3115957 - RNA, 15 nt, Human
gaauauauaaccagu

SEQ ID NO: 3115958 - RNA, 11 nt, Human
gaauauugcug

SEQ ID NO: 3115959 - RNA, 13 nt, Human
gaauauugcugau

SEQ ID NO: 3115960 - RNA, 12 nt, Human
gaauauugcuga

SEQ ID NO: 3115961 - RNA, 15 nt, Human
gacgcugugcugccc

SEQ ID NO: 3115962 - RNA, 18 nt, Human
gacgcugugcugcccugc

SEQ ID NO: 3115963 - RNA, 17 nt, Human
gacgcugugcugcccug

SEQ ID NO: 3115964 - RNA, 16 nt, Human
gacgcugugcugcccu

SEQ ID NO: 3115965 - RNA, 23 nt, Human
gacgcuacccgggaagggggcug

SEQ ID NO: 3115966 - RNA, 22 nt, Human
gacgcuacccgggaagggggcu

SEQ ID NO: 3115967 - RNA, 21 nt, Human
gacgccaucccagccccaaug

SEQ ID NO: 3115968 - RNA, 19 nt, Human
gacgccaucccagccccaa

SEQ ID NO: 3115969 - RNA, 13 nt, Human
gacgccaucccag

SEQ ID NO: 3115970 - RNA, 12 nt, Human
gacgccauccca

SEQ ID NO: 3115971 - RNA, 16 nt, Human
gaccucugcagcaaua

SEQ ID NO: 3115972 - RNA, 18 nt, Human
gaccucugcagcaauaaa

SEQ ID NO: 3115973 - RNA, 22 nt, Human
gaccucugcagcaauaaagcag

SEQ ID NO: 3115974 - RNA, 13 nt, Human
gaccucaggccug

SEQ ID NO: 3115975 - RNA, 14 nt, Human
gaccucaggccugg

SEQ ID NO: 3115976 - RNA, 19 nt, Human
gaccucaggugauccaccc

SEQ ID NO: 3115977 - RNA, 21 nt, Human
gaccucaggugagaagcagag

SEQ ID NO: 3115978 - RNA, 20 nt, Human
gaccucaggugauccaccca

SEQ ID NO: 3115979 - RNA, 21 nt, Human
gaccucaggugauccacccac

SEQ ID NO: 3115980 - RNA, 19 nt, Human
gaccucaggccugggggcu

SEQ ID NO: 3115981 - RNA, 19 nt, Human
gaccucaggugagaagcag

SEQ ID NO: 3115982 - RNA, 18 nt, Human
gaccucaggugagaagca

SEQ ID NO: 3115983 - RNA, 16 nt, Human
gacagcuccuucuguc

SEQ ID NO: 3115984 - RNA, 16 nt, Human
gacagcccgggcucug

SEQ ID NO: 3115985 - RNA, 17 nt, Human
gacagcuccuucugucc

SEQ ID NO: 3115986 - RNA, 18 nt, Human
gacagcuccuucuguccu

SEQ ID NO: 3115987 - RNA, 14 nt, Human
gacagcccgggcuc

SEQ ID NO: 3115988 - RNA, 20 nt, Human
gacagucccugccaauggac

SEQ ID NO: 3115989 - RNA, 16 nt, Human
gacagucccugccaau

SEQ ID NO: 3115990 - RNA, 15 nt, Human
gacagucccugccaa

SEQ ID NO: 3115991 - RNA, 14 nt, Human
gacagucccugcca

SEQ ID NO: 3115992 - RNA, 12 nt, Human
gacagucccugc

SEQ ID NO: 3115993 - RNA, 11 nt, Human
gacagcucuua

SEQ ID NO: 3115994 - RNA, 10 nt, Human
gacagcucuu

SEQ ID NO: 3115995 - RNA, 19 nt, Human
gacagcuccuucuguccua

SEQ ID NO: 3115996 - RNA, 17 nt, Human
gacauugcggacagcca

SEQ ID NO: 3115997 - RNA, 23 nt, Human
gacauugcggacagccacggcca

SEQ ID NO: 3115998 - RNA, 14 nt, Human
gagggccugcaagg

SEQ ID NO: 3115999 - RNA, 21 nt, Human
gagggccugcaagggagugag

SEQ ID NO: 3116000 - RNA, 17 nt, Human
gagggccugcaagggag

SEQ ID NO: 3116001 - RNA, 21 nt, Human
gaggcauuuguuugaacugau

SEQ ID NO: 3116002 - RNA, 21 nt, Human
gaggcaugugaugagaggaaa

SEQ ID NO: 3116003 - RNA, 20 nt, Human
gaggcaugugaugagaggaa

SEQ ID NO: 3116004 - RNA, 22 nt, Human
gaggcaugugaugagaggaaau

SEQ ID NO: 3116005 - RNA, 19 nt, Human
gaggcauuuguuugaacug

SEQ ID NO: 3116006 - RNA, 20 nt, Human
gaggacuuuucuuuguggcu

SEQ ID NO: 3116007 - RNA, 23 nt, Human
gaggacuuuucuuuguggcuucc

SEQ ID NO: 3116008 - RNA, 16 nt, Human
gaggacuuuucuuugu

SEQ ID NO: 3116009 - RNA, 18 nt, Human
gaggcagggucucacucu

SEQ ID NO: 3116010 - RNA, 19 nt, Human
gaggcagggucucacucug

SEQ ID NO: 3116011 - RNA, 20 nt, Human
gaggcagggucucacucugu

SEQ ID NO: 3116012 - RNA, 12 nt, Human
gaggagagagga

SEQ ID NO: 3116013 - RNA, 15 nt, Human
gaggagagaggaccc

SEQ ID NO: 3116014 - RNA, 14 nt, Human
gaggagagaggacc

SEQ ID NO: 3116015 - RNA, 21 nt, Human
gagcagggcucagcggggaca

SEQ ID NO: 3116016 - RNA, 14 nt, Human
gagcaucaggccag

SEQ ID NO: 3116017 - RNA, 13 nt, Human
gagcaucaggcca

SEQ ID NO: 3116018 - RNA, 16 nt, Human
gagcaucaggccaggc

SEQ ID NO: 3116019 - RNA, 15 nt, Human
gagcaucaggccagg

SEQ ID NO: 3116020 - RNA, 13 nt, Human
gagcaugccugga

SEQ ID NO: 3116021 - RNA, 13 nt, Human
gagccccgaggcc

SEQ ID NO: 3116022 - RNA, 14 nt, Human
gagccccgaggccu

SEQ ID NO: 3116023 - RNA, 17 nt, Human
gagccccgaggccuucu

SEQ ID NO: 3116024 - RNA, 13 nt, Human
gagcccugguggc

SEQ ID NO: 3116025 - RNA, 14 nt, Human
gagcccugguggca

SEQ ID NO: 3116026 - RNA, 14 nt, Human
gagauuggaaggaa

SEQ ID NO: 3116027 - RNA, 21 nt, Human
gagauugcaccacugcacucc

SEQ ID NO: 3116028 - RNA, 12 nt, Human
gagaggaaauca

SEQ ID NO: 3116029 - RNA, 20 nt, Human
gagagcugggugucaagagg

SEQ ID NO: 3116030 - RNA, 15 nt, Human
gagaggacccccuga

SEQ ID NO: 3116031 - RNA, 13 nt, Human
gagagcugggugu

SEQ ID NO: 3116032 - RNA, 21 nt, Human
gagagcuagcagcagggaggg

SEQ ID NO: 3116033 - RNA, 15 nt, Human
gagagcuagcagcag

SEQ ID NO: 3116034 - RNA, 20 nt, Human
gagagccuuccagggguggg

SEQ ID NO: 3116035 - RNA, 18 nt, Human
gagagccuuccaggggug

SEQ ID NO: 3116036 - RNA, 16 nt, Human
gagagccuuccagggg

SEQ ID NO: 3116037 - RNA, 15 nt, Human
gagagccuuccaggg

SEQ ID NO: 3116038 - RNA, 14 nt, Human
gagagccuuccagg

SEQ ID NO: 3116039 - RNA, 13 nt, Human
gagacuccugcag

SEQ ID NO: 3116040 - RNA, 15 nt, Human
gagaaugaaagggcc

SEQ ID NO: 3116041 - RNA, 23 nt, Human
gagaaugaaagggcccagagagg

SEQ ID NO: 3116042 - RNA, 21 nt, Human
gagacccugucucaaaaaaag

SEQ ID NO: 3116043 - RNA, 18 nt, Human
gagacgggggcagagagg

SEQ ID NO: 3116044 - RNA, 16 nt, Human
gagacggagucccacc

SEQ ID NO: 3116045 - RNA, 19 nt, Human
gagacggagucccaccuug

SEQ ID NO: 3116046 - RNA, 14 nt, Human
gagacggaguccca

SEQ ID NO: 3116047 - RNA, 14 nt, Human
gacuuuuccaaccc

SEQ ID NO: 3116048 - RNA, 19 nt, Human
gacuuuuccaacccucauc

SEQ ID NO: 3116049 - RNA, 18 nt, Human
gcaagugagagcugggug

SEQ ID NO: 3116050 - RNA, 17 nt, Human
gcacucagaagacacug

SEQ ID NO: 3116051 - RNA, 20 nt, Human
gcacucagaagacacugaug

SEQ ID NO: 3116052 - RNA, 14 nt, Human
gcacuccagccugg

SEQ ID NO: 3116053 - RNA, 14 nt, Human
gcacuccccugcug

SEQ ID NO: 3116054 - RNA, 13 nt, Human
gcacuccccugcu

SEQ ID NO: 3116055 - RNA, 19 nt, Human
gcacuuuguucuggcucuu

SEQ ID NO: 3116056 - RNA, 18 nt, Human
gcacuuuguucuggcucu

SEQ ID NO: 3116057 - RNA, 15 nt, Human
gcacuccccugcugg

SEQ ID NO: 3116058 - RNA, 12 nt, Human
gcacuccccugc

SEQ ID NO: 3116059 - RNA, 22 nt, Human
gcacuuuguucuggcucuucca

SEQ ID NO: 3116060 - RNA, 23 nt, Human
gcagcauauucaggaagcucagg

SEQ ID NO: 3116061 - RNA, 19 nt, Human
gcagcauauucaggaagcu

SEQ ID NO: 3116062 - RNA, 18 nt, Human
gcagcauauucaggaagc

SEQ ID NO: 3116063 - RNA, 17 nt, Human
gcagcauauucaggaag

SEQ ID NO: 3116064 - RNA, 14 nt, Human
gcagagggcacaga

SEQ ID NO: 3116065 - RNA, 21 nt, Human
gcagaggaaagcaaaggagau

SEQ ID NO: 3116066 - RNA, 20 nt, Human
gcagaggaaagcaaaggaga

SEQ ID NO: 3116067 - RNA, 18 nt, Human
gcagaggaaagcaaagga

SEQ ID NO: 3116068 - RNA, 14 nt, Human
gcagaggaaagcaa

SEQ ID NO: 3116069 - RNA, 13 nt, Human
gcagaggaaagca

SEQ ID NO: 3116070 - RNA, 16 nt, Human
gcagccaggccacaag

SEQ ID NO: 3116071 - RNA, 18 nt, Human
gcauccaguaucuugaag

SEQ ID NO: 3116072 - RNA, 17 nt, Human
gcauccaguaucuugaa

SEQ ID NO: 3116073 - RNA, 14 nt, Human
gcauccaguaucuu

SEQ ID NO: 3116074 - RNA, 19 nt, Human
gcaugugaugagaggaaau

SEQ ID NO: 3116075 - RNA, 18 nt, Human
gcaugugaugagaggaaa

SEQ ID NO: 3116076 - RNA, 21 nt, Human
gcaugugaugagaggaaauca

SEQ ID NO: 3116077 - RNA, 15 nt, Human
gcauugugggaaggg

SEQ ID NO: 3116078 - RNA, 13 nt, Human
gcauugugggaag

SEQ ID NO: 3116079 - RNA, 15 nt, Human
gcauuuacuuugugu

SEQ ID NO: 3116080 - RNA, 18 nt, Human
gcauuuaaaagauacagu

SEQ ID NO: 3116081 - RNA, 22 nt, Human
gcauuuaaaagauacaguuacu

SEQ ID NO: 3116082 - RNA, 18 nt, Human
gcauugugggaaggggag

SEQ ID NO: 3116083 - RNA, 16 nt, Human
gcauugugggaagggg

SEQ ID NO: 3116084 - RNA, 16 nt, Human
gcauuuaaaagauaca

SEQ ID NO: 3116085 - RNA, 17 nt, Human
gcauuuaaaagauacag

SEQ ID NO: 3116086 - RNA, 21 nt, Human
gcauggcugccaaugggagcu

SEQ ID NO: 3116087 - RNA, 13 nt, Human
gcauccuggcacc

SEQ ID NO: 3116088 - RNA, 14 nt, Human
gcauacguacacau

SEQ ID NO: 3116089 - RNA, 15 nt, Human
gcauacguacacauu

SEQ ID NO: 3116090 - RNA, 16 nt, Human
gcauacguacacauuu

SEQ ID NO: 3116091 - RNA, 17 nt, Human
gcauacguacacauuuu

SEQ ID NO: 3116092 - RNA, 16 nt, Human
gauuuaacagaaaugu

SEQ ID NO: 3116093 - RNA, 17 nt, Human
gauuuaacagaaaugua

SEQ ID NO: 3116094 - RNA, 18 nt, Human
gauuuaacagaaauguac

SEQ ID NO: 3116095 - RNA, 12 nt, Human
gauucuucugcu

SEQ ID NO: 3116096 - RNA, 13 nt, Human
gauucuucugcuu

SEQ ID NO: 3116097 - RNA, 15 nt, Human
gauucuucugcuuca

SEQ ID NO: 3116098 - RNA, 11 nt, Human
gauuucacucu

SEQ ID NO: 3116099 - RNA, 18 nt, Human
gauuuuuuuuuccuucag

SEQ ID NO: 3116100 - RNA, 17 nt, Human
gauuuuuuuuuccuuca

SEQ ID NO: 3116101 - RNA, 12 nt, Human
gauuucacucuc

SEQ ID NO: 3116102 - RNA, 16 nt, Human
gauuuuuuuuuccuuc

SEQ ID NO: 3116103 - RNA, 17 nt, Human
gcaaaagaugcuucuca

SEQ ID NO: 3116104 - RNA, 22 nt, Human
gcaaaagaugcuucucacugcc

SEQ ID NO: 3116105 - RNA, 14 nt, Human
gcaaaaaggcagga

SEQ ID NO: 3116106 - RNA, 21 nt, Human
gauuuuuuuuuccuucagugc

SEQ ID NO: 3116107 - RNA, 20 nt, Human
gcaaccuccgccucuugggu

SEQ ID NO: 3116108 - RNA, 14 nt, Human
gcaacccccagccu

SEQ ID NO: 3116109 - RNA, 15 nt, Human
gcaacccccagccug

SEQ ID NO: 3116110 - RNA, 16 nt, Human
gcaacccccagccugc

SEQ ID NO: 3116111 - RNA, 19 nt, Human
gcaaccuccgccucuuggg

SEQ ID NO: 3116112 - RNA, 13 nt, Human
gcaaccaccacca

SEQ ID NO: 3116113 - RNA, 18 nt, Human
gcaaccaccaccaaccac

SEQ ID NO: 3116114 - RNA, 16 nt, Human
gcaaccaccaccaacc

SEQ ID NO: 3116115 - RNA, 16 nt, Human
gcaacaggcugggcuu

SEQ ID NO: 3116116 - RNA, 19 nt, Human
gcaacaggcugggcuucag

SEQ ID NO: 3116117 - RNA, 14 nt, Human
gcaacaggcugggc

SEQ ID NO: 3116118 - RNA, 15 nt, Human
gcaacaggcugggcu

SEQ ID NO: 3116119 - RNA, 13 nt, Human
gcaacaggcuggg

SEQ ID NO: 3116120 - RNA, 16 nt, Human
gcaagugagagcuggg

SEQ ID NO: 3116121 - RNA, 15 nt, Human
gcaagugagagcugg

SEQ ID NO: 3116122 - RNA, 16 nt, Human
gauacaguuacucaga

SEQ ID NO: 3116123 - RNA, 19 nt, Human
gauacaguuacucagaauu

SEQ ID NO: 3116124 - RNA, 23 nt, Human
gauacaguuacucagaauucucu

SEQ ID NO: 3116125 - RNA, 23 nt, Human
gauacaggaaaagcugcugacag

SEQ ID NO: 3116126 - RNA, 17 nt, Human
gauacuguaucaugaca

SEQ ID NO: 3116127 - RNA, 21 nt, Human
gauacuguaucaugacaaaga

SEQ ID NO: 3116128 - RNA, 12 nt, Human
gauccaagcugg

SEQ ID NO: 3116129 - RNA, 16 nt, Human
gauccaagcugguccc

SEQ ID NO: 3116130 - RNA, 17 nt, Human
gauccaagcugguccca

SEQ ID NO: 3116131 - RNA, 19 nt, Human
gauccaagcuggucccacu

SEQ ID NO: 3116132 - RNA, 22 nt, Human
gauccacccaccucagccuccc

SEQ ID NO: 3116133 - RNA, 20 nt, Human
gauccacccaccucagccuc

SEQ ID NO: 3116134 - RNA, 21 nt, Human
gauccacccaccucagccucc

SEQ ID NO: 3116135 - RNA, 21 nt, Human
gauccaagcuggucccacuca

SEQ ID NO: 3116136 - RNA, 18 nt, Human
gauccacccaccucagcc

SEQ ID NO: 3116137 - RNA, 19 nt, Human
gauccacccaccucagccu

SEQ ID NO: 3116138 - RNA, 23 nt, Human
gaucaaaagguuaauaaaguaau

SEQ ID NO: 3116139 - RNA, 17 nt, Human
gauauuuuuuucuuuuc

SEQ ID NO: 3116140 - RNA, 20 nt, Human
gaucaaaagguuaauaaagu

SEQ ID NO: 3116141 - RNA, 15 nt, Human
gaucucuaacuucac

SEQ ID NO: 3116142 - RNA, 19 nt, Human
gaucucuugagccugggag

SEQ ID NO: 3116143 - RNA, 18 nt, Human
gaucucuugagccuggga

SEQ ID NO: 3116144 - RNA, 13 nt, Human
gaugauccuaggc

SEQ ID NO: 3116145 - RNA, 22 nt, Human
gaugauuggaggggggaggugg

SEQ ID NO: 3116146 - RNA, 23 nt, Human
gaugcuucucacugccaugccag

SEQ ID NO: 3116147 - RNA, 21 nt, Human
gaugcuucuucagagacuccu

SEQ ID NO: 3116148 - RNA, 20 nt, Human
gaugcuucuucagagacucc

SEQ ID NO: 3116149 - RNA, 17 nt, Human
gaugcuucuucagagac

SEQ ID NO: 3116150 - RNA, 16 nt, Human
ggccugcaagggagug

SEQ ID NO: 3116151 - RNA, 12 nt, Human
ggccuggccaga

SEQ ID NO: 3116152 - RNA, 15 nt, Human
ggccuggccagaugc

SEQ ID NO: 3116153 - RNA, 20 nt, Human
ggcuaagugauccucccacc

SEQ ID NO: 3116154 - RNA, 16 nt, Human
ggcuaauguacugcau

SEQ ID NO: 3116155 - RNA, 13 nt, Human
ggcuaccuuugua

SEQ ID NO: 3116156 - RNA, 14 nt, Human
ggcuaccuuuguau

SEQ ID NO: 3116157 - RNA, 23 nt, Human
ggccucccaacucaccccagccc

SEQ ID NO: 3116158 - RNA, 22 nt, Human
ggccucccaacucaccccagcc

SEQ ID NO: 3116159 - RNA, 20 nt, Human
ggccucccaacucaccccag

SEQ ID NO: 3116160 - RNA, 13 nt, Human
ggccucagugcca

SEQ ID NO: 3116161 - RNA, 17 nt, Human
ggccucccaacucaccc

SEQ ID NO: 3116162 - RNA, 19 nt, Human
ggccucccaacucacccca

SEQ ID NO: 3116163 - RNA, 18 nt, Human
ggccucccaacucacccc

SEQ ID NO: 3116164 - RNA, 15 nt, Human
ggccagaugcaccag

SEQ ID NO: 3116165 - RNA, 16 nt, Human
ggccagaugcaccagc

SEQ ID NO: 3116166 - RNA, 13 nt, Human
ggcucacugcagc

SEQ ID NO: 3116167 - RNA, 14 nt, Human
ggcucacugcagcc

SEQ ID NO: 3116168 - RNA, 15 nt, Human
ggcucacugcagccu

SEQ ID NO: 3116169 - RNA, 13 nt, Human
ggcucccuuccca

SEQ ID NO: 3116170 - RNA, 14 nt, Human
ggcucuuccaggcu

SEQ ID NO: 3116171 - RNA, 15 nt, Human
ggcucuuccaggcug

SEQ ID NO: 3116172 - RNA, 18 nt, Human
ggcucuuccaggcuggga

SEQ ID NO: 3116173 - RNA, 17 nt, Human
ggcucuuccaggcuggg

SEQ ID NO: 3116174 - RNA, 22 nt, Human
aaaaaacugcugacuguuuucu

SEQ ID NO: 3116175 - RNA, 14 nt, Human
ggcuggguuggagg

SEQ ID NO: 3116176 - RNA, 22 nt, Human
ggcuggguucuacccaggugcu

SEQ ID NO: 3116177 - RNA, 21 nt, Human
aaaaaggaugcacagaguugu

SEQ ID NO: 3116178 - RNA, 12 nt, Human
aaaaaggcagga

SEQ ID NO: 3116179 - RNA, 14 nt, Human
aaaaaggaggaaga

SEQ ID NO: 3116180 - RNA, 13 nt, Human
ggcuggccuggcc

SEQ ID NO: 3116181 - RNA, 15 nt, Human
ggcuggccuggcccc

SEQ ID NO: 3116182 - RNA, 14 nt, Human
ggcuggccuggccc

SEQ ID NO: 3116183 - RNA, 15 nt, Human
ggcaaaaaggcagga

SEQ ID NO: 3116184 - RNA, 18 nt, Human
ggcacaccgggcacucag

SEQ ID NO: 3116185 - RNA, 18 nt, Human
ggcacaucagcacgauuu

SEQ ID NO: 3116186 - RNA, 16 nt, Human
ggcacugcuuccagug

SEQ ID NO: 3116187 - RNA, 16 nt, Human
ggcagccccauucugc

SEQ ID NO: 3116188 - RNA, 20 nt, Human
ggcagccccauucugccugc

SEQ ID NO: 3116189 - RNA, 21 nt, Human
ggcagccccauucugccugcc

SEQ ID NO: 3116190 - RNA, 22 nt, Human
ggcagccccauucugccugccc

SEQ ID NO: 3116191 - RNA, 13 nt, Human
ggcagccaggcca

SEQ ID NO: 3116192 - RNA, 20 nt, Human
ggcacugcuuccagugaggc

SEQ ID NO: 3116193 - RNA, 18 nt, Human
ggcaggaggaucacuuga

SEQ ID NO: 3116194 - RNA, 14 nt, Human
ggcauuugcugaau

SEQ ID NO: 3116195 - RNA, 19 nt, Human
ggccaaaggaagcacaugc

SEQ ID NO: 3116196 - RNA, 16 nt, Human
ggccaaaggaagcaca

SEQ ID NO: 3116197 - RNA, 14 nt, Human
ggccaaaggaagca

SEQ ID NO: 3116198 - RNA, 17 nt, Human
ggcauuuguuugaacug

SEQ ID NO: 3116199 - RNA, 13 nt, Human
ggccaaaggaagc

SEQ ID NO: 3116200 - RNA, 17 nt, Human
ggccagagggagugaca

SEQ ID NO: 3116201 - RNA, 19 nt, Human
ggccagagggagugacaga

SEQ ID NO: 3116202 - RNA, 18 nt, Human
ggccagagacacaagccu

SEQ ID NO: 3116203 - RNA, 17 nt, Human
ggccagagacacaagcc

SEQ ID NO: 3116204 - RNA, 22 nt, Human
ggagugggcccaaugcacuuug

SEQ ID NO: 3116205 - RNA, 12 nt, Human
ggagugggccca

SEQ ID NO: 3116206 - RNA, 16 nt, Human
ggaguggccacagaaa

SEQ ID NO: 3116207 - RNA, 15 nt, Human
ggaguggccacagaa

SEQ ID NO: 3116208 - RNA, 23 nt, Human
ggauccugagccagauuucacuc

SEQ ID NO: 3116209 - RNA, 20 nt, Human
ggauccugagccagauuuca

SEQ ID NO: 3116210 - RNA, 19 nt, Human
ggauccugagccagauuuc

SEQ ID NO: 3116211 - RNA, 18 nt, Human
ggauccugagccagauuu

SEQ ID NO: 3116212 - RNA, 16 nt, Human
ggauccugagccagau

SEQ ID NO: 3116213 - RNA, 15 nt, Human
ggauccugagccaga

SEQ ID NO: 3116214 - RNA, 16 nt, Human
ggaguucaucuugaau

SEQ ID NO: 3116215 - RNA, 12 nt, Human
ggauuuaacaga

SEQ ID NO: 3116216 - RNA, 20 nt, Human
ggauuguccccgacccuugc

SEQ ID NO: 3116217 - RNA, 16 nt, Human
ggauuguccccgaccc

SEQ ID NO: 3116218 - RNA, 22 nt, Human
ggauuuaacagaaauguacagc

SEQ ID NO: 3116219 - RNA, 16 nt, Human
ggauuuaacagaaaug

SEQ ID NO: 3116220 - RNA, 17 nt, Human
ggauuuaacagaaaugu

SEQ ID NO: 3116221 - RNA, 14 nt, Human
ggaugaaaaaauaa

SEQ ID NO: 3116222 - RNA, 13 nt, Human
ggauuguccccga

SEQ ID NO: 3116223 - RNA, 14 nt, Human
ggaggggggaggug

SEQ ID NO: 3116224 - RNA, 13 nt, Human
ggaggggggaggu

SEQ ID NO: 3116225 - RNA, 23 nt, Human
ggaggugggauccuccaggugca

SEQ ID NO: 3116226 - RNA, 22 nt, Human
ggaggugggauccuccaggugc

SEQ ID NO: 3116227 - RNA, 22 nt, Human
ggagguaaggaauaccuguccc

SEQ ID NO: 3116228 - RNA, 21 nt, Human
ggagggugacgggggugaacu

SEQ ID NO: 3116229 - RNA, 13 nt, Human
ggugugggggaag

SEQ ID NO: 3116230 - RNA, 11 nt, Human
gguguggggga

SEQ ID NO: 3116231 - RNA, 13 nt, Human
ggugggggccucg

SEQ ID NO: 3116232 - RNA, 23 nt, Human
gguguggagaagcggcuggcagc

SEQ ID NO: 3116233 - RNA, 14 nt, Human
gguguggagaagcg

SEQ ID NO: 3116234 - RNA, 12 nt, Human
gguguggagaag

SEQ ID NO: 3116235 - RNA, 22 nt, Human
gguucccuuugacgccauccca

SEQ ID NO: 3116236 - RNA, 23 nt, Human
gguucccuuugacgccaucccag

SEQ ID NO: 3116237 - RNA, 22 nt, Human
gguucccuuuuuuggcugcuga

SEQ ID NO: 3116238 - RNA, 19 nt, Human
gguguuuccuggcacugcu

SEQ ID NO: 3116239 - RNA, 17 nt, Human
gguguuuccuggcacug

SEQ ID NO: 3116240 - RNA, 17 nt, Human
gguucccauuugcuccu

SEQ ID NO: 3116241 - RNA, 14 nt, Human
aaaguguauuuuuu

SEQ ID NO: 3116242 - RNA, 21 nt, Human
aaaguguauuuuuuuacuaau

SEQ ID NO: 3116243 - RNA, 21 nt, Human
aaaguaucccuacuguaauuu

SEQ ID NO: 3116244 - RNA, 20 nt, Human
aaaguagaagucuuagaugu

SEQ ID NO: 3116245 - RNA, 22 nt, Human
aaaguagaagucuuagauguau

SEQ ID NO: 3116246 - RNA, 18 nt, Human
aaaguacacuguuucaaa

SEQ ID NO: 3116247 - RNA, 19 nt, Human
aaaguacacuguuucaaac

SEQ ID NO: 3116248 - RNA, 15 nt, Human
gguuucagaaaugug

SEQ ID NO: 3116249 - RNA, 16 nt, Human
gguuucuaaagcugcc

SEQ ID NO: 3116250 - RNA, 22 nt, Human
gguuucuaaagcugccagccga

SEQ ID NO: 3116251 - RNA, 20 nt, Human
gguuuguaaauuaacuuuua

SEQ ID NO: 3116252 - RNA, 20 nt, Human
gguggcaccagcagccugga

SEQ ID NO: 3116253 - RNA, 14 nt, Human
gguggcaccagcag

SEQ ID NO: 3116254 - RNA, 21 nt, Human
ggugcugccauccagguucag

SEQ ID NO: 3116255 - RNA, 14 nt, Human
aaagcuaggccugg

SEQ ID NO: 3116256 - RNA, 16 nt, Human
aaagcuaggccuggcc

SEQ ID NO: 3116257 - RNA, 13 nt, Human
aaagcagugcaug

SEQ ID NO: 3116258 - RNA, 13 nt, Human
aaagcugccagcc

SEQ ID NO: 3116259 - RNA, 12 nt, Human
aaagcugccagc

SEQ ID NO: 3116260 - RNA, 19 nt, Human
gguggggaccucaggccug

SEQ ID NO: 3116261 - RNA, 16 nt, Human
ggugggacacccugug

SEQ ID NO: 3116262 - RNA, 13 nt, Human
ggugggacacccu

SEQ ID NO: 3116263 - RNA, 17 nt, Human
ggugggacacccuguga

SEQ ID NO: 3116264 - RNA, 18 nt, Human
gguggcuggguuggaggg

SEQ ID NO: 3116265 - RNA, 12 nt, Human
gguggcuggguu

SEQ ID NO: 3116266 - RNA, 20 nt, Human
aaagggcccagagagggugg

SEQ ID NO: 3116267 - RNA, 23 nt, Human
guaauccuagcacuuugggaggc

SEQ ID NO: 3116268 - RNA, 15 nt, Human
guaauuugugauaca

SEQ ID NO: 3116269 - RNA, 17 nt, Human
guaauuugugauacaau

SEQ ID NO: 3116270 - RNA, 20 nt, Human
guaauuugugauacaaugcu

SEQ ID NO: 3116271 - RNA, 21 nt, Human
guaauuuuuuuaucgucacug

SEQ ID NO: 3116272 - RNA, 19 nt, Human
guaacaggaaaauuuuaaa

SEQ ID NO: 3116273 - RNA, 16 nt, Human
guaacaagccacccca

SEQ ID NO: 3116274 - RNA, 14 nt, Human
aaauaaugugaaac

SEQ ID NO: 3116275 - RNA, 22 nt, Human
aaauaaugugaaacuggauuaa

SEQ ID NO: 3116276 - RNA, 22 nt, Human
aaaguguauuuuuuuacuaaua

SEQ ID NO: 3116277 - RNA, 12 nt, Human
aaauaucugaaa

SEQ ID NO: 3116278 - RNA, 14 nt, Human
aaauaucugaaaau

SEQ ID NO: 3116279 - RNA, 17 nt, Human
aaauaucugaaaaugua

SEQ ID NO: 3116280 - RNA, 18 nt, Human
aaauaucugaaaauguau

SEQ ID NO: 3116281 - RNA, 19 nt, Human
aaauaucugaaaauguaug

SEQ ID NO: 3116282 - RNA, 21 nt, Human
aaauaucugaaaauguaugug

SEQ ID NO: 3116283 - RNA, 22 nt, Human
aaauaucugaaaauguaugugu

SEQ ID NO: 3116284 - RNA, 23 nt, Human
aaauaucugaaaauguaugugua

SEQ ID NO: 3116285 - RNA, 21 nt, Human
aaaucagccugcuccagcugu

SEQ ID NO: 3116286 - RNA, 19 nt, Human
aaaucagccugcuccagcu

SEQ ID NO: 3116287 - RNA, 23 nt, Human
aaaucagccugcuccagcuguuc

SEQ ID NO: 3116288 - RNA, 15 nt, Human
aaauauaggaacuua

SEQ ID NO: 3116289 - RNA, 16 nt, Human
guacacacacauacac

SEQ ID NO: 3116290 - RNA, 19 nt, Human
aaauaccagccaguaaaug

SEQ ID NO: 3116291 - RNA, 20 nt, Human
aaauaccagccaguaaaugg

SEQ ID NO: 3116292 - RNA, 21 nt, Human
aaauaccagccaguaaauggg

SEQ ID NO: 3116293 - RNA, 21 nt, Human
aaacguggcugcuucaaggau

SEQ ID NO: 3116294 - RNA, 20 nt, Human
aaacguggcugcuucaagga

SEQ ID NO: 3116295 - RNA, 19 nt, Human
aaacuguuaauaguucagg

SEQ ID NO: 3116296 - RNA, 14 nt, Human
ggguggccucccaa

SEQ ID NO: 3116297 - RNA, 18 nt, Human
gggugggacacccuguga

SEQ ID NO: 3116298 - RNA, 15 nt, Human
gggugggacacccug

SEQ ID NO: 3116299 - RNA, 19 nt, Human
aaacuuaaucuaaauggaa

SEQ ID NO: 3116300 - RNA, 23 nt, Human
ggguuuugccauguuggccaggc

SEQ ID NO: 3116301 - RNA, 20 nt, Human
ggguuuugccauguuggcca

SEQ ID NO: 3116302 - RNA, 12 nt, Human
ggguggugaccu

SEQ ID NO: 3116303 - RNA, 18 nt, Human
gguaacuagggaagauaa

SEQ ID NO: 3116304 - RNA, 19 nt, Human
gguaucaggugcugccauc

SEQ ID NO: 3116305 - RNA, 18 nt, Human
aaacuuuacuauggcccu

SEQ ID NO: 3116306 - RNA, 22 nt, Human
aaacuugauguguuaucucuua

SEQ ID NO: 3116307 - RNA, 20 nt, Human
gguaggguaagugagagagg

SEQ ID NO: 3116308 - RNA, 14 nt, Human
gguaucaggugcug

SEQ ID NO: 3116309 - RNA, 20 nt, Human
gguaaggaauaccugucccc

SEQ ID NO: 3116310 - RNA, 13 nt, Human
ggggaccagagcu

SEQ ID NO: 3116311 - RNA, 12 nt, Human
ggggaccagagc

SEQ ID NO: 3116312 - RNA, 18 nt, Human
aaaauguauguguaagua

SEQ ID NO: 3116313 - RNA, 14 nt, Human
ggggaccagagcug

SEQ ID NO: 3116314 - RNA, 19 nt, Human
ggggccaguuggucccccu

SEQ ID NO: 3116315 - RNA, 17 nt, Human
gggggaucacagccucu

SEQ ID NO: 3116316 - RNA, 11 nt, Human
gggggcuggga

SEQ ID NO: 3116317 - RNA, 21 nt, Human
ggggucacucuggcagcucag

SEQ ID NO: 3116318 - RNA, 13 nt, Human
ggggguggccucc

SEQ ID NO: 3116319 - RNA, 15 nt, Human
gggggcugggcagag

SEQ ID NO: 3116320 - RNA, 22 nt, Human
aaaccugugucucugagaguag

SEQ ID NO: 3116321 - RNA, 19 nt, Human
aaacauuuugucauauaag

SEQ ID NO: 3116322 - RNA, 20 nt, Human
gggucacucuggcagcucag

SEQ ID NO: 3116323 - RNA, 14 nt, Human
gggucacucuggca

SEQ ID NO: 3116324 - RNA, 14 nt, Human
gggccaggagccuc

SEQ ID NO: 3116325 - RNA, 13 nt, Human
gggccaggagccu

SEQ ID NO: 3116326 - RNA, 12 nt, Human
gggccaggagcc

SEQ ID NO: 3116327 - RNA, 21 nt, Human
gggcggugagaggggaacaga

SEQ ID NO: 3116328 - RNA, 13 nt, Human
gggccucagugcc

SEQ ID NO: 3116329 - RNA, 14 nt, Human
gggccucagugcca

SEQ ID NO: 3116330 - RNA, 18 nt, Human
gggccucuuaugggcugg

SEQ ID NO: 3116331 - RNA, 22 nt, Human
gggccucgguguggagaagcgg

SEQ ID NO: 3116332 - RNA, 19 nt, Human
gggcugcaccggcuggccu

SEQ ID NO: 3116333 - RNA, 17 nt, Human
gggcugcaccggcuggc

SEQ ID NO: 3116334 - RNA, 21 nt, Human
gggcucagcggggacagcucc

SEQ ID NO: 3116335 - RNA, 13 nt, Human
gggcuccagacac

SEQ ID NO: 3116336 - RNA, 10 nt, Human
gggcuccaga

SEQ ID NO: 3116337 - RNA, 22 nt, Human
gggcucagcaaaagaugcuucu

SEQ ID NO: 3116338 - RNA, 18 nt, Human
gggcucagcaaaagaugc

SEQ ID NO: 3116339 - RNA, 15 nt, Human
gggcuaguugggcuu

SEQ ID NO: 3116340 - RNA, 17 nt, Human
gggcucagcggggacag

SEQ ID NO: 3116341 - RNA, 19 nt, Human
gggcucagcggggacagcu

SEQ ID NO: 3116342 - RNA, 21 nt, Human
gggcugcaccggcuggccugg

SEQ ID NO: 3116343 - RNA, 20 nt, Human
gggcugcaccggcuggccug

SEQ ID NO: 3116344 - RNA, 15 nt, Human
gggcugggcagagga

SEQ ID NO: 3116345 - RNA, 12 nt, Human
gggcugggcaga

SEQ ID NO: 3116346 - RNA, 17 nt, Human
gggcuggguucuaccca

SEQ ID NO: 3116347 - RNA, 22 nt, Human
aaaaggagccaauuuaaagaaa

SEQ ID NO: 3116348 - RNA, 13 nt, Human
aaaaggaugcaca

SEQ ID NO: 3116349 - RNA, 14 nt, Human
aaaaggaugcacag

SEQ ID NO: 3116350 - RNA, 15 nt, Human
aaaaggaugcacaga

SEQ ID NO: 3116351 - RNA, 19 nt, Human
aaaaggaugcacagaguug

SEQ ID NO: 3116352 - RNA, 22 nt, Human
aaaaggaugcacagaguuguua

SEQ ID NO: 3116353 - RNA, 19 nt, Human
aaaagguaugcaaucaaau

SEQ ID NO: 3116354 - RNA, 11 nt, Human
aaaaggcagga

SEQ ID NO: 3116355 - RNA, 17 nt, Human
aaaagguuaauaaagua

SEQ ID NO: 3116356 - RNA, 16 nt, Human
aaaagguuaauaaagu

SEQ ID NO: 3116357 - RNA, 16 nt, Human
aaaauauuuuccugcc

SEQ ID NO: 3116358 - RNA, 16 nt, Human
gcggccuuuggcuuca

SEQ ID NO: 3116359 - RNA, 15 nt, Human
gcggcuggcagccca

SEQ ID NO: 3116360 - RNA, 21 nt, Human
gcgcagcauauucaggaagcu

SEQ ID NO: 3116361 - RNA, 20 nt, Human
gcgcagcauauucaggaagc

SEQ ID NO: 3116362 - RNA, 23 nt, Human
gcgauucuucugcuucagccucc

SEQ ID NO: 3116363 - RNA, 23 nt, Human
gccuugaccauucuccaccugcc

SEQ ID NO: 3116364 - RNA, 22 nt, Human
gcgauucuucugcuucagccuc

SEQ ID NO: 3116365 - RNA, 17 nt, Human
gcgauucuucugcuuca

SEQ ID NO: 3116366 - RNA, 23 nt, Human
gccuugaacuuugaccucugcag

SEQ ID NO: 3116367 - RNA, 22 nt, Human
gccuugaccauucuccaccugc

SEQ ID NO: 3116368 - RNA, 21 nt, Human
gccuugaccauucuccaccug

SEQ ID NO: 3116369 - RNA, 11 nt, Human
gccugggcaga

SEQ ID NO: 3116370 - RNA, 21 nt, Human
gccugggaucccucauccuca

SEQ ID NO: 3116371 - RNA, 23 nt, Human
gccugggaucccucauccucaua

SEQ ID NO: 3116372 - RNA, 19 nt, Human
gccugugccucugggacug

SEQ ID NO: 3116373 - RNA, 14 nt, Human
gccuugaacuuuga

SEQ ID NO: 3116374 - RNA, 15 nt, Human
gccuguucagcucca

SEQ ID NO: 3116375 - RNA, 14 nt, Human
gccuguucagcucc

SEQ ID NO: 3116376 - RNA, 16 nt, Human
gccuguucagcuccag

SEQ ID NO: 3116377 - RNA, 15 nt, Human
gccuucucugaagga

SEQ ID NO: 3116378 - RNA, 16 nt, Human
gccuucucugaaggac

SEQ ID NO: 3116379 - RNA, 20 nt, Human
gcucagggccuggcucaggu

SEQ ID NO: 3116380 - RNA, 17 nt, Human
gcucagggccuggcuca

SEQ ID NO: 3116381 - RNA, 13 nt, Human
gcucaggaguuug

SEQ ID NO: 3116382 - RNA, 19 nt, Human
gcucagggccuggcucagg

SEQ ID NO: 3116383 - RNA, 18 nt, Human
gcucagggccuggcucag

SEQ ID NO: 3116384 - RNA, 22 nt, Human
gcucagagagggugggaguggg

SEQ ID NO: 3116385 - RNA, 20 nt, Human
gcuaggaccccuccaugugg

SEQ ID NO: 3116386 - RNA, 14 nt, Human
gcuaguugggcuuc

SEQ ID NO: 3116387 - RNA, 16 nt, Human
gcuaguugggcuuccu

SEQ ID NO: 3116388 - RNA, 18 nt, Human
gcuaagugauccucccac

SEQ ID NO: 3116389 - RNA, 22 nt, Human
gcuaagugauccucccaccuca

SEQ ID NO: 3116390 - RNA, 18 nt, Human
gcccaggccccugccacc

SEQ ID NO: 3116391 - RNA, 20 nt, Human
gcccaggccccugccacccu

SEQ ID NO: 3116392 - RNA, 21 nt, Human
gcccaggccccugccacccug

SEQ ID NO: 3116393 - RNA, 11 nt, Human
gcccaggcccc

SEQ ID NO: 3116394 - RNA, 12 nt, Human
gcccaggccccu

SEQ ID NO: 3116395 - RNA, 16 nt, Human
gcccaggcaggucuug

SEQ ID NO: 3116396 - RNA, 11 nt, Human
gcccaggcagg

SEQ ID NO: 3116397 - RNA, 18 nt, Human
gcauuuacuuuguguuca

SEQ ID NO: 3116398 - RNA, 21 nt, Human
gcccacgcccccacuggugac

SEQ ID NO: 3116399 - RNA, 17 nt, Human
gcccacgcccccacugg

SEQ ID NO: 3116400 - RNA, 16 nt, Human
gcccacgcccccacug

SEQ ID NO: 3116401 - RNA, 15 nt, Human
gcccacgcccccacu

SEQ ID NO: 3116402 - RNA, 13 nt, Human
gcccacuucugcc

SEQ ID NO: 3116403 - RNA, 23 nt, Human
gcccaggaaaggcuccaggagca

SEQ ID NO: 3116404 - RNA, 22 nt, Human
gcccaggaaaggcuccaggagc

SEQ ID NO: 3116405 - RNA, 21 nt, Human
gcccaggaaaggcuccaggag

SEQ ID NO: 3116406 - RNA, 24 nt, Human
gcccaggaaaggcuccaggagcag

SEQ ID NO: 3116407 - RNA, 23 nt, Human
gcccacgcuggagugcagugagc

SEQ ID NO: 3116408 - RNA, 19 nt, Human
gcccacgcuggagugcagu

SEQ ID NO: 3116409 - RNA, 21 nt, Human
gcccacgcuggagugcaguga

SEQ ID NO: 3116410 - RNA, 20 nt, Human
gccccaaaacucuccucugc

SEQ ID NO: 3116411 - RNA, 19 nt, Human
gccccaaaacucuccucug

SEQ ID NO: 3116412 - RNA, 21 nt, Human
gccccaaaacucuccucugcu

SEQ ID NO: 3116413 - RNA, 12 nt, Human
gccccugcuggu

SEQ ID NO: 3116414 - RNA, 15 nt, Human
gccccugcugguuca

SEQ ID NO: 3116415 - RNA, 16 nt, Human
gccccugcugguucag

SEQ ID NO: 3116416 - RNA, 15 nt, Human
gccccuggcagcccc

SEQ ID NO: 3116417 - RNA, 12 nt, Human
gccccuggcagc

SEQ ID NO: 3116418 - RNA, 14 nt, Human
gccucugggacugg

SEQ ID NO: 3116419 - RNA, 16 nt, Human
gccucgaacuggcugc

SEQ ID NO: 3116420 - RNA, 13 nt, Human
gccucgaacuggc

SEQ ID NO: 3116421 - RNA, 22 nt, Human
gccuccuuugugaggaagccgc

SEQ ID NO: 3116422 - RNA, 12 nt, Human
gccuagcauacg

SEQ ID NO: 3116423 - RNA, 17 nt, Human
gccuacaggagugagca

SEQ ID NO: 3116424 - RNA, 17 nt, Human
gccccuggcagccccug

SEQ ID NO: 3116425 - RNA, 16 nt, Human
gccccuggcagccccu

SEQ ID NO: 3116426 - RNA, 14 nt, Human
gcccugcccaccug

SEQ ID NO: 3116427 - RNA, 23 nt, Human
gcccuuaccugccaggaagccag

SEQ ID NO: 3116428 - RNA, 22 nt, Human
gcccuuaccugccaggaagcca

SEQ ID NO: 3116429 - RNA, 21 nt, Human
gcccuuaccugccaggaagcc

SEQ ID NO: 3116430 - RNA, 17 nt, Human
gcccugugggcccccaa

SEQ ID NO: 3116431 - RNA, 16 nt, Human
gcccugugggccccca

SEQ ID NO: 3116432 - RNA, 16 nt, Human
gccuacaggagugagc

SEQ ID NO: 3116433 - RNA, 21 nt, Human
gcuggguucuacccaggugcu

SEQ ID NO: 3116434 - RNA, 20 nt, Human
gcuggguucuacccaggugc

SEQ ID NO: 3116435 - RNA, 17 nt, Human
gcuggguucuacccagg

SEQ ID NO: 3116436 - RNA, 18 nt, Human
gcuggguucuacccaggu

SEQ ID NO: 3116437 - RNA, 22 nt, Human
gcugggguggggaccucaggcc

SEQ ID NO: 3116438 - RNA, 19 nt, Human
gcugggguggggaccucag

SEQ ID NO: 3116439 - RNA, 17 nt, Human
gcugggguggggaccuc

SEQ ID NO: 3116440 - RNA, 17 nt, Human
gcuggcuguuggcuggg

SEQ ID NO: 3116441 - RNA, 20 nt, Human
gcuggcuguuggcugggggc

SEQ ID NO: 3116442 - RNA, 23 nt, Human
gcuggcuguuggcugggggccuc

SEQ ID NO: 3116443 - RNA, 14 nt, Human
gcugggcagguugg

SEQ ID NO: 3116444 - RNA, 14 nt, Human
gcuggcgugcagug

SEQ ID NO: 3116445 - RNA, 15 nt, Human
gcuggcgugcagugg

SEQ ID NO: 3116446 - RNA, 18 nt, Human
gcuggcgugcaguggugc

SEQ ID NO: 3116447 - RNA, 18 nt, Human
gcuggcuguuggcugggg

SEQ ID NO: 3116448 - RNA, 19 nt, Human
gcuggcuguuggcuggggg

SEQ ID NO: 3116449 - RNA, 17 nt, Human
gcuguaucccaugagcc

SEQ ID NO: 3116450 - RNA, 13 nt, Human
gcugugcucugga

SEQ ID NO: 3116451 - RNA, 14 nt, Human
gcugugcugcccug

SEQ ID NO: 3116452 - RNA, 15 nt, Human
gcugugcucuggaca

SEQ ID NO: 3116453 - RNA, 16 nt, Human
gcugugcucuggacag

SEQ ID NO: 3116454 - RNA, 14 nt, Human
gcuguuggcugggg

SEQ ID NO: 3116455 - RNA, 16 nt, Human
gcuguuggcugggggc

SEQ ID NO: 3116456 - RNA, 20 nt, Human
gcuguuggcugggggccuca

SEQ ID NO: 3116457 - RNA, 15 nt, Human
gcuguuggcuggggg

SEQ ID NO: 3116458 - RNA, 17 nt, Human
gcugugcugcccugccc

SEQ ID NO: 3116459 - RNA, 16 nt, Human
gcugugcugcccugcc

SEQ ID NO: 3116460 - RNA, 15 nt, Human
gcugugcugcccugc

SEQ ID NO: 3116461 - RNA, 23 nt, Human
gcugcaaaggguaucaggugcug

SEQ ID NO: 3116462 - RNA, 16 nt, Human
gcugcacccucaggca

SEQ ID NO: 3116463 - RNA, 13 nt, Human
gcugcaccggcug

SEQ ID NO: 3116464 - RNA, 19 nt, Human
gcugcacccucaggcaggu

SEQ ID NO: 3116465 - RNA, 18 nt, Human
gcugcacccucaggcagg

SEQ ID NO: 3116466 - RNA, 21 nt, Human
gcugccugggaucccucaucc

SEQ ID NO: 3116467 - RNA, 17 nt, Human
gcugccuguucagcucc

SEQ ID NO: 3116468 - RNA, 12 nt, Human
gcugccuguuca

SEQ ID NO: 3116469 - RNA, 13 nt, Human
gcugccuguucag

SEQ ID NO: 3116470 - RNA, 20 nt, Human
gcugccugggaucccucauc

SEQ ID NO: 3116471 - RNA, 16 nt, Human
gcugccucucccauca

SEQ ID NO: 3116472 - RNA, 19 nt, Human
gcugccccuggcagccccu

SEQ ID NO: 3116473 - RNA, 18 nt, Human
gcugccccuggcagcccc

SEQ ID NO: 3116474 - RNA, 20 nt, Human
gcugccccuggcagccccug

SEQ ID NO: 3116475 - RNA, 17 nt, Human
gcugccccuggcagccc

SEQ ID NO: 3116476 - RNA, 14 nt, Human
gcugaggugggagg

SEQ ID NO: 3116477 - RNA, 23 nt, Human
gcugagggugagugggugaauaa

SEQ ID NO: 3116478 - RNA, 18 nt, Human
gcugagggugagugggug

SEQ ID NO: 3116479 - RNA, 14 nt, Human
ggaaagaggcucug

SEQ ID NO: 3116480 - RNA, 20 nt, Human
ggaaagacuuuuccaacccu

SEQ ID NO: 3116481 - RNA, 17 nt, Human
ggaaagaguaggaagac

SEQ ID NO: 3116482 - RNA, 16 nt, Human
ggaaagaguaggaaga

SEQ ID NO: 3116483 - RNA, 19 nt, Human
ggaaagcaaaggagauugg

SEQ ID NO: 3116484 - RNA, 15 nt, Human
gcuuuuuaauauuga

SEQ ID NO: 3116485 - RNA, 12 nt, Human
gcuuuugugcau

SEQ ID NO: 3116486 - RNA, 13 nt, Human
gcuuuugugcauu

SEQ ID NO: 3116487 - RNA, 19 nt, Human
gcuuuugugcauuaucuag

SEQ ID NO: 3116488 - RNA, 20 nt, Human
ggaaacagcuaaugggacac

SEQ ID NO: 3116489 - RNA, 15 nt, Human
ggaaacccagcucug

SEQ ID NO: 3116490 - RNA, 19 nt, Human
gcuugggcuucauccuccu

SEQ ID NO: 3116491 - RNA, 22 nt, Human
gcuuggggaccagagcugccac

SEQ ID NO: 3116492 - RNA, 21 nt, Human
gcuuggggaccagagcugcca

SEQ ID NO: 3116493 - RNA, 20 nt, Human
gcuuggggaccagagcugcc

SEQ ID NO: 3116494 - RNA, 18 nt, Human
gcuuggggaccagagcug

SEQ ID NO: 3116495 - RNA, 17 nt, Human
gcuuggggaccagagcu

SEQ ID NO: 3116496 - RNA, 13 nt, Human
gcuuucuacccag

SEQ ID NO: 3116497 - RNA, 19 nt, Human
gcuuucuacccagcgagcc

SEQ ID NO: 3116498 - RNA, 22 nt, Human
gcuuucuacccagcgagcccug

SEQ ID NO: 3116499 - RNA, 14 nt, Human
gcuuaacuucacau

SEQ ID NO: 3116500 - RNA, 17 nt, Human
gcuuaacuucacauauu

SEQ ID NO: 3116501 - RNA, 16 nt, Human
gcuucuucagagacuc

SEQ ID NO: 3116502 - RNA, 16 nt, Human
gcuuaacuucacauau

SEQ ID NO: 3116503 - RNA, 16 nt, Human
gcuuggggaccagagc

SEQ ID NO: 3116504 - RNA, 23 nt, Human
gcuugggcuucauccuccucaga

SEQ ID NO: 3116505 - RNA, 19 nt, Human
gcuugaccgugaggccaga

SEQ ID NO: 3116506 - RNA, 18 nt, Human
gcuugaccgugaggccag

SEQ ID NO: 3116507 - RNA, 17 nt, Human
gcuugaccgugaggcca

SEQ ID NO: 3116508 - RNA, 16 nt, Human
gcuugaccgugaggcc

SEQ ID NO: 3116509 - RNA, 21 nt, Human
gcuucuucagagacuccugca

SEQ ID NO: 3116510 - RNA, 19 nt, Human
gcuucuucagagacuccug

SEQ ID NO: 3116511 - RNA, 13 nt, Human
ggacauggacaag

SEQ ID NO: 3116512 - RNA, 23 nt, Human
ggacaggcauguucucugaggac

SEQ ID NO: 3116513 - RNA, 17 nt, Human
ggacagggaggugaccc

SEQ ID NO: 3116514 - RNA, 23 nt, Human
ggacacccugugauggggcccug

SEQ ID NO: 3116515 - RNA, 13 nt, Human
ggacacccuguga

SEQ ID NO: 3116516 - RNA, 16 nt, Human
ggaauauauaaccagu

SEQ ID NO: 3116517 - RNA, 19 nt, Human
ggaauaccugucccccuga

SEQ ID NO: 3116518 - RNA, 16 nt, Human
ggaauaccuguccccc

SEQ ID NO: 3116519 - RNA, 15 nt, Human
ggaauaccugucccc

SEQ ID NO: 3116520 - RNA, 21 nt, Human
ggaagcucagggccuggcuca

SEQ ID NO: 3116521 - RNA, 17 nt, Human
ggaagcucagggccugg

SEQ ID NO: 3116522 - RNA, 16 nt, Human
ggaagcucagggccug

SEQ ID NO: 3116523 - RNA, 13 nt, Human
ggacacagcucuu

SEQ ID NO: 3116524 - RNA, 21 nt, Human
ggacacagcucuucuccaggc

SEQ ID NO: 3116525 - RNA, 12 nt, Human
ggacacccugug

SEQ ID NO: 3116526 - RNA, 12 nt, Human
ggacacagcucu

SEQ ID NO: 3116527 - RNA, 19 nt, Human
ggaaugaaugucaguguga

SEQ ID NO: 3116528 - RNA, 23 nt, Human
ggaaaucaccgaaaacguggcug

SEQ ID NO: 3116529 - RNA, 21 nt, Human
ggaagccagcaggcucucagg

SEQ ID NO: 3116530 - RNA, 23 nt, Human
ggaagccagcaggcucucaggcc

SEQ ID NO: 3116531 - RNA, 22 nt, Human
ggaagccagcaggcucucaggc

SEQ ID NO: 3116532 - RNA, 18 nt, Human
ggaagccgcuggggccag

SEQ ID NO: 3116533 - RNA, 18 nt, Human
aggccaaggugggaggau

SEQ ID NO: 3116534 - RNA, 20 nt, Human
aggccaaaggaagcacaugc

SEQ ID NO: 3116535 - RNA, 23 nt, Human
aggccaaaggaagcacaugccuc

SEQ ID NO: 3116536 - RNA, 20 nt, Human
aggccaaacucaccugcccc

SEQ ID NO: 3116537 - RNA, 14 nt, Human
aggccaaaggaagc

SEQ ID NO: 3116538 - RNA, 18 nt, Human
aggcauuuguuugaacug

SEQ ID NO: 3116539 - RNA, 16 nt, Human
aggccaaacucaccug

SEQ ID NO: 3116540 - RNA, 20 nt, Human
uggaccuugaacuggguacu

SEQ ID NO: 3116541 - RNA, 15 nt, Human
aggccacaagacccu

SEQ ID NO: 3116542 - RNA, 15 nt, Human
uggaugccugguggc

SEQ ID NO: 3116543 - RNA, 20 nt, Human
uggaguucaucuugaauugu

SEQ ID NO: 3116544 - RNA, 17 nt, Human
uggaguucaucuugaau

SEQ ID NO: 3116545 - RNA, 16 nt, Human
uggaguucaucuugaa

SEQ ID NO: 3116546 - RNA, 18 nt, Human
uggaugccugguggcagc

SEQ ID NO: 3116547 - RNA, 19 nt, Human
uggaugccugguggcagcu

SEQ ID NO: 3116548 - RNA, 22 nt, Human
uggcagaguugaagacagagcu

SEQ ID NO: 3116549 - RNA, 15 nt, Human
uggcacccggccccu

SEQ ID NO: 3116550 - RNA, 21 nt, Human
uggcagaguugaagacagagc

SEQ ID NO: 3116551 - RNA, 12 nt, Human
uggauguucuga

SEQ ID NO: 3116552 - RNA, 22 nt, Human
uggauuaaacuuaaucuaaaug

SEQ ID NO: 3116553 - RNA, 20 nt, Human
uggcacaucagcacgauuuc

SEQ ID NO: 3116554 - RNA, 18 nt, Human
uggcaccagcagccugga

SEQ ID NO: 3116555 - RNA, 12 nt, Human
uggcagccccug

SEQ ID NO: 3116556 - RNA, 20 nt, Human
aggccacaagacccuugugg

SEQ ID NO: 3116557 - RNA, 15 nt, Human
uggccaggcuggucu

SEQ ID NO: 3116558 - RNA, 17 nt, Human
uggccaggcuggucuca

SEQ ID NO: 3116559 - RNA, 15 nt, Human
uggcaugggaaugaa

SEQ ID NO: 3116560 - RNA, 12 nt, Human
uggcaugggaau

SEQ ID NO: 3116561 - RNA, 14 nt, Human
aggcccucugccca

SEQ ID NO: 3116562 - RNA, 13 nt, Human
aggcccucugccc

SEQ ID NO: 3116563 - RNA, 22 nt, Human
aggccuggccagaugcaccagc

SEQ ID NO: 3116564 - RNA, 23 nt, Human
aggccuggccagaugcaccagcc

SEQ ID NO: 3116565 - RNA, 23 nt, Human
aggccugggggcugggcagagga

SEQ ID NO: 3116566 - RNA, 15 nt, Human
aggccuggccagaug

SEQ ID NO: 3116567 - RNA, 16 nt, Human
aggccuggccagaugc

SEQ ID NO: 3116568 - RNA, 17 nt, Human
aggccuggccagaugca

SEQ ID NO: 3116569 - RNA, 21 nt, Human
aggccuggccagaugcaccag

SEQ ID NO: 3116570 - RNA, 13 nt, Human
uggccucugcacu

SEQ ID NO: 3116571 - RNA, 17 nt, Human
uggccucugcacucccc

SEQ ID NO: 3116572 - RNA, 15 nt, Human
uggccucugcacucc

SEQ ID NO: 3116573 - RNA, 14 nt, Human
uggccucugcacuc

SEQ ID NO: 3116574 - RNA, 21 nt, Human
uggccccugcccggcugcgga

SEQ ID NO: 3116575 - RNA, 20 nt, Human
uggccccugcccggcugcgg

SEQ ID NO: 3116576 - RNA, 16 nt, Human
ugggaaaggggaaguu

SEQ ID NO: 3116577 - RNA, 23 nt, Human
uggcuucacggaagagccuugcg

SEQ ID NO: 3116578 - RNA, 22 nt, Human
uggcuucacggaagagccuugc

SEQ ID NO: 3116579 - RNA, 13 nt, Human
uggcuguuggcug

SEQ ID NO: 3116580 - RNA, 14 nt, Human
uggcugugucuccc

SEQ ID NO: 3116581 - RNA, 15 nt, Human
uggcuguuggcuggg

SEQ ID NO: 3116582 - RNA, 17 nt, Human
uggcuuaaaacaacacu

SEQ ID NO: 3116583 - RNA, 15 nt, Human
uggcugcagggaguc

SEQ ID NO: 3116584 - RNA, 13 nt, Human
uggcugcagggag

SEQ ID NO: 3116585 - RNA, 14 nt, Human
uggcugcagggagu

SEQ ID NO: 3116586 - RNA, 20 nt, Human
uggcugccaaugggagcuca

SEQ ID NO: 3116587 - RNA, 18 nt, Human
uggcugccaaugggagcu

SEQ ID NO: 3116588 - RNA, 18 nt, Human
uggcucaaguccucuuuu

SEQ ID NO: 3116589 - RNA, 19 nt, Human
uggcucuuccaggcuggga

SEQ ID NO: 3116590 - RNA, 21 nt, Human
uggcucuuccaggcugggaga

SEQ ID NO: 3116591 - RNA, 20 nt, Human
uggcucuuccaggcugggag

SEQ ID NO: 3116592 - RNA, 12 nt, Human
uggcugcaaagg

SEQ ID NO: 3116593 - RNA, 14 nt, Human
aggcugggagagcc

SEQ ID NO: 3116594 - RNA, 22 nt, Human
uggcuagagguucaaagauauu

SEQ ID NO: 3116595 - RNA, 18 nt, Human
aggcuggcgugcaguggu

SEQ ID NO: 3116596 - RNA, 20 nt, Human
aggcuggcgugcaguggugc

SEQ ID NO: 3116597 - RNA, 15 nt, Human
uggcuaugcauuuga

SEQ ID NO: 3116598 - RNA, 17 nt, Human
uggcuaugcauuugaaa

SEQ ID NO: 3116599 - RNA, 14 nt, Human
uggcuaugcauuug

SEQ ID NO: 3116600 - RNA, 22 nt, Human
uggcuauuagagaucaaccccu

SEQ ID NO: 3116601 - RNA, 19 nt, Human
uggcuaugcauuugaaaau

SEQ ID NO: 3116602 - RNA, 21 nt, Human
aggcucucaggccagcugcuu

SEQ ID NO: 3116603 - RNA, 11 nt, Human
aggcucugccc

SEQ ID NO: 3116604 - RNA, 12 nt, Human
aggcucugcccu

SEQ ID NO: 3116605 - RNA, 13 nt, Human
aggcucugcccuu

SEQ ID NO: 3116606 - RNA, 15 nt, Human
aggcucugcccuugg

SEQ ID NO: 3116607 - RNA, 14 nt, Human
aggcucugcccuug

SEQ ID NO: 3116608 - RNA, 20 nt, Human
aggcucucaggccagcugcu

SEQ ID NO: 3116609 - RNA, 19 nt, Human
aggcucucaggccagcugc

SEQ ID NO: 3116610 - RNA, 18 nt, Human
aggcucucaggccagcug

SEQ ID NO: 3116611 - RNA, 16 nt, Human
aggcucucaggccagc

SEQ ID NO: 3116612 - RNA, 15 nt, Human
aggcucucaggccag

SEQ ID NO: 3116613 - RNA, 14 nt, Human
aggcucucaggcca

SEQ ID NO: 3116614 - RNA, 12 nt, Human
aggcucucaggc

SEQ ID NO: 3116615 - RNA, 11 nt, Human
aggcucucagg

SEQ ID NO: 3116616 - RNA, 21 nt, Human
aggcucgagcaugccuggaug

SEQ ID NO: 3116617 - RNA, 19 nt, Human
aggcucgagcaugccugga

SEQ ID NO: 3116618 - RNA, 18 nt, Human
aggcucgagcaugccugg

SEQ ID NO: 3116619 - RNA, 17 nt, Human
aggcucgagcaugccug

SEQ ID NO: 3116620 - RNA, 15 nt, Human
aggcucgagcaugcc

SEQ ID NO: 3116621 - RNA, 19 nt, Human
aggcuccuuuagcgcccag

SEQ ID NO: 3116622 - RNA, 12 nt, Human
aggcucgagcau

SEQ ID NO: 3116623 - RNA, 13 nt, Human
aggcuggcgugca

SEQ ID NO: 3116624 - RNA, 17 nt, Human
aggcuggcgugcagugg

SEQ ID NO: 3116625 - RNA, 16 nt, Human
aggcucugcccuuggu

SEQ ID NO: 3116626 - RNA, 16 nt, Human
ugcucugcugacagac

SEQ ID NO: 3116627 - RNA, 14 nt, Human
ugcugagucugaag

SEQ ID NO: 3116628 - RNA, 15 nt, Human
ugcugagucugaagg

SEQ ID NO: 3116629 - RNA, 21 nt, Human
ugcucugcugacagacacagg

SEQ ID NO: 3116630 - RNA, 22 nt, Human
ugcucugcugacagacacaggc

SEQ ID NO: 3116631 - RNA, 19 nt, Human
ugcuccagcuguucagcug

SEQ ID NO: 3116632 - RNA, 16 nt, Human
ugcuccagcuguucag

SEQ ID NO: 3116633 - RNA, 16 nt, Human
agcugggacuacaggc

SEQ ID NO: 3116634 - RNA, 18 nt, Human
agcugggacuacaggcac

SEQ ID NO: 3116635 - RNA, 22 nt, Human
aggaagcacaugccucucucag

SEQ ID NO: 3116636 - RNA, 15 nt, Human
aggaagccagcaggc

SEQ ID NO: 3116637 - RNA, 14 nt, Human
aggaagccagcagg

SEQ ID NO: 3116638 - RNA, 24 nt, Human
aggaagcacaugccucucucaggc

SEQ ID NO: 3116639 - RNA, 23 nt, Human
aggaagcacaugccucucucagg

SEQ ID NO: 3116640 - RNA, 14 nt, Human
aggaagacuuugga

SEQ ID NO: 3116641 - RNA, 13 nt, Human
aggaagacuuugg

SEQ ID NO: 3116642 - RNA, 19 nt, Human
aggaagacuucaucccucu

SEQ ID NO: 3116643 - RNA, 13 nt, Human
aggaagacuucau

SEQ ID NO: 3116644 - RNA, 22 nt, Human
ugcugagucugaaggcuggguu

SEQ ID NO: 3116645 - RNA, 21 nt, Human
ugcugagucugaaggcugggu

SEQ ID NO: 3116646 - RNA, 18 nt, Human
ugcugagucugaaggcug

SEQ ID NO: 3116647 - RNA, 17 nt, Human
ugcugagucugaaggcu

SEQ ID NO: 3116648 - RNA, 16 nt, Human
ugcugagucugaaggc

SEQ ID NO: 3116649 - RNA, 18 nt, Human
aggaaggaaacccagcuc

SEQ ID NO: 3116650 - RNA, 13 nt, Human
aggaagccagcag

SEQ ID NO: 3116651 - RNA, 17 nt, Human
aggaagccagcaggcuc

SEQ ID NO: 3116652 - RNA, 15 nt, Human
aggaaggagaggaga

SEQ ID NO: 3116653 - RNA, 19 nt, Human
aggaaggaaacccagcucu

SEQ ID NO: 3116654 - RNA, 16 nt, Human
ugcuggcugguuagag

SEQ ID NO: 3116655 - RNA, 12 nt, Human
ugcugcccugug

SEQ ID NO: 3116656 - RNA, 14 nt, Human
ugcugcccugugag

SEQ ID NO: 3116657 - RNA, 13 nt, Human
ugcugcccuguga

SEQ ID NO: 3116658 - RNA, 15 nt, Human
ugcugcccugugagu

SEQ ID NO: 3116659 - RNA, 13 nt, Human
ugcuuauacacuu

SEQ ID NO: 3116660 - RNA, 12 nt, Human
ugcuucaaggau

SEQ ID NO: 3116661 - RNA, 13 nt, Human
ugcuucagccucc

SEQ ID NO: 3116662 - RNA, 14 nt, Human
ugcuucagccuccc

SEQ ID NO: 3116663 - RNA, 19 nt, Human
ugcuucaaggauccugagc

SEQ ID NO: 3116664 - RNA, 18 nt, Human
ugcuucaaggauccugag

SEQ ID NO: 3116665 - RNA, 16 nt, Human
ugcuucaaggauccug

SEQ ID NO: 3116666 - RNA, 22 nt, Human
aggacagggaggugaccccagg

SEQ ID NO: 3116667 - RNA, 23 nt, Human
aggacacuaaccacgcuggaccu

SEQ ID NO: 3116668 - RNA, 19 nt, Human
aggacacuaaccacgcugg

SEQ ID NO: 3116669 - RNA, 16 nt, Human
aggauccugagccaga

SEQ ID NO: 3116670 - RNA, 15 nt, Human
aggauccugagccag

SEQ ID NO: 3116671 - RNA, 17 nt, Human
aggaugaucuaggaaga

SEQ ID NO: 3116672 - RNA, 16 nt, Human
aggaugaucuaggaag

SEQ ID NO: 3116673 - RNA, 18 nt, Human
aggauccugagccagauu

SEQ ID NO: 3116674 - RNA, 17 nt, Human
aggauccugagccagau

SEQ ID NO: 3116675 - RNA, 22 nt, Human
aggaucucuugagccugggagg

SEQ ID NO: 3116676 - RNA, 21 nt, Human
aggaucucuugagccugggag

SEQ ID NO: 3116677 - RNA, 20 nt, Human
uggaaauauuaagaaagacu

SEQ ID NO: 3116678 - RNA, 18 nt, Human
uggaaaugggcagagcag

SEQ ID NO: 3116679 - RNA, 23 nt, Human
uggaaaugggcagagcagagacc

SEQ ID NO: 3116680 - RNA, 13 nt, Human
uggacccugaggc

SEQ ID NO: 3116681 - RNA, 12 nt, Human
uggacccugagg

SEQ ID NO: 3116682 - RNA, 14 nt, Human
uggacccugaggcc

SEQ ID NO: 3116683 - RNA, 18 nt, Human
uggacacagcucuucucc

SEQ ID NO: 3116684 - RNA, 15 nt, Human
uggacacagcucuuc

SEQ ID NO: 3116685 - RNA, 16 nt, Human
uggacacagcucuucu

SEQ ID NO: 3116686 - RNA, 19 nt, Human
aggauuuugauccaagcug

SEQ ID NO: 3116687 - RNA, 19 nt, Human
aggaugcccaaagaugcag

SEQ ID NO: 3116688 - RNA, 14 nt, Human
aggaugcccaaaga

SEQ ID NO: 3116689 - RNA, 20 nt, Human
aggaugaucuaggaagacuu

SEQ ID NO: 3116690 - RNA, 17 nt, Human
aggcaacucaucuuagg

SEQ ID NO: 3116691 - RNA, 19 nt, Human
aggacauugcggacagcca

SEQ ID NO: 3116692 - RNA, 23 nt, Human
aggacauugcggacagccacggc

SEQ ID NO: 3116693 - RNA, 15 nt, Human
aggacauugcggaca

SEQ ID NO: 3116694 - RNA, 17 nt, Human
aggacauugcggacagc

SEQ ID NO: 3116695 - RNA, 18 nt, Human
aggacauugcggacagcc

SEQ ID NO: 3116696 - RNA, 17 nt, Human
aggagauuggaaggaac

SEQ ID NO: 3116697 - RNA, 23 nt, Human
aggacuuuucuuuguggcuuccu

SEQ ID NO: 3116698 - RNA, 14 nt, Human
aggagcagccacau

SEQ ID NO: 3116699 - RNA, 22 nt, Human
aggagccccgaggccuucucug

SEQ ID NO: 3116700 - RNA, 15 nt, Human
uggaaauauuaagaa

SEQ ID NO: 3116701 - RNA, 19 nt, Human
ugcuugggcuucauccucc

SEQ ID NO: 3116702 - RNA, 16 nt, Human
ugcuugggcuucaucc

SEQ ID NO: 3116703 - RNA, 12 nt, Human
ugcuugggcuuc

SEQ ID NO: 3116704 - RNA, 21 nt, Human
ugcuuggaggaaggaaaccca

SEQ ID NO: 3116705 - RNA, 17 nt, Human
aggagccuccugcccuu

SEQ ID NO: 3116706 - RNA, 13 nt, Human
agcuccagcucac

SEQ ID NO: 3116707 - RNA, 17 nt, Human
agcuccagcucaccagc

SEQ ID NO: 3116708 - RNA, 19 nt, Human
agcuccaagcucccaggca

SEQ ID NO: 3116709 - RNA, 18 nt, Human
agcuccaagcucccaggc

SEQ ID NO: 3116710 - RNA, 16 nt, Human
agcuccaagcucccag

SEQ ID NO: 3116711 - RNA, 17 nt, Human
agcuccaagcucccagg

SEQ ID NO: 3116712 - RNA, 19 nt, Human
ugcccuaaaguguauuuuu

SEQ ID NO: 3116713 - RNA, 22 nt, Human
agcuccuucuguccuacucugu

SEQ ID NO: 3116714 - RNA, 23 nt, Human
agcuccuucuguccuacucugug

SEQ ID NO: 3116715 - RNA, 21 nt, Human
agcuccagcucaccagcccca

SEQ ID NO: 3116716 - RNA, 18 nt, Human
agcuccagcucaccagcc

SEQ ID NO: 3116717 - RNA, 19 nt, Human
agcuccagcucaccagccc

SEQ ID NO: 3116718 - RNA, 23 nt, Human
agcucuguccugggagugagcug

SEQ ID NO: 3116719 - RNA, 17 nt, Human
ugccugcccaggccccu

SEQ ID NO: 3116720 - RNA, 18 nt, Human
ugccugcccaggccccug

SEQ ID NO: 3116721 - RNA, 19 nt, Human
ugccugcccaggccccugc

SEQ ID NO: 3116722 - RNA, 11 nt, Human
ugccucugccu

SEQ ID NO: 3116723 - RNA, 14 nt, Human
ugccucugacacac

SEQ ID NO: 3116724 - RNA, 16 nt, Human
ugccucugacacacag

SEQ ID NO: 3116725 - RNA, 13 nt, Human
agcugccuguuca

SEQ ID NO: 3116726 - RNA, 22 nt, Human
agcugcuuuugucuaugggacu

SEQ ID NO: 3116727 - RNA, 10 nt, Human
agcugccugu

SEQ ID NO: 3116728 - RNA, 15 nt, Human
agcugggacuacagg

SEQ ID NO: 3116729 - RNA, 23 nt, Human
agcugcuuuugucuaugggacuc

SEQ ID NO: 3116730 - RNA, 24 nt, Human
agcugcuuuugucuaugggacuca

SEQ ID NO: 3116731 - RNA, 22 nt, Human
ugcccuuaccugccaggaagcc

SEQ ID NO: 3116732 - RNA, 18 nt, Human
ugcccugugggcccccaa

SEQ ID NO: 3116733 - RNA, 15 nt, Human
ugcccugugggcccc

SEQ ID NO: 3116734 - RNA, 15 nt, Human
agcucuucuccaggc

SEQ ID NO: 3116735 - RNA, 16 nt, Human
agcucuucuccaggcu

SEQ ID NO: 3116736 - RNA, 23 nt, Human
ugcccugugaguacuacaguccu

SEQ ID NO: 3116737 - RNA, 19 nt, Human
ugcccuuaccugccaggaa

SEQ ID NO: 3116738 - RNA, 20 nt, Human
ugccgcagcccugcagaggg

SEQ ID NO: 3116739 - RNA, 14 nt, Human
ugccgcagcccugc

SEQ ID NO: 3116740 - RNA, 22 nt, Human
ugccucccaucacccgcuaaga

SEQ ID NO: 3116741 - RNA, 16 nt, Human
ugccucucucaggcca

SEQ ID NO: 3116742 - RNA, 17 nt, Human
ugccucucucaggccaa

SEQ ID NO: 3116743 - RNA, 20 nt, Human
ugcccaaagaugcagccggu

SEQ ID NO: 3116744 - RNA, 17 nt, Human
ugcccaaagaugcagcc

SEQ ID NO: 3116745 - RNA, 17 nt, Human
ugcccagccccuucuga

SEQ ID NO: 3116746 - RNA, 16 nt, Human
ugcccagccccuucug

SEQ ID NO: 3116747 - RNA, 12 nt, Human
ugcccagccccu

SEQ ID NO: 3116748 - RNA, 13 nt, Human
ugcccagccccuu

SEQ ID NO: 3116749 - RNA, 14 nt, Human
ugcccaggccccug

SEQ ID NO: 3116750 - RNA, 15 nt, Human
ugcccaggccccugc

SEQ ID NO: 3116751 - RNA, 17 nt, Human
ugcccaggccccugcca

SEQ ID NO: 3116752 - RNA, 18 nt, Human
ugcccaggccccugccac

SEQ ID NO: 3116753 - RNA, 23 nt, Human
ugccccgaacauguuuuucuucu

SEQ ID NO: 3116754 - RNA, 20 nt, Human
ugcccuaaaguguauuuuuu

SEQ ID NO: 3116755 - RNA, 19 nt, Human
agcuauucaguaauaacuc

SEQ ID NO: 3116756 - RNA, 13 nt, Human
agcucagggccug

SEQ ID NO: 3116757 - RNA, 12 nt, Human
agcucagggccu

SEQ ID NO: 3116758 - RNA, 19 nt, Human
agcucagggccuggcucag

SEQ ID NO: 3116759 - RNA, 18 nt, Human
agcucagggccuggcuca

SEQ ID NO: 3116760 - RNA, 20 nt, Human
agcucagggccuggcucagg

SEQ ID NO: 3116761 - RNA, 15 nt, Human
agcuccaagcuccca

SEQ ID NO: 3116762 - RNA, 21 nt, Human
agcuaggccuggccagaugca

SEQ ID NO: 3116763 - RNA, 16 nt, Human
agcuaggccuggccag

SEQ ID NO: 3116764 - RNA, 18 nt, Human
agccuuccagggguggga

SEQ ID NO: 3116765 - RNA, 15 nt, Human
agccuugaacuuuga

SEQ ID NO: 3116766 - RNA, 22 nt, Human
agcgauucuucugcuucagccu

SEQ ID NO: 3116767 - RNA, 23 nt, Human
agccuugaccauucuccaccugc

SEQ ID NO: 3116768 - RNA, 22 nt, Human
agccuugaccauucuccaccug

SEQ ID NO: 3116769 - RNA, 13 nt, Human
agccuugaacuuu

SEQ ID NO: 3116770 - RNA, 16 nt, Human
agccuugaacuuugac

SEQ ID NO: 3116771 - RNA, 22 nt, Human
agccuugaacuuugaccucugc

SEQ ID NO: 3116772 - RNA, 19 nt, Human
ugcauuugaggucuguucu

SEQ ID NO: 3116773 - RNA, 18 nt, Human
ugcauuugaggucuguuc

SEQ ID NO: 3116774 - RNA, 20 nt, Human
ugcauuuaaaagauacaguu

SEQ ID NO: 3116775 - RNA, 20 nt, Human
ugcauuugaggucuguucuu

SEQ ID NO: 3116776 - RNA, 21 nt, Human
ugcauuugaggucuguucuuu

SEQ ID NO: 3116777 - RNA, 22 nt, Human
agcggggacagcuccuucuguc

SEQ ID NO: 3116778 - RNA, 19 nt, Human
agcggggacagcuccuucu

SEQ ID NO: 3116779 - RNA, 20 nt, Human
agcggggacagcuccuucug

SEQ ID NO: 3116780 - RNA, 23 nt, Human
agcggcuggcagcccaccccuca

SEQ ID NO: 3116781 - RNA, 18 nt, Human
ugccagcuuaucucaggg

SEQ ID NO: 3116782 - RNA, 13 nt, Human
agcggcuggcagc

SEQ ID NO: 3116783 - RNA, 16 nt, Human
agcccuuagcagggaa

SEQ ID NO: 3116784 - RNA, 16 nt, Human
ugcagacucuacagag

SEQ ID NO: 3116785 - RNA, 17 nt, Human
ugcagacucuacagagg

SEQ ID NO: 3116786 - RNA, 21 nt, Human
agcccuuagcagggaaacagc

SEQ ID NO: 3116787 - RNA, 17 nt, Human
agccgagaucacgccac

SEQ ID NO: 3116788 - RNA, 21 nt, Human
agccgagauagccaaggccaa

SEQ ID NO: 3116789 - RNA, 20 nt, Human
agccgagauagccaaggcca

SEQ ID NO: 3116790 - RNA, 19 nt, Human
ugcacuccccugcugggug

SEQ ID NO: 3116791 - RNA, 17 nt, Human
ugcacuccccugcuggg

SEQ ID NO: 3116792 - RNA, 16 nt, Human
ugcacuccccugcugg

SEQ ID NO: 3116793 - RNA, 11 nt, Human
ugcacacauuu

SEQ ID NO: 3116794 - RNA, 12 nt, Human
ugcacacauuuu

SEQ ID NO: 3116795 - RNA, 13 nt, Human
ugcacacauuuuu

SEQ ID NO: 3116796 - RNA, 15 nt, Human
ugcacacauuuuuua

SEQ ID NO: 3116797 - RNA, 22 nt, Human
ugcagacaggcaagcaccuccu

SEQ ID NO: 3116798 - RNA, 22 nt, Human
ugcagccucaaccuccugggcu

SEQ ID NO: 3116799 - RNA, 20 nt, Human
ugcagccucaaccuccuggg

SEQ ID NO: 3116800 - RNA, 21 nt, Human
ugcagccucaaccuccugggc

SEQ ID NO: 3116801 - RNA, 23 nt, Human
agccucugaaaaccaauguucuc

SEQ ID NO: 3116802 - RNA, 18 nt, Human
agccucacaguccuuacc

SEQ ID NO: 3116803 - RNA, 17 nt, Human
agccucacaguccuuac

SEQ ID NO: 3116804 - RNA, 20 nt, Human
agccucaaccuccugggcua

SEQ ID NO: 3116805 - RNA, 19 nt, Human
agccucaaccuccugggcu

SEQ ID NO: 3116806 - RNA, 20 nt, Human
ugcaaaccaucauugaaauc

SEQ ID NO: 3116807 - RNA, 21 nt, Human
ugcaaaccaucauugaaaucu

SEQ ID NO: 3116808 - RNA, 21 nt, Human
agcccaggccuccuacagcuu

SEQ ID NO: 3116809 - RNA, 17 nt, Human
agccccaaaacucuccu

SEQ ID NO: 3116810 - RNA, 16 nt, Human
agccccaaaacucucc

SEQ ID NO: 3116811 - RNA, 20 nt, Human
agccccauucugccugccca

SEQ ID NO: 3116812 - RNA, 18 nt, Human
agccccaaaacucuccuc

SEQ ID NO: 3116813 - RNA, 21 nt, Human
agccccauucugccugcccag

SEQ ID NO: 3116814 - RNA, 22 nt, Human
agccccauucugccugcccagg

SEQ ID NO: 3116815 - RNA, 14 nt, Human
agcccugguggcag

SEQ ID NO: 3116816 - RNA, 15 nt, Human
agcccugguggcagu

SEQ ID NO: 3116817 - RNA, 16 nt, Human
agcccugguggcagug

SEQ ID NO: 3116818 - RNA, 21 nt, Human
ugcacacaccagagcccaccu

SEQ ID NO: 3116819 - RNA, 17 nt, Human
ugcacacaccagagccc

SEQ ID NO: 3116820 - RNA, 18 nt, Human
ugcacacaccagagccca

SEQ ID NO: 3116821 - RNA, 18 nt, Human
ugauuuccguuaaaauac

SEQ ID NO: 3116822 - RNA, 22 nt, Human
ugauuuccguuaaaauaccagc

SEQ ID NO: 3116823 - RNA, 17 nt, Human
ugauuuggggauauuuu

SEQ ID NO: 3116824 - RNA, 22 nt, Human
ugauucccaagcucugcuccuc

SEQ ID NO: 3116825 - RNA, 23 nt, Human
ugauucccaagcucugcuccucu

SEQ ID NO: 3116826 - RNA, 21 nt, Human
ugauucauaaugacuuaagca

SEQ ID NO: 3116827 - RNA, 16 nt, Human
ugauucauaaugacuu

SEQ ID NO: 3116828 - RNA, 15 nt, Human
ugauucauaaugacu

SEQ ID NO: 3116829 - RNA, 14 nt, Human
agcccaggaaaggc

SEQ ID NO: 3116830 - RNA, 21 nt, Human
agccaguaaaugggggugcau

SEQ ID NO: 3116831 - RNA, 13 nt, Human
agccaguaaaugg

SEQ ID NO: 3116832 - RNA, 13 nt, Human
agcccacuucugc

SEQ ID NO: 3116833 - RNA, 14 nt, Human
agcccacuucugcc

SEQ ID NO: 3116834 - RNA, 15 nt, Human
agcccacuucugcca

SEQ ID NO: 3116835 - RNA, 18 nt, Human
agccacugcaccgggcca

SEQ ID NO: 3116836 - RNA, 19 nt, Human
agccacugcaccgggccac

SEQ ID NO: 3116837 - RNA, 11 nt, Human
agccagaggag

SEQ ID NO: 3116838 - RNA, 10 nt, Human
agccagagga

SEQ ID NO: 3116839 - RNA, 13 nt, Human
ugauggugcaaug

SEQ ID NO: 3116840 - RNA, 19 nt, Human
ugauuaaauucuugcaaag

SEQ ID NO: 3116841 - RNA, 20 nt, Human
ugauuaaauucuugcaaagu

SEQ ID NO: 3116842 - RNA, 19 nt, Human
ugauuaaccacuucagcug

SEQ ID NO: 3116843 - RNA, 16 nt, Human
agccacugcaccgggc

SEQ ID NO: 3116844 - RNA, 22 nt, Human
ugauccucccaccucagccucc

SEQ ID NO: 3116845 - RNA, 21 nt, Human
ugauccucccaccucagccuc

SEQ ID NO: 3116846 - RNA, 15 nt, Human
ugauccucccaccuc

SEQ ID NO: 3116847 - RNA, 16 nt, Human
ugauccuaguuccacc

SEQ ID NO: 3116848 - RNA, 23 nt, Human
ugaugcuucuucagagacuccug

SEQ ID NO: 3116849 - RNA, 16 nt, Human
ugaugagaggaaauca

SEQ ID NO: 3116850 - RNA, 15 nt, Human
ugaugagaggaaauc

SEQ ID NO: 3116851 - RNA, 14 nt, Human
ugaugagaggaaau

SEQ ID NO: 3116852 - RNA, 13 nt, Human
ugaugagaggaaa

SEQ ID NO: 3116853 - RNA, 19 nt, Human
ugauggggcccugccuccu

SEQ ID NO: 3116854 - RNA, 16 nt, Human
ugauggggcccugccu

SEQ ID NO: 3116855 - RNA, 15 nt, Human
ugauggggcccugcc

SEQ ID NO: 3116856 - RNA, 14 nt, Human
ugauggggcccugc

SEQ ID NO: 3116857 - RNA, 23 nt, Human
agugaaaaaggaggaagagaaaa

SEQ ID NO: 3116858 - RNA, 20 nt, Human
agugaaaaaggaggaagaga

SEQ ID NO: 3116859 - RNA, 17 nt, Human
agugaaaaaggaggaag

SEQ ID NO: 3116860 - RNA, 11 nt, Human
agugaaaaagg

SEQ ID NO: 3116861 - RNA, 19 nt, Human
ugugagcacaaagguagcu

SEQ ID NO: 3116862 - RNA, 14 nt, Human
ugugaagagaacca

SEQ ID NO: 3116863 - RNA, 13 nt, Human
agugagacucugu

SEQ ID NO: 3116864 - RNA, 21 nt, Human
agugagacccugucucaaaaa

SEQ ID NO: 3116865 - RNA, 17 nt, Human
agugagacccugucuca

SEQ ID NO: 3116866 - RNA, 22 nt, Human
agugagacucugucucaaaaaa

SEQ ID NO: 3116867 - RNA, 16 nt, Human
agugagacucugucuc

SEQ ID NO: 3116868 - RNA, 17 nt, Human
agugagacucugucuca

SEQ ID NO: 3116869 - RNA, 16 nt, Human
ugugauggggcccugc

SEQ ID NO: 3116870 - RNA, 15 nt, Human
ugugauggggcccug

SEQ ID NO: 3116871 - RNA, 22 nt, Human
agugagcacuaaggugugcucu

SEQ ID NO: 3116872 - RNA, 14 nt, Human
agugagagcugggu

SEQ ID NO: 3116873 - RNA, 17 nt, Human
ugugauggggcccugcc

SEQ ID NO: 3116874 - RNA, 15 nt, Human
ugucuugcaauggca

SEQ ID NO: 3116875 - RNA, 17 nt, Human
ugucuugcaauggcagc

SEQ ID NO: 3116876 - RNA, 18 nt, Human
ugucuugcaauggcagcc

SEQ ID NO: 3116877 - RNA, 20 nt, Human
ugucuugcaauggcagccuu

SEQ ID NO: 3116878 - RNA, 21 nt, Human
ugucuugcaauggcagccuug

SEQ ID NO: 3116879 - RNA, 16 nt, Human
ugugaaccaccacacc

SEQ ID NO: 3116880 - RNA, 21 nt, Human
ugugaaccaccacacccagcc

SEQ ID NO: 3116881 - RNA, 22 nt, Human
ugugaaccaccacacccagccc

SEQ ID NO: 3116882 - RNA, 23 nt, Human
ugugaaccaccacacccagccca

SEQ ID NO: 3116883 - RNA, 15 nt, Human
ugugaaccaccacac

SEQ ID NO: 3116884 - RNA, 21 nt, Human
ugucucuugguccugcugcag

SEQ ID NO: 3116885 - RNA, 20 nt, Human
ugucucuugguccugcugca

SEQ ID NO: 3116886 - RNA, 19 nt, Human
ugucucuugguccugcugc

SEQ ID NO: 3116887 - RNA, 18 nt, Human
ugucucuugguccugcug

SEQ ID NO: 3116888 - RNA, 22 nt, Human
ugucucuuuaaugucacaggca

SEQ ID NO: 3116889 - RNA, 21 nt, Human
ugucucuuuaaugucacaggc

SEQ ID NO: 3116890 - RNA, 22 nt, Human
ugucucuugguccugcugcagu

SEQ ID NO: 3116891 - RNA, 16 nt, Human
agucccugccaaugga

SEQ ID NO: 3116892 - RNA, 14 nt, Human
agucccugccaaug

SEQ ID NO: 3116893 - RNA, 13 nt, Human
agucccugccaau

SEQ ID NO: 3116894 - RNA, 23 nt, Human
aguccccuguuuguuucugaaag

SEQ ID NO: 3116895 - RNA, 13 nt, Human
ugucucugagagu

SEQ ID NO: 3116896 - RNA, 16 nt, Human
ugucagccauuccugu

SEQ ID NO: 3116897 - RNA, 12 nt, Human
ugucccuuuucc

SEQ ID NO: 3116898 - RNA, 19 nt, Human
aguccccuguuuguuucug

SEQ ID NO: 3116899 - RNA, 14 nt, Human
aguccccuguuugu

SEQ ID NO: 3116900 - RNA, 21 nt, Human
agucccaccuuggcugcaggg

SEQ ID NO: 3116901 - RNA, 23 nt, Human
agucccaccuuggcugcagggag

SEQ ID NO: 3116902 - RNA, 20 nt, Human
agucccaccuuggcugcagg

SEQ ID NO: 3116903 - RNA, 19 nt, Human
agucagggguucccuuuuu

SEQ ID NO: 3116904 - RNA, 15 nt, Human
aguauuauaccuuuu

SEQ ID NO: 3116905 - RNA, 14 nt, Human
aguauuauaccuuu

SEQ ID NO: 3116906 - RNA, 19 nt, Human
aguagcugggacuacaggc

SEQ ID NO: 3116907 - RNA, 21 nt, Human
aguagcugggacuacaggcac

SEQ ID NO: 3116908 - RNA, 22 nt, Human
aguagcugggacuacaggcacc

SEQ ID NO: 3116909 - RNA, 16 nt, Human
agucacugagacagcc

SEQ ID NO: 3116910 - RNA, 15 nt, Human
agucacugagacagc

SEQ ID NO: 3116911 - RNA, 17 nt, Human
agucacugagacagccc

SEQ ID NO: 3116912 - RNA, 15 nt, Human
ugucagcauagaagu

SEQ ID NO: 3116913 - RNA, 14 nt, Human
uguauguguaagua

SEQ ID NO: 3116914 - RNA, 15 nt, Human
uguaucccaugagcc

SEQ ID NO: 3116915 - RNA, 12 nt, Human
uguagagccagg

SEQ ID NO: 3116916 - RNA, 15 nt, Human
uguagagccaggguc

SEQ ID NO: 3116917 - RNA, 19 nt, Human
ugucaaaguggugagaggc

SEQ ID NO: 3116918 - RNA, 16 nt, Human
ugucaaaguggugaga

SEQ ID NO: 3116919 - RNA, 13 nt, Human
aguagcugggacu

SEQ ID NO: 3116920 - RNA, 14 nt, Human
aguagcugggacua

SEQ ID NO: 3116921 - RNA, 15 nt, Human
ugucaaaguggugag

SEQ ID NO: 3116922 - RNA, 14 nt, Human
ugucaaagugguga

SEQ ID NO: 3116923 - RNA, 20 nt, Human
uggucaccaaaucagcugcu

SEQ ID NO: 3116924 - RNA, 23 nt, Human
uggucaccaaaucagcugcuacu

SEQ ID NO: 3116925 - RNA, 21 nt, Human
uggucaccaaaucagcugcua

SEQ ID NO: 3116926 - RNA, 16 nt, Human
ugguccauagagagca

SEQ ID NO: 3116927 - RNA, 15 nt, Human
ugguccauagagagc

SEQ ID NO: 3116928 - RNA, 23 nt, Human
uggguggaugccugguggcagcu

SEQ ID NO: 3116929 - RNA, 14 nt, Human
uggguggaugccug

SEQ ID NO: 3116930 - RNA, 19 nt, Human
aggguacuaaggaaucuuu

SEQ ID NO: 3116931 - RNA, 16 nt, Human
aggguaucaggugcug

SEQ ID NO: 3116932 - RNA, 13 nt, Human
agggggcugggac

SEQ ID NO: 3116933 - RNA, 13 nt, Human
aggguuggccccu

SEQ ID NO: 3116934 - RNA, 14 nt, Human
aggguuggccccug

SEQ ID NO: 3116935 - RNA, 13 nt, Human
aggguugggcugg

SEQ ID NO: 3116936 - RNA, 15 nt, Human
aggguugggcuggug

SEQ ID NO: 3116937 - RNA, 19 nt, Human
uggugaacagaacaaaagg

SEQ ID NO: 3116938 - RNA, 17 nt, Human
aggguggugaccucugc

SEQ ID NO: 3116939 - RNA, 18 nt, Human
aggguggugaccucugcc

SEQ ID NO: 3116940 - RNA, 19 nt, Human
aggguggugaccucugccu

SEQ ID NO: 3116941 - RNA, 19 nt, Human
ugguccauagagagcaaga

SEQ ID NO: 3116942 - RNA, 12 nt, Human
uggucuguguga

SEQ ID NO: 3116943 - RNA, 18 nt, Human
uggucugacccacugcuu

SEQ ID NO: 3116944 - RNA, 18 nt, Human
aggucuugaacuccuggc

SEQ ID NO: 3116945 - RNA, 20 nt, Human
aggucauuuuuuuuaagaaa

SEQ ID NO: 3116946 - RNA, 20 nt, Human
aggucuugaacuccuggccu

SEQ ID NO: 3116947 - RNA, 21 nt, Human
aggucuugaacuccuggccuc

SEQ ID NO: 3116948 - RNA, 22 nt, Human
aggucauuuuuuuuaagaaaaa

SEQ ID NO: 3116949 - RNA, 23 nt, Human
aggucauuuuuuuuaagaaaaag

SEQ ID NO: 3116950 - RNA, 21 nt, Human
aggucaaggcugcagugagcc

SEQ ID NO: 3116951 - RNA, 17 nt, Human
aggguugggcugguguc

SEQ ID NO: 3116952 - RNA, 21 nt, Human
aggugauccacccaccucagc

SEQ ID NO: 3116953 - RNA, 23 nt, Human
aggugauccacccaccucagccu

SEQ ID NO: 3116954 - RNA, 13 nt, Human
ugguuuucuguuc

SEQ ID NO: 3116955 - RNA, 15 nt, Human
ugguuuucuguucuu

SEQ ID NO: 3116956 - RNA, 14 nt, Human
ugguuucagaaaug

SEQ ID NO: 3116957 - RNA, 15 nt, Human
ugguuucagaaaugu

SEQ ID NO: 3116958 - RNA, 21 nt, Human
ugguuuguaaauuaacuuuua

SEQ ID NO: 3116959 - RNA, 12 nt, Human
ugguuuucuguu

SEQ ID NO: 3116960 - RNA, 23 nt, Human
ugguggcagcucaccucucccuu

SEQ ID NO: 3116961 - RNA, 20 nt, Human
ugguggcagcucaccucucc

SEQ ID NO: 3116962 - RNA, 19 nt, Human
ugguggcagcucaccucuc

SEQ ID NO: 3116963 - RNA, 16 nt, Human
ugguggcagcucaccu

SEQ ID NO: 3116964 - RNA, 12 nt, Human
ugguggcagcuc

SEQ ID NO: 3116965 - RNA, 15 nt, Human
ugguggcagagugga

SEQ ID NO: 3116966 - RNA, 12 nt, Human
ugguggcagcug

SEQ ID NO: 3116967 - RNA, 20 nt, Human
ugguucaggguuggccccug

SEQ ID NO: 3116968 - RNA, 22 nt, Human
ugguucaggguuggccccugcc

SEQ ID NO: 3116969 - RNA, 17 nt, Human
ugguguuuccuggcacu

SEQ ID NO: 3116970 - RNA, 15 nt, Human
ugguguuuccuggca

SEQ ID NO: 3116971 - RNA, 14 nt, Human
ugguuauggagagg

SEQ ID NO: 3116972 - RNA, 13 nt, Human
uguaaggaaugau

SEQ ID NO: 3116973 - RNA, 15 nt, Human
uguaaggaaugauua

SEQ ID NO: 3116974 - RNA, 14 nt, Human
uguaaggaaugauu

SEQ ID NO: 3116975 - RNA, 22 nt, Human
uguaagcucuacugaggugcua

SEQ ID NO: 3116976 - RNA, 14 nt, Human
agguggggcagcuu

SEQ ID NO: 3116977 - RNA, 23 nt, Human
agguggggucacucuggcagcuc

SEQ ID NO: 3116978 - RNA, 13 nt, Human
agguggggcagcu

SEQ ID NO: 3116979 - RNA, 23 nt, Human
aggugugaaccaccacacccagc

SEQ ID NO: 3116980 - RNA, 18 nt, Human
aggugugacugaauuucu

SEQ ID NO: 3116981 - RNA, 22 nt, Human
aggugugaaccaccacacccag

SEQ ID NO: 3116982 - RNA, 20 nt, Human
aggugugacugaauuucuuu

SEQ ID NO: 3116983 - RNA, 14 nt, Human
aggugugagucacc

SEQ ID NO: 3116984 - RNA, 19 nt, Human
uguacaaaguagaagucuu

SEQ ID NO: 3116985 - RNA, 23 nt, Human
uguacaaaguagaagucuuagau

SEQ ID NO: 3116986 - RNA, 17 nt, Human
uguaauuugugauacaa

SEQ ID NO: 3116987 - RNA, 21 nt, Human
uguaauuugugauacaaugcu

SEQ ID NO: 3116988 - RNA, 18 nt, Human
uguaaggaaugauuaauu

SEQ ID NO: 3116989 - RNA, 16 nt, Human
uguaauuugugauaca

SEQ ID NO: 3116990 - RNA, 19 nt, Human
uguacaugaaaacacauuu

SEQ ID NO: 3116991 - RNA, 17 nt, Human
uguacaugaaaacacau

SEQ ID NO: 3116992 - RNA, 18 nt, Human
uguacaugaaaacacauu

SEQ ID NO: 3116993 - RNA, 20 nt, Human
auaacauguaauuaaguacu

SEQ ID NO: 3116994 - RNA, 23 nt, Human
uuaccauuuugggguacccacug

SEQ ID NO: 3116995 - RNA, 22 nt, Human
uuacaggaaguacuggagaaaa

SEQ ID NO: 3116996 - RNA, 18 nt, Human
uuacaggaaguacuggag

SEQ ID NO: 3116997 - RNA, 16 nt, Human
uuacaggaaguacugg

SEQ ID NO: 3116998 - RNA, 15 nt, Human
uuacaggaaguacug

SEQ ID NO: 3116999 - RNA, 13 nt, Human
auaaacuuuaccu

SEQ ID NO: 3117000 - RNA, 15 nt, Human
auaaacuuuaccuuu

SEQ ID NO: 3117001 - RNA, 23 nt, Human
auaagaaccuuuugagugccuua

SEQ ID NO: 3117002 - RNA, 17 nt, Human
auaaguuaacuuccaau

SEQ ID NO: 3117003 - RNA, 22 nt, Human
auaagaaccuuuugagugccuu

SEQ ID NO: 3117004 - RNA, 23 nt, Human
auaauacaccacuacauucuguu

SEQ ID NO: 3117005 - RNA, 21 nt, Human
auaauacaccacuacauucug

SEQ ID NO: 3117006 - RNA, 22 nt, Human
auaaguuaacuuccaauuuaca

SEQ ID NO: 3117007 - RNA, 14 nt, Human
auaauucuacuuug

SEQ ID NO: 3117008 - RNA, 19 nt, Human
auaauacaguaucucaggg

SEQ ID NO: 3117009 - RNA, 13 nt, Human
uuauacauaaaca

SEQ ID NO: 3117010 - RNA, 12 nt, Human
auacaaaagcau

SEQ ID NO: 3117011 - RNA, 13 nt, Human
auacaaaagcaug

SEQ ID NO: 3117012 - RNA, 15 nt, Human
auacaaaagcaugug

SEQ ID NO: 3117013 - RNA, 16 nt, Human
auacauuugauaaagu

SEQ ID NO: 3117014 - RNA, 14 nt, Human
auacaggaaaagcu

SEQ ID NO: 3117015 - RNA, 19 nt, Human
auacaggaaaagcugcuga

SEQ ID NO: 3117016 - RNA, 20 nt, Human
auacaggaaaagcugcugac

SEQ ID NO: 3117017 - RNA, 13 nt, Human
auacuacaguuug

SEQ ID NO: 3117018 - RNA, 15 nt, Human
auacuacaguuuguu

SEQ ID NO: 3117019 - RNA, 16 nt, Human
auacuacaguuuguua

SEQ ID NO: 3117020 - RNA, 20 nt, Human
auacuacaguuuguuaguau

SEQ ID NO: 3117021 - RNA, 21 nt, Human
auacuaaccagcagaaaugcc

SEQ ID NO: 3117022 - RNA, 17 nt, Human
auaccagccaguaaaug

SEQ ID NO: 3117023 - RNA, 19 nt, Human
auaccagccaguaaauggg

SEQ ID NO: 3117024 - RNA, 20 nt, Human
agugggggaguggccacaga

SEQ ID NO: 3117025 - RNA, 19 nt, Human
agugggggaguggccacag

SEQ ID NO: 3117026 - RNA, 18 nt, Human
agugggugaauaauacag

SEQ ID NO: 3117027 - RNA, 13 nt, Human
agugggugaauaa

SEQ ID NO: 3117028 - RNA, 11 nt, Human
aguggcagcug

SEQ ID NO: 3117029 - RNA, 12 nt, Human
aguggcagcugc

SEQ ID NO: 3117030 - RNA, 13 nt, Human
aguggcagcugcu

SEQ ID NO: 3117031 - RNA, 14 nt, Human
aguggcagcugcuu

SEQ ID NO: 3117032 - RNA, 20 nt, Human
aguggcagcugcuuuugucu

SEQ ID NO: 3117033 - RNA, 19 nt, Human
agugggugaauaauacagu

SEQ ID NO: 3117034 - RNA, 21 nt, Human
agugguuccuaauccucuagg

SEQ ID NO: 3117035 - RNA, 21 nt, Human
aguguacauggaauaacaugu

SEQ ID NO: 3117036 - RNA, 22 nt, Human
aguguacauggaauaacaugua

SEQ ID NO: 3117037 - RNA, 23 nt, Human
aguguacauggaauaacauguaa

SEQ ID NO: 3117038 - RNA, 19 nt, Human
uguucuuucacccuuuucu

SEQ ID NO: 3117039 - RNA, 13 nt, Human
uguucuuuccaaa

SEQ ID NO: 3117040 - RNA, 14 nt, Human
uguucuuuccaaag

SEQ ID NO: 3117041 - RNA, 17 nt, Human
uguucuugguuuguaaa

SEQ ID NO: 3117042 - RNA, 18 nt, Human
uguucuugguuuguaaau

SEQ ID NO: 3117043 - RNA, 14 nt, Human
uguucugggacaca

SEQ ID NO: 3117044 - RNA, 15 nt, Human
uguucugggacacag

SEQ ID NO: 3117045 - RNA, 14 nt, Human
uguucuuaauucuu

SEQ ID NO: 3117046 - RNA, 16 nt, Human
uguucuuaauucuuag

SEQ ID NO: 3117047 - RNA, 12 nt, Human
uguucugggaca

SEQ ID NO: 3117048 - RNA, 13 nt, Human
uguucugggacac

SEQ ID NO: 3117049 - RNA, 13 nt, Human
uguugucagcuga

SEQ ID NO: 3117050 - RNA, 16 nt, Human
uguugggccaggagcc

SEQ ID NO: 3117051 - RNA, 13 nt, Human
uguugggccagga

SEQ ID NO: 3117052 - RNA, 21 nt, Human
aguuauuuuuauuuauuuaaa

SEQ ID NO: 3117053 - RNA, 18 nt, Human
uguucuuuccaaaguaca

SEQ ID NO: 3117054 - RNA, 14 nt, Human
aguugauagcacag

SEQ ID NO: 3117055 - RNA, 21 nt, Human
aguugauagcacagacccugc

SEQ ID NO: 3117056 - RNA, 20 nt, Human
aguugauagcacagacccug

SEQ ID NO: 3117057 - RNA, 19 nt, Human
aguugauagcacagacccu

SEQ ID NO: 3117058 - RNA, 15 nt, Human
aguugauagcacaga

SEQ ID NO: 3117059 - RNA, 13 nt, Human
aguugauucagcu

SEQ ID NO: 3117060 - RNA, 23 nt, Human
aguugauagcacagacccugccc

SEQ ID NO: 3117061 - RNA, 22 nt, Human
aguugauagcacagacccugcc

SEQ ID NO: 3117062 - RNA, 18 nt, Human
aguugauucagcucugca

SEQ ID NO: 3117063 - RNA, 17 nt, Human
aguugauucagcucugc

SEQ ID NO: 3117064 - RNA, 15 nt, Human
aguugauucagcucu

SEQ ID NO: 3117065 - RNA, 14 nt, Human
aguugauucagcuc

SEQ ID NO: 3117066 - RNA, 23 nt, Human
aguugauucagcucugcaagaau

SEQ ID NO: 3117067 - RNA, 15 nt, Human
uguuuggggaugaga

SEQ ID NO: 3117068 - RNA, 14 nt, Human
uguugucagcugaa

SEQ ID NO: 3117069 - RNA, 16 nt, Human
uguuugccucugccuc

SEQ ID NO: 3117070 - RNA, 14 nt, Human
uguuugccucugcc

SEQ ID NO: 3117071 - RNA, 15 nt, Human
uguuuucaguguaca

SEQ ID NO: 3117072 - RNA, 21 nt, Human
uguuuuauuuuaauucaguug

SEQ ID NO: 3117073 - RNA, 15 nt, Human
uguuuucucuugaga

SEQ ID NO: 3117074 - RNA, 12 nt, Human
aguucucuccuu

SEQ ID NO: 3117075 - RNA, 13 nt, Human
aguucucuccuuc

SEQ ID NO: 3117076 - RNA, 16 nt, Human
aguucucuccuucuuc

SEQ ID NO: 3117077 - RNA, 13 nt, Human
uuaaauaaaucau

SEQ ID NO: 3117078 - RNA, 15 nt, Human
uuaaauaaaucauaa

SEQ ID NO: 3117079 - RNA, 19 nt, Human
uuaaauaaugugaaacugg

SEQ ID NO: 3117080 - RNA, 22 nt, Human
uuaaauaaugugaaacuggauu

SEQ ID NO: 3117081 - RNA, 20 nt, Human
uuaaauaaugugaaacugga

SEQ ID NO: 3117082 - RNA, 21 nt, Human
uuaaauaaugugaaacuggau

SEQ ID NO: 3117083 - RNA, 17 nt, Human
uuaaaccgccaaggcug

SEQ ID NO: 3117084 - RNA, 18 nt, Human
uuaaaaaguggaaaaaua

SEQ ID NO: 3117085 - RNA, 17 nt, Human
uuaaaacaacacucaca

SEQ ID NO: 3117086 - RNA, 20 nt, Human
aguugccagucaccccggcc

SEQ ID NO: 3117087 - RNA, 22 nt, Human
aguuuucacucuuauugcccac

SEQ ID NO: 3117088 - RNA, 16 nt, Human
uuaaauucuugcaaag

SEQ ID NO: 3117089 - RNA, 13 nt, Human
uuaaauucuugca

SEQ ID NO: 3117090 - RNA, 15 nt, Human
aguuucuccaagcag

SEQ ID NO: 3117091 - RNA, 13 nt, Human
aguuucuccaagc

SEQ ID NO: 3117092 - RNA, 23 nt, Human
augaguccccuguuuguuucuga

SEQ ID NO: 3117093 - RNA, 22 nt, Human
augaggucagagccugcaguua

SEQ ID NO: 3117094 - RNA, 17 nt, Human
augagccucagcauccu

SEQ ID NO: 3117095 - RNA, 18 nt, Human
augagccucagcauccug

SEQ ID NO: 3117096 - RNA, 15 nt, Human
augauaaaacacaaa

SEQ ID NO: 3117097 - RNA, 18 nt, Human
uugucacacacuuuggcu

SEQ ID NO: 3117098 - RNA, 16 nt, Human
uuguccccgacccuug

SEQ ID NO: 3117099 - RNA, 15 nt, Human
augagcaucaggcca

SEQ ID NO: 3117100 - RNA, 17 nt, Human
augagcaucaggccagg

SEQ ID NO: 3117101 - RNA, 16 nt, Human
augagcaucaggccag

SEQ ID NO: 3117102 - RNA, 21 nt, Human
augagcaucaggccaggcccu

SEQ ID NO: 3117103 - RNA, 20 nt, Human
augagcaucaggccaggccc

SEQ ID NO: 3117104 - RNA, 19 nt, Human
augagcaucaggccaggcc

SEQ ID NO: 3117105 - RNA, 18 nt, Human
augagcaucaggccaggc

SEQ ID NO: 3117106 - RNA, 22 nt, Human
augagcaucaggccaggcccuc

SEQ ID NO: 3117107 - RNA, 12 nt, Human
augagccucagc

SEQ ID NO: 3117108 - RNA, 15 nt, Human
augagccucagcauc

SEQ ID NO: 3117109 - RNA, 16 nt, Human
augagccucagcaucc

SEQ ID NO: 3117110 - RNA, 16 nt, Human
augagaggaaaucacc

SEQ ID NO: 3117111 - RNA, 15 nt, Human
augagaggaaaucac

SEQ ID NO: 3117112 - RNA, 14 nt, Human
augagaggaaauca

SEQ ID NO: 3117113 - RNA, 13 nt, Human
augagaggaaauc

SEQ ID NO: 3117114 - RNA, 12 nt, Human
augagaggaaau

SEQ ID NO: 3117115 - RNA, 18 nt, Human
augaucacggcucacugc

SEQ ID NO: 3117116 - RNA, 19 nt, Human
augaucacggcucacugca

SEQ ID NO: 3117117 - RNA, 15 nt, Human
augaucacggcucac

SEQ ID NO: 3117118 - RNA, 23 nt, Human
augaucacggcucacugcagccu

SEQ ID NO: 3117119 - RNA, 16 nt, Human
augauccuaggcauuu

SEQ ID NO: 3117120 - RNA, 14 nt, Human
augaucuucuuuau

SEQ ID NO: 3117121 - RNA, 19 nt, Human
augcaccuggaauauauaa

SEQ ID NO: 3117122 - RNA, 22 nt, Human
augcaaaccaucauugaaaucu

SEQ ID NO: 3117123 - RNA, 21 nt, Human
augcaaaccaucauugaaauc

SEQ ID NO: 3117124 - RNA, 20 nt, Human
augcaaaccaucauugaaau

SEQ ID NO: 3117125 - RNA, 19 nt, Human
augcaaaccaucauugaaa

SEQ ID NO: 3117126 - RNA, 18 nt, Human
augcaaaccaucauugaa

SEQ ID NO: 3117127 - RNA, 16 nt, Human
augcaaaccaucauug

SEQ ID NO: 3117128 - RNA, 15 nt, Human
augaucuucuuuaua

SEQ ID NO: 3117129 - RNA, 22 nt, Human
augcaaggucauuuuuuuuaag

SEQ ID NO: 3117130 - RNA, 16 nt, Human
augcaccuggaauaua

SEQ ID NO: 3117131 - RNA, 14 nt, Human
augcaccuggaaua

SEQ ID NO: 3117132 - RNA, 14 nt, Human
augcaaggucauuu

SEQ ID NO: 3117133 - RNA, 16 nt, Human
augcaaggucauuuuu

SEQ ID NO: 3117134 - RNA, 20 nt, Human
augacacgaauauugcugau

SEQ ID NO: 3117135 - RNA, 19 nt, Human
augacacgaauauugcuga

SEQ ID NO: 3117136 - RNA, 20 nt, Human
uuguaaggaaugauuaauua

SEQ ID NO: 3117137 - RNA, 17 nt, Human
uugggguacccacugcu

SEQ ID NO: 3117138 - RNA, 19 nt, Human
uuggggaagaacgaagcca

SEQ ID NO: 3117139 - RNA, 13 nt, Human
augaaccacaucu

SEQ ID NO: 3117140 - RNA, 20 nt, Human
augaaccacaucuugcucug

SEQ ID NO: 3117141 - RNA, 22 nt, Human
uugggguacccacugcucuggu

SEQ ID NO: 3117142 - RNA, 19 nt, Human
uugguuaggcauuguggga

SEQ ID NO: 3117143 - RNA, 14 nt, Human
uuguaaggaaugau

SEQ ID NO: 3117144 - RNA, 20 nt, Human
augaaagacuguacaaagua

SEQ ID NO: 3117145 - RNA, 19 nt, Human
augaaagacuguacaaagu

SEQ ID NO: 3117146 - RNA, 18 nt, Human
uuggaaagaguaggaaga

SEQ ID NO: 3117147 - RNA, 21 nt, Human
uuggcuagagguucaaagaua

SEQ ID NO: 3117148 - RNA, 22 nt, Human
uuggcuaggaccccuccaugug

SEQ ID NO: 3117149 - RNA, 22 nt, Human
uuggcuagagguucaaagauau

SEQ ID NO: 3117150 - RNA, 13 nt, Human
uuggcugcaggga

SEQ ID NO: 3117151 - RNA, 14 nt, Human
uuggcugcagggag

SEQ ID NO: 3117152 - RNA, 15 nt, Human
uuggcugcugaaggc

SEQ ID NO: 3117153 - RNA, 11 nt, Human
uuggcugcuga

SEQ ID NO: 3117154 - RNA, 20 nt, Human
uugcuaagugaggaugaaaa

SEQ ID NO: 3117155 - RNA, 19 nt, Human
uugcugaauacagaggcaa

SEQ ID NO: 3117156 - RNA, 18 nt, Human
uugcugauggugcaauga

SEQ ID NO: 3117157 - RNA, 17 nt, Human
uugcugauggugcaaug

SEQ ID NO: 3117158 - RNA, 17 nt, Human
uuggaaagaguaggaag

SEQ ID NO: 3117159 - RNA, 11 nt, Human
uuuccuucagu

SEQ ID NO: 3117160 - RNA, 15 nt, Human
uuuccuucagugccu

SEQ ID NO: 3117161 - RNA, 12 nt, Human
uuuccuucagug

SEQ ID NO: 3117162 - RNA, 12 nt, Human
uuuccugugucu

SEQ ID NO: 3117163 - RNA, 23 nt, Human
uuuccuucauucaacccaccugc

SEQ ID NO: 3117164 - RNA, 21 nt, Human
uuuccuucagugccuuaugga

SEQ ID NO: 3117165 - RNA, 18 nt, Human
uuuccuucagugccuuau

SEQ ID NO: 3117166 - RNA, 22 nt, Human
uuuccuucagugccuuauggaa

SEQ ID NO: 3117167 - RNA, 21 nt, Human
uuuccuucauucaacccaccu

SEQ ID NO: 3117168 - RNA, 22 nt, Human
uuucgcaggauucuuccucccu

SEQ ID NO: 3117169 - RNA, 18 nt, Human
uuucgcaggauucuuccu

SEQ ID NO: 3117170 - RNA, 13 nt, Human
augggagcucaug

SEQ ID NO: 3117171 - RNA, 18 nt, Human
augggcaacccccagccu

SEQ ID NO: 3117172 - RNA, 19 nt, Human
augggcaacccccagccug

SEQ ID NO: 3117173 - RNA, 21 nt, Human
augggcaacccccagccugcu

SEQ ID NO: 3117174 - RNA, 15 nt, Human
augggccuccugugu

SEQ ID NO: 3117175 - RNA, 15 nt, Human
augggcagagcagag

SEQ ID NO: 3117176 - RNA, 14 nt, Human
augggcagagcaga

SEQ ID NO: 3117177 - RNA, 13 nt, Human
augggcagagcag

SEQ ID NO: 3117178 - RNA, 21 nt, Human
auggacccaauauuuaccaga

SEQ ID NO: 3117179 - RNA, 19 nt, Human
auggacaugaucuucuuua

SEQ ID NO: 3117180 - RNA, 18 nt, Human
auggccucuucagaucuc

SEQ ID NO: 3117181 - RNA, 16 nt, Human
uuucugccgcagcccu

SEQ ID NO: 3117182 - RNA, 14 nt, Human
uuucugccgcagcc

SEQ ID NO: 3117183 - RNA, 21 nt, Human
uuucugcagccacuauuguua

SEQ ID NO: 3117184 - RNA, 15 nt, Human
uuucuaugacacaug

SEQ ID NO: 3117185 - RNA, 21 nt, Human
uuucuaugacacaugcaaggu

SEQ ID NO: 3117186 - RNA, 13 nt, Human
uuucuuuguggcu

SEQ ID NO: 3117187 - RNA, 13 nt, Human
auggggcccugcc

SEQ ID NO: 3117188 - RNA, 14 nt, Human
auggggcccugccu

SEQ ID NO: 3117189 - RNA, 23 nt, Human
augggcuggguucuacccaggug

SEQ ID NO: 3117190 - RNA, 19 nt, Human
uuuccagguuuaagcuguu

SEQ ID NO: 3117191 - RNA, 24 nt, Human
uuucacucuuauugcccacgcugg

SEQ ID NO: 3117192 - RNA, 15 nt, Human
uuucacucuccuugg

SEQ ID NO: 3117193 - RNA, 14 nt, Human
uuucacucuccuug

SEQ ID NO: 3117194 - RNA, 17 nt, Human
auggaacacucugagac

SEQ ID NO: 3117195 - RNA, 18 nt, Human
auggaacacucugagacu

SEQ ID NO: 3117196 - RNA, 21 nt, Human
auggaaguacuauaauuuacc

SEQ ID NO: 3117197 - RNA, 14 nt, Human
auggaauaacaugu

SEQ ID NO: 3117198 - RNA, 15 nt, Human
auggaauaacaugua

SEQ ID NO: 3117199 - RNA, 19 nt, Human
augcugugcccuaaagugu

SEQ ID NO: 3117200 - RNA, 22 nt, Human
augcuggcuguuggcugggggc

SEQ ID NO: 3117201 - RNA, 14 nt, Human
uuuaccuuuuuuau

SEQ ID NO: 3117202 - RNA, 19 nt, Human
uuuaccuuuuuuauacaua

SEQ ID NO: 3117203 - RNA, 20 nt, Human
uuuaccuuuuuuauacauaa

SEQ ID NO: 3117204 - RNA, 17 nt, Human
augcuacacacugcaug

SEQ ID NO: 3117205 - RNA, 22 nt, Human
uuuaccugaagucuuuguacag

SEQ ID NO: 3117206 - RNA, 18 nt, Human
augcuacacacugcaugu

SEQ ID NO: 3117207 - RNA, 18 nt, Human
uuuacuaauagacaauuu

SEQ ID NO: 3117208 - RNA, 14 nt, Human
uuuacuaauagaca

SEQ ID NO: 3117209 - RNA, 17 nt, Human
uuuacuaauagacaauu

SEQ ID NO: 3117210 - RNA, 21 nt, Human
uuuaccuuuuuuauacauaaa

SEQ ID NO: 3117211 - RNA, 18 nt, Human
uuuagaguugauacuaca

SEQ ID NO: 3117212 - RNA, 13 nt, Human
uuuagauaauaca

SEQ ID NO: 3117213 - RNA, 15 nt, Human
uuuagauaauacacc

SEQ ID NO: 3117214 - RNA, 19 nt, Human
uuuauuaaaugcccagccc

SEQ ID NO: 3117215 - RNA, 21 nt, Human
auccugagccagauuucacuc

SEQ ID NO: 3117216 - RNA, 17 nt, Human
auccugagccagauuuc

SEQ ID NO: 3117217 - RNA, 15 nt, Human
auccugagccagauu

SEQ ID NO: 3117218 - RNA, 14 nt, Human
auccugagccagau

SEQ ID NO: 3117219 - RNA, 11 nt, Human
auccugagcca

SEQ ID NO: 3117220 - RNA, 13 nt, Human
auccugagccaga

SEQ ID NO: 3117221 - RNA, 12 nt, Human
auccugagccag

SEQ ID NO: 3117222 - RNA, 17 nt, Human
auccucuuugagugaag

SEQ ID NO: 3117223 - RNA, 20 nt, Human
auccucuguacagagcccac

SEQ ID NO: 3117224 - RNA, 18 nt, Human
auccucuguacagagccc

SEQ ID NO: 3117225 - RNA, 20 nt, Human
uucuuuugccguuauuaaaa

SEQ ID NO: 3117226 - RNA, 22 nt, Human
auccuggcacccggccccugcu

SEQ ID NO: 3117227 - RNA, 23 nt, Human
auccuggcacccggccccugcug

SEQ ID NO: 3117228 - RNA, 15 nt, Human
auccuggaguucugg

SEQ ID NO: 3117229 - RNA, 17 nt, Human
auccuggcacccggccc

SEQ ID NO: 3117230 - RNA, 19 nt, Human
auccuggcacccggccccu

SEQ ID NO: 3117231 - RNA, 20 nt, Human
auccuggcacccggccccug

SEQ ID NO: 3117232 - RNA, 21 nt, Human
auccuggcacccggccccugc

SEQ ID NO: 3117233 - RNA, 12 nt, Human
uugauaaaguaa

SEQ ID NO: 3117234 - RNA, 15 nt, Human
uugaggucuguucuu

SEQ ID NO: 3117235 - RNA, 16 nt, Human
uugaggucuguucuuu

SEQ ID NO: 3117236 - RNA, 17 nt, Human
uugaccauucuccaccu

SEQ ID NO: 3117237 - RNA, 19 nt, Human
uugaccauucuccaccugc

SEQ ID NO: 3117238 - RNA, 18 nt, Human
uugaccauucuccaccug

SEQ ID NO: 3117239 - RNA, 19 nt, Human
uugacagggcacaccgggc

SEQ ID NO: 3117240 - RNA, 24 nt, Human
uugaccauucuccaccugccaggg

SEQ ID NO: 3117241 - RNA, 14 nt, Human
aucgugacaacacu

SEQ ID NO: 3117242 - RNA, 15 nt, Human
aucgugacaacacuu

SEQ ID NO: 3117243 - RNA, 18 nt, Human
aucgucacugcuuaacuu

SEQ ID NO: 3117244 - RNA, 14 nt, Human
aucgucacugcuua

SEQ ID NO: 3117245 - RNA, 19 nt, Human
aucuaaauggaaccacucu

SEQ ID NO: 3117246 - RNA, 15 nt, Human
aucuaaauguugaaa

SEQ ID NO: 3117247 - RNA, 19 nt, Human
uucugcagccacuauuguu

SEQ ID NO: 3117248 - RNA, 20 nt, Human
uucucuaguuugauuaaauu

SEQ ID NO: 3117249 - RNA, 21 nt, Human
uucucuaguuugauuaaauuc

SEQ ID NO: 3117250 - RNA, 12 nt, Human
aucauugaaauc

SEQ ID NO: 3117251 - RNA, 23 nt, Human
aucauaguggcuuaaaacaacac

SEQ ID NO: 3117252 - RNA, 15 nt, Human
aucauaaaacuugau

SEQ ID NO: 3117253 - RNA, 21 nt, Human
aucauccacugugccaugugc

SEQ ID NO: 3117254 - RNA, 23 nt, Human
aucauccacugugccaugugcca

SEQ ID NO: 3117255 - RNA, 16 nt, Human
aucauuaggugugacu

SEQ ID NO: 3117256 - RNA, 17 nt, Human
aucaggugcugccaucc

SEQ ID NO: 3117257 - RNA, 15 nt, Human
aucaggugcugccau

SEQ ID NO: 3117258 - RNA, 14 nt, Human
aucaggugcugcca

SEQ ID NO: 3117259 - RNA, 19 nt, Human
aucagucugauucccaagc

SEQ ID NO: 3117260 - RNA, 22 nt, Human
aucccugaaggccccgcccagg

SEQ ID NO: 3117261 - RNA, 17 nt, Human
aucccugaaggccccgc

SEQ ID NO: 3117262 - RNA, 17 nt, Human
aucccaugagccucagc

SEQ ID NO: 3117263 - RNA, 18 nt, Human
aucccaugagccucagca

SEQ ID NO: 3117264 - RNA, 11 nt, Human
aucccagcccc

SEQ ID NO: 3117265 - RNA, 13 nt, Human
aucccaugagccu

SEQ ID NO: 3117266 - RNA, 16 nt, Human
aucccaugagccucag

SEQ ID NO: 3117267 - RNA, 17 nt, Human
auccagguucagcuugu

SEQ ID NO: 3117268 - RNA, 14 nt, Human
auccaguaucuuga

SEQ ID NO: 3117269 - RNA, 15 nt, Human
uucugccugcccagg

SEQ ID NO: 3117270 - RNA, 16 nt, Human
uucugccugcccaggc

SEQ ID NO: 3117271 - RNA, 22 nt, Human
uucuucuccacuuucuagccag

SEQ ID NO: 3117272 - RNA, 13 nt, Human
uucuugcaaagua

SEQ ID NO: 3117273 - RNA, 12 nt, Human
uucuuucuggcu

SEQ ID NO: 3117274 - RNA, 17 nt, Human
uucuuucuggcuaugca

SEQ ID NO: 3117275 - RNA, 20 nt, Human
uucuuucuggcuaugcauuu

SEQ ID NO: 3117276 - RNA, 21 nt, Human
uucuguuggccagugugacaa

SEQ ID NO: 3117277 - RNA, 13 nt, Human
uucuguuuagaua

SEQ ID NO: 3117278 - RNA, 18 nt, Human
uucuguuuagauaauaca

SEQ ID NO: 3117279 - RNA, 22 nt, Human
uuccuggcacugcuuccaguga

SEQ ID NO: 3117280 - RNA, 20 nt, Human
uuccuggcacugcuuccagu

SEQ ID NO: 3117281 - RNA, 19 nt, Human
uuccuggcacugcuuccag

SEQ ID NO: 3117282 - RNA, 22 nt, Human
uuccucuuuuuauuuaguuccu

SEQ ID NO: 3117283 - RNA, 20 nt, Human
uucccuuuuuuggcugcuga

SEQ ID NO: 3117284 - RNA, 14 nt, Human
aucacgccacugca

SEQ ID NO: 3117285 - RNA, 15 nt, Human
aucacgccacugcac

SEQ ID NO: 3117286 - RNA, 17 nt, Human
aucacgccacugcacua

SEQ ID NO: 3117287 - RNA, 21 nt, Human
aucaacugcaucaagauguga

SEQ ID NO: 3117288 - RNA, 17 nt, Human
auauuaccacagacaua

SEQ ID NO: 3117289 - RNA, 16 nt, Human
auauuaagaaagacua

SEQ ID NO: 3117290 - RNA, 15 nt, Human
auauuaagaaagacu

SEQ ID NO: 3117291 - RNA, 17 nt, Human
auauuaagaaagacuau

SEQ ID NO: 3117292 - RNA, 16 nt, Human
uuccagugaggcucug

SEQ ID NO: 3117293 - RNA, 15 nt, Human
uuccagugaggcucu

SEQ ID NO: 3117294 - RNA, 22 nt, Human
auauugcugauggugcaaugac

SEQ ID NO: 3117295 - RNA, 15 nt, Human
auauugauaugcuua

SEQ ID NO: 3117296 - RNA, 13 nt, Human
auauuguuuucag

SEQ ID NO: 3117297 - RNA, 17 nt, Human
uucagguaacaggcaga

SEQ ID NO: 3117298 - RNA, 14 nt, Human
uucaguaagccgug

SEQ ID NO: 3117299 - RNA, 21 nt, Human
auauauguuuuaagaggcagg

SEQ ID NO: 3117300 - RNA, 22 nt, Human
auauauguuuuaagaggcaggg

SEQ ID NO: 3117301 - RNA, 14 nt, Human
uucaggguuggccc

SEQ ID NO: 3117302 - RNA, 16 nt, Human
uucaggguuggccccu

SEQ ID NO: 3117303 - RNA, 17 nt, Human
uucaggguuggccccug

SEQ ID NO: 3117304 - RNA, 19 nt, Human
uucaggguuggccccugcc

SEQ ID NO: 3117305 - RNA, 22 nt, Human
uucaggguuggccccugcccgg

SEQ ID NO: 3117306 - RNA, 15 nt, Human
uucagguaacaggca

SEQ ID NO: 3117307 - RNA, 16 nt, Human
uucagguaacaggcag

SEQ ID NO: 3117308 - RNA, 16 nt, Human
uucagaaauguguuau

SEQ ID NO: 3117309 - RNA, 22 nt, Human
uuccaauuuacauacucugcuu

SEQ ID NO: 3117310 - RNA, 17 nt, Human
uuccagguuuaagcugu

SEQ ID NO: 3117311 - RNA, 18 nt, Human
uuccagguuuaagcuguu

SEQ ID NO: 3117312 - RNA, 17 nt, Human
uuccaggcugggagagc

SEQ ID NO: 3117313 - RNA, 15 nt, Human
uuccaggcugggaga

SEQ ID NO: 3117314 - RNA, 13 nt, Human
uuccaggcuggga

SEQ ID NO: 3117315 - RNA, 21 nt, Human
uuccacaagagcccaggccuc

SEQ ID NO: 3117316 - RNA, 21 nt, Human
auauguggaguucaucuugaa

SEQ ID NO: 3117317 - RNA, 20 nt, Human
auauguggaguucaucuuga

SEQ ID NO: 3117318 - RNA, 13 nt, Human
auuuauucugcuc

SEQ ID NO: 3117319 - RNA, 17 nt, Human
auuuccagccaaagccu

SEQ ID NO: 3117320 - RNA, 14 nt, Human
auuugaaaauuuug

SEQ ID NO: 3117321 - RNA, 15 nt, Human
auuuccguuaaaaua

SEQ ID NO: 3117322 - RNA, 16 nt, Human
auuuccguuaaaauac

SEQ ID NO: 3117323 - RNA, 14 nt, Human
auuuauucugcuca

SEQ ID NO: 3117324 - RNA, 12 nt, Human
auuuaacagaaa

SEQ ID NO: 3117325 - RNA, 14 nt, Human
auuuaacagaaaug

SEQ ID NO: 3117326 - RNA, 14 nt, Human
auuuacuucuuaua

SEQ ID NO: 3117327 - RNA, 16 nt, Human
auuuacuucuuauaca

SEQ ID NO: 3117328 - RNA, 15 nt, Human
auuuagaaauauaau

SEQ ID NO: 3117329 - RNA, 22 nt, Human
auuuauuaaaugcccagccccu

SEQ ID NO: 3117330 - RNA, 14 nt, Human
auugugucucuugg

SEQ ID NO: 3117331 - RNA, 14 nt, Human
auuuaaaaaaaauc

SEQ ID NO: 3117332 - RNA, 18 nt, Human
auugugucucuugguccu

SEQ ID NO: 3117333 - RNA, 20 nt, Human
auuguccccgacccuugccg

SEQ ID NO: 3117334 - RNA, 19 nt, Human
auuguccccgacccuugcc

SEQ ID NO: 3117335 - RNA, 17 nt, Human
auuguccccgacccuug

SEQ ID NO: 3117336 - RNA, 13 nt, Human
auucuuauuuaau

SEQ ID NO: 3117337 - RNA, 14 nt, Human
auucuuauuuaaug

SEQ ID NO: 3117338 - RNA, 18 nt, Human
auucuuauuuaaugaaag

SEQ ID NO: 3117339 - RNA, 13 nt, Human
auucuucuccacu

SEQ ID NO: 3117340 - RNA, 13 nt, Human
auucuuccucccu

SEQ ID NO: 3117341 - RNA, 22 nt, Human
auucuuccucccucccucuuuc

SEQ ID NO: 3117342 - RNA, 18 nt, Human
auugacaggauuauugga

SEQ ID NO: 3117343 - RNA, 15 nt, Human
auugaaaaaccauuu

SEQ ID NO: 3117344 - RNA, 21 nt, Human
auuuuacuuuaaaaggagcca

SEQ ID NO: 3117345 - RNA, 15 nt, Human
auuuuaauucaguug

SEQ ID NO: 3117346 - RNA, 14 nt, Human
auuugugauacaau

SEQ ID NO: 3117347 - RNA, 21 nt, Human
uuuuguuccacaaguuaaaua

SEQ ID NO: 3117348 - RNA, 15 nt, Human
uuuuguuccacaagu

SEQ ID NO: 3117349 - RNA, 17 nt, Human
uuuugugcauuaucuag

SEQ ID NO: 3117350 - RNA, 20 nt, Human
uuuugugcauuaucuagaua

SEQ ID NO: 3117351 - RNA, 22 nt, Human
uuuuuagacagagucucacugu

SEQ ID NO: 3117352 - RNA, 11 nt, Human
uuuuuacuaau

SEQ ID NO: 3117353 - RNA, 12 nt, Human
uuuuuauggcuu

SEQ ID NO: 3117354 - RNA, 20 nt, Human
uuuuuaucgucacugcuuaa

SEQ ID NO: 3117355 - RNA, 23 nt, Human
uuuugccauguuggccaggcugg

SEQ ID NO: 3117356 - RNA, 17 nt, Human
uuuugagugccuuacac

SEQ ID NO: 3117357 - RNA, 17 nt, Human
uuuugauccaagcuggu

SEQ ID NO: 3117358 - RNA, 14 nt, Human
auuaaguacuaugu

SEQ ID NO: 3117359 - RNA, 22 nt, Human
uuuuuauggcuuuugugcauua

SEQ ID NO: 3117360 - RNA, 20 nt, Human
uuuuuauggcuuuugugcau

SEQ ID NO: 3117361 - RNA, 21 nt, Human
uuuuuauggcuuuugugcauu

SEQ ID NO: 3117362 - RNA, 19 nt, Human
uuuuuguagagccaggguc

SEQ ID NO: 3117363 - RNA, 20 nt, Human
uuuuuguagagccagggucu

SEQ ID NO: 3117364 - RNA, 22 nt, Human
augugccagguuuuuggucuga

SEQ ID NO: 3117365 - RNA, 21 nt, Human
augugccagguuuuuggucug

SEQ ID NO: 3117366 - RNA, 20 nt, Human
auggggcccugccuccuuug

SEQ ID NO: 3117367 - RNA, 24 nt, Human
auguggaguucaucuugaauugua

SEQ ID NO: 3117368 - RNA, 20 nt, Human
auguggaguucaucuugaau

SEQ ID NO: 3117369 - RNA, 16 nt, Human
auguugcccaggcagg

SEQ ID NO: 3117370 - RNA, 17 nt, Human
auguugcccaggcaggu

SEQ ID NO: 3117371 - RNA, 12 nt, Human
auguugcccagg

SEQ ID NO: 3117372 - RNA, 20 nt, Human
auguugcccaggcaggucuu

SEQ ID NO: 3117373 - RNA, 14 nt, Human
uuuucaguguacau

SEQ ID NO: 3117374 - RNA, 11 nt, Human
uuuuauuuuau

SEQ ID NO: 3117375 - RNA, 13 nt, Human
uuuuauuaugcau

SEQ ID NO: 3117376 - RNA, 20 nt, Human
uuuucauuuaggugaggaag

SEQ ID NO: 3117377 - RNA, 15 nt, Human
auuaaaaaucucaaa

SEQ ID NO: 3117378 - RNA, 19 nt, Human
auuaaaaaucucaaauuuc

SEQ ID NO: 3117379 - RNA, 23 nt, Human
auuaaaacacaacaucuuuuucu

SEQ ID NO: 3117380 - RNA, 20 nt, Human
auuaaaaaucucaaauuucu

SEQ ID NO: 3117381 - RNA, 20 nt, Human
auucuccaccugccagggac

SEQ ID NO: 3117382 - RNA, 19 nt, Human
auucuccaccugccaggga

SEQ ID NO: 3117383 - RNA, 16 nt, Human
auucuccuuguguuac

SEQ ID NO: 3117384 - RNA, 20 nt, Human
auucuccugccucagccucc

SEQ ID NO: 3117385 - RNA, 19 nt, Human
auucuccugccucagccuc

SEQ ID NO: 3117386 - RNA, 15 nt, Human
auucuccugccucag

SEQ ID NO: 3117387 - RNA, 17 nt, Human
auucuccugccucagcc

SEQ ID NO: 3117388 - RNA, 11 nt, Human
auucuccugcc

SEQ ID NO: 3117389 - RNA, 14 nt, Human
auucuccugccuca

SEQ ID NO: 3117390 - RNA, 13 nt, Human
auucuccugccuc

SEQ ID NO: 3117391 - RNA, 21 nt, Human
auucuccaccugccagggaca

SEQ ID NO: 3117392 - RNA, 18 nt, Human
auucuccaccugccaggg

SEQ ID NO: 3117393 - RNA, 16 nt, Human
auucccaagcucugcu

SEQ ID NO: 3117394 - RNA, 14 nt, Human
auucccaagcucug

SEQ ID NO: 3117395 - RNA, 15 nt, Human
auucccaagcucugc

SEQ ID NO: 3117396 - RNA, 15 nt, Human
auucaguaauaacuc

SEQ ID NO: 3117397 - RNA, 19 nt, Human
auucaguaauaacucuacc

SEQ ID NO: 3117398 - RNA, 19 nt, Human
auucaggaagcucagggcc

SEQ ID NO: 3117399 - RNA, 17 nt, Human
auucaggaagcucaggg

SEQ ID NO: 3117400 - RNA, 19 nt, Human
auucagacagcugccuggg

SEQ ID NO: 3117401 - RNA, 14 nt, Human
auucaggaagcuca

SEQ ID NO: 3117402 - RNA, 21 nt, Human
ugacuguuuucucuugagagg

SEQ ID NO: 3117403 - RNA, 12 nt, Human
ugaccuuucaau

SEQ ID NO: 3117404 - RNA, 15 nt, Human
ugaccuuuaagagaa

SEQ ID NO: 3117405 - RNA, 17 nt, Human
agauuucacucuccuug

SEQ ID NO: 3117406 - RNA, 19 nt, Human
agauuucacucuccuuggu

SEQ ID NO: 3117407 - RNA, 13 nt, Human
agauucauauuua

SEQ ID NO: 3117408 - RNA, 16 nt, Human
agauucauauuuacuu

SEQ ID NO: 3117409 - RNA, 19 nt, Human
ugacuuacuguacaugaaa

SEQ ID NO: 3117410 - RNA, 12 nt, Human
ugacuuacugua

SEQ ID NO: 3117411 - RNA, 20 nt, Human
ugacuuacuguacaugaaaa

SEQ ID NO: 3117412 - RNA, 22 nt, Human
ugacagagugagacucugucuc

SEQ ID NO: 3117413 - RNA, 19 nt, Human
ugacacgaauauugcugau

SEQ ID NO: 3117414 - RNA, 16 nt, Human
ugacacgaauauugcu

SEQ ID NO: 3117415 - RNA, 13 nt, Human
ugacauguuuuau

SEQ ID NO: 3117416 - RNA, 17 nt, Human
ugacaggcaaugcuggc

SEQ ID NO: 3117417 - RNA, 19 nt, Human
ugacaggcaaugcuggcug

SEQ ID NO: 3117418 - RNA, 21 nt, Human
ugacagggcacaccgggcacu

SEQ ID NO: 3117419 - RNA, 22 nt, Human
ugacagggcacaccgggcacuc

SEQ ID NO: 3117420 - RNA, 20 nt, Human
ugagccagauuucacucucc

SEQ ID NO: 3117421 - RNA, 14 nt, Human
ugagccacugcacc

SEQ ID NO: 3117422 - RNA, 19 nt, Human
ugagccagauuucacucuc

SEQ ID NO: 3117423 - RNA, 18 nt, Human
ugagccagauuucacucu

SEQ ID NO: 3117424 - RNA, 12 nt, Human
ugagccacugca

SEQ ID NO: 3117425 - RNA, 13 nt, Human
ugagccacugcac

SEQ ID NO: 3117426 - RNA, 14 nt, Human
agcaaggagauuua

SEQ ID NO: 3117427 - RNA, 17 nt, Human
agcaaggagauuuacaa

SEQ ID NO: 3117428 - RNA, 19 nt, Human
agcaaggagauuuacaacu

SEQ ID NO: 3117429 - RNA, 16 nt, Human
agcaagugagacccug

SEQ ID NO: 3117430 - RNA, 15 nt, Human
agcaagugagagcug

SEQ ID NO: 3117431 - RNA, 16 nt, Human
agcaagugagagcugg

SEQ ID NO: 3117432 - RNA, 17 nt, Human
agcaagugagagcuggg

SEQ ID NO: 3117433 - RNA, 21 nt, Human
agcacagcuucauuuccugug

SEQ ID NO: 3117434 - RNA, 16 nt, Human
agcacaugccucucuc

SEQ ID NO: 3117435 - RNA, 18 nt, Human
agcacaugccucucucag

SEQ ID NO: 3117436 - RNA, 22 nt, Human
agcacaugccucucucaggcca

SEQ ID NO: 3117437 - RNA, 21 nt, Human
agcacaugccucucucaggcc

SEQ ID NO: 3117438 - RNA, 20 nt, Human
agcacaugccucucucaggc

SEQ ID NO: 3117439 - RNA, 19 nt, Human
agcacaugccucucucagg

SEQ ID NO: 3117440 - RNA, 23 nt, Human
agcacaugccucucucaggccaa

SEQ ID NO: 3117441 - RNA, 16 nt, Human
agcaccaucucuccuc

SEQ ID NO: 3117442 - RNA, 13 nt, Human
agcaccuccugcc

SEQ ID NO: 3117443 - RNA, 14 nt, Human
agcaccuccugccu

SEQ ID NO: 3117444 - RNA, 16 nt, Human
agcaccuccugccucg

SEQ ID NO: 3117445 - RNA, 20 nt, Human
ugagaagcagaggaaggaga

SEQ ID NO: 3117446 - RNA, 11 nt, Human
ugagacagagu

SEQ ID NO: 3117447 - RNA, 21 nt, Human
ugagacagaguuuucacucuu

SEQ ID NO: 3117448 - RNA, 13 nt, Human
ugagacagcccgg

SEQ ID NO: 3117449 - RNA, 20 nt, Human
ugagacucugucucaaaaaa

SEQ ID NO: 3117450 - RNA, 22 nt, Human
ugagacagcccgggcucugccu

SEQ ID NO: 3117451 - RNA, 20 nt, Human
ugagacagcccgggcucugc

SEQ ID NO: 3117452 - RNA, 19 nt, Human
ugagacagcccgggcucug

SEQ ID NO: 3117453 - RNA, 18 nt, Human
ugagacagcccgggcucu

SEQ ID NO: 3117454 - RNA, 17 nt, Human
ugagacagcccgggcuc

SEQ ID NO: 3117455 - RNA, 14 nt, Human
ugagaggaaaucac

SEQ ID NO: 3117456 - RNA, 13 nt, Human
ugagaggaaauca

SEQ ID NO: 3117457 - RNA, 12 nt, Human
ugagaggaaauc

SEQ ID NO: 3117458 - RNA, 11 nt, Human
ugagaggaaau

SEQ ID NO: 3117459 - RNA, 14 nt, Human
ugagagcugggugu

SEQ ID NO: 3117460 - RNA, 10 nt, Human
ugagaggaaa

SEQ ID NO: 3117461 - RNA, 23 nt, Human
ugagaggacuuuucuuuguggcu

SEQ ID NO: 3117462 - RNA, 17 nt, Human
ugagaggaaaucaccga

SEQ ID NO: 3117463 - RNA, 23 nt, Human
agagaccaucccugaaggccccg

SEQ ID NO: 3117464 - RNA, 22 nt, Human
agagaccaucccugaaggcccc

SEQ ID NO: 3117465 - RNA, 18 nt, Human
agagaccaucccugaagg

SEQ ID NO: 3117466 - RNA, 21 nt, Human
agagaccaucccugaaggccc

SEQ ID NO: 3117467 - RNA, 19 nt, Human
agagaccaucccugaaggc

SEQ ID NO: 3117468 - RNA, 22 nt, Human
ugaaagacuguacaaaguagaa

SEQ ID NO: 3117469 - RNA, 18 nt, Human
ugaaagacuguacaaagu

SEQ ID NO: 3117470 - RNA, 19 nt, Human
ugaaagacuguacaaagua

SEQ ID NO: 3117471 - RNA, 16 nt, Human
ugaaagacuguacaaa

SEQ ID NO: 3117472 - RNA, 11 nt, Human
agagacuccug

SEQ ID NO: 3117473 - RNA, 12 nt, Human
agagacuccugc

SEQ ID NO: 3117474 - RNA, 14 nt, Human
agagacuccugcag

SEQ ID NO: 3117475 - RNA, 13 nt, Human
agagacuccugca

SEQ ID NO: 3117476 - RNA, 14 nt, Human
ugaaaacacauuuu

SEQ ID NO: 3117477 - RNA, 12 nt, Human
ugaaaacacauu

SEQ ID NO: 3117478 - RNA, 13 nt, Human
ugaaaacacauuu

SEQ ID NO: 3117479 - RNA, 15 nt, Human
ugaaaacacauuuuu

SEQ ID NO: 3117480 - RNA, 17 nt, Human
ugaaaacacauuuuucu

SEQ ID NO: 3117481 - RNA, 19 nt, Human
ugaaaacacauuuuucuua

SEQ ID NO: 3117482 - RNA, 17 nt, Human
ugaaacuggauuaaacu

SEQ ID NO: 3117483 - RNA, 18 nt, Human
ugaaacuggauuaaacuu

SEQ ID NO: 3117484 - RNA, 13 nt, Human
agacuccugcagg

SEQ ID NO: 3117485 - RNA, 18 nt, Human
ucuuuaaugucacaggca

SEQ ID NO: 3117486 - RNA, 15 nt, Human
ucuuuaaugucacag

SEQ ID NO: 3117487 - RNA, 20 nt, Human
agacaggcaagcaccuccug

SEQ ID NO: 3117488 - RNA, 20 nt, Human
ucuuuguacagacaacaaac

SEQ ID NO: 3117489 - RNA, 15 nt, Human
ucuuuguacagacaa

SEQ ID NO: 3117490 - RNA, 14 nt, Human
ucuuuguacagaca

SEQ ID NO: 3117491 - RNA, 15 nt, Human
agacuuuggaaagac

SEQ ID NO: 3117492 - RNA, 15 nt, Human
agacuuuggaaagag

SEQ ID NO: 3117493 - RNA, 17 nt, Human
agacuuuggaaagacuu

SEQ ID NO: 3117494 - RNA, 20 nt, Human
agacugguuccauggccucu

SEQ ID NO: 3117495 - RNA, 15 nt, Human
agagacacaagccuu

SEQ ID NO: 3117496 - RNA, 19 nt, Human
agagacacaagccuucggc

SEQ ID NO: 3117497 - RNA, 16 nt, Human
agagacacaagccuuc

SEQ ID NO: 3117498 - RNA, 15 nt, Human
agacuuuuccaaccc

SEQ ID NO: 3117499 - RNA, 19 nt, Human
agacuuuggaaagaguagg

SEQ ID NO: 3117500 - RNA, 22 nt, Human
ugaagacaaugacuuacuguac

SEQ ID NO: 3117501 - RNA, 23 nt, Human
ugaagacaaugacuuacuguaca

SEQ ID NO: 3117502 - RNA, 21 nt, Human
ugaagacaaugacuuacugua

SEQ ID NO: 3117503 - RNA, 22 nt, Human
ugaaccaccacacccagcccac

SEQ ID NO: 3117504 - RNA, 21 nt, Human
ugaaccaccacacccagccca

SEQ ID NO: 3117505 - RNA, 19 nt, Human
ugaaauuuuuauuaaauua

SEQ ID NO: 3117506 - RNA, 20 nt, Human
ugaaauuuuuauuaaauuau

SEQ ID NO: 3117507 - RNA, 21 nt, Human
agaggcagccccauucugccu

SEQ ID NO: 3117508 - RNA, 22 nt, Human
agaggcagccccauucugccug

SEQ ID NO: 3117509 - RNA, 21 nt, Human
agaggcagggucucacucugu

SEQ ID NO: 3117510 - RNA, 23 nt, Human
agaggcagccccauucugccugc

SEQ ID NO: 3117511 - RNA, 15 nt, Human
agagggagguaagga

SEQ ID NO: 3117512 - RNA, 15 nt, Human
agagggagugacaga

SEQ ID NO: 3117513 - RNA, 20 nt, Human
agagggagugacagaggcag

SEQ ID NO: 3117514 - RNA, 13 nt, Human
agagguucaaaga

SEQ ID NO: 3117515 - RNA, 22 nt, Human
agaggcugccucucccaucacu

SEQ ID NO: 3117516 - RNA, 20 nt, Human
agagguucaaagauauuuug

SEQ ID NO: 3117517 - RNA, 16 nt, Human
agagguucaaagauau

SEQ ID NO: 3117518 - RNA, 19 nt, Human
agagguucaaagauauuuu

SEQ ID NO: 3117519 - RNA, 15 nt, Human
ugaaguaauaugcac

SEQ ID NO: 3117520 - RNA, 16 nt, Human
ugaaguaauaugcaca

SEQ ID NO: 3117521 - RNA, 20 nt, Human
ugaaguaauaugcacacauu

SEQ ID NO: 3117522 - RNA, 21 nt, Human
ugaaguaauaugcacacauuu

SEQ ID NO: 3117523 - RNA, 22 nt, Human
ugaaguaauaugcacacauuuu

SEQ ID NO: 3117524 - RNA, 13 nt, Human
ugaagucacacag

SEQ ID NO: 3117525 - RNA, 12 nt, Human
ugaauaauacag

SEQ ID NO: 3117526 - RNA, 13 nt, Human
ugaauaauacagu

SEQ ID NO: 3117527 - RNA, 21 nt, Human
ucugaaggacauugcggacag

SEQ ID NO: 3117528 - RNA, 15 nt, Human
ucugacacacagcuc

SEQ ID NO: 3117529 - RNA, 13 nt, Human
ucugacacacagc

SEQ ID NO: 3117530 - RNA, 14 nt, Human
ucugacacacagcu

SEQ ID NO: 3117531 - RNA, 12 nt, Human
ucugacacacag

SEQ ID NO: 3117532 - RNA, 21 nt, Human
ucugagacucgcgacaaugca

SEQ ID NO: 3117533 - RNA, 17 nt, Human
ucugaucauccacugug

SEQ ID NO: 3117534 - RNA, 21 nt, Human
ucugaucauccacugugccau

SEQ ID NO: 3117535 - RNA, 16 nt, Human
ucugcacuccccugcu

SEQ ID NO: 3117536 - RNA, 15 nt, Human
ucugcacuccccugc

SEQ ID NO: 3117537 - RNA, 14 nt, Human
ucugcacuccccug

SEQ ID NO: 3117538 - RNA, 13 nt, Human
ucugcacuccccu

SEQ ID NO: 3117539 - RNA, 17 nt, Human
ucugcagcaauaaagca

SEQ ID NO: 3117540 - RNA, 14 nt, Human
agaaauguacagca

SEQ ID NO: 3117541 - RNA, 15 nt, Human
agaaauguacagcaa

SEQ ID NO: 3117542 - RNA, 15 nt, Human
ucugccgcagcccug

SEQ ID NO: 3117543 - RNA, 14 nt, Human
ucugccgcagcccu

SEQ ID NO: 3117544 - RNA, 19 nt, Human
ucugcccuccaagaccuuc

SEQ ID NO: 3117545 - RNA, 18 nt, Human
ucugcccuccaagaccuu

SEQ ID NO: 3117546 - RNA, 21 nt, Human
ucugcccacucccugcaaccu

SEQ ID NO: 3117547 - RNA, 18 nt, Human
ucugcccacucccugcaa

SEQ ID NO: 3117548 - RNA, 21 nt, Human
ucugccugcccaggccccugc

SEQ ID NO: 3117549 - RNA, 22 nt, Human
ucugccugcccaggccccugcc

SEQ ID NO: 3117550 - RNA, 22 nt, Human
ucugccgcagcccugcagaggg

SEQ ID NO: 3117551 - RNA, 23 nt, Human
ucugcccuugguuaggcauugug

SEQ ID NO: 3117552 - RNA, 17 nt, Human
ucugcucacauaucugu

SEQ ID NO: 3117553 - RNA, 19 nt, Human
ucugcucacauaucuguca

SEQ ID NO: 3117554 - RNA, 20 nt, Human
ucugcucacauaucugucau

SEQ ID NO: 3117555 - RNA, 13 nt, Human
ucugcuucagccu

SEQ ID NO: 3117556 - RNA, 14 nt, Human
ucugcuucagccuc

SEQ ID NO: 3117557 - RNA, 15 nt, Human
ucugcuucagccucc

SEQ ID NO: 3117558 - RNA, 17 nt, Human
ucugcccacucccugca

SEQ ID NO: 3117559 - RNA, 16 nt, Human
ucugcccacucccugc

SEQ ID NO: 3117560 - RNA, 22 nt, Human
agaagcccaggaaaggcuccag

SEQ ID NO: 3117561 - RNA, 21 nt, Human
agaagcccaggaaaggcucca

SEQ ID NO: 3117562 - RNA, 20 nt, Human
agaagcccaggaaaggcucc

SEQ ID NO: 3117563 - RNA, 18 nt, Human
agaagcccaggaaaggcu

SEQ ID NO: 3117564 - RNA, 16 nt, Human
agaagcccaggaaagg

SEQ ID NO: 3117565 - RNA, 12 nt, Human
agaagcccagga

SEQ ID NO: 3117566 - RNA, 18 nt, Human
agaagauuuugaaauuuu

SEQ ID NO: 3117567 - RNA, 23 nt, Human
agaaguuucugccgcagcccugc

SEQ ID NO: 3117568 - RNA, 22 nt, Human
agaaguuucugccgcagcccug

SEQ ID NO: 3117569 - RNA, 21 nt, Human
agaaguuucugccgcagcccu

SEQ ID NO: 3117570 - RNA, 12 nt, Human
agacacaggccc

SEQ ID NO: 3117571 - RNA, 13 nt, Human
agacacaggcccg

SEQ ID NO: 3117572 - RNA, 16 nt, Human
agacaggaccagggau

SEQ ID NO: 3117573 - RNA, 17 nt, Human
agacaccuugacagggc

SEQ ID NO: 3117574 - RNA, 18 nt, Human
agacaccuugacagggca

SEQ ID NO: 3117575 - RNA, 16 nt, Human
agacacauguccaaga

SEQ ID NO: 3117576 - RNA, 12 nt, Human
ucuguuggccag

SEQ ID NO: 3117577 - RNA, 17 nt, Human
ucuguuggccaguguga

SEQ ID NO: 3117578 - RNA, 22 nt, Human
ucuguucuuuccaaaguacacu

SEQ ID NO: 3117579 - RNA, 13 nt, Human
ucuguucuuucca

SEQ ID NO: 3117580 - RNA, 22 nt, Human
ucugugaaaggaaagagggagg

SEQ ID NO: 3117581 - RNA, 23 nt, Human
ucuaugggacucaaugcacugac

SEQ ID NO: 3117582 - RNA, 17 nt, Human
ucucacuauguugccca

SEQ ID NO: 3117583 - RNA, 19 nt, Human
ucucacuauguugcccagg

SEQ ID NO: 3117584 - RNA, 16 nt, Human
ucucacuauguugccc

SEQ ID NO: 3117585 - RNA, 23 nt, Human
ucuaguuguuugauucagacagc

SEQ ID NO: 3117586 - RNA, 21 nt, Human
ucuaguuugauuaaauucuug

SEQ ID NO: 3117587 - RNA, 22 nt, Human
ucuaguuguuugauucagacag

SEQ ID NO: 3117588 - RNA, 18 nt, Human
ucuagcauggcugccaau

SEQ ID NO: 3117589 - RNA, 15 nt, Human
acuguucucugcccu

SEQ ID NO: 3117590 - RNA, 18 nt, Human
acuguucucugcccucca

SEQ ID NO: 3117591 - RNA, 17 nt, Human
acuguucucugcccucc

SEQ ID NO: 3117592 - RNA, 16 nt, Human
acuguucucugcccuc

SEQ ID NO: 3117593 - RNA, 21 nt, Human
ucuacccuggcacuauaaugu

SEQ ID NO: 3117594 - RNA, 20 nt, Human
ucuacccagcgagcccuggu

SEQ ID NO: 3117595 - RNA, 19 nt, Human
ucuacccuggcacuauaau

SEQ ID NO: 3117596 - RNA, 14 nt, Human
ucuacccuggcacu

SEQ ID NO: 3117597 - RNA, 21 nt, Human
ucuacagaggccaugggccuc

SEQ ID NO: 3117598 - RNA, 19 nt, Human
ucuacccagcgagcccugg

SEQ ID NO: 3117599 - RNA, 16 nt, Human
ucuacagaggccaugg

SEQ ID NO: 3117600 - RNA, 18 nt, Human
uccugggagugagcuggu

SEQ ID NO: 3117601 - RNA, 15 nt, Human
acuuagguguggggg

SEQ ID NO: 3117602 - RNA, 22 nt, Human
acuuacuguacaugaaaacaca

SEQ ID NO: 3117603 - RNA, 17 nt, Human
acuuacacuuuaugcac

SEQ ID NO: 3117604 - RNA, 21 nt, Human
acuuacuguacaugaaaacac

SEQ ID NO: 3117605 - RNA, 16 nt, Human
acuuacuguacaugaa

SEQ ID NO: 3117606 - RNA, 13 nt, Human
acuuaagcacacu

SEQ ID NO: 3117607 - RNA, 17 nt, Human
acuuaaucuaaauggaa

SEQ ID NO: 3117608 - RNA, 19 nt, Human
acuuaaucuaaauggaacc

SEQ ID NO: 3117609 - RNA, 22 nt, Human
acuuaaucuaaauggaaccacu

SEQ ID NO: 3117610 - RNA, 16 nt, Human
acuuacacuuuaugca

SEQ ID NO: 3117611 - RNA, 20 nt, Human
acuuaaauaaugugaaacug

SEQ ID NO: 3117612 - RNA, 15 nt, Human
ucuccuccagaguca

SEQ ID NO: 3117613 - RNA, 16 nt, Human
ucuccucugcugcugg

SEQ ID NO: 3117614 - RNA, 15 nt, Human
ucuccucugcugcug

SEQ ID NO: 3117615 - RNA, 18 nt, Human
ucuccucugcugcuggcu

SEQ ID NO: 3117616 - RNA, 17 nt, Human
ucuccucugcugcuggc

SEQ ID NO: 3117617 - RNA, 12 nt, Human
acuuuaccuuuu

SEQ ID NO: 3117618 - RNA, 19 nt, Human
ucuccaagcaggacaugga

SEQ ID NO: 3117619 - RNA, 18 nt, Human
ucuccaagcaggacaugg

SEQ ID NO: 3117620 - RNA, 23 nt, Human
ucuccccagcaagugagagcugg

SEQ ID NO: 3117621 - RNA, 21 nt, Human
ucucccuuggauuguccccga

SEQ ID NO: 3117622 - RNA, 17 nt, Human
ucuccgaccagacaccu

SEQ ID NO: 3117623 - RNA, 23 nt, Human
ucuccgaccagacaccuugacag

SEQ ID NO: 3117624 - RNA, 15 nt, Human
acuuuuguucuuggu

SEQ ID NO: 3117625 - RNA, 23 nt, Human
acuuuuguucuugguuuguaaau

SEQ ID NO: 3117626 - RNA, 17 nt, Human
agaaaaaauauuuuccc

SEQ ID NO: 3117627 - RNA, 15 nt, Human
ucuccuucaccuuug

SEQ ID NO: 3117628 - RNA, 14 nt, Human
ucuccuucaccuuu

SEQ ID NO: 3117629 - RNA, 16 nt, Human
ucuccuucaccuuugu

SEQ ID NO: 3117630 - RNA, 13 nt, Human
ucuccuuguguua

SEQ ID NO: 3117631 - RNA, 21 nt, Human
ucuccuuguguuacuaaguuu

SEQ ID NO: 3117632 - RNA, 18 nt, Human
acuuuguguucaccuugu

SEQ ID NO: 3117633 - RNA, 20 nt, Human
acuuuguuaguuucuccaag

SEQ ID NO: 3117634 - RNA, 14 nt, Human
acuuuguucuggcu

SEQ ID NO: 3117635 - RNA, 21 nt, Human
acuuuguuaguuucuccaagc

SEQ ID NO: 3117636 - RNA, 12 nt, Human
acuuuuguucuu

SEQ ID NO: 3117637 - RNA, 13 nt, Human
acuuuuguucuug

SEQ ID NO: 3117638 - RNA, 12 nt, Human
acuuugaccucu

SEQ ID NO: 3117639 - RNA, 13 nt, Human
acuuugaccucug

SEQ ID NO: 3117640 - RNA, 10 nt, Human
ucucaggcca

SEQ ID NO: 3117641 - RNA, 12 nt, Human
ucucaggccaaa

SEQ ID NO: 3117642 - RNA, 13 nt, Human
ucucaggccagcu

SEQ ID NO: 3117643 - RNA, 12 nt, Human
ucucaggccagc

SEQ ID NO: 3117644 - RNA, 21 nt, Human
ucucaggccagcugcuugggc

SEQ ID NO: 3117645 - RNA, 18 nt, Human
ucucaggccagcugcuug

SEQ ID NO: 3117646 - RNA, 17 nt, Human
ucucaggccagcugcuu

SEQ ID NO: 3117647 - RNA, 16 nt, Human
ucucauuugucacaca

SEQ ID NO: 3117648 - RNA, 16 nt, Human
ucuccaagcaggacau

SEQ ID NO: 3117649 - RNA, 15 nt, Human
ucuccaagcaggaca

SEQ ID NO: 3117650 - RNA, 14 nt, Human
ucucauuugucaca

SEQ ID NO: 3117651 - RNA, 20 nt, Human
ucucacuauguugcccaggc

SEQ ID NO: 3117652 - RNA, 21 nt, Human
ucucacuauguugcccaggca

SEQ ID NO: 3117653 - RNA, 22 nt, Human
ucucacuauguugcccaggcag

SEQ ID NO: 3117654 - RNA, 23 nt, Human
ucucacuauguugcccaggcagg

SEQ ID NO: 3117655 - RNA, 19 nt, Human
acuugcagacucuacagag

SEQ ID NO: 3117656 - RNA, 22 nt, Human
acuugcagacucuacagaggcc

SEQ ID NO: 3117657 - RNA, 23 nt, Human
acuugcagacucuacagaggcca

SEQ ID NO: 3117658 - RNA, 21 nt, Human
acuugucuuuggacccugagg

SEQ ID NO: 3117659 - RNA, 18 nt, Human
acuugucuuuggacccug

SEQ ID NO: 3117660 - RNA, 20 nt, Human
acuugucuuuggacccugag

SEQ ID NO: 3117661 - RNA, 19 nt, Human
acuuguggacacagcucuu

SEQ ID NO: 3117662 - RNA, 22 nt, Human
acuuguggacacagcucuucuc

SEQ ID NO: 3117663 - RNA, 22 nt, Human
acccugcccugugggcccccaa

SEQ ID NO: 3117664 - RNA, 17 nt, Human
acccugcccugugggcc

SEQ ID NO: 3117665 - RNA, 14 nt, Human
acccugcccugugg

SEQ ID NO: 3117666 - RNA, 15 nt, Human
acccugcccuguggg

SEQ ID NO: 3117667 - RNA, 16 nt, Human
acccugaggcccagag

SEQ ID NO: 3117668 - RNA, 15 nt, Human
acccugaggcccaga

SEQ ID NO: 3117669 - RNA, 15 nt, Human
accgaaaacguggcu

SEQ ID NO: 3117670 - RNA, 17 nt, Human
acccuugccgucuaccu

SEQ ID NO: 3117671 - RNA, 23 nt, Human
acccuuguggucccaccccacac

SEQ ID NO: 3117672 - RNA, 20 nt, Human
acccuuguggucccacccca

SEQ ID NO: 3117673 - RNA, 18 nt, Human
acccugaaagcccugagc

SEQ ID NO: 3117674 - RNA, 16 nt, Human
acccugaaagcccuga

SEQ ID NO: 3117675 - RNA, 14 nt, Human
acccugaggcccag

SEQ ID NO: 3117676 - RNA, 13 nt, Human
acccugaggccca

SEQ ID NO: 3117677 - RNA, 23 nt, Human
ucagguaacaggcagauacagga

SEQ ID NO: 3117678 - RNA, 21 nt, Human
ucagguaacaggcagauacag

SEQ ID NO: 3117679 - RNA, 22 nt, Human
ucagguaacaggcagauacagg

SEQ ID NO: 3117680 - RNA, 14 nt, Human
acccggccccugcu

SEQ ID NO: 3117681 - RNA, 15 nt, Human
acccggccccugcug

SEQ ID NO: 3117682 - RNA, 16 nt, Human
acccggccccugcugg

SEQ ID NO: 3117683 - RNA, 22 nt, Human
acccggccccugcugguucagg

SEQ ID NO: 3117684 - RNA, 17 nt, Human
acccggccccugcuggu

SEQ ID NO: 3117685 - RNA, 20 nt, Human
acccggccccugcugguuca

SEQ ID NO: 3117686 - RNA, 13 nt, Human
acccgggaagggg

SEQ ID NO: 3117687 - RNA, 12 nt, Human
acccgggaaggg

SEQ ID NO: 3117688 - RNA, 20 nt, Human
ucaggccaggcccucugccc

SEQ ID NO: 3117689 - RNA, 22 nt, Human
ucaggccaggcccucugcccac

SEQ ID NO: 3117690 - RNA, 21 nt, Human
ucaggccaggcccucugccca

SEQ ID NO: 3117691 - RNA, 14 nt, Human
ucagcuccagcuca

SEQ ID NO: 3117692 - RNA, 21 nt, Human
ucagcuuguaaauagcucagg

SEQ ID NO: 3117693 - RNA, 22 nt, Human
ucagcuuguaaauagcucaggu

SEQ ID NO: 3117694 - RNA, 23 nt, Human
ucaggccaggcccucugcccacu

SEQ ID NO: 3117695 - RNA, 16 nt, Human
ucaggguuggccccug

SEQ ID NO: 3117696 - RNA, 19 nt, Human
ucagggucccugguggcag

SEQ ID NO: 3117697 - RNA, 18 nt, Human
ucagcggggacagcuccu

SEQ ID NO: 3117698 - RNA, 19 nt, Human
ucagcggggacagcuccuu

SEQ ID NO: 3117699 - RNA, 20 nt, Human
ucagcggggacagcuccuuc

SEQ ID NO: 3117700 - RNA, 21 nt, Human
ucagcggggacagcuccuucu

SEQ ID NO: 3117701 - RNA, 23 nt, Human
ucagcggggacagcuccuucugu

SEQ ID NO: 3117702 - RNA, 12 nt, Human
ucagcuccagcu

SEQ ID NO: 3117703 - RNA, 18 nt, Human
accccaucucuacaaaaa

SEQ ID NO: 3117704 - RNA, 19 nt, Human
acccaggagccccgaggcc

SEQ ID NO: 3117705 - RNA, 23 nt, Human
acccaggagccccgaggccuucu

SEQ ID NO: 3117706 - RNA, 17 nt, Human
accccacacacgccaga

SEQ ID NO: 3117707 - RNA, 22 nt, Human
accccagccccaaaacucuccu

SEQ ID NO: 3117708 - RNA, 13 nt, Human
accccagccccaa

SEQ ID NO: 3117709 - RNA, 12 nt, Human
ucagauuugaac

SEQ ID NO: 3117710 - RNA, 21 nt, Human
ucagauuugaacucuucaauc

SEQ ID NO: 3117711 - RNA, 15 nt, Human
ucagcaaaagaugcu

SEQ ID NO: 3117712 - RNA, 15 nt, Human
ucauauuuacuucuu

SEQ ID NO: 3117713 - RNA, 23 nt, Human
ucauauuuacuucuuauacauuu

SEQ ID NO: 3117714 - RNA, 18 nt, Human
ucauauaagauucauauu

SEQ ID NO: 3117715 - RNA, 21 nt, Human
ucauaguaugguggcuggguu

SEQ ID NO: 3117716 - RNA, 15 nt, Human
ucauaguaugguggc

SEQ ID NO: 3117717 - RNA, 18 nt, Human
ucauaguaugguggcugg

SEQ ID NO: 3117718 - RNA, 19 nt, Human
ucauaguaugguggcuggg

SEQ ID NO: 3117719 - RNA, 14 nt, Human
ucauaaccuagccu

SEQ ID NO: 3117720 - RNA, 12 nt, Human
ucaguggcagcu

SEQ ID NO: 3117721 - RNA, 11 nt, Human
ucaguggcagc

SEQ ID NO: 3117722 - RNA, 16 nt, Human
ucagugccuuauggaa

SEQ ID NO: 3117723 - RNA, 10 nt, Human
ucagugccuu

SEQ ID NO: 3117724 - RNA, 9 nt, Human
ucagugccu

SEQ ID NO: 3117725 - RNA, 15 nt, Human
ucagugccuuaugga

SEQ ID NO: 3117726 - RNA, 14 nt, Human
ucagugccuuaugg

SEQ ID NO: 3117727 - RNA, 12 nt, Human
ucagugccuuau

SEQ ID NO: 3117728 - RNA, 11 nt, Human
ucagugccuua

SEQ ID NO: 3117729 - RNA, 19 nt, Human
accgaaaacguggcugcuu

SEQ ID NO: 3117730 - RNA, 17 nt, Human
accgaaaacguggcugc

SEQ ID NO: 3117731 - RNA, 12 nt, Human
ucagugccacua

SEQ ID NO: 3117732 - RNA, 16 nt, Human
ucagugccaaaaacaa

SEQ ID NO: 3117733 - RNA, 20 nt, Human
accucccacaaaggagagcu

SEQ ID NO: 3117734 - RNA, 16 nt, Human
accgcagacaggacca

SEQ ID NO: 3117735 - RNA, 12 nt, Human
accgcagacagg

SEQ ID NO: 3117736 - RNA, 10 nt, Human
ucacuugagu

SEQ ID NO: 3117737 - RNA, 15 nt, Human
accaguguuguggau

SEQ ID NO: 3117738 - RNA, 17 nt, Human
accaguguuguggauuu

SEQ ID NO: 3117739 - RNA, 23 nt, Human
ucacuguugcccaggcuggcgug

SEQ ID NO: 3117740 - RNA, 19 nt, Human
ucacuguugcccaggcugg

SEQ ID NO: 3117741 - RNA, 15 nt, Human
ucacugcagccucaa

SEQ ID NO: 3117742 - RNA, 13 nt, Human
ucacugcagccuc

SEQ ID NO: 3117743 - RNA, 16 nt, Human
ucacugagacagcccg

SEQ ID NO: 3117744 - RNA, 14 nt, Human
ucacugcagccuca

SEQ ID NO: 3117745 - RNA, 22 nt, Human
ucacugagacagcccgggcucu

SEQ ID NO: 3117746 - RNA, 21 nt, Human
ucacugagacagcccgggcuc

SEQ ID NO: 3117747 - RNA, 17 nt, Human
ucacugagacagcccgg

SEQ ID NO: 3117748 - RNA, 22 nt, Human
accagcgugugacuacuccccc

SEQ ID NO: 3117749 - RNA, 17 nt, Human
accacuacauucuguua

SEQ ID NO: 3117750 - RNA, 16 nt, Human
accacuacauucuguu

SEQ ID NO: 3117751 - RNA, 15 nt, Human
accacuacauucugu

SEQ ID NO: 3117752 - RNA, 17 nt, Human
accacaucuugcucugc

SEQ ID NO: 3117753 - RNA, 18 nt, Human
accacaucuugcucugcu

SEQ ID NO: 3117754 - RNA, 19 nt, Human
accacaucuugcucugcug

SEQ ID NO: 3117755 - RNA, 15 nt, Human
accaccacacccagc

SEQ ID NO: 3117756 - RNA, 20 nt, Human
accaccacacccagcccacu

SEQ ID NO: 3117757 - RNA, 18 nt, Human
accacaugugcacaugca

SEQ ID NO: 3117758 - RNA, 16 nt, Human
accacaucuugcucug

SEQ ID NO: 3117759 - RNA, 17 nt, Human
ucacaaaggaugcccaa

SEQ ID NO: 3117760 - RNA, 20 nt, Human
ucacagaugggugcuuggag

SEQ ID NO: 3117761 - RNA, 13 nt, Human
ucacagccucuga

SEQ ID NO: 3117762 - RNA, 20 nt, Human
ucacaguucucuccuucuuc

SEQ ID NO: 3117763 - RNA, 16 nt, Human
ucacaguucucuccuu

SEQ ID NO: 3117764 - RNA, 15 nt, Human
acauguccaagaagc

SEQ ID NO: 3117765 - RNA, 23 nt, Human
acauguaauuaaguacuauguau

SEQ ID NO: 3117766 - RNA, 14 nt, Human
acauuccugaugcu

SEQ ID NO: 3117767 - RNA, 13 nt, Human
ucaaauuucuaaa

SEQ ID NO: 3117768 - RNA, 20 nt, Human
ucaacugcaucaagauguga

SEQ ID NO: 3117769 - RNA, 14 nt, Human
ucaaccagcagaug

SEQ ID NO: 3117770 - RNA, 15 nt, Human
acauguaauuaagua

SEQ ID NO: 3117771 - RNA, 17 nt, Human
acauguaauuaaguacu

SEQ ID NO: 3117772 - RNA, 19 nt, Human
acauguaauuaaguacuau

SEQ ID NO: 3117773 - RNA, 21 nt, Human
acauguaauuaaguacuaugu

SEQ ID NO: 3117774 - RNA, 22 nt, Human
acauguaauuaaguacuaugua

SEQ ID NO: 3117775 - RNA, 15 nt, Human
acaugcuacacacug

SEQ ID NO: 3117776 - RNA, 21 nt, Human
acaugcuacacacugcauguu

SEQ ID NO: 3117777 - RNA, 17 nt, Human
acauuuuuuaaaugcac

SEQ ID NO: 3117778 - RNA, 14 nt, Human
acauuuuuuaaaug

SEQ ID NO: 3117779 - RNA, 16 nt, Human
acauuuuuuaaaugca

SEQ ID NO: 3117780 - RNA, 21 nt, Human
acauuuuuaagugcugcauuu

SEQ ID NO: 3117781 - RNA, 22 nt, Human
acauuuuuaagugcugcauuua

SEQ ID NO: 3117782 - RNA, 23 nt, Human
acauuuuuaagugcugcauuuaa

SEQ ID NO: 3117783 - RNA, 19 nt, Human
acauuuuuaagugcugcau

SEQ ID NO: 3117784 - RNA, 18 nt, Human
acauuuuauuuuauuaug

SEQ ID NO: 3117785 - RNA, 14 nt, Human
acauuuuauuuuau

SEQ ID NO: 3117786 - RNA, 19 nt, Human
acauuuuauuuuauuaugc

SEQ ID NO: 3117787 - RNA, 20 nt, Human
acauuuuauuuuauuaugca

SEQ ID NO: 3117788 - RNA, 22 nt, Human
ucaaguccucuuuucugagagg

SEQ ID NO: 3117789 - RNA, 13 nt, Human
acugauaaagaug

SEQ ID NO: 3117790 - RNA, 21 nt, Human
acugauaaagaugagugagca

SEQ ID NO: 3117791 - RNA, 14 nt, Human
acugcaccgggcca

SEQ ID NO: 3117792 - RNA, 16 nt, Human
acugcaccgggccaca

SEQ ID NO: 3117793 - RNA, 20 nt, Human
acugcacuauagccuaggug

SEQ ID NO: 3117794 - RNA, 21 nt, Human
acugcacuauagccuagguga

SEQ ID NO: 3117795 - RNA, 14 nt, Human
acugcacuccagcc

SEQ ID NO: 3117796 - RNA, 17 nt, Human
acugcacuccagccugg

SEQ ID NO: 3117797 - RNA, 18 nt, Human
acugcacuccagccuggg

SEQ ID NO: 3117798 - RNA, 20 nt, Human
acugcacuccagccugggug

SEQ ID NO: 3117799 - RNA, 19 nt, Human
acugcacuccagccugggu

SEQ ID NO: 3117800 - RNA, 19 nt, Human
uccugaugcuucuucagag

SEQ ID NO: 3117801 - RNA, 21 nt, Human
uccugaugcuucuucagagac

SEQ ID NO: 3117802 - RNA, 20 nt, Human
uccugaugcuucuucagaga

SEQ ID NO: 3117803 - RNA, 21 nt, Human
uccugccucgaacuggcugca

SEQ ID NO: 3117804 - RNA, 14 nt, Human
uccugcaggcagcc

SEQ ID NO: 3117805 - RNA, 13 nt, Human
uccugcaggcagc

SEQ ID NO: 3117806 - RNA, 12 nt, Human
uccugcaggcag

SEQ ID NO: 3117807 - RNA, 21 nt, Human
uccugcugcaguugccaguca

SEQ ID NO: 3117808 - RNA, 12 nt, Human
uccugggaguga

SEQ ID NO: 3117809 - RNA, 14 nt, Human
uccugggagugagc

SEQ ID NO: 3117810 - RNA, 17 nt, Human
uccugggagugagcugg

SEQ ID NO: 3117811 - RNA, 15 nt, Human
uccuggaaauauuaa

SEQ ID NO: 3117812 - RNA, 23 nt, Human
acugagacagcccgggcucugcc

SEQ ID NO: 3117813 - RNA, 22 nt, Human
acugagacagcccgggcucugc

SEQ ID NO: 3117814 - RNA, 21 nt, Human
acugagacagcccgggcucug

SEQ ID NO: 3117815 - RNA, 18 nt, Human
acugagacagcccgggcu

SEQ ID NO: 3117816 - RNA, 15 nt, Human
acugagacagcccgg

SEQ ID NO: 3117817 - RNA, 19 nt, Human
uccucuuuccaucuacccu

SEQ ID NO: 3117818 - RNA, 21 nt, Human
uccucuuuggucuacacugug

SEQ ID NO: 3117819 - RNA, 19 nt, Human
uccucuuuggucuacacug

SEQ ID NO: 3117820 - RNA, 11 nt, Human
uccucccuccc

SEQ ID NO: 3117821 - RNA, 14 nt, Human
uccucccucccucu

SEQ ID NO: 3117822 - RNA, 11 nt, Human
uccucuuucca

SEQ ID NO: 3117823 - RNA, 12 nt, Human
uccucuuuccau

SEQ ID NO: 3117824 - RNA, 22 nt, Human
uccucuuuggucuacacugugc

SEQ ID NO: 3117825 - RNA, 14 nt, Human
acuccugcaggcag

SEQ ID NO: 3117826 - RNA, 12 nt, Human
acuccugcaggc

SEQ ID NO: 3117827 - RNA, 22 nt, Human
acuccugcaggcagccaggcca

SEQ ID NO: 3117828 - RNA, 16 nt, Human
acuccugcaggcagcc

SEQ ID NO: 3117829 - RNA, 15 nt, Human
acuccugcaggcagc

SEQ ID NO: 3117830 - RNA, 11 nt, Human
acuccuggccu

SEQ ID NO: 3117831 - RNA, 17 nt, Human
ucccugguggcagcuca

SEQ ID NO: 3117832 - RNA, 16 nt, Human
ucccugguggcagcuc

SEQ ID NO: 3117833 - RNA, 21 nt, Human
ucccugguggcagcucaccuc

SEQ ID NO: 3117834 - RNA, 20 nt, Human
ucccugguggcagcucaccu

SEQ ID NO: 3117835 - RNA, 19 nt, Human
ucccugguggcagcucacc

SEQ ID NO: 3117836 - RNA, 18 nt, Human
ucccugguggcagcucac

SEQ ID NO: 3117837 - RNA, 13 nt, Human
acucaccccagcc

SEQ ID NO: 3117838 - RNA, 16 nt, Human
acucaccccagcccca

SEQ ID NO: 3117839 - RNA, 15 nt, Human
acucaccccagcccc

SEQ ID NO: 3117840 - RNA, 14 nt, Human
acucaccccagccc

SEQ ID NO: 3117841 - RNA, 12 nt, Human
acuccuggccuc

SEQ ID NO: 3117842 - RNA, 13 nt, Human
uccuaggcauuug

SEQ ID NO: 3117843 - RNA, 13 nt, Human
acuccuggccuca

SEQ ID NO: 3117844 - RNA, 14 nt, Human
acuccuggccucaa

SEQ ID NO: 3117845 - RNA, 15 nt, Human
uccuacucuguguca

SEQ ID NO: 3117846 - RNA, 12 nt, Human
uccuacucugug

SEQ ID NO: 3117847 - RNA, 13 nt, Human
uccuacucugugu

SEQ ID NO: 3117848 - RNA, 14 nt, Human
uccuacucuguguc

SEQ ID NO: 3117849 - RNA, 18 nt, Human
ucccuuugacgccauccc

SEQ ID NO: 3117850 - RNA, 16 nt, Human
ucccuuugacgccauc

SEQ ID NO: 3117851 - RNA, 20 nt, Human
ucccuuggauuguccccgac

SEQ ID NO: 3117852 - RNA, 19 nt, Human
ucccuuggauuguccccga

SEQ ID NO: 3117853 - RNA, 22 nt, Human
ucccugguggcagcucaccucu

SEQ ID NO: 3117854 - RNA, 19 nt, Human
ucccuuuuuuggcugcuga

SEQ ID NO: 3117855 - RNA, 17 nt, Human
ucccuuuuuuggcugcu

SEQ ID NO: 3117856 - RNA, 19 nt, Human
ucccuuugacgccauccca

SEQ ID NO: 3117857 - RNA, 22 nt, Human
ucccuuuuuuggcugcugaagg

SEQ ID NO: 3117858 - RNA, 20 nt, Human
ucccuuuuuuggcugcugaa

SEQ ID NO: 3117859 - RNA, 23 nt, Human
ucccuuuuuuggcugcugaaggc

SEQ ID NO: 3117860 - RNA, 22 nt, Human
acucugagacucgcgacaaugc

SEQ ID NO: 3117861 - RNA, 11 nt, Human
acucugagacu

SEQ ID NO: 3117862 - RNA, 23 nt, Human
acucuccuuggugucgggcauga

SEQ ID NO: 3117863 - RNA, 16 nt, Human
acucuccuuggugucg

SEQ ID NO: 3117864 - RNA, 15 nt, Human
acucuggcagcucag

SEQ ID NO: 3117865 - RNA, 13 nt, Human
acucuggcagcuc

SEQ ID NO: 3117866 - RNA, 12 nt, Human
acucuccucugc

SEQ ID NO: 3117867 - RNA, 14 nt, Human
acucuccucugcug

SEQ ID NO: 3117868 - RNA, 13 nt, Human
acucuccucugcu

SEQ ID NO: 3117869 - RNA, 21 nt, Human
acucuccucugcugcuggcug

SEQ ID NO: 3117870 - RNA, 15 nt, Human
acucuccuugguguc

SEQ ID NO: 3117871 - RNA, 18 nt, Human
acucuccuggaaauauua

SEQ ID NO: 3117872 - RNA, 17 nt, Human
acucuccuccagaguca

SEQ ID NO: 3117873 - RNA, 14 nt, Human
acucuccuccagag

SEQ ID NO: 3117874 - RNA, 24 nt, Human
acuccuugaaaacacuguucucug

SEQ ID NO: 3117875 - RNA, 23 nt, Human
acuccuugaaaacacuguucucu

SEQ ID NO: 3117876 - RNA, 23 nt, Human
uccucauacccacccccacccaa

SEQ ID NO: 3117877 - RNA, 22 nt, Human
uccucauaguaugguggcuggg

SEQ ID NO: 3117878 - RNA, 22 nt, Human
uccucauacccacccccaccca

SEQ ID NO: 3117879 - RNA, 15 nt, Human
acucuugaccucagg

SEQ ID NO: 3117880 - RNA, 16 nt, Human
acucuugaccucaggu

SEQ ID NO: 3117881 - RNA, 14 nt, Human
acucuugaccucag

SEQ ID NO: 3117882 - RNA, 16 nt, Human
ucccccagccccaucc

SEQ ID NO: 3117883 - RNA, 15 nt, Human
ucccccagccccauc

SEQ ID NO: 3117884 - RNA, 13 nt, Human
ucccccagcccca

SEQ ID NO: 3117885 - RNA, 11 nt, Human
ucccccagccc

SEQ ID NO: 3117886 - RNA, 21 nt, Human
uccccaggaggccagccuuga

SEQ ID NO: 3117887 - RNA, 20 nt, Human
uccccaggaggccagccuug

SEQ ID NO: 3117888 - RNA, 17 nt, Human
uccccaggaggccagcc

SEQ ID NO: 3117889 - RNA, 12 nt, Human
uccccacccuga

SEQ ID NO: 3117890 - RNA, 18 nt, Human
uccccaggaggccagccu

SEQ ID NO: 3117891 - RNA, 16 nt, Human
uccccaccgcagacag

SEQ ID NO: 3117892 - RNA, 15 nt, Human
uccccaccgcagaca

SEQ ID NO: 3117893 - RNA, 23 nt, Human
uccccacccugaaagcccugagc

SEQ ID NO: 3117894 - RNA, 14 nt, Human
acuauguugcccag

SEQ ID NO: 3117895 - RNA, 22 nt, Human
acuauggcccuggccuagcaua

SEQ ID NO: 3117896 - RNA, 15 nt, Human
acuauguugcccagg

SEQ ID NO: 3117897 - RNA, 16 nt, Human
acuauguugcccaggc

SEQ ID NO: 3117898 - RNA, 16 nt, Human
acucaaugcacugaca

SEQ ID NO: 3117899 - RNA, 20 nt, Human
acuauagccuaggugacaga

SEQ ID NO: 3117900 - RNA, 22 nt, Human
acuauagccuaggugacagagu

SEQ ID NO: 3117901 - RNA, 18 nt, Human
acuauagccuaggugaca

SEQ ID NO: 3117902 - RNA, 16 nt, Human
acuaucuaaauguuga

SEQ ID NO: 3117903 - RNA, 21 nt, Human
acuaucuaaauguugaaagau

SEQ ID NO: 3117904 - RNA, 21 nt, Human
acguggcugcuucaaggaucc

SEQ ID NO: 3117905 - RNA, 19 nt, Human
acguggcugcuucaaggau

SEQ ID NO: 3117906 - RNA, 18 nt, Human
acguggcugcuucaagga

SEQ ID NO: 3117907 - RNA, 17 nt, Human
acguggcugcuucaagg

SEQ ID NO: 3117908 - RNA, 15 nt, Human
acguuucuaaaggcu

SEQ ID NO: 3117909 - RNA, 16 nt, Human
acguuucuaaaggcua

SEQ ID NO: 3117910 - RNA, 14 nt, Human
acguugugcauuug

SEQ ID NO: 3117911 - RNA, 15 nt, Human
acguugugcauuugg

SEQ ID NO: 3117912 - RNA, 13 nt, Human
acguugugcauuu

SEQ ID NO: 3117913 - RNA, 17 nt, Human
acgguuuuacugcagcu

SEQ ID NO: 3117914 - RNA, 18 nt, Human
ucccagauacuugggggg

SEQ ID NO: 3117915 - RNA, 12 nt, Human
ucccagccccaa

SEQ ID NO: 3117916 - RNA, 16 nt, Human
ucccagauacuugggg

SEQ ID NO: 3117917 - RNA, 22 nt, Human
acguuucuaaaggcuaccuuug

SEQ ID NO: 3117918 - RNA, 18 nt, Human
uccaguaucuugaagacu

SEQ ID NO: 3117919 - RNA, 16 nt, Human
uccaguaucuugaaga

SEQ ID NO: 3117920 - RNA, 23 nt, Human
uccagugaggcucugcccuuggu

SEQ ID NO: 3117921 - RNA, 22 nt, Human
uccagugaggcucugcccuugg

SEQ ID NO: 3117922 - RNA, 16 nt, Human
uccagugaggcucugc

SEQ ID NO: 3117923 - RNA, 15 nt, Human
uccagugaggcucug

SEQ ID NO: 3117924 - RNA, 15 nt, Human
uccaguaucuugaag

SEQ ID NO: 3117925 - RNA, 14 nt, Human
uccaguaucuugaa

SEQ ID NO: 3117926 - RNA, 18 nt, Human
acggcuuuuacuuaaacc

SEQ ID NO: 3117927 - RNA, 16 nt, Human
acggcucacugcagcc

SEQ ID NO: 3117928 - RNA, 15 nt, Human
acggcucacugcagc

SEQ ID NO: 3117929 - RNA, 17 nt, Human
acggcucacugcagccu

SEQ ID NO: 3117930 - RNA, 18 nt, Human
acggcucacugcagccuc

SEQ ID NO: 3117931 - RNA, 12 nt, Human
acggccaggcca

SEQ ID NO: 3117932 - RNA, 18 nt, Human
acgcuacccgggaagggg

SEQ ID NO: 3117933 - RNA, 21 nt, Human
acgcuacccgggaagggggcu

SEQ ID NO: 3117934 - RNA, 14 nt, Human
acgaauauugcuga

SEQ ID NO: 3117935 - RNA, 21 nt, Human
acgaauauugcugauggugca

SEQ ID NO: 3117936 - RNA, 23 nt, Human
acggagucccaccuuggcugcag

SEQ ID NO: 3117937 - RNA, 21 nt, Human
acggagucccaccuuggcugc

SEQ ID NO: 3117938 - RNA, 17 nt, Human
acgcuggagugcaguga

SEQ ID NO: 3117939 - RNA, 20 nt, Human
acgcuggaccuugaacuggg

SEQ ID NO: 3117940 - RNA, 23 nt, Human
acgcuggaccuugaacuggguac

SEQ ID NO: 3117941 - RNA, 15 nt, Human
acgcuggagugcagu

SEQ ID NO: 3117942 - RNA, 16 nt, Human
acgcuggagugcagug

SEQ ID NO: 3117943 - RNA, 13 nt, Human
acgcuggaccuug

SEQ ID NO: 3117944 - RNA, 18 nt, Human
acgaauauugcugauggu

SEQ ID NO: 3117945 - RNA, 15 nt, Human
acgaauauugcugau

SEQ ID NO: 3117946 - RNA, 22 nt, Human
accuuuuuuauacauaaacaag

SEQ ID NO: 3117947 - RNA, 23 nt, Human
uccaggcugggagagccuuccag

SEQ ID NO: 3117948 - RNA, 10 nt, Human
uccaggcucc

SEQ ID NO: 3117949 - RNA, 12 nt, Human
uccaggcuccuu

SEQ ID NO: 3117950 - RNA, 21 nt, Human
uccaggcugggagagccuucc

SEQ ID NO: 3117951 - RNA, 20 nt, Human
uccaggcugggagagccuuc

SEQ ID NO: 3117952 - RNA, 13 nt, Human
uccagacacaugu

SEQ ID NO: 3117953 - RNA, 15 nt, Human
uccagaauuucccaa

SEQ ID NO: 3117954 - RNA, 14 nt, Human
uccagaauuuccca

SEQ ID NO: 3117955 - RNA, 22 nt, Human
uccaggagcagccacauuccug

SEQ ID NO: 3117956 - RNA, 20 nt, Human
accuugaacuggguacuugu

SEQ ID NO: 3117957 - RNA, 17 nt, Human
accuuuguccccaccgc

SEQ ID NO: 3117958 - RNA, 18 nt, Human
accuuuguccccaccgca

SEQ ID NO: 3117959 - RNA, 21 nt, Human
uccacugugccaugugccagg

SEQ ID NO: 3117960 - RNA, 13 nt, Human
accuuuuuuauac

SEQ ID NO: 3117961 - RNA, 22 nt, Human
aauaugcacacauuuuuuaaau

SEQ ID NO: 3117962 - RNA, 15 nt, Human
aauaugcacacauuu

SEQ ID NO: 3117963 - RNA, 16 nt, Human
aauaugcacacauuuu

SEQ ID NO: 3117964 - RNA, 17 nt, Human
aauaugcacacauuuuu

SEQ ID NO: 3117965 - RNA, 15 nt, Human
uaagagaaaugagcu

SEQ ID NO: 3117966 - RNA, 18 nt, Human
uaagcacacuugacauca

SEQ ID NO: 3117967 - RNA, 22 nt, Human
uaagcuguuacugucuucagua

SEQ ID NO: 3117968 - RNA, 13 nt, Human
uaacuucacauau

SEQ ID NO: 3117969 - RNA, 21 nt, Human
uaacuucacauauugauuucc

SEQ ID NO: 3117970 - RNA, 14 nt, Human
uaacuucaccauau

SEQ ID NO: 3117971 - RNA, 17 nt, Human
uaacuuccaauuuacau

SEQ ID NO: 3117972 - RNA, 16 nt, Human
uaacauggaaguacua

SEQ ID NO: 3117973 - RNA, 18 nt, Human
uaacauggacaugaucuu

SEQ ID NO: 3117974 - RNA, 23 nt, Human
uaacauggacaugaucuucuuua

SEQ ID NO: 3117975 - RNA, 22 nt, Human
aauaguggugugauuuggggau

SEQ ID NO: 3117976 - RNA, 16 nt, Human
aauaguggugugauuu

SEQ ID NO: 3117977 - RNA, 21 nt, Human
aauaguucagguaacaggcag

SEQ ID NO: 3117978 - RNA, 13 nt, Human
aauaguuggcuag

SEQ ID NO: 3117979 - RNA, 15 nt, Human
aaucauuagguguga

SEQ ID NO: 3117980 - RNA, 17 nt, Human
aaucauuaggugugacu

SEQ ID NO: 3117981 - RNA, 23 nt, Human
aaucauuaggugugacugaauuu

SEQ ID NO: 3117982 - RNA, 17 nt, Human
uaaguacuauguaucaa

SEQ ID NO: 3117983 - RNA, 13 nt, Human
uaaguacuaugua

SEQ ID NO: 3117984 - RNA, 16 nt, Human
uaaguacuauguauca

SEQ ID NO: 3117985 - RNA, 20 nt, Human
uaaguauucuuauuuaauga

SEQ ID NO: 3117986 - RNA, 19 nt, Human
uaaguauucuuauuuaaug

SEQ ID NO: 3117987 - RNA, 15 nt, Human
aaugaccuuucaaua

SEQ ID NO: 3117988 - RNA, 22 nt, Human
aaugaaugucagugugacugau

SEQ ID NO: 3117989 - RNA, 13 nt, Human
aaugaaugucagu

SEQ ID NO: 3117990 - RNA, 17 nt, Human
aaugaaacauuuuguca

SEQ ID NO: 3117991 - RNA, 16 nt, Human
aaugaaagacuguaca

SEQ ID NO: 3117992 - RNA, 17 nt, Human
aaugaaagacuguacaa

SEQ ID NO: 3117993 - RNA, 17 nt, Human
aaugaaaccugugucuc

SEQ ID NO: 3117994 - RNA, 18 nt, Human
uaaugucacaggcagguc

SEQ ID NO: 3117995 - RNA, 13 nt, Human
uaauguacugcau

SEQ ID NO: 3117996 - RNA, 17 nt, Human
uaaugaaugaaacauuu

SEQ ID NO: 3117997 - RNA, 18 nt, Human
uaauacaccacuacauuc

SEQ ID NO: 3117998 - RNA, 19 nt, Human
uaauacaccacuacauucu

SEQ ID NO: 3117999 - RNA, 14 nt, Human
uaauagacaauuua

SEQ ID NO: 3118000 - RNA, 16 nt, Human
uaauagacaauuuauu

SEQ ID NO: 3118001 - RNA, 16 nt, Human
uaauacaccacuacau

SEQ ID NO: 3118002 - RNA, 14 nt, Human
uaauacaccacuac

SEQ ID NO: 3118003 - RNA, 18 nt, Human
uaauagacaauuuauuau

SEQ ID NO: 3118004 - RNA, 22 nt, Human
uaauagacaauuuauuauggca

SEQ ID NO: 3118005 - RNA, 13 nt, Human
uacauucuguuaa

SEQ ID NO: 3118006 - RNA, 12 nt, Human
uacauucuguua

SEQ ID NO: 3118007 - RNA, 21 nt, Human
aauguucucucuucuccaccu

SEQ ID NO: 3118008 - RNA, 19 nt, Human
aauguauguguaaguauuc

SEQ ID NO: 3118009 - RNA, 20 nt, Human
aauguauguguaaguauucu

SEQ ID NO: 3118010 - RNA, 17 nt, Human
aaugugaaaagaaaaau

SEQ ID NO: 3118011 - RNA, 15 nt, Human
aaugugaaacuggau

SEQ ID NO: 3118012 - RNA, 14 nt, Human
aaugugaaacugga

SEQ ID NO: 3118013 - RNA, 19 nt, Human
aaugugaaaagaaaaauga

SEQ ID NO: 3118014 - RNA, 24 nt, Human
uacauaaugcgugcauaccacuuu

SEQ ID NO: 3118015 - RNA, 21 nt, Human
uacauaaugcgugcauaccac

SEQ ID NO: 3118016 - RNA, 23 nt, Human
uacauaaugcgugcauaccacuu

SEQ ID NO: 3118017 - RNA, 16 nt, Human
uacaggugugagucac

SEQ ID NO: 3118018 - RNA, 12 nt, Human
aauggcagccuu

SEQ ID NO: 3118019 - RNA, 16 nt, Human
aauggcagccuuggca

SEQ ID NO: 3118020 - RNA, 18 nt, Human
uacagaggccaugggccu

SEQ ID NO: 3118021 - RNA, 19 nt, Human
uacagacaaagcguggugg

SEQ ID NO: 3118022 - RNA, 22 nt, Human
uacagacaacaaaccuguuucu

SEQ ID NO: 3118023 - RNA, 19 nt, Human
uacacauuuuauuuuauua

SEQ ID NO: 3118024 - RNA, 21 nt, Human
uacacauuuuauuuuauuaug

SEQ ID NO: 3118025 - RNA, 22 nt, Human
uacacauuuuauuuuauuaugc

SEQ ID NO: 3118026 - RNA, 15 nt, Human
uacacuaaaagguga

SEQ ID NO: 3118027 - RNA, 21 nt, Human
aaugcacuuuguucuggcucu

SEQ ID NO: 3118028 - RNA, 17 nt, Human
aaugaccuuucaauagg

SEQ ID NO: 3118029 - RNA, 16 nt, Human
aaugaccuuucaauag

SEQ ID NO: 3118030 - RNA, 18 nt, Human
aaugaccuuucaauagga

SEQ ID NO: 3118031 - RNA, 21 nt, Human
uacaaugcugugcccuaaagu

SEQ ID NO: 3118032 - RNA, 22 nt, Human
aaugcacuuuguucuggcucuu

SEQ ID NO: 3118033 - RNA, 12 nt, Human
aaugcccagccc

SEQ ID NO: 3118034 - RNA, 11 nt, Human
aaugcccagcc

SEQ ID NO: 3118035 - RNA, 21 nt, Human
aauggacguguuaugacucca

SEQ ID NO: 3118036 - RNA, 14 nt, Human
aauggaaccacucu

SEQ ID NO: 3118037 - RNA, 20 nt, Human
aauggacuaacuugucuuug

SEQ ID NO: 3118038 - RNA, 23 nt, Human
aauggacguguuaugacuccaga

SEQ ID NO: 3118039 - RNA, 21 nt, Human
aauggaaaugggcagagcaga

SEQ ID NO: 3118040 - RNA, 20 nt, Human
aauggaaaugggcagagcag

SEQ ID NO: 3118041 - RNA, 13 nt, Human
uacuacuccugua

SEQ ID NO: 3118042 - RNA, 17 nt, Human
uacuacuccuguaggaa

SEQ ID NO: 3118043 - RNA, 23 nt, Human
uacuauggcccuggccuagcaua

SEQ ID NO: 3118044 - RNA, 12 nt, Human
uacuauguauca

SEQ ID NO: 3118045 - RNA, 13 nt, Human
uacuauguaucaa

SEQ ID NO: 3118046 - RNA, 14 nt, Human
uacuauguaucaau

SEQ ID NO: 3118047 - RNA, 22 nt, Human
uacucuccuggaaauauuaaga

SEQ ID NO: 3118048 - RNA, 23 nt, Human
uacucuccuggaaauauuaagaa

SEQ ID NO: 3118049 - RNA, 18 nt, Human
uacgggaggguaaggcug

SEQ ID NO: 3118050 - RNA, 12 nt, Human
uacguacacauu

SEQ ID NO: 3118051 - RNA, 14 nt, Human
uacguugugcauuu

SEQ ID NO: 3118052 - RNA, 13 nt, Human
uacguacacauuu

SEQ ID NO: 3118053 - RNA, 15 nt, Human
uacguugugcauuug

SEQ ID NO: 3118054 - RNA, 16 nt, Human
uacguugugcauuugg

SEQ ID NO: 3118055 - RNA, 22 nt, Human
uacgccaggggaaaaucagccu

SEQ ID NO: 3118056 - RNA, 18 nt, Human
uacuguacaugaaaacac

SEQ ID NO: 3118057 - RNA, 22 nt, Human
uacuguacaugaaaacacauuu

SEQ ID NO: 3118058 - RNA, 21 nt, Human
uacuguacaugaaaacacauu

SEQ ID NO: 3118059 - RNA, 12 nt, Human
uacucuguguca

SEQ ID NO: 3118060 - RNA, 16 nt, Human
uacuggagaaaaugga

SEQ ID NO: 3118061 - RNA, 19 nt, Human
uacuguaauuugugauaca

SEQ ID NO: 3118062 - RNA, 20 nt, Human
uacuguaauuugugauacaa

SEQ ID NO: 3118063 - RNA, 18 nt, Human
uacuguaauuugugauac

SEQ ID NO: 3118064 - RNA, 11 nt, Human
aauuacaggaa

SEQ ID NO: 3118065 - RNA, 15 nt, Human
aauuagccaagugug

SEQ ID NO: 3118066 - RNA, 10 nt, Human
uaccuguccc

SEQ ID NO: 3118067 - RNA, 17 nt, Human
uaccugucccccugaca

SEQ ID NO: 3118068 - RNA, 16 nt, Human
uaccugucccccugac

SEQ ID NO: 3118069 - RNA, 14 nt, Human
uaccugucccccug

SEQ ID NO: 3118070 - RNA, 13 nt, Human
uaccugucccccu

SEQ ID NO: 3118071 - RNA, 23 nt, Human
uaccugccaggaagccagcaggc

SEQ ID NO: 3118072 - RNA, 20 nt, Human
uaccugccaggaagccagca

SEQ ID NO: 3118073 - RNA, 18 nt, Human
uaccugccaggaagccag

SEQ ID NO: 3118074 - RNA, 12 nt, Human
aauuccccagau

SEQ ID NO: 3118075 - RNA, 14 nt, Human
aauuccccacccug

SEQ ID NO: 3118076 - RNA, 20 nt, Human
acacuaaccacgcuggaccu

SEQ ID NO: 3118077 - RNA, 16 nt, Human
acaccgggcacucaga

SEQ ID NO: 3118078 - RNA, 19 nt, Human
acacccugugauggggccc

SEQ ID NO: 3118079 - RNA, 21 nt, Human
acaccucugcacaagcugcac

SEQ ID NO: 3118080 - RNA, 19 nt, Human
acaccucugcacaagcugc

SEQ ID NO: 3118081 - RNA, 15 nt, Human
acacucaaaagcugg

SEQ ID NO: 3118082 - RNA, 20 nt, Human
acacucacauuuauucugcu

SEQ ID NO: 3118083 - RNA, 21 nt, Human
acacaugagcaucaggccagg

SEQ ID NO: 3118084 - RNA, 13 nt, Human
acacauuuuauuu

SEQ ID NO: 3118085 - RNA, 14 nt, Human
acacauuuuauuuu

SEQ ID NO: 3118086 - RNA, 19 nt, Human
acacauuuuauuuuauuau

SEQ ID NO: 3118087 - RNA, 20 nt, Human
acacauuuuauuuuauuaug

SEQ ID NO: 3118088 - RNA, 18 nt, Human
uaguucagguaacaggca

SEQ ID NO: 3118089 - RNA, 20 nt, Human
uaguuccaccaucaagccac

SEQ ID NO: 3118090 - RNA, 13 nt, Human
acacagugagucg

SEQ ID NO: 3118091 - RNA, 19 nt, Human
acacaguauuacuucugcu

SEQ ID NO: 3118092 - RNA, 18 nt, Human
acacaguauuacuucugc

SEQ ID NO: 3118093 - RNA, 16 nt, Human
acacaguauuacuucu

SEQ ID NO: 3118094 - RNA, 14 nt, Human
acacaccagagccc

SEQ ID NO: 3118095 - RNA, 15 nt, Human
acacaccagagccca

SEQ ID NO: 3118096 - RNA, 20 nt, Human
acacaccagagcccaccuug

SEQ ID NO: 3118097 - RNA, 21 nt, Human
acacacgcgugcacacaccag

SEQ ID NO: 3118098 - RNA, 21 nt, Human
acacacugcauguuugugauu

SEQ ID NO: 3118099 - RNA, 17 nt, Human
acacacagcucuguccu

SEQ ID NO: 3118100 - RNA, 13 nt, Human
acacacagcucug

SEQ ID NO: 3118101 - RNA, 14 nt, Human
acacacagcucugu

SEQ ID NO: 3118102 - RNA, 17 nt, Human
acaaugugaaaagaaaa

SEQ ID NO: 3118103 - RNA, 19 nt, Human
acaaugugaaaagaaaaau

SEQ ID NO: 3118104 - RNA, 14 nt, Human
acacacacauacac

SEQ ID NO: 3118105 - RNA, 21 nt, Human
acaaugcugugcccuaaagug

SEQ ID NO: 3118106 - RNA, 22 nt, Human
acaaugcugugcccuaaagugu

SEQ ID NO: 3118107 - RNA, 23 nt, Human
acaaugcugugcccuaaagugua

SEQ ID NO: 3118108 - RNA, 24 nt, Human
acaaugcugugcccuaaaguguau

SEQ ID NO: 3118109 - RNA, 22 nt, Human
acaaaggaugcccaaagaugca

SEQ ID NO: 3118110 - RNA, 11 nt, Human
acaaaagcaug

SEQ ID NO: 3118111 - RNA, 22 nt, Human
acaaaagcaugugagacugguu

SEQ ID NO: 3118112 - RNA, 19 nt, Human
uagauauaugcucugcaug

SEQ ID NO: 3118113 - RNA, 15 nt, Human
uagauauaugcucug

SEQ ID NO: 3118114 - RNA, 19 nt, Human
acaagaccacguuucuaaa

SEQ ID NO: 3118115 - RNA, 19 nt, Human
acaagacccuugugguccc

SEQ ID NO: 3118116 - RNA, 21 nt, Human
acaacacucauugaccugagg

SEQ ID NO: 3118117 - RNA, 23 nt, Human
acaacacucauugaccugaggcc

SEQ ID NO: 3118118 - RNA, 15 nt, Human
uagccagaggagaga

SEQ ID NO: 3118119 - RNA, 11 nt, Human
uagccagagga

SEQ ID NO: 3118120 - RNA, 16 nt, Human
uagcauuuugcuaaau

SEQ ID NO: 3118121 - RNA, 14 nt, Human
uagccaaggccaaa

SEQ ID NO: 3118122 - RNA, 22 nt, Human
uagcauuuugcuaaaugugaau

SEQ ID NO: 3118123 - RNA, 21 nt, Human
uagccaaggccaaaggaagca

SEQ ID NO: 3118124 - RNA, 19 nt, Human
uagcauggcugccaauggg

SEQ ID NO: 3118125 - RNA, 18 nt, Human
acaagaccacguuucuaa

SEQ ID NO: 3118126 - RNA, 12 nt, Human
acaaugacuuac

SEQ ID NO: 3118127 - RNA, 17 nt, Human
acaaugacuuacuguac

SEQ ID NO: 3118128 - RNA, 18 nt, Human
acaaugacuuacuguaca

SEQ ID NO: 3118129 - RNA, 21 nt, Human
uagggaaggauacaaaagcau

SEQ ID NO: 3118130 - RNA, 14 nt, Human
uaggcauuguggga

SEQ ID NO: 3118131 - RNA, 20 nt, Human
uaggcauuugcugaauacag

SEQ ID NO: 3118132 - RNA, 16 nt, Human
uaggcauuugcugaau

SEQ ID NO: 3118133 - RNA, 23 nt, Human
acaggcugggcuucaguggcagc

SEQ ID NO: 3118134 - RNA, 22 nt, Human
acaggcugggcuucaguggcag

SEQ ID NO: 3118135 - RNA, 12 nt, Human
acagggcacacc

SEQ ID NO: 3118136 - RNA, 13 nt, Human
uauuacuucugcu

SEQ ID NO: 3118137 - RNA, 14 nt, Human
uauuacuucugcua

SEQ ID NO: 3118138 - RNA, 20 nt, Human
uauucaguaauaacucuacc

SEQ ID NO: 3118139 - RNA, 14 nt, Human
uauucaggaagcuc

SEQ ID NO: 3118140 - RNA, 14 nt, Human
acaggcauguucuc

SEQ ID NO: 3118141 - RNA, 14 nt, Human
acaggcagguccag

SEQ ID NO: 3118142 - RNA, 16 nt, Human
acaggcagguccaggg

SEQ ID NO: 3118143 - RNA, 16 nt, Human
acaggagugagcacua

SEQ ID NO: 3118144 - RNA, 14 nt, Human
acaggaucagucug

SEQ ID NO: 3118145 - RNA, 13 nt, Human
acaggcaggucca

SEQ ID NO: 3118146 - RNA, 23 nt, Human
acaggaccagggauuuccaugau

SEQ ID NO: 3118147 - RNA, 13 nt, Human
acaggaaguacug

SEQ ID NO: 3118148 - RNA, 15 nt, Human
acaggaaaagcugcu

SEQ ID NO: 3118149 - RNA, 16 nt, Human
acaggaaaagcugcug

SEQ ID NO: 3118150 - RNA, 17 nt, Human
acaggaaaagcugcuga

SEQ ID NO: 3118151 - RNA, 13 nt, Human
acagcuaacaugg

SEQ ID NO: 3118152 - RNA, 20 nt, Human
uauguggaguucaucuugaa

SEQ ID NO: 3118153 - RNA, 15 nt, Human
acaggcauguucucu

SEQ ID NO: 3118154 - RNA, 18 nt, Human
acaggcauguucucugag

SEQ ID NO: 3118155 - RNA, 19 nt, Human
acaggcauguucucugagg

SEQ ID NO: 3118156 - RNA, 20 nt, Human
acaggcauguucucugagga

SEQ ID NO: 3118157 - RNA, 22 nt, Human
acaggcauguucucugaggaca

SEQ ID NO: 3118158 - RNA, 17 nt, Human
acagaaauguacagcaa

SEQ ID NO: 3118159 - RNA, 14 nt, Human
acagaaauguacag

SEQ ID NO: 3118160 - RNA, 16 nt, Human
acagaaauguacagca

SEQ ID NO: 3118161 - RNA, 17 nt, Human
acagaaaauucuucucc

SEQ ID NO: 3118162 - RNA, 13 nt, Human
acagaaauguaca

SEQ ID NO: 3118163 - RNA, 20 nt, Human
acagaaaauggaagacagcu

SEQ ID NO: 3118164 - RNA, 15 nt, Human
acagacccugcccug

SEQ ID NO: 3118165 - RNA, 14 nt, Human
acagacccugcccu

SEQ ID NO: 3118166 - RNA, 13 nt, Human
acagacccugccc

SEQ ID NO: 3118167 - RNA, 11 nt, Human
acagagaaagu

SEQ ID NO: 3118168 - RNA, 18 nt, Human
acagagaaaguacuucuc

SEQ ID NO: 3118169 - RNA, 13 nt, Human
uaucucccccagc

SEQ ID NO: 3118170 - RNA, 14 nt, Human
uaucucccccagcc

SEQ ID NO: 3118171 - RNA, 11 nt, Human
uaugcauuuga

SEQ ID NO: 3118172 - RNA, 23 nt, Human
uaugcauuugaaaauuuugaugu

SEQ ID NO: 3118173 - RNA, 24 nt, Human
uaugcauuugaaaauuuugauguu

SEQ ID NO: 3118174 - RNA, 17 nt, Human
uaugccugggcagaagg

SEQ ID NO: 3118175 - RNA, 15 nt, Human
uaugcuuauacacuu

SEQ ID NO: 3118176 - RNA, 18 nt, Human
uauggcuuuugugcauua

SEQ ID NO: 3118177 - RNA, 21 nt, Human
uauggcuuuugugcauuaucu

SEQ ID NO: 3118178 - RNA, 17 nt, Human
uauggcuuuugugcauu

SEQ ID NO: 3118179 - RNA, 16 nt, Human
acagcaaggagauuua

SEQ ID NO: 3118180 - RNA, 21 nt, Human
acagcaaggagauuuacaacu

SEQ ID NO: 3118181 - RNA, 17 nt, Human
acagcccgggcucugcc

SEQ ID NO: 3118182 - RNA, 19 nt, Human
acagcccgggcucugccuc

SEQ ID NO: 3118183 - RNA, 18 nt, Human
acagcccgggcucugccu

SEQ ID NO: 3118184 - RNA, 14 nt, Human
acagagcccacgcc

SEQ ID NO: 3118185 - RNA, 15 nt, Human
acagagcccacgccc

SEQ ID NO: 3118186 - RNA, 19 nt, Human
acagagcccacgcccccac

SEQ ID NO: 3118187 - RNA, 18 nt, Human
acagagcccacgccccca

SEQ ID NO: 3118188 - RNA, 17 nt, Human
acagcaaggagauuuac

SEQ ID NO: 3118189 - RNA, 14 nt, Human
guucuuaauucuua

SEQ ID NO: 3118190 - RNA, 17 nt, Human
guucuuaauucuuagcu

SEQ ID NO: 3118191 - RNA, 18 nt, Human
guucucugcccuccaaga

SEQ ID NO: 3118192 - RNA, 17 nt, Human
guucucugcccuccaag

SEQ ID NO: 3118193 - RNA, 13 nt, Human
guucuuaauucuu

SEQ ID NO: 3118194 - RNA, 12 nt, Human
guucucugagga

SEQ ID NO: 3118195 - RNA, 15 nt, Human
guucucucuucucca

SEQ ID NO: 3118196 - RNA, 15 nt, Human
guucucugcccucca

SEQ ID NO: 3118197 - RNA, 13 nt, Human
guucucugcccuc

SEQ ID NO: 3118198 - RNA, 13 nt, Human
guucucuccuucu

SEQ ID NO: 3118199 - RNA, 19 nt, Human
guucuagcauggcugccaa

SEQ ID NO: 3118200 - RNA, 15 nt, Human
guucuugguuuguaa

SEQ ID NO: 3118201 - RNA, 18 nt, Human
guucuugguuuguaaauu

SEQ ID NO: 3118202 - RNA, 14 nt, Human
guucuugguuugua

SEQ ID NO: 3118203 - RNA, 19 nt, Human
guugauagcacagacccug

SEQ ID NO: 3118204 - RNA, 14 nt, Human
guugauagcacaga

SEQ ID NO: 3118205 - RNA, 17 nt, Human
aagcucugcuccucucc

SEQ ID NO: 3118206 - RNA, 22 nt, Human
guucccuuugacgccaucccag

SEQ ID NO: 3118207 - RNA, 22 nt, Human
guucccuuuuuuggcugcugaa

SEQ ID NO: 3118208 - RNA, 21 nt, Human
guucccuuuuuuggcugcuga

SEQ ID NO: 3118209 - RNA, 22 nt, Human
aagcuaggccuggccagaugca

SEQ ID NO: 3118210 - RNA, 16 nt, Human
aagccucccacgacug

SEQ ID NO: 3118211 - RNA, 15 nt, Human
aagccuccuccagcc

SEQ ID NO: 3118212 - RNA, 21 nt, Human
aagccgugauuuucauugcug

SEQ ID NO: 3118213 - RNA, 17 nt, Human
guucagguaacaggcag

SEQ ID NO: 3118214 - RNA, 18 nt, Human
guucagguaacaggcaga

SEQ ID NO: 3118215 - RNA, 20 nt, Human
guucaggguuggccccugcc

SEQ ID NO: 3118216 - RNA, 21 nt, Human
guucaggguuggccccugccc

SEQ ID NO: 3118217 - RNA, 22 nt, Human
guucaggguuggccccugcccg

SEQ ID NO: 3118218 - RNA, 23 nt, Human
guucagcuuguaaauagcucagg

SEQ ID NO: 3118219 - RNA, 19 nt, Human
guuagagguucccuuugac

SEQ ID NO: 3118220 - RNA, 17 nt, Human
aagccaaagcuaggccu

SEQ ID NO: 3118221 - RNA, 18 nt, Human
aagccaaagcuaggccug

SEQ ID NO: 3118222 - RNA, 12 nt, Human
aagcaugugaga

SEQ ID NO: 3118223 - RNA, 14 nt, Human
aagcacaugccucu

SEQ ID NO: 3118224 - RNA, 20 nt, Human
aagcacaugccucucucagg

SEQ ID NO: 3118225 - RNA, 19 nt, Human
aagcacaugccucucucag

SEQ ID NO: 3118226 - RNA, 16 nt, Human
aagcacaugccucucu

SEQ ID NO: 3118227 - RNA, 15 nt, Human
aagcacaugccucuc

SEQ ID NO: 3118228 - RNA, 16 nt, Human
aagcacacuugacauc

SEQ ID NO: 3118229 - RNA, 21 nt, Human
aagcacaugccucucucaggc

SEQ ID NO: 3118230 - RNA, 13 nt, Human
aagcaccuccugc

SEQ ID NO: 3118231 - RNA, 14 nt, Human
aagcaccuccugcc

SEQ ID NO: 3118232 - RNA, 15 nt, Human
aagcaccuccugccu

SEQ ID NO: 3118233 - RNA, 16 nt, Human
aagcaccuccugccuc

SEQ ID NO: 3118234 - RNA, 17 nt, Human
aagcaccuccugccucg

SEQ ID NO: 3118235 - RNA, 22 nt, Human
gugucaccugaagacucauucu

SEQ ID NO: 3118236 - RNA, 14 nt, Human
gugucagguggggc

SEQ ID NO: 3118237 - RNA, 18 nt, Human
gugucagguggggcagcu

SEQ ID NO: 3118238 - RNA, 14 nt, Human
gugucaccugaaga

SEQ ID NO: 3118239 - RNA, 23 nt, Human
gugugaaccaccacacccagccc

SEQ ID NO: 3118240 - RNA, 19 nt, Human
gugucagguggggcagcuu

SEQ ID NO: 3118241 - RNA, 23 nt, Human
aagaucaaaagguuaauaaagua

SEQ ID NO: 3118242 - RNA, 20 nt, Human
aagaucaaaagguuaauaaa

SEQ ID NO: 3118243 - RNA, 23 nt, Human
gugcugcccugcccaccuggccu

SEQ ID NO: 3118244 - RNA, 15 nt, Human
gugguuucagaaaug

SEQ ID NO: 3118245 - RNA, 14 nt, Human
aagaggcagggucu

SEQ ID NO: 3118246 - RNA, 11 nt, Human
aagaggcaggg

SEQ ID NO: 3118247 - RNA, 22 nt, Human
aagagggagggagggcuccaga

SEQ ID NO: 3118248 - RNA, 21 nt, Human
aagagggagggagggcuccag

SEQ ID NO: 3118249 - RNA, 22 nt, Human
aagagggucugaggaauccaga

SEQ ID NO: 3118250 - RNA, 23 nt, Human
aagugauccucccaccucagccu

SEQ ID NO: 3118251 - RNA, 20 nt, Human
aagugauucuccugccucag

SEQ ID NO: 3118252 - RNA, 13 nt, Human
aagugauccuccc

SEQ ID NO: 3118253 - RNA, 19 nt, Human
aagugauccucccaccuca

SEQ ID NO: 3118254 - RNA, 20 nt, Human
aagugauccucccaccucag

SEQ ID NO: 3118255 - RNA, 13 nt, Human
uaaaagucuugug

SEQ ID NO: 3118256 - RNA, 19 nt, Human
uaaaaggugaccaaugaug

SEQ ID NO: 3118257 - RNA, 13 nt, Human
uaaaacccaagug

SEQ ID NO: 3118258 - RNA, 12 nt, Human
uaaaacuuuuua

SEQ ID NO: 3118259 - RNA, 15 nt, Human
uaaaacuuuuuaaaa

SEQ ID NO: 3118260 - RNA, 22 nt, Human
uaaaaaugagguacucuccugg

SEQ ID NO: 3118261 - RNA, 15 nt, Human
uaaaaaugagguacu

SEQ ID NO: 3118262 - RNA, 23 nt, Human
uaaaaaucucaaauuucuaaauc

SEQ ID NO: 3118263 - RNA, 23 nt, Human
aaguguauuuuuuuacuaauaga

SEQ ID NO: 3118264 - RNA, 13 nt, Human
aagugugguagag

SEQ ID NO: 3118265 - RNA, 21 nt, Human
aaguuucugccgcagcccugc

SEQ ID NO: 3118266 - RNA, 19 nt, Human
aaguuucugccgcagcccu

SEQ ID NO: 3118267 - RNA, 20 nt, Human
aaguuugagaucagccuggg

SEQ ID NO: 3118268 - RNA, 14 nt, Human
aaguacuauaauuu

SEQ ID NO: 3118269 - RNA, 17 nt, Human
aaguacuauaauuuacc

SEQ ID NO: 3118270 - RNA, 13 nt, Human
aaguacuauguau

SEQ ID NO: 3118271 - RNA, 19 nt, Human
aaguacuucuccacccugc

SEQ ID NO: 3118272 - RNA, 18 nt, Human
aaguacuucuccacccug

SEQ ID NO: 3118273 - RNA, 15 nt, Human
aaguauuauaccuuu

SEQ ID NO: 3118274 - RNA, 23 nt, Human
aaguauucuuauuuaaugaaaga

SEQ ID NO: 3118275 - RNA, 21 nt, Human
aaguauucuuauuuaaugaaa

SEQ ID NO: 3118276 - RNA, 19 nt, Human
aaguauucuuauuuaauga

SEQ ID NO: 3118277 - RNA, 16 nt, Human
aaguauuauaccuuuu

SEQ ID NO: 3118278 - RNA, 19 nt, Human
aaguauuauaccuuuuuua

SEQ ID NO: 3118279 - RNA, 12 nt, Human
guuuucuguucu

SEQ ID NO: 3118280 - RNA, 14 nt, Human
guuuucuguucuuu

SEQ ID NO: 3118281 - RNA, 15 nt, Human
guuuucuguucuuuc

SEQ ID NO: 3118282 - RNA, 16 nt, Human
guuuucuguucuuucu

SEQ ID NO: 3118283 - RNA, 18 nt, Human
guuuuaaggaugcuugua

SEQ ID NO: 3118284 - RNA, 22 nt, Human
guuuuaaggaugcuuguacaua

SEQ ID NO: 3118285 - RNA, 21 nt, Human
aaguaauaugcacacauuuuu

SEQ ID NO: 3118286 - RNA, 18 nt, Human
aaguaauaugcacacauu

SEQ ID NO: 3118287 - RNA, 20 nt, Human
aaguaauaugcacacauuuu

SEQ ID NO: 3118288 - RNA, 17 nt, Human
aaguaauaugcacacau

SEQ ID NO: 3118289 - RNA, 16 nt, Human
aaggaaacccagcucu

SEQ ID NO: 3118290 - RNA, 20 nt, Human
guuguuugauucagacagcu

SEQ ID NO: 3118291 - RNA, 23 nt, Human
guuguuugauucagacagcugcc

SEQ ID NO: 3118292 - RNA, 22 nt, Human
aaggaaacccagcucuggucca

SEQ ID NO: 3118293 - RNA, 17 nt, Human
aaggaaacccagcucug

SEQ ID NO: 3118294 - RNA, 21 nt, Human
guuuaagugacugauggcuaa

SEQ ID NO: 3118295 - RNA, 17 nt, Human
guuucaaacuuuacuau

SEQ ID NO: 3118296 - RNA, 20 nt, Human
aaggcugucaauuacaggaa

SEQ ID NO: 3118297 - RNA, 22 nt, Human
aaggcugggggaagaagcucuc

SEQ ID NO: 3118298 - RNA, 19 nt, Human
aaggcugggggaagaagcu

SEQ ID NO: 3118299 - RNA, 11 nt, Human
guuucagaaau

SEQ ID NO: 3118300 - RNA, 13 nt, Human
guuucagaaaugu

SEQ ID NO: 3118301 - RNA, 14 nt, Human
aaggcugggggaag

SEQ ID NO: 3118302 - RNA, 16 nt, Human
aaggcugggggaagaa

SEQ ID NO: 3118303 - RNA, 13 nt, Human
aaggggagaguaa

SEQ ID NO: 3118304 - RNA, 23 nt, Human
aagggggcugggacaugggaaag

SEQ ID NO: 3118305 - RNA, 12 nt, Human
aagggggcuggg

SEQ ID NO: 3118306 - RNA, 15 nt, Human
aagaaaauaguggug

SEQ ID NO: 3118307 - RNA, 21 nt, Human
aagaaaauaguggugugauuu

SEQ ID NO: 3118308 - RNA, 22 nt, Human
aagaaaauaguggugugauuug

SEQ ID NO: 3118309 - RNA, 21 nt, Human
aacuuuaccuuuuuuauacau

SEQ ID NO: 3118310 - RNA, 22 nt, Human
aacuuuaccuuuuuuauacaua

SEQ ID NO: 3118311 - RNA, 23 nt, Human
aacuuuaccuuuuuuauacauaa

SEQ ID NO: 3118312 - RNA, 19 nt, Human
aagaaaaaauauuuucccu

SEQ ID NO: 3118313 - RNA, 13 nt, Human
aagaaaaagaaaa

SEQ ID NO: 3118314 - RNA, 17 nt, Human
aagaaaaaugagccugg

SEQ ID NO: 3118315 - RNA, 18 nt, Human
aagaaaaaugagccuggc

SEQ ID NO: 3118316 - RNA, 18 nt, Human
gugcuaucucccccagcc

SEQ ID NO: 3118317 - RNA, 15 nt, Human
gugcuaucuccccca

SEQ ID NO: 3118318 - RNA, 15 nt, Human
gugcugcccugccca

SEQ ID NO: 3118319 - RNA, 14 nt, Human
gugcugcccugccc

SEQ ID NO: 3118320 - RNA, 13 nt, Human
gugcugcccugcc

SEQ ID NO: 3118321 - RNA, 12 nt, Human
gugcugcccugc

SEQ ID NO: 3118322 - RNA, 13 nt, Human
gugcucuggacag

SEQ ID NO: 3118323 - RNA, 14 nt, Human
gugcucuggacagg

SEQ ID NO: 3118324 - RNA, 16 nt, Human
gugcucugaucaucca

SEQ ID NO: 3118325 - RNA, 21 nt, Human
gugcacaugcacgugugugca

SEQ ID NO: 3118326 - RNA, 21 nt, Human
gugcacaagcuccaagcuccc

SEQ ID NO: 3118327 - RNA, 16 nt, Human
gugcacaagcuccaag

SEQ ID NO: 3118328 - RNA, 13 nt, Human
gugcacaagcucc

SEQ ID NO: 3118329 - RNA, 18 nt, Human
gugcaaugaccuuucaau

SEQ ID NO: 3118330 - RNA, 23 nt, Human
gugccaaaaacaacaacaaaaug

SEQ ID NO: 3118331 - RNA, 21 nt, Human
gugcauuuggugguuucagaa

SEQ ID NO: 3118332 - RNA, 17 nt, Human
gugcauuugaggucugu

SEQ ID NO: 3118333 - RNA, 19 nt, Human
gugcauuugaggucuguuc

SEQ ID NO: 3118334 - RNA, 23 nt, Human
gugauccucccaccucagccucc

SEQ ID NO: 3118335 - RNA, 14 nt, Human
aacuucacauauug

SEQ ID NO: 3118336 - RNA, 13 nt, Human
aacuucacauauu

SEQ ID NO: 3118337 - RNA, 22 nt, Human
aacuucacauauugauuuccgu

SEQ ID NO: 3118338 - RNA, 22 nt, Human
aacuucaccauauuaccacaga

SEQ ID NO: 3118339 - RNA, 16 nt, Human
aacugcauuggcuuug

SEQ ID NO: 3118340 - RNA, 23 nt, Human
aacugauuuuuuuuuccuucagu

SEQ ID NO: 3118341 - RNA, 22 nt, Human
aacugauuuuuuuuuccuucag

SEQ ID NO: 3118342 - RNA, 21 nt, Human
aacugauuuuuuuuuccuuca

SEQ ID NO: 3118343 - RNA, 20 nt, Human
aacugauuuuuuuuuccuuc

SEQ ID NO: 3118344 - RNA, 23 nt, Human
aacucuccucugcugcuggcugg

SEQ ID NO: 3118345 - RNA, 22 nt, Human
aacucuccucugcugcuggcug

SEQ ID NO: 3118346 - RNA, 18 nt, Human
gugaggcucugcccuugg

SEQ ID NO: 3118347 - RNA, 17 nt, Human
gugagucaccaagccca

SEQ ID NO: 3118348 - RNA, 23 nt, Human
gugaguacuacaguccucccauc

SEQ ID NO: 3118349 - RNA, 19 nt, Human
gugagucaccaagcccagu

SEQ ID NO: 3118350 - RNA, 17 nt, Human
aacucuccucugcugcu

SEQ ID NO: 3118351 - RNA, 21 nt, Human
gugaguacuacaguccuccca

SEQ ID NO: 3118352 - RNA, 21 nt, Human
aacucuccucugcugcuggcu

SEQ ID NO: 3118353 - RNA, 19 nt, Human
aacucuccucugcugcugg

SEQ ID NO: 3118354 - RNA, 18 nt, Human
gugagacucugucucaaa

SEQ ID NO: 3118355 - RNA, 13 nt, Human
gugaggcucugcc

SEQ ID NO: 3118356 - RNA, 12 nt, Human
gugaggcucugc

SEQ ID NO: 3118357 - RNA, 17 nt, Human
gugaggcucugcccuug

SEQ ID NO: 3118358 - RNA, 16 nt, Human
gugaggcucugcccuu

SEQ ID NO: 3118359 - RNA, 15 nt, Human
gugaggcucugcccu

SEQ ID NO: 3118360 - RNA, 14 nt, Human
gugaggcucugccc

SEQ ID NO: 3118361 - RNA, 22 nt, Human
gugagacccugucucaaaaaaa

SEQ ID NO: 3118362 - RNA, 14 nt, Human
gugagacucugucu

SEQ ID NO: 3118363 - RNA, 16 nt, Human
gugagacucugucuca

SEQ ID NO: 3118364 - RNA, 19 nt, Human
gugacaugucuuuucuugc

SEQ ID NO: 3118365 - RNA, 14 nt, Human
gugacaugucuuuu

SEQ ID NO: 3118366 - RNA, 23 nt, Human
gugacagaggcagccccauucug

SEQ ID NO: 3118367 - RNA, 20 nt, Human
gugacagagugagacucugu

SEQ ID NO: 3118368 - RNA, 22 nt, Human
gugacagagugagacucugucu

SEQ ID NO: 3118369 - RNA, 23 nt, Human
gugaauaauacaguaucucaggg

SEQ ID NO: 3118370 - RNA, 14 nt, Human
gucucaaaaaaaca

SEQ ID NO: 3118371 - RNA, 17 nt, Human
gucucaaaaaaagaaaa

SEQ ID NO: 3118372 - RNA, 23 nt, Human
gucucuuuaaugucacaggcagg

SEQ ID NO: 3118373 - RNA, 20 nt, Human
gucugacaggcaaugcuggc

SEQ ID NO: 3118374 - RNA, 15 nt, Human
gucugacaggcaaug

SEQ ID NO: 3118375 - RNA, 18 nt, Human
gucugacaggcaaugcug

SEQ ID NO: 3118376 - RNA, 12 nt, Human
gucugacaggca

SEQ ID NO: 3118377 - RNA, 13 nt, Human
gucugacaggcaa

SEQ ID NO: 3118378 - RNA, 14 nt, Human
gucugacaggcaau

SEQ ID NO: 3118379 - RNA, 15 nt, Human
gucuggaaugcagug

SEQ ID NO: 3118380 - RNA, 16 nt, Human
gucuggaaugcagugg

SEQ ID NO: 3118381 - RNA, 13 nt, Human
aacgucugugcca

SEQ ID NO: 3118382 - RNA, 13 nt, Human
aacguggcugcuu

SEQ ID NO: 3118383 - RNA, 12 nt, Human
aacguggcugcu

SEQ ID NO: 3118384 - RNA, 17 nt, Human
aacuagggaagauaaua

SEQ ID NO: 3118385 - RNA, 19 nt, Human
gucccuuacgugaguccug

SEQ ID NO: 3118386 - RNA, 18 nt, Human
gucccuuacgugaguccu

SEQ ID NO: 3118387 - RNA, 18 nt, Human
gucccugguggcagcuca

SEQ ID NO: 3118388 - RNA, 19 nt, Human
gucccugguggcagcucac

SEQ ID NO: 3118389 - RNA, 18 nt, Human
guccccuguuuguuucug

SEQ ID NO: 3118390 - RNA, 22 nt, Human
guccccuguuuguuucugaaag

SEQ ID NO: 3118391 - RNA, 15 nt, Human
gucccaccccacaca

SEQ ID NO: 3118392 - RNA, 17 nt, Human
guccccaccgcagacag

SEQ ID NO: 3118393 - RNA, 18 nt, Human
guccccaccgcagacagg

SEQ ID NO: 3118394 - RNA, 22 nt, Human
guccccaccgcagacaggacca

SEQ ID NO: 3118395 - RNA, 19 nt, Human
aacacaaacgggcucagca

SEQ ID NO: 3118396 - RNA, 19 nt, Human
aaauuucuaaaucuccaaa

SEQ ID NO: 3118397 - RNA, 16 nt, Human
aacacuguucucugcc

SEQ ID NO: 3118398 - RNA, 18 nt, Human
aacacuguucucugcccu

SEQ ID NO: 3118399 - RNA, 17 nt, Human
aacacuguucucugccc

SEQ ID NO: 3118400 - RNA, 17 nt, Human
gucauuugagcagggcu

SEQ ID NO: 3118401 - RNA, 19 nt, Human
aacacuguucucugcccuc

SEQ ID NO: 3118402 - RNA, 21 nt, Human
aacacucacauuuauucugcu

SEQ ID NO: 3118403 - RNA, 23 nt, Human
aacauguaauuaaguacuaugua

SEQ ID NO: 3118404 - RNA, 14 nt, Human
guccucuuuucuga

SEQ ID NO: 3118405 - RNA, 16 nt, Human
guccuggcaugggaau

SEQ ID NO: 3118406 - RNA, 17 nt, Human
guccugcugcaguugcc

SEQ ID NO: 3118407 - RNA, 19 nt, Human
guccugcugcaguugccag

SEQ ID NO: 3118408 - RNA, 12 nt, Human
gucgaggcagga

SEQ ID NO: 3118409 - RNA, 16 nt, Human
gucgaggacagggagg

SEQ ID NO: 3118410 - RNA, 15 nt, Human
gucuaugggacucaa

SEQ ID NO: 3118411 - RNA, 22 nt, Human
gucuaugggacucaaugcacug

SEQ ID NO: 3118412 - RNA, 16 nt, Human
gucuaccugaggggcc

SEQ ID NO: 3118413 - RNA, 15 nt, Human
gucuaccugaggggc

SEQ ID NO: 3118414 - RNA, 13 nt, Human
gucuaccugaggg

SEQ ID NO: 3118415 - RNA, 14 nt, Human
gucuaccugagggg

SEQ ID NO: 3118416 - RNA, 21 nt, Human
gucagaaguuucugccgcagc

SEQ ID NO: 3118417 - RNA, 15 nt, Human
gucacugcuuaacuu

SEQ ID NO: 3118418 - RNA, 21 nt, Human
gucacugcuuaacuucacaua

SEQ ID NO: 3118419 - RNA, 16 nt, Human
gucagguggggcagcu

SEQ ID NO: 3118420 - RNA, 17 nt, Human
gucagguggggcagcuu

SEQ ID NO: 3118421 - RNA, 18 nt, Human
gucagguggggcagcuug

SEQ ID NO: 3118422 - RNA, 22 nt, Human
gucagguggggcagcuugaggg

SEQ ID NO: 3118423 - RNA, 12 nt, Human
aaauuucuaaau

SEQ ID NO: 3118424 - RNA, 13 nt, Human
aaauuucuaaauc

SEQ ID NO: 3118425 - RNA, 15 nt, Human
aaauuucuaaaucuc

SEQ ID NO: 3118426 - RNA, 22 nt, Human
gucaccaaaucagcugcuacua

SEQ ID NO: 3118427 - RNA, 22 nt, Human
gucaauuacaggaaguacugga

SEQ ID NO: 3118428 - RNA, 12 nt, Human
gucaccaagccc

SEQ ID NO: 3118429 - RNA, 15 nt, Human
gucaccaagcccagu

SEQ ID NO: 3118430 - RNA, 23 nt, Human
gucacucuggcagcucagagagg

SEQ ID NO: 3118431 - RNA, 16 nt, Human
gucacugagacagccc

SEQ ID NO: 3118432 - RNA, 15 nt, Human
gucacugagacagcc

SEQ ID NO: 3118433 - RNA, 14 nt, Human
gucacugagacagc

SEQ ID NO: 3118434 - RNA, 22 nt, Human
gucacucuggcagcucagagag

SEQ ID NO: 3118435 - RNA, 23 nt, Human
gucacugagacagcccgggcucu

SEQ ID NO: 3118436 - RNA, 21 nt, Human
gucacugagacagcccgggcu

SEQ ID NO: 3118437 - RNA, 18 nt, Human
gucacugagacagcccgg

SEQ ID NO: 3118438 - RNA, 17 nt, Human
gucacugagacagcccg

SEQ ID NO: 3118439 - RNA, 10 nt, Human
gucacugcuu

SEQ ID NO: 3118440 - RNA, 24 nt, Human
aaaugucuaguuguaacaccauga

SEQ ID NO: 3118441 - RNA, 21 nt, Human
aaaugucucuuuaaugucaca

SEQ ID NO: 3118442 - RNA, 18 nt, Human
guauucucuccuguaccu

SEQ ID NO: 3118443 - RNA, 14 nt, Human
cacaguucucuccu

SEQ ID NO: 3118444 - RNA, 15 nt, Human
cacaguucucuccuu

SEQ ID NO: 3118445 - RNA, 22 nt, Human
cacagugagucgaggacaggga

SEQ ID NO: 3118446 - RNA, 21 nt, Human
cacagugagucgaggacaggg

SEQ ID NO: 3118447 - RNA, 22 nt, Human
cacaguccuuaccagcagagca

SEQ ID NO: 3118448 - RNA, 21 nt, Human
cacaguccuuaccagcagagc

SEQ ID NO: 3118449 - RNA, 15 nt, Human
cacaguccuuaccag

SEQ ID NO: 3118450 - RNA, 13 nt, Human
cacaguccuuacc

SEQ ID NO: 3118451 - RNA, 11 nt, Human
cacaggcaggu

SEQ ID NO: 3118452 - RNA, 14 nt, Human
cacaggcaggucca

SEQ ID NO: 3118453 - RNA, 15 nt, Human
cacaggcagguccag

SEQ ID NO: 3118454 - RNA, 23 nt, Human
cacagcugggguggggaccucag

SEQ ID NO: 3118455 - RNA, 22 nt, Human
cacagcugggguggggaccuca

SEQ ID NO: 3118456 - RNA, 21 nt, Human
cacagcuucauuuccuguguc

SEQ ID NO: 3118457 - RNA, 22 nt, Human
cacagcuucauuuccugugucu

SEQ ID NO: 3118458 - RNA, 14 nt, Human
cacauaucugucau

SEQ ID NO: 3118459 - RNA, 21 nt, Human
caaggcugucaauuacaggaa

SEQ ID NO: 3118460 - RNA, 23 nt, Human
caaggcugucaauuacaggaagu

SEQ ID NO: 3118461 - RNA, 12 nt, Human
caaggcugcagu

SEQ ID NO: 3118462 - RNA, 18 nt, Human
caaggggcccaaauucuu

SEQ ID NO: 3118463 - RNA, 17 nt, Human
caaggggcccaaauucu

SEQ ID NO: 3118464 - RNA, 13 nt, Human
caaggucauuuuu

SEQ ID NO: 3118465 - RNA, 14 nt, Human
caaggucauuuuuu

SEQ ID NO: 3118466 - RNA, 20 nt, Human
caaggucauuuuuuuuaaga

SEQ ID NO: 3118467 - RNA, 14 nt, Human
caaguccucuuuuc

SEQ ID NO: 3118468 - RNA, 14 nt, Human
caaguuaaauaaau

SEQ ID NO: 3118469 - RNA, 18 nt, Human
caagugagagcugggugu

SEQ ID NO: 3118470 - RNA, 19 nt, Human
caagugagacccugucuca

SEQ ID NO: 3118471 - RNA, 21 nt, Human
caaguccucuuuucugagagg

SEQ ID NO: 3118472 - RNA, 14 nt, Human
caagugagagcugg

SEQ ID NO: 3118473 - RNA, 15 nt, Human
caagugagagcuggg

SEQ ID NO: 3118474 - RNA, 17 nt, Human
caagugagagcugggug

SEQ ID NO: 3118475 - RNA, 20 nt, Human
caagcgauucuucugcuuca

SEQ ID NO: 3118476 - RNA, 22 nt, Human
caagcgauucuucugcuucagc

SEQ ID NO: 3118477 - RNA, 19 nt, Human
caagcgauucuucugcuuc

SEQ ID NO: 3118478 - RNA, 18 nt, Human
caagcaggacauggacaa

SEQ ID NO: 3118479 - RNA, 14 nt, Human
caagcaggacaugg

SEQ ID NO: 3118480 - RNA, 14 nt, Human
caagcaccuccugc

SEQ ID NO: 3118481 - RNA, 22 nt, Human
caagccaccaacauacucccau

SEQ ID NO: 3118482 - RNA, 17 nt, Human
caagcuggucccacuca

SEQ ID NO: 3118483 - RNA, 19 nt, Human
caagcuggucccacucagu

SEQ ID NO: 3118484 - RNA, 14 nt, Human
caacgucugugcca

SEQ ID NO: 3118485 - RNA, 13 nt, Human
caacgucugugcc

SEQ ID NO: 3118486 - RNA, 15 nt, Human
caaccuccugggcua

SEQ ID NO: 3118487 - RNA, 14 nt, Human
caaccuccugggcu

SEQ ID NO: 3118488 - RNA, 22 nt, Human
caacacucacauuuauucugcu

SEQ ID NO: 3118489 - RNA, 18 nt, Human
caacacucauugaccuga

SEQ ID NO: 3118490 - RNA, 22 nt, Human
caacacucauugaccugaggcc

SEQ ID NO: 3118491 - RNA, 20 nt, Human
caacacucauugaccugagg

SEQ ID NO: 3118492 - RNA, 22 nt, Human
caaccccuucgcuccugugucu

SEQ ID NO: 3118493 - RNA, 20 nt, Human
caagaacuuuccaggaaggc

SEQ ID NO: 3118494 - RNA, 16 nt, Human
caagaccuucuccuuc

SEQ ID NO: 3118495 - RNA, 14 nt, Human
caagaccuucuccu

SEQ ID NO: 3118496 - RNA, 17 nt, Human
caagacgcugugcugcc

SEQ ID NO: 3118497 - RNA, 16 nt, Human
caagacgcugugcugc

SEQ ID NO: 3118498 - RNA, 18 nt, Human
caagaccuucuccuucac

SEQ ID NO: 3118499 - RNA, 17 nt, Human
caagaccuucuccuuca

SEQ ID NO: 3118500 - RNA, 18 nt, Human
caagacgcugugcugccc

SEQ ID NO: 3118501 - RNA, 15 nt, Human
caagacgcugugcug

SEQ ID NO: 3118502 - RNA, 23 nt, Human
caagacgcugugcugcccugccc

SEQ ID NO: 3118503 - RNA, 15 nt, Human
caagagcccaggccu

SEQ ID NO: 3118504 - RNA, 14 nt, Human
caagagcccaggcc

SEQ ID NO: 3118505 - RNA, 13 nt, Human
caagagcccaggc

SEQ ID NO: 3118506 - RNA, 18 nt, Human
caagacucuuuggacacu

SEQ ID NO: 3118507 - RNA, 15 nt, Human
caagcaccuccugcc

SEQ ID NO: 3118508 - RNA, 16 nt, Human
caagcaccuccugccu

SEQ ID NO: 3118509 - RNA, 17 nt, Human
caagcaccuccugccuc

SEQ ID NO: 3118510 - RNA, 16 nt, Human
caagagcccaggccuc

SEQ ID NO: 3118511 - RNA, 13 nt, Human
caauaggaaaaac

SEQ ID NO: 3118512 - RNA, 12 nt, Human
caauaggaaaaa

SEQ ID NO: 3118513 - RNA, 23 nt, Human
caaugaccuuucaauaggaaaaa

SEQ ID NO: 3118514 - RNA, 17 nt, Human
caaugacuuacuguaca

SEQ ID NO: 3118515 - RNA, 18 nt, Human
caaugacuuacuguacau

SEQ ID NO: 3118516 - RNA, 15 nt, Human
caaugacuuacugua

SEQ ID NO: 3118517 - RNA, 21 nt, Human
caaugaccuuucaauaggaaa

SEQ ID NO: 3118518 - RNA, 17 nt, Human
caauauucgcuguguca

SEQ ID NO: 3118519 - RNA, 23 nt, Human
caauucucauuugucacacacuu

SEQ ID NO: 3118520 - RNA, 16 nt, Human
caauuacaggaaguac

SEQ ID NO: 3118521 - RNA, 17 nt, Human
caaugugauaaaacccc

SEQ ID NO: 3118522 - RNA, 15 nt, Human
caaugugauaaaacc

SEQ ID NO: 3118523 - RNA, 17 nt, Human
caaugcacuuuguucug

SEQ ID NO: 3118524 - RNA, 21 nt, Human
caaugcacuuuguucuggcuc

SEQ ID NO: 3118525 - RNA, 20 nt, Human
caaugcacuuuguucuggcu

SEQ ID NO: 3118526 - RNA, 13 nt, Human
caaaaaggcagga

SEQ ID NO: 3118527 - RNA, 22 nt, Human
auuuugggguacccacugcucu

SEQ ID NO: 3118528 - RNA, 23 nt, Human
auuuugggguacccacugcucug

SEQ ID NO: 3118529 - RNA, 16 nt, Human
caaaaaaugcuugcuu

SEQ ID NO: 3118530 - RNA, 21 nt, Human
auuuugggguacccacugcuc

SEQ ID NO: 3118531 - RNA, 22 nt, Human
caaaacucuccucugcugcugg

SEQ ID NO: 3118532 - RNA, 21 nt, Human
caaaacucuccucugcugcug

SEQ ID NO: 3118533 - RNA, 20 nt, Human
caaaacucuccucugcugcu

SEQ ID NO: 3118534 - RNA, 17 nt, Human
caaaauaaaaaugaggu

SEQ ID NO: 3118535 - RNA, 19 nt, Human
caaaacucuccucugcugc

SEQ ID NO: 3118536 - RNA, 23 nt, Human
caaagugcugggauuacaggugu

SEQ ID NO: 3118537 - RNA, 19 nt, Human
caaagugcugggauuacag

SEQ ID NO: 3118538 - RNA, 19 nt, Human
caaaggguaucaggugcug

SEQ ID NO: 3118539 - RNA, 11 nt, Human
caaauuucuaa

SEQ ID NO: 3118540 - RNA, 12 nt, Human
caaauuucuaaa

SEQ ID NO: 3118541 - RNA, 14 nt, Human
caaauuucuaaauc

SEQ ID NO: 3118542 - RNA, 20 nt, Human
caaacccuucagugccaaaa

SEQ ID NO: 3118543 - RNA, 14 nt, Human
caaacccuucagug

SEQ ID NO: 3118544 - RNA, 15 nt, Human
caaacacauacagga

SEQ ID NO: 3118545 - RNA, 12 nt, Human
caaaauaaaacu

SEQ ID NO: 3118546 - RNA, 15 nt, Human
caaaauguaggguua

SEQ ID NO: 3118547 - RNA, 14 nt, Human
caaaggaagcacau

SEQ ID NO: 3118548 - RNA, 16 nt, Human
caaaggguaucaggug

SEQ ID NO: 3118549 - RNA, 18 nt, Human
caaaggguaucaggugcu

SEQ ID NO: 3118550 - RNA, 13 nt, Human
caaagcuaggccu

SEQ ID NO: 3118551 - RNA, 14 nt, Human
caaagcuaggccug

SEQ ID NO: 3118552 - RNA, 19 nt, Human
caaagcuaggccuggccag

SEQ ID NO: 3118553 - RNA, 18 nt, Human
caaagcuaggccuggcca

SEQ ID NO: 3118554 - RNA, 13 nt, Human
caaaggaagcaca

SEQ ID NO: 3118555 - RNA, 12 nt, Human
caaaggaagcac

SEQ ID NO: 3118556 - RNA, 17 nt, Human
caaacucaccugccccu

SEQ ID NO: 3118557 - RNA, 22 nt, Human
caaagccaaagcuaggccuggc

SEQ ID NO: 3118558 - RNA, 18 nt, Human
caaagccuccuccagccg

SEQ ID NO: 3118559 - RNA, 17 nt, Human
caaagccuccuccagcc

SEQ ID NO: 3118560 - RNA, 22 nt, Human
uauuggaaauuuguuauaauga

SEQ ID NO: 3118561 - RNA, 17 nt, Human
uauugcugauggugcaa

SEQ ID NO: 3118562 - RNA, 17 nt, Human
uauucucuccuguaccu

SEQ ID NO: 3118563 - RNA, 21 nt, Human
uauugauaugcuuauacacuu

SEQ ID NO: 3118564 - RNA, 12 nt, Human
uauuguuuucag

SEQ ID NO: 3118565 - RNA, 22 nt, Human
uauuguuuucaguguacaugga

SEQ ID NO: 3118566 - RNA, 18 nt, Human
uauuguuuucaguguaca

SEQ ID NO: 3118567 - RNA, 20 nt, Human
uauuguuuucaguguacaug

SEQ ID NO: 3118568 - RNA, 15 nt, Human
gggaguggccacaga

SEQ ID NO: 3118569 - RNA, 13 nt, Human
gggaguggccaca

SEQ ID NO: 3118570 - RNA, 16 nt, Human
uauguugcccaggcag

SEQ ID NO: 3118571 - RNA, 19 nt, Human
uauguugcccaggcagguc

SEQ ID NO: 3118572 - RNA, 13 nt, Human
uauguugcccagg

SEQ ID NO: 3118573 - RNA, 20 nt, Human
uauguugcccaggcaggucu

SEQ ID NO: 3118574 - RNA, 24 nt, Human
uauuaagaaagacuaucuaaaugu

SEQ ID NO: 3118575 - RNA, 12 nt, Human
uauuaaauuaug

SEQ ID NO: 3118576 - RNA, 18 nt, Human
ucaagugauucuccugcc

SEQ ID NO: 3118577 - RNA, 20 nt, Human
ucaagugauucuccugccuc

SEQ ID NO: 3118578 - RNA, 23 nt, Human
ucaauuacaggaaguacuggaga

SEQ ID NO: 3118579 - RNA, 21 nt, Human
ucaauuacaggaaguacugga

SEQ ID NO: 3118580 - RNA, 18 nt, Human
ucacauuuauucugcuca

SEQ ID NO: 3118581 - RNA, 19 nt, Human
ucacauuuauucugcucac

SEQ ID NO: 3118582 - RNA, 17 nt, Human
ucacauuuauucugcuc

SEQ ID NO: 3118583 - RNA, 19 nt, Human
ucaccaaaucagcugcuac

SEQ ID NO: 3118584 - RNA, 20 nt, Human
ucaccaaaucagcugcuacu

SEQ ID NO: 3118585 - RNA, 16 nt, Human
ucacaggcagguccag

SEQ ID NO: 3118586 - RNA, 17 nt, Human
ucacaggcagguccagg

SEQ ID NO: 3118587 - RNA, 18 nt, Human
ucacaggcagguccaggg

SEQ ID NO: 3118588 - RNA, 19 nt, Human
ucacaguccuuaccagcag

SEQ ID NO: 3118589 - RNA, 23 nt, Human
ucacaguccuuaccagcagagca

SEQ ID NO: 3118590 - RNA, 22 nt, Human
ucacaguccuuaccagcagagc

SEQ ID NO: 3118591 - RNA, 20 nt, Human
ucaauuacaggaaguacugg

SEQ ID NO: 3118592 - RNA, 23 nt, Human
ucaaccccuucgcuccugugucu

SEQ ID NO: 3118593 - RNA, 14 nt, Human
uauuuuauuaugca

SEQ ID NO: 3118594 - RNA, 17 nt, Human
uauuuuauuaugcauga

SEQ ID NO: 3118595 - RNA, 22 nt, Human
uauuuucccuauuagagaagag

SEQ ID NO: 3118596 - RNA, 15 nt, Human
ucaaaaaaagaaaaa

SEQ ID NO: 3118597 - RNA, 14 nt, Human
ucaaaaaaagaaaa

SEQ ID NO: 3118598 - RNA, 17 nt, Human
uauuuuuuucuuuucuu

SEQ ID NO: 3118599 - RNA, 14 nt, Human
uauuuuuuuacuaa

SEQ ID NO: 3118600 - RNA, 16 nt, Human
ucagggccuggcucag

SEQ ID NO: 3118601 - RNA, 14 nt, Human
ucagggccuggcuc

SEQ ID NO: 3118602 - RNA, 16 nt, Human
ucaggugagaagcaga

SEQ ID NO: 3118603 - RNA, 15 nt, Human
ucaggugagaagcag

SEQ ID NO: 3118604 - RNA, 20 nt, Human
ucagccucccgaguagcugg

SEQ ID NO: 3118605 - RNA, 18 nt, Human
ucagccucccgaguagcu

SEQ ID NO: 3118606 - RNA, 21 nt, Human
ucagccucccgaauagcuggg

SEQ ID NO: 3118607 - RNA, 22 nt, Human
ucagccucccgaauagcuggga

SEQ ID NO: 3118608 - RNA, 13 nt, Human
ucagccucccaaa

SEQ ID NO: 3118609 - RNA, 14 nt, Human
ucagccucccaaag

SEQ ID NO: 3118610 - RNA, 19 nt, Human
ucagccucccaaagugcug

SEQ ID NO: 3118611 - RNA, 21 nt, Human
ucagccucccaaagugcuggg

SEQ ID NO: 3118612 - RNA, 19 nt, Human
ucagccugcuccagcuguu

SEQ ID NO: 3118613 - RNA, 18 nt, Human
ucagccugcuccagcugu

SEQ ID NO: 3118614 - RNA, 21 nt, Human
ucagccucccgaguagcuggg

SEQ ID NO: 3118615 - RNA, 22 nt, Human
ucagccucccgaguagcuggga

SEQ ID NO: 3118616 - RNA, 16 nt, Human
ucagcugaaccugggu

SEQ ID NO: 3118617 - RNA, 15 nt, Human
ucagcugaaccuggg

SEQ ID NO: 3118618 - RNA, 10 nt, Human
ucagaaaugu

SEQ ID NO: 3118619 - RNA, 23 nt, Human
ucagaauucucuaguuugauuaa

SEQ ID NO: 3118620 - RNA, 15 nt, Human
ucagaaauguguuau

SEQ ID NO: 3118621 - RNA, 16 nt, Human
ucagaauucucuaguu

SEQ ID NO: 3118622 - RNA, 13 nt, Human
ucagacagcugcc

SEQ ID NO: 3118623 - RNA, 20 nt, Human
ucacugcuuaacuucacaua

SEQ ID NO: 3118624 - RNA, 14 nt, Human
ucacugcuuaacuu

SEQ ID NO: 3118625 - RNA, 17 nt, Human
ucacucuuauugcccac

SEQ ID NO: 3118626 - RNA, 22 nt, Human
ucacucugucgcccagucugga

SEQ ID NO: 3118627 - RNA, 13 nt, Human
ucaccagccccag

SEQ ID NO: 3118628 - RNA, 22 nt, Human
ucaccccggccaccugcggugc

SEQ ID NO: 3118629 - RNA, 20 nt, Human
ucacucuuauugcccacgcu

SEQ ID NO: 3118630 - RNA, 18 nt, Human
ucacugccaugccagcuu

SEQ ID NO: 3118631 - RNA, 21 nt, Human
uccaccugccagggacagagg

SEQ ID NO: 3118632 - RNA, 18 nt, Human
uccaccugccagggacag

SEQ ID NO: 3118633 - RNA, 15 nt, Human
uccaccugccaggga

SEQ ID NO: 3118634 - RNA, 17 nt, Human
uccaccugccagggaca

SEQ ID NO: 3118635 - RNA, 12 nt, Human
uccacccugcuc

SEQ ID NO: 3118636 - RNA, 17 nt, Human
uccacaaguuaaauaaa

SEQ ID NO: 3118637 - RNA, 18 nt, Human
uccacaaguuaaauaaau

SEQ ID NO: 3118638 - RNA, 15 nt, Human
uccacaagagcccag

SEQ ID NO: 3118639 - RNA, 18 nt, Human
uccacaagagcccaggcc

SEQ ID NO: 3118640 - RNA, 17 nt, Human
uccacaagagcccaggc

SEQ ID NO: 3118641 - RNA, 16 nt, Human
uccacaagagcccagg

SEQ ID NO: 3118642 - RNA, 17 nt, Human
uccaauuuacauacucu

SEQ ID NO: 3118643 - RNA, 18 nt, Human
uccaauuuacauacucug

SEQ ID NO: 3118644 - RNA, 20 nt, Human
uccaaaauaaaacuuuuuaa

SEQ ID NO: 3118645 - RNA, 18 nt, Human
uccaaaauaaaacuuuuu

SEQ ID NO: 3118646 - RNA, 16 nt, Human
uccaggagcagccaca

SEQ ID NO: 3118647 - RNA, 17 nt, Human
uccagcuguucagcugg

SEQ ID NO: 3118648 - RNA, 15 nt, Human
uccagcucaccagcc

SEQ ID NO: 3118649 - RNA, 18 nt, Human
uccagcucaccagcccca

SEQ ID NO: 3118650 - RNA, 16 nt, Human
uccagcucaccagccc

SEQ ID NO: 3118651 - RNA, 17 nt, Human
uccagcucaccagcccc

SEQ ID NO: 3118652 - RNA, 23 nt, Human
uccagccaaagccuccuccagcc

SEQ ID NO: 3118653 - RNA, 22 nt, Human
uccaggggugggacacccugug

SEQ ID NO: 3118654 - RNA, 18 nt, Human
uccaggagcagccacauu

SEQ ID NO: 3118655 - RNA, 17 nt, Human
uccaggagcagccacau

SEQ ID NO: 3118656 - RNA, 15 nt, Human
uccaggugcacaagc

SEQ ID NO: 3118657 - RNA, 23 nt, Human
uccaggggugggacacccuguga

SEQ ID NO: 3118658 - RNA, 22 nt, Human
uccaggugcacaagcuccaagc

SEQ ID NO: 3118659 - RNA, 21 nt, Human
uccaggugcacaagcuccaag

SEQ ID NO: 3118660 - RNA, 20 nt, Human
uccaggugcacaagcuccaa

SEQ ID NO: 3118661 - RNA, 18 nt, Human
uccaggugcacaagcucc

SEQ ID NO: 3118662 - RNA, 15 nt, Human
uccagguucagcuug

SEQ ID NO: 3118663 - RNA, 16 nt, Human
uccagguucagcuugu

SEQ ID NO: 3118664 - RNA, 21 nt, Human
ucaucaccaacgucugugcca

SEQ ID NO: 3118665 - RNA, 20 nt, Human
ucaucaccaacgucugugcc

SEQ ID NO: 3118666 - RNA, 19 nt, Human
ucaucaccaacgucugugc

SEQ ID NO: 3118667 - RNA, 13 nt, Human
ucaggugcugcca

SEQ ID NO: 3118668 - RNA, 14 nt, Human
ucaggugcugccau

SEQ ID NO: 3118669 - RNA, 23 nt, Human
ucaggugccucaagagaaggcaa

SEQ ID NO: 3118670 - RNA, 21 nt, Human
ucaggugagaagcagaggaag

SEQ ID NO: 3118671 - RNA, 21 nt, Human
ucauacccacccccacccaag

SEQ ID NO: 3118672 - RNA, 23 nt, Human
ucaucuuagguuggcaaaaaggc

SEQ ID NO: 3118673 - RNA, 13 nt, Human
ucauuuccugugu

SEQ ID NO: 3118674 - RNA, 16 nt, Human
ucauuuccugugucuu

SEQ ID NO: 3118675 - RNA, 22 nt, Human
ucauuaggugugacugaauuuc

SEQ ID NO: 3118676 - RNA, 21 nt, Human
ucauucaacccaccugcgucu

SEQ ID NO: 3118677 - RNA, 21 nt, Human
ucuggacaggcauguucucug

SEQ ID NO: 3118678 - RNA, 14 nt, Human
ucuggacaggcaug

SEQ ID NO: 3118679 - RNA, 15 nt, Human
ucuggaaugcagugg

SEQ ID NO: 3118680 - RNA, 19 nt, Human
ucuggaauaaggagaauga

SEQ ID NO: 3118681 - RNA, 19 nt, Human
ucugcugacagacacaggc

SEQ ID NO: 3118682 - RNA, 20 nt, Human
ucugcugacagacacaggcc

SEQ ID NO: 3118683 - RNA, 21 nt, Human
ucugcugacagacacaggccc

SEQ ID NO: 3118684 - RNA, 22 nt, Human
ucugcugacagacacaggcccg

SEQ ID NO: 3118685 - RNA, 15 nt, Human
ucugccugcccaggc

SEQ ID NO: 3118686 - RNA, 18 nt, Human
ucugcuccucuccccagc

SEQ ID NO: 3118687 - RNA, 18 nt, Human
ucugcugacagacacagg

SEQ ID NO: 3118688 - RNA, 17 nt, Human
ucugcugacagacacag

SEQ ID NO: 3118689 - RNA, 14 nt, Human
ucugccugcccagg

SEQ ID NO: 3118690 - RNA, 13 nt, Human
ucugccugcccag

SEQ ID NO: 3118691 - RNA, 14 nt, Human
ucugggacacaguu

SEQ ID NO: 3118692 - RNA, 13 nt, Human
ucugggacacagu

SEQ ID NO: 3118693 - RNA, 23 nt, Human
ucuggugacuuuccucuuugguc

SEQ ID NO: 3118694 - RNA, 23 nt, Human
ucuggcucuuccaggcugggaga

SEQ ID NO: 3118695 - RNA, 18 nt, Human
ucuggcucuuccaggcug

SEQ ID NO: 3118696 - RNA, 19 nt, Human
ucuggcuaugcauuugaaa

SEQ ID NO: 3118697 - RNA, 22 nt, Human
ucuggcuaugcauuugaaaauu

SEQ ID NO: 3118698 - RNA, 17 nt, Human
ucuggcuaugcauuuga

SEQ ID NO: 3118699 - RNA, 14 nt, Human
ucuguccuacucug

SEQ ID NO: 3118700 - RNA, 21 nt, Human
ucuguccugggagugagcugg

SEQ ID NO: 3118701 - RNA, 15 nt, Human
ucuguccuacucugu

SEQ ID NO: 3118702 - RNA, 19 nt, Human
ucuguccuacucuguguca

SEQ ID NO: 3118703 - RNA, 14 nt, Human
ucugucgcccaguc

SEQ ID NO: 3118704 - RNA, 15 nt, Human
ucuucagaucucuaa

SEQ ID NO: 3118705 - RNA, 18 nt, Human
ucuucagaucucuaacuu

SEQ ID NO: 3118706 - RNA, 23 nt, Human
ucuucagaucucuaacuucacca

SEQ ID NO: 3118707 - RNA, 15 nt, Human
ucuucuccaggcugu

SEQ ID NO: 3118708 - RNA, 12 nt, Human
ucuugaacuccu

SEQ ID NO: 3118709 - RNA, 22 nt, Human
ucuuaaauauguggaguucauc

SEQ ID NO: 3118710 - RNA, 20 nt, Human
ucugcaagaauugaagcagg

SEQ ID NO: 3118711 - RNA, 14 nt, Human
ucugacccacugcu

SEQ ID NO: 3118712 - RNA, 23 nt, Human
ucugaggaauccagacccggcug

SEQ ID NO: 3118713 - RNA, 16 nt, Human
ucugacacacagcucu

SEQ ID NO: 3118714 - RNA, 17 nt, Human
ucugacacacagcucug

SEQ ID NO: 3118715 - RNA, 18 nt, Human
ucugacacacagcucugu

SEQ ID NO: 3118716 - RNA, 19 nt, Human
ucugacacacagcucuguc

SEQ ID NO: 3118717 - RNA, 12 nt, Human
ucugacaggcaa

SEQ ID NO: 3118718 - RNA, 21 nt, Human
ucugacaggcaaugcuggcug

SEQ ID NO: 3118719 - RNA, 22 nt, Human
ucugacaggcaaugcuggcugu

SEQ ID NO: 3118720 - RNA, 13 nt, Human
ucugacccacugc

SEQ ID NO: 3118721 - RNA, 13 nt, Human
ucugaaaauguau

SEQ ID NO: 3118722 - RNA, 19 nt, Human
ucucuaacuucaccauauu

SEQ ID NO: 3118723 - RNA, 12 nt, Human
ucucuaacuuca

SEQ ID NO: 3118724 - RNA, 22 nt, Human
ucucgugauugauaagaaccuu

SEQ ID NO: 3118725 - RNA, 14 nt, Human
ucucgugauugaua

SEQ ID NO: 3118726 - RNA, 13 nt, Human
ucuccuguaccuc

SEQ ID NO: 3118727 - RNA, 16 nt, Human
ucuccuguaccucuug

SEQ ID NO: 3118728 - RNA, 17 nt, Human
ucuccuguaccucuuga

SEQ ID NO: 3118729 - RNA, 17 nt, Human
ucuccugccucagccuc

SEQ ID NO: 3118730 - RNA, 15 nt, Human
ucuccugccucagcc

SEQ ID NO: 3118731 - RNA, 15 nt, Human
ucuccuguaccucuu

SEQ ID NO: 3118732 - RNA, 21 nt, Human
ucuccuggaaauauuaagaaa

SEQ ID NO: 3118733 - RNA, 15 nt, Human
ucucuaguuugauua

SEQ ID NO: 3118734 - RNA, 14 nt, Human
ucucugaggacacu

SEQ ID NO: 3118735 - RNA, 17 nt, Human
ucucugaggacacuaac

SEQ ID NO: 3118736 - RNA, 17 nt, Human
uccagguuuaagcuguu

SEQ ID NO: 3118737 - RNA, 20 nt, Human
uccccuguuuguuucugaaa

SEQ ID NO: 3118738 - RNA, 18 nt, Human
uccccuguuuguuucuga

SEQ ID NO: 3118739 - RNA, 21 nt, Human
uccccuguuuguuucugaaag

SEQ ID NO: 3118740 - RNA, 14 nt, Human
ucccugcacuugca

SEQ ID NO: 3118741 - RNA, 13 nt, Human
ucccugcacuugc

SEQ ID NO: 3118742 - RNA, 13 nt, Human
ucccuucccaccu

SEQ ID NO: 3118743 - RNA, 19 nt, Human
uccuccuuuucacaguucu

SEQ ID NO: 3118744 - RNA, 14 nt, Human
uccucuaggagguc

SEQ ID NO: 3118745 - RNA, 15 nt, Human
uccucuguacagagc

SEQ ID NO: 3118746 - RNA, 18 nt, Human
uccucuguacagagccca

SEQ ID NO: 3118747 - RNA, 17 nt, Human
uccucuguacagagccc

SEQ ID NO: 3118748 - RNA, 16 nt, Human
uccucuguacagagcc

SEQ ID NO: 3118749 - RNA, 16 nt, Human
uccucugcugcuggcu

SEQ ID NO: 3118750 - RNA, 15 nt, Human
uccucugcugcuggc

SEQ ID NO: 3118751 - RNA, 14 nt, Human
uccucugcugcugg

SEQ ID NO: 3118752 - RNA, 12 nt, Human
uccucugcugcu

SEQ ID NO: 3118753 - RNA, 22 nt, Human
uccuaguuccaccaucaagcca

SEQ ID NO: 3118754 - RNA, 18 nt, Human
uccuauauuguuuucagu

SEQ ID NO: 3118755 - RNA, 18 nt, Human
uccuacccacccuccuuu

SEQ ID NO: 3118756 - RNA, 13 nt, Human
uccgaccagacac

SEQ ID NO: 3118757 - RNA, 16 nt, Human
uccuaaucuucugaac

SEQ ID NO: 3118758 - RNA, 19 nt, Human
uccuucacagaugggugcu

SEQ ID NO: 3118759 - RNA, 20 nt, Human
uccuucaccuuuguccccac

SEQ ID NO: 3118760 - RNA, 18 nt, Human
uccuucaccuuugucccc

SEQ ID NO: 3118761 - RNA, 18 nt, Human
uccuucacagaugggugc

SEQ ID NO: 3118762 - RNA, 18 nt, Human
uccuuaccagcagagcac

SEQ ID NO: 3118763 - RNA, 17 nt, Human
uccuuaccagcagagca

SEQ ID NO: 3118764 - RNA, 16 nt, Human
uccuuaccagcagagc

SEQ ID NO: 3118765 - RNA, 22 nt, Human
uccuucaccuuuguccccaccg

SEQ ID NO: 3118766 - RNA, 21 nt, Human
uccuucaccuuuguccccacc

SEQ ID NO: 3118767 - RNA, 23 nt, Human
uccuuuucacaguucucuccuuc

SEQ ID NO: 3118768 - RNA, 16 nt, Human
uccugccucagccucc

SEQ ID NO: 3118769 - RNA, 13 nt, Human
uccugccucagcc

SEQ ID NO: 3118770 - RNA, 15 nt, Human
uccugccucagccuc

SEQ ID NO: 3118771 - RNA, 16 nt, Human
uccuggcacccggccc

SEQ ID NO: 3118772 - RNA, 19 nt, Human
uccuggcacccggccccug

SEQ ID NO: 3118773 - RNA, 14 nt, Human
uccuggcacccggc

SEQ ID NO: 3118774 - RNA, 13 nt, Human
uccugagccagau

SEQ ID NO: 3118775 - RNA, 14 nt, Human
uccugccucagccu

SEQ ID NO: 3118776 - RNA, 20 nt, Human
uccuggcacccggccccugc

SEQ ID NO: 3118777 - RNA, 21 nt, Human
uccuggcacccggccccugcu

SEQ ID NO: 3118778 - RNA, 17 nt, Human
uccuggcacugcuucca

SEQ ID NO: 3118779 - RNA, 22 nt, Human
uccuggcacugcuuccagugag

SEQ ID NO: 3118780 - RNA, 18 nt, Human
uccuggcacugcuuccag

SEQ ID NO: 3118781 - RNA, 20 nt, Human
uccuguaccucuugagccuu

SEQ ID NO: 3118782 - RNA, 14 nt, Human
uccuuaccagcaga

SEQ ID NO: 3118783 - RNA, 16 nt, Human
ucgugauugauaagaa

SEQ ID NO: 3118784 - RNA, 21 nt, Human
ucuaaaucuccaaaauaaaac

SEQ ID NO: 3118785 - RNA, 21 nt, Human
ucuaggaagacuuuggaaaga

SEQ ID NO: 3118786 - RNA, 15 nt, Human
ucuaucaaguauuau

SEQ ID NO: 3118787 - RNA, 21 nt, Human
ucuaucaaguauuauaccuuu

SEQ ID NO: 3118788 - RNA, 17 nt, Human
ucucaaauaacuaaaag

SEQ ID NO: 3118789 - RNA, 15 nt, Human
ugauuuucauugcug

SEQ ID NO: 3118790 - RNA, 13 nt, Human
ugauuuucauugc

SEQ ID NO: 3118791 - RNA, 23 nt, Human
ugauuuuuuuuuccuucagugcc

SEQ ID NO: 3118792 - RNA, 22 nt, Human
ugauuuuuuuuuccuucagugc

SEQ ID NO: 3118793 - RNA, 20 nt, Human
ugauuuuuuuuuccuucagu

SEQ ID NO: 3118794 - RNA, 19 nt, Human
ugauuuuuuuuuccuucag

SEQ ID NO: 3118795 - RNA, 17 nt, Human
ugauuuuuuuuuccuuc

SEQ ID NO: 3118796 - RNA, 16 nt, Human
ugauuuuuuuuuccuu

SEQ ID NO: 3118797 - RNA, 14 nt, Human
ugcaacaggcuggg

SEQ ID NO: 3118798 - RNA, 15 nt, Human
ugcaacaggcugggc

SEQ ID NO: 3118799 - RNA, 16 nt, Human
ugcaacaggcugggcu

SEQ ID NO: 3118800 - RNA, 17 nt, Human
ugcaacaggcugggcuu

SEQ ID NO: 3118801 - RNA, 19 nt, Human
ugcaacaggcugggcuuca

SEQ ID NO: 3118802 - RNA, 20 nt, Human
ugcaacaggcugggcuucag

SEQ ID NO: 3118803 - RNA, 13 nt, Human
ugcaaccuccgcc

SEQ ID NO: 3118804 - RNA, 14 nt, Human
ugcaaccuccgccu

SEQ ID NO: 3118805 - RNA, 20 nt, Human
ugcaaccugauugugucucu

SEQ ID NO: 3118806 - RNA, 19 nt, Human
ugcaaccugauugugucuc

SEQ ID NO: 3118807 - RNA, 18 nt, Human
ugcaaccuccgccucuug

SEQ ID NO: 3118808 - RNA, 20 nt, Human
ugcaaccuccgccucuuggg

SEQ ID NO: 3118809 - RNA, 21 nt, Human
ugcaaccuccgccucuugggu

SEQ ID NO: 3118810 - RNA, 22 nt, Human
ugcaaccugauugugucucuug

SEQ ID NO: 3118811 - RNA, 21 nt, Human
ugcaccggcuggccuggcccc

SEQ ID NO: 3118812 - RNA, 17 nt, Human
ugcaccuggaauauaua

SEQ ID NO: 3118813 - RNA, 20 nt, Human
ugcaccuggaauauauaacc

SEQ ID NO: 3118814 - RNA, 22 nt, Human
ugcaccuggaauauauaaccag

SEQ ID NO: 3118815 - RNA, 18 nt, Human
ugcaccggcuggccuggc

SEQ ID NO: 3118816 - RNA, 20 nt, Human
ugcaccggcuggccuggccc

SEQ ID NO: 3118817 - RNA, 19 nt, Human
ugcaccggcuggccuggcc

SEQ ID NO: 3118818 - RNA, 18 nt, Human
ugcacugacauuguuggc

SEQ ID NO: 3118819 - RNA, 21 nt, Human
ugcacugacauuguuggccaa

SEQ ID NO: 3118820 - RNA, 17 nt, Human
ugcacagaguuguuaca

SEQ ID NO: 3118821 - RNA, 18 nt, Human
ugcacagaguuguuacau

SEQ ID NO: 3118822 - RNA, 19 nt, Human
ugcacagaguuguuacauu

SEQ ID NO: 3118823 - RNA, 20 nt, Human
ugcacaaacagaggccgcca

SEQ ID NO: 3118824 - RNA, 19 nt, Human
ugcacaaacagaggccgcc

SEQ ID NO: 3118825 - RNA, 17 nt, Human
ugcacaaacagaggccg

SEQ ID NO: 3118826 - RNA, 16 nt, Human
ugcacaaacagaggcc

SEQ ID NO: 3118827 - RNA, 15 nt, Human
ugcacaaacagaggc

SEQ ID NO: 3118828 - RNA, 16 nt, Human
ugcaaugaccuuucaa

SEQ ID NO: 3118829 - RNA, 13 nt, Human
ugcaaugaccuuu

SEQ ID NO: 3118830 - RNA, 23 nt, Human
ugcaaugaccuuucaauaggaaa

SEQ ID NO: 3118831 - RNA, 22 nt, Human
ugcaaugaccuuucaauaggaa

SEQ ID NO: 3118832 - RNA, 19 nt, Human
ugcaaugaccuuucaauag

SEQ ID NO: 3118833 - RNA, 17 nt, Human
ugcaaugaccuuucaau

SEQ ID NO: 3118834 - RNA, 13 nt, Human
ugcaauggcagcc

SEQ ID NO: 3118835 - RNA, 14 nt, Human
ugcaauggcagccu

SEQ ID NO: 3118836 - RNA, 15 nt, Human
ugcaauggcagccuu

SEQ ID NO: 3118837 - RNA, 16 nt, Human
ugcaauggcagccuug

SEQ ID NO: 3118838 - RNA, 19 nt, Human
ugccgucuaccugaggggc

SEQ ID NO: 3118839 - RNA, 17 nt, Human
ugccgucuaccugaggg

SEQ ID NO: 3118840 - RNA, 16 nt, Human
ugccgucuaccugagg

SEQ ID NO: 3118841 - RNA, 15 nt, Human
ugccgucuaccugag

SEQ ID NO: 3118842 - RNA, 21 nt, Human
ugcccugcccaccuggccucu

SEQ ID NO: 3118843 - RNA, 23 nt, Human
ugcccugcccaccuggccucugc

SEQ ID NO: 3118844 - RNA, 22 nt, Human
ugcccugcccaccuggccucug

SEQ ID NO: 3118845 - RNA, 17 nt, Human
ugcccuaaaguguauuu

SEQ ID NO: 3118846 - RNA, 13 nt, Human
ugccucugggacu

SEQ ID NO: 3118847 - RNA, 22 nt, Human
ugccuccuuugugaggaagccg

SEQ ID NO: 3118848 - RNA, 20 nt, Human
ugccuccuuugugaggaagc

SEQ ID NO: 3118849 - RNA, 21 nt, Human
ugccuccuuugugaggaagcc

SEQ ID NO: 3118850 - RNA, 21 nt, Human
ugccucuucucuacucuaggg

SEQ ID NO: 3118851 - RNA, 17 nt, Human
ugccugguggcagcugc

SEQ ID NO: 3118852 - RNA, 18 nt, Human
ugccugguggcagcugcg

SEQ ID NO: 3118853 - RNA, 19 nt, Human
ugccugguggcagcugcgg

SEQ ID NO: 3118854 - RNA, 15 nt, Human
ugccauguuggccag

SEQ ID NO: 3118855 - RNA, 12 nt, Human
ugccauguuggc

SEQ ID NO: 3118856 - RNA, 16 nt, Human
ugccauguuggccagg

SEQ ID NO: 3118857 - RNA, 20 nt, Human
ugcccaccuggccucugcac

SEQ ID NO: 3118858 - RNA, 18 nt, Human
ugcccacgcuggagugca

SEQ ID NO: 3118859 - RNA, 19 nt, Human
ugcccaccuggccucugca

SEQ ID NO: 3118860 - RNA, 21 nt, Human
ugcccacucccugcaaccuga

SEQ ID NO: 3118861 - RNA, 15 nt, Human
ugccaugugccaggu

SEQ ID NO: 3118862 - RNA, 14 nt, Human
ugccaugugccagg

SEQ ID NO: 3118863 - RNA, 23 nt, Human
ugccaugaggaacaaggcaaggc

SEQ ID NO: 3118864 - RNA, 20 nt, Human
ugccaugaggaacaaggcaa

SEQ ID NO: 3118865 - RNA, 19 nt, Human
ugccaggaagccagcaggc

SEQ ID NO: 3118866 - RNA, 18 nt, Human
ugccaggaagccagcagg

SEQ ID NO: 3118867 - RNA, 16 nt, Human
ugccaggaagccagca

SEQ ID NO: 3118868 - RNA, 12 nt, Human
ugccaggaagcc

SEQ ID NO: 3118869 - RNA, 17 nt, Human
ugccagguuuuuggucu

SEQ ID NO: 3118870 - RNA, 15 nt, Human
ugccauccagguuca

SEQ ID NO: 3118871 - RNA, 12 nt, Human
ugccauccaggu

SEQ ID NO: 3118872 - RNA, 15 nt, Human
ugcauguuugugauu

SEQ ID NO: 3118873 - RNA, 12 nt, Human
ugcauuaucuag

SEQ ID NO: 3118874 - RNA, 17 nt, Human
ugcauuaucuagauacu

SEQ ID NO: 3118875 - RNA, 20 nt, Human
ugacgccaucccagccccaa

SEQ ID NO: 3118876 - RNA, 19 nt, Human
ugacgccaucccagcccca

SEQ ID NO: 3118877 - RNA, 18 nt, Human
ugacgccaucccagcccc

SEQ ID NO: 3118878 - RNA, 17 nt, Human
ugacgccaucccagccc

SEQ ID NO: 3118879 - RNA, 22 nt, Human
ugaccuuucaauaggaaaaacu

SEQ ID NO: 3118880 - RNA, 18 nt, Human
ugaccuuucaauaggaaa

SEQ ID NO: 3118881 - RNA, 16 nt, Human
ugacgccaucccagcc

SEQ ID NO: 3118882 - RNA, 15 nt, Human
ugacgccaucccagc

SEQ ID NO: 3118883 - RNA, 14 nt, Human
ugacgccaucccag

SEQ ID NO: 3118884 - RNA, 13 nt, Human
ugacgccauccca

SEQ ID NO: 3118885 - RNA, 14 nt, Human
ugacugaauuucuu

SEQ ID NO: 3118886 - RNA, 15 nt, Human
ugacugaauuucuuu

SEQ ID NO: 3118887 - RNA, 13 nt, Human
ugacugaauuucu

SEQ ID NO: 3118888 - RNA, 13 nt, Human
ugaccucugcagc

SEQ ID NO: 3118889 - RNA, 16 nt, Human
ugaccucugcagcaau

SEQ ID NO: 3118890 - RNA, 22 nt, Human
ugaccucaggugauccacccac

SEQ ID NO: 3118891 - RNA, 13 nt, Human
ugaccuuucaaua

SEQ ID NO: 3118892 - RNA, 14 nt, Human
ugaccuuucaauag

SEQ ID NO: 3118893 - RNA, 16 nt, Human
ugaccuuucaauagga

SEQ ID NO: 3118894 - RNA, 15 nt, Human
ugaccuuucaauagg

SEQ ID NO: 3118895 - RNA, 12 nt, Human
ugaccucugccu

SEQ ID NO: 3118896 - RNA, 23 nt, Human
ugaccucugcagcaauaaagcag

SEQ ID NO: 3118897 - RNA, 18 nt, Human
ugaccucugcagcaauaa

SEQ ID NO: 3118898 - RNA, 21 nt, Human
ugaccucugcagcaauaaagc

SEQ ID NO: 3118899 - RNA, 19 nt, Human
ugaccauucuccaccugcc

SEQ ID NO: 3118900 - RNA, 22 nt, Human
ugaccauucuccaccugccagg

SEQ ID NO: 3118901 - RNA, 21 nt, Human
ugaccauucuccaccugccag

SEQ ID NO: 3118902 - RNA, 20 nt, Human
ugaccauucuccaccugcca

SEQ ID NO: 3118903 - RNA, 15 nt, Human
ucuugaacuccuggc

SEQ ID NO: 3118904 - RNA, 13 nt, Human
ugagccucagcau

SEQ ID NO: 3118905 - RNA, 15 nt, Human
ugagcaucaggccag

SEQ ID NO: 3118906 - RNA, 14 nt, Human
ugagcaucaggcca

SEQ ID NO: 3118907 - RNA, 13 nt, Human
ugagcaucaggcc

SEQ ID NO: 3118908 - RNA, 12 nt, Human
ugagacucuguc

SEQ ID NO: 3118909 - RNA, 13 nt, Human
ugagacucugucu

SEQ ID NO: 3118910 - RNA, 14 nt, Human
ugagacucugucuc

SEQ ID NO: 3118911 - RNA, 22 nt, Human
ugagaggcauccaguaucuuga

SEQ ID NO: 3118912 - RNA, 23 nt, Human
ugagaggcauccaguaucuugaa

SEQ ID NO: 3118913 - RNA, 15 nt, Human
ugagaucagccuggg

SEQ ID NO: 3118914 - RNA, 19 nt, Human
ugagaggggaacagacugg

SEQ ID NO: 3118915 - RNA, 17 nt, Human
ugagaguagagucacug

SEQ ID NO: 3118916 - RNA, 12 nt, Human
ugagacccuguc

SEQ ID NO: 3118917 - RNA, 20 nt, Human
ugaggucuguucuuuccaaa

SEQ ID NO: 3118918 - RNA, 14 nt, Human
ugaggucuguucuu

SEQ ID NO: 3118919 - RNA, 15 nt, Human
ugaggucuguucuuu

SEQ ID NO: 3118920 - RNA, 11 nt, Human
ugaggcugggc

SEQ ID NO: 3118921 - RNA, 20 nt, Human
ugaguccccuguuuguuucu

SEQ ID NO: 3118922 - RNA, 18 nt, Human
ugaguccuggcaugggaa

SEQ ID NO: 3118923 - RNA, 11 nt, Human
ugaguccuggc

SEQ ID NO: 3118924 - RNA, 14 nt, Human
ugagucgaggacag

SEQ ID NO: 3118925 - RNA, 22 nt, Human
ugaguccuggcaugggaaugaa

SEQ ID NO: 3118926 - RNA, 19 nt, Human
ugaguccuggcaugggaau

SEQ ID NO: 3118927 - RNA, 21 nt, Human
ugaguccccuguuuguuucug

SEQ ID NO: 3118928 - RNA, 19 nt, Human
ugagguuucaaaccucccu

SEQ ID NO: 3118929 - RNA, 16 nt, Human
ugaggugcuauguucu

SEQ ID NO: 3118930 - RNA, 15 nt, Human
ugaggugcuauguuc

SEQ ID NO: 3118931 - RNA, 23 nt, Human
ugauagcacagacccugcccugu

SEQ ID NO: 3118932 - RNA, 22 nt, Human
ugauagcacagacccugcccug

SEQ ID NO: 3118933 - RNA, 16 nt, Human
ugauagcacagacccu

SEQ ID NO: 3118934 - RNA, 15 nt, Human
ugauagcacagaccc

SEQ ID NO: 3118935 - RNA, 14 nt, Human
ugauagcacagacc

SEQ ID NO: 3118936 - RNA, 21 nt, Human
ugauagcacagacccugcccu

SEQ ID NO: 3118937 - RNA, 20 nt, Human
ugauagcacagacccugccc

SEQ ID NO: 3118938 - RNA, 18 nt, Human
ugauagcacagacccugc

SEQ ID NO: 3118939 - RNA, 17 nt, Human
ugauagcacagacccug

SEQ ID NO: 3118940 - RNA, 15 nt, Human
ugagucgaggacagg

SEQ ID NO: 3118941 - RNA, 16 nt, Human
ugagucgaggacaggg

SEQ ID NO: 3118942 - RNA, 23 nt, Human
ugaguugauagcacagacccugc

SEQ ID NO: 3118943 - RNA, 21 nt, Human
ugaguugauagcacagacccu

SEQ ID NO: 3118944 - RNA, 19 nt, Human
ugaguugauucagcucugc

SEQ ID NO: 3118945 - RNA, 16 nt, Human
ugaguugauucagcuc

SEQ ID NO: 3118946 - RNA, 21 nt, Human
ugauccacccaccucagccuc

SEQ ID NO: 3118947 - RNA, 22 nt, Human
ugauccacccaccucagccucc

SEQ ID NO: 3118948 - RNA, 21 nt, Human
ugaucuaggaagacuuuggaa

SEQ ID NO: 3118949 - RNA, 19 nt, Human
ugaucuaggaagacuuugg

SEQ ID NO: 3118950 - RNA, 17 nt, Human
ugaucucucgugauuga

SEQ ID NO: 3118951 - RNA, 15 nt, Human
ugaucuaggaagacu

SEQ ID NO: 3118952 - RNA, 13 nt, Human
ugaucauccacug

SEQ ID NO: 3118953 - RNA, 24 nt, Human
ugaucauccacugugccaugugcc

SEQ ID NO: 3118954 - RNA, 17 nt, Human
ugauccaagcugguccc

SEQ ID NO: 3118955 - RNA, 21 nt, Human
ugauccaagcuggucccacuc

SEQ ID NO: 3118956 - RNA, 15 nt, Human
ugauccacccaccuc

SEQ ID NO: 3118957 - RNA, 20 nt, Human
ugauccacccaccucagccu

SEQ ID NO: 3118958 - RNA, 19 nt, Human
ugauccacccaccucagcc

SEQ ID NO: 3118959 - RNA, 22 nt, Human
ugaucacggcucacugcagccu

SEQ ID NO: 3118960 - RNA, 18 nt, Human
ugaucuuugcagacaggc

SEQ ID NO: 3118961 - RNA, 21 nt, Human
ugaucuuugcagacaggcaag

SEQ ID NO: 3118962 - RNA, 23 nt, Human
ugaucuuugcagacaggcaagca

SEQ ID NO: 3118963 - RNA, 19 nt, Human
ugaucuuugcagacaggca

SEQ ID NO: 3118964 - RNA, 20 nt, Human
ugaucuuugcagacaggcaa

SEQ ID NO: 3118965 - RNA, 14 nt, Human
ugaugccaugagga

SEQ ID NO: 3118966 - RNA, 23 nt, Human
ugaugaucuuugcagacaggcaa

SEQ ID NO: 3118967 - RNA, 20 nt, Human
ugaugaugaaaugaggucag

SEQ ID NO: 3118968 - RNA, 22 nt, Human
ugaugaucuuugcagacaggca

SEQ ID NO: 3118969 - RNA, 22 nt, Human
ugaugcuucuucagagacuccu

SEQ ID NO: 3118970 - RNA, 21 nt, Human
ugaugcuucuucagagacucc

SEQ ID NO: 3118971 - RNA, 19 nt, Human
ugaugcuucuucagagacu

SEQ ID NO: 3118972 - RNA, 18 nt, Human
ugaugcuucuucagagac

SEQ ID NO: 3118973 - RNA, 16 nt, Human
ugucuuuucuugcaug

SEQ ID NO: 3118974 - RNA, 23 nt, Human
ugucuuuggacccugaggcccag

SEQ ID NO: 3118975 - RNA, 14 nt, Human
ugucuaugggacuc

SEQ ID NO: 3118976 - RNA, 15 nt, Human
ugucuaugggacuca

SEQ ID NO: 3118977 - RNA, 16 nt, Human
ugucuaugggacucaa

SEQ ID NO: 3118978 - RNA, 23 nt, Human
ugucuaguuguuugauucagaca

SEQ ID NO: 3118979 - RNA, 15 nt, Human
ugucuaguuguuuga

SEQ ID NO: 3118980 - RNA, 21 nt, Human
ugucucaaaaaaagaaaaaga

SEQ ID NO: 3118981 - RNA, 19 nt, Human
uguccccgcacugggcuug

SEQ ID NO: 3118982 - RNA, 17 nt, Human
uguccccgcacugggcu

SEQ ID NO: 3118983 - RNA, 14 nt, Human
ugucuaaugaaacc

SEQ ID NO: 3118984 - RNA, 12 nt, Human
uguccugggagu

SEQ ID NO: 3118985 - RNA, 19 nt, Human
uguccugggagugagcugg

SEQ ID NO: 3118986 - RNA, 20 nt, Human
uguccugggagugagcuggu

SEQ ID NO: 3118987 - RNA, 14 nt, Human
ugucagugugacug

SEQ ID NO: 3118988 - RNA, 15 nt, Human
ugucagugugacuga

SEQ ID NO: 3118989 - RNA, 19 nt, Human
ugucagugugacugaucuc

SEQ ID NO: 3118990 - RNA, 16 nt, Human
ugucagugugacugau

SEQ ID NO: 3118991 - RNA, 13 nt, Human
ugucacaggcagg

SEQ ID NO: 3118992 - RNA, 15 nt, Human
ugucacaggcagguc

SEQ ID NO: 3118993 - RNA, 16 nt, Human
ugucacaggcaggucc

SEQ ID NO: 3118994 - RNA, 17 nt, Human
ugucacaggcaggucca

SEQ ID NO: 3118995 - RNA, 21 nt, Human
ugucacaggcagguccagggu

SEQ ID NO: 3118996 - RNA, 21 nt, Human
ugucaauuacaggaaguacug

SEQ ID NO: 3118997 - RNA, 14 nt, Human
ugucacaggcaggu

SEQ ID NO: 3118998 - RNA, 19 nt, Human
ugucaauuacaggaaguac

SEQ ID NO: 3118999 - RNA, 13 nt, Human
uguaucugagcag

SEQ ID NO: 3119000 - RNA, 22 nt, Human
uguacagcaaggagauuuacaa

SEQ ID NO: 3119001 - RNA, 12 nt, Human
uguacagagccc

SEQ ID NO: 3119002 - RNA, 21 nt, Human
uguacagagcccacgccccca

SEQ ID NO: 3119003 - RNA, 23 nt, Human
uguacagcaaggagauuuacaac

SEQ ID NO: 3119004 - RNA, 19 nt, Human
uggugguuuucuguucuuu

SEQ ID NO: 3119005 - RNA, 17 nt, Human
uggugguuucagaaaug

SEQ ID NO: 3119006 - RNA, 18 nt, Human
uggugguuucagaaaugu

SEQ ID NO: 3119007 - RNA, 18 nt, Human
uggugggggccucggugu

SEQ ID NO: 3119008 - RNA, 16 nt, Human
uggugggggccucggu

SEQ ID NO: 3119009 - RNA, 13 nt, Human
ugguggcuggguu

SEQ ID NO: 3119010 - RNA, 12 nt, Human
ugguggcagugg

SEQ ID NO: 3119011 - RNA, 19 nt, Human
uggugcaaugaccuuucaa

SEQ ID NO: 3119012 - RNA, 14 nt, Human
uggugcaaugaccu

SEQ ID NO: 3119013 - RNA, 20 nt, Human
ugguggcagugggagcugcc

SEQ ID NO: 3119014 - RNA, 13 nt, Human
ugguggcaguggg

SEQ ID NO: 3119015 - RNA, 18 nt, Human
ugguggcagugggagcug

SEQ ID NO: 3119016 - RNA, 14 nt, Human
uggugagaggcauc

SEQ ID NO: 3119017 - RNA, 20 nt, Human
uggguacuuguggacacagc

SEQ ID NO: 3119018 - RNA, 23 nt, Human
uggguacuuguggacacagcucu

SEQ ID NO: 3119019 - RNA, 18 nt, Human
ugguugaugaucuuugca

SEQ ID NO: 3119020 - RNA, 16 nt, Human
uggugucaccugaaga

SEQ ID NO: 3119021 - RNA, 15 nt, Human
uggugucgggcauga

SEQ ID NO: 3119022 - RNA, 18 nt, Human
uggugucgggcaugacac

SEQ ID NO: 3119023 - RNA, 23 nt, Human
ugguucaggguuggccccugccc

SEQ ID NO: 3119024 - RNA, 19 nt, Human
ugguuuucuuguguguuua

SEQ ID NO: 3119025 - RNA, 21 nt, Human
ugguuuuuaaaaaacugcuga

SEQ ID NO: 3119026 - RNA, 23 nt, Human
ugguuuuuaaaaaacugcugacu

SEQ ID NO: 3119027 - RNA, 16 nt, Human
ugguuuucuguucuuu

SEQ ID NO: 3119028 - RNA, 11 nt, Human
uguacagagcc

SEQ ID NO: 3119029 - RNA, 14 nt, Human
uguacagacaacaa

SEQ ID NO: 3119030 - RNA, 17 nt, Human
uguaacaagccacccca

SEQ ID NO: 3119031 - RNA, 14 nt, Human
uguaacaagccacc

SEQ ID NO: 3119032 - RNA, 22 nt, Human
uggccucccaacucaccccagc

SEQ ID NO: 3119033 - RNA, 21 nt, Human
uggccucccaacucaccccag

SEQ ID NO: 3119034 - RNA, 20 nt, Human
uggccucccaacucacccca

SEQ ID NO: 3119035 - RNA, 19 nt, Human
uggccucccaacucacccc

SEQ ID NO: 3119036 - RNA, 14 nt, Human
uggccucccaacuc

SEQ ID NO: 3119037 - RNA, 11 nt, Human
uggccucccaa

SEQ ID NO: 3119038 - RNA, 18 nt, Human
uggccucaagugauucuc

SEQ ID NO: 3119039 - RNA, 23 nt, Human
uggccucaagugauucuccugcc

SEQ ID NO: 3119040 - RNA, 23 nt, Human
uggccuagcauacguacacauuu

SEQ ID NO: 3119041 - RNA, 17 nt, Human
uggcagcugcgguccac

SEQ ID NO: 3119042 - RNA, 20 nt, Human
uggccccucagggucccugg

SEQ ID NO: 3119043 - RNA, 13 nt, Human
uggccccucaggg

SEQ ID NO: 3119044 - RNA, 22 nt, Human
uggccccucagggucccuggug

SEQ ID NO: 3119045 - RNA, 21 nt, Human
uggccccucagggucccuggu

SEQ ID NO: 3119046 - RNA, 20 nt, Human
uggccuagcauacguacaca

SEQ ID NO: 3119047 - RNA, 16 nt, Human
uggcugcugaaggcuc

SEQ ID NO: 3119048 - RNA, 14 nt, Human
uggcugcugaaggc

SEQ ID NO: 3119049 - RNA, 13 nt, Human
uggcugcugaagg

SEQ ID NO: 3119050 - RNA, 11 nt, Human
uggcugcugaa

SEQ ID NO: 3119051 - RNA, 13 nt, Human
ugggcagagcaga

SEQ ID NO: 3119052 - RNA, 14 nt, Human
ugggcagagcagag

SEQ ID NO: 3119053 - RNA, 17 nt, Human
ugggcagagcagagacc

SEQ ID NO: 3119054 - RNA, 15 nt, Human
ugggcagagcagaga

SEQ ID NO: 3119055 - RNA, 15 nt, Human
ugggacacccuguga

SEQ ID NO: 3119056 - RNA, 14 nt, Human
ugggacacccugug

SEQ ID NO: 3119057 - RNA, 13 nt, Human
ugggacacccugu

SEQ ID NO: 3119058 - RNA, 16 nt, Human
ugggaaugaaugucag

SEQ ID NO: 3119059 - RNA, 16 nt, Human
ugggaggaucucuuga

SEQ ID NO: 3119060 - RNA, 18 nt, Human
ugggaugauuggaggggg

SEQ ID NO: 3119061 - RNA, 22 nt, Human
ugggcuucaguggcagcugcuu

SEQ ID NO: 3119062 - RNA, 21 nt, Human
ugggcuucaguggcagcugcu

SEQ ID NO: 3119063 - RNA, 15 nt, Human
ugggcuucauccucc

SEQ ID NO: 3119064 - RNA, 22 nt, Human
ugggcuuggggaccagagcugc

SEQ ID NO: 3119065 - RNA, 21 nt, Human
ugggcuugucuguagauuuua

SEQ ID NO: 3119066 - RNA, 23 nt, Human
ugggcuuggggaccagagcugcc

SEQ ID NO: 3119067 - RNA, 17 nt, Human
ugggcuugucuguagau

SEQ ID NO: 3119068 - RNA, 19 nt, Human
ugggggcugggcagaggaa

SEQ ID NO: 3119069 - RNA, 19 nt, Human
uggggggcugaggugggag

SEQ ID NO: 3119070 - RNA, 16 nt, Human
ugggggccucagugcc

SEQ ID NO: 3119071 - RNA, 12 nt, Human
ugcuucucacug

SEQ ID NO: 3119072 - RNA, 21 nt, Human
ugcuuccagugaggcucugcc

SEQ ID NO: 3119073 - RNA, 23 nt, Human
ugcuuccagugaggcucugcccu

SEQ ID NO: 3119074 - RNA, 22 nt, Human
ugcuuccagugaggcucugccc

SEQ ID NO: 3119075 - RNA, 19 nt, Human
ugcuuaacuucacauauug

SEQ ID NO: 3119076 - RNA, 13 nt, Human
ugcuuaacuucac

SEQ ID NO: 3119077 - RNA, 14 nt, Human
ugcuuaacuucaca

SEQ ID NO: 3119078 - RNA, 17 nt, Human
ugcuuaacuucacauau

SEQ ID NO: 3119079 - RNA, 18 nt, Human
ugcuuaacuucacauauu

SEQ ID NO: 3119080 - RNA, 14 nt, Human
uggaacacucugag

SEQ ID NO: 3119081 - RNA, 17 nt, Human
uggaacacucugagacu

SEQ ID NO: 3119082 - RNA, 15 nt, Human
uggaacacucugaga

SEQ ID NO: 3119083 - RNA, 13 nt, Human
ugcuucuucagag

SEQ ID NO: 3119084 - RNA, 18 nt, Human
ugcuugugaaaggaaaga

SEQ ID NO: 3119085 - RNA, 15 nt, Human
uggauuuaacagaaa

SEQ ID NO: 3119086 - RNA, 21 nt, Human
uggcacuauaauguaagcucu

SEQ ID NO: 3119087 - RNA, 22 nt, Human
uggcacuauaauguaagcucua

SEQ ID NO: 3119088 - RNA, 19 nt, Human
uggcacugcuuccagugag

SEQ ID NO: 3119089 - RNA, 22 nt, Human
uggcacugcuuccagugaggcu

SEQ ID NO: 3119090 - RNA, 18 nt, Human
uggcagcucagagagggu

SEQ ID NO: 3119091 - RNA, 23 nt, Human
uggaggggggaggugggauccuc

SEQ ID NO: 3119092 - RNA, 21 nt, Human
uggauuguccccgacccuugc

SEQ ID NO: 3119093 - RNA, 22 nt, Human
uggaugcagccucacaguccuu

SEQ ID NO: 3119094 - RNA, 21 nt, Human
uggaugcagccucacaguccu

SEQ ID NO: 3119095 - RNA, 13 nt, Human
uggaugcagccuc

SEQ ID NO: 3119096 - RNA, 17 nt, Human
uggacaggcauguucuc

SEQ ID NO: 3119097 - RNA, 18 nt, Human
uggacaggcauguucucu

SEQ ID NO: 3119098 - RNA, 22 nt, Human
uggacaggcauguucucugagg

SEQ ID NO: 3119099 - RNA, 23 nt, Human
uggacguguuaugacuccagaau

SEQ ID NO: 3119100 - RNA, 19 nt, Human
uggacguguuaugacucca

SEQ ID NO: 3119101 - RNA, 20 nt, Human
uggacuaacuugucuuugga

SEQ ID NO: 3119102 - RNA, 19 nt, Human
uggacuaacuugucuuugg

SEQ ID NO: 3119103 - RNA, 13 nt, Human
uuuauuaugcaug

SEQ ID NO: 3119104 - RNA, 13 nt, Human
uuuauuauggcac

SEQ ID NO: 3119105 - RNA, 14 nt, Human
uuuauggcuuuugu

SEQ ID NO: 3119106 - RNA, 16 nt, Human
uuuauggcuuuugugc

SEQ ID NO: 3119107 - RNA, 14 nt, Human
uuucaauaggaaaa

SEQ ID NO: 3119108 - RNA, 12 nt, Human
uuucaauaggaa

SEQ ID NO: 3119109 - RNA, 17 nt, Human
uuucaauaggaaaaacu

SEQ ID NO: 3119110 - RNA, 13 nt, Human
uuucaguguacau

SEQ ID NO: 3119111 - RNA, 14 nt, Human
uuucaguguacaug

SEQ ID NO: 3119112 - RNA, 14 nt, Human
uuucauuuagguga

SEQ ID NO: 3119113 - RNA, 18 nt, Human
uuucauuuaggugaggaa

SEQ ID NO: 3119114 - RNA, 19 nt, Human
uuuaagugcugcauuuaaa

SEQ ID NO: 3119115 - RNA, 22 nt, Human
uuuaagaaaaaggaugcacaga

SEQ ID NO: 3119116 - RNA, 18 nt, Human
uuuaagaaaaaggaugca

SEQ ID NO: 3119117 - RNA, 18 nt, Human
uuuaacagaaauguacag

SEQ ID NO: 3119118 - RNA, 15 nt, Human
uuuacuucuuauaca

SEQ ID NO: 3119119 - RNA, 19 nt, Human
uuuacuucuuauacauuug

SEQ ID NO: 3119120 - RNA, 22 nt, Human
uuuacuucuuauacauuugaua

SEQ ID NO: 3119121 - RNA, 14 nt, Human
uuuagaaauauaau

SEQ ID NO: 3119122 - RNA, 12 nt, Human
uuuagacagagu

SEQ ID NO: 3119123 - RNA, 20 nt, Human
uuguuagugugucuuagugu

SEQ ID NO: 3119124 - RNA, 22 nt, Human
uuguuaguaugaggcauuuguu

SEQ ID NO: 3119125 - RNA, 14 nt, Human
uuguuacauuuuua

SEQ ID NO: 3119126 - RNA, 19 nt, Human
uuguuaguaugaggcauuu

SEQ ID NO: 3119127 - RNA, 21 nt, Human
uuguuaguaugaggcauuugu

SEQ ID NO: 3119128 - RNA, 17 nt, Human
uugugcauuaucuagau

SEQ ID NO: 3119129 - RNA, 12 nt, Human
uugugcauuugg

SEQ ID NO: 3119130 - RNA, 22 nt, Human
uugugcauuaucuagauacugu

SEQ ID NO: 3119131 - RNA, 23 nt, Human
uugugcauuaucuagauacugua

SEQ ID NO: 3119132 - RNA, 20 nt, Human
uuguggauuuaacagaaaug

SEQ ID NO: 3119133 - RNA, 21 nt, Human
uuguggauuuaacagaaaugu

SEQ ID NO: 3119134 - RNA, 17 nt, Human
uuguggacacagcucuu

SEQ ID NO: 3119135 - RNA, 16 nt, Human
uuguggacacagcucu

SEQ ID NO: 3119136 - RNA, 13 nt, Human
uuguguucaccuu

SEQ ID NO: 3119137 - RNA, 22 nt, Human
uuguggauuuaacagaaaugua

SEQ ID NO: 3119138 - RNA, 23 nt, Human
uuguggauuuaacagaaauguac

SEQ ID NO: 3119139 - RNA, 21 nt, Human
uuguguuuauauauaagccaa

SEQ ID NO: 3119140 - RNA, 13 nt, Human
uuggucuguguga

SEQ ID NO: 3119141 - RNA, 22 nt, Human
uuggguucaagcgauucuucug

SEQ ID NO: 3119142 - RNA, 18 nt, Human
uuguacauaaugcgugca

SEQ ID NO: 3119143 - RNA, 14 nt, Human
uuguacauaaugcg

SEQ ID NO: 3119144 - RNA, 15 nt, Human
uuguaaauuaacuuu

SEQ ID NO: 3119145 - RNA, 16 nt, Human
uuguaaauuaacuuuu

SEQ ID NO: 3119146 - RNA, 18 nt, Human
uuguaaauuaacuuuuau

SEQ ID NO: 3119147 - RNA, 23 nt, Human
uuguaaauuaacuuuuauaaacu

SEQ ID NO: 3119148 - RNA, 17 nt, Human
uuguaaauagcucaggu

SEQ ID NO: 3119149 - RNA, 20 nt, Human
uugugaaaggaaagaggcuc

SEQ ID NO: 3119150 - RNA, 12 nt, Human
uugugauuuuug

SEQ ID NO: 3119151 - RNA, 16 nt, Human
uugugauuuuuguaau

SEQ ID NO: 3119152 - RNA, 17 nt, Human
uugugauuuuuguaauu

SEQ ID NO: 3119153 - RNA, 15 nt, Human
uugucuuaaaaagug

SEQ ID NO: 3119154 - RNA, 19 nt, Human
uuguauucucuccuguacc

SEQ ID NO: 3119155 - RNA, 15 nt, Human
uuguauucucuccug

SEQ ID NO: 3119156 - RNA, 16 nt, Human
uuguauucucuccugu

SEQ ID NO: 3119157 - RNA, 19 nt, Human
uucuguccuacucuguguc

SEQ ID NO: 3119158 - RNA, 18 nt, Human
uucuguauuuuguuuuug

SEQ ID NO: 3119159 - RNA, 14 nt, Human
uucugcuucagccu

SEQ ID NO: 3119160 - RNA, 15 nt, Human
uucugcuucagccuc

SEQ ID NO: 3119161 - RNA, 16 nt, Human
uucugcuucagccucc

SEQ ID NO: 3119162 - RNA, 19 nt, Human
uucugcuucagccucccga

SEQ ID NO: 3119163 - RNA, 21 nt, Human
uucuuuccaaaguacacuguu

SEQ ID NO: 3119164 - RNA, 20 nt, Human
uugaaaaaccauuuugcugu

SEQ ID NO: 3119165 - RNA, 23 nt, Human
uugaaaacacuguucucugcccu

SEQ ID NO: 3119166 - RNA, 22 nt, Human
uugaaaacacuguucucugccc

SEQ ID NO: 3119167 - RNA, 15 nt, Human
uugaacuccuggccu

SEQ ID NO: 3119168 - RNA, 16 nt, Human
uugaacuccuggccuc

SEQ ID NO: 3119169 - RNA, 12 nt, Human
uucuuucagcca

SEQ ID NO: 3119170 - RNA, 14 nt, Human
uucuuuccaaagua

SEQ ID NO: 3119171 - RNA, 21 nt, Human
uucuuguguguuuauugucaa

SEQ ID NO: 3119172 - RNA, 13 nt, Human
uucuuccucccuc

SEQ ID NO: 3119173 - RNA, 14 nt, Human
uucuuguguguuua

SEQ ID NO: 3119174 - RNA, 21 nt, Human
uucuuccacaagagcccaggc

SEQ ID NO: 3119175 - RNA, 21 nt, Human
uucuuauacauuugauaaagu

SEQ ID NO: 3119176 - RNA, 16 nt, Human
uugaugaucuuugcag

SEQ ID NO: 3119177 - RNA, 21 nt, Human
uugcaaaguaucccuacugua

SEQ ID NO: 3119178 - RNA, 13 nt, Human
uugaggguugggc

SEQ ID NO: 3119179 - RNA, 16 nt, Human
uugaggguugggcugg

SEQ ID NO: 3119180 - RNA, 11 nt, Human
uugagccuggg

SEQ ID NO: 3119181 - RNA, 23 nt, Human
uugauagcacagacccugcccug

SEQ ID NO: 3119182 - RNA, 23 nt, Human
uugauauccucuuugagugaagc

SEQ ID NO: 3119183 - RNA, 15 nt, Human
uugacgccaucccag

SEQ ID NO: 3119184 - RNA, 19 nt, Human
uugacgccaucccagcccc

SEQ ID NO: 3119185 - RNA, 18 nt, Human
uugacgccaucccagccc

SEQ ID NO: 3119186 - RNA, 17 nt, Human
uugacgccaucccagcc

SEQ ID NO: 3119187 - RNA, 21 nt, Human
uugaccucaggugauccaccc

SEQ ID NO: 3119188 - RNA, 14 nt, Human
uugaccucugcagc

SEQ ID NO: 3119189 - RNA, 15 nt, Human
uugaccucugcagca

SEQ ID NO: 3119190 - RNA, 17 nt, Human
uugaccgugaggccaga

SEQ ID NO: 3119191 - RNA, 18 nt, Human
uugaacuggguacuugug

SEQ ID NO: 3119192 - RNA, 14 nt, Human
uugaauuguaagga

SEQ ID NO: 3119193 - RNA, 21 nt, Human
uuccuugaguugauucagcuc

SEQ ID NO: 3119194 - RNA, 20 nt, Human
uuccuugaguugauucagcu

SEQ ID NO: 3119195 - RNA, 18 nt, Human
uuccugaagaauugaaaa

SEQ ID NO: 3119196 - RNA, 16 nt, Human
uuccauggccucuuca

SEQ ID NO: 3119197 - RNA, 12 nt, Human
uuccauggccuc

SEQ ID NO: 3119198 - RNA, 23 nt, Human
uuccugaugcuucuucagagacu

SEQ ID NO: 3119199 - RNA, 15 nt, Human
uuccugaggcugggc

SEQ ID NO: 3119200 - RNA, 20 nt, Human
uuccugaggcugggcucccu

SEQ ID NO: 3119201 - RNA, 12 nt, Human
uucuacccagcg

SEQ ID NO: 3119202 - RNA, 19 nt, Human
uucuacccagcgagcccug

SEQ ID NO: 3119203 - RNA, 13 nt, Human
uucuacgccaggg

SEQ ID NO: 3119204 - RNA, 20 nt, Human
uucuacccagcgagcccugg

SEQ ID NO: 3119205 - RNA, 21 nt, Human
uucuacccagcgagcccuggu

SEQ ID NO: 3119206 - RNA, 14 nt, Human
uucuacccaggugc

SEQ ID NO: 3119207 - RNA, 22 nt, Human
uucuacucgaguuacagacaaa

SEQ ID NO: 3119208 - RNA, 16 nt, Human
uucuccacccugcucu

SEQ ID NO: 3119209 - RNA, 20 nt, Human
uucuccaccugccagggaca

SEQ ID NO: 3119210 - RNA, 18 nt, Human
uucuccaccugccaggga

SEQ ID NO: 3119211 - RNA, 16 nt, Human
uucuccaccugccagg

SEQ ID NO: 3119212 - RNA, 15 nt, Human
uucuccaccugccag

SEQ ID NO: 3119213 - RNA, 14 nt, Human
uucuccaccugcca

SEQ ID NO: 3119214 - RNA, 12 nt, Human
uucuccaccugc

SEQ ID NO: 3119215 - RNA, 21 nt, Human
uucuccaccucccacaaagga

SEQ ID NO: 3119216 - RNA, 19 nt, Human
uucucuccuguaccucuug

SEQ ID NO: 3119217 - RNA, 14 nt, Human
uucucugaggacac

SEQ ID NO: 3119218 - RNA, 12 nt, Human
uucucugcccuc

SEQ ID NO: 3119219 - RNA, 11 nt, Human
uucucugcccu

SEQ ID NO: 3119220 - RNA, 14 nt, Human
uucucuccagcccc

SEQ ID NO: 3119221 - RNA, 13 nt, Human
uucucuccagccc

SEQ ID NO: 3119222 - RNA, 15 nt, Human
uucucuccagccccu

SEQ ID NO: 3119223 - RNA, 14 nt, Human
uucucuccuguacc

SEQ ID NO: 3119224 - RNA, 18 nt, Human
uucucuccuguaccucuu

SEQ ID NO: 3119225 - RNA, 19 nt, Human
uucugauccuaguuccacc

SEQ ID NO: 3119226 - RNA, 19 nt, Human
uucugcucacauaucuguc

SEQ ID NO: 3119227 - RNA, 18 nt, Human
uucugacccugcuucaaa

SEQ ID NO: 3119228 - RNA, 22 nt, Human
uucugacccaugcugcccugug

SEQ ID NO: 3119229 - RNA, 23 nt, Human
uucugacccaugcugcccuguga

SEQ ID NO: 3119230 - RNA, 16 nt, Human
uucucugcccuccaag

SEQ ID NO: 3119231 - RNA, 15 nt, Human
uuccauggacuuugu

SEQ ID NO: 3119232 - RNA, 14 nt, Human
uuccauggacuuug

SEQ ID NO: 3119233 - RNA, 19 nt, Human
uuccaacccucaucaccaa

SEQ ID NO: 3119234 - RNA, 16 nt, Human
uuccaaaguacacugu

SEQ ID NO: 3119235 - RNA, 13 nt, Human
uuccaaaguacac

SEQ ID NO: 3119236 - RNA, 15 nt, Human
uucauaaccuagccu

SEQ ID NO: 3119237 - RNA, 19 nt, Human
uucauccuccucagaucuu

SEQ ID NO: 3119238 - RNA, 15 nt, Human
uucauccuccucaga

SEQ ID NO: 3119239 - RNA, 13 nt, Human
uucaguguacaug

SEQ ID NO: 3119240 - RNA, 12 nt, Human
uucaguguacau

SEQ ID NO: 3119241 - RNA, 17 nt, Human
uucaguggcagcugcuu

SEQ ID NO: 3119242 - RNA, 15 nt, Human
uucaguggcagcugc

SEQ ID NO: 3119243 - RNA, 16 nt, Human
uucaguggcagcugcu

SEQ ID NO: 3119244 - RNA, 21 nt, Human
uucagcugguugagguuucaa

SEQ ID NO: 3119245 - RNA, 12 nt, Human
uucagcuccagc

SEQ ID NO: 3119246 - RNA, 15 nt, Human
uucagcuccagcuca

SEQ ID NO: 3119247 - RNA, 22 nt, Human
uucagcuuguaaauagcucagg

SEQ ID NO: 3119248 - RNA, 14 nt, Human
uucaguggcagcug

SEQ ID NO: 3119249 - RNA, 13 nt, Human
uucaguggcagcu

SEQ ID NO: 3119250 - RNA, 13 nt, Human
uucacggaagagc

SEQ ID NO: 3119251 - RNA, 22 nt, Human
uucaccuuuguccccaccgcag

SEQ ID NO: 3119252 - RNA, 16 nt, Human
uucagacagcugccug

SEQ ID NO: 3119253 - RNA, 15 nt, Human
uucagacagcugccu

SEQ ID NO: 3119254 - RNA, 14 nt, Human
uucagacagcugcc

SEQ ID NO: 3119255 - RNA, 17 nt, Human
uucacggaagagccuug

SEQ ID NO: 3119256 - RNA, 17 nt, Human
uucagacagcugccugg

SEQ ID NO: 3119257 - RNA, 13 nt, Human
uucacccuuuucu

SEQ ID NO: 3119258 - RNA, 14 nt, Human
uucaccuuuguccc

SEQ ID NO: 3119259 - RNA, 20 nt, Human
uucaccuuuguccccaccgc

SEQ ID NO: 3119260 - RNA, 19 nt, Human
uucaccuuuguccccaccg

SEQ ID NO: 3119261 - RNA, 21 nt, Human
uucaauaggaaaaacugauuu

SEQ ID NO: 3119262 - RNA, 22 nt, Human
uucaauaggaaaaacugauuuu

SEQ ID NO: 3119263 - RNA, 20 nt, Human
uucaauaggaaaaacugauu

SEQ ID NO: 3119264 - RNA, 22 nt, Human
uuauuuuggaaaauaaauuauu

SEQ ID NO: 3119265 - RNA, 21 nt, Human
uucaacagguuuuccugaaga

SEQ ID NO: 3119266 - RNA, 18 nt, Human
uuauuuuauuaugcauga

SEQ ID NO: 3119267 - RNA, 21 nt, Human
uuauuaaaugcccagccccuu

SEQ ID NO: 3119268 - RNA, 19 nt, Human
uuauuaaaugcccagcccc

SEQ ID NO: 3119269 - RNA, 17 nt, Human
uuauggaacacucugag

SEQ ID NO: 3119270 - RNA, 16 nt, Human
uuauggaacacucuga

SEQ ID NO: 3119271 - RNA, 21 nt, Human
uuauggacaaugacccagugg

SEQ ID NO: 3119272 - RNA, 20 nt, Human
uuauggaacacucugagacu

SEQ ID NO: 3119273 - RNA, 18 nt, Human
uuauggaacacucugaga

SEQ ID NO: 3119274 - RNA, 16 nt, Human
uuauggcuuuugugca

SEQ ID NO: 3119275 - RNA, 17 nt, Human
uuauggcuuuugugcau

SEQ ID NO: 3119276 - RNA, 11 nt, Human
uuauacauaaa

SEQ ID NO: 3119277 - RNA, 17 nt, Human
ugugaaaagaaaaauga

SEQ ID NO: 3119278 - RNA, 15 nt, Human
ugugaaaagaaaaau

SEQ ID NO: 3119279 - RNA, 13 nt, Human
ugugaaaagaaaa

SEQ ID NO: 3119280 - RNA, 18 nt, Human
uuauaauaauguuaacau

SEQ ID NO: 3119281 - RNA, 15 nt, Human
uuauaauaauguuaa

SEQ ID NO: 3119282 - RNA, 15 nt, Human
uuauaaugaaugaaa

SEQ ID NO: 3119283 - RNA, 13 nt, Human
uuuuuuuugacaa

SEQ ID NO: 3119284 - RNA, 15 nt, Human
uuuuacuaauagaca

SEQ ID NO: 3119285 - RNA, 13 nt, Human
uuuuauacauaaa

SEQ ID NO: 3119286 - RNA, 21 nt, Human
uuuuauacauaaacaagacca

SEQ ID NO: 3119287 - RNA, 19 nt, Human
uuuuaucgucacugcuuaa

SEQ ID NO: 3119288 - RNA, 17 nt, Human
uuuucaaaauaaaaaug

SEQ ID NO: 3119289 - RNA, 18 nt, Human
uuuuauuuuuagacagag

SEQ ID NO: 3119290 - RNA, 22 nt, Human
uuuucccuauuagagaagagau

SEQ ID NO: 3119291 - RNA, 18 nt, Human
uuuucccuauuagagaag

SEQ ID NO: 3119292 - RNA, 16 nt, Human
uuuucuuucagccaag

SEQ ID NO: 3119293 - RNA, 13 nt, Human
uuuucuucucccu

SEQ ID NO: 3119294 - RNA, 22 nt, Human
uuuucuuguguguuuauuguca

SEQ ID NO: 3119295 - RNA, 13 nt, Human
uuuucuacucgag

SEQ ID NO: 3119296 - RNA, 22 nt, Human
uuuucuacucgaguuacagaca

SEQ ID NO: 3119297 - RNA, 20 nt, Human
uuuucuacucgaguuacaga

SEQ ID NO: 3119298 - RNA, 17 nt, Human
uuuccguuaaaauacca

SEQ ID NO: 3119299 - RNA, 13 nt, Human
uuugagugccuua

SEQ ID NO: 3119300 - RNA, 15 nt, Human
uuuccguuaaaauac

SEQ ID NO: 3119301 - RNA, 21 nt, Human
uuugagugccuuacacaaugg

SEQ ID NO: 3119302 - RNA, 12 nt, Human
uuuggaaaauaa

SEQ ID NO: 3119303 - RNA, 15 nt, Human
uuuguugucagcuga

SEQ ID NO: 3119304 - RNA, 22 nt, Human
uuuguuaguaugaggcauuugu

SEQ ID NO: 3119305 - RNA, 15 nt, Human
uuuguauucucuccu

SEQ ID NO: 3119306 - RNA, 11 nt, Human
uuuuuuuacua

SEQ ID NO: 3119307 - RNA, 12 nt, Human
uuuuuuuuaaga

SEQ ID NO: 3119308 - RNA, 12 nt, Human
uuuuuaagaaaa

SEQ ID NO: 3119309 - RNA, 16 nt, Human
uuuuuaagugcugcau

SEQ ID NO: 3119310 - RNA, 17 nt, Human
uuuuuaagugcugcauu

SEQ ID NO: 3119311 - RNA, 18 nt, Human
uuuuuaagugcugcauuu

SEQ ID NO: 3119312 - RNA, 19 nt, Human
uuuuuaagugcugcauuua

SEQ ID NO: 3119313 - RNA, 22 nt, Human
uuuuuaagugcugcauuuaaaa

SEQ ID NO: 3119314 - RNA, 23 nt, Human
uuuuuaagugcugcauuuaaaag

SEQ ID NO: 3119315 - RNA, 11 nt, Human
uuuuuaaaugc

SEQ ID NO: 3119316 - RNA, 17 nt, Human
cauuugaaaauuuugau

SEQ ID NO: 3119317 - RNA, 19 nt, Human
cauuugaaaauuuugaugu

SEQ ID NO: 3119318 - RNA, 18 nt, Human
cauugaccugaggcccuu

SEQ ID NO: 3119319 - RNA, 14 nt, Human
cauugaccugaggc

SEQ ID NO: 3119320 - RNA, 17 nt, Human
cauugaccugaggcccu

SEQ ID NO: 3119321 - RNA, 15 nt, Human
cauugaccugaggcc

SEQ ID NO: 3119322 - RNA, 15 nt, Human
cauuuaaaaaaaauc

SEQ ID NO: 3119323 - RNA, 15 nt, Human
cauugugggaagggg

SEQ ID NO: 3119324 - RNA, 13 nt, Human
cauugugggaagg

SEQ ID NO: 3119325 - RNA, 21 nt, Human
cauuuuuaagugcugcauuua

SEQ ID NO: 3119326 - RNA, 17 nt, Human
cauuuuuaguagagaca

SEQ ID NO: 3119327 - RNA, 22 nt, Human
cauuugaggucuguucuuucca

SEQ ID NO: 3119328 - RNA, 13 nt, Human
cauuugcugaaua

SEQ ID NO: 3119329 - RNA, 22 nt, Human
cauuuuauuuuauuaugcauga

SEQ ID NO: 3119330 - RNA, 23 nt, Human
cauuuuauuuuauuaugcaugaa

SEQ ID NO: 3119331 - RNA, 23 nt, Human
cauucuucuguacgucugacagg

SEQ ID NO: 3119332 - RNA, 23 nt, Human
cauuccugaugcuucuucagaga

SEQ ID NO: 3119333 - RNA, 22 nt, Human
cauuccugaugcuucuucagag

SEQ ID NO: 3119334 - RNA, 19 nt, Human
cauuccugaugcuucuuca

SEQ ID NO: 3119335 - RNA, 16 nt, Human
cauuccugaugcuucu

SEQ ID NO: 3119336 - RNA, 14 nt, Human
cauuccugaugcuu

SEQ ID NO: 3119337 - RNA, 12 nt, Human
cauucugccugc

SEQ ID NO: 3119338 - RNA, 13 nt, Human
cauucugccugcc

SEQ ID NO: 3119339 - RNA, 15 nt, Human
cauucugccugccca

SEQ ID NO: 3119340 - RNA, 16 nt, Human
cauucugccugcccag

SEQ ID NO: 3119341 - RNA, 17 nt, Human
cauucugccugcccagg

SEQ ID NO: 3119342 - RNA, 18 nt, Human
cauucugccugcccaggc

SEQ ID NO: 3119343 - RNA, 19 nt, Human
cauucugccugcccaggcc

SEQ ID NO: 3119344 - RNA, 20 nt, Human
cauucugccugcccaggccc

SEQ ID NO: 3119345 - RNA, 17 nt, Human
cauucuguuaaucauua

SEQ ID NO: 3119346 - RNA, 20 nt, Human
cauuccccaggaggccagcc

SEQ ID NO: 3119347 - RNA, 19 nt, Human
cauuccccaggaggccagc

SEQ ID NO: 3119348 - RNA, 18 nt, Human
cauuccccaggaggccag

SEQ ID NO: 3119349 - RNA, 13 nt, Human
cauuccccaggag

SEQ ID NO: 3119350 - RNA, 17 nt, Human
cauuccccaggaggcca

SEQ ID NO: 3119351 - RNA, 15 nt, Human
cauuccccaggaggc

SEQ ID NO: 3119352 - RNA, 23 nt, Human
cauggucggaaaacaugcuacac

SEQ ID NO: 3119353 - RNA, 17 nt, Human
cauggucggaaaacaug

SEQ ID NO: 3119354 - RNA, 19 nt, Human
cauggucggaaaacaugcu

SEQ ID NO: 3119355 - RNA, 22 nt, Human
caugugccagguuuuuggucug

SEQ ID NO: 3119356 - RNA, 14 nt, Human
caugugcacaugca

SEQ ID NO: 3119357 - RNA, 15 nt, Human
caugugaugagagga

SEQ ID NO: 3119358 - RNA, 17 nt, Human
caugugaugagaggaaa

SEQ ID NO: 3119359 - RNA, 16 nt, Human
caugugaugagaggaa

SEQ ID NO: 3119360 - RNA, 20 nt, Human
caugugaugagaggaaauca

SEQ ID NO: 3119361 - RNA, 18 nt, Human
caugugaugagaggaaau

SEQ ID NO: 3119362 - RNA, 21 nt, Human
caugugaugagaggaaaucac

SEQ ID NO: 3119363 - RNA, 12 nt, Human
caugucuggcua

SEQ ID NO: 3119364 - RNA, 23 nt, Human
cauguuugauguaucugagcagg

SEQ ID NO: 3119365 - RNA, 12 nt, Human
cauguuugugau

SEQ ID NO: 3119366 - RNA, 14 nt, Human
cauguuugugauug

SEQ ID NO: 3119367 - RNA, 19 nt, Human
cauguuuuucuucucccuc

SEQ ID NO: 3119368 - RNA, 20 nt, Human
cauguuuuucuucucccuca

SEQ ID NO: 3119369 - RNA, 18 nt, Human
cauguuuuucuucucccu

SEQ ID NO: 3119370 - RNA, 15 nt, Human
cauggacuuccacug

SEQ ID NO: 3119371 - RNA, 15 nt, Human
caugcugucccuuac

SEQ ID NO: 3119372 - RNA, 13 nt, Human
caugcugucccuu

SEQ ID NO: 3119373 - RNA, 18 nt, Human
caugggccuccugugugu

SEQ ID NO: 3119374 - RNA, 14 nt, Human
cauccacugugcca

SEQ ID NO: 3119375 - RNA, 17 nt, Human
cauccacugugccaugu

SEQ ID NO: 3119376 - RNA, 23 nt, Human
cauccacugugccaugugccagg

SEQ ID NO: 3119377 - RNA, 17 nt, Human
cauccagguucagcuug

SEQ ID NO: 3119378 - RNA, 22 nt, Human
caucccugaaggccccgcccag

SEQ ID NO: 3119379 - RNA, 15 nt, Human
caucccucuggggcu

SEQ ID NO: 3119380 - RNA, 12 nt, Human
caucacccgcua

SEQ ID NO: 3119381 - RNA, 20 nt, Human
caucaccaacgucugugcca

SEQ ID NO: 3119382 - RNA, 16 nt, Human
caucauccuaagcuau

SEQ ID NO: 3119383 - RNA, 13 nt, Human
caucaugucuggc

SEQ ID NO: 3119384 - RNA, 14 nt, Human
caucaugucuggcu

SEQ ID NO: 3119385 - RNA, 15 nt, Human
caucaugucuggcua

SEQ ID NO: 3119386 - RNA, 14 nt, Human
caucaacaucuugg

SEQ ID NO: 3119387 - RNA, 16 nt, Human
cauaguaugguggcug

SEQ ID NO: 3119388 - RNA, 15 nt, Human
cauaguaugguggcu

SEQ ID NO: 3119389 - RNA, 23 nt, Human
cauauaagauucauauuuacuuc

SEQ ID NO: 3119390 - RNA, 23 nt, Human
cauauauauguuuuaagaggcag

SEQ ID NO: 3119391 - RNA, 21 nt, Human
cauauugauuuccguuaaaau

SEQ ID NO: 3119392 - RNA, 22 nt, Human
cauauucuguuggccaguguga

SEQ ID NO: 3119393 - RNA, 18 nt, Human
cauauucuguuggccagu

SEQ ID NO: 3119394 - RNA, 17 nt, Human
cauauugauuuccguua

SEQ ID NO: 3119395 - RNA, 13 nt, Human
caugaaaacacau

SEQ ID NO: 3119396 - RNA, 14 nt, Human
caugaaaacacauu

SEQ ID NO: 3119397 - RNA, 15 nt, Human
caugaaaacacauuu

SEQ ID NO: 3119398 - RNA, 16 nt, Human
caugaaaacacauuuu

SEQ ID NO: 3119399 - RNA, 17 nt, Human
caugaaaacacauuuuu

SEQ ID NO: 3119400 - RNA, 19 nt, Human
caugaaaacacauuuuucu

SEQ ID NO: 3119401 - RNA, 21 nt, Human
caugaaaacacauuuuucuua

SEQ ID NO: 3119402 - RNA, 22 nt, Human
caugagccucagcauccuggca

SEQ ID NO: 3119403 - RNA, 23 nt, Human
caugagccucagcauccuggcac

SEQ ID NO: 3119404 - RNA, 21 nt, Human
caugaggaacaaggcaaggcu

SEQ ID NO: 3119405 - RNA, 20 nt, Human
caugaggaacaaggcaaggc

SEQ ID NO: 3119406 - RNA, 17 nt, Human
caugaggaacaaggcaa

SEQ ID NO: 3119407 - RNA, 16 nt, Human
caugaggaacaaggca

SEQ ID NO: 3119408 - RNA, 23 nt, Human
caugaggaacaaggcaaggcugu

SEQ ID NO: 3119409 - RNA, 23 nt, Human
caugaguccccuguuuguuucug

SEQ ID NO: 3119410 - RNA, 15 nt, Human
caugaguccccuguu

SEQ ID NO: 3119411 - RNA, 14 nt, Human
caugaguccccugu

SEQ ID NO: 3119412 - RNA, 13 nt, Human
caugaguccccug

SEQ ID NO: 3119413 - RNA, 12 nt, Human
caugagccucag

SEQ ID NO: 3119414 - RNA, 15 nt, Human
caugagccucagcau

SEQ ID NO: 3119415 - RNA, 17 nt, Human
caugagccucagcaucc

SEQ ID NO: 3119416 - RNA, 18 nt, Human
caugagccucagcauccu

SEQ ID NO: 3119417 - RNA, 19 nt, Human
caugagccucagcauccug

SEQ ID NO: 3119418 - RNA, 20 nt, Human
caugagccucagcauccugg

SEQ ID NO: 3119419 - RNA, 21 nt, Human
caugagccucagcauccuggc

SEQ ID NO: 3119420 - RNA, 23 nt, Human
caugagcaucaggccaggcccuc

SEQ ID NO: 3119421 - RNA, 22 nt, Human
caugagcaucaggccaggcccu

SEQ ID NO: 3119422 - RNA, 21 nt, Human
caugagcaucaggccaggccc

SEQ ID NO: 3119423 - RNA, 20 nt, Human
caugagcaucaggccaggcc

SEQ ID NO: 3119424 - RNA, 18 nt, Human
caugagcaucaggccagg

SEQ ID NO: 3119425 - RNA, 17 nt, Human
caugagcaucaggccag

SEQ ID NO: 3119426 - RNA, 16 nt, Human
caugagcaucaggcca

SEQ ID NO: 3119427 - RNA, 15 nt, Human
caugagcaucaggcc

SEQ ID NO: 3119428 - RNA, 13 nt, Human
caugagcaucagg

SEQ ID NO: 3119429 - RNA, 21 nt, Human
caucuugaauuguaaggaaug

SEQ ID NO: 3119430 - RNA, 16 nt, Human
caucuugaauuguaag

SEQ ID NO: 3119431 - RNA, 15 nt, Human
caucuugcucugcug

SEQ ID NO: 3119432 - RNA, 16 nt, Human
caucuugcucugcuga

SEQ ID NO: 3119433 - RNA, 17 nt, Human
caucuugcucugcugac

SEQ ID NO: 3119434 - RNA, 16 nt, Human
caucucuacaaaaagc

SEQ ID NO: 3119435 - RNA, 15 nt, Human
caucucuccuccuuu

SEQ ID NO: 3119436 - RNA, 15 nt, Human
ccagcaagugagagc

SEQ ID NO: 3119437 - RNA, 14 nt, Human
ccagauuucacucu

SEQ ID NO: 3119438 - RNA, 20 nt, Human
ccagcaagugagagcugggu

SEQ ID NO: 3119439 - RNA, 21 nt, Human
ccagcaagugagagcugggug

SEQ ID NO: 3119440 - RNA, 22 nt, Human
ccagcaagugagagcugggugu

SEQ ID NO: 3119441 - RNA, 13 nt, Human
ccagccccagugc

SEQ ID NO: 3119442 - RNA, 15 nt, Human
ccagccccagugccc

SEQ ID NO: 3119443 - RNA, 23 nt, Human
ccagccccaaaacucuccucugc

SEQ ID NO: 3119444 - RNA, 16 nt, Human
ccagccccagugccca

SEQ ID NO: 3119445 - RNA, 16 nt, Human
ccagcccuuagcaggg

SEQ ID NO: 3119446 - RNA, 17 nt, Human
ccagcccuuagcaggga

SEQ ID NO: 3119447 - RNA, 23 nt, Human
ccagccgagauagccaaggccaa

SEQ ID NO: 3119448 - RNA, 14 nt, Human
ccagccgccaugcu

SEQ ID NO: 3119449 - RNA, 18 nt, Human
ccagccgccaugcuccug

SEQ ID NO: 3119450 - RNA, 19 nt, Human
ccagccaaagccuccucca

SEQ ID NO: 3119451 - RNA, 18 nt, Human
ccagccaaagccuccucc

SEQ ID NO: 3119452 - RNA, 15 nt, Human
ccagccaaagccucc

SEQ ID NO: 3119453 - RNA, 11 nt, Human
ccagagcugcc

SEQ ID NO: 3119454 - RNA, 13 nt, Human
ccagagcugccac

SEQ ID NO: 3119455 - RNA, 12 nt, Human
ccagagcugcca

SEQ ID NO: 3119456 - RNA, 19 nt, Human
ccagagcugccaccugccu

SEQ ID NO: 3119457 - RNA, 16 nt, Human
ccagagcugccaccug

SEQ ID NO: 3119458 - RNA, 15 nt, Human
ccagagcugccaccu

SEQ ID NO: 3119459 - RNA, 14 nt, Human
ccagagcugccacc

SEQ ID NO: 3119460 - RNA, 16 nt, Human
ccagagggagugacag

SEQ ID NO: 3119461 - RNA, 17 nt, Human
ccagagggagugacaga

SEQ ID NO: 3119462 - RNA, 18 nt, Human
ccagagggagugacagag

SEQ ID NO: 3119463 - RNA, 19 nt, Human
ccagagggagugacagagg

SEQ ID NO: 3119464 - RNA, 20 nt, Human
ccagagggagugacagaggc

SEQ ID NO: 3119465 - RNA, 21 nt, Human
ccagagggagugacagaggca

SEQ ID NO: 3119466 - RNA, 21 nt, Human
ccagaggagagaggacccccu

SEQ ID NO: 3119467 - RNA, 22 nt, Human
ccagaggagagaggacccccug

SEQ ID NO: 3119468 - RNA, 21 nt, Human
ccagagaggguggugaccucu

SEQ ID NO: 3119469 - RNA, 23 nt, Human
ccagagaggguggugaccucugc

SEQ ID NO: 3119470 - RNA, 14 nt, Human
ccagagaggguggu

SEQ ID NO: 3119471 - RNA, 13 nt, Human
ccagagagggugg

SEQ ID NO: 3119472 - RNA, 17 nt, Human
ccagacaccuugacagg

SEQ ID NO: 3119473 - RNA, 19 nt, Human
ccagacaccuugacagggc

SEQ ID NO: 3119474 - RNA, 18 nt, Human
ccagauucuuuccugagg

SEQ ID NO: 3119475 - RNA, 22 nt, Human
ccagauucuuuccugaggcugg

SEQ ID NO: 3119476 - RNA, 21 nt, Human
ccagauucuuuccugaggcug

SEQ ID NO: 3119477 - RNA, 20 nt, Human
ccagauucuuuccugaggcu

SEQ ID NO: 3119478 - RNA, 19 nt, Human
ccagauucuuuccugaggc

SEQ ID NO: 3119479 - RNA, 13 nt, Human
ccagagggccugc

SEQ ID NO: 3119480 - RNA, 22 nt, Human
ccagagggagugacagaggcag

SEQ ID NO: 3119481 - RNA, 23 nt, Human
ccagagggagugacagaggcagc

SEQ ID NO: 3119482 - RNA, 23 nt, Human
ccagaugcaccagcccuuagcag

SEQ ID NO: 3119483 - RNA, 16 nt, Human
ccagagggccugcaag

SEQ ID NO: 3119484 - RNA, 15 nt, Human
ccagagggccugcaa

SEQ ID NO: 3119485 - RNA, 19 nt, Human
ccagauugcaacaggcugg

SEQ ID NO: 3119486 - RNA, 20 nt, Human
ccagauugcaacaggcuggg

SEQ ID NO: 3119487 - RNA, 23 nt, Human
ccagauucuuuccugaggcuggg

SEQ ID NO: 3119488 - RNA, 18 nt, Human
ccagauugcaacaggcug

SEQ ID NO: 3119489 - RNA, 12 nt, Human
ccagauuucacu

SEQ ID NO: 3119490 - RNA, 21 nt, Human
ccagauugcaacaggcugggc

SEQ ID NO: 3119491 - RNA, 13 nt, Human
ccacguuucuaaa

SEQ ID NO: 3119492 - RNA, 18 nt, Human
ccacugcacuccagccug

SEQ ID NO: 3119493 - RNA, 15 nt, Human
ccacucccugcaacc

SEQ ID NO: 3119494 - RNA, 19 nt, Human
ccacugcacuccagccugg

SEQ ID NO: 3119495 - RNA, 20 nt, Human
ccacugcacuccagccuggg

SEQ ID NO: 3119496 - RNA, 16 nt, Human
ccacugcgaccacaag

SEQ ID NO: 3119497 - RNA, 23 nt, Human
ccacuacggaauaguuggcuagg

SEQ ID NO: 3119498 - RNA, 22 nt, Human
ccacuacggaauaguuggcuag

SEQ ID NO: 3119499 - RNA, 18 nt, Human
ccacuacauucuguuaau

SEQ ID NO: 3119500 - RNA, 13 nt, Human
ccacucccugcaa

SEQ ID NO: 3119501 - RNA, 12 nt, Human
ccacucccugca

SEQ ID NO: 3119502 - RNA, 18 nt, Human
ccacucaguccauagcag

SEQ ID NO: 3119503 - RNA, 16 nt, Human
ccaccuggccucugca

SEQ ID NO: 3119504 - RNA, 15 nt, Human
ccaccuggccucugc

SEQ ID NO: 3119505 - RNA, 22 nt, Human
ccaccugcggugcuaucucccc

SEQ ID NO: 3119506 - RNA, 14 nt, Human
ccaccuggccucug

SEQ ID NO: 3119507 - RNA, 17 nt, Human
ccaccuggccucugcac

SEQ ID NO: 3119508 - RNA, 12 nt, Human
ccacggccaggc

SEQ ID NO: 3119509 - RNA, 13 nt, Human
ccacggccaggcc

SEQ ID NO: 3119510 - RNA, 14 nt, Human
ccacggccaggcca

SEQ ID NO: 3119511 - RNA, 15 nt, Human
ccacggccaggccag

SEQ ID NO: 3119512 - RNA, 16 nt, Human
ccaccugccagggaca

SEQ ID NO: 3119513 - RNA, 20 nt, Human
ccaccugccuguugggccag

SEQ ID NO: 3119514 - RNA, 17 nt, Human
ccaccugccuguugggc

SEQ ID NO: 3119515 - RNA, 17 nt, Human
ccaccucccacaaagga

SEQ ID NO: 3119516 - RNA, 12 nt, Human
ccacccaggagc

SEQ ID NO: 3119517 - RNA, 14 nt, Human
ccacccaggagccc

SEQ ID NO: 3119518 - RNA, 12 nt, Human
ccaccucagccu

SEQ ID NO: 3119519 - RNA, 17 nt, Human
ccacccugaaagcccug

SEQ ID NO: 3119520 - RNA, 16 nt, Human
ccacccugaaagcccu

SEQ ID NO: 3119521 - RNA, 13 nt, Human
ccaccucagccuc

SEQ ID NO: 3119522 - RNA, 14 nt, Human
ccaccucagccucc

SEQ ID NO: 3119523 - RNA, 15 nt, Human
ccaccucagccuccc

SEQ ID NO: 3119524 - RNA, 13 nt, Human
ccacacccagccc

SEQ ID NO: 3119525 - RNA, 14 nt, Human
ccacacccagccca

SEQ ID NO: 3119526 - RNA, 12 nt, Human
ccacacccagcc

SEQ ID NO: 3119527 - RNA, 16 nt, Human
ccacccaccucagccu

SEQ ID NO: 3119528 - RNA, 14 nt, Human
ccacccaccucagc

SEQ ID NO: 3119529 - RNA, 15 nt, Human
ccacccaccucagcc

SEQ ID NO: 3119530 - RNA, 13 nt, Human
ccacccaccucag

SEQ ID NO: 3119531 - RNA, 22 nt, Human
ccacccaagggccuggccugag

SEQ ID NO: 3119532 - RNA, 21 nt, Human
ccacccaagggccuggccuga

SEQ ID NO: 3119533 - RNA, 20 nt, Human
ccacccaagggccuggccug

SEQ ID NO: 3119534 - RNA, 16 nt, Human
ccacccaagggccugg

SEQ ID NO: 3119535 - RNA, 19 nt, Human
ccacccaagggccuggccu

SEQ ID NO: 3119536 - RNA, 17 nt, Human
ccacccaagggccuggc

SEQ ID NO: 3119537 - RNA, 14 nt, Human
ccaccacacccagc

SEQ ID NO: 3119538 - RNA, 16 nt, Human
ccaccacacccagccc

SEQ ID NO: 3119539 - RNA, 20 nt, Human
ccaccaacauacucccaucu

SEQ ID NO: 3119540 - RNA, 18 nt, Human
ccaccaacauacucccau

SEQ ID NO: 3119541 - RNA, 14 nt, Human
ccaccaacauacuc

SEQ ID NO: 3119542 - RNA, 16 nt, Human
ccacaucuugcucugc

SEQ ID NO: 3119543 - RNA, 20 nt, Human
ccacaucuugcucugcugac

SEQ ID NO: 3119544 - RNA, 22 nt, Human
ccacaucuugcucugcugacag

SEQ ID NO: 3119545 - RNA, 23 nt, Human
ccacaucuugcucugcugacaga

SEQ ID NO: 3119546 - RNA, 14 nt, Human
ccacaucuugcucu

SEQ ID NO: 3119547 - RNA, 18 nt, Human
ccauucuccaccugccag

SEQ ID NO: 3119548 - RNA, 17 nt, Human
ccauguuggccaggcug

SEQ ID NO: 3119549 - RNA, 16 nt, Human
ccauguuggccaggcu

SEQ ID NO: 3119550 - RNA, 19 nt, Human
ccauauucuguuggccagu

SEQ ID NO: 3119551 - RNA, 22 nt, Human
cccaaauggaaaugggcagagc

SEQ ID NO: 3119552 - RNA, 18 nt, Human
cccaaauggaaaugggca

SEQ ID NO: 3119553 - RNA, 16 nt, Human
cccaaagugcugggau

SEQ ID NO: 3119554 - RNA, 20 nt, Human
ccauucuccaccugccaggg

SEQ ID NO: 3119555 - RNA, 19 nt, Human
ccauucuccaccugccagg

SEQ ID NO: 3119556 - RNA, 14 nt, Human
ccauuuguguuuau

SEQ ID NO: 3119557 - RNA, 13 nt, Human
cccaaagugcugg

SEQ ID NO: 3119558 - RNA, 15 nt, Human
cccaaagugcuggga

SEQ ID NO: 3119559 - RNA, 18 nt, Human
cccaaaacucuccucugc

SEQ ID NO: 3119560 - RNA, 16 nt, Human
cccaaaacucuccucu

SEQ ID NO: 3119561 - RNA, 22 nt, Human
ccaguguuguggauuuaacaga

SEQ ID NO: 3119562 - RNA, 23 nt, Human
ccauauucuguuggccaguguga

SEQ ID NO: 3119563 - RNA, 23 nt, Human
ccagugcccacaggaucagucug

SEQ ID NO: 3119564 - RNA, 16 nt, Human
ccagugaggcucugcc

SEQ ID NO: 3119565 - RNA, 15 nt, Human
ccagugaggcucugc

SEQ ID NO: 3119566 - RNA, 14 nt, Human
ccagugaggcucug

SEQ ID NO: 3119567 - RNA, 22 nt, Human
ccagugguuccuaauccucuag

SEQ ID NO: 3119568 - RNA, 20 nt, Human
ccagugccgagaaggaagcc

SEQ ID NO: 3119569 - RNA, 15 nt, Human
ccagguucagcuugu

SEQ ID NO: 3119570 - RNA, 24 nt, Human
ccaggugcacaagcuccaagcucc

SEQ ID NO: 3119571 - RNA, 17 nt, Human
ccagguuuuuggucuga

SEQ ID NO: 3119572 - RNA, 19 nt, Human
ccagucuggaaugcagugg

SEQ ID NO: 3119573 - RNA, 20 nt, Human
ccagucuggaaugcaguggu

SEQ ID NO: 3119574 - RNA, 13 nt, Human
ccagugaggcucu

SEQ ID NO: 3119575 - RNA, 18 nt, Human
ccagucuggaaugcagug

SEQ ID NO: 3119576 - RNA, 18 nt, Human
ccaggugcacaagcucca

SEQ ID NO: 3119577 - RNA, 20 nt, Human
ccaggugcacaagcuccaag

SEQ ID NO: 3119578 - RNA, 19 nt, Human
ccaggugcacaagcuccaa

SEQ ID NO: 3119579 - RNA, 21 nt, Human
ccagggacagaggggguggcc

SEQ ID NO: 3119580 - RNA, 15 nt, Human
ccagggacagagggg

SEQ ID NO: 3119581 - RNA, 14 nt, Human
ccagggacagaggg

SEQ ID NO: 3119582 - RNA, 20 nt, Human
ccaggcuuagucacugagac

SEQ ID NO: 3119583 - RNA, 22 nt, Human
ccagggacagaggggguggccu

SEQ ID NO: 3119584 - RNA, 21 nt, Human
ccaggcauuccccaggaggcc

SEQ ID NO: 3119585 - RNA, 19 nt, Human
ccaggcauuccccaggagg

SEQ ID NO: 3119586 - RNA, 18 nt, Human
ccaggcauuccccaggag

SEQ ID NO: 3119587 - RNA, 17 nt, Human
ccaggcauuccccagga

SEQ ID NO: 3119588 - RNA, 19 nt, Human
ccaggagccuccugcccuu

SEQ ID NO: 3119589 - RNA, 20 nt, Human
ccaggagccccgaggccuuc

SEQ ID NO: 3119590 - RNA, 16 nt, Human
ccaggagccccgaggc

SEQ ID NO: 3119591 - RNA, 19 nt, Human
ccaggagccccgaggccuu

SEQ ID NO: 3119592 - RNA, 24 nt, Human
ccaggcuguaucccaugagccuca

SEQ ID NO: 3119593 - RNA, 17 nt, Human
ccaggcuuagucacuga

SEQ ID NO: 3119594 - RNA, 23 nt, Human
ccaggcccucugcccacucccug

SEQ ID NO: 3119595 - RNA, 22 nt, Human
ccaggcccucugcccacucccu

SEQ ID NO: 3119596 - RNA, 21 nt, Human
ccaggcccucugcccacuccc

SEQ ID NO: 3119597 - RNA, 20 nt, Human
ccaggcccucugcccacucc

SEQ ID NO: 3119598 - RNA, 15 nt, Human
ccuggccagaugcac

SEQ ID NO: 3119599 - RNA, 22 nt, Human
ccuggcacccggccccugcugg

SEQ ID NO: 3119600 - RNA, 21 nt, Human
ccuggcacccggccccugcug

SEQ ID NO: 3119601 - RNA, 23 nt, Human
ccuggcacccggccccugcuggu

SEQ ID NO: 3119602 - RNA, 13 nt, Human
ccuggcagccccu

SEQ ID NO: 3119603 - RNA, 12 nt, Human
ccuggcagcccc

SEQ ID NO: 3119604 - RNA, 18 nt, Human
ccuggaauauauaaccag

SEQ ID NO: 3119605 - RNA, 21 nt, Human
ccugcucuccgaccagacacc

SEQ ID NO: 3119606 - RNA, 22 nt, Human
ccugcggugcuaucucccccag

SEQ ID NO: 3119607 - RNA, 22 nt, Human
ccugcucuccgaccagacaccu

SEQ ID NO: 3119608 - RNA, 14 nt, Human
ccugcuucaaauau

SEQ ID NO: 3119609 - RNA, 17 nt, Human
ccugcggugcuaucucc

SEQ ID NO: 3119610 - RNA, 16 nt, Human
ccugcggugcuaucuc

SEQ ID NO: 3119611 - RNA, 22 nt, Human
ccugccccucaacucuccucca

SEQ ID NO: 3119612 - RNA, 23 nt, Human
ccugccuguugggccaggagccu

SEQ ID NO: 3119613 - RNA, 15 nt, Human
ccugauugugucucu

SEQ ID NO: 3119614 - RNA, 22 nt, Human
ccugaugcuucuucagagacuc

SEQ ID NO: 3119615 - RNA, 21 nt, Human
ccugaugcuucuucagagacu

SEQ ID NO: 3119616 - RNA, 20 nt, Human
ccugaugcuucuucagagac

SEQ ID NO: 3119617 - RNA, 19 nt, Human
ccugaugcuucuucagaga

SEQ ID NO: 3119618 - RNA, 12 nt, Human
ccugaggcccuu

SEQ ID NO: 3119619 - RNA, 11 nt, Human
ccugaggcccu

SEQ ID NO: 3119620 - RNA, 19 nt, Human
ccugauugugucucuuggu

SEQ ID NO: 3119621 - RNA, 17 nt, Human
ccugauugugucucuug

SEQ ID NO: 3119622 - RNA, 21 nt, Human
ccugcaaccugauugugucuc

SEQ ID NO: 3119623 - RNA, 22 nt, Human
ccugcaaccugauugugucucu

SEQ ID NO: 3119624 - RNA, 14 nt, Human
ccugcaagaacaag

SEQ ID NO: 3119625 - RNA, 23 nt, Human
ccugcaggcagccaggccacaag

SEQ ID NO: 3119626 - RNA, 16 nt, Human
ccugccagggacagag

SEQ ID NO: 3119627 - RNA, 15 nt, Human
ccugccagggacaga

SEQ ID NO: 3119628 - RNA, 14 nt, Human
ccugccagggacag

SEQ ID NO: 3119629 - RNA, 13 nt, Human
ccugccagggaca

SEQ ID NO: 3119630 - RNA, 12 nt, Human
ccugccagggac

SEQ ID NO: 3119631 - RNA, 22 nt, Human
ccugccaggaagccagcaggcu

SEQ ID NO: 3119632 - RNA, 21 nt, Human
ccugccaggaagccagcaggc

SEQ ID NO: 3119633 - RNA, 19 nt, Human
ccugccaggaagccagcag

SEQ ID NO: 3119634 - RNA, 18 nt, Human
ccugccaggaagccagca

SEQ ID NO: 3119635 - RNA, 11 nt, Human
ccugccaggga

SEQ ID NO: 3119636 - RNA, 16 nt, Human
ccugccaggcauggug

SEQ ID NO: 3119637 - RNA, 23 nt, Human
ccugccaggaagccagcaggcuc

SEQ ID NO: 3119638 - RNA, 15 nt, Human
ccugccaggcauggu

SEQ ID NO: 3119639 - RNA, 17 nt, Human
ccugccaggaagccagc

SEQ ID NO: 3119640 - RNA, 15 nt, Human
ccugccaggaagcca

SEQ ID NO: 3119641 - RNA, 14 nt, Human
ccugccaggaagcc

SEQ ID NO: 3119642 - RNA, 13 nt, Human
ccugccaggaagc

SEQ ID NO: 3119643 - RNA, 23 nt, Human
ccugacaacacucauugaccuga

SEQ ID NO: 3119644 - RNA, 20 nt, Human
ccugagccagauuucacucu

SEQ ID NO: 3119645 - RNA, 14 nt, Human
ccugagcuuucugc

SEQ ID NO: 3119646 - RNA, 18 nt, Human
ccugaggcccagagggcc

SEQ ID NO: 3119647 - RNA, 21 nt, Human
ccugaggcccagagggccugc

SEQ ID NO: 3119648 - RNA, 16 nt, Human
ccugagcuuucugcua

SEQ ID NO: 3119649 - RNA, 15 nt, Human
cgagcccugguggca

SEQ ID NO: 3119650 - RNA, 16 nt, Human
cgagcccugguggcag

SEQ ID NO: 3119651 - RNA, 18 nt, Human
cgagcaugccuggauggg

SEQ ID NO: 3119652 - RNA, 20 nt, Human
cgauuucuguuuagauaaua

SEQ ID NO: 3119653 - RNA, 14 nt, Human
cgcagcccugcaga

SEQ ID NO: 3119654 - RNA, 16 nt, Human
cgcagacaggaccagg

SEQ ID NO: 3119655 - RNA, 15 nt, Human
cgcagacaggaccag

SEQ ID NO: 3119656 - RNA, 22 nt, Human
cgccaggggaaaaucagccugc

SEQ ID NO: 3119657 - RNA, 21 nt, Human
cgccagauucuuuccugaggc

SEQ ID NO: 3119658 - RNA, 20 nt, Human
cgccagauucuuuccugagg

SEQ ID NO: 3119659 - RNA, 19 nt, Human
cgccagauucuuuccugag

SEQ ID NO: 3119660 - RNA, 17 nt, Human
cgccagauucuuuccug

SEQ ID NO: 3119661 - RNA, 17 nt, Human
cgccaugcuccuggccc

SEQ ID NO: 3119662 - RNA, 13 nt, Human
cgaauagcuggga

SEQ ID NO: 3119663 - RNA, 14 nt, Human
cgaauagcugggac

SEQ ID NO: 3119664 - RNA, 17 nt, Human
cgagaucacgccacugc

SEQ ID NO: 3119665 - RNA, 18 nt, Human
cgagauagccaaggccaa

SEQ ID NO: 3119666 - RNA, 20 nt, Human
cgagcaggcuucuucccccc

SEQ ID NO: 3119667 - RNA, 17 nt, Human
cgagcaugccuggaugg

SEQ ID NO: 3119668 - RNA, 16 nt, Human
cgagcaugccuggaug

SEQ ID NO: 3119669 - RNA, 13 nt, Human
cgagcaugccugg

SEQ ID NO: 3119670 - RNA, 14 nt, Human
cgagcaugccugga

SEQ ID NO: 3119671 - RNA, 20 nt, Human
cgagauugcaccacugcacu

SEQ ID NO: 3119672 - RNA, 18 nt, Human
cgagaucacgccacugca

SEQ ID NO: 3119673 - RNA, 20 nt, Human
cgagaucacgccacugcacu

SEQ ID NO: 3119674 - RNA, 22 nt, Human
ccuuugacgccaucccagcccc

SEQ ID NO: 3119675 - RNA, 21 nt, Human
ccuuugacgccaucccagccc

SEQ ID NO: 3119676 - RNA, 20 nt, Human
ccuuugacgccaucccagcc

SEQ ID NO: 3119677 - RNA, 20 nt, Human
cgaaaacguggcugcuucaa

SEQ ID NO: 3119678 - RNA, 15 nt, Human
cgaaaacguggcugc

SEQ ID NO: 3119679 - RNA, 19 nt, Human
cgaaaacguggcugcuuca

SEQ ID NO: 3119680 - RNA, 18 nt, Human
cgaaaacguggcugcuuc

SEQ ID NO: 3119681 - RNA, 19 nt, Human
cgaaagggacuuggaagcu

SEQ ID NO: 3119682 - RNA, 20 nt, Human
cgaaaggaugaaagugacca

SEQ ID NO: 3119683 - RNA, 22 nt, Human
cgaaagggacuuggaagcuccg

SEQ ID NO: 3119684 - RNA, 12 nt, Human
cgaacuggcugc

SEQ ID NO: 3119685 - RNA, 14 nt, Human
cgaacuggcugcaa

SEQ ID NO: 3119686 - RNA, 21 nt, Human
ccuuggugucgggcaugacac

SEQ ID NO: 3119687 - RNA, 22 nt, Human
ccuuggugucgggcaugacacg

SEQ ID NO: 3119688 - RNA, 22 nt, Human
ccuugguuaggcauugugggaa

SEQ ID NO: 3119689 - RNA, 21 nt, Human
ccuugguuaggcauuguggga

SEQ ID NO: 3119690 - RNA, 18 nt, Human
ccuuugacgccaucccag

SEQ ID NO: 3119691 - RNA, 17 nt, Human
ccuuugacgccauccca

SEQ ID NO: 3119692 - RNA, 16 nt, Human
ccuuugacgccauccc

SEQ ID NO: 3119693 - RNA, 15 nt, Human
ccuucggcgccuuaa

SEQ ID NO: 3119694 - RNA, 19 nt, Human
ccuucuccuucaccuuugu

SEQ ID NO: 3119695 - RNA, 15 nt, Human
ccuucuccuucaccu

SEQ ID NO: 3119696 - RNA, 23 nt, Human
ccuugaccauucuccaccugcca

SEQ ID NO: 3119697 - RNA, 22 nt, Human
ccuugaccauucuccaccugcc

SEQ ID NO: 3119698 - RNA, 13 nt, Human
ccuugacucuuuc

SEQ ID NO: 3119699 - RNA, 19 nt, Human
ccuugaacuuugaccucug

SEQ ID NO: 3119700 - RNA, 17 nt, Human
ccuucacagaugggugc

SEQ ID NO: 3119701 - RNA, 20 nt, Human
ccuucaccuuuguccccacc

SEQ ID NO: 3119702 - RNA, 19 nt, Human
ccuucaccuuuguccccac

SEQ ID NO: 3119703 - RNA, 21 nt, Human
ccuucaccuuuguccccaccg

SEQ ID NO: 3119704 - RNA, 10 nt, Human
ccuucagugc

SEQ ID NO: 3119705 - RNA, 11 nt, Human
ccuucagugcc

SEQ ID NO: 3119706 - RNA, 14 nt, Human
ccuucagugccaaa

SEQ ID NO: 3119707 - RNA, 19 nt, Human
ccuucauuuggcauucccc

SEQ ID NO: 3119708 - RNA, 22 nt, Human
ccuucauuuggcauuccccacu

SEQ ID NO: 3119709 - RNA, 17 nt, Human
ccuuagaagucacacag

SEQ ID NO: 3119710 - RNA, 18 nt, Human
ccuuagaagucacacagu

SEQ ID NO: 3119711 - RNA, 19 nt, Human
ccuuaccugccaggaagcc

SEQ ID NO: 3119712 - RNA, 14 nt, Human
ccuuaccugccagg

SEQ ID NO: 3119713 - RNA, 15 nt, Human
ccuuacccucauguu

SEQ ID NO: 3119714 - RNA, 20 nt, Human
ccuuaccagcagagcaccuu

SEQ ID NO: 3119715 - RNA, 17 nt, Human
ccuuaccagcagagcac

SEQ ID NO: 3119716 - RNA, 13 nt, Human
ccuuaccagcaga

SEQ ID NO: 3119717 - RNA, 20 nt, Human
ccuuacacaaugguuuucuu

SEQ ID NO: 3119718 - RNA, 14 nt, Human
ccuuacacaauggu

SEQ ID NO: 3119719 - RNA, 17 nt, Human
ccugugucuugcaaugg

SEQ ID NO: 3119720 - RNA, 19 nt, Human
ccugugucuugcaauggca

SEQ ID NO: 3119721 - RNA, 21 nt, Human
ccugugucuugcaauggcagc

SEQ ID NO: 3119722 - RNA, 22 nt, Human
ccugugucuugcaauggcagcc

SEQ ID NO: 3119723 - RNA, 20 nt, Human
ccugugugugcgccuacagg

SEQ ID NO: 3119724 - RNA, 21 nt, Human
ccugugugugcgccuacagga

SEQ ID NO: 3119725 - RNA, 16 nt, Human
ccuguuucugcagcca

SEQ ID NO: 3119726 - RNA, 18 nt, Human
ccuguuuguuucugaaag

SEQ ID NO: 3119727 - RNA, 14 nt, Human
ccuguuuguuucug

SEQ ID NO: 3119728 - RNA, 23 nt, Human
ccuguugggccaggagccuccug

SEQ ID NO: 3119729 - RNA, 12 nt, Human
ccgcuuucuacc

SEQ ID NO: 3119730 - RNA, 19 nt, Human
ccgcuuucuacccagcgag

SEQ ID NO: 3119731 - RNA, 15 nt, Human
ccggcuggccuggcc

SEQ ID NO: 3119732 - RNA, 18 nt, Human
ccggcuggccuggccccu

SEQ ID NO: 3119733 - RNA, 17 nt, Human
ccggcuggccuggcccc

SEQ ID NO: 3119734 - RNA, 20 nt, Human
ccgggaagggggcugggaca

SEQ ID NO: 3119735 - RNA, 22 nt, Human
ccgggcucugccucccaucacc

SEQ ID NO: 3119736 - RNA, 20 nt, Human
ccgggcgcgguggcucacgc

SEQ ID NO: 3119737 - RNA, 21 nt, Human
ccgcuaagagggagggagggc

SEQ ID NO: 3119738 - RNA, 23 nt, Human
ccgcuaagagggagggagggcuc

SEQ ID NO: 3119739 - RNA, 14 nt, Human
ccgcacugggcuug

SEQ ID NO: 3119740 - RNA, 20 nt, Human
ccgaguagcugggacuacag

SEQ ID NO: 3119741 - RNA, 16 nt, Human
ccgaguagcugggacu

SEQ ID NO: 3119742 - RNA, 17 nt, Human
ccgaguagcugggacua

SEQ ID NO: 3119743 - RNA, 20 nt, Human
cccugguggcagcucaccuc

SEQ ID NO: 3119744 - RNA, 14 nt, Human
ccgaggccuucucu

SEQ ID NO: 3119745 - RNA, 22 nt, Human
ccuauauuguuuucaguguaca

SEQ ID NO: 3119746 - RNA, 18 nt, Human
ccuauauuguuuucagug

SEQ ID NO: 3119747 - RNA, 23 nt, Human
ccuaguuccaccaucaagccacc

SEQ ID NO: 3119748 - RNA, 21 nt, Human
ccuaguuccaccaucaagcca

SEQ ID NO: 3119749 - RNA, 13 nt, Human
ccuaguuccacca

SEQ ID NO: 3119750 - RNA, 14 nt, Human
ccuaaaguguauuu

SEQ ID NO: 3119751 - RNA, 17 nt, Human
ccucccgaauagcuggg

SEQ ID NO: 3119752 - RNA, 13 nt, Human
ccuccugccucga

SEQ ID NO: 3119753 - RNA, 23 nt, Human
ccuccugccucgaacuggcugca

SEQ ID NO: 3119754 - RNA, 14 nt, Human
ccuccugggcuaag

SEQ ID NO: 3119755 - RNA, 19 nt, Human
ccucccgaguagcugggac

SEQ ID NO: 3119756 - RNA, 20 nt, Human
ccucccgaguagcugggacu

SEQ ID NO: 3119757 - RNA, 21 nt, Human
ccucccgaguagcugggacua

SEQ ID NO: 3119758 - RNA, 14 nt, Human
ccuccucagaucuu

SEQ ID NO: 3119759 - RNA, 10 nt, Human
ccucccuccc

SEQ ID NO: 3119760 - RNA, 14 nt, Human
ccucgguguggaga

SEQ ID NO: 3119761 - RNA, 16 nt, Human
ccucggugccuuccuc

SEQ ID NO: 3119762 - RNA, 16 nt, Human
ccucuaggaggucucu

SEQ ID NO: 3119763 - RNA, 16 nt, Human
ccucccaaagugcugg

SEQ ID NO: 3119764 - RNA, 23 nt, Human
ccuccaugugggcuaguugggcu

SEQ ID NO: 3119765 - RNA, 15 nt, Human
ccucccaaagugcug

SEQ ID NO: 3119766 - RNA, 22 nt, Human
ccuccaggugcacaagcuccaa

SEQ ID NO: 3119767 - RNA, 21 nt, Human
ccuccaggugcacaagcucca

SEQ ID NO: 3119768 - RNA, 19 nt, Human
ccuccaggugcacaagcuc

SEQ ID NO: 3119769 - RNA, 19 nt, Human
ccucagucuggcccuuccu

SEQ ID NO: 3119770 - RNA, 11 nt, Human
ccucagugcca

SEQ ID NO: 3119771 - RNA, 12 nt, Human
ccucauacccac

SEQ ID NO: 3119772 - RNA, 20 nt, Human
ccucagucuggcccuuccuu

SEQ ID NO: 3119773 - RNA, 20 nt, Human
ccucauaguaugguggcugg

SEQ ID NO: 3119774 - RNA, 13 nt, Human
ccucauacccacc

SEQ ID NO: 3119775 - RNA, 21 nt, Human
ccucauaguaugguggcuggg

SEQ ID NO: 3119776 - RNA, 22 nt, Human
ccucauaguaugguggcugggu

SEQ ID NO: 3119777 - RNA, 14 nt, Human
ccucaucaccaacg

SEQ ID NO: 3119778 - RNA, 13 nt, Human
ccucaucaccaac

SEQ ID NO: 3119779 - RNA, 20 nt, Human
ccucauccucauacccaccc

SEQ ID NO: 3119780 - RNA, 13 nt, Human
ccucauccucaua

SEQ ID NO: 3119781 - RNA, 12 nt, Human
cccgggcucugc

SEQ ID NO: 3119782 - RNA, 15 nt, Human
cccgggcucugccuc

SEQ ID NO: 3119783 - RNA, 14 nt, Human
cccgggcucugccu

SEQ ID NO: 3119784 - RNA, 22 nt, Human
cccgaguagcugggacuacagg

SEQ ID NO: 3119785 - RNA, 20 nt, Human
cccgcugucagccauuccug

SEQ ID NO: 3119786 - RNA, 19 nt, Human
cccgcugucagccauuccu

SEQ ID NO: 3119787 - RNA, 14 nt, Human
cccagagggccugc

SEQ ID NO: 3119788 - RNA, 21 nt, Human
cccgaggccuucucugaagga

SEQ ID NO: 3119789 - RNA, 15 nt, Human
cccagagggccugca

SEQ ID NO: 3119790 - RNA, 13 nt, Human
cccgaguagcugg

SEQ ID NO: 3119791 - RNA, 14 nt, Human
cccgaguagcuggg

SEQ ID NO: 3119792 - RNA, 15 nt, Human
cccgaguagcuggga

SEQ ID NO: 3119793 - RNA, 16 nt, Human
cccgaguagcugggac

SEQ ID NO: 3119794 - RNA, 17 nt, Human
cccgaguagcugggacu

SEQ ID NO: 3119795 - RNA, 18 nt, Human
cccgaguagcugggacua

SEQ ID NO: 3119796 - RNA, 21 nt, Human
cccgaguagcugggacuacag

SEQ ID NO: 3119797 - RNA, 16 nt, Human
cccgggcucugccucc

SEQ ID NO: 3119798 - RNA, 20 nt, Human
cccuacaguugaaaaacagc

SEQ ID NO: 3119799 - RNA, 12 nt, Human
cccugcacuugc

SEQ ID NO: 3119800 - RNA, 19 nt, Human
cccugcacuugcagacucu

SEQ ID NO: 3119801 - RNA, 15 nt, Human
cccugaaagcccuga

SEQ ID NO: 3119802 - RNA, 13 nt, Human
cccugaggcccag

SEQ ID NO: 3119803 - RNA, 16 nt, Human
cccucuggggcuguuc

SEQ ID NO: 3119804 - RNA, 23 nt, Human
cccugaggcccagagggccugca

SEQ ID NO: 3119805 - RNA, 20 nt, Human
cccugaggcccagagggccu

SEQ ID NO: 3119806 - RNA, 19 nt, Human
cccugaggcccagagggcc

SEQ ID NO: 3119807 - RNA, 18 nt, Human
cccugaggcccagagggc

SEQ ID NO: 3119808 - RNA, 17 nt, Human
cccugaggcccagaggg

SEQ ID NO: 3119809 - RNA, 16 nt, Human
cccugaggcccagagg

SEQ ID NO: 3119810 - RNA, 15 nt, Human
cccugaggcccagag

SEQ ID NO: 3119811 - RNA, 14 nt, Human
cccugaggcccaga

SEQ ID NO: 3119812 - RNA, 12 nt, Human
cccucuggggcu

SEQ ID NO: 3119813 - RNA, 21 nt, Human
cccugcuggguguggcgcagc

SEQ ID NO: 3119814 - RNA, 16 nt, Human
cccugcuggguguggc

SEQ ID NO: 3119815 - RNA, 18 nt, Human
cccugcccaccuggccuc

SEQ ID NO: 3119816 - RNA, 17 nt, Human
cccugcccaccuggccu

SEQ ID NO: 3119817 - RNA, 14 nt, Human
cccugcccaccugg

SEQ ID NO: 3119818 - RNA, 13 nt, Human
cccugcccaccug

SEQ ID NO: 3119819 - RNA, 15 nt, Human
cccugguggcagcuc

SEQ ID NO: 3119820 - RNA, 17 nt, Human
cccugguggcagcucac

SEQ ID NO: 3119821 - RNA, 16 nt, Human
cccugguggcagcuca

SEQ ID NO: 3119822 - RNA, 21 nt, Human
cccacaaaggagagcuagcag

SEQ ID NO: 3119823 - RNA, 20 nt, Human
cccaaugcacuuuguucugg

SEQ ID NO: 3119824 - RNA, 16 nt, Human
cccaaugcacuuuguu

SEQ ID NO: 3119825 - RNA, 17 nt, Human
cccaccuggccucugca

SEQ ID NO: 3119826 - RNA, 21 nt, Human
cccaccuggccucugcacucc

SEQ ID NO: 3119827 - RNA, 19 nt, Human
cccaccuggccucugcacu

SEQ ID NO: 3119828 - RNA, 16 nt, Human
cccaccuggccucugc

SEQ ID NO: 3119829 - RNA, 20 nt, Human
cccaccuuggcugcagggag

SEQ ID NO: 3119830 - RNA, 21 nt, Human
cccacgacugcccggcagggu

SEQ ID NO: 3119831 - RNA, 20 nt, Human
cccacgacugcccggcaggg

SEQ ID NO: 3119832 - RNA, 12 nt, Human
cccacuucugcc

SEQ ID NO: 3119833 - RNA, 23 nt, Human
cccacuugagaauuacccuuuug

SEQ ID NO: 3119834 - RNA, 14 nt, Human
cccacgcuggagug

SEQ ID NO: 3119835 - RNA, 19 nt, Human
cccacgcuggagugcagug

SEQ ID NO: 3119836 - RNA, 20 nt, Human
cccacgcuggagugcaguga

SEQ ID NO: 3119837 - RNA, 17 nt, Human
cccaccucagccucccg

SEQ ID NO: 3119838 - RNA, 22 nt, Human
cccaccucucucacuccuugaa

SEQ ID NO: 3119839 - RNA, 19 nt, Human
cccaccucucucacuccuu

SEQ ID NO: 3119840 - RNA, 19 nt, Human
cccaccgcagacaggacca

SEQ ID NO: 3119841 - RNA, 20 nt, Human
cccaccgcagacaggaccag

SEQ ID NO: 3119842 - RNA, 20 nt, Human
cuguauuuuguuuuugucuu

SEQ ID NO: 3119843 - RNA, 13 nt, Human
cugucaauuacag

SEQ ID NO: 3119844 - RNA, 16 nt, Human
cugucaauuacaggaa

SEQ ID NO: 3119845 - RNA, 15 nt, Human
cugucaauuacagga

SEQ ID NO: 3119846 - RNA, 21 nt, Human
cuguaucccaugagccucagc

SEQ ID NO: 3119847 - RNA, 20 nt, Human
cuguaucccaugagccucag

SEQ ID NO: 3119848 - RNA, 19 nt, Human
cuguaucccaugagccuca

SEQ ID NO: 3119849 - RNA, 19 nt, Human
cuguacgucugacaggcaa

SEQ ID NO: 3119850 - RNA, 20 nt, Human
cuguacgucugacaggcaau

SEQ ID NO: 3119851 - RNA, 17 nt, Human
cuguacaugaaaacaca

SEQ ID NO: 3119852 - RNA, 20 nt, Human
cuguacaugaaaacacauuu

SEQ ID NO: 3119853 - RNA, 21 nt, Human
cuguacaugaaaacacauuuu

SEQ ID NO: 3119854 - RNA, 14 nt, Human
cuguacgucugaca

SEQ ID NO: 3119855 - RNA, 15 nt, Human
cuguacgucugacag

SEQ ID NO: 3119856 - RNA, 16 nt, Human
cuguacgucugacagg

SEQ ID NO: 3119857 - RNA, 18 nt, Human
cuguacgucugacaggca

SEQ ID NO: 3119858 - RNA, 14 nt, Human
cuguaauuugugau

SEQ ID NO: 3119859 - RNA, 15 nt, Human
cuguaauuugugaua

SEQ ID NO: 3119860 - RNA, 22 nt, Human
cuguacagagcccacgccccca

SEQ ID NO: 3119861 - RNA, 18 nt, Human
cuguacagagcccacgcc

SEQ ID NO: 3119862 - RNA, 15 nt, Human
cuguacagagcccac

SEQ ID NO: 3119863 - RNA, 14 nt, Human
cuguacagagccca

SEQ ID NO: 3119864 - RNA, 22 nt, Human
cugguuagagguucccuuugac

SEQ ID NO: 3119865 - RNA, 21 nt, Human
cugguuagagguucccuuuga

SEQ ID NO: 3119866 - RNA, 16 nt, Human
cugguggcagcucacc

SEQ ID NO: 3119867 - RNA, 18 nt, Human
cugguggcagcucaccuc

SEQ ID NO: 3119868 - RNA, 17 nt, Human
cugguggcagcucaccu

SEQ ID NO: 3119869 - RNA, 15 nt, Human
cugguggcagcugcg

SEQ ID NO: 3119870 - RNA, 20 nt, Human
cugguggcagcucaccucuc

SEQ ID NO: 3119871 - RNA, 14 nt, Human
cugguggcaguggg

SEQ ID NO: 3119872 - RNA, 18 nt, Human
cugguggcagugggagcu

SEQ ID NO: 3119873 - RNA, 21 nt, Human
cugggauuacaagcgugagcc

SEQ ID NO: 3119874 - RNA, 15 nt, Human
cugggcuucaguggc

SEQ ID NO: 3119875 - RNA, 22 nt, Human
cugggcuuggggaccagagcug

SEQ ID NO: 3119876 - RNA, 18 nt, Human
cugggcuugucuguagau

SEQ ID NO: 3119877 - RNA, 14 nt, Human
cugggggcugggca

SEQ ID NO: 3119878 - RNA, 18 nt, Human
cugggggccucagugcca

SEQ ID NO: 3119879 - RNA, 21 nt, Human
cuguggguuucuaaagcugcc

SEQ ID NO: 3119880 - RNA, 22 nt, Human
cuguggguuucuaaagcugcca

SEQ ID NO: 3119881 - RNA, 23 nt, Human
cugugucuugcaauggcagccuu

SEQ ID NO: 3119882 - RNA, 20 nt, Human
cugugucuuuuuucacuaca

SEQ ID NO: 3119883 - RNA, 14 nt, Human
cugugccaugugcc

SEQ ID NO: 3119884 - RNA, 19 nt, Human
cugugcccuaaaguguauu

SEQ ID NO: 3119885 - RNA, 15 nt, Human
cugugccaugugcca

SEQ ID NO: 3119886 - RNA, 22 nt, Human
cugugccauuuuguauuuuacu

SEQ ID NO: 3119887 - RNA, 23 nt, Human
cugugauggggcccugccuccuu

SEQ ID NO: 3119888 - RNA, 21 nt, Human
cugugauggggcccugccucc

SEQ ID NO: 3119889 - RNA, 16 nt, Human
cugugauggggcccug

SEQ ID NO: 3119890 - RNA, 15 nt, Human
cugugauggggcccu

SEQ ID NO: 3119891 - RNA, 22 nt, Human
cugugaaaggaaagagggaggu

SEQ ID NO: 3119892 - RNA, 16 nt, Human
cugugaaaggaaagag

SEQ ID NO: 3119893 - RNA, 21 nt, Human
cugucauuugagcagggcuca

SEQ ID NO: 3119894 - RNA, 22 nt, Human
cugucauuugagcagggcucag

SEQ ID NO: 3119895 - RNA, 20 nt, Human
cugucauuugagcagggcuc

SEQ ID NO: 3119896 - RNA, 18 nt, Human
cugucaauuacaggaagu

SEQ ID NO: 3119897 - RNA, 18 nt, Human
cugucuucaguaagccgu

SEQ ID NO: 3119898 - RNA, 15 nt, Human
cugugaaaggaaaga

SEQ ID NO: 3119899 - RNA, 19 nt, Human
cuucgggaggucgaggcag

SEQ ID NO: 3119900 - RNA, 16 nt, Human
cuucucacugccaugc

SEQ ID NO: 3119901 - RNA, 21 nt, Human
cuucucacugccaugccagcu

SEQ ID NO: 3119902 - RNA, 16 nt, Human
cuucgcuccugugucu

SEQ ID NO: 3119903 - RNA, 17 nt, Human
cuucgcuccugugucuu

SEQ ID NO: 3119904 - RNA, 17 nt, Human
cuucccuacaguugaaa

SEQ ID NO: 3119905 - RNA, 16 nt, Human
cuucaaggauccugag

SEQ ID NO: 3119906 - RNA, 20 nt, Human
cuucaaggauccugagccag

SEQ ID NO: 3119907 - RNA, 19 nt, Human
cuucaaggauccugagcca

SEQ ID NO: 3119908 - RNA, 18 nt, Human
cuucaaggauccugagcc

SEQ ID NO: 3119909 - RNA, 17 nt, Human
cuucaaggauccugagc

SEQ ID NO: 3119910 - RNA, 15 nt, Human
cuucaaauauuuccc

SEQ ID NO: 3119911 - RNA, 22 nt, Human
cuuagucacugagacagcccgg

SEQ ID NO: 3119912 - RNA, 20 nt, Human
cuuagucacugagacagccc

SEQ ID NO: 3119913 - RNA, 21 nt, Human
cuuagucacugagacagcccg

SEQ ID NO: 3119914 - RNA, 24 nt, Human
cuucagagacuccugcaggcagcc

SEQ ID NO: 3119915 - RNA, 14 nt, Human
cuucacauauugau

SEQ ID NO: 3119916 - RNA, 23 nt, Human
cuucacauauugauuuccguuaa

SEQ ID NO: 3119917 - RNA, 23 nt, Human
cuucaaggauccugagccagauu

SEQ ID NO: 3119918 - RNA, 22 nt, Human
cuucaaggauccugagccagau

SEQ ID NO: 3119919 - RNA, 21 nt, Human
cuucaaggauccugagccaga

SEQ ID NO: 3119920 - RNA, 19 nt, Human
cuucagcugacuuuucugu

SEQ ID NO: 3119921 - RNA, 15 nt, Human
cuucagcugacuuuu

SEQ ID NO: 3119922 - RNA, 14 nt, Human
cuucaguaagccgu

SEQ ID NO: 3119923 - RNA, 14 nt, Human
cuucagccucccga

SEQ ID NO: 3119924 - RNA, 16 nt, Human
cuucagccucccgagu

SEQ ID NO: 3119925 - RNA, 20 nt, Human
cuucagccucccgaguagcu

SEQ ID NO: 3119926 - RNA, 14 nt, Human
cuucagugccaaaa

SEQ ID NO: 3119927 - RNA, 13 nt, Human
cuuccacaagagc

SEQ ID NO: 3119928 - RNA, 15 nt, Human
cuuccacaagagccc

SEQ ID NO: 3119929 - RNA, 14 nt, Human
cuuccacaagagcc

SEQ ID NO: 3119930 - RNA, 21 nt, Human
cuguuuuauuuuaauucaguu

SEQ ID NO: 3119931 - RNA, 17 nt, Human
cuuaaaaaguggaaaaa

SEQ ID NO: 3119932 - RNA, 16 nt, Human
cuuaaaaaguggaaaa

SEQ ID NO: 3119933 - RNA, 17 nt, Human
cuguugcccaggcuggc

SEQ ID NO: 3119934 - RNA, 14 nt, Human
cuguuuagauaaua

SEQ ID NO: 3119935 - RNA, 17 nt, Human
cuguuuagauaauacac

SEQ ID NO: 3119936 - RNA, 15 nt, Human
cuguuucaaacuuua

SEQ ID NO: 3119937 - RNA, 17 nt, Human
cuguuucaaacuuuacu

SEQ ID NO: 3119938 - RNA, 18 nt, Human
cuguuuagauaauacacc

SEQ ID NO: 3119939 - RNA, 19 nt, Human
cuguuugcuaagugaggau

SEQ ID NO: 3119940 - RNA, 17 nt, Human
cuguuugcuaagugagg

SEQ ID NO: 3119941 - RNA, 16 nt, Human
cuguuaauaguucagg

SEQ ID NO: 3119942 - RNA, 15 nt, Human
cuguucuuuccaaag

SEQ ID NO: 3119943 - RNA, 16 nt, Human
cuguucuuuccaaagu

SEQ ID NO: 3119944 - RNA, 19 nt, Human
cuguucuuuccaaaguaca

SEQ ID NO: 3119945 - RNA, 21 nt, Human
cuguucuuuccaaaguacacu

SEQ ID NO: 3119946 - RNA, 13 nt, Human
cuguucuuucugg

SEQ ID NO: 3119947 - RNA, 14 nt, Human
cuguucuuucuggc

SEQ ID NO: 3119948 - RNA, 21 nt, Human
cuguucuuucuggcuaugcau

SEQ ID NO: 3119949 - RNA, 12 nt, Human
cuguugcccagg

SEQ ID NO: 3119950 - RNA, 13 nt, Human
cuguugcccaggc

SEQ ID NO: 3119951 - RNA, 14 nt, Human
cuguugcccaggcu

SEQ ID NO: 3119952 - RNA, 15 nt, Human
cuguugcccaggcug

SEQ ID NO: 3119953 - RNA, 16 nt, Human
cuguugcccaggcugg

SEQ ID NO: 3119954 - RNA, 23 nt, Human
cuguucuuucuggcuaugcauuu

SEQ ID NO: 3119955 - RNA, 21 nt, Human
cuuagguuggcaaaaaggcag

SEQ ID NO: 3119956 - RNA, 23 nt, Human
cuuagguuggcaaaaaggcagga

SEQ ID NO: 3119957 - RNA, 20 nt, Human
cuuaccugccaggaagccag

SEQ ID NO: 3119958 - RNA, 13 nt, Human
cuuaccugccagg

SEQ ID NO: 3119959 - RNA, 20 nt, Human
cuuagaaaaaccaccaccau

SEQ ID NO: 3119960 - RNA, 17 nt, Human
cuuagaagucacacagu

SEQ ID NO: 3119961 - RNA, 20 nt, Human
cuuagaagucacacaguauu

SEQ ID NO: 3119962 - RNA, 20 nt, Human
cuuaauucuuagcucauucu

SEQ ID NO: 3119963 - RNA, 16 nt, Human
cuuaaucuaaauggaa

SEQ ID NO: 3119964 - RNA, 16 nt, Human
gaaggccccgcccagg

SEQ ID NO: 3119965 - RNA, 15 nt, Human
gaaggccccgcccag

SEQ ID NO: 3119966 - RNA, 14 nt, Human
gaaggccccgccca

SEQ ID NO: 3119967 - RNA, 12 nt, Human
gaaggauacaaa

SEQ ID NO: 3119968 - RNA, 19 nt, Human
gaaggauacaaaagcaugu

SEQ ID NO: 3119969 - RNA, 21 nt, Human
gaaggauacaaaagcauguga

SEQ ID NO: 3119970 - RNA, 17 nt, Human
gaaggaaacccagcucu

SEQ ID NO: 3119971 - RNA, 14 nt, Human
gaaggaaacccagc

SEQ ID NO: 3119972 - RNA, 18 nt, Human
gaaggaaacccagcucug

SEQ ID NO: 3119973 - RNA, 19 nt, Human
gaagacucauucuucugua

SEQ ID NO: 3119974 - RNA, 21 nt, Human
gaagacucauucuucuguacg

SEQ ID NO: 3119975 - RNA, 16 nt, Human
gaagccagcaggcucu

SEQ ID NO: 3119976 - RNA, 15 nt, Human
gaagccagcaggcuc

SEQ ID NO: 3119977 - RNA, 23 nt, Human
gaagccagcaggcucucaggcca

SEQ ID NO: 3119978 - RNA, 21 nt, Human
gaagccgcuggggccaguugg

SEQ ID NO: 3119979 - RNA, 22 nt, Human
gaagcccaggaaaggcuccagg

SEQ ID NO: 3119980 - RNA, 21 nt, Human
gaagcccaggaaaggcuccag

SEQ ID NO: 3119981 - RNA, 20 nt, Human
gaagcccaggaaaggcucca

SEQ ID NO: 3119982 - RNA, 12 nt, Human
gaaguuucugcc

SEQ ID NO: 3119983 - RNA, 14 nt, Human
gaauaacauguaau

SEQ ID NO: 3119984 - RNA, 15 nt, Human
gaauagcugggacua

SEQ ID NO: 3119985 - RNA, 14 nt, Human
gaauagcugggacu

SEQ ID NO: 3119986 - RNA, 16 nt, Human
gaaucucaaauaacua

SEQ ID NO: 3119987 - RNA, 14 nt, Human
gaaugaaagggccc

SEQ ID NO: 3119988 - RNA, 19 nt, Human
gaaugaaagggcccagaga

SEQ ID NO: 3119989 - RNA, 20 nt, Human
gaaauaucugaaaauguaug

SEQ ID NO: 3119990 - RNA, 13 nt, Human
gaaauauaauuga

SEQ ID NO: 3119991 - RNA, 21 nt, Human
gaaauaucugaaaauguaugu

SEQ ID NO: 3119992 - RNA, 14 nt, Human
gaaaugggcagagc

SEQ ID NO: 3119993 - RNA, 20 nt, Human
gaaaugggcagagcagagac

SEQ ID NO: 3119994 - RNA, 17 nt, Human
gaaauuuguuauaauga

SEQ ID NO: 3119995 - RNA, 16 nt, Human
gaaccaccacacccag

SEQ ID NO: 3119996 - RNA, 17 nt, Human
gaaccaccacacccagc

SEQ ID NO: 3119997 - RNA, 15 nt, Human
gaacagacuggaagc

SEQ ID NO: 3119998 - RNA, 16 nt, Human
gaacagacuggaagca

SEQ ID NO: 3119999 - RNA, 20 nt, Human
gaaccacaucuugcucugcu

SEQ ID NO: 3120000 - RNA, 21 nt, Human
gaaccacaucuugcucugcug

SEQ ID NO: 3120001 - RNA, 22 nt, Human
gaacuggguacuuguggacaca

SEQ ID NO: 3120002 - RNA, 13 nt, Human
gaacuuggcgcug

SEQ ID NO: 3120003 - RNA, 16 nt, Human
gaacuuggcgcugccc

SEQ ID NO: 3120004 - RNA, 15 nt, Human
gaacuuggcgcugcc

SEQ ID NO: 3120005 - RNA, 12 nt, Human
gaacuugguucc

SEQ ID NO: 3120006 - RNA, 23 nt, Human
gaacuugguucccauuugcuccu

SEQ ID NO: 3120007 - RNA, 22 nt, Human
cuuuccaaaugcccagcuuaaa

SEQ ID NO: 3120008 - RNA, 19 nt, Human
cuuuccaaaugcccagcuu

SEQ ID NO: 3120009 - RNA, 18 nt, Human
cuuuccaaaugcccagcu

SEQ ID NO: 3120010 - RNA, 16 nt, Human
cuuuccaaaugcccag

SEQ ID NO: 3120011 - RNA, 20 nt, Human
cuuguguguuuauugucaaa

SEQ ID NO: 3120012 - RNA, 21 nt, Human
cuuguguguuuauugucaaag

SEQ ID NO: 3120013 - RNA, 16 nt, Human
cuugcucugcugacag

SEQ ID NO: 3120014 - RNA, 13 nt, Human
cuuggaagcuccg

SEQ ID NO: 3120015 - RNA, 13 nt, Human
cuuggaggaagga

SEQ ID NO: 3120016 - RNA, 16 nt, Human
cuuggaaaugggagac

SEQ ID NO: 3120017 - RNA, 17 nt, Human
cuucuccacccugcucu

SEQ ID NO: 3120018 - RNA, 18 nt, Human
cuucuccacccugcucuc

SEQ ID NO: 3120019 - RNA, 16 nt, Human
cuucuccacccugcuc

SEQ ID NO: 3120020 - RNA, 21 nt, Human
cuucuccacccugcucuccga

SEQ ID NO: 3120021 - RNA, 13 nt, Human
cuugcucugcuga

SEQ ID NO: 3120022 - RNA, 14 nt, Human
cuugcucugcugac

SEQ ID NO: 3120023 - RNA, 22 nt, Human
cuuggggaccagagcugccacc

SEQ ID NO: 3120024 - RNA, 15 nt, Human
cuuggggggcugagg

SEQ ID NO: 3120025 - RNA, 16 nt, Human
cuuggggggcugaggu

SEQ ID NO: 3120026 - RNA, 13 nt, Human
cuugggcuucauc

SEQ ID NO: 3120027 - RNA, 14 nt, Human
cuugggccacugug

SEQ ID NO: 3120028 - RNA, 21 nt, Human
cuuggggaccagagcugccac

SEQ ID NO: 3120029 - RNA, 20 nt, Human
cuuggggaccagagcugcca

SEQ ID NO: 3120030 - RNA, 22 nt, Human
cuugggcuucauccuccucaga

SEQ ID NO: 3120031 - RNA, 14 nt, Human
cuuggcugcaggga

SEQ ID NO: 3120032 - RNA, 17 nt, Human
cuuggcugcagggaguc

SEQ ID NO: 3120033 - RNA, 22 nt, Human
cuuggaggaaggaaacccagcu

SEQ ID NO: 3120034 - RNA, 16 nt, Human
cuuggcugcagggagu

SEQ ID NO: 3120035 - RNA, 14 nt, Human
gaaaaucagccugc

SEQ ID NO: 3120036 - RNA, 18 nt, Human
gaaaaucagccugcucca

SEQ ID NO: 3120037 - RNA, 16 nt, Human
gaaaaucagccugcuc

SEQ ID NO: 3120038 - RNA, 13 nt, Human
gaaaagcugcuga

SEQ ID NO: 3120039 - RNA, 17 nt, Human
gaaaagcugcugacagu

SEQ ID NO: 3120040 - RNA, 18 nt, Human
gaaacagcuaaugggaca

SEQ ID NO: 3120041 - RNA, 14 nt, Human
gaaaacguggcugc

SEQ ID NO: 3120042 - RNA, 18 nt, Human
gaaaacguggcugcuuca

SEQ ID NO: 3120043 - RNA, 16 nt, Human
gaaaacguggcugcuu

SEQ ID NO: 3120044 - RNA, 15 nt, Human
gaaaacguggcugcu

SEQ ID NO: 3120045 - RNA, 12 nt, Human
gaaaacaugcua

SEQ ID NO: 3120046 - RNA, 14 nt, Human
gaaaacaugcuaca

SEQ ID NO: 3120047 - RNA, 15 nt, Human
gaaaacaugcuacac

SEQ ID NO: 3120048 - RNA, 13 nt, Human
gaaaacacauuuu

SEQ ID NO: 3120049 - RNA, 23 nt, Human
gaaaaaggaugcacagaguuguu

SEQ ID NO: 3120050 - RNA, 17 nt, Human
gaaaaaggaugcacaga

SEQ ID NO: 3120051 - RNA, 15 nt, Human
cuuuuuuggcugcug

SEQ ID NO: 3120052 - RNA, 14 nt, Human
cuuuuuuggcugcu

SEQ ID NO: 3120053 - RNA, 21 nt, Human
cuuuugagugccuuacacaau

SEQ ID NO: 3120054 - RNA, 16 nt, Human
cuuuugagcauuuaga

SEQ ID NO: 3120055 - RNA, 15 nt, Human
cuuuuuucacuacau

SEQ ID NO: 3120056 - RNA, 14 nt, Human
cuuugugauuuuug

SEQ ID NO: 3120057 - RNA, 22 nt, Human
cuuuguccccaccgcagacagg

SEQ ID NO: 3120058 - RNA, 18 nt, Human
cuuuguccccaccgcaga

SEQ ID NO: 3120059 - RNA, 13 nt, Human
cuuugggaggcca

SEQ ID NO: 3120060 - RNA, 14 nt, Human
cuuuguucuggcuc

SEQ ID NO: 3120061 - RNA, 17 nt, Human
cuuugugauuuuuguaa

SEQ ID NO: 3120062 - RNA, 18 nt, Human
cuuugugauuuuuguaau

SEQ ID NO: 3120063 - RNA, 16 nt, Human
cuuucccaucuuccaa

SEQ ID NO: 3120064 - RNA, 16 nt, Human
cuuuggacccugaggc

SEQ ID NO: 3120065 - RNA, 15 nt, Human
cuuuggacccugagg

SEQ ID NO: 3120066 - RNA, 18 nt, Human
cuuuggacccugaggccc

SEQ ID NO: 3120067 - RNA, 17 nt, Human
cuuuggacccugaggcc

SEQ ID NO: 3120068 - RNA, 19 nt, Human
cuuuggacccugaggccca

SEQ ID NO: 3120069 - RNA, 23 nt, Human
cuuuucuugcaugaggcuagugu

SEQ ID NO: 3120070 - RNA, 18 nt, Human
cuuuucuugcaugaggcu

SEQ ID NO: 3120071 - RNA, 18 nt, Human
cuuuucuguccgagcuuu

SEQ ID NO: 3120072 - RNA, 22 nt, Human
cuuuucauaaccuagccuuaga

SEQ ID NO: 3120073 - RNA, 20 nt, Human
cuuuucauaaccuagccuua

SEQ ID NO: 3120074 - RNA, 20 nt, Human
cuuuguuuguugucagcuga

SEQ ID NO: 3120075 - RNA, 18 nt, Human
cuuuguuuguugucagcu

SEQ ID NO: 3120076 - RNA, 18 nt, Human
cuccugccucgaacuggc

SEQ ID NO: 3120077 - RNA, 20 nt, Human
cuccugccucgaacuggcug

SEQ ID NO: 3120078 - RNA, 21 nt, Human
cuccugccucgaacuggcugc

SEQ ID NO: 3120079 - RNA, 17 nt, Human
cuccugccucagccucc

SEQ ID NO: 3120080 - RNA, 16 nt, Human
cuccugccucagccuc

SEQ ID NO: 3120081 - RNA, 12 nt, Human
cuccugccucag

SEQ ID NO: 3120082 - RNA, 11 nt, Human
cuccugccuca

SEQ ID NO: 3120083 - RNA, 13 nt, Human
cuccucuccccag

SEQ ID NO: 3120084 - RNA, 15 nt, Human
cuccucuccccagca

SEQ ID NO: 3120085 - RNA, 14 nt, Human
cuccuggaaauauu

SEQ ID NO: 3120086 - RNA, 21 nt, Human
cuccugugugugcgccuacag

SEQ ID NO: 3120087 - RNA, 23 nt, Human
cuccugugugugcgccuacagga

SEQ ID NO: 3120088 - RNA, 24 nt, Human
cuccugugugugcgccuacaggag

SEQ ID NO: 3120089 - RNA, 20 nt, Human
cuccugugugugcgccuaca

SEQ ID NO: 3120090 - RNA, 22 nt, Human
cucgagcaugccuggauggggc

SEQ ID NO: 3120091 - RNA, 23 nt, Human
cuccuuggugucgggcaugacac

SEQ ID NO: 3120092 - RNA, 19 nt, Human
cucgagcaugccuggaugg

SEQ ID NO: 3120093 - RNA, 16 nt, Human
cucgagcaugccugga

SEQ ID NO: 3120094 - RNA, 15 nt, Human
cucgagcaugccugg

SEQ ID NO: 3120095 - RNA, 13 nt, Human
cucgagcaugccu

SEQ ID NO: 3120096 - RNA, 18 nt, Human
cucccgaguagcugggac

SEQ ID NO: 3120097 - RNA, 19 nt, Human
cucccgaguagcugggacu

SEQ ID NO: 3120098 - RNA, 20 nt, Human
cucccgaguagcugggacua

SEQ ID NO: 3120099 - RNA, 21 nt, Human
cuccccagcaagugagagcug

SEQ ID NO: 3120100 - RNA, 22 nt, Human
cuccccagcaagugagagcugg

SEQ ID NO: 3120101 - RNA, 23 nt, Human
cuccccagcaagugagagcuggg

SEQ ID NO: 3120102 - RNA, 18 nt, Human
cuccucagaucuucugug

SEQ ID NO: 3120103 - RNA, 20 nt, Human
cucccuuggauuguccccga

SEQ ID NO: 3120104 - RNA, 15 nt, Human
cuccgaccagacacc

SEQ ID NO: 3120105 - RNA, 15 nt, Human
cuccuccagagucag

SEQ ID NO: 3120106 - RNA, 13 nt, Human
cuccuccagaguc

SEQ ID NO: 3120107 - RNA, 15 nt, Human
cuccuccagccgcca

SEQ ID NO: 3120108 - RNA, 21 nt, Human
cucauaguaugguggcugggu

SEQ ID NO: 3120109 - RNA, 15 nt, Human
cucauacccaccccc

SEQ ID NO: 3120110 - RNA, 14 nt, Human
cucauacucaccuc

SEQ ID NO: 3120111 - RNA, 22 nt, Human
cucauacucaccucaccccacu

SEQ ID NO: 3120112 - RNA, 20 nt, Human
cucaggugauccacccaccu

SEQ ID NO: 3120113 - RNA, 14 nt, Human
cucagggucccugg

SEQ ID NO: 3120114 - RNA, 18 nt, Human
cucaggugauccacccac

SEQ ID NO: 3120115 - RNA, 19 nt, Human
cucaggugauccacccacc

SEQ ID NO: 3120116 - RNA, 21 nt, Human
cucauacccacccccacccaa

SEQ ID NO: 3120117 - RNA, 19 nt, Human
cucauacccacccccaccc

SEQ ID NO: 3120118 - RNA, 18 nt, Human
cucauacccacccccacc

SEQ ID NO: 3120119 - RNA, 16 nt, Human
cucauacccaccccca

SEQ ID NO: 3120120 - RNA, 22 nt, Human
cucaucaccaacgucugugcca

SEQ ID NO: 3120121 - RNA, 20 nt, Human
cucauaguaugguggcuggg

SEQ ID NO: 3120122 - RNA, 23 nt, Human
cucauaguaugguggcuggguug

SEQ ID NO: 3120123 - RNA, 21 nt, Human
cucaucaccaacgucugugcc

SEQ ID NO: 3120124 - RNA, 15 nt, Human
cucauccucauaccc

SEQ ID NO: 3120125 - RNA, 15 nt, Human
cucagcauccuggca

SEQ ID NO: 3120126 - RNA, 18 nt, Human
cucagcauccuggcaccc

SEQ ID NO: 3120127 - RNA, 23 nt, Human
cucaggaguuugagaccaaccug

SEQ ID NO: 3120128 - RNA, 18 nt, Human
cucaggaguuugagacca

SEQ ID NO: 3120129 - RNA, 13 nt, Human
cucagggccuggc

SEQ ID NO: 3120130 - RNA, 15 nt, Human
cucagggccuggcuc

SEQ ID NO: 3120131 - RNA, 14 nt, Human
cucagggccuggcu

SEQ ID NO: 3120132 - RNA, 16 nt, Human
cucagggccuggcuca

SEQ ID NO: 3120133 - RNA, 15 nt, Human
cucagggccuggucg

SEQ ID NO: 3120134 - RNA, 14 nt, Human
cucagggccugguc

SEQ ID NO: 3120135 - RNA, 17 nt, Human
cucagggucccuggugg

SEQ ID NO: 3120136 - RNA, 16 nt, Human
cucagggucccuggug

SEQ ID NO: 3120137 - RNA, 15 nt, Human
cucagggucccuggu

SEQ ID NO: 3120138 - RNA, 20 nt, Human
cucaggugagaagcagagga

SEQ ID NO: 3120139 - RNA, 19 nt, Human
cucaggugagaagcagagg

SEQ ID NO: 3120140 - RNA, 14 nt, Human
cucaggugagaagc

SEQ ID NO: 3120141 - RNA, 16 nt, Human
cucaggugagaagcag

SEQ ID NO: 3120142 - RNA, 13 nt, Human
cuccaggagcagc

SEQ ID NO: 3120143 - RNA, 11 nt, Human
cuccaggagca

SEQ ID NO: 3120144 - RNA, 17 nt, Human
cuccaggagcagccaca

SEQ ID NO: 3120145 - RNA, 16 nt, Human
cuccaggagcagccac

SEQ ID NO: 3120146 - RNA, 15 nt, Human
cuccaggagcagcca

SEQ ID NO: 3120147 - RNA, 14 nt, Human
cuccaggagcagcc

SEQ ID NO: 3120148 - RNA, 23 nt, Human
cuccaggagcagccacauuccug

SEQ ID NO: 3120149 - RNA, 18 nt, Human
cuccaggagcagccacau

SEQ ID NO: 3120150 - RNA, 12 nt, Human
cuccagccuggg

SEQ ID NO: 3120151 - RNA, 17 nt, Human
cuccagccccuggaugc

SEQ ID NO: 3120152 - RNA, 16 nt, Human
cuccagccccuggaug

SEQ ID NO: 3120153 - RNA, 20 nt, Human
cuccagccccuggaugcagc

SEQ ID NO: 3120154 - RNA, 14 nt, Human
cuccaccugccagg

SEQ ID NO: 3120155 - RNA, 13 nt, Human
cuccaccugccag

SEQ ID NO: 3120156 - RNA, 12 nt, Human
cuccaccugcca

SEQ ID NO: 3120157 - RNA, 15 nt, Human
cuccagccccuggau

SEQ ID NO: 3120158 - RNA, 17 nt, Human
cucauuugucacacacu

SEQ ID NO: 3120159 - RNA, 15 nt, Human
cuccaaaauaaaacu

SEQ ID NO: 3120160 - RNA, 16 nt, Human
cuccaaaauaaaacuu

SEQ ID NO: 3120161 - RNA, 15 nt, Human
cuccacccugcucuc

SEQ ID NO: 3120162 - RNA, 13 nt, Human
cuccacccugcuc

SEQ ID NO: 3120163 - RNA, 24 nt, Human
cuaggugacagagugagacucugu

SEQ ID NO: 3120164 - RNA, 14 nt, Human
cuaggugacagagu

SEQ ID NO: 3120165 - RNA, 18 nt, Human
cuaggugacagagugaga

SEQ ID NO: 3120166 - RNA, 22 nt, Human
cgcccaguuggguggaugccug

SEQ ID NO: 3120167 - RNA, 17 nt, Human
cgccaucccagccccaa

SEQ ID NO: 3120168 - RNA, 20 nt, Human
cgccaucccagccccaauga

SEQ ID NO: 3120169 - RNA, 15 nt, Human
cgccaugcuccuggc

SEQ ID NO: 3120170 - RNA, 23 nt, Human
cgcccaguuggguggaugccugg

SEQ ID NO: 3120171 - RNA, 17 nt, Human
cuauagccuaggugaca

SEQ ID NO: 3120172 - RNA, 16 nt, Human
cuauaauguaagcucu

SEQ ID NO: 3120173 - RNA, 22 nt, Human
cuauaauuuaccugaagucuuu

SEQ ID NO: 3120174 - RNA, 21 nt, Human
cuauaauguaagcucuacuga

SEQ ID NO: 3120175 - RNA, 18 nt, Human
cuaugggacucaaugcac

SEQ ID NO: 3120176 - RNA, 22 nt, Human
cuaugggacucaaugcacugac

SEQ ID NO: 3120177 - RNA, 23 nt, Human
cuaugggacucaaugcacugaca

SEQ ID NO: 3120178 - RNA, 15 nt, Human
cuauuagagaagaga

SEQ ID NO: 3120179 - RNA, 16 nt, Human
cucagcauccuggcac

SEQ ID NO: 3120180 - RNA, 17 nt, Human
cucagcauccuggcacc

SEQ ID NO: 3120181 - RNA, 15 nt, Human
cucagaucuucugug

SEQ ID NO: 3120182 - RNA, 21 nt, Human
cucagcaaaagaugcuucuca

SEQ ID NO: 3120183 - RNA, 20 nt, Human
cucacuguugcccaggcugg

SEQ ID NO: 3120184 - RNA, 22 nt, Human
cucacugccaugccagcuuauc

SEQ ID NO: 3120185 - RNA, 19 nt, Human
cucacugccaugccagcuu

SEQ ID NO: 3120186 - RNA, 21 nt, Human
cucacuguugcccaggcuggc

SEQ ID NO: 3120187 - RNA, 22 nt, Human
cucacuguugcccaggcuggcg

SEQ ID NO: 3120188 - RNA, 14 nt, Human
cucagagagggugg

SEQ ID NO: 3120189 - RNA, 23 nt, Human
cucacuauguugcccaggcaggu

SEQ ID NO: 3120190 - RNA, 21 nt, Human
cucacuauguugcccaggcag

SEQ ID NO: 3120191 - RNA, 22 nt, Human
cucacuauguugcccaggcagg

SEQ ID NO: 3120192 - RNA, 14 nt, Human
cucaccccagcccc

SEQ ID NO: 3120193 - RNA, 15 nt, Human
cucaccccagcccca

SEQ ID NO: 3120194 - RNA, 19 nt, Human
cucacuauguugcccaggc

SEQ ID NO: 3120195 - RNA, 20 nt, Human
cucacuauguugcccaggca

SEQ ID NO: 3120196 - RNA, 11 nt, Human
cucacucuguc

SEQ ID NO: 3120197 - RNA, 12 nt, Human
cucacucugucg

SEQ ID NO: 3120198 - RNA, 13 nt, Human
cucacuccuugaa

SEQ ID NO: 3120199 - RNA, 13 nt, Human
cucacugcagccu

SEQ ID NO: 3120200 - RNA, 12 nt, Human
cucacugcagcc

SEQ ID NO: 3120201 - RNA, 22 nt, Human
cucacucugucgcccagucugg

SEQ ID NO: 3120202 - RNA, 13 nt, Human
cucacucugucgc

SEQ ID NO: 3120203 - RNA, 21 nt, Human
cucacucugucgcccagucug

SEQ ID NO: 3120204 - RNA, 21 nt, Human
cucaacaccucugcacaagcu

SEQ ID NO: 3120205 - RNA, 13 nt, Human
cucaaccuccugg

SEQ ID NO: 3120206 - RNA, 15 nt, Human
cucaaccuccugggc

SEQ ID NO: 3120207 - RNA, 17 nt, Human
cucaaccuccugggcua

SEQ ID NO: 3120208 - RNA, 17 nt, Human
cucaagugauucuccug

SEQ ID NO: 3120209 - RNA, 21 nt, Human
cucaaguccucuuuucugaga

SEQ ID NO: 3120210 - RNA, 14 nt, Human
cucaaguccucuuu

SEQ ID NO: 3120211 - RNA, 15 nt, Human
cucacaguccuuacc

SEQ ID NO: 3120212 - RNA, 24 nt, Human
cucacacaugagcaucaggccagg

SEQ ID NO: 3120213 - RNA, 22 nt, Human
cucacacaugagcaucaggcca

SEQ ID NO: 3120214 - RNA, 13 nt, Human
cucaccagcccca

SEQ ID NO: 3120215 - RNA, 14 nt, Human
cucaccagccccag

SEQ ID NO: 3120216 - RNA, 15 nt, Human
cucaccagccccagu

SEQ ID NO: 3120217 - RNA, 17 nt, Human
cucaccagccccagugc

SEQ ID NO: 3120218 - RNA, 18 nt, Human
cucaccagccccagugcc

SEQ ID NO: 3120219 - RNA, 15 nt, Human
cucacauuuauucug

SEQ ID NO: 3120220 - RNA, 19 nt, Human
cucacauuuauucugcuca

SEQ ID NO: 3120221 - RNA, 22 nt, Human
cucacauuuauucugcucacau

SEQ ID NO: 3120222 - RNA, 19 nt, Human
cucacaguccuuaccagca

SEQ ID NO: 3120223 - RNA, 17 nt, Human
cucacaguccuuaccag

SEQ ID NO: 3120224 - RNA, 22 nt, Human
cucacaguccuuaccagcagag

SEQ ID NO: 3120225 - RNA, 22 nt, Human
cucugaaggacauugcggacag

SEQ ID NO: 3120226 - RNA, 14 nt, Human
cucugacacacagc

SEQ ID NO: 3120227 - RNA, 15 nt, Human
cucugacacacagcu

SEQ ID NO: 3120228 - RNA, 16 nt, Human
cucugacacacagcuc

SEQ ID NO: 3120229 - RNA, 17 nt, Human
cucugacacacagcucu

SEQ ID NO: 3120230 - RNA, 18 nt, Human
cucugacacacagcucug

SEQ ID NO: 3120231 - RNA, 19 nt, Human
cucugacacacagcucugu

SEQ ID NO: 3120232 - RNA, 23 nt, Human
cucugacagaagaaccccagggu

SEQ ID NO: 3120233 - RNA, 21 nt, Human
cucugagacucgcgacaaugc

SEQ ID NO: 3120234 - RNA, 23 nt, Human
cucugagacucgcgacaaugcaa

SEQ ID NO: 3120235 - RNA, 20 nt, Human
cucugagacucgcgacaaug

SEQ ID NO: 3120236 - RNA, 12 nt, Human
cucugaggacac

SEQ ID NO: 3120237 - RNA, 14 nt, Human
cucugaggacacua

SEQ ID NO: 3120238 - RNA, 17 nt, Human
cucugccucccaucacc

SEQ ID NO: 3120239 - RNA, 16 nt, Human
cucugccucccaucac

SEQ ID NO: 3120240 - RNA, 14 nt, Human
cucugccucccauc

SEQ ID NO: 3120241 - RNA, 13 nt, Human
cucugccucccau

SEQ ID NO: 3120242 - RNA, 12 nt, Human
cucugcccuugg

SEQ ID NO: 3120243 - RNA, 17 nt, Human
cucugcccacucccugc

SEQ ID NO: 3120244 - RNA, 16 nt, Human
cucugcccacucccug

SEQ ID NO: 3120245 - RNA, 15 nt, Human
cucugcccacucccu

SEQ ID NO: 3120246 - RNA, 13 nt, Human
cucugcccacucc

SEQ ID NO: 3120247 - RNA, 20 nt, Human
cucugcccacucccugcaac

SEQ ID NO: 3120248 - RNA, 18 nt, Human
cucugcccacucccugca

SEQ ID NO: 3120249 - RNA, 13 nt, Human
cucugcacaagcu

SEQ ID NO: 3120250 - RNA, 10 nt, Human
cucugcacaa

SEQ ID NO: 3120251 - RNA, 15 nt, Human
cucugcacaagcugc

SEQ ID NO: 3120252 - RNA, 14 nt, Human
cucugcacaagcug

SEQ ID NO: 3120253 - RNA, 19 nt, Human
cucugugucagguggggca

SEQ ID NO: 3120254 - RNA, 20 nt, Human
cucugugucagguggggcag

SEQ ID NO: 3120255 - RNA, 21 nt, Human
cucugugucagguggggcagc

SEQ ID NO: 3120256 - RNA, 22 nt, Human
cucugugucagguggggcagcu

SEQ ID NO: 3120257 - RNA, 23 nt, Human
cucugugucagguggggcagcuu

SEQ ID NO: 3120258 - RNA, 15 nt, Human
cucuucuccaggcug

SEQ ID NO: 3120259 - RNA, 13 nt, Human
cucuucuccaggc

SEQ ID NO: 3120260 - RNA, 14 nt, Human
cucuguccugggag

SEQ ID NO: 3120261 - RNA, 13 nt, Human
cucuguccuggga

SEQ ID NO: 3120262 - RNA, 15 nt, Human
cucuguccugggagu

SEQ ID NO: 3120263 - RNA, 22 nt, Human
cucuguccugggagugagcugg

SEQ ID NO: 3120264 - RNA, 18 nt, Human
cucugucgcccagucugg

SEQ ID NO: 3120265 - RNA, 19 nt, Human
cucugucgcccagucugga

SEQ ID NO: 3120266 - RNA, 17 nt, Human
cucugucgcccagucug

SEQ ID NO: 3120267 - RNA, 13 nt, Human
cucugucgcccag

SEQ ID NO: 3120268 - RNA, 20 nt, Human
cucuggcagcucagagaggg

SEQ ID NO: 3120269 - RNA, 23 nt, Human
cucuggcagcucagagagggugg

SEQ ID NO: 3120270 - RNA, 16 nt, Human
cucugccucugacaca

SEQ ID NO: 3120271 - RNA, 21 nt, Human
cucugccucccaucacccgcu

SEQ ID NO: 3120272 - RNA, 19 nt, Human
cucugccucugacacacag

SEQ ID NO: 3120273 - RNA, 20 nt, Human
cucugccucugacacacagc

SEQ ID NO: 3120274 - RNA, 16 nt, Human
cucuucuccaggcugu

SEQ ID NO: 3120275 - RNA, 23 nt, Human
cucuuuggucuacacugugcuga

SEQ ID NO: 3120276 - RNA, 22 nt, Human
cucuuuggucuacacugugcug

SEQ ID NO: 3120277 - RNA, 14 nt, Human
cucuuuucaaaaca

SEQ ID NO: 3120278 - RNA, 23 nt, Human
cugaaagggacgcuacccgggaa

SEQ ID NO: 3120279 - RNA, 20 nt, Human
cugaagucuuuguacagaca

SEQ ID NO: 3120280 - RNA, 17 nt, Human
cugaagucuuuguacag

SEQ ID NO: 3120281 - RNA, 22 nt, Human
cugaagucccagauacuugggg

SEQ ID NO: 3120282 - RNA, 16 nt, Human
cugaagucacacagug

SEQ ID NO: 3120283 - RNA, 21 nt, Human
cugaagucacacagugagucg

SEQ ID NO: 3120284 - RNA, 18 nt, Human
cugaagucacacagugag

SEQ ID NO: 3120285 - RNA, 19 nt, Human
cugaagucacacagugagu

SEQ ID NO: 3120286 - RNA, 17 nt, Human
cugaagucacacaguga

SEQ ID NO: 3120287 - RNA, 19 nt, Human
cugaaugguuuucaaaaua

SEQ ID NO: 3120288 - RNA, 20 nt, Human
cugaaugguuuucaaaauaa

SEQ ID NO: 3120289 - RNA, 12 nt, Human
cugaauuucuuu

SEQ ID NO: 3120290 - RNA, 16 nt, Human
cugacagacacaggcc

SEQ ID NO: 3120291 - RNA, 14 nt, Human
cugaauuucuuuug

SEQ ID NO: 3120292 - RNA, 15 nt, Human
cugacagacacaggc

SEQ ID NO: 3120293 - RNA, 17 nt, Human
cugacagacacaggccc

SEQ ID NO: 3120294 - RNA, 18 nt, Human
cugacagacacaggcccg

SEQ ID NO: 3120295 - RNA, 19 nt, Human
cugagacagcccgggcucu

SEQ ID NO: 3120296 - RNA, 20 nt, Human
cugagacagcccgggcucug

SEQ ID NO: 3120297 - RNA, 22 nt, Human
cugagacagcccgggcucugcc

SEQ ID NO: 3120298 - RNA, 21 nt, Human
cugagacagcccgggcucugc

SEQ ID NO: 3120299 - RNA, 14 nt, Human
cugagccagauuuc

SEQ ID NO: 3120300 - RNA, 13 nt, Human
cugagccagauuu

SEQ ID NO: 3120301 - RNA, 19 nt, Human
cugcgguccacccaggagc

SEQ ID NO: 3120302 - RNA, 20 nt, Human
cugcgguccacccaggagcc

SEQ ID NO: 3120303 - RNA, 17 nt, Human
cugcgguccacccagga

SEQ ID NO: 3120304 - RNA, 18 nt, Human
cugcgguccacccaggag

SEQ ID NO: 3120305 - RNA, 21 nt, Human
cugccugcccaggccccugcc

SEQ ID NO: 3120306 - RNA, 22 nt, Human
cugccugcccaggccccugcca

SEQ ID NO: 3120307 - RNA, 17 nt, Human
cugccucugacacacag

SEQ ID NO: 3120308 - RNA, 15 nt, Human
cugccucugacacac

SEQ ID NO: 3120309 - RNA, 18 nt, Human
cugccucugacacacagc

SEQ ID NO: 3120310 - RNA, 21 nt, Human
cugccucugacacacagcucu

SEQ ID NO: 3120311 - RNA, 13 nt, Human
cugccgcagcccu

SEQ ID NO: 3120312 - RNA, 12 nt, Human
cugccgcagccc

SEQ ID NO: 3120313 - RNA, 23 nt, Human
cugccgcagcccugcagagggca

SEQ ID NO: 3120314 - RNA, 22 nt, Human
cugccgcagcccugcagagggc

SEQ ID NO: 3120315 - RNA, 21 nt, Human
cugccgcagcccugcagaggg

SEQ ID NO: 3120316 - RNA, 20 nt, Human
cugccgcagcccugcagagg

SEQ ID NO: 3120317 - RNA, 19 nt, Human
cugccgcagcccugcagag

SEQ ID NO: 3120318 - RNA, 19 nt, Human
cugccucagccucccaaag

SEQ ID NO: 3120319 - RNA, 15 nt, Human
cugccucagccuccc

SEQ ID NO: 3120320 - RNA, 14 nt, Human
cugccucagccucc

SEQ ID NO: 3120321 - RNA, 22 nt, Human
cugcaugcgggcuuccuccugg

SEQ ID NO: 3120322 - RNA, 18 nt, Human
cugcaugcgggcuuccuc

SEQ ID NO: 3120323 - RNA, 19 nt, Human
cugccaaugggagcucaug

SEQ ID NO: 3120324 - RNA, 18 nt, Human
cugccaaugggagcucau

SEQ ID NO: 3120325 - RNA, 17 nt, Human
cugccaaugggagcuca

SEQ ID NO: 3120326 - RNA, 22 nt, Human
cugcaucguuucaucuuccaac

SEQ ID NO: 3120327 - RNA, 16 nt, Human
cugcaucguuucaucu

SEQ ID NO: 3120328 - RNA, 23 nt, Human
cugcacuugcagacucuacagag

SEQ ID NO: 3120329 - RNA, 19 nt, Human
cugcaguugccagucaccc

SEQ ID NO: 3120330 - RNA, 17 nt, Human
cugcaguugccagucac

SEQ ID NO: 3120331 - RNA, 22 nt, Human
cugcaguugccagucaccccgg

SEQ ID NO: 3120332 - RNA, 21 nt, Human
cugcaguugccagucaccccg

SEQ ID NO: 3120333 - RNA, 18 nt, Human
cugcccacucccugcaac

SEQ ID NO: 3120334 - RNA, 16 nt, Human
cugcccacucccugca

SEQ ID NO: 3120335 - RNA, 15 nt, Human
cugcccacucccugc

SEQ ID NO: 3120336 - RNA, 14 nt, Human
cugcccacucccug

SEQ ID NO: 3120337 - RNA, 22 nt, Human
cugcccaccuggccucugcacu

SEQ ID NO: 3120338 - RNA, 20 nt, Human
cugcccaccuggccucugca

SEQ ID NO: 3120339 - RNA, 19 nt, Human
cugcccaccuggccucugc

SEQ ID NO: 3120340 - RNA, 18 nt, Human
cugcccaccuggccucug

SEQ ID NO: 3120341 - RNA, 17 nt, Human
cugcccaccuggccucu

SEQ ID NO: 3120342 - RNA, 14 nt, Human
cugccaugccagcu

SEQ ID NO: 3120343 - RNA, 13 nt, Human
cugcccaccuggc

SEQ ID NO: 3120344 - RNA, 15 nt, Human
cugcccaccuggccu

SEQ ID NO: 3120345 - RNA, 14 nt, Human
cugcccaccuggcc

SEQ ID NO: 3120346 - RNA, 13 nt, Human
cugccaggcaugg

SEQ ID NO: 3120347 - RNA, 11 nt, Human
cugccaggcau

SEQ ID NO: 3120348 - RNA, 13 nt, Human
cugaggcugggcu

SEQ ID NO: 3120349 - RNA, 22 nt, Human
cugaggcugggcucccuuccca

SEQ ID NO: 3120350 - RNA, 17 nt, Human
cugaggcugggcucccu

SEQ ID NO: 3120351 - RNA, 16 nt, Human
cugaggcugggcuccc

SEQ ID NO: 3120352 - RNA, 15 nt, Human
cugaggcugggcucc

SEQ ID NO: 3120353 - RNA, 24 nt, Human
cugaggcccuucucuccagccccu

SEQ ID NO: 3120354 - RNA, 14 nt, Human
cugauggugcaaug

SEQ ID NO: 3120355 - RNA, 16 nt, Human
cugauggugcaaugac

SEQ ID NO: 3120356 - RNA, 15 nt, Human
cugauggugcaauga

SEQ ID NO: 3120357 - RNA, 21 nt, Human
cugauccuaguuccaccauca

SEQ ID NO: 3120358 - RNA, 20 nt, Human
cugauccuaguuccaccauc

SEQ ID NO: 3120359 - RNA, 21 nt, Human
cugauaaagaugagugagcau

SEQ ID NO: 3120360 - RNA, 17 nt, Human
cugagucugaaggcugg

SEQ ID NO: 3120361 - RNA, 19 nt, Human
cugagucugaaggcugggu

SEQ ID NO: 3120362 - RNA, 18 nt, Human
cugagucugaaggcuggg

SEQ ID NO: 3120363 - RNA, 22 nt, Human
cugagugggggaucacagccuc

SEQ ID NO: 3120364 - RNA, 12 nt, Human
cugcaccgggcc

SEQ ID NO: 3120365 - RNA, 23 nt, Human
cugcaccggcuggccuggccccu

SEQ ID NO: 3120366 - RNA, 15 nt, Human
cugcacuccccugcu

SEQ ID NO: 3120367 - RNA, 14 nt, Human
cugcacuccccugc

SEQ ID NO: 3120368 - RNA, 22 nt, Human
cugcaccggcuggccuggcccc

SEQ ID NO: 3120369 - RNA, 20 nt, Human
cugcaccggcuggccuggcc

SEQ ID NO: 3120370 - RNA, 14 nt, Human
cugcacccucaggc

SEQ ID NO: 3120371 - RNA, 13 nt, Human
cugcacccucagg

SEQ ID NO: 3120372 - RNA, 18 nt, Human
cugcacuugcagacucua

SEQ ID NO: 3120373 - RNA, 17 nt, Human
cugcacuccccugcugg

SEQ ID NO: 3120374 - RNA, 16 nt, Human
cugcacuccccugcug

SEQ ID NO: 3120375 - RNA, 18 nt, Human
cugcacaagcugcacccu

SEQ ID NO: 3120376 - RNA, 22 nt, Human
cugcacaagcugcacccucagg

SEQ ID NO: 3120377 - RNA, 18 nt, Human
cugcaauaaggggagagu

SEQ ID NO: 3120378 - RNA, 23 nt, Human
cugauuuuuuuuuccuucagugc

SEQ ID NO: 3120379 - RNA, 22 nt, Human
cugauuuuuuuuuccuucagug

SEQ ID NO: 3120380 - RNA, 21 nt, Human
cugauuuuuuuuuccuucagu

SEQ ID NO: 3120381 - RNA, 20 nt, Human
cugauuuuuuuuuccuucag

SEQ ID NO: 3120382 - RNA, 19 nt, Human
cugauuuuuuuuuccuuca

SEQ ID NO: 3120383 - RNA, 18 nt, Human
cugauuuuuuuuuccuuc

SEQ ID NO: 3120384 - RNA, 16 nt, Human
cugauuuuuuuuuccu

SEQ ID NO: 3120385 - RNA, 21 nt, Human
cugauugugucucuugguccu

SEQ ID NO: 3120386 - RNA, 21 nt, Human
cugauggugcaaugaccuuuc

SEQ ID NO: 3120387 - RNA, 20 nt, Human
cugauggugcaaugaccuuu

SEQ ID NO: 3120388 - RNA, 19 nt, Human
cugauggugcaaugaccuu

SEQ ID NO: 3120389 - RNA, 17 nt, Human
cugauggugcaaugacc

SEQ ID NO: 3120390 - RNA, 17 nt, Human
cugauugugucucuugg

SEQ ID NO: 3120391 - RNA, 12 nt, Human
gaguccccuguu

SEQ ID NO: 3120392 - RNA, 23 nt, Human
gaguccccuguuuguuucugaaa

SEQ ID NO: 3120393 - RNA, 14 nt, Human
gaguccccuguuug

SEQ ID NO: 3120394 - RNA, 12 nt, Human
gaguagcuggga

SEQ ID NO: 3120395 - RNA, 14 nt, Human
gaguagcugggacu

SEQ ID NO: 3120396 - RNA, 21 nt, Human
gagucccaccuuggcugcagg

SEQ ID NO: 3120397 - RNA, 21 nt, Human
gagucugaaggcuggguucug

SEQ ID NO: 3120398 - RNA, 22 nt, Human
gagucucacuguugcccaggcu

SEQ ID NO: 3120399 - RNA, 23 nt, Human
gagucucacuguugcccaggcug

SEQ ID NO: 3120400 - RNA, 19 nt, Human
gagucucacuguugcccag

SEQ ID NO: 3120401 - RNA, 20 nt, Human
gagucucacuguugcccagg

SEQ ID NO: 3120402 - RNA, 21 nt, Human
gagucucacuguugcccaggc

SEQ ID NO: 3120403 - RNA, 16 nt, Human
gagucgaggacaggga

SEQ ID NO: 3120404 - RNA, 17 nt, Human
gagucgaggacagggag

SEQ ID NO: 3120405 - RNA, 22 nt, Human
gaggggggaggugggauccucc

SEQ ID NO: 3120406 - RNA, 15 nt, Human
gaggggggagguggg

SEQ ID NO: 3120407 - RNA, 18 nt, Human
gaggugggauccuccagg

SEQ ID NO: 3120408 - RNA, 22 nt, Human
gaggugggauccuccaggugca

SEQ ID NO: 3120409 - RNA, 21 nt, Human
gaggugggauccuccaggugc

SEQ ID NO: 3120410 - RNA, 19 nt, Human
gaguacuacaguccuccca

SEQ ID NO: 3120411 - RNA, 18 nt, Human
gaguacuacaguccuccc

SEQ ID NO: 3120412 - RNA, 17 nt, Human
gaguacguugugcauuu

SEQ ID NO: 3120413 - RNA, 18 nt, Human
gaguacguugugcauuug

SEQ ID NO: 3120414 - RNA, 15 nt, Human
gaguacuacaguccu

SEQ ID NO: 3120415 - RNA, 20 nt, Human
gaguacguugugcauuuggu

SEQ ID NO: 3120416 - RNA, 19 nt, Human
gagguuuuaaaaaaauccc

SEQ ID NO: 3120417 - RNA, 16 nt, Human
gaguacguugugcauu

SEQ ID NO: 3120418 - RNA, 19 nt, Human
gagguucaaagauauuuug

SEQ ID NO: 3120419 - RNA, 14 nt, Human
gagguucccuuuga

SEQ ID NO: 3120420 - RNA, 13 nt, Human
gauacaaugcugu

SEQ ID NO: 3120421 - RNA, 18 nt, Human
gauacaaugcugugcccu

SEQ ID NO: 3120422 - RNA, 18 nt, Human
gauagcacagacccugcc

SEQ ID NO: 3120423 - RNA, 17 nt, Human
gauagcacagacccugc

SEQ ID NO: 3120424 - RNA, 17 nt, Human
gauacaaaagcauguga

SEQ ID NO: 3120425 - RNA, 23 nt, Human
gauauaugcucugcauguuacau

SEQ ID NO: 3120426 - RNA, 21 nt, Human
gaucaaccccuucgcuccugu

SEQ ID NO: 3120427 - RNA, 22 nt, Human
gaucaaccccuucgcuccugug

SEQ ID NO: 3120428 - RNA, 19 nt, Human
gauagcacagacccugccc

SEQ ID NO: 3120429 - RNA, 12 nt, Human
gauagccaaggc

SEQ ID NO: 3120430 - RNA, 16 nt, Human
gauagcacagacccug

SEQ ID NO: 3120431 - RNA, 13 nt, Human
gauagccaaggcc

SEQ ID NO: 3120432 - RNA, 12 nt, Human
gagugggcccaa

SEQ ID NO: 3120433 - RNA, 15 nt, Human
gagucugaaggcugg

SEQ ID NO: 3120434 - RNA, 20 nt, Human
gaguucaucuugaauuguaa

SEQ ID NO: 3120435 - RNA, 23 nt, Human
gaguucaucuugaauuguaagga

SEQ ID NO: 3120436 - RNA, 13 nt, Human
gaguucugguucc

SEQ ID NO: 3120437 - RNA, 23 nt, Human
gaucaaccccuucgcuccugugu

SEQ ID NO: 3120438 - RNA, 13 nt, Human
gaucacgccacug

SEQ ID NO: 3120439 - RNA, 14 nt, Human
gaucacgccacugc

SEQ ID NO: 3120440 - RNA, 15 nt, Human
gaucacgccacugca

SEQ ID NO: 3120441 - RNA, 18 nt, Human
gauccuaguuccaccauc

SEQ ID NO: 3120442 - RNA, 18 nt, Human
gauccuaggcauuugcug

SEQ ID NO: 3120443 - RNA, 11 nt, Human
gauccuccagg

SEQ ID NO: 3120444 - RNA, 19 nt, Human
gauccucccaccucagccu

SEQ ID NO: 3120445 - RNA, 12 nt, Human
gauccuccaggu

SEQ ID NO: 3120446 - RNA, 20 nt, Human
gauccucccaccucagccuc

SEQ ID NO: 3120447 - RNA, 19 nt, Human
gauccugagccagauuuca

SEQ ID NO: 3120448 - RNA, 15 nt, Human
gauccugagccagau

SEQ ID NO: 3120449 - RNA, 14 nt, Human
gauccugagccaga

SEQ ID NO: 3120450 - RNA, 13 nt, Human
gauccugagccag

SEQ ID NO: 3120451 - RNA, 15 nt, Human
gaugaaaaaauaaca

SEQ ID NO: 3120452 - RNA, 16 nt, Human
gaucuuugcagacagg

SEQ ID NO: 3120453 - RNA, 18 nt, Human
gauccucccaccucagcc

SEQ ID NO: 3120454 - RNA, 22 nt, Human
gaugggcaacccccagccugcu

SEQ ID NO: 3120455 - RNA, 22 nt, Human
gaugagaaagguugaagcacca

SEQ ID NO: 3120456 - RNA, 11 nt, Human
gaugagaaagg

SEQ ID NO: 3120457 - RNA, 20 nt, Human
gaugaccuugaaugaugcca

SEQ ID NO: 3120458 - RNA, 20 nt, Human
gauuguccccgacccuugcc

SEQ ID NO: 3120459 - RNA, 15 nt, Human
gauuguccccgaccc

SEQ ID NO: 3120460 - RNA, 18 nt, Human
gauugcuugagcucagga

SEQ ID NO: 3120461 - RNA, 23 nt, Human
gauugacgggacuguugguauug

SEQ ID NO: 3120462 - RNA, 21 nt, Human
gauucccaagcucugcuccuc

SEQ ID NO: 3120463 - RNA, 22 nt, Human
gauucccaagcucugcuccucu

SEQ ID NO: 3120464 - RNA, 12 nt, Human
gauucagacagc

SEQ ID NO: 3120465 - RNA, 20 nt, Human
gauggugcaaugaccuuuca

SEQ ID NO: 3120466 - RNA, 23 nt, Human
gauggugcaaugaccuuucaaua

SEQ ID NO: 3120467 - RNA, 14 nt, Human
gauguucugggaca

SEQ ID NO: 3120468 - RNA, 16 nt, Human
gauguucugggacaca

SEQ ID NO: 3120469 - RNA, 21 nt, Human
gauguucuuucacccuuuucu

SEQ ID NO: 3120470 - RNA, 21 nt, Human
gauguuuuaaggaugcuugua

SEQ ID NO: 3120471 - RNA, 14 nt, Human
gauguuuuccauga

SEQ ID NO: 3120472 - RNA, 23 nt, Human
gauguuuuccaugaguccccugu

SEQ ID NO: 3120473 - RNA, 15 nt, Human
gauguuuuccaugag

SEQ ID NO: 3120474 - RNA, 12 nt, Human
gauuaaauucuu

SEQ ID NO: 3120475 - RNA, 19 nt, Human
gauuaaauucuugcaaagu

SEQ ID NO: 3120476 - RNA, 18 nt, Human
gauuaaccacuucagcug

SEQ ID NO: 3120477 - RNA, 21 nt, Human
gauuaaccacuucagcugacu

SEQ ID NO: 3120478 - RNA, 19 nt, Human
gauuaaccacuucagcuga

SEQ ID NO: 3120479 - RNA, 19 nt, Human
gauucaacagguuuuccug

SEQ ID NO: 3120480 - RNA, 13 nt, Human
gagcugccaccug

SEQ ID NO: 3120481 - RNA, 16 nt, Human
gagcugccaccugccu

SEQ ID NO: 3120482 - RNA, 15 nt, Human
gagcugccaccugcc

SEQ ID NO: 3120483 - RNA, 23 nt, Human
gagcuacacaggggaaaagagga

SEQ ID NO: 3120484 - RNA, 15 nt, Human
gagccuggcaagaau

SEQ ID NO: 3120485 - RNA, 10 nt, Human
gagccuggca

SEQ ID NO: 3120486 - RNA, 21 nt, Human
gagccugggaggucaaggcug

SEQ ID NO: 3120487 - RNA, 13 nt, Human
gagccugggaggu

SEQ ID NO: 3120488 - RNA, 20 nt, Human
gagccucagcauccuggcac

SEQ ID NO: 3120489 - RNA, 21 nt, Human
gagccucagcauccuggcacc

SEQ ID NO: 3120490 - RNA, 14 nt, Human
gagccuccugcccu

SEQ ID NO: 3120491 - RNA, 15 nt, Human
gagcccugguggcag

SEQ ID NO: 3120492 - RNA, 16 nt, Human
gagcccugguggcagu

SEQ ID NO: 3120493 - RNA, 19 nt, Human
gagccucagcauccuggca

SEQ ID NO: 3120494 - RNA, 17 nt, Human
gagcccugguggcagug

SEQ ID NO: 3120495 - RNA, 22 nt, Human
gagccuccugcccuuaccugcc

SEQ ID NO: 3120496 - RNA, 20 nt, Human
gagccuccugcccuuaccug

SEQ ID NO: 3120497 - RNA, 22 nt, Human
gagccacugcaccgggccacag

SEQ ID NO: 3120498 - RNA, 11 nt, Human
gagcccacgcc

SEQ ID NO: 3120499 - RNA, 14 nt, Human
gagcccaggccucc

SEQ ID NO: 3120500 - RNA, 13 nt, Human
gagcccaggccuc

SEQ ID NO: 3120501 - RNA, 12 nt, Human
gagcccaggccu

SEQ ID NO: 3120502 - RNA, 16 nt, Human
gagcccacgcccccac

SEQ ID NO: 3120503 - RNA, 15 nt, Human
gagcccacgccccca

SEQ ID NO: 3120504 - RNA, 12 nt, Human
gagcccacgccc

SEQ ID NO: 3120505 - RNA, 18 nt, Human
gagcagccacauuccuga

SEQ ID NO: 3120506 - RNA, 20 nt, Human
gagccacugcaccgggccac

SEQ ID NO: 3120507 - RNA, 13 nt, Human
gagaucagccugg

SEQ ID NO: 3120508 - RNA, 16 nt, Human
gagaucagccugggca

SEQ ID NO: 3120509 - RNA, 14 nt, Human
gagaucagccuggg

SEQ ID NO: 3120510 - RNA, 20 nt, Human
gagaucaaccccuucgcucc

SEQ ID NO: 3120511 - RNA, 17 nt, Human
gagcaccuuagacaguc

SEQ ID NO: 3120512 - RNA, 22 nt, Human
gagcaagacgcugugcugcccu

SEQ ID NO: 3120513 - RNA, 18 nt, Human
gagcaagacgcugugcug

SEQ ID NO: 3120514 - RNA, 21 nt, Human
gagcaagacgcugugcugccc

SEQ ID NO: 3120515 - RNA, 19 nt, Human
gagcaaaaucgaugcagug

SEQ ID NO: 3120516 - RNA, 12 nt, Human
gaggggccucuu

SEQ ID NO: 3120517 - RNA, 22 nt, Human
gaggggccucuuaugggcuggg

SEQ ID NO: 3120518 - RNA, 23 nt, Human
gagggcacagaaaauggaagaca

SEQ ID NO: 3120519 - RNA, 22 nt, Human
gagggcacagaaaauggaagac

SEQ ID NO: 3120520 - RNA, 14 nt, Human
gagggcacagaaaa

SEQ ID NO: 3120521 - RNA, 13 nt, Human
gagggagugacag

SEQ ID NO: 3120522 - RNA, 14 nt, Human
gagggagguaagga

SEQ ID NO: 3120523 - RNA, 14 nt, Human
gagggagugacaga

SEQ ID NO: 3120524 - RNA, 14 nt, Human
gagggagggagggc

SEQ ID NO: 3120525 - RNA, 15 nt, Human
gagggagggcuccag

SEQ ID NO: 3120526 - RNA, 15 nt, Human
gagggagggagggcu

SEQ ID NO: 3120527 - RNA, 15 nt, Human
gaggcugggcucccu

SEQ ID NO: 3120528 - RNA, 14 nt, Human
gaggcugggcuccc

SEQ ID NO: 3120529 - RNA, 13 nt, Human
gaggcugggcucc

SEQ ID NO: 3120530 - RNA, 14 nt, Human
gaggccuucucuga

SEQ ID NO: 3120531 - RNA, 22 nt, Human
gaggcccuucucuccagccccu

SEQ ID NO: 3120532 - RNA, 24 nt, Human
gaggcccuucucuccagccccugg

SEQ ID NO: 3120533 - RNA, 23 nt, Human
gaggcccuucucuccagccccug

SEQ ID NO: 3120534 - RNA, 14 nt, Human
gaggaauccagacc

SEQ ID NO: 3120535 - RNA, 22 nt, Human
gaggaaggaaacccagcucugg

SEQ ID NO: 3120536 - RNA, 15 nt, Human
gaggaauccagaccc

SEQ ID NO: 3120537 - RNA, 13 nt, Human
gaggacagggagg

SEQ ID NO: 3120538 - RNA, 22 nt, Human
gaggacagggaggugaccccag

SEQ ID NO: 3120539 - RNA, 23 nt, Human
gaggacagggaggugaccccagg

SEQ ID NO: 3120540 - RNA, 12 nt, Human
gaggccagccuu

SEQ ID NO: 3120541 - RNA, 13 nt, Human
gaggccagccuug

SEQ ID NO: 3120542 - RNA, 23 nt, Human
gaggcagccccauucugccugcc

SEQ ID NO: 3120543 - RNA, 21 nt, Human
gaggcagccccauucugccug

SEQ ID NO: 3120544 - RNA, 22 nt, Human
gaggcagccccauucugccugc

SEQ ID NO: 3120545 - RNA, 13 nt, Human
gaggcagccccau

SEQ ID NO: 3120546 - RNA, 23 nt, Human
gaggaguuugggguaugggagag

SEQ ID NO: 3120547 - RNA, 17 nt, Human
gaggauguucugggaca

SEQ ID NO: 3120548 - RNA, 20 nt, Human
gaggauguucugggacacag

SEQ ID NO: 3120549 - RNA, 12 nt, Human
gaggauguucug

SEQ ID NO: 3120550 - RNA, 21 nt, Human
gccagagggagugacagaggc

SEQ ID NO: 3120551 - RNA, 22 nt, Human
gccagagggagugacagaggca

SEQ ID NO: 3120552 - RNA, 22 nt, Human
gccagaggagagaggacccccu

SEQ ID NO: 3120553 - RNA, 19 nt, Human
gccagaggagagaggaccc

SEQ ID NO: 3120554 - RNA, 17 nt, Human
gccagaggagagaggac

SEQ ID NO: 3120555 - RNA, 15 nt, Human
gccagaggagagagg

SEQ ID NO: 3120556 - RNA, 13 nt, Human
gccagaggagaga

SEQ ID NO: 3120557 - RNA, 12 nt, Human
gccagaggagag

SEQ ID NO: 3120558 - RNA, 23 nt, Human
gccagagggagugacagaggcag

SEQ ID NO: 3120559 - RNA, 16 nt, Human
gccagaugcaccagcc

SEQ ID NO: 3120560 - RNA, 17 nt, Human
gccagaugcaccagccc

SEQ ID NO: 3120561 - RNA, 18 nt, Human
gccagaugcaccagcccu

SEQ ID NO: 3120562 - RNA, 16 nt, Human
gccagagacacaagcc

SEQ ID NO: 3120563 - RNA, 19 nt, Human
gccagagacacaagccuuc

SEQ ID NO: 3120564 - RNA, 17 nt, Human
gccagagacacaagccu

SEQ ID NO: 3120565 - RNA, 10 nt, Human
gccagaggag

SEQ ID NO: 3120566 - RNA, 20 nt, Human
gccagagacacaagccuucg

SEQ ID NO: 3120567 - RNA, 17 nt, Human
gccaccugccuguuggg

SEQ ID NO: 3120568 - RNA, 18 nt, Human
gccacggccaggccagag

SEQ ID NO: 3120569 - RNA, 17 nt, Human
gccacggccaggccaga

SEQ ID NO: 3120570 - RNA, 19 nt, Human
gccacggccaggccagagg

SEQ ID NO: 3120571 - RNA, 22 nt, Human
gccaccugcggugcuaucuccc

SEQ ID NO: 3120572 - RNA, 20 nt, Human
gccaccugcggugcuaucuc

SEQ ID NO: 3120573 - RNA, 14 nt, Human
gccaccugcggugc

SEQ ID NO: 3120574 - RNA, 15 nt, Human
gccaaggugggagga

SEQ ID NO: 3120575 - RNA, 14 nt, Human
gccaaggugggagg

SEQ ID NO: 3120576 - RNA, 23 nt, Human
gccaaggugggaggauugcuuga

SEQ ID NO: 3120577 - RNA, 21 nt, Human
gccaaggcugggggaagaagc

SEQ ID NO: 3120578 - RNA, 19 nt, Human
gcauuugaggucuguucuu

SEQ ID NO: 3120579 - RNA, 20 nt, Human
gcauuugaggucuguucuuu

SEQ ID NO: 3120580 - RNA, 22 nt, Human
gcauuuggugguuucagaaaug

SEQ ID NO: 3120581 - RNA, 23 nt, Human
gcauuuggugguuucagaaaugu

SEQ ID NO: 3120582 - RNA, 23 nt, Human
gccacagagaaaguacuucucca

SEQ ID NO: 3120583 - RNA, 13 nt, Human
gccacagagaaag

SEQ ID NO: 3120584 - RNA, 14 nt, Human
gccacagagaaagu

SEQ ID NO: 3120585 - RNA, 20 nt, Human
gccacagagaaaguacuucu

SEQ ID NO: 3120586 - RNA, 22 nt, Human
gccacaagacccuugugguccc

SEQ ID NO: 3120587 - RNA, 16 nt, Human
gccacaagacccuugu

SEQ ID NO: 3120588 - RNA, 24 nt, Human
gcccagccccuucugacccaugcu

SEQ ID NO: 3120589 - RNA, 20 nt, Human
gcccagccccuucugaccca

SEQ ID NO: 3120590 - RNA, 17 nt, Human
gcccagccccuucugac

SEQ ID NO: 3120591 - RNA, 16 nt, Human
gcccagccccuucuga

SEQ ID NO: 3120592 - RNA, 14 nt, Human
gcccagccccuucu

SEQ ID NO: 3120593 - RNA, 13 nt, Human
gcccagccccuuc

SEQ ID NO: 3120594 - RNA, 15 nt, Human
gcccaguugggugga

SEQ ID NO: 3120595 - RNA, 19 nt, Human
gcccagucuggaaugcagu

SEQ ID NO: 3120596 - RNA, 23 nt, Human
gcccaggcuuagucacugagaca

SEQ ID NO: 3120597 - RNA, 21 nt, Human
gcccaggcuuagucacugaga

SEQ ID NO: 3120598 - RNA, 19 nt, Human
gcccaggcuuagucacuga

SEQ ID NO: 3120599 - RNA, 22 nt, Human
gcccaggcuggcgugcaguggu

SEQ ID NO: 3120600 - RNA, 19 nt, Human
gcccaggcuggcgugcagu

SEQ ID NO: 3120601 - RNA, 20 nt, Human
gcccaggcuggcgugcagug

SEQ ID NO: 3120602 - RNA, 20 nt, Human
gcccaggaaaggcuccagga

SEQ ID NO: 3120603 - RNA, 19 nt, Human
gcccaggaaaggcuccagg

SEQ ID NO: 3120604 - RNA, 18 nt, Human
gcccaggaaaggcuccag

SEQ ID NO: 3120605 - RNA, 21 nt, Human
gcccaaugcacuuuguucugg

SEQ ID NO: 3120606 - RNA, 12 nt, Human
gcccagagggcc

SEQ ID NO: 3120607 - RNA, 19 nt, Human
gcccagagggccugcaagg

SEQ ID NO: 3120608 - RNA, 18 nt, Human
gcccagagggccugcaag

SEQ ID NO: 3120609 - RNA, 15 nt, Human
gcccagagggccugc

SEQ ID NO: 3120610 - RNA, 14 nt, Human
gcccagagggccug

SEQ ID NO: 3120611 - RNA, 9 nt, Human
gcccagccc

SEQ ID NO: 3120612 - RNA, 12 nt, Human
gcccagccccuu

SEQ ID NO: 3120613 - RNA, 11 nt, Human
gcccagccccu

SEQ ID NO: 3120614 - RNA, 22 nt, Human
gcccagagggccugcaagggag

SEQ ID NO: 3120615 - RNA, 21 nt, Human
gcccagagggccugcaaggga

SEQ ID NO: 3120616 - RNA, 20 nt, Human
gcccagagggccugcaaggg

SEQ ID NO: 3120617 - RNA, 24 nt, Human
gccaugcuccuggcccacugcauc

SEQ ID NO: 3120618 - RNA, 19 nt, Human
gccaugccagcuuaucuca

SEQ ID NO: 3120619 - RNA, 18 nt, Human
gccaugccagcuuaucuc

SEQ ID NO: 3120620 - RNA, 13 nt, Human
gccaugccagcuu

SEQ ID NO: 3120621 - RNA, 18 nt, Human
gccaugaggaacaaggca

SEQ ID NO: 3120622 - RNA, 16 nt, Human
gccauuuguguuuaua

SEQ ID NO: 3120623 - RNA, 17 nt, Human
gccagguuuuuggucug

SEQ ID NO: 3120624 - RNA, 20 nt, Human
gccagucaccccggccaccu

SEQ ID NO: 3120625 - RNA, 18 nt, Human
gccagucaccccggccac

SEQ ID NO: 3120626 - RNA, 17 nt, Human
gccagucaccccggcca

SEQ ID NO: 3120627 - RNA, 13 nt, Human
gccagggacagag

SEQ ID NO: 3120628 - RNA, 18 nt, Human
gccagggacagagggggu

SEQ ID NO: 3120629 - RNA, 16 nt, Human
gccagggacagagggg

SEQ ID NO: 3120630 - RNA, 15 nt, Human
gccaggcuggucuca

SEQ ID NO: 3120631 - RNA, 23 nt, Human
gccagggacagaggggguggccu

SEQ ID NO: 3120632 - RNA, 21 nt, Human
gccagauuucacucuccuugg

SEQ ID NO: 3120633 - RNA, 18 nt, Human
gccagauuucacucuccu

SEQ ID NO: 3120634 - RNA, 16 nt, Human
gccagauuucacucuc

SEQ ID NO: 3120635 - RNA, 15 nt, Human
gccagaugcaccagc

SEQ ID NO: 3120636 - RNA, 17 nt, Human
gcaggcagccaggccac

SEQ ID NO: 3120637 - RNA, 18 nt, Human
gcaggcagccaggccaca

SEQ ID NO: 3120638 - RNA, 22 nt, Human
gcagggcucagcggggacagcu

SEQ ID NO: 3120639 - RNA, 16 nt, Human
gcagggucucacucug

SEQ ID NO: 3120640 - RNA, 19 nt, Human
gcaggguccuagaaauucc

SEQ ID NO: 3120641 - RNA, 18 nt, Human
gcauacguacacauuuua

SEQ ID NO: 3120642 - RNA, 19 nt, Human
gcauacguacacauuuuau

SEQ ID NO: 3120643 - RNA, 22 nt, Human
gcaguggugcgaucuggguuca

SEQ ID NO: 3120644 - RNA, 19 nt, Human
gcaguggugguuuucuguu

SEQ ID NO: 3120645 - RNA, 20 nt, Human
gcaguggugcgaucuggguu

SEQ ID NO: 3120646 - RNA, 21 nt, Human
gcaguggugcgaucuggguuc

SEQ ID NO: 3120647 - RNA, 20 nt, Human
gcaguggugguuuucuguuc

SEQ ID NO: 3120648 - RNA, 21 nt, Human
gcaguggugguuuucuguucu

SEQ ID NO: 3120649 - RNA, 18 nt, Human
gcaguggugcgaucuggg

SEQ ID NO: 3120650 - RNA, 19 nt, Human
gcaguggugcgaucugggu

SEQ ID NO: 3120651 - RNA, 11 nt, Human
gcagugggagc

SEQ ID NO: 3120652 - RNA, 18 nt, Human
gcauuugaggucuguucu

SEQ ID NO: 3120653 - RNA, 22 nt, Human
gcauuccccaggaggccagccu

SEQ ID NO: 3120654 - RNA, 21 nt, Human
gcauuccccaggaggccagcc

SEQ ID NO: 3120655 - RNA, 20 nt, Human
gcauuccccaggaggccagc

SEQ ID NO: 3120656 - RNA, 19 nt, Human
gcauuccccaggaggccag

SEQ ID NO: 3120657 - RNA, 18 nt, Human
gcauuccccaggaggcca

SEQ ID NO: 3120658 - RNA, 17 nt, Human
gcauuccccaggaggcc

SEQ ID NO: 3120659 - RNA, 16 nt, Human
gcauuccccaggaggc

SEQ ID NO: 3120660 - RNA, 15 nt, Human
gcauuccccaggagg

SEQ ID NO: 3120661 - RNA, 14 nt, Human
gcauuccccaggag

SEQ ID NO: 3120662 - RNA, 12 nt, Human
gcauuccccagg

SEQ ID NO: 3120663 - RNA, 19 nt, Human
gcauuaucuagauacugua

SEQ ID NO: 3120664 - RNA, 22 nt, Human
gcauuaucuagauacuguauca

SEQ ID NO: 3120665 - RNA, 24 nt, Human
gcauuaucuagauacuguaucaug

SEQ ID NO: 3120666 - RNA, 14 nt, Human
gcaugccuggaugg

SEQ ID NO: 3120667 - RNA, 13 nt, Human
gcauguuacauaa

SEQ ID NO: 3120668 - RNA, 20 nt, Human
gcaugaaguaauaugcacac

SEQ ID NO: 3120669 - RNA, 21 nt, Human
gcaugaaguaauaugcacaca

SEQ ID NO: 3120670 - RNA, 22 nt, Human
gcaugaaguaauaugcacacau

SEQ ID NO: 3120671 - RNA, 22 nt, Human
gcaugacacgaauauugcugau

SEQ ID NO: 3120672 - RNA, 18 nt, Human
gcaugaaguaauaugcac

SEQ ID NO: 3120673 - RNA, 21 nt, Human
gcaugacacgaauauugcuga

SEQ ID NO: 3120674 - RNA, 20 nt, Human
gcaugacacgaauauugcug

SEQ ID NO: 3120675 - RNA, 12 nt, Human
gcaucaggccag

SEQ ID NO: 3120676 - RNA, 23 nt, Human
gcaucaggccaggcccucugccc

SEQ ID NO: 3120677 - RNA, 18 nt, Human
gcaucaggccaggcccuc

SEQ ID NO: 3120678 - RNA, 22 nt, Human
gcacuucgggaggucgaggcag

SEQ ID NO: 3120679 - RNA, 14 nt, Human
gcacuugcagacuc

SEQ ID NO: 3120680 - RNA, 17 nt, Human
gcagacucuacagaggc

SEQ ID NO: 3120681 - RNA, 18 nt, Human
gcagacucuacagaggcc

SEQ ID NO: 3120682 - RNA, 19 nt, Human
gcagacucuacagaggcca

SEQ ID NO: 3120683 - RNA, 22 nt, Human
gcagacucuacagaggccaugg

SEQ ID NO: 3120684 - RNA, 19 nt, Human
gcagagaccaucccugaag

SEQ ID NO: 3120685 - RNA, 21 nt, Human
gcagagaccaucccugaaggc

SEQ ID NO: 3120686 - RNA, 20 nt, Human
gcagagaccaucccugaagg

SEQ ID NO: 3120687 - RNA, 22 nt, Human
gcagagaccaucccugaaggcc

SEQ ID NO: 3120688 - RNA, 18 nt, Human
gcagauggagaccccuug

SEQ ID NO: 3120689 - RNA, 17 nt, Human
gcagccucacaguccuu

SEQ ID NO: 3120690 - RNA, 15 nt, Human
gcagccucacagucc

SEQ ID NO: 3120691 - RNA, 19 nt, Human
gcagccucacaguccuuac

SEQ ID NO: 3120692 - RNA, 19 nt, Human
gcagcagggagggcuucug

SEQ ID NO: 3120693 - RNA, 18 nt, Human
gcagcagggagggcuucu

SEQ ID NO: 3120694 - RNA, 16 nt, Human
gcagcucaccucuccc

SEQ ID NO: 3120695 - RNA, 14 nt, Human
gcagcucagagagg

SEQ ID NO: 3120696 - RNA, 21 nt, Human
gcagcucaccucucccuugga

SEQ ID NO: 3120697 - RNA, 20 nt, Human
gcagcucaccucucccuugg

SEQ ID NO: 3120698 - RNA, 17 nt, Human
gcagcucaccucucccu

SEQ ID NO: 3120699 - RNA, 19 nt, Human
gcagcucagagaggguggg

SEQ ID NO: 3120700 - RNA, 18 nt, Human
gcagcucagagagggugg

SEQ ID NO: 3120701 - RNA, 20 nt, Human
gcacuauaauguaagcucua

SEQ ID NO: 3120702 - RNA, 14 nt, Human
gcacuauaauguaa

SEQ ID NO: 3120703 - RNA, 15 nt, Human
gcacuauaauguaag

SEQ ID NO: 3120704 - RNA, 15 nt, Human
gcacugcuuccagug

SEQ ID NO: 3120705 - RNA, 14 nt, Human
gcacugcuuccagu

SEQ ID NO: 3120706 - RNA, 13 nt, Human
gcacugcuuccag

SEQ ID NO: 3120707 - RNA, 12 nt, Human
gcacugcuucca

SEQ ID NO: 3120708 - RNA, 12 nt, Human
gcacugggcuug

SEQ ID NO: 3120709 - RNA, 19 nt, Human
gcacuguuuuauuuuaauu

SEQ ID NO: 3120710 - RNA, 19 nt, Human
gcacccucaggcagguggg

SEQ ID NO: 3120711 - RNA, 16 nt, Human
gcacccucaggcaggu

SEQ ID NO: 3120712 - RNA, 19 nt, Human
gcacuaaggugugcucuga

SEQ ID NO: 3120713 - RNA, 20 nt, Human
gcacuaaggugugcucugau

SEQ ID NO: 3120714 - RNA, 14 nt, Human
gcacgugugugcac

SEQ ID NO: 3120715 - RNA, 23 nt, Human
gcacagcuucauuuccugugucu

SEQ ID NO: 3120716 - RNA, 21 nt, Human
gcacagcuucauuuccugugu

SEQ ID NO: 3120717 - RNA, 20 nt, Human
gauugugucucuugguccug

SEQ ID NO: 3120718 - RNA, 13 nt, Human
gcaccagcagccu

SEQ ID NO: 3120719 - RNA, 15 nt, Human
gcaccaucucuccuc

SEQ ID NO: 3120720 - RNA, 14 nt, Human
gcaccaucucuccu

SEQ ID NO: 3120721 - RNA, 17 nt, Human
gcaccaucucuccuccu

SEQ ID NO: 3120722 - RNA, 15 nt, Human
gcuggccuggccccu

SEQ ID NO: 3120723 - RNA, 14 nt, Human
gcuggccuggcccc

SEQ ID NO: 3120724 - RNA, 12 nt, Human
gcuggccuggcc

SEQ ID NO: 3120725 - RNA, 13 nt, Human
gcuggccuggccc

SEQ ID NO: 3120726 - RNA, 21 nt, Human
gcugggcucccuucccaccuc

SEQ ID NO: 3120727 - RNA, 19 nt, Human
gcugggaugauuggagggg

SEQ ID NO: 3120728 - RNA, 20 nt, Human
gcugggcuucaguggcagcu

SEQ ID NO: 3120729 - RNA, 21 nt, Human
gcugggcuucaguggcagcug

SEQ ID NO: 3120730 - RNA, 22 nt, Human
gcugggcuucaguggcagcugc

SEQ ID NO: 3120731 - RNA, 19 nt, Human
gcugggcuucaguggcagc

SEQ ID NO: 3120732 - RNA, 18 nt, Human
gcugggggccucagugcc

SEQ ID NO: 3120733 - RNA, 13 nt, Human
gcugggggccuca

SEQ ID NO: 3120734 - RNA, 14 nt, Human
gcugggggccucag

SEQ ID NO: 3120735 - RNA, 15 nt, Human
gcugggggccucagu

SEQ ID NO: 3120736 - RNA, 16 nt, Human
gcugucccuuuuccuu

SEQ ID NO: 3120737 - RNA, 22 nt, Human
gcugucccuuacgugaguccug

SEQ ID NO: 3120738 - RNA, 23 nt, Human
gcugucccuuacgugaguccugg

SEQ ID NO: 3120739 - RNA, 17 nt, Human
gcugucagccauuccug

SEQ ID NO: 3120740 - RNA, 14 nt, Human
gcuggugucaccug

SEQ ID NO: 3120741 - RNA, 15 nt, Human
gcuggugucaccuga

SEQ ID NO: 3120742 - RNA, 15 nt, Human
gcugugucucccuuc

SEQ ID NO: 3120743 - RNA, 17 nt, Human
gcuucucacugccaugc

SEQ ID NO: 3120744 - RNA, 22 nt, Human
gcuucucacugccaugccagcu

SEQ ID NO: 3120745 - RNA, 18 nt, Human
gcuucauuuccugugucu

SEQ ID NO: 3120746 - RNA, 20 nt, Human
gcuuauacacuuacacuuua

SEQ ID NO: 3120747 - RNA, 19 nt, Human
gcuucaguggcagcugcuu

SEQ ID NO: 3120748 - RNA, 20 nt, Human
gcuucaguggcagcugcuuu

SEQ ID NO: 3120749 - RNA, 21 nt, Human
gcuucauccuccucagaucuu

SEQ ID NO: 3120750 - RNA, 22 nt, Human
gcugcuuuugucuaugggacuc

SEQ ID NO: 3120751 - RNA, 22 nt, Human
gcugcuugggcuucauccuccu

SEQ ID NO: 3120752 - RNA, 15 nt, Human
gcuggaccuugaacu

SEQ ID NO: 3120753 - RNA, 24 nt, Human
gcugcccugcccaccuggccucug

SEQ ID NO: 3120754 - RNA, 23 nt, Human
gcugcccugcccaccuggccucu

SEQ ID NO: 3120755 - RNA, 22 nt, Human
gcugcccugcccaccuggccuc

SEQ ID NO: 3120756 - RNA, 21 nt, Human
gcugcccugcccaccuggccu

SEQ ID NO: 3120757 - RNA, 20 nt, Human
gcugcccugcccaccuggcc

SEQ ID NO: 3120758 - RNA, 18 nt, Human
gcugcccugcccaccugg

SEQ ID NO: 3120759 - RNA, 16 nt, Human
gcugcccugcccaccu

SEQ ID NO: 3120760 - RNA, 12 nt, Human
gcugcccugccc

SEQ ID NO: 3120761 - RNA, 14 nt, Human
gcugcccugcccac

SEQ ID NO: 3120762 - RNA, 13 nt, Human
gcugcccugccca

SEQ ID NO: 3120763 - RNA, 20 nt, Human
gcugccuguucagcuccagc

SEQ ID NO: 3120764 - RNA, 22 nt, Human
gcugccuguucagcuccagcuc

SEQ ID NO: 3120765 - RNA, 18 nt, Human
gcugccuguucagcucca

SEQ ID NO: 3120766 - RNA, 19 nt, Human
gcugccuguucagcuccag

SEQ ID NO: 3120767 - RNA, 14 nt, Human
gcugcgguccaccc

SEQ ID NO: 3120768 - RNA, 15 nt, Human
gcugcgguccaccca

SEQ ID NO: 3120769 - RNA, 19 nt, Human
gcugcgguccacccaggag

SEQ ID NO: 3120770 - RNA, 21 nt, Human
gcugcgguccacccaggagcc

SEQ ID NO: 3120771 - RNA, 22 nt, Human
gcugcgguccacccaggagccc

SEQ ID NO: 3120772 - RNA, 14 nt, Human
gcugcaguugccag

SEQ ID NO: 3120773 - RNA, 13 nt, Human
gcugcaguugcca

SEQ ID NO: 3120774 - RNA, 19 nt, Human
gcugcauuuaaaagauaca

SEQ ID NO: 3120775 - RNA, 17 nt, Human
gcugcauuuaaaagaua

SEQ ID NO: 3120776 - RNA, 18 nt, Human
gcugcauuuaaaagauac

SEQ ID NO: 3120777 - RNA, 20 nt, Human
gcugccaaugggagcucaug

SEQ ID NO: 3120778 - RNA, 12 nt, Human
gcugccaccugc

SEQ ID NO: 3120779 - RNA, 22 nt, Human
gcugcaaaggguaucaggugcu

SEQ ID NO: 3120780 - RNA, 22 nt, Human
gcugacuguuuucucuugagag

SEQ ID NO: 3120781 - RNA, 17 nt, Human
gcugacagacacaggcc

SEQ ID NO: 3120782 - RNA, 18 nt, Human
gcugacagacacaggccc

SEQ ID NO: 3120783 - RNA, 19 nt, Human
gcugacagacacaggcccg

SEQ ID NO: 3120784 - RNA, 20 nt, Human
gcucucaggccagcugcuug

SEQ ID NO: 3120785 - RNA, 21 nt, Human
gcucucaggccagcugcuugg

SEQ ID NO: 3120786 - RNA, 24 nt, Human
gcuccgcuuucuacccagcgagcc

SEQ ID NO: 3120787 - RNA, 13 nt, Human
gcuccuucugucc

SEQ ID NO: 3120788 - RNA, 17 nt, Human
gcuccuuuagcgcccag

SEQ ID NO: 3120789 - RNA, 17 nt, Human
gcucgagcaugccugga

SEQ ID NO: 3120790 - RNA, 21 nt, Human
gcucgagcaugccuggauggg

SEQ ID NO: 3120791 - RNA, 19 nt, Human
gcucgagcaugccuggaug

SEQ ID NO: 3120792 - RNA, 12 nt, Human
gcuccugugucu

SEQ ID NO: 3120793 - RNA, 13 nt, Human
gcuccugugucuu

SEQ ID NO: 3120794 - RNA, 20 nt, Human
gcucccuucccaccucucuc

SEQ ID NO: 3120795 - RNA, 18 nt, Human
gcuccgcuuucuacccag

SEQ ID NO: 3120796 - RNA, 21 nt, Human
gcuccgcuuucuacccagcga

SEQ ID NO: 3120797 - RNA, 22 nt, Human
gcuccgcuuucuacccagcgag

SEQ ID NO: 3120798 - RNA, 23 nt, Human
gcuccgcuuucuacccagcgagc

SEQ ID NO: 3120799 - RNA, 19 nt, Human
gcucccuucccaccucucu

SEQ ID NO: 3120800 - RNA, 20 nt, Human
gcuccagcuguucagcuggu

SEQ ID NO: 3120801 - RNA, 21 nt, Human
gcuccagcuguucagcugguu

SEQ ID NO: 3120802 - RNA, 11 nt, Human
gcuccaggagc

SEQ ID NO: 3120803 - RNA, 14 nt, Human
gcuccaggagcagc

SEQ ID NO: 3120804 - RNA, 12 nt, Human
gcuccaggagca

SEQ ID NO: 3120805 - RNA, 18 nt, Human
gcuccaggagcagccaca

SEQ ID NO: 3120806 - RNA, 17 nt, Human
gcuccaggagcagccac

SEQ ID NO: 3120807 - RNA, 16 nt, Human
gcuccaggagcagcca

SEQ ID NO: 3120808 - RNA, 15 nt, Human
gcuccaggagcagcc

SEQ ID NO: 3120809 - RNA, 12 nt, Human
gcuccaggcucc

SEQ ID NO: 3120810 - RNA, 24 nt, Human
gcuccaggcuccuuuagcgcccag

SEQ ID NO: 3120811 - RNA, 21 nt, Human
gcuaguugggcuuccucauag

SEQ ID NO: 3120812 - RNA, 22 nt, Human
gcggugcuaucucccccagccc

SEQ ID NO: 3120813 - RNA, 19 nt, Human
gcggugcuaucucccccag

SEQ ID NO: 3120814 - RNA, 19 nt, Human
gcucaaguccucuuuucug

SEQ ID NO: 3120815 - RNA, 22 nt, Human
gcucaaguccucuuuucugaga

SEQ ID NO: 3120816 - RNA, 14 nt, Human
gcuaucucccccag

SEQ ID NO: 3120817 - RNA, 18 nt, Human
gcucaaguccucuuuucu

SEQ ID NO: 3120818 - RNA, 13 nt, Human
gcuaucuccccca

SEQ ID NO: 3120819 - RNA, 18 nt, Human
gcucaccucucccuugga

SEQ ID NO: 3120820 - RNA, 17 nt, Human
gcucaccucucccuugg

SEQ ID NO: 3120821 - RNA, 16 nt, Human
gcucaccucucccuug

SEQ ID NO: 3120822 - RNA, 14 nt, Human
gcucaccucucccu

SEQ ID NO: 3120823 - RNA, 16 nt, Human
gcucacauaucuguca

SEQ ID NO: 3120824 - RNA, 12 nt, Human
gcucaccagccc

SEQ ID NO: 3120825 - RNA, 13 nt, Human
gcucaccagcccc

SEQ ID NO: 3120826 - RNA, 14 nt, Human
gcucaccagcccca

SEQ ID NO: 3120827 - RNA, 15 nt, Human
gcucaccagccccag

SEQ ID NO: 3120828 - RNA, 16 nt, Human
gcucagcggggacagc

SEQ ID NO: 3120829 - RNA, 17 nt, Human
gcucagcggggacagcu

SEQ ID NO: 3120830 - RNA, 18 nt, Human
gcucagcggggacagcuc

SEQ ID NO: 3120831 - RNA, 23 nt, Human
gcucagcggggacagcuccuucu

SEQ ID NO: 3120832 - RNA, 20 nt, Human
gccuggccagaugcaccagc

SEQ ID NO: 3120833 - RNA, 16 nt, Human
gccuggccagaugcac

SEQ ID NO: 3120834 - RNA, 21 nt, Human
gccuggccagaugcaccagcc

SEQ ID NO: 3120835 - RNA, 14 nt, Human
gccuggccccucag

SEQ ID NO: 3120836 - RNA, 13 nt, Human
gccuggccccuca

SEQ ID NO: 3120837 - RNA, 18 nt, Human
gccugggcagaaggaaga

SEQ ID NO: 3120838 - RNA, 20 nt, Human
gccuguaauccuagcacuuu

SEQ ID NO: 3120839 - RNA, 15 nt, Human
gccuguaauccuagc

SEQ ID NO: 3120840 - RNA, 12 nt, Human
gccugagcuggg

SEQ ID NO: 3120841 - RNA, 19 nt, Human
gcccaguuggguggaugcc

SEQ ID NO: 3120842 - RNA, 21 nt, Human
gcccaguuggguggaugccug

SEQ ID NO: 3120843 - RNA, 15 nt, Human
gccugaagucacaca

SEQ ID NO: 3120844 - RNA, 16 nt, Human
gccugaagucacacag

SEQ ID NO: 3120845 - RNA, 17 nt, Human
gccugaagucacacagu

SEQ ID NO: 3120846 - RNA, 18 nt, Human
gccugaagucacacagug

SEQ ID NO: 3120847 - RNA, 20 nt, Human
gccuggauggggcugcaccg

SEQ ID NO: 3120848 - RNA, 18 nt, Human
gccuggauggggcugcac

SEQ ID NO: 3120849 - RNA, 16 nt, Human
gccuggauggggcugc

SEQ ID NO: 3120850 - RNA, 15 nt, Human
gcggggacagcuccu

SEQ ID NO: 3120851 - RNA, 17 nt, Human
gcggggacagcuccuuc

SEQ ID NO: 3120852 - RNA, 19 nt, Human
gcggugagaggggaacaga

SEQ ID NO: 3120853 - RNA, 13 nt, Human
gcgguccacccag

SEQ ID NO: 3120854 - RNA, 14 nt, Human
gcgguccacccagg

SEQ ID NO: 3120855 - RNA, 21 nt, Human
gcgcugccccuggcagccccu

SEQ ID NO: 3120856 - RNA, 18 nt, Human
gcgcugccccuggcagcc

SEQ ID NO: 3120857 - RNA, 17 nt, Human
gcgcugccccuggcagc

SEQ ID NO: 3120858 - RNA, 16 nt, Human
gcggagaaaggaaggg

SEQ ID NO: 3120859 - RNA, 19 nt, Human
gcggagacggagucccacc

SEQ ID NO: 3120860 - RNA, 14 nt, Human
gcggggacagcucc

SEQ ID NO: 3120861 - RNA, 21 nt, Human
gcgccuuaaggauguucuagc

SEQ ID NO: 3120862 - RNA, 23 nt, Human
gcgcccaguuggguggaugccug

SEQ ID NO: 3120863 - RNA, 21 nt, Human
gcgacaaugcaaaccaucauu

SEQ ID NO: 3120864 - RNA, 20 nt, Human
gcgacaaugcaaaccaucau

SEQ ID NO: 3120865 - RNA, 13 nt, Human
gcgacaaugcaaa

SEQ ID NO: 3120866 - RNA, 12 nt, Human
gcgacaaugcaa

SEQ ID NO: 3120867 - RNA, 15 nt, Human
gccuuacacaauggu

SEQ ID NO: 3120868 - RNA, 22 nt, Human
ggacagccacggccaggccaga

SEQ ID NO: 3120869 - RNA, 11 nt, Human
ggacagcuccu

SEQ ID NO: 3120870 - RNA, 15 nt, Human
ggacagcuccuucug

SEQ ID NO: 3120871 - RNA, 16 nt, Human
ggacagcuccuucugu

SEQ ID NO: 3120872 - RNA, 14 nt, Human
ggaccagagcugcc

SEQ ID NO: 3120873 - RNA, 19 nt, Human
ggaccagagcugccaccug

SEQ ID NO: 3120874 - RNA, 16 nt, Human
ggacagaggggguggc

SEQ ID NO: 3120875 - RNA, 22 nt, Human
ggacacucaaaagcugggcagg

SEQ ID NO: 3120876 - RNA, 18 nt, Human
ggaccuugaacuggguac

SEQ ID NO: 3120877 - RNA, 15 nt, Human
ggagccuccugcccu

SEQ ID NO: 3120878 - RNA, 14 nt, Human
ggagccuccugccc

SEQ ID NO: 3120879 - RNA, 21 nt, Human
ggagucccaccuuggcugcag

SEQ ID NO: 3120880 - RNA, 22 nt, Human
ggagucccaccuuggcugcagg

SEQ ID NO: 3120881 - RNA, 15 nt, Human
ggaggauguucuggg

SEQ ID NO: 3120882 - RNA, 18 nt, Human
ggaggauguucugggaca

SEQ ID NO: 3120883 - RNA, 21 nt, Human
ggaggauguucugggacacag

SEQ ID NO: 3120884 - RNA, 16 nt, Human
ggagggagggcuccag

SEQ ID NO: 3120885 - RNA, 13 nt, Human
ggagggagggcuc

SEQ ID NO: 3120886 - RNA, 17 nt, Human
ggagggagggcuccaga

SEQ ID NO: 3120887 - RNA, 22 nt, Human
ggcaugacacgaauauugcuga

SEQ ID NO: 3120888 - RNA, 23 nt, Human
ggcaugugaugagaggaaaucac

SEQ ID NO: 3120889 - RNA, 18 nt, Human
ggcaugugaugagaggaa

SEQ ID NO: 3120890 - RNA, 17 nt, Human
ggcagggucucacucug

SEQ ID NO: 3120891 - RNA, 18 nt, Human
ggcagggucucacucugu

SEQ ID NO: 3120892 - RNA, 17 nt, Human
ggcagguuggugggggc

SEQ ID NO: 3120893 - RNA, 23 nt, Human
ggcagcugcgguccacccaggag

SEQ ID NO: 3120894 - RNA, 24 nt, Human
ggcagcugcgguccacccaggagc

SEQ ID NO: 3120895 - RNA, 12 nt, Human
ggcaggguccua

SEQ ID NO: 3120896 - RNA, 21 nt, Human
ggcagcugcgguccacccagg

SEQ ID NO: 3120897 - RNA, 17 nt, Human
ggcagaguugaagacag

SEQ ID NO: 3120898 - RNA, 19 nt, Human
ggcagaguugaagacagag

SEQ ID NO: 3120899 - RNA, 20 nt, Human
ggcauguucucugaggacac

SEQ ID NO: 3120900 - RNA, 22 nt, Human
ggccacagaaaauucuucucca

SEQ ID NO: 3120901 - RNA, 20 nt, Human
ggccacugugaagagaacca

SEQ ID NO: 3120902 - RNA, 11 nt, Human
ggccaggagcc

SEQ ID NO: 3120903 - RNA, 14 nt, Human
ggccaggcccucug

SEQ ID NO: 3120904 - RNA, 13 nt, Human
ggccaggagccuc

SEQ ID NO: 3120905 - RNA, 17 nt, Human
ggccaggcccucugccc

SEQ ID NO: 3120906 - RNA, 16 nt, Human
ggccaggcccucugcc

SEQ ID NO: 3120907 - RNA, 15 nt, Human
ggccaggcccucugc

SEQ ID NO: 3120908 - RNA, 12 nt, Human
ggcccagagagg

SEQ ID NO: 3120909 - RNA, 17 nt, Human
ggcaagcaccuccugcc

SEQ ID NO: 3120910 - RNA, 21 nt, Human
ggauucuuccucccucccucu

SEQ ID NO: 3120911 - RNA, 16 nt, Human
ggauucuuccucccuc

SEQ ID NO: 3120912 - RNA, 18 nt, Human
ggcaagcaccuccugccu

SEQ ID NO: 3120913 - RNA, 19 nt, Human
ggcaagcaccuccugccuc

SEQ ID NO: 3120914 - RNA, 17 nt, Human
ggcaccagcagccugga

SEQ ID NO: 3120915 - RNA, 18 nt, Human
ggcacccggccccugcug

SEQ ID NO: 3120916 - RNA, 19 nt, Human
ggcacccggccccugcugg

SEQ ID NO: 3120917 - RNA, 20 nt, Human
ggcacccggccccugcuggu

SEQ ID NO: 3120918 - RNA, 17 nt, Human
ggcacccggccccugcu

SEQ ID NO: 3120919 - RNA, 18 nt, Human
ggcacucagaagacacug

SEQ ID NO: 3120920 - RNA, 19 nt, Human
ggcacucagaagacacuga

SEQ ID NO: 3120921 - RNA, 22 nt, Human
ggcagagcagagaccaucccug

SEQ ID NO: 3120922 - RNA, 18 nt, Human
ggaugccugguggcagcu

SEQ ID NO: 3120923 - RNA, 19 nt, Human
ggaugccugguggcagcug

SEQ ID NO: 3120924 - RNA, 20 nt, Human
ggaugccugguggcagcugc

SEQ ID NO: 3120925 - RNA, 21 nt, Human
ggaugccugguggcagcugcg

SEQ ID NO: 3120926 - RNA, 16 nt, Human
ggaugaucuaggaaga

SEQ ID NO: 3120927 - RNA, 22 nt, Human
ggaugaucuaggaagacuuugg

SEQ ID NO: 3120928 - RNA, 18 nt, Human
ggaugaucuaggaagacu

SEQ ID NO: 3120929 - RNA, 23 nt, Human
ggagucccaccuuggcugcaggg

SEQ ID NO: 3120930 - RNA, 19 nt, Human
ggaugcccaaagaugcagc

SEQ ID NO: 3120931 - RNA, 13 nt, Human
ggaugccuggugg

SEQ ID NO: 3120932 - RNA, 17 nt, Human
ggaugccugguggcagc

SEQ ID NO: 3120933 - RNA, 18 nt, Human
ggaugcccaaagaugcag

SEQ ID NO: 3120934 - RNA, 14 nt, Human
ggcuuagucacuga

SEQ ID NO: 3120935 - RNA, 20 nt, Human
ggcuucacggaagagccuug

SEQ ID NO: 3120936 - RNA, 21 nt, Human
ggcuucacggaagagccuugc

SEQ ID NO: 3120937 - RNA, 18 nt, Human
ggcuuggggaccagagcu

SEQ ID NO: 3120938 - RNA, 17 nt, Human
ggcuuggggaccagagc

SEQ ID NO: 3120939 - RNA, 16 nt, Human
ggcuguuggcuggggg

SEQ ID NO: 3120940 - RNA, 20 nt, Human
ggcuguuggcugggggccuc

SEQ ID NO: 3120941 - RNA, 14 nt, Human
ggcuguuggcuggg

SEQ ID NO: 3120942 - RNA, 15 nt, Human
ggcuguuggcugggg

SEQ ID NO: 3120943 - RNA, 16 nt, Human
ggcugggggaagaagc

SEQ ID NO: 3120944 - RNA, 14 nt, Human
ggcugggggccuca

SEQ ID NO: 3120945 - RNA, 11 nt, Human
ggcugggcuuc

SEQ ID NO: 3120946 - RNA, 21 nt, Human
ggcugggcuucaguggcagcu

SEQ ID NO: 3120947 - RNA, 22 nt, Human
ggcugggcuucaguggcagcug

SEQ ID NO: 3120948 - RNA, 18 nt, Human
ggcugggcuucaguggca

SEQ ID NO: 3120949 - RNA, 18 nt, Human
ggcugggcucccuuccca

SEQ ID NO: 3120950 - RNA, 21 nt, Human
ggcugggcucccuucccaccu

SEQ ID NO: 3120951 - RNA, 20 nt, Human
ggcugggcucccuucccacc

SEQ ID NO: 3120952 - RNA, 20 nt, Human
ggcugcuucaaggauccuga

SEQ ID NO: 3120953 - RNA, 19 nt, Human
ggcugcuucaaggauccug

SEQ ID NO: 3120954 - RNA, 15 nt, Human
ggcugcuucaaggau

SEQ ID NO: 3120955 - RNA, 13 nt, Human
gggagcugccugu

SEQ ID NO: 3120956 - RNA, 21 nt, Human
gggagcugccuguucagcucc

SEQ ID NO: 3120957 - RNA, 22 nt, Human
gggagcugccuguucagcucca

SEQ ID NO: 3120958 - RNA, 20 nt, Human
gggaggugggauccuccagg

SEQ ID NO: 3120959 - RNA, 23 nt, Human
gggaggauugcuugagcucagga

SEQ ID NO: 3120960 - RNA, 21 nt, Human
gggagugaguugauagcacag

SEQ ID NO: 3120961 - RNA, 22 nt, Human
gggaggauguucugggacacag

SEQ ID NO: 3120962 - RNA, 21 nt, Human
gggaggauugcuugagcucag

SEQ ID NO: 3120963 - RNA, 23 nt, Human
gggaggaucucuugagccuggga

SEQ ID NO: 3120964 - RNA, 19 nt, Human
gggaauguuugccucugcc

SEQ ID NO: 3120965 - RNA, 21 nt, Human
gggaauguuugccucugccuc

SEQ ID NO: 3120966 - RNA, 14 nt, Human
gggacacccuguga

SEQ ID NO: 3120967 - RNA, 17 nt, Human
gggacucaaugcacuga

SEQ ID NO: 3120968 - RNA, 19 nt, Human
gggacucaaugcacugaca

SEQ ID NO: 3120969 - RNA, 16 nt, Human
gggacucaaugcacug

SEQ ID NO: 3120970 - RNA, 23 nt, Human
gggacucaaugcacugacauugu

SEQ ID NO: 3120971 - RNA, 24 nt, Human
ggcgcagcauauucaggaagcuca

SEQ ID NO: 3120972 - RNA, 23 nt, Human
ggcgcagcauauucaggaagcuc

SEQ ID NO: 3120973 - RNA, 23 nt, Human
ggccugggggcugggcagaggaa

SEQ ID NO: 3120974 - RNA, 16 nt, Human
ggccuggccugagcug

SEQ ID NO: 3120975 - RNA, 15 nt, Human
ggccuggccugagcu

SEQ ID NO: 3120976 - RNA, 14 nt, Human
ggccuggccugagc

SEQ ID NO: 3120977 - RNA, 13 nt, Human
ggccuggccugag

SEQ ID NO: 3120978 - RNA, 10 nt, Human
ggccuggccu

SEQ ID NO: 3120979 - RNA, 23 nt, Human
ggccuggccccucagggucccug

SEQ ID NO: 3120980 - RNA, 18 nt, Human
ggccuggccccucagggu

SEQ ID NO: 3120981 - RNA, 17 nt, Human
ggccuggccccucaggg

SEQ ID NO: 3120982 - RNA, 15 nt, Human
ggccuggccccucag

SEQ ID NO: 3120983 - RNA, 14 nt, Human
ggccuggccccuca

SEQ ID NO: 3120984 - RNA, 13 nt, Human
ggccuggccccuc

SEQ ID NO: 3120985 - RNA, 19 nt, Human
ggccucugcacuccccugc

SEQ ID NO: 3120986 - RNA, 18 nt, Human
ggccucugcacuccccug

SEQ ID NO: 3120987 - RNA, 22 nt, Human
ggccucugcacuccccugcugg

SEQ ID NO: 3120988 - RNA, 20 nt, Human
ggcccagagggccugcaagg

SEQ ID NO: 3120989 - RNA, 19 nt, Human
ggcccagagggccugcaag

SEQ ID NO: 3120990 - RNA, 17 nt, Human
ggcccagagggccugca

SEQ ID NO: 3120991 - RNA, 14 nt, Human
ggcccagagggccu

SEQ ID NO: 3120992 - RNA, 14 nt, Human
ggccucaagugauu

SEQ ID NO: 3120993 - RNA, 22 nt, Human
ggccucaagugauucuccugcc

SEQ ID NO: 3120994 - RNA, 20 nt, Human
ggccuagcauacguacacau

SEQ ID NO: 3120995 - RNA, 22 nt, Human
ggccuagcauacguacacauuu

SEQ ID NO: 3120996 - RNA, 20 nt, Human
ggccucgguguggagaagcg

SEQ ID NO: 3120997 - RNA, 14 nt, Human
ggccuccugugugu

SEQ ID NO: 3120998 - RNA, 16 nt, Human
ggccucugcacucccc

SEQ ID NO: 3120999 - RNA, 15 nt, Human
ggcgcgguggcucac

SEQ ID NO: 3121000 - RNA, 17 nt, Human
ggcgcugccccuggcag

SEQ ID NO: 3121001 - RNA, 11 nt, Human
ggcgcugcccc

SEQ ID NO: 3121002 - RNA, 12 nt, Human
ggcuccaggcuc

SEQ ID NO: 3121003 - RNA, 13 nt, Human
ggcuccaggcucc

SEQ ID NO: 3121004 - RNA, 13 nt, Human
ggcuccaggagca

SEQ ID NO: 3121005 - RNA, 17 nt, Human
ggcuccaggagcagcca

SEQ ID NO: 3121006 - RNA, 16 nt, Human
ggcuccaggagcagcc

SEQ ID NO: 3121007 - RNA, 14 nt, Human
ggcuccaggagcag

SEQ ID NO: 3121008 - RNA, 10 nt, Human
ggcuccagac

SEQ ID NO: 3121009 - RNA, 12 nt, Human
ggcuaugcauuu

SEQ ID NO: 3121010 - RNA, 13 nt, Human
ggcuaugcauuug

SEQ ID NO: 3121011 - RNA, 9 nt, Human
ggcuccaga

SEQ ID NO: 3121012 - RNA, 14 nt, Human
ggcuccaggcuccu

SEQ ID NO: 3121013 - RNA, 16 nt, Human
ggcucucaggccagcu

SEQ ID NO: 3121014 - RNA, 15 nt, Human
ggcucucaggccagc

SEQ ID NO: 3121015 - RNA, 20 nt, Human
ggcucucaggccagcugcuu

SEQ ID NO: 3121016 - RNA, 19 nt, Human
ggcucucaggccagcugcu

SEQ ID NO: 3121017 - RNA, 18 nt, Human
ggcucucaggccagcugc

SEQ ID NO: 3121018 - RNA, 17 nt, Human
ggcucucaggccagcug

SEQ ID NO: 3121019 - RNA, 14 nt, Human
ggcucucaggccag

SEQ ID NO: 3121020 - RNA, 12 nt, Human
ggcucugcccuu

SEQ ID NO: 3121021 - RNA, 15 nt, Human
ggcucugccucccau

SEQ ID NO: 3121022 - RNA, 13 nt, Human
ggcucugccuccc

SEQ ID NO: 3121023 - RNA, 15 nt, Human
ggcucugcccuuggu

SEQ ID NO: 3121024 - RNA, 14 nt, Human
ggcucugcccuugg

SEQ ID NO: 3121025 - RNA, 16 nt, Human
ggcucugccucccauc

SEQ ID NO: 3121026 - RNA, 14 nt, Human
cacucuggcagcuc

SEQ ID NO: 3121027 - RNA, 13 nt, Human
cacucuggcagcu

SEQ ID NO: 3121028 - RNA, 12 nt, Human
cacucuggcagc

SEQ ID NO: 3121029 - RNA, 12 nt, Human
cacucuccuugg

SEQ ID NO: 3121030 - RNA, 23 nt, Human
cacucugagacucgcgacaaugc

SEQ ID NO: 3121031 - RNA, 12 nt, Human
cacucugagacu

SEQ ID NO: 3121032 - RNA, 15 nt, Human
cacuccccugcuggg

SEQ ID NO: 3121033 - RNA, 12 nt, Human
cacucccugcaa

SEQ ID NO: 3121034 - RNA, 16 nt, Human
cacucccugcaaccug

SEQ ID NO: 3121035 - RNA, 13 nt, Human
cacucccugcaac

SEQ ID NO: 3121036 - RNA, 22 nt, Human
cacucauugaccugaggcccuu

SEQ ID NO: 3121037 - RNA, 20 nt, Human
cacucauugaccugaggccc

SEQ ID NO: 3121038 - RNA, 19 nt, Human
cacucauugaccugaggcc

SEQ ID NO: 3121039 - RNA, 18 nt, Human
cacucauugaccugaggc

SEQ ID NO: 3121040 - RNA, 16 nt, Human
cacucaguccauagca

SEQ ID NO: 3121041 - RNA, 15 nt, Human
cacucauugaccuga

SEQ ID NO: 3121042 - RNA, 17 nt, Human
cacucccugcaaccuga

SEQ ID NO: 3121043 - RNA, 21 nt, Human
cacuccuucacagaugggugc

SEQ ID NO: 3121044 - RNA, 14 nt, Human
cacuccuucacaga

SEQ ID NO: 3121045 - RNA, 12 nt, Human
cacucagaagac

SEQ ID NO: 3121046 - RNA, 16 nt, Human
cacucagaagacacug

SEQ ID NO: 3121047 - RNA, 17 nt, Human
cacucagaagacacuga

SEQ ID NO: 3121048 - RNA, 19 nt, Human
cacucacauuuauucugcu

SEQ ID NO: 3121049 - RNA, 20 nt, Human
cacucacauuuauucugcuc

SEQ ID NO: 3121050 - RNA, 22 nt, Human
cacucagaagacacugaugggc

SEQ ID NO: 3121051 - RNA, 18 nt, Human
cacucagaagacacugau

SEQ ID NO: 3121052 - RNA, 19 nt, Human
cacucagaagacacugaug

SEQ ID NO: 3121053 - RNA, 20 nt, Human
cacuauguugcccaggcagg

SEQ ID NO: 3121054 - RNA, 21 nt, Human
cacuauguugcccaggcaggu

SEQ ID NO: 3121055 - RNA, 19 nt, Human
cacucaaaagcugggcagg

SEQ ID NO: 3121056 - RNA, 18 nt, Human
cacucaaaagcugggcag

SEQ ID NO: 3121057 - RNA, 17 nt, Human
cacucaaaagcugggca

SEQ ID NO: 3121058 - RNA, 15 nt, Human
cacucaaaagcuggg

SEQ ID NO: 3121059 - RNA, 20 nt, Human
cacucaaaagcugggcaggu

SEQ ID NO: 3121060 - RNA, 15 nt, Human
cacuauguugcccag

SEQ ID NO: 3121061 - RNA, 16 nt, Human
cacuauguugcccagg

SEQ ID NO: 3121062 - RNA, 17 nt, Human
cacuauguugcccaggc

SEQ ID NO: 3121063 - RNA, 18 nt, Human
cacuauguugcccaggca

SEQ ID NO: 3121064 - RNA, 19 nt, Human
cacuauguugcccaggcag

SEQ ID NO: 3121065 - RNA, 14 nt, Human
cacuauagccuagg

SEQ ID NO: 3121066 - RNA, 18 nt, Human
cacuauaauguaagcucu

SEQ ID NO: 3121067 - RNA, 21 nt, Human
cacuauagccuaggugacaga

SEQ ID NO: 3121068 - RNA, 14 nt, Human
cacuauaauguaag

SEQ ID NO: 3121069 - RNA, 17 nt, Human
cacuaaggugugcucug

SEQ ID NO: 3121070 - RNA, 18 nt, Human
cacuaaggugugcucuga

SEQ ID NO: 3121071 - RNA, 18 nt, Human
cacuaaccacgcuggacc

SEQ ID NO: 3121072 - RNA, 14 nt, Human
cacuaaccacgcug

SEQ ID NO: 3121073 - RNA, 15 nt, Human
cacuaaccacgcugg

SEQ ID NO: 3121074 - RNA, 16 nt, Human
cacuaaccacgcugga

SEQ ID NO: 3121075 - RNA, 17 nt, Human
cacgcacuucgggaggu

SEQ ID NO: 3121076 - RNA, 16 nt, Human
cacgauuucuguuuag

SEQ ID NO: 3121077 - RNA, 12 nt, Human
cacgauuucugu

SEQ ID NO: 3121078 - RNA, 14 nt, Human
cacgauuucuguuu

SEQ ID NO: 3121079 - RNA, 18 nt, Human
cacgcccccacuggugac

SEQ ID NO: 3121080 - RNA, 17 nt, Human
cacgcccccacugguga

SEQ ID NO: 3121081 - RNA, 23 nt, Human
cacgccagauucuuuccugaggc

SEQ ID NO: 3121082 - RNA, 15 nt, Human
cacgcccccacuggu

SEQ ID NO: 3121083 - RNA, 13 nt, Human
cacgcccccacug

SEQ ID NO: 3121084 - RNA, 13 nt, Human
cacgccacugcac

SEQ ID NO: 3121085 - RNA, 15 nt, Human
cacgccacugcacua

SEQ ID NO: 3121086 - RNA, 19 nt, Human
cacgccagauucuuuccug

SEQ ID NO: 3121087 - RNA, 22 nt, Human
cacgccagauucuuuccugagg

SEQ ID NO: 3121088 - RNA, 20 nt, Human
cacgccagauucuuuccuga

SEQ ID NO: 3121089 - RNA, 15 nt, Human
caccuugacagggca

SEQ ID NO: 3121090 - RNA, 16 nt, Human
caccuugacagggcac

SEQ ID NO: 3121091 - RNA, 13 nt, Human
caccuugacaggg

SEQ ID NO: 3121092 - RNA, 17 nt, Human
cacgacugcccggcagg

SEQ ID NO: 3121093 - RNA, 16 nt, Human
cacgacugcccggcag

SEQ ID NO: 3121094 - RNA, 22 nt, Human
cacgaauauugcugauggugca

SEQ ID NO: 3121095 - RNA, 19 nt, Human
cacgaauauugcugauggu

SEQ ID NO: 3121096 - RNA, 16 nt, Human
cacgaauauugcugau

SEQ ID NO: 3121097 - RNA, 23 nt, Human
caccuuagacagucccugccaau

SEQ ID NO: 3121098 - RNA, 21 nt, Human
caccuuagacagucccugcca

SEQ ID NO: 3121099 - RNA, 19 nt, Human
caccuuagacagucccugc

SEQ ID NO: 3121100 - RNA, 18 nt, Human
caccuuagacagucccug

SEQ ID NO: 3121101 - RNA, 16 nt, Human
caccuuagacaguccc

SEQ ID NO: 3121102 - RNA, 14 nt, Human
caccuuagacaguc

SEQ ID NO: 3121103 - RNA, 20 nt, Human
cacgccuguaauccuagcac

SEQ ID NO: 3121104 - RNA, 19 nt, Human
cacgccuguaauccuagca

SEQ ID NO: 3121105 - RNA, 15 nt, Human
cacgcgugcacacac

SEQ ID NO: 3121106 - RNA, 16 nt, Human
cacgcgugcacacacc

SEQ ID NO: 3121107 - RNA, 21 nt, Human
cacgcgugcacacaccagagc

SEQ ID NO: 3121108 - RNA, 23 nt, Human
cacgcgugcacacaccagagccc

SEQ ID NO: 3121109 - RNA, 15 nt, Human
cacggcucacugcag

SEQ ID NO: 3121110 - RNA, 20 nt, Human
cacgcuggaccuugaacugg

SEQ ID NO: 3121111 - RNA, 17 nt, Human
cacgcuggaccuugaac

SEQ ID NO: 3121112 - RNA, 16 nt, Human
cacggcucacugcagc

SEQ ID NO: 3121113 - RNA, 17 nt, Human
cacggcucacugcagcc

SEQ ID NO: 3121114 - RNA, 19 nt, Human
cacggcucacugcagccuc

SEQ ID NO: 3121115 - RNA, 20 nt, Human
cacggcucacugcagccuca

SEQ ID NO: 3121116 - RNA, 18 nt, Human
cacguacacacacauaca

SEQ ID NO: 3121117 - RNA, 19 nt, Human
cacguacacacacauacac

SEQ ID NO: 3121118 - RNA, 14 nt, Human
cacguacacacaca

SEQ ID NO: 3121119 - RNA, 19 nt, Human
cacgugguccuaaucuucu

SEQ ID NO: 3121120 - RNA, 16 nt, Human
cacgugguccuaaucu

SEQ ID NO: 3121121 - RNA, 23 nt, Human
cacguuucuaaaggcuaccuuug

SEQ ID NO: 3121122 - RNA, 12 nt, Human
cacguuucuaaa

SEQ ID NO: 3121123 - RNA, 14 nt, Human
cacguuucuaaagg

SEQ ID NO: 3121124 - RNA, 21 nt, Human
cacuucagcugacuuuucugu

SEQ ID NO: 3121125 - RNA, 12 nt, Human
cacuucagcuga

SEQ ID NO: 3121126 - RNA, 16 nt, Human
cacuucccuacaugga

SEQ ID NO: 3121127 - RNA, 23 nt, Human
cacuucgggaggucgaggcagga

SEQ ID NO: 3121128 - RNA, 21 nt, Human
cacuucgggaggucgaggcag

SEQ ID NO: 3121129 - RNA, 22 nt, Human
cacuucugccauauucuguugg

SEQ ID NO: 3121130 - RNA, 20 nt, Human
cacuugagaauuacccuuuu

SEQ ID NO: 3121131 - RNA, 19 nt, Human
cacuugacaucaacugcau

SEQ ID NO: 3121132 - RNA, 17 nt, Human
cacuugagaauuacccu

SEQ ID NO: 3121133 - RNA, 13 nt, Human
cacuugaguccag

SEQ ID NO: 3121134 - RNA, 13 nt, Human
cacuugcagacuc

SEQ ID NO: 3121135 - RNA, 16 nt, Human
cacuugacaucaacug

SEQ ID NO: 3121136 - RNA, 18 nt, Human
cacuuucuagccagagga

SEQ ID NO: 3121137 - RNA, 20 nt, Human
cacuuucuagccagaggaga

SEQ ID NO: 3121138 - RNA, 19 nt, Human
cacuuucuagccagaggag

SEQ ID NO: 3121139 - RNA, 14 nt, Human
cacuugcagacucu

SEQ ID NO: 3121140 - RNA, 18 nt, Human
cacuugcagacucuacag

SEQ ID NO: 3121141 - RNA, 19 nt, Human
cacuugcagacucuacaga

SEQ ID NO: 3121142 - RNA, 22 nt, Human
cacuugcagacucuacagaggc

SEQ ID NO: 3121143 - RNA, 24 nt, Human
cacuugcagacucuacagaggcca

SEQ ID NO: 3121144 - RNA, 22 nt, Human
cacuguucucugcccuccaaga

SEQ ID NO: 3121145 - RNA, 21 nt, Human
cacuguucucugcccuccaag

SEQ ID NO: 3121146 - RNA, 19 nt, Human
cacuguucucugcccucca

SEQ ID NO: 3121147 - RNA, 17 nt, Human
cacuguucucugcccuc

SEQ ID NO: 3121148 - RNA, 16 nt, Human
cacuguucucugcccu

SEQ ID NO: 3121149 - RNA, 15 nt, Human
cacuguucucugccc

SEQ ID NO: 3121150 - RNA, 14 nt, Human
cacuguucucugcc

SEQ ID NO: 3121151 - RNA, 13 nt, Human
cacuguucucugc

SEQ ID NO: 3121152 - RNA, 15 nt, Human
cacugugcugagucu

SEQ ID NO: 3121153 - RNA, 13 nt, Human
cacugugcugagu

SEQ ID NO: 3121154 - RNA, 18 nt, Human
cacugugccaugugccag

SEQ ID NO: 3121155 - RNA, 15 nt, Human
cacugugccaugugc

SEQ ID NO: 3121156 - RNA, 16 nt, Human
cacugugccaugugcc

SEQ ID NO: 3121157 - RNA, 22 nt, Human
cacugugcugagucugaaggcu

SEQ ID NO: 3121158 - RNA, 21 nt, Human
cacugugcugagucugaaggc

SEQ ID NO: 3121159 - RNA, 20 nt, Human
cacugugcugagucugaagg

SEQ ID NO: 3121160 - RNA, 17 nt, Human
cacugugcugagucuga

SEQ ID NO: 3121161 - RNA, 13 nt, Human
cacugugaagaga

SEQ ID NO: 3121162 - RNA, 14 nt, Human
cacugugccaugug

SEQ ID NO: 3121163 - RNA, 21 nt, Human
cacugcuuuuggucuguguga

SEQ ID NO: 3121164 - RNA, 17 nt, Human
cacuggaacacuaauga

SEQ ID NO: 3121165 - RNA, 16 nt, Human
cacugcuuccagugag

SEQ ID NO: 3121166 - RNA, 15 nt, Human
cacugcuuccaguga

SEQ ID NO: 3121167 - RNA, 14 nt, Human
cacugcuuccagug

SEQ ID NO: 3121168 - RNA, 13 nt, Human
cacugcuuaacuu

SEQ ID NO: 3121169 - RNA, 20 nt, Human
cacugcuuuuggucugugug

SEQ ID NO: 3121170 - RNA, 22 nt, Human
cacugcuuccagugaggcucug

SEQ ID NO: 3121171 - RNA, 21 nt, Human
cacugcuuccagugaggcucu

SEQ ID NO: 3121172 - RNA, 20 nt, Human
cacugcuuccagugaggcuc

SEQ ID NO: 3121173 - RNA, 19 nt, Human
cacugcuuccagugaggcu

SEQ ID NO: 3121174 - RNA, 18 nt, Human
cacugcuuccagugaggc

SEQ ID NO: 3121175 - RNA, 14 nt, Human
cacugcaccgggcc

SEQ ID NO: 3121176 - RNA, 15 nt, Human
cacugcaccgggcca

SEQ ID NO: 3121177 - RNA, 16 nt, Human
cacugcaccgggccac

SEQ ID NO: 3121178 - RNA, 18 nt, Human
cacugcaccgggccacag

SEQ ID NO: 3121179 - RNA, 19 nt, Human
cacugcaccgggccacaga

SEQ ID NO: 3121180 - RNA, 18 nt, Human
cacugcacuauagccuag

SEQ ID NO: 3121181 - RNA, 12 nt, Human
cacugcucuggu

SEQ ID NO: 3121182 - RNA, 13 nt, Human
cacugagacagcc

SEQ ID NO: 3121183 - RNA, 12 nt, Human
cacugagacagc

SEQ ID NO: 3121184 - RNA, 22 nt, Human
cacugagacagcccgggcucug

SEQ ID NO: 3121185 - RNA, 19 nt, Human
cacugagacagcccgggcu

SEQ ID NO: 3121186 - RNA, 17 nt, Human
cacugagacagcccggg

SEQ ID NO: 3121187 - RNA, 14 nt, Human
cacugagacagccc

SEQ ID NO: 3121188 - RNA, 23 nt, Human
cacucuggcagcucagagagggu

SEQ ID NO: 3121189 - RNA, 21 nt, Human
cacucuggcagcucagagagg

SEQ ID NO: 3121190 - RNA, 20 nt, Human
cacucuggcagcucagagag

SEQ ID NO: 3121191 - RNA, 19 nt, Human
cacucuggcagcucagaga

SEQ ID NO: 3121192 - RNA, 17 nt, Human
cacucuggcagcucaga

SEQ ID NO: 3121193 - RNA, 16 nt, Human
cacucuggcagcucag

SEQ ID NO: 3121194 - RNA, 15 nt, Human
cacucuggcagcuca

SEQ ID NO: 3121195 - RNA, 15 nt, Human
cacucugucgcccag

SEQ ID NO: 3121196 - RNA, 16 nt, Human
cacucugucgcccagu

SEQ ID NO: 3121197 - RNA, 19 nt, Human
cacucugucgcccagucug

SEQ ID NO: 3121198 - RNA, 23 nt, Human
cacugacauuguuggccaaagcc

SEQ ID NO: 3121199 - RNA, 14 nt, Human
cacugcaaccuccg

SEQ ID NO: 3121200 - RNA, 16 nt, Human
cacugcaaccuccgcc

SEQ ID NO: 3121201 - RNA, 23 nt, Human
cacugcaaccuccgccucuuggg

SEQ ID NO: 3121202 - RNA, 13 nt, Human
cacugcaaccucc

SEQ ID NO: 3121203 - RNA, 23 nt, Human
cacugagacagcccgggcucugc

SEQ ID NO: 3121204 - RNA, 14 nt, Human
cacugaugggcaac

SEQ ID NO: 3121205 - RNA, 18 nt, Human
cacugaugggcaaccccc

SEQ ID NO: 3121206 - RNA, 24 nt, Human
cacugaugggcaacccccagccug

SEQ ID NO: 3121207 - RNA, 16 nt, Human
cacgccagauucuuuc

SEQ ID NO: 3121208 - RNA, 12 nt, Human
cacccggccccu

SEQ ID NO: 3121209 - RNA, 19 nt, Human
cacccgcuaagagggaggg

SEQ ID NO: 3121210 - RNA, 13 nt, Human
cacccggccccug

SEQ ID NO: 3121211 - RNA, 14 nt, Human
cacccggccccugc

SEQ ID NO: 3121212 - RNA, 16 nt, Human
cacccggccccugcug

SEQ ID NO: 3121213 - RNA, 17 nt, Human
cacccggccccugcugg

SEQ ID NO: 3121214 - RNA, 18 nt, Human
cacccggccccugcuggu

SEQ ID NO: 3121215 - RNA, 21 nt, Human
cacccggccccugcugguuca

SEQ ID NO: 3121216 - RNA, 13 nt, Human
cacauauugauuu

SEQ ID NO: 3121217 - RNA, 20 nt, Human
caccccucaacaccucugca

SEQ ID NO: 3121218 - RNA, 13 nt, Human
caccgcagacagg

SEQ ID NO: 3121219 - RNA, 12 nt, Human
caccgcagacag

SEQ ID NO: 3121220 - RNA, 18 nt, Human
caccgcagacaggaccag

SEQ ID NO: 3121221 - RNA, 17 nt, Human
caccgcagacaggacca

SEQ ID NO: 3121222 - RNA, 15 nt, Human
caccgcagacaggac

SEQ ID NO: 3121223 - RNA, 14 nt, Human
caccgcagacagga

SEQ ID NO: 3121224 - RNA, 22 nt, Human
caccgaaaacguggcugcuuca

SEQ ID NO: 3121225 - RNA, 21 nt, Human
caccgaaaacguggcugcuuc

SEQ ID NO: 3121226 - RNA, 19 nt, Human
caccgaaaacguggcugcu

SEQ ID NO: 3121227 - RNA, 18 nt, Human
caccgaaaacguggcugc

SEQ ID NO: 3121228 - RNA, 15 nt, Human
caccgaaaacguggc

SEQ ID NO: 3121229 - RNA, 23 nt, Human
cacccugugauggggcccugccu

SEQ ID NO: 3121230 - RNA, 22 nt, Human
cacccugugauggggcccugcc

SEQ ID NO: 3121231 - RNA, 21 nt, Human
cacccugugauggggcccugc

SEQ ID NO: 3121232 - RNA, 20 nt, Human
cacccugugauggggcccug

SEQ ID NO: 3121233 - RNA, 18 nt, Human
cacccugugauggggccc

SEQ ID NO: 3121234 - RNA, 15 nt, Human
cacccugugaugggg

SEQ ID NO: 3121235 - RNA, 12 nt, Human
cacccugugaug

SEQ ID NO: 3121236 - RNA, 11 nt, Human
cacccugugau

SEQ ID NO: 3121237 - RNA, 20 nt, Human
caccugcggugcuaucuccc

SEQ ID NO: 3121238 - RNA, 23 nt, Human
caccugcggugcuaucuccccca

SEQ ID NO: 3121239 - RNA, 20 nt, Human
caccuggaauauauaaccag

SEQ ID NO: 3121240 - RNA, 19 nt, Human
caccucugcacaagcugca

SEQ ID NO: 3121241 - RNA, 18 nt, Human
caccucugcacaagcugc

SEQ ID NO: 3121242 - RNA, 19 nt, Human
caccucucucacuccuuga

SEQ ID NO: 3121243 - RNA, 18 nt, Human
caccucucucacuccuug

SEQ ID NO: 3121244 - RNA, 17 nt, Human
caccucucucacuccuu

SEQ ID NO: 3121245 - RNA, 15 nt, Human
caccucucucacucc

SEQ ID NO: 3121246 - RNA, 14 nt, Human
caccugaagacuca

SEQ ID NO: 3121247 - RNA, 15 nt, Human
caccugaagacucau

SEQ ID NO: 3121248 - RNA, 23 nt, Human
caccugaagacucauucuucugu

SEQ ID NO: 3121249 - RNA, 23 nt, Human
caccuggccucugcacuccccug

SEQ ID NO: 3121250 - RNA, 20 nt, Human
caccuggccucugcacuccc

SEQ ID NO: 3121251 - RNA, 19 nt, Human
caccuggccucugcacucc

SEQ ID NO: 3121252 - RNA, 18 nt, Human
caccuggccucugcacuc

SEQ ID NO: 3121253 - RNA, 17 nt, Human
caccuggccucugcacu

SEQ ID NO: 3121254 - RNA, 15 nt, Human
caccuggccucugca

SEQ ID NO: 3121255 - RNA, 14 nt, Human
caccuggccucugc

SEQ ID NO: 3121256 - RNA, 13 nt, Human
caccuggccucug

SEQ ID NO: 3121257 - RNA, 12 nt, Human
caccuggccucu

SEQ ID NO: 3121258 - RNA, 17 nt, Human
caccucucccuuggauu

SEQ ID NO: 3121259 - RNA, 14 nt, Human
caccucucccuugg

SEQ ID NO: 3121260 - RNA, 13 nt, Human
caccucucccuug

SEQ ID NO: 3121261 - RNA, 14 nt, Human
caccuccugccucg

SEQ ID NO: 3121262 - RNA, 13 nt, Human
caccuccugccuc

SEQ ID NO: 3121263 - RNA, 11 nt, Human
caccuccugcc

SEQ ID NO: 3121264 - RNA, 15 nt, Human
caccgggcacucaga

SEQ ID NO: 3121265 - RNA, 22 nt, Human
caccgggcacucagaagacacu

SEQ ID NO: 3121266 - RNA, 15 nt, Human
caccgggccacagag

SEQ ID NO: 3121267 - RNA, 18 nt, Human
caccgggccacagagaaa

SEQ ID NO: 3121268 - RNA, 14 nt, Human
caccgggcacucag

SEQ ID NO: 3121269 - RNA, 20 nt, Human
caccggcuggccuggccccu

SEQ ID NO: 3121270 - RNA, 18 nt, Human
caccggcuggccuggccc

SEQ ID NO: 3121271 - RNA, 17 nt, Human
caccggcuggccuggcc

SEQ ID NO: 3121272 - RNA, 14 nt, Human
caccggcuggccug

SEQ ID NO: 3121273 - RNA, 16 nt, Human
caccggcuggccuggc

SEQ ID NO: 3121274 - RNA, 15 nt, Human
caccggcuggccugg

SEQ ID NO: 3121275 - RNA, 21 nt, Human
caccgcagacaggaccaggga

SEQ ID NO: 3121276 - RNA, 19 nt, Human
cagagaaaguacuucucca

SEQ ID NO: 3121277 - RNA, 23 nt, Human
cagagaaaguacuucuccacccu

SEQ ID NO: 3121278 - RNA, 16 nt, Human
cagacccggcugcgug

SEQ ID NO: 3121279 - RNA, 12 nt, Human
cagacccugccc

SEQ ID NO: 3121280 - RNA, 14 nt, Human
cagacccugcccug

SEQ ID NO: 3121281 - RNA, 13 nt, Human
cagacccugcccu

SEQ ID NO: 3121282 - RNA, 12 nt, Human
cagacccggcug

SEQ ID NO: 3121283 - RNA, 14 nt, Human
cagacccggcugcg

SEQ ID NO: 3121284 - RNA, 21 nt, Human
cagacccugcccugugggccc

SEQ ID NO: 3121285 - RNA, 17 nt, Human
cagacccugcccugugg

SEQ ID NO: 3121286 - RNA, 16 nt, Human
cagacccugcccugug

SEQ ID NO: 3121287 - RNA, 15 nt, Human
cagacccugcccugu

SEQ ID NO: 3121288 - RNA, 22 nt, Human
cagacccugcccugugggcccc

SEQ ID NO: 3121289 - RNA, 20 nt, Human
cagaccacaaaacuuuucua

SEQ ID NO: 3121290 - RNA, 14 nt, Human
cagaccacaaaacu

SEQ ID NO: 3121291 - RNA, 20 nt, Human
cagacaguuaagagaaauga

SEQ ID NO: 3121292 - RNA, 19 nt, Human
cagacaccuugacagggca

SEQ ID NO: 3121293 - RNA, 20 nt, Human
cagacaccuugacagggcac

SEQ ID NO: 3121294 - RNA, 22 nt, Human
cagacaccuugacagggcacac

SEQ ID NO: 3121295 - RNA, 19 nt, Human
cagacauacuaaccagcag

SEQ ID NO: 3121296 - RNA, 13 nt, Human
cagacacaggccc

SEQ ID NO: 3121297 - RNA, 14 nt, Human
cagacacaggcccg

SEQ ID NO: 3121298 - RNA, 15 nt, Human
cagacacaggcccgg

SEQ ID NO: 3121299 - RNA, 17 nt, Human
cagacacaggcccggcu

SEQ ID NO: 3121300 - RNA, 18 nt, Human
cagacacaggcccggcuc

SEQ ID NO: 3121301 - RNA, 21 nt, Human
cagacacaggcccggcuccag

SEQ ID NO: 3121302 - RNA, 22 nt, Human
cagacacaggcccggcuccagg

SEQ ID NO: 3121303 - RNA, 23 nt, Human
cagacacaggcccggcuccaggc

SEQ ID NO: 3121304 - RNA, 23 nt, Human
cagacacauguccaagaagccca

SEQ ID NO: 3121305 - RNA, 22 nt, Human
cagacacauguccaagaagccc

SEQ ID NO: 3121306 - RNA, 21 nt, Human
cagacacauguccaagaagcc

SEQ ID NO: 3121307 - RNA, 17 nt, Human
cagacacauguccaaga

SEQ ID NO: 3121308 - RNA, 14 nt, Human
cagacacaugucca

SEQ ID NO: 3121309 - RNA, 22 nt, Human
cagacaaagcgugguggacaug

SEQ ID NO: 3121310 - RNA, 16 nt, Human
cagacaacaaaccugu

SEQ ID NO: 3121311 - RNA, 20 nt, Human
cagacaacaaaccuguuucu

SEQ ID NO: 3121312 - RNA, 12 nt, Human
cagacaaagcgu

SEQ ID NO: 3121313 - RNA, 24 nt, Human
cagaauuucccaaagcagugcaug

SEQ ID NO: 3121314 - RNA, 20 nt, Human
cagaauuucccaaagcagug

SEQ ID NO: 3121315 - RNA, 19 nt, Human
cagaauuucccaaagcagu

SEQ ID NO: 3121316 - RNA, 18 nt, Human
cagaauuucccaaagcag

SEQ ID NO: 3121317 - RNA, 17 nt, Human
cagaauuucccaaagca

SEQ ID NO: 3121318 - RNA, 11 nt, Human
cagaauucuca

SEQ ID NO: 3121319 - RNA, 15 nt, Human
cagaauucucuaguu

SEQ ID NO: 3121320 - RNA, 18 nt, Human
cagaauucucuaguuuga

SEQ ID NO: 3121321 - RNA, 14 nt, Human
cagaauuucccaaa

SEQ ID NO: 3121322 - RNA, 22 nt, Human
cagaaaauggaagacagcucuu

SEQ ID NO: 3121323 - RNA, 21 nt, Human
cagaaaauggaagacagcucu

SEQ ID NO: 3121324 - RNA, 20 nt, Human
cagaaaauggaagacagcuc

SEQ ID NO: 3121325 - RNA, 16 nt, Human
cagaaaauggaagaca

SEQ ID NO: 3121326 - RNA, 23 nt, Human
cagaaaauggaagacagcucuua

SEQ ID NO: 3121327 - RNA, 22 nt, Human
cacuuuuguucuugguuuguaa

SEQ ID NO: 3121328 - RNA, 14 nt, Human
cacuuuuguucuug

SEQ ID NO: 3121329 - RNA, 16 nt, Human
cacuuugggaggccaa

SEQ ID NO: 3121330 - RNA, 13 nt, Human
cacuuugggaggc

SEQ ID NO: 3121331 - RNA, 12 nt, Human
cacuuugggagg

SEQ ID NO: 3121332 - RNA, 23 nt, Human
cacuuuguucuggcucuuccagg

SEQ ID NO: 3121333 - RNA, 16 nt, Human
cacuuuguucuggcuc

SEQ ID NO: 3121334 - RNA, 14 nt, Human
cacuuuguucuggc

SEQ ID NO: 3121335 - RNA, 13 nt, Human
cacuuuguucugg

SEQ ID NO: 3121336 - RNA, 22 nt, Human
cacuuucuagccagaggagaga

SEQ ID NO: 3121337 - RNA, 17 nt, Human
cagaaucucaaauaacu

SEQ ID NO: 3121338 - RNA, 18 nt, Human
cagaaucucaaauaacua

SEQ ID NO: 3121339 - RNA, 18 nt, Human
cagaaggaagacuucauc

SEQ ID NO: 3121340 - RNA, 17 nt, Human
cagaaggaagacuucau

SEQ ID NO: 3121341 - RNA, 16 nt, Human
cagaaggaagacuuca

SEQ ID NO: 3121342 - RNA, 19 nt, Human
cagaaggaagacuucaucc

SEQ ID NO: 3121343 - RNA, 21 nt, Human
cagaagacacugaugggcaac

SEQ ID NO: 3121344 - RNA, 19 nt, Human
cagagugagacucugucuc

SEQ ID NO: 3121345 - RNA, 20 nt, Human
cagagugagacucugucuca

SEQ ID NO: 3121346 - RNA, 22 nt, Human
cagagucucacuguugcccagg

SEQ ID NO: 3121347 - RNA, 23 nt, Human
cagagucucacuguugcccaggc

SEQ ID NO: 3121348 - RNA, 16 nt, Human
cagagugagacucugu

SEQ ID NO: 3121349 - RNA, 17 nt, Human
cagagugagacucuguc

SEQ ID NO: 3121350 - RNA, 18 nt, Human
cagagugagacucugucu

SEQ ID NO: 3121351 - RNA, 19 nt, Human
cagagggccugcaagggag

SEQ ID NO: 3121352 - RNA, 15 nt, Human
cagagggccugcaag

SEQ ID NO: 3121353 - RNA, 20 nt, Human
cagagggagugacagaggca

SEQ ID NO: 3121354 - RNA, 21 nt, Human
cagagggagugacagaggcag

SEQ ID NO: 3121355 - RNA, 22 nt, Human
cagagggagugacagaggcagc

SEQ ID NO: 3121356 - RNA, 23 nt, Human
cagagggagugacagaggcagcc

SEQ ID NO: 3121357 - RNA, 17 nt, Human
cagagucucacuguugc

SEQ ID NO: 3121358 - RNA, 19 nt, Human
cagagucucacuguugccc

SEQ ID NO: 3121359 - RNA, 20 nt, Human
cagagucucacuguugccca

SEQ ID NO: 3121360 - RNA, 21 nt, Human
cagagucucacuguugcccag

SEQ ID NO: 3121361 - RNA, 13 nt, Human
cagagucucacug

SEQ ID NO: 3121362 - RNA, 20 nt, Human
cagaggccaugggccuccug

SEQ ID NO: 3121363 - RNA, 21 nt, Human
cagaggccaugggccuccugu

SEQ ID NO: 3121364 - RNA, 23 nt, Human
cagaggcagccccauucugccug

SEQ ID NO: 3121365 - RNA, 19 nt, Human
cagaggccaugggccuccu

SEQ ID NO: 3121366 - RNA, 16 nt, Human
cagaggccaugggccu

SEQ ID NO: 3121367 - RNA, 12 nt, Human
cagaggcagccc

SEQ ID NO: 3121368 - RNA, 13 nt, Human
cagaggcagcccc

SEQ ID NO: 3121369 - RNA, 14 nt, Human
cagaggcagcccca

SEQ ID NO: 3121370 - RNA, 15 nt, Human
cagaggcagccccau

SEQ ID NO: 3121371 - RNA, 18 nt, Human
cagaggcagccccauucu

SEQ ID NO: 3121372 - RNA, 19 nt, Human
cagaggcagccccauucug

SEQ ID NO: 3121373 - RNA, 20 nt, Human
cagaggcagccccauucugc

SEQ ID NO: 3121374 - RNA, 22 nt, Human
cagaggcagccccauucugccu

SEQ ID NO: 3121375 - RNA, 23 nt, Human
cagaggcugccucucccaucacu

SEQ ID NO: 3121376 - RNA, 14 nt, Human
cagagggagugaca

SEQ ID NO: 3121377 - RNA, 16 nt, Human
cagagggagugacaga

SEQ ID NO: 3121378 - RNA, 18 nt, Human
cagagggagugacagagg

SEQ ID NO: 3121379 - RNA, 19 nt, Human
cagagggagugacagaggc

SEQ ID NO: 3121380 - RNA, 13 nt, Human
cagaggcugccuc

SEQ ID NO: 3121381 - RNA, 20 nt, Human
cagauacaggaaaagcugcu

SEQ ID NO: 3121382 - RNA, 21 nt, Human
cagauacaggaaaagcugcug

SEQ ID NO: 3121383 - RNA, 22 nt, Human
cagauacaggaaaagcugcuga

SEQ ID NO: 3121384 - RNA, 20 nt, Human
cagaucucuaacuucaccau

SEQ ID NO: 3121385 - RNA, 13 nt, Human
cagaugcaccagc

SEQ ID NO: 3121386 - RNA, 14 nt, Human
cagaugcaccagcc

SEQ ID NO: 3121387 - RNA, 16 nt, Human
cagaugcaccagcccu

SEQ ID NO: 3121388 - RNA, 17 nt, Human
cagaugcaccagcccuu

SEQ ID NO: 3121389 - RNA, 22 nt, Human
cagaugcaccagcccuuagcag

SEQ ID NO: 3121390 - RNA, 22 nt, Human
cagaguugaagacagagcuaca

SEQ ID NO: 3121391 - RNA, 14 nt, Human
cagaguuguuacau

SEQ ID NO: 3121392 - RNA, 20 nt, Human
cagaguugaagacagagcua

SEQ ID NO: 3121393 - RNA, 19 nt, Human
cagaguugaagacagagcu

SEQ ID NO: 3121394 - RNA, 18 nt, Human
cagaguugaagacagagc

SEQ ID NO: 3121395 - RNA, 17 nt, Human
cagaguugaagacagag

SEQ ID NO: 3121396 - RNA, 14 nt, Human
cagaguugaagaca

SEQ ID NO: 3121397 - RNA, 16 nt, Human
cagaguugaagacaga

SEQ ID NO: 3121398 - RNA, 15 nt, Human
cagaguugaagacag

SEQ ID NO: 3121399 - RNA, 19 nt, Human
cagaguuguuacauuuuua

SEQ ID NO: 3121400 - RNA, 15 nt, Human
cagaguuguuacauu

SEQ ID NO: 3121401 - RNA, 18 nt, Human
cagaguuguuacauuuuu

SEQ ID NO: 3121402 - RNA, 16 nt, Human
cagagcaccuuagaca

SEQ ID NO: 3121403 - RNA, 20 nt, Human
cagagcaagugagacccugu

SEQ ID NO: 3121404 - RNA, 14 nt, Human
cagagcaagugaga

SEQ ID NO: 3121405 - RNA, 21 nt, Human
cagagaccaucccugaaggcc

SEQ ID NO: 3121406 - RNA, 20 nt, Human
cagagaccaucccugaaggc

SEQ ID NO: 3121407 - RNA, 19 nt, Human
cagagaccaucccugaagg

SEQ ID NO: 3121408 - RNA, 18 nt, Human
cagagaccaucccugaag

SEQ ID NO: 3121409 - RNA, 17 nt, Human
cagagaccaucccugaa

SEQ ID NO: 3121410 - RNA, 13 nt, Human
cagagacuccugc

SEQ ID NO: 3121411 - RNA, 15 nt, Human
cagagacuccugcag

SEQ ID NO: 3121412 - RNA, 14 nt, Human
cagagacuccugca

SEQ ID NO: 3121413 - RNA, 18 nt, Human
cagagacuccugcaggca

SEQ ID NO: 3121414 - RNA, 17 nt, Human
cagagacuccugcaggc

SEQ ID NO: 3121415 - RNA, 16 nt, Human
cagagacuccugcagg

SEQ ID NO: 3121416 - RNA, 19 nt, Human
cagagaaugaaagggccca

SEQ ID NO: 3121417 - RNA, 15 nt, Human
cagagaauucucuua

SEQ ID NO: 3121418 - RNA, 20 nt, Human
cagagaaugaaagggcccag

SEQ ID NO: 3121419 - RNA, 21 nt, Human
cagagaaugaaagggcccaga

SEQ ID NO: 3121420 - RNA, 13 nt, Human
cagagaccauccc

SEQ ID NO: 3121421 - RNA, 16 nt, Human
cagagaccaucccuga

SEQ ID NO: 3121422 - RNA, 14 nt, Human
cagagaccaucccu

SEQ ID NO: 3121423 - RNA, 15 nt, Human
cagagacacaagccu

SEQ ID NO: 3121424 - RNA, 14 nt, Human
cagagacacaagcc

SEQ ID NO: 3121425 - RNA, 17 nt, Human
cagagacacaagccuuc

SEQ ID NO: 3121426 - RNA, 16 nt, Human
cagagacacaagccuu

SEQ ID NO: 3121427 - RNA, 23 nt, Human
cagagcaccuuagacagucccug

SEQ ID NO: 3121428 - RNA, 12 nt, Human
cagagcagagac

SEQ ID NO: 3121429 - RNA, 11 nt, Human
cagagcagaga

SEQ ID NO: 3121430 - RNA, 22 nt, Human
cagagcaccuuagacagucccu

SEQ ID NO: 3121431 - RNA, 21 nt, Human
cagagcaccuuagacaguccc

SEQ ID NO: 3121432 - RNA, 19 nt, Human
cagagcaccuuagacaguc

SEQ ID NO: 3121433 - RNA, 18 nt, Human
cagagcaccuuagacagu

SEQ ID NO: 3121434 - RNA, 21 nt, Human
cagagcagagaccaucccuga

SEQ ID NO: 3121435 - RNA, 19 nt, Human
cagagcagagaccaucccu

SEQ ID NO: 3121436 - RNA, 18 nt, Human
cagagcagagaccauccc

SEQ ID NO: 3121437 - RNA, 17 nt, Human
cagagcagagaccaucc

SEQ ID NO: 3121438 - RNA, 15 nt, Human
cagagcagagaccau

SEQ ID NO: 3121439 - RNA, 14 nt, Human
cagagcagagacca

SEQ ID NO: 3121440 - RNA, 13 nt, Human
cagagcagagacc

SEQ ID NO: 3121441 - RNA, 15 nt, Human
cagagcccaccuugg

SEQ ID NO: 3121442 - RNA, 17 nt, Human
cagagcccaccuuggcu

SEQ ID NO: 3121443 - RNA, 19 nt, Human
cagagcccaccuuggcuca

SEQ ID NO: 3121444 - RNA, 20 nt, Human
cagagcccaccuuggcucaa

SEQ ID NO: 3121445 - RNA, 16 nt, Human
cagagcccacgccccc

SEQ ID NO: 3121446 - RNA, 12 nt, Human
cagagccugcag

SEQ ID NO: 3121447 - RNA, 13 nt, Human
cagaggaaggaga

SEQ ID NO: 3121448 - RNA, 13 nt, Human
cagagccugcagu

SEQ ID NO: 3121449 - RNA, 20 nt, Human
cagaggaaagcaaaggagau

SEQ ID NO: 3121450 - RNA, 21 nt, Human
cagagcccacgcccccacugg

SEQ ID NO: 3121451 - RNA, 20 nt, Human
cagagcccacgcccccacug

SEQ ID NO: 3121452 - RNA, 19 nt, Human
cagagcccacgcccccacu

SEQ ID NO: 3121453 - RNA, 17 nt, Human
cagagcccacgccccca

SEQ ID NO: 3121454 - RNA, 23 nt, Human
cagagcccacgcccccacuggug

SEQ ID NO: 3121455 - RNA, 11 nt, Human
cagaggcagcc

SEQ ID NO: 3121456 - RNA, 20 nt, Human
cagaggagagaggacccccu

SEQ ID NO: 3121457 - RNA, 13 nt, Human
cagaggagagagg

SEQ ID NO: 3121458 - RNA, 19 nt, Human
cagaggagagaggaccccc

SEQ ID NO: 3121459 - RNA, 15 nt, Human
cagaggagagaggac

SEQ ID NO: 3121460 - RNA, 20 nt, Human
cagccucacaguccuuacca

SEQ ID NO: 3121461 - RNA, 15 nt, Human
cagccucacaguccu

SEQ ID NO: 3121462 - RNA, 14 nt, Human
cagccucacagucc

SEQ ID NO: 3121463 - RNA, 19 nt, Human
cagccucaaccuccugggc

SEQ ID NO: 3121464 - RNA, 20 nt, Human
cagccucaaccuccugggcu

SEQ ID NO: 3121465 - RNA, 21 nt, Human
cagccucaaccuccugggcua

SEQ ID NO: 3121466 - RNA, 17 nt, Human
cagccucaaccuccugg

SEQ ID NO: 3121467 - RNA, 18 nt, Human
cagccucaaccuccuggg

SEQ ID NO: 3121468 - RNA, 20 nt, Human
cagccucccgaauagcuggg

SEQ ID NO: 3121469 - RNA, 21 nt, Human
cagccucccgaauagcuggga

SEQ ID NO: 3121470 - RNA, 22 nt, Human
cagccucccgaauagcugggac

SEQ ID NO: 3121471 - RNA, 19 nt, Human
cagccucccaaagugcugg

SEQ ID NO: 3121472 - RNA, 20 nt, Human
cagccucccaaagugcuggg

SEQ ID NO: 3121473 - RNA, 21 nt, Human
cagccucccaaagugcuggga

SEQ ID NO: 3121474 - RNA, 23 nt, Human
cagccucccaaagugcugggauu

SEQ ID NO: 3121475 - RNA, 21 nt, Human
cagccguguaaccauggaccc

SEQ ID NO: 3121476 - RNA, 16 nt, Human
cagcccugcagagggc

SEQ ID NO: 3121477 - RNA, 15 nt, Human
cagcccugcagaggg

SEQ ID NO: 3121478 - RNA, 14 nt, Human
cagcccugcagagg

SEQ ID NO: 3121479 - RNA, 13 nt, Human
cagcccugcagag

SEQ ID NO: 3121480 - RNA, 20 nt, Human
cagcccugcagagggcacag

SEQ ID NO: 3121481 - RNA, 18 nt, Human
cagcccugcagagggcac

SEQ ID NO: 3121482 - RNA, 13 nt, Human
cagccccagugcc

SEQ ID NO: 3121483 - RNA, 14 nt, Human
cagccccagugccc

SEQ ID NO: 3121484 - RNA, 15 nt, Human
cagccccagugccca

SEQ ID NO: 3121485 - RNA, 16 nt, Human
cagccccagugcccac

SEQ ID NO: 3121486 - RNA, 17 nt, Human
cagccccagugcccaca

SEQ ID NO: 3121487 - RNA, 18 nt, Human
cagccccagugcccacag

SEQ ID NO: 3121488 - RNA, 21 nt, Human
cagccccaucccaaacccuuc

SEQ ID NO: 3121489 - RNA, 11 nt, Human
cagccccaucc

SEQ ID NO: 3121490 - RNA, 21 nt, Human
cagccccuguucuggcagagu

SEQ ID NO: 3121491 - RNA, 22 nt, Human
cagccccuggaugcagccucac

SEQ ID NO: 3121492 - RNA, 20 nt, Human
cagccccuguucuggcagag

SEQ ID NO: 3121493 - RNA, 16 nt, Human
cagccccauucugccu

SEQ ID NO: 3121494 - RNA, 17 nt, Human
cagccccauucugccug

SEQ ID NO: 3121495 - RNA, 18 nt, Human
cagccccauucugccugc

SEQ ID NO: 3121496 - RNA, 23 nt, Human
cagccccuggaugcagccucaca

SEQ ID NO: 3121497 - RNA, 13 nt, Human
cagccccauucug

SEQ ID NO: 3121498 - RNA, 14 nt, Human
cagccccauucugc

SEQ ID NO: 3121499 - RNA, 22 nt, Human
cagccccauccucuguacagag

SEQ ID NO: 3121500 - RNA, 16 nt, Human
cagccccauccucugu

SEQ ID NO: 3121501 - RNA, 14 nt, Human
cagccccauccucu

SEQ ID NO: 3121502 - RNA, 13 nt, Human
cagccccauccuc

SEQ ID NO: 3121503 - RNA, 12 nt, Human
cagccccauccu

SEQ ID NO: 3121504 - RNA, 22 nt, Human
cagccccaucccaaacccuuca

SEQ ID NO: 3121505 - RNA, 16 nt, Human
cagcccgggcucugcc

SEQ ID NO: 3121506 - RNA, 15 nt, Human
cagcccgggcucugc

SEQ ID NO: 3121507 - RNA, 14 nt, Human
cagcccgggcucug

SEQ ID NO: 3121508 - RNA, 13 nt, Human
cagcccgggcucu

SEQ ID NO: 3121509 - RNA, 24 nt, Human
cagccccuucugacccaugcugcc

SEQ ID NO: 3121510 - RNA, 23 nt, Human
cagccccuucugacccaugcugc

SEQ ID NO: 3121511 - RNA, 22 nt, Human
cagccccuucugacccaugcug

SEQ ID NO: 3121512 - RNA, 21 nt, Human
cagccccuucugacccaugcu

SEQ ID NO: 3121513 - RNA, 19 nt, Human
cagccccuucugacccaug

SEQ ID NO: 3121514 - RNA, 17 nt, Human
cagccccuucugaccca

SEQ ID NO: 3121515 - RNA, 16 nt, Human
cagccccuucugaccc

SEQ ID NO: 3121516 - RNA, 22 nt, Human
cagcccgggcucugccucccau

SEQ ID NO: 3121517 - RNA, 21 nt, Human
cagcccgggcucugccuccca

SEQ ID NO: 3121518 - RNA, 20 nt, Human
cagcccgggcucugccuccc

SEQ ID NO: 3121519 - RNA, 19 nt, Human
cagcccgggcucugccucc

SEQ ID NO: 3121520 - RNA, 18 nt, Human
cagcccgggcucugccuc

SEQ ID NO: 3121521 - RNA, 17 nt, Human
cagcccgggcucugccu

SEQ ID NO: 3121522 - RNA, 12 nt, Human
cagcucagagag

SEQ ID NO: 3121523 - RNA, 20 nt, Human
cagcucaccucucccuugga

SEQ ID NO: 3121524 - RNA, 19 nt, Human
cagcucaccucucccuugg

SEQ ID NO: 3121525 - RNA, 22 nt, Human
cagcucaccagccccagugccc

SEQ ID NO: 3121526 - RNA, 14 nt, Human
cagcucaccagccc

SEQ ID NO: 3121527 - RNA, 20 nt, Human
cagcucaccagccccagugc

SEQ ID NO: 3121528 - RNA, 21 nt, Human
cagcucaccagccccagugcc

SEQ ID NO: 3121529 - RNA, 17 nt, Human
cagcucaccucucccuu

SEQ ID NO: 3121530 - RNA, 16 nt, Human
cagcucaccucucccu

SEQ ID NO: 3121531 - RNA, 15 nt, Human
cagcucaccucuccc

SEQ ID NO: 3121532 - RNA, 13 nt, Human
cagcucaccucuc

SEQ ID NO: 3121533 - RNA, 13 nt, Human
cagcucaccagcc

SEQ ID NO: 3121534 - RNA, 15 nt, Human
cagcucaccagcccc

SEQ ID NO: 3121535 - RNA, 16 nt, Human
cagcucaccagcccca

SEQ ID NO: 3121536 - RNA, 17 nt, Human
cagcucaccagccccag

SEQ ID NO: 3121537 - RNA, 19 nt, Human
cagcucaccagccccagug

SEQ ID NO: 3121538 - RNA, 21 nt, Human
cagcgagcccugguggcagug

SEQ ID NO: 3121539 - RNA, 18 nt, Human
cagcuaacauggaaguac

SEQ ID NO: 3121540 - RNA, 19 nt, Human
cagcuaacauggaaguacu

SEQ ID NO: 3121541 - RNA, 13 nt, Human
cagcgagcccugg

SEQ ID NO: 3121542 - RNA, 16 nt, Human
cagcgagcccuggugg

SEQ ID NO: 3121543 - RNA, 17 nt, Human
cagcgagcccugguggc

SEQ ID NO: 3121544 - RNA, 19 nt, Human
cagcgagcccugguggcag

SEQ ID NO: 3121545 - RNA, 20 nt, Human
cagcgagcccugguggcagu

SEQ ID NO: 3121546 - RNA, 20 nt, Human
cagcuaacauggaaguacua

SEQ ID NO: 3121547 - RNA, 15 nt, Human
cagcuaaugggacac

SEQ ID NO: 3121548 - RNA, 16 nt, Human
cagcuaaugggacacu

SEQ ID NO: 3121549 - RNA, 19 nt, Human
cagccugggcaaugugaua

SEQ ID NO: 3121550 - RNA, 16 nt, Human
cagccugggcaaugug

SEQ ID NO: 3121551 - RNA, 24 nt, Human
cagccuugaccauucuccaccugc

SEQ ID NO: 3121552 - RNA, 23 nt, Human
cagccuugaccauucuccaccug

SEQ ID NO: 3121553 - RNA, 22 nt, Human
cagccuugaccauucuccaccu

SEQ ID NO: 3121554 - RNA, 17 nt, Human
cagccuugaccauucuc

SEQ ID NO: 3121555 - RNA, 21 nt, Human
cagccuugaccauucuccacc

SEQ ID NO: 3121556 - RNA, 20 nt, Human
cagccuugaccauucuccac

SEQ ID NO: 3121557 - RNA, 20 nt, Human
cagccugcuccagcuguuca

SEQ ID NO: 3121558 - RNA, 23 nt, Human
cagccucccgaauagcugggacu

SEQ ID NO: 3121559 - RNA, 19 nt, Human
cagccucccgaguagcugg

SEQ ID NO: 3121560 - RNA, 20 nt, Human
cagccucccgaguagcuggg

SEQ ID NO: 3121561 - RNA, 21 nt, Human
cagccucccgaguagcuggga

SEQ ID NO: 3121562 - RNA, 22 nt, Human
cagccucccgaguagcugggac

SEQ ID NO: 3121563 - RNA, 23 nt, Human
cagccucccgaguagcugggacu

SEQ ID NO: 3121564 - RNA, 19 nt, Human
cagccuggacccuguggau

SEQ ID NO: 3121565 - RNA, 15 nt, Human
cagccuggacccugu

SEQ ID NO: 3121566 - RNA, 23 nt, Human
cagcuuuguuuguugucagcuga

SEQ ID NO: 3121567 - RNA, 22 nt, Human
cagcuuuguuuguugucagcug

SEQ ID NO: 3121568 - RNA, 21 nt, Human
cagcuuuguuuguugucagcu

SEQ ID NO: 3121569 - RNA, 12 nt, Human
cagcuuuguuug

SEQ ID NO: 3121570 - RNA, 18 nt, Human
cagcuuguaaauagcuca

SEQ ID NO: 3121571 - RNA, 19 nt, Human
cagcuuguaaauagcucag

SEQ ID NO: 3121572 - RNA, 20 nt, Human
cagcuuguaaauagcucagg

SEQ ID NO: 3121573 - RNA, 21 nt, Human
cagcuuguaaauagcucaggu

SEQ ID NO: 3121574 - RNA, 22 nt, Human
cagcuuguaaauagcucaggug

SEQ ID NO: 3121575 - RNA, 14 nt, Human
cagcuugaggguug

SEQ ID NO: 3121576 - RNA, 15 nt, Human
cagcuugaggguugg

SEQ ID NO: 3121577 - RNA, 21 nt, Human
cagcuugaccgugaggccaga

SEQ ID NO: 3121578 - RNA, 20 nt, Human
cagcuugaccgugaggccag

SEQ ID NO: 3121579 - RNA, 19 nt, Human
cagcuugaccgugaggcca

SEQ ID NO: 3121580 - RNA, 18 nt, Human
cagcuugaccgugaggcc

SEQ ID NO: 3121581 - RNA, 18 nt, Human
cagcuugaggguugggcu

SEQ ID NO: 3121582 - RNA, 19 nt, Human
cagcuugaggguugggcug

SEQ ID NO: 3121583 - RNA, 20 nt, Human
cagcuugaggguugggcugg

SEQ ID NO: 3121584 - RNA, 21 nt, Human
cagcuugaggguugggcuggu

SEQ ID NO: 3121585 - RNA, 19 nt, Human
cagcuucauuuccuguguc

SEQ ID NO: 3121586 - RNA, 20 nt, Human
cagcuucauuuccugugucu

SEQ ID NO: 3121587 - RNA, 21 nt, Human
cagcuucauuuccugugucuu

SEQ ID NO: 3121588 - RNA, 20 nt, Human
caggaaguacuggagaaaau

SEQ ID NO: 3121589 - RNA, 18 nt, Human
caggaaguacuggagaaa

SEQ ID NO: 3121590 - RNA, 17 nt, Human
caggaaguacuggagaa

SEQ ID NO: 3121591 - RNA, 12 nt, Human
caggaaguacug

SEQ ID NO: 3121592 - RNA, 16 nt, Human
caggaaguacuggaga

SEQ ID NO: 3121593 - RNA, 14 nt, Human
caggaaguacugga

SEQ ID NO: 3121594 - RNA, 15 nt, Human
caggaaggcuaaagg

SEQ ID NO: 3121595 - RNA, 23 nt, Human
caggaagcucagggccuggcuca

SEQ ID NO: 3121596 - RNA, 22 nt, Human
caggaagcucagggccuggcuc

SEQ ID NO: 3121597 - RNA, 21 nt, Human
caggaagcucagggccuggcu

SEQ ID NO: 3121598 - RNA, 20 nt, Human
caggaagcucagggccuggc

SEQ ID NO: 3121599 - RNA, 13 nt, Human
caggaagcucagg

SEQ ID NO: 3121600 - RNA, 15 nt, Human
caggaagcucagggc

SEQ ID NO: 3121601 - RNA, 14 nt, Human
caggaagcucaggg

SEQ ID NO: 3121602 - RNA, 19 nt, Human
caggaagcucagggccugg

SEQ ID NO: 3121603 - RNA, 18 nt, Human
caggaagcucagggccug

SEQ ID NO: 3121604 - RNA, 17 nt, Human
caggaagcucagggccu

SEQ ID NO: 3121605 - RNA, 16 nt, Human
caggaagcucagggcc

SEQ ID NO: 3121606 - RNA, 22 nt, Human
caggaagccagcaggcucucag

SEQ ID NO: 3121607 - RNA, 21 nt, Human
caggaagccagcaggcucuca

SEQ ID NO: 3121608 - RNA, 19 nt, Human
caggaagccagcaggcucu

SEQ ID NO: 3121609 - RNA, 18 nt, Human
caggaagccagcaggcuc

SEQ ID NO: 3121610 - RNA, 17 nt, Human
caggaagccagcaggcu

SEQ ID NO: 3121611 - RNA, 16 nt, Human
caggaagccagcaggc

SEQ ID NO: 3121612 - RNA, 14 nt, Human
caggaagccagcag

SEQ ID NO: 3121613 - RNA, 16 nt, Human
cagcucugcaagaauu

SEQ ID NO: 3121614 - RNA, 15 nt, Human
cagcucugcaagaau

SEQ ID NO: 3121615 - RNA, 21 nt, Human
cagcucugcaagaauugaagc

SEQ ID NO: 3121616 - RNA, 20 nt, Human
cagcucagagagggugggag

SEQ ID NO: 3121617 - RNA, 19 nt, Human
cagcucagagaggguggga

SEQ ID NO: 3121618 - RNA, 17 nt, Human
cagcucagagagggugg

SEQ ID NO: 3121619 - RNA, 13 nt, Human
cagcucagagagg

SEQ ID NO: 3121620 - RNA, 16 nt, Human
cagcuccuucuguccu

SEQ ID NO: 3121621 - RNA, 17 nt, Human
cagcuccuucuguccua

SEQ ID NO: 3121622 - RNA, 21 nt, Human
cagcuccuucuguccuacucu

SEQ ID NO: 3121623 - RNA, 23 nt, Human
cagcuccuucuguccuacucugu

SEQ ID NO: 3121624 - RNA, 13 nt, Human
cagcucuggucca

SEQ ID NO: 3121625 - RNA, 10 nt, Human
cagcucuggu

SEQ ID NO: 3121626 - RNA, 21 nt, Human
cagcucugguccauagagagc

SEQ ID NO: 3121627 - RNA, 18 nt, Human
cagcucugguccauagag

SEQ ID NO: 3121628 - RNA, 17 nt, Human
cagcucugguccauaga

SEQ ID NO: 3121629 - RNA, 16 nt, Human
cagcucugguccauag

SEQ ID NO: 3121630 - RNA, 12 nt, Human
cagcucuguccu

SEQ ID NO: 3121631 - RNA, 13 nt, Human
cagcucuguccug

SEQ ID NO: 3121632 - RNA, 23 nt, Human
cagcucugguccauagagagcaa

SEQ ID NO: 3121633 - RNA, 22 nt, Human
cagcucugguccauagagagca

SEQ ID NO: 3121634 - RNA, 14 nt, Human
cagcucuguccugg

SEQ ID NO: 3121635 - RNA, 16 nt, Human
cagcucuguccuggga

SEQ ID NO: 3121636 - RNA, 17 nt, Human
cagcucuguccugggag

SEQ ID NO: 3121637 - RNA, 18 nt, Human
cagcucuguccugggagu

SEQ ID NO: 3121638 - RNA, 23 nt, Human
cagcucuguccugggagugagcu

SEQ ID NO: 3121639 - RNA, 21 nt, Human
cagcucuuauauugccauuuc

SEQ ID NO: 3121640 - RNA, 10 nt, Human
cagcucuuau

SEQ ID NO: 3121641 - RNA, 13 nt, Human
cagcucuucucca

SEQ ID NO: 3121642 - RNA, 14 nt, Human
cagcucuucuccag

SEQ ID NO: 3121643 - RNA, 15 nt, Human
cagcucuucuccagg

SEQ ID NO: 3121644 - RNA, 16 nt, Human
cagcucuucuccaggc

SEQ ID NO: 3121645 - RNA, 17 nt, Human
cagcucuucuccaggcu

SEQ ID NO: 3121646 - RNA, 18 nt, Human
cagcucuucuccaggcug

SEQ ID NO: 3121647 - RNA, 19 nt, Human
cagcucuucuccaggcugu

SEQ ID NO: 3121648 - RNA, 23 nt, Human
cagcucuucuccaggcuguaucc

SEQ ID NO: 3121649 - RNA, 18 nt, Human
cagcugcgguccacccag

SEQ ID NO: 3121650 - RNA, 15 nt, Human
cagcugccugggauc

SEQ ID NO: 3121651 - RNA, 19 nt, Human
cagcugcgguccacccagg

SEQ ID NO: 3121652 - RNA, 20 nt, Human
cagcugcgguccacccagga

SEQ ID NO: 3121653 - RNA, 21 nt, Human
cagcugcgguccacccaggag

SEQ ID NO: 3121654 - RNA, 22 nt, Human
cagcugcgguccacccaggagc

SEQ ID NO: 3121655 - RNA, 23 nt, Human
cagcugcgguccacccaggagcc

SEQ ID NO: 3121656 - RNA, 24 nt, Human
cagcugcgguccacccaggagccc

SEQ ID NO: 3121657 - RNA, 23 nt, Human
cagcugccugggaucccucaucc

SEQ ID NO: 3121658 - RNA, 18 nt, Human
cagcugccugggaucccu

SEQ ID NO: 3121659 - RNA, 17 nt, Human
cagcugcuacuacuccu

SEQ ID NO: 3121660 - RNA, 22 nt, Human
cagcugcuugggcuucauccuc

SEQ ID NO: 3121661 - RNA, 21 nt, Human
cagcugcuugggcuucauccu

SEQ ID NO: 3121662 - RNA, 19 nt, Human
cagcugcuugggcuucauc

SEQ ID NO: 3121663 - RNA, 18 nt, Human
cagcugcuugggcuucau

SEQ ID NO: 3121664 - RNA, 16 nt, Human
cagcugcuugggcuuc

SEQ ID NO: 3121665 - RNA, 15 nt, Human
cagcugcuugggcuu

SEQ ID NO: 3121666 - RNA, 14 nt, Human
cagcugcuugggcu

SEQ ID NO: 3121667 - RNA, 13 nt, Human
cagcugcuugggc

SEQ ID NO: 3121668 - RNA, 18 nt, Human
cagcugguugagguuuca

SEQ ID NO: 3121669 - RNA, 23 nt, Human
cagcugggguggggaccucaggc

SEQ ID NO: 3121670 - RNA, 22 nt, Human
cagcugggguggggaccucagg

SEQ ID NO: 3121671 - RNA, 21 nt, Human
cagcugggguggggaccucag

SEQ ID NO: 3121672 - RNA, 23 nt, Human
cagcugcuuuugucuaugggacu

SEQ ID NO: 3121673 - RNA, 22 nt, Human
cagcugcuuuugucuaugggac

SEQ ID NO: 3121674 - RNA, 14 nt, Human
cagcauccuggcac

SEQ ID NO: 3121675 - RNA, 15 nt, Human
cagcauccuggcacc

SEQ ID NO: 3121676 - RNA, 16 nt, Human
cagcauccuggcaccc

SEQ ID NO: 3121677 - RNA, 17 nt, Human
cagcauccuggcacccg

SEQ ID NO: 3121678 - RNA, 20 nt, Human
cagcagggagggcuucugcc

SEQ ID NO: 3121679 - RNA, 19 nt, Human
cagcaggcucucaggccag

SEQ ID NO: 3121680 - RNA, 18 nt, Human
cagcaggcucucaggcca

SEQ ID NO: 3121681 - RNA, 17 nt, Human
cagcaggcucucaggcc

SEQ ID NO: 3121682 - RNA, 16 nt, Human
cagcaggcucucaggc

SEQ ID NO: 3121683 - RNA, 22 nt, Human
cagcaggcucucaggccagcug

SEQ ID NO: 3121684 - RNA, 20 nt, Human
cagcaggcucucaggccagc

SEQ ID NO: 3121685 - RNA, 18 nt, Human
cagcagggagggcuucug

SEQ ID NO: 3121686 - RNA, 12 nt, Human
cagcaggcucuc

SEQ ID NO: 3121687 - RNA, 15 nt, Human
cagcaggcucucagg

SEQ ID NO: 3121688 - RNA, 14 nt, Human
cagcaggcucucag

SEQ ID NO: 3121689 - RNA, 22 nt, Human
cagcagccuggacccuguggau

SEQ ID NO: 3121690 - RNA, 19 nt, Human
cagcagccuggacccugug

SEQ ID NO: 3121691 - RNA, 18 nt, Human
cagcagccuggacccugu

SEQ ID NO: 3121692 - RNA, 15 nt, Human
cagcagccuggaccc

SEQ ID NO: 3121693 - RNA, 14 nt, Human
cagcagccuggacc

SEQ ID NO: 3121694 - RNA, 12 nt, Human
cagcagccugga

SEQ ID NO: 3121695 - RNA, 21 nt, Human
cagcauccuggcacccggccc

SEQ ID NO: 3121696 - RNA, 19 nt, Human
cagcauccuggcacccggc

SEQ ID NO: 3121697 - RNA, 20 nt, Human
cagcauccuggcacccggcc

SEQ ID NO: 3121698 - RNA, 16 nt, Human
cagccaaagccuccuc

SEQ ID NO: 3121699 - RNA, 15 nt, Human
cagccaaagccuccu

SEQ ID NO: 3121700 - RNA, 21 nt, Human
cagccaaagccuccuccagcc

SEQ ID NO: 3121701 - RNA, 18 nt, Human
cagccaaagccuccucca

SEQ ID NO: 3121702 - RNA, 23 nt, Human
cagccacggccaggccagaggga

SEQ ID NO: 3121703 - RNA, 22 nt, Human
cagccaguaaaugggggugcau

SEQ ID NO: 3121704 - RNA, 13 nt, Human
cagccaguaaaug

SEQ ID NO: 3121705 - RNA, 14 nt, Human
cagccacggccagg

SEQ ID NO: 3121706 - RNA, 15 nt, Human
cagccacggccaggc

SEQ ID NO: 3121707 - RNA, 16 nt, Human
cagccacggccaggcc

SEQ ID NO: 3121708 - RNA, 17 nt, Human
cagccacggccaggcca

SEQ ID NO: 3121709 - RNA, 18 nt, Human
cagccacggccaggccag

SEQ ID NO: 3121710 - RNA, 19 nt, Human
cagccacggccaggccaga

SEQ ID NO: 3121711 - RNA, 21 nt, Human
cagccacggccaggccagagg

SEQ ID NO: 3121712 - RNA, 22 nt, Human
cagccacggccaggccagaggg

SEQ ID NO: 3121713 - RNA, 19 nt, Human
cagccacauuccugaugcu

SEQ ID NO: 3121714 - RNA, 17 nt, Human
cagccacauuccugaug

SEQ ID NO: 3121715 - RNA, 15 nt, Human
cagccacauuccuga

SEQ ID NO: 3121716 - RNA, 14 nt, Human
cagccacauuccug

SEQ ID NO: 3121717 - RNA, 18 nt, Human
cagcccacuucugccaua

SEQ ID NO: 3121718 - RNA, 22 nt, Human
cagccccaaaacucuccucugc

SEQ ID NO: 3121719 - RNA, 21 nt, Human
cagccccaaaacucuccucug

SEQ ID NO: 3121720 - RNA, 20 nt, Human
cagccccaaaacucuccucu

SEQ ID NO: 3121721 - RNA, 15 nt, Human
cagcccaccccucaa

SEQ ID NO: 3121722 - RNA, 15 nt, Human
cagcccacuucugcc

SEQ ID NO: 3121723 - RNA, 22 nt, Human
cagcaauaaagcagcguuucua

SEQ ID NO: 3121724 - RNA, 19 nt, Human
cagcaagugagagcugggu

SEQ ID NO: 3121725 - RNA, 21 nt, Human
cagcaagugagagcugggugu

SEQ ID NO: 3121726 - RNA, 13 nt, Human
cagcaauaaagca

SEQ ID NO: 3121727 - RNA, 21 nt, Human
cagcaauaaagcagcguuucu

SEQ ID NO: 3121728 - RNA, 17 nt, Human
cagcaaggagauuuaca

SEQ ID NO: 3121729 - RNA, 18 nt, Human
cagcaaggagauuuacaa

SEQ ID NO: 3121730 - RNA, 14 nt, Human
cagcaagugagagc

SEQ ID NO: 3121731 - RNA, 15 nt, Human
cagcaagugagagcu

SEQ ID NO: 3121732 - RNA, 16 nt, Human
cagcaagugagagcug

SEQ ID NO: 3121733 - RNA, 17 nt, Human
cagcaagugagagcugg

SEQ ID NO: 3121734 - RNA, 12 nt, Human
cagcaagugaga

SEQ ID NO: 3121735 - RNA, 15 nt, Human
cagcagaaaugccuu

SEQ ID NO: 3121736 - RNA, 17 nt, Human
cagcagaaaugccuuac

SEQ ID NO: 3121737 - RNA, 19 nt, Human
cagcagaaaugccuuaccc

SEQ ID NO: 3121738 - RNA, 22 nt, Human
cagcagaaaugccuuacccuca

SEQ ID NO: 3121739 - RNA, 13 nt, Human
cagcagagcaccu

SEQ ID NO: 3121740 - RNA, 11 nt, Human
cagcagagcac

SEQ ID NO: 3121741 - RNA, 18 nt, Human
cagcaaaagaugcuucuc

SEQ ID NO: 3121742 - RNA, 14 nt, Human
cagauucuuuccug

SEQ ID NO: 3121743 - RNA, 23 nt, Human
cagaugggugcuuggaggaagga

SEQ ID NO: 3121744 - RNA, 18 nt, Human
cagaugggugcuuggagg

SEQ ID NO: 3121745 - RNA, 12 nt, Human
caggagugagca

SEQ ID NO: 3121746 - RNA, 20 nt, Human
caggagccuccugcccuuac

SEQ ID NO: 3121747 - RNA, 17 nt, Human
caggagccuccugcccu

SEQ ID NO: 3121748 - RNA, 14 nt, Human
caggagccuccugc

SEQ ID NO: 3121749 - RNA, 15 nt, Human
caggagccccgaggc

SEQ ID NO: 3121750 - RNA, 16 nt, Human
caggagccccgaggcc

SEQ ID NO: 3121751 - RNA, 18 nt, Human
caggagccccgaggccuu

SEQ ID NO: 3121752 - RNA, 19 nt, Human
caggagcagccacauuccu

SEQ ID NO: 3121753 - RNA, 14 nt, Human
caggagcagccaca

SEQ ID NO: 3121754 - RNA, 13 nt, Human
caggagcagccac

SEQ ID NO: 3121755 - RNA, 12 nt, Human
caggagcagcca

SEQ ID NO: 3121756 - RNA, 20 nt, Human
caggagccccgaggccuucu

SEQ ID NO: 3121757 - RNA, 22 nt, Human
caggagccccgaggccuucucu

SEQ ID NO: 3121758 - RNA, 23 nt, Human
caggagccccgaggccuucucug

SEQ ID NO: 3121759 - RNA, 23 nt, Human
caggaguuugagaccaaccuggg

SEQ ID NO: 3121760 - RNA, 22 nt, Human
caggaguuugagaccaaccugg

SEQ ID NO: 3121761 - RNA, 21 nt, Human
caggaguuugagaccaaccug

SEQ ID NO: 3121762 - RNA, 17 nt, Human
caggcagccaggccaca

SEQ ID NO: 3121763 - RNA, 16 nt, Human
caggcagccaggccac

SEQ ID NO: 3121764 - RNA, 13 nt, Human
caggcagguccag

SEQ ID NO: 3121765 - RNA, 14 nt, Human
caggcaagcaccuc

SEQ ID NO: 3121766 - RNA, 15 nt, Human
caggcaagcaccucc

SEQ ID NO: 3121767 - RNA, 16 nt, Human
caggcaagcaccuccu

SEQ ID NO: 3121768 - RNA, 21 nt, Human
caggcaagcaccuccugccuc

SEQ ID NO: 3121769 - RNA, 15 nt, Human
caggcagccaggcca

SEQ ID NO: 3121770 - RNA, 14 nt, Human
caggcagccaggcc

SEQ ID NO: 3121771 - RNA, 20 nt, Human
caggauucuuccucccuccc

SEQ ID NO: 3121772 - RNA, 24 nt, Human
caggcauuccccaggaggccagcc

SEQ ID NO: 3121773 - RNA, 23 nt, Human
caggcauuccccaggaggccagc

SEQ ID NO: 3121774 - RNA, 22 nt, Human
caggcauuccccaggaggccag

SEQ ID NO: 3121775 - RNA, 21 nt, Human
caggcauuccccaggaggcca

SEQ ID NO: 3121776 - RNA, 20 nt, Human
caggcauuccccaggaggcc

SEQ ID NO: 3121777 - RNA, 19 nt, Human
caggcauuccccaggaggc

SEQ ID NO: 3121778 - RNA, 18 nt, Human
caggcauuccccaggagg

SEQ ID NO: 3121779 - RNA, 15 nt, Human
caggcauguucucug

SEQ ID NO: 3121780 - RNA, 18 nt, Human
caggcauguucucugagg

SEQ ID NO: 3121781 - RNA, 19 nt, Human
caggcauguucucugagga

SEQ ID NO: 3121782 - RNA, 20 nt, Human
caggcauguucucugaggac

SEQ ID NO: 3121783 - RNA, 17 nt, Human
caggcauuccccaggag

SEQ ID NO: 3121784 - RNA, 16 nt, Human
caggcauuccccagga

SEQ ID NO: 3121785 - RNA, 15 nt, Human
caggcauuccccagg

SEQ ID NO: 3121786 - RNA, 13 nt, Human
caggcauucccca

SEQ ID NO: 3121787 - RNA, 23 nt, Human
caggcaggucuugaacuccuggc

SEQ ID NO: 3121788 - RNA, 15 nt, Human
caggcaggugggaug

SEQ ID NO: 3121789 - RNA, 13 nt, Human
caggcaggucuug

SEQ ID NO: 3121790 - RNA, 22 nt, Human
caggcaggucuugaacuccugg

SEQ ID NO: 3121791 - RNA, 14 nt, Human
caggcagguccagg

SEQ ID NO: 3121792 - RNA, 15 nt, Human
caggcagguccaggg

SEQ ID NO: 3121793 - RNA, 19 nt, Human
caggcagguccaggguuug

SEQ ID NO: 3121794 - RNA, 12 nt, Human
caggcaggucuu

SEQ ID NO: 3121795 - RNA, 17 nt, Human
caggcaugguggcccac

SEQ ID NO: 3121796 - RNA, 14 nt, Human
caggaucagucuga

SEQ ID NO: 3121797 - RNA, 13 nt, Human
caggaucagucug

SEQ ID NO: 3121798 - RNA, 17 nt, Human
caggauucuuccucccu

SEQ ID NO: 3121799 - RNA, 18 nt, Human
caggauucuuccucccuc

SEQ ID NO: 3121800 - RNA, 23 nt, Human
caggauggccgggcgcgguggcu

SEQ ID NO: 3121801 - RNA, 13 nt, Human
caggcccggcucc

SEQ ID NO: 3121802 - RNA, 14 nt, Human
caggcccggcucca

SEQ ID NO: 3121803 - RNA, 15 nt, Human
caggcccggcuccag

SEQ ID NO: 3121804 - RNA, 15 nt, Human
caggccccugccacc

SEQ ID NO: 3121805 - RNA, 17 nt, Human
caggccccugccacccu

SEQ ID NO: 3121806 - RNA, 19 nt, Human
caggccccugccacccugg

SEQ ID NO: 3121807 - RNA, 20 nt, Human
caggccccugccacccuggg

SEQ ID NO: 3121808 - RNA, 13 nt, Human
caggccccugcca

SEQ ID NO: 3121809 - RNA, 23 nt, Human
caggccaaacucaccugccccuc

SEQ ID NO: 3121810 - RNA, 18 nt, Human
caggccaaacucaccugc

SEQ ID NO: 3121811 - RNA, 13 nt, Human
caggccacaagac

SEQ ID NO: 3121812 - RNA, 18 nt, Human
caggccacaagacccuug

SEQ ID NO: 3121813 - RNA, 17 nt, Human
caggccacaagacccuu

SEQ ID NO: 3121814 - RNA, 20 nt, Human
caggccacaagacccuugug

SEQ ID NO: 3121815 - RNA, 22 nt, Human
caggccaggcccucugcccacu

SEQ ID NO: 3121816 - RNA, 21 nt, Human
caggccaggcccucugcccac

SEQ ID NO: 3121817 - RNA, 20 nt, Human
caggccaggcccucugccca

SEQ ID NO: 3121818 - RNA, 22 nt, Human
caggcccucugcccacucccug

SEQ ID NO: 3121819 - RNA, 21 nt, Human
caggcccucugcccacucccu

SEQ ID NO: 3121820 - RNA, 20 nt, Human
caggcccucugcccacuccc

SEQ ID NO: 3121821 - RNA, 19 nt, Human
caggcccucugcccacucc

SEQ ID NO: 3121822 - RNA, 17 nt, Human
caggcccucugcccacu

SEQ ID NO: 3121823 - RNA, 16 nt, Human
caggcccucugcccac

SEQ ID NO: 3121824 - RNA, 22 nt, Human
caggcccggcuccaggcuccuu

SEQ ID NO: 3121825 - RNA, 20 nt, Human
caggcccggcuccaggcucc

SEQ ID NO: 3121826 - RNA, 21 nt, Human
caggcccggcuccaggcuccu

SEQ ID NO: 3121827 - RNA, 15 nt, Human
caggcccucugccca

SEQ ID NO: 3121828 - RNA, 14 nt, Human
caggcccucugccc

SEQ ID NO: 3121829 - RNA, 13 nt, Human
caggcccucugcc

SEQ ID NO: 3121830 - RNA, 17 nt, Human
caggcccggcuccaggc

SEQ ID NO: 3121831 - RNA, 16 nt, Human
caggcccggcuccagg

SEQ ID NO: 3121832 - RNA, 18 nt, Human
caggcccggcuccaggcu

SEQ ID NO: 3121833 - RNA, 19 nt, Human
caggcccggcuccaggcuc

SEQ ID NO: 3121834 - RNA, 23 nt, Human
caggcucucaggccagcugcuug

SEQ ID NO: 3121835 - RNA, 21 nt, Human
caggcucucaggccagcugcu

SEQ ID NO: 3121836 - RNA, 20 nt, Human
caggcucucaggccagcugc

SEQ ID NO: 3121837 - RNA, 19 nt, Human
caggcucucaggccagcug

SEQ ID NO: 3121838 - RNA, 18 nt, Human
caggcucucaggccagcu

SEQ ID NO: 3121839 - RNA, 17 nt, Human
caggcucucaggccagc

SEQ ID NO: 3121840 - RNA, 21 nt, Human
caggcuccuuuagcgcccagu

SEQ ID NO: 3121841 - RNA, 12 nt, Human
caggcucucagg

SEQ ID NO: 3121842 - RNA, 20 nt, Human
caggcucgggcuccccagcc

SEQ ID NO: 3121843 - RNA, 16 nt, Human
caggcucucaggccag

SEQ ID NO: 3121844 - RNA, 15 nt, Human
caggcucucaggcca

SEQ ID NO: 3121845 - RNA, 14 nt, Human
caggcucucaggcc

SEQ ID NO: 3121846 - RNA, 13 nt, Human
caggcucucaggc

SEQ ID NO: 3121847 - RNA, 14 nt, Human
caggcuccuuuagc

SEQ ID NO: 3121848 - RNA, 19 nt, Human
caggcuccuuuagcgccca

SEQ ID NO: 3121849 - RNA, 20 nt, Human
caggcuccuuuagcgcccag

SEQ ID NO: 3121850 - RNA, 12 nt, Human
caggcuggucuc

SEQ ID NO: 3121851 - RNA, 19 nt, Human
caggcuggucucaaacucu

SEQ ID NO: 3121852 - RNA, 14 nt, Human
caggcuguauccca

SEQ ID NO: 3121853 - RNA, 20 nt, Human
caggcuguaucccaugagcc

SEQ ID NO: 3121854 - RNA, 21 nt, Human
caggcuguaucccaugagccu

SEQ ID NO: 3121855 - RNA, 22 nt, Human
caggcuguaucccaugagccuc

SEQ ID NO: 3121856 - RNA, 23 nt, Human
caggcuguaucccaugagccuca

SEQ ID NO: 3121857 - RNA, 21 nt, Human
caggcuuagucacugagacag

SEQ ID NO: 3121858 - RNA, 20 nt, Human
caggcuuagucacugagaca

SEQ ID NO: 3121859 - RNA, 17 nt, Human
caggcuuagucacugag

SEQ ID NO: 3121860 - RNA, 16 nt, Human
caggcuuagucacuga

SEQ ID NO: 3121861 - RNA, 23 nt, Human
caggcuuagucacugagacagcc

SEQ ID NO: 3121862 - RNA, 22 nt, Human
caggcuuagucacugagacagc

SEQ ID NO: 3121863 - RNA, 23 nt, Human
caggcugggcuucaguggcagcu

SEQ ID NO: 3121864 - RNA, 16 nt, Human
cagggaaacagcuaau

SEQ ID NO: 3121865 - RNA, 22 nt, Human
cagggaaacagcuaaugggaca

SEQ ID NO: 3121866 - RNA, 13 nt, Human
cagggacagaggg

SEQ ID NO: 3121867 - RNA, 20 nt, Human
cagggacagaggggguggcc

SEQ ID NO: 3121868 - RNA, 14 nt, Human
cagggacagagggg

SEQ ID NO: 3121869 - RNA, 22 nt, Human
cagggcacaccgggcacucaga

SEQ ID NO: 3121870 - RNA, 23 nt, Human
cagggcacaccgggcacucagaa

SEQ ID NO: 3121871 - RNA, 15 nt, Human
cagggcacaccgggc

SEQ ID NO: 3121872 - RNA, 17 nt, Human
cagggcacaccgggcac

SEQ ID NO: 3121873 - RNA, 19 nt, Human
cagggcacaccgggcacuc

SEQ ID NO: 3121874 - RNA, 21 nt, Human
cagggcacaccgggcacucag

SEQ ID NO: 3121875 - RNA, 14 nt, Human
cagggcacaccggg

SEQ ID NO: 3121876 - RNA, 23 nt, Human
cagggacagaggggguggccucc

SEQ ID NO: 3121877 - RNA, 19 nt, Human
cagggccuggcucaggugg

SEQ ID NO: 3121878 - RNA, 16 nt, Human
cagggccuggcucagg

SEQ ID NO: 3121879 - RNA, 13 nt, Human
cagggccuggcuc

SEQ ID NO: 3121880 - RNA, 15 nt, Human
cagggccuggcucag

SEQ ID NO: 3121881 - RNA, 14 nt, Human
cagggccuggcuca

SEQ ID NO: 3121882 - RNA, 19 nt, Human
caggggaggguagagcgga

SEQ ID NO: 3121883 - RNA, 23 nt, Human
cagugccuuauggaacacucuga

SEQ ID NO: 3121884 - RNA, 13 nt, Human
cagugccuuaugg

SEQ ID NO: 3121885 - RNA, 11 nt, Human
cagugccuuau

SEQ ID NO: 3121886 - RNA, 18 nt, Human
cagugccgagaaggaagc

SEQ ID NO: 3121887 - RNA, 15 nt, Human
cagugccgagaagga

SEQ ID NO: 3121888 - RNA, 22 nt, Human
cagugccuuauggaacacucug

SEQ ID NO: 3121889 - RNA, 21 nt, Human
cagugccuuauggaacacucu

SEQ ID NO: 3121890 - RNA, 20 nt, Human
cagugccuuauggaacacuc

SEQ ID NO: 3121891 - RNA, 19 nt, Human
cagugccuuauggaacacu

SEQ ID NO: 3121892 - RNA, 18 nt, Human
cagugccuuauggaacac

SEQ ID NO: 3121893 - RNA, 17 nt, Human
cagugccuuauggaaca

SEQ ID NO: 3121894 - RNA, 16 nt, Human
cagugccuuauggaac

SEQ ID NO: 3121895 - RNA, 15 nt, Human
cagugccuuauggaa

SEQ ID NO: 3121896 - RNA, 19 nt, Human
cagugagucgaggacaggg

SEQ ID NO: 3121897 - RNA, 20 nt, Human
cagugagucgaggacaggga

SEQ ID NO: 3121898 - RNA, 22 nt, Human
cagugagucgaggacagggagg

SEQ ID NO: 3121899 - RNA, 23 nt, Human
cagugagucgaggacagggaggu

SEQ ID NO: 3121900 - RNA, 24 nt, Human
cagugagccgagauugcaccacug

SEQ ID NO: 3121901 - RNA, 12 nt, Human
cagugaggcucu

SEQ ID NO: 3121902 - RNA, 16 nt, Human
cagugaggcucugccc

SEQ ID NO: 3121903 - RNA, 15 nt, Human
cagugaggcucugcc

SEQ ID NO: 3121904 - RNA, 14 nt, Human
cagugaggcucugc

SEQ ID NO: 3121905 - RNA, 13 nt, Human
cagugaggcucug

SEQ ID NO: 3121906 - RNA, 21 nt, Human
cagugaggcucugcccuuggu

SEQ ID NO: 3121907 - RNA, 17 nt, Human
cagugagucgaggacag

SEQ ID NO: 3121908 - RNA, 18 nt, Human
cagugagucgaggacagg

SEQ ID NO: 3121909 - RNA, 20 nt, Human
cagugaggcucugcccuugg

SEQ ID NO: 3121910 - RNA, 19 nt, Human
cagugaggcucugcccuug

SEQ ID NO: 3121911 - RNA, 18 nt, Human
cagugaggcucugcccuu

SEQ ID NO: 3121912 - RNA, 17 nt, Human
cagugaggcucugcccu

SEQ ID NO: 3121913 - RNA, 17 nt, Human
caguccucccaucucac

SEQ ID NO: 3121914 - RNA, 16 nt, Human
caguccucccaucuca

SEQ ID NO: 3121915 - RNA, 18 nt, Human
cagucuggaaugcagugg

SEQ ID NO: 3121916 - RNA, 21 nt, Human
caguccuuaccagcagagcac

SEQ ID NO: 3121917 - RNA, 20 nt, Human
caguccuuaccagcagagca

SEQ ID NO: 3121918 - RNA, 19 nt, Human
caguccuuaccagcagagc

SEQ ID NO: 3121919 - RNA, 18 nt, Human
caguccuuaccagcagag

SEQ ID NO: 3121920 - RNA, 15 nt, Human
caguccuuaccagca

SEQ ID NO: 3121921 - RNA, 19 nt, Human
cagucuggaaugcaguggu

SEQ ID NO: 3121922 - RNA, 17 nt, Human
cagucccugccaaugga

SEQ ID NO: 3121923 - RNA, 15 nt, Human
caguccucccaucuc

SEQ ID NO: 3121924 - RNA, 14 nt, Human
caguccucccaucu

SEQ ID NO: 3121925 - RNA, 13 nt, Human
caguccucccauc

SEQ ID NO: 3121926 - RNA, 12 nt, Human
caguccucccau

SEQ ID NO: 3121927 - RNA, 16 nt, Human
cagucccugccaaugg

SEQ ID NO: 3121928 - RNA, 15 nt, Human
cagucccugccaaug

SEQ ID NO: 3121929 - RNA, 14 nt, Human
cagucccugccaau

SEQ ID NO: 3121930 - RNA, 13 nt, Human
cagucccugccaa

SEQ ID NO: 3121931 - RNA, 12 nt, Human
cagucccugcca

SEQ ID NO: 3121932 - RNA, 13 nt, Human
caguaucucaggg

SEQ ID NO: 3121933 - RNA, 21 nt, Human
caguaucuugaagacuuuucu

SEQ ID NO: 3121934 - RNA, 18 nt, Human
caguaucuugaagacuuu

SEQ ID NO: 3121935 - RNA, 12 nt, Human
caguaucuugaa

SEQ ID NO: 3121936 - RNA, 15 nt, Human
caguaucucagggcc

SEQ ID NO: 3121937 - RNA, 16 nt, Human
caguccauagcagaga

SEQ ID NO: 3121938 - RNA, 18 nt, Human
caguauuacuucugcuac

SEQ ID NO: 3121939 - RNA, 16 nt, Human
caguauuacuucugcu

SEQ ID NO: 3121940 - RNA, 21 nt, Human
caggggugggacacccuguga

SEQ ID NO: 3121941 - RNA, 20 nt, Human
caggggugggacacccugug

SEQ ID NO: 3121942 - RNA, 15 nt, Human
caggggugggacacc

SEQ ID NO: 3121943 - RNA, 14 nt, Human
caggggugggacac

SEQ ID NO: 3121944 - RNA, 21 nt, Human
caggguauuccagagugggga

SEQ ID NO: 3121945 - RNA, 20 nt, Human
caggguauuccagagugggg

SEQ ID NO: 3121946 - RNA, 12 nt, Human
cagggucccugg

SEQ ID NO: 3121947 - RNA, 14 nt, Human
cagggucccuggug

SEQ ID NO: 3121948 - RNA, 22 nt, Human
cagggucccugguggcagcuca

SEQ ID NO: 3121949 - RNA, 19 nt, Human
cagggucccugguggcagc

SEQ ID NO: 3121950 - RNA, 18 nt, Human
cagggucccugguggcag

SEQ ID NO: 3121951 - RNA, 15 nt, Human
cagggucccuggugg

SEQ ID NO: 3121952 - RNA, 14 nt, Human
cagguaacaggcag

SEQ ID NO: 3121953 - RNA, 15 nt, Human
cagguaacaggcaga

SEQ ID NO: 3121954 - RNA, 16 nt, Human
cagguaacaggcagau

SEQ ID NO: 3121955 - RNA, 17 nt, Human
cagguaacaggcagaua

SEQ ID NO: 3121956 - RNA, 16 nt, Human
caggguuuugccaugu

SEQ ID NO: 3121957 - RNA, 16 nt, Human
cagggucucacucugu

SEQ ID NO: 3121958 - RNA, 21 nt, Human
cagggucucacuauguugccc

SEQ ID NO: 3121959 - RNA, 22 nt, Human
cagggucucacuauguugccca

SEQ ID NO: 3121960 - RNA, 23 nt, Human
cagggucucacuauguugcccag

SEQ ID NO: 3121961 - RNA, 15 nt, Human
cagggucucacucug

SEQ ID NO: 3121962 - RNA, 18 nt, Human
caggguccuguagcccua

SEQ ID NO: 3121963 - RNA, 23 nt, Human
cagggucccugguggcagcucac

SEQ ID NO: 3121964 - RNA, 21 nt, Human
caggugagaagcagaggaagg

SEQ ID NO: 3121965 - RNA, 20 nt, Human
caggugagaagcagaggaag

SEQ ID NO: 3121966 - RNA, 13 nt, Human
caggugagaagca

SEQ ID NO: 3121967 - RNA, 18 nt, Human
caggucuugaacuccugg

SEQ ID NO: 3121968 - RNA, 19 nt, Human
caggucuugaacuccuggc

SEQ ID NO: 3121969 - RNA, 20 nt, Human
caggucuugaacuccuggcc

SEQ ID NO: 3121970 - RNA, 21 nt, Human
caggucuugaacuccuggccu

SEQ ID NO: 3121971 - RNA, 22 nt, Human
caggucuugaacuccuggccuc

SEQ ID NO: 3121972 - RNA, 23 nt, Human
caggucuugaacuccuggccuca

SEQ ID NO: 3121973 - RNA, 20 nt, Human
cagguaacaggcagauacag

SEQ ID NO: 3121974 - RNA, 21 nt, Human
cagguaacaggcagauacagg

SEQ ID NO: 3121975 - RNA, 20 nt, Human
caggugguuauggagagggu

SEQ ID NO: 3121976 - RNA, 11 nt, Human
caggugucccu

SEQ ID NO: 3121977 - RNA, 14 nt, Human
caggugucccugca

SEQ ID NO: 3121978 - RNA, 18 nt, Human
caggugguuauggagagg

SEQ ID NO: 3121979 - RNA, 23 nt, Human
cagguggggucacucuggcagcu

SEQ ID NO: 3121980 - RNA, 22 nt, Human
cagguggggucacucuggcagc

SEQ ID NO: 3121981 - RNA, 21 nt, Human
cagguggggucacucuggcag

SEQ ID NO: 3121982 - RNA, 20 nt, Human
cagguggggucacucuggca

SEQ ID NO: 3121983 - RNA, 19 nt, Human
cagguggggucacucuggc

SEQ ID NO: 3121984 - RNA, 13 nt, Human
cagguggggcagc

SEQ ID NO: 3121985 - RNA, 14 nt, Human
cagguggggcagcu

SEQ ID NO: 3121986 - RNA, 15 nt, Human
cagguggggcagcuu

SEQ ID NO: 3121987 - RNA, 16 nt, Human
cagguggggcagcuug

SEQ ID NO: 3121988 - RNA, 17 nt, Human
cagguggggcagcuuga

SEQ ID NO: 3121989 - RNA, 18 nt, Human
cagguggggucacucugg

SEQ ID NO: 3121990 - RNA, 12 nt, Human
caguaauaacuc

SEQ ID NO: 3121991 - RNA, 13 nt, Human
caguaauaacucu

SEQ ID NO: 3121992 - RNA, 22 nt, Human
caguaaaugggggugcauuuga

SEQ ID NO: 3121993 - RNA, 20 nt, Human
caguaaaugggggugcauuu

SEQ ID NO: 3121994 - RNA, 21 nt, Human
caguaaaugggggugcauuug

SEQ ID NO: 3121995 - RNA, 13 nt, Human
cagguucagcuug

SEQ ID NO: 3121996 - RNA, 12 nt, Human
cagguucagcuu

SEQ ID NO: 3121997 - RNA, 15 nt, Human
caggugucccugcac

SEQ ID NO: 3121998 - RNA, 16 nt, Human
caggugucccugcacu

SEQ ID NO: 3121999 - RNA, 18 nt, Human
caggugucccugcacuug

SEQ ID NO: 3122000 - RNA, 19 nt, Human
caggugucccugcacuugc

SEQ ID NO: 3122001 - RNA, 12 nt, Human
caggugugaacc

SEQ ID NO: 3122002 - RNA, 16 nt, Human
caggugugaaccacca

SEQ ID NO: 3122003 - RNA, 19 nt, Human
caggugugaaccaccacac

SEQ ID NO: 3122004 - RNA, 22 nt, Human
caggugugaaccaccacaccca

SEQ ID NO: 3122005 - RNA, 23 nt, Human
caggugugaaccaccacacccag

SEQ ID NO: 3122006 - RNA, 20 nt, Human
caggugugagucaccaagcc

SEQ ID NO: 3122007 - RNA, 21 nt, Human
caggugugagucaccaagccc

SEQ ID NO: 3122008 - RNA, 16 nt, Human
caggugugagucacca

SEQ ID NO: 3122009 - RNA, 22 nt, Human
caggugugagucaccaagccca

SEQ ID NO: 3122010 - RNA, 23 nt, Human
caggugugagucaccaagcccag

SEQ ID NO: 3122011 - RNA, 23 nt, Human
cuccgcuuucuacccagcgagcc

SEQ ID NO: 3122012 - RNA, 16 nt, Human
cuccuguaccucuuga

SEQ ID NO: 3122013 - RNA, 15 nt, Human
cuccuuucaccacau

SEQ ID NO: 3122014 - RNA, 14 nt, Human
cuccuuguguuacu

SEQ ID NO: 3122015 - RNA, 19 nt, Human
cuccuggccucaagugauu

SEQ ID NO: 3122016 - RNA, 18 nt, Human
cuccugggcuaagugauc

SEQ ID NO: 3122017 - RNA, 19 nt, Human
cuccuggcccacugcaucg

SEQ ID NO: 3122018 - RNA, 14 nt, Human
cuccucugcugcug

SEQ ID NO: 3122019 - RNA, 13 nt, Human
cuccucugcugcu

SEQ ID NO: 3122020 - RNA, 23 nt, Human
cuccaggugcacaagcuccaagc

SEQ ID NO: 3122021 - RNA, 15 nt, Human
cuccaggcuccuuua

SEQ ID NO: 3122022 - RNA, 23 nt, Human
cuccaggcuccuuuagcgcccag

SEQ ID NO: 3122023 - RNA, 20 nt, Human
cuccaggcuguaucccauga

SEQ ID NO: 3122024 - RNA, 22 nt, Human
cuccaggugcacaagcuccaag

SEQ ID NO: 3122025 - RNA, 20 nt, Human
cucccucuuucccucccuuc

SEQ ID NO: 3122026 - RNA, 19 nt, Human
cucugcacaagcugcaccc

SEQ ID NO: 3122027 - RNA, 21 nt, Human
cucugcacaagcugcacccuc

SEQ ID NO: 3122028 - RNA, 20 nt, Human
cucugcacaagcugcacccu

SEQ ID NO: 3122029 - RNA, 14 nt, Human
cucugcacuccccu

SEQ ID NO: 3122030 - RNA, 16 nt, Human
cucugcacuccccugc

SEQ ID NO: 3122031 - RNA, 15 nt, Human
cucugcacuccccug

SEQ ID NO: 3122032 - RNA, 13 nt, Human
cucuguacagagc

SEQ ID NO: 3122033 - RNA, 15 nt, Human
cucuguacagagccc

SEQ ID NO: 3122034 - RNA, 14 nt, Human
cucuguacagagcc

SEQ ID NO: 3122035 - RNA, 16 nt, Human
cucugcugcuggcugg

SEQ ID NO: 3122036 - RNA, 15 nt, Human
cucugcugcuggcug

SEQ ID NO: 3122037 - RNA, 14 nt, Human
cucugcugcuggcu

SEQ ID NO: 3122038 - RNA, 16 nt, Human
cucuguacagagccca

SEQ ID NO: 3122039 - RNA, 21 nt, Human
cucugcugacagacacaggcc

SEQ ID NO: 3122040 - RNA, 22 nt, Human
cucugcugacagacacaggccc

SEQ ID NO: 3122041 - RNA, 20 nt, Human
cucugcugacagacacaggc

SEQ ID NO: 3122042 - RNA, 13 nt, Human
cucugcugcuggc

SEQ ID NO: 3122043 - RNA, 23 nt, Human
cucugcugacagacacaggcccg

SEQ ID NO: 3122044 - RNA, 20 nt, Human
cucugcuccucuccccagca

SEQ ID NO: 3122045 - RNA, 21 nt, Human
cucugcuccucuccccagcaa

SEQ ID NO: 3122046 - RNA, 17 nt, Human
cucugcacuccccugcu

SEQ ID NO: 3122047 - RNA, 12 nt, Human
cucuccuccaga

SEQ ID NO: 3122048 - RNA, 15 nt, Human
cucuccuccagaguc

SEQ ID NO: 3122049 - RNA, 13 nt, Human
cucuccuccagag

SEQ ID NO: 3122050 - RNA, 16 nt, Human
cucuccuccagaguca

SEQ ID NO: 3122051 - RNA, 18 nt, Human
cuccuuugugaggaagcc

SEQ ID NO: 3122052 - RNA, 17 nt, Human
cuccuuugugaggaagc

SEQ ID NO: 3122053 - RNA, 16 nt, Human
cucgguguggagaagc

SEQ ID NO: 3122054 - RNA, 17 nt, Human
cucgguguggagaagcg

SEQ ID NO: 3122055 - RNA, 18 nt, Human
cuauguugcccaggcagg

SEQ ID NO: 3122056 - RNA, 19 nt, Human
cuauguugcccaggcaggu

SEQ ID NO: 3122057 - RNA, 21 nt, Human
cuauguugcccaggcaggucu

SEQ ID NO: 3122058 - RNA, 22 nt, Human
cuauguugcccaggcaggucuu

SEQ ID NO: 3122059 - RNA, 14 nt, Human
cuaugugagaccau

SEQ ID NO: 3122060 - RNA, 13 nt, Human
cuaucucccccag

SEQ ID NO: 3122061 - RNA, 21 nt, Human
cucaagugauucuccugccuc

SEQ ID NO: 3122062 - RNA, 23 nt, Human
cucaauuauuuugcauuuuuucu

SEQ ID NO: 3122063 - RNA, 13 nt, Human
cucagaagacacu

SEQ ID NO: 3122064 - RNA, 15 nt, Human
cucagaagacacuga

SEQ ID NO: 3122065 - RNA, 17 nt, Human
cucagaagacacugaug

SEQ ID NO: 3122066 - RNA, 20 nt, Human
cucagaagacacugaugggc

SEQ ID NO: 3122067 - RNA, 22 nt, Human
cucagaagacacugaugggcaa

SEQ ID NO: 3122068 - RNA, 17 nt, Human
cucaccuuucccaucuu

SEQ ID NO: 3122069 - RNA, 23 nt, Human
cucagaagacacugaugggcaac

SEQ ID NO: 3122070 - RNA, 19 nt, Human
cucagccucccgaauagcu

SEQ ID NO: 3122071 - RNA, 21 nt, Human
cucagccucccgaauagcugg

SEQ ID NO: 3122072 - RNA, 22 nt, Human
cucagccucccgaauagcuggg

SEQ ID NO: 3122073 - RNA, 15 nt, Human
cucaggccagcugcu

SEQ ID NO: 3122074 - RNA, 21 nt, Human
cucaggccaaacucaccugcc

SEQ ID NO: 3122075 - RNA, 20 nt, Human
cucaggccaaacucaccugc

SEQ ID NO: 3122076 - RNA, 19 nt, Human
cucaggccaaacucaccug

SEQ ID NO: 3122077 - RNA, 17 nt, Human
cucaggccagcugcuug

SEQ ID NO: 3122078 - RNA, 16 nt, Human
cucaggccagcugcuu

SEQ ID NO: 3122079 - RNA, 18 nt, Human
cucaggccagcugcuugg

SEQ ID NO: 3122080 - RNA, 11 nt, Human
cucaggccugg

SEQ ID NO: 3122081 - RNA, 22 nt, Human
cucaggccugggggcugggcag

SEQ ID NO: 3122082 - RNA, 23 nt, Human
cucaggugucccugcacuugcag

SEQ ID NO: 3122083 - RNA, 15 nt, Human
cucaguccauagcag

SEQ ID NO: 3122084 - RNA, 17 nt, Human
cucaguccauagcagag

SEQ ID NO: 3122085 - RNA, 20 nt, Human
cucagucuggcccuuccuuu

SEQ ID NO: 3122086 - RNA, 22 nt, Human
cucagucuggcccuuccuuuuc

SEQ ID NO: 3122087 - RNA, 22 nt, Human
cuaacuugucuuuggacccuga

SEQ ID NO: 3122088 - RNA, 14 nt, Human
cuaacuugucuuug

SEQ ID NO: 3122089 - RNA, 15 nt, Human
cguguuaugacucca

SEQ ID NO: 3122090 - RNA, 19 nt, Human
cguguuaugacuccagaau

SEQ ID NO: 3122091 - RNA, 18 nt, Human
cgugaguccuggcauggg

SEQ ID NO: 3122092 - RNA, 19 nt, Human
cgugaguccuggcauggga

SEQ ID NO: 3122093 - RNA, 11 nt, Human
cuaaagcugcc

SEQ ID NO: 3122094 - RNA, 22 nt, Human
cgugagccacugcaccgggcca

SEQ ID NO: 3122095 - RNA, 14 nt, Human
cgugaggccagaga

SEQ ID NO: 3122096 - RNA, 14 nt, Human
cgugagccacugca

SEQ ID NO: 3122097 - RNA, 15 nt, Human
cgugagccacugcac

SEQ ID NO: 3122098 - RNA, 20 nt, Human
cgugagccacugcaccgggc

SEQ ID NO: 3122099 - RNA, 14 nt, Human
cgugacaacacuug

SEQ ID NO: 3122100 - RNA, 15 nt, Human
cgugacaacacuugu

SEQ ID NO: 3122101 - RNA, 12 nt, Human
cgugacaacacu

SEQ ID NO: 3122102 - RNA, 14 nt, Human
cuaaguuuuuaugg

SEQ ID NO: 3122103 - RNA, 19 nt, Human
cuacaaaaagcauaaaaau

SEQ ID NO: 3122104 - RNA, 20 nt, Human
cgcugccccuggcagccccu

SEQ ID NO: 3122105 - RNA, 19 nt, Human
cgcugccccuggcagcccc

SEQ ID NO: 3122106 - RNA, 17 nt, Human
cgcuggagugcagugag

SEQ ID NO: 3122107 - RNA, 18 nt, Human
cgcuggagugcagugagc

SEQ ID NO: 3122108 - RNA, 23 nt, Human
cgccaaggcugggggaagaagcu

SEQ ID NO: 3122109 - RNA, 23 nt, Human
cggagucccaccuuggcugcagg

SEQ ID NO: 3122110 - RNA, 21 nt, Human
cggagucccaccuuggcugca

SEQ ID NO: 3122111 - RNA, 22 nt, Human
cggagucccaccuuggcugcag

SEQ ID NO: 3122112 - RNA, 15 nt, Human
cggagacggaguccc

SEQ ID NO: 3122113 - RNA, 20 nt, Human
cggagacggagucccaccuu

SEQ ID NO: 3122114 - RNA, 17 nt, Human
cggagacggagucccac

SEQ ID NO: 3122115 - RNA, 22 nt, Human
cguacacauuuuauuuuauuau

SEQ ID NO: 3122116 - RNA, 16 nt, Human
cguacacauuuuauuu

SEQ ID NO: 3122117 - RNA, 20 nt, Human
cgguggcucacgccuguaau

SEQ ID NO: 3122118 - RNA, 17 nt, Human
cgggccacagagaaagu

SEQ ID NO: 3122119 - RNA, 19 nt, Human
cgggcucagcaaaagaugc

SEQ ID NO: 3122120 - RNA, 12 nt, Human
cgggcucugccu

SEQ ID NO: 3122121 - RNA, 18 nt, Human
ccuguucccaugagauga

SEQ ID NO: 3122122 - RNA, 17 nt, Human
ccuguucuggcagaguu

SEQ ID NO: 3122123 - RNA, 12 nt, Human
ccuguucuggca

SEQ ID NO: 3122124 - RNA, 23 nt, Human
ccuguucagcuccagcucaccag

SEQ ID NO: 3122125 - RNA, 20 nt, Human
ccuguucagcuccagcucac

SEQ ID NO: 3122126 - RNA, 21 nt, Human
ccuguucagcuccagcucacc

SEQ ID NO: 3122127 - RNA, 14 nt, Human
ccuguucagcucca

SEQ ID NO: 3122128 - RNA, 15 nt, Human
ccuguucagcuccag

SEQ ID NO: 3122129 - RNA, 16 nt, Human
ccuguucagcuccagc

SEQ ID NO: 3122130 - RNA, 19 nt, Human
ccuguucagcuccagcuca

SEQ ID NO: 3122131 - RNA, 16 nt, Human
ccuguugggccaggag

SEQ ID NO: 3122132 - RNA, 20 nt, Human
ccuguugggccaggagccuc

SEQ ID NO: 3122133 - RNA, 19 nt, Human
ccuguugggccaggagccu

SEQ ID NO: 3122134 - RNA, 18 nt, Human
ccuguugggccaggagcc

SEQ ID NO: 3122135 - RNA, 17 nt, Human
ccuguugggccaggagc

SEQ ID NO: 3122136 - RNA, 16 nt, Human
ccuuagcaaauucugu

SEQ ID NO: 3122137 - RNA, 19 nt, Human
ccuuagcagggaaacagcu

SEQ ID NO: 3122138 - RNA, 20 nt, Human
ccuuagcagggaaacagcua

SEQ ID NO: 3122139 - RNA, 12 nt, Human
ccuucccaccuc

SEQ ID NO: 3122140 - RNA, 19 nt, Human
ccuucccaccucucucacu

SEQ ID NO: 3122141 - RNA, 14 nt, Human
ccuucccaccucuc

SEQ ID NO: 3122142 - RNA, 18 nt, Human
ccuuauggaacacucuga

SEQ ID NO: 3122143 - RNA, 17 nt, Human
ccuuauggaacacucug

SEQ ID NO: 3122144 - RNA, 16 nt, Human
ccuuauggaacacucu

SEQ ID NO: 3122145 - RNA, 14 nt, Human
ccuuauggaacacu

SEQ ID NO: 3122146 - RNA, 20 nt, Human
ccuuauggaacacucugaga

SEQ ID NO: 3122147 - RNA, 19 nt, Human
ccuuauggaacacucugag

SEQ ID NO: 3122148 - RNA, 22 nt, Human
ccuuauggaacacucugagacu

SEQ ID NO: 3122149 - RNA, 12 nt, Human
ccuuauggaaca

SEQ ID NO: 3122150 - RNA, 13 nt, Human
ccuguucagcucc

SEQ ID NO: 3122151 - RNA, 22 nt, Human
ccuucuguccuacucuguguca

SEQ ID NO: 3122152 - RNA, 20 nt, Human
ccuucuguccuacucugugu

SEQ ID NO: 3122153 - RNA, 21 nt, Human
ccuucuguccuacucuguguc

SEQ ID NO: 3122154 - RNA, 23 nt, Human
ccuucucuccagccccuggaugc

SEQ ID NO: 3122155 - RNA, 21 nt, Human
ccuucucuccagccccuggau

SEQ ID NO: 3122156 - RNA, 14 nt, Human
ccuucucugaagga

SEQ ID NO: 3122157 - RNA, 16 nt, Human
ccuucucugaaggaca

SEQ ID NO: 3122158 - RNA, 20 nt, Human
ccuucucuccagccccugga

SEQ ID NO: 3122159 - RNA, 17 nt, Human
ccuuucaauaggaaaaa

SEQ ID NO: 3122160 - RNA, 15 nt, Human
ccuuucaauaggaaa

SEQ ID NO: 3122161 - RNA, 19 nt, Human
ccucuuuggucuacacugu

SEQ ID NO: 3122162 - RNA, 16 nt, Human
ccucuuugagugaagc

SEQ ID NO: 3122163 - RNA, 12 nt, Human
ccugaggggccu

SEQ ID NO: 3122164 - RNA, 16 nt, Human
ccugaggggccucuua

SEQ ID NO: 3122165 - RNA, 21 nt, Human
ccugaggcugggcucccuucc

SEQ ID NO: 3122166 - RNA, 19 nt, Human
ccugaggcugggcucccuu

SEQ ID NO: 3122167 - RNA, 17 nt, Human
ccugaggcugggcuccc

SEQ ID NO: 3122168 - RNA, 16 nt, Human
ccugaggcugggcucc

SEQ ID NO: 3122169 - RNA, 21 nt, Human
ccugcaggcagccaggccaca

SEQ ID NO: 3122170 - RNA, 20 nt, Human
ccugcaggcagccaggccac

SEQ ID NO: 3122171 - RNA, 19 nt, Human
ccugcaggcagccaggcca

SEQ ID NO: 3122172 - RNA, 18 nt, Human
ccugcaggcagccaggcc

SEQ ID NO: 3122173 - RNA, 17 nt, Human
ccugcaggcagccaggc

SEQ ID NO: 3122174 - RNA, 16 nt, Human
ccugcaggcagccagg

SEQ ID NO: 3122175 - RNA, 12 nt, Human
ccugcagagggc

SEQ ID NO: 3122176 - RNA, 15 nt, Human
ccugcaggcagccag

SEQ ID NO: 3122177 - RNA, 21 nt, Human
ccugcugcaguugccagucac

SEQ ID NO: 3122178 - RNA, 22 nt, Human
ccugcugcaguugccagucacc

SEQ ID NO: 3122179 - RNA, 11 nt, Human
ccugcugcagu

SEQ ID NO: 3122180 - RNA, 16 nt, Human
ccugcugcaguugcca

SEQ ID NO: 3122181 - RNA, 12 nt, Human
ccugcugcaguu

SEQ ID NO: 3122182 - RNA, 15 nt, Human
ccugccucuucucua

SEQ ID NO: 3122183 - RNA, 20 nt, Human
ccugccuccuuugugaggaa

SEQ ID NO: 3122184 - RNA, 19 nt, Human
ccugccuccuuugugagga

SEQ ID NO: 3122185 - RNA, 15 nt, Human
ccugccuccuuugug

SEQ ID NO: 3122186 - RNA, 13 nt, Human
ccugccuccuuug

SEQ ID NO: 3122187 - RNA, 22 nt, Human
ccugccuccuuugugaggaagc

SEQ ID NO: 3122188 - RNA, 21 nt, Human
ccugccuccuuugugaggaag

SEQ ID NO: 3122189 - RNA, 23 nt, Human
ccugccuccuuugugaggaagcc

SEQ ID NO: 3122190 - RNA, 11 nt, Human
ccucaggcagg

SEQ ID NO: 3122191 - RNA, 17 nt, Human
ccucccaccucagccuc

SEQ ID NO: 3122192 - RNA, 21 nt, Human
ccucccaacucaccccagccc

SEQ ID NO: 3122193 - RNA, 20 nt, Human
ccucccaacucaccccagcc

SEQ ID NO: 3122194 - RNA, 17 nt, Human
ccucccaacucacccca

SEQ ID NO: 3122195 - RNA, 16 nt, Human
ccucgaacuggcugca

SEQ ID NO: 3122196 - RNA, 15 nt, Human
ccucgaacuggcugc

SEQ ID NO: 3122197 - RNA, 18 nt, Human
ccuccuuugugaggaagc

SEQ ID NO: 3122198 - RNA, 19 nt, Human
ccuccuuugugaggaagcc

SEQ ID NO: 3122199 - RNA, 20 nt, Human
ccucugccucugacacacag

SEQ ID NO: 3122200 - RNA, 21 nt, Human
ccucugccucugacacacagc

SEQ ID NO: 3122201 - RNA, 23 nt, Human
ccucugccucugacacacagcuc

SEQ ID NO: 3122202 - RNA, 11 nt, Human
ccucugccuga

SEQ ID NO: 3122203 - RNA, 20 nt, Human
ccucugccugaagucacaca

SEQ ID NO: 3122204 - RNA, 18 nt, Human
ccggcaggguccuagaaa

SEQ ID NO: 3122205 - RNA, 15 nt, Human
ccggccccugcuggu

SEQ ID NO: 3122206 - RNA, 16 nt, Human
ccggccaccugcggug

SEQ ID NO: 3122207 - RNA, 19 nt, Human
ccuagcauacguacacauu

SEQ ID NO: 3122208 - RNA, 17 nt, Human
ccuagcacuuugggagg

SEQ ID NO: 3122209 - RNA, 20 nt, Human
ccuagccugugccucuggga

SEQ ID NO: 3122210 - RNA, 14 nt, Human
ccuaaucuucugaa

SEQ ID NO: 3122211 - RNA, 12 nt, Human
ccggcuccaggc

SEQ ID NO: 3122212 - RNA, 13 nt, Human
ccggcuccaggcu

SEQ ID NO: 3122213 - RNA, 14 nt, Human
ccggcuccaggcuc

SEQ ID NO: 3122214 - RNA, 15 nt, Human
ccgucuaccugaggg

SEQ ID NO: 3122215 - RNA, 14 nt, Human
ccgucuaccugagg

SEQ ID NO: 3122216 - RNA, 16 nt, Human
ccgugaggccagagac

SEQ ID NO: 3122217 - RNA, 14 nt, Human
ccgugaggccagag

SEQ ID NO: 3122218 - RNA, 13 nt, Human
ccgugaggccaga

SEQ ID NO: 3122219 - RNA, 12 nt, Human
ccgugaggccag

SEQ ID NO: 3122220 - RNA, 17 nt, Human
ccgucuaccugaggggc

SEQ ID NO: 3122221 - RNA, 23 nt, Human
cccugugauggggcccugccucc

SEQ ID NO: 3122222 - RNA, 22 nt, Human
cccugugauggggcccugccuc

SEQ ID NO: 3122223 - RNA, 21 nt, Human
cccugugauggggcccugccu

SEQ ID NO: 3122224 - RNA, 12 nt, Human
ccgcccaggcuu

SEQ ID NO: 3122225 - RNA, 17 nt, Human
ccgcagacaggaccagg

SEQ ID NO: 3122226 - RNA, 16 nt, Human
ccgcagacaggaccag

SEQ ID NO: 3122227 - RNA, 15 nt, Human
cccuuccucuuucca

SEQ ID NO: 3122228 - RNA, 19 nt, Human
ccgaaagggacuuggaagc

SEQ ID NO: 3122229 - RNA, 17 nt, Human
ccgaaaacguggcugcu

SEQ ID NO: 3122230 - RNA, 16 nt, Human
ccgaaaacguggcugc

SEQ ID NO: 3122231 - RNA, 15 nt, Human
ccgcagacaggacca

SEQ ID NO: 3122232 - RNA, 13 nt, Human
ccgaccagacacc

SEQ ID NO: 3122233 - RNA, 17 nt, Human
ccgaccagacaccuuga

SEQ ID NO: 3122234 - RNA, 16 nt, Human
ccgaauagcugggacu

SEQ ID NO: 3122235 - RNA, 13 nt, Human
cccuggaugcagc

SEQ ID NO: 3122236 - RNA, 21 nt, Human
cccuggaugcagccucacagu

SEQ ID NO: 3122237 - RNA, 17 nt, Human
cccuggaugcagccuca

SEQ ID NO: 3122238 - RNA, 22 nt, Human
cccugcccaccuggccucugca

SEQ ID NO: 3122239 - RNA, 14 nt, Human
cccugcccggcugc

SEQ ID NO: 3122240 - RNA, 17 nt, Human
cccugcccggcugcgga

SEQ ID NO: 3122241 - RNA, 20 nt, Human
cccugcccaccuggccucug

SEQ ID NO: 3122242 - RNA, 16 nt, Human
cccugagcuuucugcu

SEQ ID NO: 3122243 - RNA, 18 nt, Human
cccugaaagcccugagcu

SEQ ID NO: 3122244 - RNA, 14 nt, Human
cccugacaacacuc

SEQ ID NO: 3122245 - RNA, 22 nt, Human
cccugaaggccccgcccaggcu

SEQ ID NO: 3122246 - RNA, 20 nt, Human
cccugaaggccccgcccagg

SEQ ID NO: 3122247 - RNA, 22 nt, Human
cccugacaacacucauugaccu

SEQ ID NO: 3122248 - RNA, 16 nt, Human
cccugacaacacucau

SEQ ID NO: 3122249 - RNA, 19 nt, Human
cccugaaggccccgcccag

SEQ ID NO: 3122250 - RNA, 16 nt, Human
cccugaaggccccgcc

SEQ ID NO: 3122251 - RNA, 14 nt, Human
cccugaaggccccg

SEQ ID NO: 3122252 - RNA, 13 nt, Human
cccugaaggcccc

SEQ ID NO: 3122253 - RNA, 16 nt, Human
cccugaaagcccugag

SEQ ID NO: 3122254 - RNA, 12 nt, Human
cccugaaggccc

SEQ ID NO: 3122255 - RNA, 23 nt, Human
cccauucugccugcccaggcccc

SEQ ID NO: 3122256 - RNA, 12 nt, Human
ccccagccccaa

SEQ ID NO: 3122257 - RNA, 10 nt, Human
ccccagcccc

SEQ ID NO: 3122258 - RNA, 21 nt, Human
ccccauucugccugcccaggc

SEQ ID NO: 3122259 - RNA, 14 nt, Human
ccccagccccaaaa

SEQ ID NO: 3122260 - RNA, 14 nt, Human
ccccagccccaucc

SEQ ID NO: 3122261 - RNA, 20 nt, Human
ccccaaaacucuccucugcu

SEQ ID NO: 3122262 - RNA, 18 nt, Human
ccccaaaacucuccucug

SEQ ID NO: 3122263 - RNA, 14 nt, Human
ccccgcccaggcuu

SEQ ID NO: 3122264 - RNA, 18 nt, Human
ccccggccaccugcggug

SEQ ID NO: 3122265 - RNA, 14 nt, Human
ccccggccaccugc

SEQ ID NO: 3122266 - RNA, 13 nt, Human
ccccggccaccug

SEQ ID NO: 3122267 - RNA, 12 nt, Human
ccccgcccaggc

SEQ ID NO: 3122268 - RNA, 14 nt, Human
cccccuuccaugga

SEQ ID NO: 3122269 - RNA, 19 nt, Human
cccauccucuguacagagc

SEQ ID NO: 3122270 - RNA, 15 nt, Human
cccauccucuguaca

SEQ ID NO: 3122271 - RNA, 14 nt, Human
cccauccucuguac

SEQ ID NO: 3122272 - RNA, 19 nt, Human
cccaggcuggcgugcagug

SEQ ID NO: 3122273 - RNA, 20 nt, Human
cccaggcuggcgugcagugg

SEQ ID NO: 3122274 - RNA, 18 nt, Human
cccaggcuggcgugcagu

SEQ ID NO: 3122275 - RNA, 17 nt, Human
cccagcccacuucugcc

SEQ ID NO: 3122276 - RNA, 19 nt, Human
cccagcccacuucugccau

SEQ ID NO: 3122277 - RNA, 21 nt, Human
cccagccccaaaacucuccuc

SEQ ID NO: 3122278 - RNA, 23 nt, Human
cccagccccaaaacucuccucug

SEQ ID NO: 3122279 - RNA, 17 nt, Human
ccaugggccuccugugu

SEQ ID NO: 3122280 - RNA, 18 nt, Human
ccaugaggaacaaggcaa

SEQ ID NO: 3122281 - RNA, 17 nt, Human
ccaugaggaacaaggca

SEQ ID NO: 3122282 - RNA, 16 nt, Human
ccaugaggaacaaggc

SEQ ID NO: 3122283 - RNA, 18 nt, Human
cccaccgcagacaggacc

SEQ ID NO: 3122284 - RNA, 15 nt, Human
cccaccgcagacagg

SEQ ID NO: 3122285 - RNA, 18 nt, Human
cccaccaucaugucuggc

SEQ ID NO: 3122286 - RNA, 15 nt, Human
cccacccaagggccu

SEQ ID NO: 3122287 - RNA, 15 nt, Human
cccaagcucugcucc

SEQ ID NO: 3122288 - RNA, 17 nt, Human
cccaagcucugcuccuc

SEQ ID NO: 3122289 - RNA, 13 nt, Human
ccagucaccccgg

SEQ ID NO: 3122290 - RNA, 18 nt, Human
ccagucaccccggccacc

SEQ ID NO: 3122291 - RNA, 17 nt, Human
ccagucaccccggccac

SEQ ID NO: 3122292 - RNA, 16 nt, Human
ccagucaccccggcca

SEQ ID NO: 3122293 - RNA, 22 nt, Human
ccaguaucuugaagacuuuucu

SEQ ID NO: 3122294 - RNA, 19 nt, Human
ccaguaucuugaagacuuu

SEQ ID NO: 3122295 - RNA, 13 nt, Human
ccaguaucuugaa

SEQ ID NO: 3122296 - RNA, 22 nt, Human
ccaggggugggacacccuguga

SEQ ID NO: 3122297 - RNA, 21 nt, Human
ccaggggugggacacccugug

SEQ ID NO: 3122298 - RNA, 20 nt, Human
ccaggggugggacacccugu

SEQ ID NO: 3122299 - RNA, 19 nt, Human
ccaggggugggacacccug

SEQ ID NO: 3122300 - RNA, 17 nt, Human
ccaggaaaggcuccagg

SEQ ID NO: 3122301 - RNA, 19 nt, Human
ccaggaaaggcuccaggag

SEQ ID NO: 3122302 - RNA, 18 nt, Human
ccaggaaaggcuccagga

SEQ ID NO: 3122303 - RNA, 20 nt, Human
ccaggaaaggcuccaggagc

SEQ ID NO: 3122304 - RNA, 21 nt, Human
ccagcgagcccugguggcagu

SEQ ID NO: 3122305 - RNA, 18 nt, Human
ccagccccuucugaccca

SEQ ID NO: 3122306 - RNA, 17 nt, Human
ccagccccuucugaccc

SEQ ID NO: 3122307 - RNA, 16 nt, Human
ccagccccuucugacc

SEQ ID NO: 3122308 - RNA, 15 nt, Human
ccagccccuucugac

SEQ ID NO: 3122309 - RNA, 18 nt, Human
ccagccccauccucugua

SEQ ID NO: 3122310 - RNA, 23 nt, Human
ccagccccauccucuguacagag

SEQ ID NO: 3122311 - RNA, 13 nt, Human
ccagcagccugga

SEQ ID NO: 3122312 - RNA, 15 nt, Human
ccagccccuggaugc

SEQ ID NO: 3122313 - RNA, 14 nt, Human
ccagccccuggaug

SEQ ID NO: 3122314 - RNA, 13 nt, Human
ccagccccuggau

SEQ ID NO: 3122315 - RNA, 12 nt, Human
ccagcagaaaug

SEQ ID NO: 3122316 - RNA, 12 nt, Human
ccagcagccugg

SEQ ID NO: 3122317 - RNA, 11 nt, Human
ccagcagccug

SEQ ID NO: 3122318 - RNA, 16 nt, Human
ccagcagaaaugccuu

SEQ ID NO: 3122319 - RNA, 17 nt, Human
ccagcagaaaugccuua

SEQ ID NO: 3122320 - RNA, 22 nt, Human
ccagcagaaaugccuuacccuc

SEQ ID NO: 3122321 - RNA, 20 nt, Human
ccagagggccugcaagggag

SEQ ID NO: 3122322 - RNA, 13 nt, Human
ccagaugcaccag

SEQ ID NO: 3122323 - RNA, 14 nt, Human
ccagaugcaccagc

SEQ ID NO: 3122324 - RNA, 18 nt, Human
ccagagacacaagccuuc

SEQ ID NO: 3122325 - RNA, 16 nt, Human
ccagagacacaagccu

SEQ ID NO: 3122326 - RNA, 19 nt, Human
ccacugcacuauagccuag

SEQ ID NO: 3122327 - RNA, 20 nt, Human
ccacugcacuauagccuagg

SEQ ID NO: 3122328 - RNA, 13 nt, Human
ccacugcaccggg

SEQ ID NO: 3122329 - RNA, 14 nt, Human
ccacugcaccgggc

SEQ ID NO: 3122330 - RNA, 17 nt, Human
ccacugcaccgggccac

SEQ ID NO: 3122331 - RNA, 19 nt, Human
ccacugcaccgggccacag

SEQ ID NO: 3122332 - RNA, 13 nt, Human
ccacuuucuagcc

SEQ ID NO: 3122333 - RNA, 19 nt, Human
ccacuuucuagccagagga

SEQ ID NO: 3122334 - RNA, 18 nt, Human
ccacuuucuagccagagg

SEQ ID NO: 3122335 - RNA, 20 nt, Human
ccacuuucuagccagaggag

SEQ ID NO: 3122336 - RNA, 17 nt, Human
ccagacccggcugcgug

SEQ ID NO: 3122337 - RNA, 16 nt, Human
ccagacccggcugcgu

SEQ ID NO: 3122338 - RNA, 14 nt, Human
ccacuuuuguucuu

SEQ ID NO: 3122339 - RNA, 15 nt, Human
ccacuuuuguucuug

SEQ ID NO: 3122340 - RNA, 21 nt, Human
ccacuuuuguucuugguuugu

SEQ ID NO: 3122341 - RNA, 16 nt, Human
caaaccaucauugaaa

SEQ ID NO: 3122342 - RNA, 14 nt, Human
caaaccaucauuga

SEQ ID NO: 3122343 - RNA, 17 nt, Human
caaaccaucauugaaau

SEQ ID NO: 3122344 - RNA, 20 nt, Human
caaaagguuaauaaaguaau

SEQ ID NO: 3122345 - RNA, 19 nt, Human
caaaagcaucuaugugaga

SEQ ID NO: 3122346 - RNA, 13 nt, Human
caaaagcauguga

SEQ ID NO: 3122347 - RNA, 21 nt, Human
auuuuguuuuugucuuaaaaa

SEQ ID NO: 3122348 - RNA, 22 nt, Human
auuuuguuuuugucuuaaaaag

SEQ ID NO: 3122349 - RNA, 16 nt, Human
auuuuuauuaaauuau

SEQ ID NO: 3122350 - RNA, 14 nt, Human
auuuguuauaauga

SEQ ID NO: 3122351 - RNA, 20 nt, Human
auuucuguuuagauaauaca

SEQ ID NO: 3122352 - RNA, 19 nt, Human
auuucuguuuagauaauac

SEQ ID NO: 3122353 - RNA, 21 nt, Human
auuucuguuuagauaauacac

SEQ ID NO: 3122354 - RNA, 12 nt, Human
auuucacucucc

SEQ ID NO: 3122355 - RNA, 22 nt, Human
auuacaagcgugagccacugca

SEQ ID NO: 3122356 - RNA, 20 nt, Human
auucucuaguuugauuaaau

SEQ ID NO: 3122357 - RNA, 19 nt, Human
auucucuaguuugauuaaa

SEQ ID NO: 3122358 - RNA, 23 nt, Human
auucucuaguuugauuaaauucu

SEQ ID NO: 3122359 - RNA, 12 nt, Human
auucucuuaucc

SEQ ID NO: 3122360 - RNA, 14 nt, Human
auucucuuauccaa

SEQ ID NO: 3122361 - RNA, 15 nt, Human
auucucuuauccaac

SEQ ID NO: 3122362 - RNA, 14 nt, Human
auucauauuuacuu

SEQ ID NO: 3122363 - RNA, 12 nt, Human
cacccagcccac

SEQ ID NO: 3122364 - RNA, 23 nt, Human
cacaucuugcucugcugacagac

SEQ ID NO: 3122365 - RNA, 19 nt, Human
cacaucuugcucugcugac

SEQ ID NO: 3122366 - RNA, 17 nt, Human
cacauuuauucugcuca

SEQ ID NO: 3122367 - RNA, 18 nt, Human
cacauuuauucugcucac

SEQ ID NO: 3122368 - RNA, 17 nt, Human
caccagccccagugccc

SEQ ID NO: 3122369 - RNA, 18 nt, Human
caccagccccagugccca

SEQ ID NO: 3122370 - RNA, 21 nt, Human
caccagccccagugcccacag

SEQ ID NO: 3122371 - RNA, 22 nt, Human
caccagccccagugcccacagg

SEQ ID NO: 3122372 - RNA, 16 nt, Human
caccagccccagugcc

SEQ ID NO: 3122373 - RNA, 19 nt, Human
caccagcccuuagcaggga

SEQ ID NO: 3122374 - RNA, 13 nt, Human
cacaucuugcucu

SEQ ID NO: 3122375 - RNA, 14 nt, Human
cacaucuugcucug

SEQ ID NO: 3122376 - RNA, 15 nt, Human
cacaucuugcucugc

SEQ ID NO: 3122377 - RNA, 20 nt, Human
cacaucuugcucugcugaca

SEQ ID NO: 3122378 - RNA, 21 nt, Human
cacaucuugcucugcugacag

SEQ ID NO: 3122379 - RNA, 22 nt, Human
cacaucuugcucugcugacaga

SEQ ID NO: 3122380 - RNA, 15 nt, Human
cacuacauucuguua

SEQ ID NO: 3122381 - RNA, 22 nt, Human
cacggaagagccuugcggaagg

SEQ ID NO: 3122382 - RNA, 16 nt, Human
cacggaagagccuugc

SEQ ID NO: 3122383 - RNA, 21 nt, Human
cacuacauuauaaaugucucu

SEQ ID NO: 3122384 - RNA, 13 nt, Human
cacuacauucugu

SEQ ID NO: 3122385 - RNA, 14 nt, Human
cacuacauucuguu

SEQ ID NO: 3122386 - RNA, 21 nt, Human
cacgcuggagugcagugagcc

SEQ ID NO: 3122387 - RNA, 16 nt, Human
cacgcuggagugcagu

SEQ ID NO: 3122388 - RNA, 17 nt, Human
cacgcuggagugcagug

SEQ ID NO: 3122389 - RNA, 18 nt, Human
cacgcuggagugcaguga

SEQ ID NO: 3122390 - RNA, 20 nt, Human
cacgcuggagugcagugagc

SEQ ID NO: 3122391 - RNA, 15 nt, Human
cacgcuggagugcag

SEQ ID NO: 3122392 - RNA, 16 nt, Human
caccugcggugcuauc

SEQ ID NO: 3122393 - RNA, 19 nt, Human
caccugcggugcuaucucc

SEQ ID NO: 3122394 - RNA, 17 nt, Human
caccugcggugcuaucu

SEQ ID NO: 3122395 - RNA, 12 nt, Human
cacccugcucuc

SEQ ID NO: 3122396 - RNA, 12 nt, Human
cacccuccuuuc

SEQ ID NO: 3122397 - RNA, 12 nt, Human
caccugccaggg

SEQ ID NO: 3122398 - RNA, 11 nt, Human
caccugccagg

SEQ ID NO: 3122399 - RNA, 21 nt, Human
caccugccccucaacucuccu

SEQ ID NO: 3122400 - RNA, 18 nt, Human
caccugccccucaacucu

SEQ ID NO: 3122401 - RNA, 16 nt, Human
caccugccccucaacu

SEQ ID NO: 3122402 - RNA, 17 nt, Human
cacccuggggagaaagu

SEQ ID NO: 3122403 - RNA, 20 nt, Human
caauuuauuauggcacauca

SEQ ID NO: 3122404 - RNA, 13 nt, Human
caauuuauuaugg

SEQ ID NO: 3122405 - RNA, 13 nt, Human
caauggcagccuu

SEQ ID NO: 3122406 - RNA, 14 nt, Human
caauggcagccuug

SEQ ID NO: 3122407 - RNA, 15 nt, Human
caauggcagccuugg

SEQ ID NO: 3122408 - RNA, 14 nt, Human
caaucaaaucugcu

SEQ ID NO: 3122409 - RNA, 15 nt, Human
caagcucugcuccuc

SEQ ID NO: 3122410 - RNA, 16 nt, Human
caagcucugcuccucu

SEQ ID NO: 3122411 - RNA, 17 nt, Human
caagcucccaggcauuc

SEQ ID NO: 3122412 - RNA, 15 nt, Human
caagcucccaggcau

SEQ ID NO: 3122413 - RNA, 14 nt, Human
caagcucccaggca

SEQ ID NO: 3122414 - RNA, 12 nt, Human
caagcucccagg

SEQ ID NO: 3122415 - RNA, 21 nt, Human
caagcuccaagcucccaggca

SEQ ID NO: 3122416 - RNA, 19 nt, Human
caagcuccaagcucccagg

SEQ ID NO: 3122417 - RNA, 18 nt, Human
caagcuccaagcucccag

SEQ ID NO: 3122418 - RNA, 17 nt, Human
caagcuccaagcuccca

SEQ ID NO: 3122419 - RNA, 13 nt, Human
caaguauuauacc

SEQ ID NO: 3122420 - RNA, 17 nt, Human
caaguauuauaccuuuu

SEQ ID NO: 3122421 - RNA, 22 nt, Human
caaguauuauaccuuuuuuaga

SEQ ID NO: 3122422 - RNA, 14 nt, Human
caaggcaaggcugu

SEQ ID NO: 3122423 - RNA, 19 nt, Human
caaggauugcuacuguccu

SEQ ID NO: 3122424 - RNA, 20 nt, Human
caaggauugcuacuguccua

SEQ ID NO: 3122425 - RNA, 13 nt, Human
caagcaccuccug

SEQ ID NO: 3122426 - RNA, 14 nt, Human
caagaccacguuuc

SEQ ID NO: 3122427 - RNA, 17 nt, Human
caagaaggaugauucaa

SEQ ID NO: 3122428 - RNA, 18 nt, Human
caagaagcccaggaaagg

SEQ ID NO: 3122429 - RNA, 15 nt, Human
caagaagcccaggaa

SEQ ID NO: 3122430 - RNA, 14 nt, Human
caagaagcccagga

SEQ ID NO: 3122431 - RNA, 14 nt, Human
caacccccagccug

SEQ ID NO: 3122432 - RNA, 17 nt, Human
caaccccuucgcuccug

SEQ ID NO: 3122433 - RNA, 14 nt, Human
caaccccuucgcuc

SEQ ID NO: 3122434 - RNA, 16 nt, Human
caaccccuucgcuccu

SEQ ID NO: 3122435 - RNA, 15 nt, Human
cagccugcuccagcu

SEQ ID NO: 3122436 - RNA, 19 nt, Human
cagccugcuccagcuguuc

SEQ ID NO: 3122437 - RNA, 17 nt, Human
cagccugcuccagcugu

SEQ ID NO: 3122438 - RNA, 16 nt, Human
cagccugcuccagcug

SEQ ID NO: 3122439 - RNA, 19 nt, Human
cagcguuucuaugacacau

SEQ ID NO: 3122440 - RNA, 15 nt, Human
cagcuaacauggaag

SEQ ID NO: 3122441 - RNA, 21 nt, Human
cagcugacuuuucuguccgag

SEQ ID NO: 3122442 - RNA, 19 nt, Human
caggaaaggcuccaggagc

SEQ ID NO: 3122443 - RNA, 17 nt, Human
caggaaaggcuccagga

SEQ ID NO: 3122444 - RNA, 16 nt, Human
caggaaaggcuccagg

SEQ ID NO: 3122445 - RNA, 12 nt, Human
caggccaggccc

SEQ ID NO: 3122446 - RNA, 11 nt, Human
caggccaggcc

SEQ ID NO: 3122447 - RNA, 19 nt, Human
caggaggaucacuugaguc

SEQ ID NO: 3122448 - RNA, 22 nt, Human
caggaggccagccuugaccauu

SEQ ID NO: 3122449 - RNA, 19 nt, Human
caggaggccagccuugacc

SEQ ID NO: 3122450 - RNA, 18 nt, Human
caggaggccagccuugac

SEQ ID NO: 3122451 - RNA, 14 nt, Human
caggcaaugcuggc

SEQ ID NO: 3122452 - RNA, 15 nt, Human
caggcaaugcuggcu

SEQ ID NO: 3122453 - RNA, 16 nt, Human
caggcaaugcuggcug

SEQ ID NO: 3122454 - RNA, 23 nt, Human
caggaccucaggugagaagcaga

SEQ ID NO: 3122455 - RNA, 16 nt, Human
caggaccucaggugag

SEQ ID NO: 3122456 - RNA, 21 nt, Human
caggaccagggauuuccauga

SEQ ID NO: 3122457 - RNA, 23 nt, Human
caggcugggagagccuuccaggg

SEQ ID NO: 3122458 - RNA, 22 nt, Human
caggcugggagagccuuccagg

SEQ ID NO: 3122459 - RNA, 16 nt, Human
caggggaaaagaggag

SEQ ID NO: 3122460 - RNA, 14 nt, Human
caggggaaaagagg

SEQ ID NO: 3122461 - RNA, 20 nt, Human
caggcugggagagccuucca

SEQ ID NO: 3122462 - RNA, 21 nt, Human
caggcugggagagccuuccag

SEQ ID NO: 3122463 - RNA, 14 nt, Human
caggccuccuacag

SEQ ID NO: 3122464 - RNA, 12 nt, Human
caggccuccuac

SEQ ID NO: 3122465 - RNA, 20 nt, Human
cagacuggaagcacagcuuc

SEQ ID NO: 3122466 - RNA, 21 nt, Human
cagacuggaagcacagcuuca

SEQ ID NO: 3122467 - RNA, 13 nt, Human
cagacuggaagca

SEQ ID NO: 3122468 - RNA, 14 nt, Human
cagacuggaagcac

SEQ ID NO: 3122469 - RNA, 16 nt, Human
cagacuggaagcacag

SEQ ID NO: 3122470 - RNA, 17 nt, Human
cagacuggaagcacagc

SEQ ID NO: 3122471 - RNA, 18 nt, Human
cagacuggaagcacagcu

SEQ ID NO: 3122472 - RNA, 23 nt, Human
cagacucuacagaggccaugggc

SEQ ID NO: 3122473 - RNA, 18 nt, Human
cagacucuacagaggcca

SEQ ID NO: 3122474 - RNA, 19 nt, Human
cagacucuacagaggccau

SEQ ID NO: 3122475 - RNA, 20 nt, Human
cagacucuacagaggccaug

SEQ ID NO: 3122476 - RNA, 21 nt, Human
cagacucuacagaggccaugg

SEQ ID NO: 3122477 - RNA, 17 nt, Human
cagacucuacagaggcc

SEQ ID NO: 3122478 - RNA, 22 nt, Human
cagacaggcaagcaccuccugc

SEQ ID NO: 3122479 - RNA, 23 nt, Human
cagacaggcaagcaccuccugcc

SEQ ID NO: 3122480 - RNA, 11 nt, Human
cagacaggcaa

SEQ ID NO: 3122481 - RNA, 24 nt, Human
cagacaggaccagggauuuccaug

SEQ ID NO: 3122482 - RNA, 17 nt, Human
cagacaggaccagggau

SEQ ID NO: 3122483 - RNA, 13 nt, Human
cagacaggcaagc

SEQ ID NO: 3122484 - RNA, 18 nt, Human
cagacaggcaagcaccuc

SEQ ID NO: 3122485 - RNA, 20 nt, Human
cagacaggcaagcaccuccu

SEQ ID NO: 3122486 - RNA, 21 nt, Human
cagacaggcaagcaccuccug

SEQ ID NO: 3122487 - RNA, 18 nt, Human
cagacagcugccugggau

SEQ ID NO: 3122488 - RNA, 17 nt, Human
cagacagcugccuggga

SEQ ID NO: 3122489 - RNA, 16 nt, Human
cagacagcugccuggg

SEQ ID NO: 3122490 - RNA, 15 nt, Human
cagacagcugccugg

SEQ ID NO: 3122491 - RNA, 16 nt, Human
cagacaggaccaggga

SEQ ID NO: 3122492 - RNA, 15 nt, Human
cagacaggaccaggg

SEQ ID NO: 3122493 - RNA, 13 nt, Human
cagacaggaccag

SEQ ID NO: 3122494 - RNA, 14 nt, Human
cagacagcugccug

SEQ ID NO: 3122495 - RNA, 13 nt, Human
cagacagcugccu

SEQ ID NO: 3122496 - RNA, 19 nt, Human
cagauagauauaugcucug

SEQ ID NO: 3122497 - RNA, 19 nt, Human
cagauacuuggggggcuga

SEQ ID NO: 3122498 - RNA, 16 nt, Human
cagaggggguggccuc

SEQ ID NO: 3122499 - RNA, 14 nt, Human
cagaggggguggcc

SEQ ID NO: 3122500 - RNA, 23 nt, Human
cagagagggugggagugggccca

SEQ ID NO: 3122501 - RNA, 23 nt, Human
cagagaggguggugaccucugcc

SEQ ID NO: 3122502 - RNA, 20 nt, Human
cagagagguuaaggugggua

SEQ ID NO: 3122503 - RNA, 13 nt, Human
cagagcugccacc

SEQ ID NO: 3122504 - RNA, 13 nt, Human
cagaggggguggc

SEQ ID NO: 3122505 - RNA, 19 nt, Human
cagaggaaagcaaaggaga

SEQ ID NO: 3122506 - RNA, 17 nt, Human
cagaggaaagcaaagga

SEQ ID NO: 3122507 - RNA, 23 nt, Human
cagagacuccugcaggcagccag

SEQ ID NO: 3122508 - RNA, 20 nt, Human
cagagaggguggugaccucu

SEQ ID NO: 3122509 - RNA, 22 nt, Human
cagagaggguggugaccucugc

SEQ ID NO: 3122510 - RNA, 17 nt, Human
cagagaggguggugacc

SEQ ID NO: 3122511 - RNA, 12 nt, Human
cagagagggugg

SEQ ID NO: 3122512 - RNA, 22 nt, Human
cagccaggccacaagacccuug

SEQ ID NO: 3122513 - RNA, 14 nt, Human
cagcacgauuucug

SEQ ID NO: 3122514 - RNA, 15 nt, Human
cagcacgauuucugu

SEQ ID NO: 3122515 - RNA, 20 nt, Human
cagcacgauuucuguuuaga

SEQ ID NO: 3122516 - RNA, 18 nt, Human
cagauugcaacaggcugg

SEQ ID NO: 3122517 - RNA, 19 nt, Human
cagauuucacucuccuugg

SEQ ID NO: 3122518 - RNA, 17 nt, Human
cagcaccaucucuccuc

SEQ ID NO: 3122519 - RNA, 19 nt, Human
cagcaccaucucuccuccu

SEQ ID NO: 3122520 - RNA, 19 nt, Human
cagauugcaacaggcuggg

SEQ ID NO: 3122521 - RNA, 20 nt, Human
cagauugcaacaggcugggc

SEQ ID NO: 3122522 - RNA, 20 nt, Human
cagauuucacucuccuuggu

SEQ ID NO: 3122523 - RNA, 23 nt, Human
cauuuuuuuuaagaaaaaggaug

SEQ ID NO: 3122524 - RNA, 22 nt, Human
cauuuuuuuuaagaaaaaggau

SEQ ID NO: 3122525 - RNA, 18 nt, Human
cauuuaggugaggaagca

SEQ ID NO: 3122526 - RNA, 16 nt, Human
cauuuaggugaggaag

SEQ ID NO: 3122527 - RNA, 22 nt, Human
ccaaaguacacuguuucaaacu

SEQ ID NO: 3122528 - RNA, 20 nt, Human
ccaaaguacacuguuucaaa

SEQ ID NO: 3122529 - RNA, 16 nt, Human
ccaagcucugcuccuc

SEQ ID NO: 3122530 - RNA, 14 nt, Human
ccaagcucugcucc

SEQ ID NO: 3122531 - RNA, 15 nt, Human
ccaagcucugcuccu

SEQ ID NO: 3122532 - RNA, 21 nt, Human
ccaacucaccccagccccaaa

SEQ ID NO: 3122533 - RNA, 15 nt, Human
ccaaaucagcugcua

SEQ ID NO: 3122534 - RNA, 23 nt, Human
ccaaaucagcugcuacuacuccu

SEQ ID NO: 3122535 - RNA, 13 nt, Human
ccaacucacccca

SEQ ID NO: 3122536 - RNA, 23 nt, Human
ccaauggacuaacuugucuuugg

SEQ ID NO: 3122537 - RNA, 19 nt, Human
cauucuccaccugccaggg

SEQ ID NO: 3122538 - RNA, 18 nt, Human
cauucuccaccugccagg

SEQ ID NO: 3122539 - RNA, 17 nt, Human
cauucuccaccugccag

SEQ ID NO: 3122540 - RNA, 20 nt, Human
cauucuccuuguguuacuaa

SEQ ID NO: 3122541 - RNA, 18 nt, Human
cauguucuuaauucuuag

SEQ ID NO: 3122542 - RNA, 18 nt, Human
cauguuggccaggcuggu

SEQ ID NO: 3122543 - RNA, 17 nt, Human
cauguuggccaggcugg

SEQ ID NO: 3122544 - RNA, 21 nt, Human
cauguuacauaagauaaaugu

SEQ ID NO: 3122545 - RNA, 13 nt, Human
cauguucuuaauu

SEQ ID NO: 3122546 - RNA, 16 nt, Human
cauguucuuaauucuu

SEQ ID NO: 3122547 - RNA, 15 nt, Human
cauguccaagaagcc

SEQ ID NO: 3122548 - RNA, 16 nt, Human
cauguuacauaagaua

SEQ ID NO: 3122549 - RNA, 17 nt, Human
cauguuacauaagauaa

SEQ ID NO: 3122550 - RNA, 17 nt, Human
caugcuccuggcccacu

SEQ ID NO: 3122551 - RNA, 16 nt, Human
caugcuccuggcccac

SEQ ID NO: 3122552 - RNA, 14 nt, Human
caugcuccuggccc

SEQ ID NO: 3122553 - RNA, 18 nt, Human
caugggaaaggggaaguu

SEQ ID NO: 3122554 - RNA, 21 nt, Human
cauggccucuucagaucucua

SEQ ID NO: 3122555 - RNA, 12 nt, Human
caugcaagguca

SEQ ID NO: 3122556 - RNA, 13 nt, Human
caugacaaagacu

SEQ ID NO: 3122557 - RNA, 21 nt, Human
cagucugauucccaagcucug

SEQ ID NO: 3122558 - RNA, 22 nt, Human
cagucugauucccaagcucugc

SEQ ID NO: 3122559 - RNA, 16 nt, Human
cagugggagcugccug

SEQ ID NO: 3122560 - RNA, 15 nt, Human
cagugggagcugccu

SEQ ID NO: 3122561 - RNA, 17 nt, Human
cagugggagcugccugu

SEQ ID NO: 3122562 - RNA, 18 nt, Human
cagugggagcugccuguu

SEQ ID NO: 3122563 - RNA, 20 nt, Human
cagugguaugaucacggcuc

SEQ ID NO: 3122564 - RNA, 21 nt, Human
cagugcccacaggaucagucu

SEQ ID NO: 3122565 - RNA, 18 nt, Human
cagugcccacaggaucag

SEQ ID NO: 3122566 - RNA, 22 nt, Human
cagugcccacaggaucagucug

SEQ ID NO: 3122567 - RNA, 23 nt, Human
cagucugauucccaagcucugcu

SEQ ID NO: 3122568 - RNA, 20 nt, Human
caguuacucagaauucucua

SEQ ID NO: 3122569 - RNA, 21 nt, Human
cagugguaugaucacggcuca

SEQ ID NO: 3122570 - RNA, 14 nt, Human
caguuacucagaau

SEQ ID NO: 3122571 - RNA, 19 nt, Human
caguggugcgaucuggguu

SEQ ID NO: 3122572 - RNA, 21 nt, Human
caucagcacgauuucuguuua

SEQ ID NO: 3122573 - RNA, 19 nt, Human
caucagcacgauuucuguu

SEQ ID NO: 3122574 - RNA, 19 nt, Human
caucccaaacccuucagug

SEQ ID NO: 3122575 - RNA, 22 nt, Human
cauccucuguacagagcccacg

SEQ ID NO: 3122576 - RNA, 21 nt, Human
cauccucuguacagagcccac

SEQ ID NO: 3122577 - RNA, 20 nt, Human
caucccaaacccuucagugc

SEQ ID NO: 3122578 - RNA, 11 nt, Human
caucccagccc

SEQ ID NO: 3122579 - RNA, 23 nt, Human
cauagcagagaaugaaagggccc

SEQ ID NO: 3122580 - RNA, 22 nt, Human
cauauuaccacagacauacuaa

SEQ ID NO: 3122581 - RNA, 23 nt, Human
cauaaugcgugcauaccacuuuu

SEQ ID NO: 3122582 - RNA, 23 nt, Human
cauacaggaagguagaaauaucu

SEQ ID NO: 3122583 - RNA, 21 nt, Human
caguuuguuaguaugaggcau

SEQ ID NO: 3122584 - RNA, 23 nt, Human
caguuuguuaguaugaggcauuu

SEQ ID NO: 3122585 - RNA, 22 nt, Human
caguuguuagugugucuuagug

SEQ ID NO: 3122586 - RNA, 18 nt, Human
caguuguuagugugucuu

SEQ ID NO: 3122587 - RNA, 14 nt, Human
gcugacagacacag

SEQ ID NO: 3122588 - RNA, 15 nt, Human
gcugacagacacagg

SEQ ID NO: 3122589 - RNA, 16 nt, Human
gcugacagacacaggc

SEQ ID NO: 3122590 - RNA, 20 nt, Human
gcugaaggcucgagcaugcc

SEQ ID NO: 3122591 - RNA, 12 nt, Human
gcugaaggcucg

SEQ ID NO: 3122592 - RNA, 17 nt, Human
gcugaaugguuuucaaa

SEQ ID NO: 3122593 - RNA, 22 nt, Human
gcugaauacagaggcaacugca

SEQ ID NO: 3122594 - RNA, 12 nt, Human
gcucuuccaggc

SEQ ID NO: 3122595 - RNA, 16 nt, Human
gcucuuccaggcuggg

SEQ ID NO: 3122596 - RNA, 15 nt, Human
gcucuuccaggcugg

SEQ ID NO: 3122597 - RNA, 15 nt, Human
gcucuguccugggag

SEQ ID NO: 3122598 - RNA, 14 nt, Human
gcucuguccuggga

SEQ ID NO: 3122599 - RNA, 16 nt, Human
gcucuguccugggagu

SEQ ID NO: 3122600 - RNA, 21 nt, Human
gcucccaggcauuccccagga

SEQ ID NO: 3122601 - RNA, 20 nt, Human
gcucccaggcauuccccagg

SEQ ID NO: 3122602 - RNA, 17 nt, Human
gcucccaggcauucccc

SEQ ID NO: 3122603 - RNA, 22 nt, Human
gcucccaggcauuccccaggag

SEQ ID NO: 3122604 - RNA, 14 nt, Human
gcuccccagcccca

SEQ ID NO: 3122605 - RNA, 16 nt, Human
gcucucaggccagcug

SEQ ID NO: 3122606 - RNA, 15 nt, Human
gcucucaggccagcu

SEQ ID NO: 3122607 - RNA, 14 nt, Human
gcucucaggccagc

SEQ ID NO: 3122608 - RNA, 13 nt, Human
gcucucaggccag

SEQ ID NO: 3122609 - RNA, 16 nt, Human
gcuaggaacacuccuu

SEQ ID NO: 3122610 - RNA, 18 nt, Human
gcuaggaacacuccuuca

SEQ ID NO: 3122611 - RNA, 21 nt, Human
gcuaggaacacuccuucacag

SEQ ID NO: 3122612 - RNA, 19 nt, Human
gcuaggaacacuccuucac

SEQ ID NO: 3122613 - RNA, 22 nt, Human
gcuaggaccccuccaugugggc

SEQ ID NO: 3122614 - RNA, 14 nt, Human
gcuaggccuggcca

SEQ ID NO: 3122615 - RNA, 15 nt, Human
gcuaggccuggccag

SEQ ID NO: 3122616 - RNA, 20 nt, Human
gccuguucagcuccagcuca

SEQ ID NO: 3122617 - RNA, 17 nt, Human
gccuguucagcuccagc

SEQ ID NO: 3122618 - RNA, 19 nt, Human
gccuguucagcuccagcuc

SEQ ID NO: 3122619 - RNA, 22 nt, Human
gcucagguggggucacucuggc

SEQ ID NO: 3122620 - RNA, 21 nt, Human
gcucagguggggucacucugg

SEQ ID NO: 3122621 - RNA, 15 nt, Human
gcucagagagggugg

SEQ ID NO: 3122622 - RNA, 20 nt, Human
gcucagagagggugggagug

SEQ ID NO: 3122623 - RNA, 18 nt, Human
gcucagagagggugggag

SEQ ID NO: 3122624 - RNA, 16 nt, Human
gcucagggccuggcuc

SEQ ID NO: 3122625 - RNA, 13 nt, Human
gcucagggccugg

SEQ ID NO: 3122626 - RNA, 12 nt, Human
gcucagggccug

SEQ ID NO: 3122627 - RNA, 14 nt, Human
gcuuguacauaaug

SEQ ID NO: 3122628 - RNA, 16 nt, Human
gcuuguacauaaugcg

SEQ ID NO: 3122629 - RNA, 20 nt, Human
gcuguaucccaugagccuca

SEQ ID NO: 3122630 - RNA, 23 nt, Human
gcuguaucccaugagccucagca

SEQ ID NO: 3122631 - RNA, 19 nt, Human
gcuguaucccaugagccuc

SEQ ID NO: 3122632 - RNA, 14 nt, Human
gcuggguuggaggg

SEQ ID NO: 3122633 - RNA, 21 nt, Human
gcuggguuggaggguguccca

SEQ ID NO: 3122634 - RNA, 15 nt, Human
gcuggguucugaucc

SEQ ID NO: 3122635 - RNA, 15 nt, Human
gcuggguucuaccca

SEQ ID NO: 3122636 - RNA, 20 nt, Human
gcuucacggaagagccuugc

SEQ ID NO: 3122637 - RNA, 19 nt, Human
gcuucacggaagagccuug

SEQ ID NO: 3122638 - RNA, 22 nt, Human
gcuucaaggauccugagccaga

SEQ ID NO: 3122639 - RNA, 18 nt, Human
gcugugcucuggacaggc

SEQ ID NO: 3122640 - RNA, 13 nt, Human
gcugugcugcccu

SEQ ID NO: 3122641 - RNA, 21 nt, Human
gcugugcucuggacaggcaug

SEQ ID NO: 3122642 - RNA, 12 nt, Human
gcugugcugccc

SEQ ID NO: 3122643 - RNA, 21 nt, Human
gcuguuggcugggggccucag

SEQ ID NO: 3122644 - RNA, 22 nt, Human
gcuguuggcugggggccucagu

SEQ ID NO: 3122645 - RNA, 22 nt, Human
gcugugcugcccugcccaccug

SEQ ID NO: 3122646 - RNA, 19 nt, Human
gcugugcugcccugcccac

SEQ ID NO: 3122647 - RNA, 22 nt, Human
gcuggaccuugaacuggguacu

SEQ ID NO: 3122648 - RNA, 12 nt, Human
gcuggagugcag

SEQ ID NO: 3122649 - RNA, 19 nt, Human
gcugggauuacagguguga

SEQ ID NO: 3122650 - RNA, 18 nt, Human
gcugggauuacaggugug

SEQ ID NO: 3122651 - RNA, 13 nt, Human
gcugggcagagga

SEQ ID NO: 3122652 - RNA, 15 nt, Human
gcugggcagaggaaa

SEQ ID NO: 3122653 - RNA, 14 nt, Human
gcugggcagaggaa

SEQ ID NO: 3122654 - RNA, 14 nt, Human
gcuggagugcagug

SEQ ID NO: 3122655 - RNA, 15 nt, Human
gcuggagugcaguga

SEQ ID NO: 3122656 - RNA, 17 nt, Human
gcuggccuggccccuca

SEQ ID NO: 3122657 - RNA, 16 nt, Human
gcuggccuggccccuc

SEQ ID NO: 3122658 - RNA, 16 nt, Human
gcugggauuacaggug

SEQ ID NO: 3122659 - RNA, 19 nt, Human
gcuggccuggccccucagg

SEQ ID NO: 3122660 - RNA, 18 nt, Human
gcuggccuggccccucag

SEQ ID NO: 3122661 - RNA, 20 nt, Human
gcugggcucccuucccaccu

SEQ ID NO: 3122662 - RNA, 17 nt, Human
gcugggcucccuuccca

SEQ ID NO: 3122663 - RNA, 16 nt, Human
gcugggcucccuuccc

SEQ ID NO: 3122664 - RNA, 12 nt, Human
gcugggcucccu

SEQ ID NO: 3122665 - RNA, 17 nt, Human
gcugggcagaggaaagc

SEQ ID NO: 3122666 - RNA, 16 nt, Human
gcugggcagaggaaag

SEQ ID NO: 3122667 - RNA, 19 nt, Human
gcugggcagaggaaagcaa

SEQ ID NO: 3122668 - RNA, 15 nt, Human
gcuggguguggcgca

SEQ ID NO: 3122669 - RNA, 14 nt, Human
gcugcaccggcugg

SEQ ID NO: 3122670 - RNA, 17 nt, Human
gcugcaccggcuggccu

SEQ ID NO: 3122671 - RNA, 16 nt, Human
gcugcaccggcuggcc

SEQ ID NO: 3122672 - RNA, 22 nt, Human
gcugcaccggcuggccuggccc

SEQ ID NO: 3122673 - RNA, 19 nt, Human
gcugcaccggcuggccugg

SEQ ID NO: 3122674 - RNA, 18 nt, Human
gcugcaccggcuggccug

SEQ ID NO: 3122675 - RNA, 21 nt, Human
gcugccauccagguucagcuu

SEQ ID NO: 3122676 - RNA, 23 nt, Human
gcugccauccagguucagcuugu

SEQ ID NO: 3122677 - RNA, 21 nt, Human
gcugccagccgagauagccaa

SEQ ID NO: 3122678 - RNA, 19 nt, Human
gcugccagccgagauagcc

SEQ ID NO: 3122679 - RNA, 13 nt, Human
gcugccaccugcc

SEQ ID NO: 3122680 - RNA, 18 nt, Human
gcugccugggaucccuca

SEQ ID NO: 3122681 - RNA, 16 nt, Human
gcugccugggaucccu

SEQ ID NO: 3122682 - RNA, 19 nt, Human
gcugccugggaucccucau

SEQ ID NO: 3122683 - RNA, 13 nt, Human
gcugccugggauc

SEQ ID NO: 3122684 - RNA, 22 nt, Human
gccaccaacauacucccaucug

SEQ ID NO: 3122685 - RNA, 19 nt, Human
gccaccaacauacucccau

SEQ ID NO: 3122686 - RNA, 21 nt, Human
gccaccaacauacucccaucu

SEQ ID NO: 3122687 - RNA, 20 nt, Human
gccaccaacauacucccauc

SEQ ID NO: 3122688 - RNA, 20 nt, Human
gccacauuccugaugcuucu

SEQ ID NO: 3122689 - RNA, 16 nt, Human
gccacauuccugaugc

SEQ ID NO: 3122690 - RNA, 22 nt, Human
gccacugcaccgggccacagag

SEQ ID NO: 3122691 - RNA, 21 nt, Human
gccacugcacuauagccuagg

SEQ ID NO: 3122692 - RNA, 13 nt, Human
gccacccugggga

SEQ ID NO: 3122693 - RNA, 19 nt, Human
gccacccuggggagaaagu

SEQ ID NO: 3122694 - RNA, 23 nt, Human
gccacugcaccgggccacagaga

SEQ ID NO: 3122695 - RNA, 18 nt, Human
gccacugugaagagaacc

SEQ ID NO: 3122696 - RNA, 19 nt, Human
gccacugugaagagaacca

SEQ ID NO: 3122697 - RNA, 23 nt, Human
gccaggccacaagacccuugugg

SEQ ID NO: 3122698 - RNA, 12 nt, Human
gccaggccagag

SEQ ID NO: 3122699 - RNA, 21 nt, Human
gccaggcccucugcccacucc

SEQ ID NO: 3122700 - RNA, 20 nt, Human
gccaggcccucugcccacuc

SEQ ID NO: 3122701 - RNA, 19 nt, Human
gccaggcccucugcccacu

SEQ ID NO: 3122702 - RNA, 17 nt, Human
gccaggcccucugccca

SEQ ID NO: 3122703 - RNA, 16 nt, Human
gccaggcccucugccc

SEQ ID NO: 3122704 - RNA, 13 nt, Human
gccaggccagagg

SEQ ID NO: 3122705 - RNA, 15 nt, Human
gccaggcccucugcc

SEQ ID NO: 3122706 - RNA, 16 nt, Human
gccagcaggcucucag

SEQ ID NO: 3122707 - RNA, 13 nt, Human
gccagcaggcucu

SEQ ID NO: 3122708 - RNA, 21 nt, Human
gccagcaggcucucaggccag

SEQ ID NO: 3122709 - RNA, 20 nt, Human
gccagcaggcucucaggcca

SEQ ID NO: 3122710 - RNA, 19 nt, Human
gccagcaggcucucaggcc

SEQ ID NO: 3122711 - RNA, 18 nt, Human
gccagcaggcucucaggc

SEQ ID NO: 3122712 - RNA, 17 nt, Human
gccagcaggcucucagg

SEQ ID NO: 3122713 - RNA, 19 nt, Human
gccauauucuguuggccag

SEQ ID NO: 3122714 - RNA, 20 nt, Human
gccauauucuguuggccagu

SEQ ID NO: 3122715 - RNA, 14 nt, Human
gccauguuggccag

SEQ ID NO: 3122716 - RNA, 15 nt, Human
gccauguuggccagg

SEQ ID NO: 3122717 - RNA, 16 nt, Human
gccauguuggccaggc

SEQ ID NO: 3122718 - RNA, 17 nt, Human
gccauguuggccaggcu

SEQ ID NO: 3122719 - RNA, 18 nt, Human
gccauguuggccaggcug

SEQ ID NO: 3122720 - RNA, 15 nt, Human
gcccacgcuggagug

SEQ ID NO: 3122721 - RNA, 16 nt, Human
gcccacgcuggagugc

SEQ ID NO: 3122722 - RNA, 17 nt, Human
gcccacgcuggagugca

SEQ ID NO: 3122723 - RNA, 17 nt, Human
gcccaccuuggcucaag

SEQ ID NO: 3122724 - RNA, 18 nt, Human
gcccaccuuggcucaagu

SEQ ID NO: 3122725 - RNA, 14 nt, Human
gcccacgcccccac

SEQ ID NO: 3122726 - RNA, 13 nt, Human
gcccacgccccca

SEQ ID NO: 3122727 - RNA, 19 nt, Human
gccauguuggccaggcugg

SEQ ID NO: 3122728 - RNA, 20 nt, Human
gccauguuggccaggcuggu

SEQ ID NO: 3122729 - RNA, 22 nt, Human
gccauguuggccaggcuggucu

SEQ ID NO: 3122730 - RNA, 24 nt, Human
gccauguuggccaggcuggucuca

SEQ ID NO: 3122731 - RNA, 13 nt, Human
gccuccuccagcc

SEQ ID NO: 3122732 - RNA, 18 nt, Human
gccuccugcccuuaccug

SEQ ID NO: 3122733 - RNA, 12 nt, Human
gccucugggacu

SEQ ID NO: 3122734 - RNA, 17 nt, Human
gccugcccaggccccug

SEQ ID NO: 3122735 - RNA, 18 nt, Human
gccugcccaggccccugc

SEQ ID NO: 3122736 - RNA, 19 nt, Human
gccugcccaggccccugcc

SEQ ID NO: 3122737 - RNA, 23 nt, Human
gccucuucucuacucuagggaaa

SEQ ID NO: 3122738 - RNA, 12 nt, Human
gccucuucucua

SEQ ID NO: 3122739 - RNA, 15 nt, Human
gccuggccccucagg

SEQ ID NO: 3122740 - RNA, 17 nt, Human
gccuggccccucagggu

SEQ ID NO: 3122741 - RNA, 16 nt, Human
gccuggccccucaggg

SEQ ID NO: 3122742 - RNA, 22 nt, Human
gccuggccccucagggucccug

SEQ ID NO: 3122743 - RNA, 20 nt, Human
gccuggccccucaggguccc

SEQ ID NO: 3122744 - RNA, 10 nt, Human
gccuggccug

SEQ ID NO: 3122745 - RNA, 21 nt, Human
gccugggaggucaaggcugca

SEQ ID NO: 3122746 - RNA, 14 nt, Human
gccugggaucccuc

SEQ ID NO: 3122747 - RNA, 22 nt, Human
gccugggaggucaaggcugcag

SEQ ID NO: 3122748 - RNA, 18 nt, Human
gccugggaucccucaucc

SEQ ID NO: 3122749 - RNA, 16 nt, Human
gccugccucuucucua

SEQ ID NO: 3122750 - RNA, 22 nt, Human
gcccuaaaguguauuuuuuuac

SEQ ID NO: 3122751 - RNA, 22 nt, Human
gccccuggaugcagccucacag

SEQ ID NO: 3122752 - RNA, 18 nt, Human
gccccuggaugcagccuc

SEQ ID NO: 3122753 - RNA, 16 nt, Human
gccccuggaugcagcc

SEQ ID NO: 3122754 - RNA, 15 nt, Human
gccccuggaugcagc

SEQ ID NO: 3122755 - RNA, 13 nt, Human
gccccugcccggc

SEQ ID NO: 3122756 - RNA, 14 nt, Human
gccccugcccggcu

SEQ ID NO: 3122757 - RNA, 18 nt, Human
gccccaaaacucuccucu

SEQ ID NO: 3122758 - RNA, 13 nt, Human
gcccacucccugc

SEQ ID NO: 3122759 - RNA, 19 nt, Human
gcccacucccugcaaccug

SEQ ID NO: 3122760 - RNA, 15 nt, Human
gcccacucccugcaa

SEQ ID NO: 3122761 - RNA, 14 nt, Human
gcccacucccugca

SEQ ID NO: 3122762 - RNA, 14 nt, Human
gcccugccuccuuu

SEQ ID NO: 3122763 - RNA, 22 nt, Human
gcccugccuccuuugugaggaa

SEQ ID NO: 3122764 - RNA, 16 nt, Human
gcccugccuccuuugu

SEQ ID NO: 3122765 - RNA, 21 nt, Human
gcccugugggcccccaaaugg

SEQ ID NO: 3122766 - RNA, 16 nt, Human
gccgccaugcuccugg

SEQ ID NO: 3122767 - RNA, 20 nt, Human
gcccuuaccugccaggaagc

SEQ ID NO: 3122768 - RNA, 16 nt, Human
gcccuuaccugccagg

SEQ ID NO: 3122769 - RNA, 15 nt, Human
gccgccaugcuccug

SEQ ID NO: 3122770 - RNA, 16 nt, Human
ggcucccuucccaccu

SEQ ID NO: 3122771 - RNA, 18 nt, Human
ggcucccuucccaccucu

SEQ ID NO: 3122772 - RNA, 17 nt, Human
ggcucccuucccaccuc

SEQ ID NO: 3122773 - RNA, 22 nt, Human
ggcucccuucccaccucucuca

SEQ ID NO: 3122774 - RNA, 20 nt, Human
ggcucccuucccaccucucu

SEQ ID NO: 3122775 - RNA, 21 nt, Human
ggcugccaaugggagcucaug

SEQ ID NO: 3122776 - RNA, 20 nt, Human
ggcugcaugcgggcuuccuc

SEQ ID NO: 3122777 - RNA, 17 nt, Human
ggcugcagggaguccga

SEQ ID NO: 3122778 - RNA, 18 nt, Human
ggcucgagcaugccugga

SEQ ID NO: 3122779 - RNA, 24 nt, Human
ggcucuuccaggcugggagagccu

SEQ ID NO: 3122780 - RNA, 23 nt, Human
ggcucuuccaggcugggagagcc

SEQ ID NO: 3122781 - RNA, 20 nt, Human
ggcucuuccaggcugggaga

SEQ ID NO: 3122782 - RNA, 14 nt, Human
ggcuggcgugcagu

SEQ ID NO: 3122783 - RNA, 16 nt, Human
ggcuggcgugcagugg

SEQ ID NO: 3122784 - RNA, 20 nt, Human
ggcuggcgugcaguggugcg

SEQ ID NO: 3122785 - RNA, 22 nt, Human
ggcuggccuggccccucagggu

SEQ ID NO: 3122786 - RNA, 17 nt, Human
ggcuggccuggccccuc

SEQ ID NO: 3122787 - RNA, 13 nt, Human
aaaaaaacacaaa

SEQ ID NO: 3122788 - RNA, 15 nt, Human
ggcuucaguggcagc

SEQ ID NO: 3122789 - RNA, 20 nt, Human
ggcuguaucccaugagccuc

SEQ ID NO: 3122790 - RNA, 22 nt, Human
ggcuguaucccaugagccucag

SEQ ID NO: 3122791 - RNA, 23 nt, Human
ggcuguaucccaugagccucagc

SEQ ID NO: 3122792 - RNA, 15 nt, Human
ggcugucaauuacag

SEQ ID NO: 3122793 - RNA, 19 nt, Human
ggcuguaucccaugagccu

SEQ ID NO: 3122794 - RNA, 16 nt, Human
ggcuggugucaccuga

SEQ ID NO: 3122795 - RNA, 16 nt, Human
ggcuucaguggcagcu

SEQ ID NO: 3122796 - RNA, 13 nt, Human
gggaaaaucagcc

SEQ ID NO: 3122797 - RNA, 23 nt, Human
gggaaaaucagccugcuccagcu

SEQ ID NO: 3122798 - RNA, 23 nt, Human
gggcagagcagagaccaucccug

SEQ ID NO: 3122799 - RNA, 15 nt, Human
gggauuuccaugaug

SEQ ID NO: 3122800 - RNA, 18 nt, Human
gggagggcuccagacaca

SEQ ID NO: 3122801 - RNA, 15 nt, Human
aaaauaccagccagu

SEQ ID NO: 3122802 - RNA, 14 nt, Human
aaaauaccagccag

SEQ ID NO: 3122803 - RNA, 12 nt, Human
aaaauaaauuau

SEQ ID NO: 3122804 - RNA, 18 nt, Human
aaaauaguggugugauuu

SEQ ID NO: 3122805 - RNA, 12 nt, Human
aaaauagccugc

SEQ ID NO: 3122806 - RNA, 13 nt, Human
gggagggcuccag

SEQ ID NO: 3122807 - RNA, 11 nt, Human
gggagggcucc

SEQ ID NO: 3122808 - RNA, 22 nt, Human
aaaacuugauguguuaucucuu

SEQ ID NO: 3122809 - RNA, 14 nt, Human
aaaagcugggcagg

SEQ ID NO: 3122810 - RNA, 14 nt, Human
gggaacagacugga

SEQ ID NO: 3122811 - RNA, 22 nt, Human
gggaacagacuggaagcacagc

SEQ ID NO: 3122812 - RNA, 17 nt, Human
aaaaaucucaaauuucu

SEQ ID NO: 3122813 - RNA, 19 nt, Human
aaaaaucucaaauuucuaa

SEQ ID NO: 3122814 - RNA, 20 nt, Human
aaaaaucucaaauuucuaaa

SEQ ID NO: 3122815 - RNA, 15 nt, Human
aaaaccaauguucuc

SEQ ID NO: 3122816 - RNA, 18 nt, Human
aaaacguggcugcuucaa

SEQ ID NO: 3122817 - RNA, 17 nt, Human
aaaacguggcugcuuca

SEQ ID NO: 3122818 - RNA, 16 nt, Human
aaaacguggcugcuuc

SEQ ID NO: 3122819 - RNA, 14 nt, Human
aaaacguggcugcu

SEQ ID NO: 3122820 - RNA, 21 nt, Human
aaaacguggcugcuucaagga

SEQ ID NO: 3122821 - RNA, 22 nt, Human
aaaacugauuuuuuuuuccuuc

SEQ ID NO: 3122822 - RNA, 18 nt, Human
aaaacugauuuuuuuuuc

SEQ ID NO: 3122823 - RNA, 22 nt, Human
gggucacucuggcagcucagag

SEQ ID NO: 3122824 - RNA, 20 nt, Human
ggguaucaggugcugccauc

SEQ ID NO: 3122825 - RNA, 22 nt, Human
gggucucacuauguugcccagg

SEQ ID NO: 3122826 - RNA, 23 nt, Human
gggucucacuauguugcccaggc

SEQ ID NO: 3122827 - RNA, 16 nt, Human
aaacuggauuaaacuu

SEQ ID NO: 3122828 - RNA, 17 nt, Human
aaacguggcugcuucaa

SEQ ID NO: 3122829 - RNA, 16 nt, Human
aaacguggcugcuuca

SEQ ID NO: 3122830 - RNA, 21 nt, Human
aaaauguaggguuauaauaau

SEQ ID NO: 3122831 - RNA, 21 nt, Human
aaaauggacguguuaugacuc

SEQ ID NO: 3122832 - RNA, 20 nt, Human
aaaauggaagacagcucuua

SEQ ID NO: 3122833 - RNA, 19 nt, Human
aaacacaaacgggcucagc

SEQ ID NO: 3122834 - RNA, 22 nt, Human
aaacaugcuacacacugcaugu

SEQ ID NO: 3122835 - RNA, 16 nt, Human
aaacaugcuacacacu

SEQ ID NO: 3122836 - RNA, 24 nt, Human
ggggaaaaucagccugcuccagcu

SEQ ID NO: 3122837 - RNA, 17 nt, Human
ggggaccucaggccugg

SEQ ID NO: 3122838 - RNA, 16 nt, Human
ggggaccucaggccug

SEQ ID NO: 3122839 - RNA, 15 nt, Human
ggggaccucaggccu

SEQ ID NO: 3122840 - RNA, 13 nt, Human
ggggaccucaggc

SEQ ID NO: 3122841 - RNA, 23 nt, Human
ggggcccugccuccuuugugagg

SEQ ID NO: 3122842 - RNA, 19 nt, Human
ggggcccugccuccuuugu

SEQ ID NO: 3122843 - RNA, 15 nt, Human
ggggcccugccuccu

SEQ ID NO: 3122844 - RNA, 16 nt, Human
ggggcccugccuccuu

SEQ ID NO: 3122845 - RNA, 17 nt, Human
ggggccaguuggucccc

SEQ ID NO: 3122846 - RNA, 15 nt, Human
aaagacuguacaaag

SEQ ID NO: 3122847 - RNA, 14 nt, Human
aaagacuguacaaa

SEQ ID NO: 3122848 - RNA, 19 nt, Human
aaagacuuuuccaacccuc

SEQ ID NO: 3122849 - RNA, 15 nt, Human
aaagaugagugagca

SEQ ID NO: 3122850 - RNA, 18 nt, Human
aaagaggcuaugugagca

SEQ ID NO: 3122851 - RNA, 13 nt, Human
aaagaggcuaugu

SEQ ID NO: 3122852 - RNA, 20 nt, Human
gguccacccaggagccccga

SEQ ID NO: 3122853 - RNA, 22 nt, Human
gguccacccaggagccccgagg

SEQ ID NO: 3122854 - RNA, 12 nt, Human
ggucccacccca

SEQ ID NO: 3122855 - RNA, 14 nt, Human
aaacuuuaccuuuu

SEQ ID NO: 3122856 - RNA, 19 nt, Human
gguccacccaggagccccg

SEQ ID NO: 3122857 - RNA, 23 nt, Human
gguauuggcuagagguucaaaga

SEQ ID NO: 3122858 - RNA, 22 nt, Human
ggugcacaagcuccaagcuccc

SEQ ID NO: 3122859 - RNA, 16 nt, Human
ggugcacaagcuccaa

SEQ ID NO: 3122860 - RNA, 12 nt, Human
ggucuguucuuu

SEQ ID NO: 3122861 - RNA, 21 nt, Human
ggucuugaacuccuggccuca

SEQ ID NO: 3122862 - RNA, 22 nt, Human
ggucuugaacuccuggccucaa

SEQ ID NO: 3122863 - RNA, 17 nt, Human
ggucuguucuuuccaaa

SEQ ID NO: 3122864 - RNA, 19 nt, Human
ggucuguucuuuccaaagu

SEQ ID NO: 3122865 - RNA, 17 nt, Human
aaagcagugcaugcugu

SEQ ID NO: 3122866 - RNA, 17 nt, Human
aaagcuaggccuggcca

SEQ ID NO: 3122867 - RNA, 18 nt, Human
aaagcuaggccuggccag

SEQ ID NO: 3122868 - RNA, 22 nt, Human
aaagcagugcaugcugucccuu

SEQ ID NO: 3122869 - RNA, 21 nt, Human
aaagcagugcaugcugucccu

SEQ ID NO: 3122870 - RNA, 16 nt, Human
aaagcagugcaugcug

SEQ ID NO: 3122871 - RNA, 11 nt, Human
aaaggaaagag

SEQ ID NO: 3122872 - RNA, 18 nt, Human
ggaggucgaggcaggagg

SEQ ID NO: 3122873 - RNA, 14 nt, Human
ggaggucgaggcag

SEQ ID NO: 3122874 - RNA, 16 nt, Human
ggaggucgaggcagga

SEQ ID NO: 3122875 - RNA, 15 nt, Human
ggaggucgaggcagg

SEQ ID NO: 3122876 - RNA, 22 nt, Human
ggagcugccuguucagcuccag

SEQ ID NO: 3122877 - RNA, 12 nt, Human
ggaggaagagaa

SEQ ID NO: 3122878 - RNA, 21 nt, Human
ggaggcaugugaugagaggaa

SEQ ID NO: 3122879 - RNA, 13 nt, Human
ggaggccagccuu

SEQ ID NO: 3122880 - RNA, 18 nt, Human
ggaggccaaggugggagg

SEQ ID NO: 3122881 - RNA, 12 nt, Human
ggaggccagccu

SEQ ID NO: 3122882 - RNA, 21 nt, Human
ggagcagccacauuccugaug

SEQ ID NO: 3122883 - RNA, 13 nt, Human
ggagcagccacau

SEQ ID NO: 3122884 - RNA, 19 nt, Human
gcuuguacauaaugcgugc

SEQ ID NO: 3122885 - RNA, 14 nt, Human
ggacccugaggccc

SEQ ID NO: 3122886 - RNA, 18 nt, Human
ggacccugaggcccagag

SEQ ID NO: 3122887 - RNA, 15 nt, Human
ggacccugaggccca

SEQ ID NO: 3122888 - RNA, 15 nt, Human
ggagagcuagcagca

SEQ ID NO: 3122889 - RNA, 16 nt, Human
ggagagccuuccaggg

SEQ ID NO: 3122890 - RNA, 13 nt, Human
ggagagccuucca

SEQ ID NO: 3122891 - RNA, 18 nt, Human
ggagagccuuccaggggu

SEQ ID NO: 3122892 - RNA, 17 nt, Human
ggagagccuuccagggg

SEQ ID NO: 3122893 - RNA, 22 nt, Human
ggagagccuuccagggguggga

SEQ ID NO: 3122894 - RNA, 18 nt, Human
ggacucaaugcacugaca

SEQ ID NO: 3122895 - RNA, 22 nt, Human
ggacucaaugcacugacauugu

SEQ ID NO: 3122896 - RNA, 20 nt, Human
ggacuacaggugugagucac

SEQ ID NO: 3122897 - RNA, 22 nt, Human
ggagaaccaaaaagaggcuaug

SEQ ID NO: 3122898 - RNA, 9 nt, Human
ggacuuugu

SEQ ID NO: 3122899 - RNA, 19 nt, Human
ggagaaaauggacguguua

SEQ ID NO: 3122900 - RNA, 15 nt, Human
ggacuuggaagcucc

SEQ ID NO: 3122901 - RNA, 17 nt, Human
ggacuuggaagcuccgc

SEQ ID NO: 3122902 - RNA, 21 nt, Human
ggccaaaggaagcacaugccu

SEQ ID NO: 3122903 - RNA, 15 nt, Human
ggccaaagccaaagc

SEQ ID NO: 3122904 - RNA, 12 nt, Human
ggccaaaggaag

SEQ ID NO: 3122905 - RNA, 21 nt, Human
ggccaaacucaccugccccuc

SEQ ID NO: 3122906 - RNA, 12 nt, Human
ggcauuguggga

SEQ ID NO: 3122907 - RNA, 13 nt, Human
ggccaagguggga

SEQ ID NO: 3122908 - RNA, 22 nt, Human
ggccagagggagugacagaggc

SEQ ID NO: 3122909 - RNA, 23 nt, Human
ggccagagggagugacagaggca

SEQ ID NO: 3122910 - RNA, 17 nt, Human
ggccagaugcaccagcc

SEQ ID NO: 3122911 - RNA, 19 nt, Human
ggccagaugcaccagcccu

SEQ ID NO: 3122912 - RNA, 20 nt, Human
ggccagaugcaccagcccuu

SEQ ID NO: 3122913 - RNA, 14 nt, Human
ggccucccaacuca

SEQ ID NO: 3122914 - RNA, 13 nt, Human
ggccucccaacuc

SEQ ID NO: 3122915 - RNA, 21 nt, Human
ggaugaauuccaaauucugcu

SEQ ID NO: 3122916 - RNA, 12 nt, Human
ggaugagaaagg

SEQ ID NO: 3122917 - RNA, 22 nt, Human
ggaugagaaagguugaagcacc

SEQ ID NO: 3122918 - RNA, 21 nt, Human
ggauuuugauccaagcugguc

SEQ ID NO: 3122919 - RNA, 23 nt, Human
ggauuaaacuuaaucuaaaugga

SEQ ID NO: 3122920 - RNA, 12 nt, Human
ggcagaaggaag

SEQ ID NO: 3122921 - RNA, 17 nt, Human
ggcagccaggccacaag

SEQ ID NO: 3122922 - RNA, 15 nt, Human
ggcagccaggccaca

SEQ ID NO: 3122923 - RNA, 10 nt, Human
ggcagagcag

SEQ ID NO: 3122924 - RNA, 14 nt, Human
ggcagccaggccac

SEQ ID NO: 3122925 - RNA, 14 nt, Human
cugcauuuaaaaga

SEQ ID NO: 3122926 - RNA, 13 nt, Human
cugcauuggcuuu

SEQ ID NO: 3122927 - RNA, 19 nt, Human
cugcccugugggcccccaa

SEQ ID NO: 3122928 - RNA, 12 nt, Human
cugcccuuaccu

SEQ ID NO: 3122929 - RNA, 17 nt, Human
cugcccuuaccugccag

SEQ ID NO: 3122930 - RNA, 16 nt, Human
cugcccuuaccugcca

SEQ ID NO: 3122931 - RNA, 12 nt, Human
cugccauccagg

SEQ ID NO: 3122932 - RNA, 16 nt, Human
cugccauauucuguug

SEQ ID NO: 3122933 - RNA, 16 nt, Human
cugccauccagguuca

SEQ ID NO: 3122934 - RNA, 18 nt, Human
cugccauccagguucagc

SEQ ID NO: 3122935 - RNA, 19 nt, Human
cugccauccagguucagcu

SEQ ID NO: 3122936 - RNA, 23 nt, Human
cugccagggacagaggggguggc

SEQ ID NO: 3122937 - RNA, 22 nt, Human
cugccagggacagagggggugg

SEQ ID NO: 3122938 - RNA, 20 nt, Human
cugccagggacagagggggu

SEQ ID NO: 3122939 - RNA, 17 nt, Human
cugcauuuaaaagauac

SEQ ID NO: 3122940 - RNA, 20 nt, Human
cugcaggcagccaggccaca

SEQ ID NO: 3122941 - RNA, 19 nt, Human
cugcaggcagccaggccac

SEQ ID NO: 3122942 - RNA, 18 nt, Human
cugcaggcagccaggcca

SEQ ID NO: 3122943 - RNA, 17 nt, Human
cugcaggcagccaggcc

SEQ ID NO: 3122944 - RNA, 16 nt, Human
cugcaggcagccaggc

SEQ ID NO: 3122945 - RNA, 15 nt, Human
cugcaggcagccagg

SEQ ID NO: 3122946 - RNA, 14 nt, Human
cugcaggcagccag

SEQ ID NO: 3122947 - RNA, 13 nt, Human
cugcaggcagcca

SEQ ID NO: 3122948 - RNA, 12 nt, Human
cugcagcuuugu

SEQ ID NO: 3122949 - RNA, 23 nt, Human
cugcagccucaaccuccugggcu

SEQ ID NO: 3122950 - RNA, 24 nt, Human
cugcagccucaaccuccugggcua

SEQ ID NO: 3122951 - RNA, 18 nt, Human
cugcacuccagccugggu

SEQ ID NO: 3122952 - RNA, 16 nt, Human
cugcacuccagccugg

SEQ ID NO: 3122953 - RNA, 17 nt, Human
cugcacuccagccuggg

SEQ ID NO: 3122954 - RNA, 16 nt, Human
cugcacuauagccuag

SEQ ID NO: 3122955 - RNA, 17 nt, Human
cugcacuauagccuagg

SEQ ID NO: 3122956 - RNA, 18 nt, Human
cugcacuauagccuaggu

SEQ ID NO: 3122957 - RNA, 20 nt, Human
cugcacuauagccuagguga

SEQ ID NO: 3122958 - RNA, 22 nt, Human
cugcacuauagccuaggugaca

SEQ ID NO: 3122959 - RNA, 23 nt, Human
cugcacuauagccuaggugacag

SEQ ID NO: 3122960 - RNA, 13 nt, Human
cugcacuccagcc

SEQ ID NO: 3122961 - RNA, 15 nt, Human
cugcacuccagccug

SEQ ID NO: 3122962 - RNA, 24 nt, Human
cugaugggcaacccccagccugcu

SEQ ID NO: 3122963 - RNA, 22 nt, Human
cugaugggcaacccccagccug

SEQ ID NO: 3122964 - RNA, 23 nt, Human
cugaugggcaacccccagccugc

SEQ ID NO: 3122965 - RNA, 21 nt, Human
cugcaaaggguaucaggugcu

SEQ ID NO: 3122966 - RNA, 22 nt, Human
cugcaaaggguaucaggugcug

SEQ ID NO: 3122967 - RNA, 20 nt, Human
cugaugcuucuucagagacu

SEQ ID NO: 3122968 - RNA, 19 nt, Human
cugaugcuucuucagagac

SEQ ID NO: 3122969 - RNA, 18 nt, Human
cugaugcuucuucagaga

SEQ ID NO: 3122970 - RNA, 18 nt, Human
cugaugggcaacccccag

SEQ ID NO: 3122971 - RNA, 21 nt, Human
cugaugggcaacccccagccu

SEQ ID NO: 3122972 - RNA, 15 nt, Human
cucuuaugggcuggg

SEQ ID NO: 3122973 - RNA, 14 nt, Human
cucuuaugggcugg

SEQ ID NO: 3122974 - RNA, 17 nt, Human
cugaugcuucuucagag

SEQ ID NO: 3122975 - RNA, 16 nt, Human
cugaugcuucuucaga

SEQ ID NO: 3122976 - RNA, 12 nt, Human
cugcaagggagu

SEQ ID NO: 3122977 - RNA, 20 nt, Human
cugcaagaauugaagcagga

SEQ ID NO: 3122978 - RNA, 20 nt, Human
cugcaccgggccacagagaa

SEQ ID NO: 3122979 - RNA, 23 nt, Human
cugcaccgggccacagagaaagu

SEQ ID NO: 3122980 - RNA, 22 nt, Human
cugcaaccugauugugucucuu

SEQ ID NO: 3122981 - RNA, 18 nt, Human
cugcaagaauugaagcag

SEQ ID NO: 3122982 - RNA, 22 nt, Human
cugcaaccuccgccucuugggu

SEQ ID NO: 3122983 - RNA, 14 nt, Human
cugcaaccugauug

SEQ ID NO: 3122984 - RNA, 21 nt, Human
cugcaaccugauugugucucu

SEQ ID NO: 3122985 - RNA, 19 nt, Human
cugcaaccugauugugucu

SEQ ID NO: 3122986 - RNA, 20 nt, Human
cugcaaccuccgccucuugg

SEQ ID NO: 3122987 - RNA, 22 nt, Human
cuggaugcagccucacaguccu

SEQ ID NO: 3122988 - RNA, 15 nt, Human
cuggaguucugguuc

SEQ ID NO: 3122989 - RNA, 17 nt, Human
cuggaguucugguuccu

SEQ ID NO: 3122990 - RNA, 16 nt, Human
cuggaguucugguucc

SEQ ID NO: 3122991 - RNA, 20 nt, Human
cugcuuaacuucacauauug

SEQ ID NO: 3122992 - RNA, 12 nt, Human
cugcugaaggcu

SEQ ID NO: 3122993 - RNA, 16 nt, Human
cugcucacauaucugu

SEQ ID NO: 3122994 - RNA, 19 nt, Human
cugcucacauaucugucau

SEQ ID NO: 3122995 - RNA, 14 nt, Human
cugcucacauaucu

SEQ ID NO: 3122996 - RNA, 13 nt, Human
cugcugacagugu

SEQ ID NO: 3122997 - RNA, 15 nt, Human
cugcugacaguguug

SEQ ID NO: 3122998 - RNA, 11 nt, Human
cugcugacagu

SEQ ID NO: 3122999 - RNA, 12 nt, Human
cugcugacagug

SEQ ID NO: 3123000 - RNA, 15 nt, Human
cugcugaaggcucga

SEQ ID NO: 3123001 - RNA, 14 nt, Human
cugcugaaggcucg

SEQ ID NO: 3123002 - RNA, 13 nt, Human
cugcugaaggcuc

SEQ ID NO: 3123003 - RNA, 13 nt, Human
cuggcuaugcauu

SEQ ID NO: 3123004 - RNA, 14 nt, Human
cuggcuaugcauuu

SEQ ID NO: 3123005 - RNA, 22 nt, Human
cuggcuaugcauuugaaaauuu

SEQ ID NO: 3123006 - RNA, 15 nt, Human
cuggcuaugcauuug

SEQ ID NO: 3123007 - RNA, 16 nt, Human
cuggcuaugcauuuga

SEQ ID NO: 3123008 - RNA, 12 nt, Human
cuggcccuuccu

SEQ ID NO: 3123009 - RNA, 14 nt, Human
cugggacaugggaa

SEQ ID NO: 3123010 - RNA, 22 nt, Human
cugggacaugggaaaggggaag

SEQ ID NO: 3123011 - RNA, 18 nt, Human
cugggacaugggaaaggg

SEQ ID NO: 3123012 - RNA, 13 nt, Human
cugggacuacagg

SEQ ID NO: 3123013 - RNA, 15 nt, Human
cugggacuacaggca

SEQ ID NO: 3123014 - RNA, 22 nt, Human
cugggagaaccaaaaagaggcu

SEQ ID NO: 3123015 - RNA, 12 nt, Human
cugggcagagga

SEQ ID NO: 3123016 - RNA, 16 nt, Human
cugggcagaggaaagc

SEQ ID NO: 3123017 - RNA, 13 nt, Human
cugggcagaggaa

SEQ ID NO: 3123018 - RNA, 20 nt, Human
cugggcagaggaaagcaaag

SEQ ID NO: 3123019 - RNA, 20 nt, Human
cugggcagguuggugggggc

SEQ ID NO: 3123020 - RNA, 20 nt, Human
cuggguggcaccagcagccu

SEQ ID NO: 3123021 - RNA, 18 nt, Human
cuggguggcaccagcagc

SEQ ID NO: 3123022 - RNA, 13 nt, Human
cuggggagaaagu

SEQ ID NO: 3123023 - RNA, 15 nt, Human
cuggguguggcgcag

SEQ ID NO: 3123024 - RNA, 21 nt, Human
cuggguggcaccagcagccug

SEQ ID NO: 3123025 - RNA, 14 nt, Human
cuggguguggcgca

SEQ ID NO: 3123026 - RNA, 17 nt, Human
cuuccauggacuuuguu

SEQ ID NO: 3123027 - RNA, 16 nt, Human
cuuccauggacuuugu

SEQ ID NO: 3123028 - RNA, 20 nt, Human
cuuccagugaggcucugccc

SEQ ID NO: 3123029 - RNA, 19 nt, Human
cuuccagugaggcucugcc

SEQ ID NO: 3123030 - RNA, 17 nt, Human
cuuccagugaggcucug

SEQ ID NO: 3123031 - RNA, 18 nt, Human
cuuccagugaggcucugc

SEQ ID NO: 3123032 - RNA, 14 nt, Human
cuucaccuuugucc

SEQ ID NO: 3123033 - RNA, 18 nt, Human
cuuauugcccacgcugga

SEQ ID NO: 3123034 - RNA, 20 nt, Human
cuucaccuuuguccccaccg

SEQ ID NO: 3123035 - RNA, 17 nt, Human
cuucaccuuugucccca

SEQ ID NO: 3123036 - RNA, 22 nt, Human
cuucagagacuccugcaggcag

SEQ ID NO: 3123037 - RNA, 21 nt, Human
cuucagagacuccugcaggca

SEQ ID NO: 3123038 - RNA, 16 nt, Human
cuucagagacuccugc

SEQ ID NO: 3123039 - RNA, 15 nt, Human
cuucauccuccucag

SEQ ID NO: 3123040 - RNA, 13 nt, Human
cuucaucccucug

SEQ ID NO: 3123041 - RNA, 18 nt, Human
cuucaguggcagcugcuu

SEQ ID NO: 3123042 - RNA, 17 nt, Human
cuucaguggcagcugcu

SEQ ID NO: 3123043 - RNA, 23 nt, Human
cuucagagacuccugcaggcagc

SEQ ID NO: 3123044 - RNA, 16 nt, Human
cuucauccuccucaga

SEQ ID NO: 3123045 - RNA, 18 nt, Human
cuuagcagggaaacagcu

SEQ ID NO: 3123046 - RNA, 21 nt, Human
cuuauggaacacucugagacu

SEQ ID NO: 3123047 - RNA, 21 nt, Human
cuuaugggcuggguucuaccc

SEQ ID NO: 3123048 - RNA, 14 nt, Human
cuuaugggcugggu

SEQ ID NO: 3123049 - RNA, 23 nt, Human
cuuaugggcuggguucuacccag

SEQ ID NO: 3123050 - RNA, 22 nt, Human
cuuaugggcuggguucuaccca

SEQ ID NO: 3123051 - RNA, 12 nt, Human
cuuauugcccac

SEQ ID NO: 3123052 - RNA, 13 nt, Human
cuuauugcccacg

SEQ ID NO: 3123053 - RNA, 19 nt, Human
cugugucagguggggcagc

SEQ ID NO: 3123054 - RNA, 20 nt, Human
cugugucagcauagaaguaa

SEQ ID NO: 3123055 - RNA, 21 nt, Human
cugugucagguggggcagcuu

SEQ ID NO: 3123056 - RNA, 14 nt, Human
cugugucuugcaau

SEQ ID NO: 3123057 - RNA, 19 nt, Human
cugugucucccuucauccu

SEQ ID NO: 3123058 - RNA, 14 nt, Human
cugugucucccuuc

SEQ ID NO: 3123059 - RNA, 19 nt, Human
cugugcugagucugaaggc

SEQ ID NO: 3123060 - RNA, 11 nt, Human
cugugcugccc

SEQ ID NO: 3123061 - RNA, 22 nt, Human
cugugcugagucugaaggcugg

SEQ ID NO: 3123062 - RNA, 20 nt, Human
cugugcugagucugaaggcu

SEQ ID NO: 3123063 - RNA, 13 nt, Human
cuguucagcucca

SEQ ID NO: 3123064 - RNA, 16 nt, Human
cugugucuugcaaugg

SEQ ID NO: 3123065 - RNA, 19 nt, Human
cugugucuugcaauggcag

SEQ ID NO: 3123066 - RNA, 19 nt, Human
cuuagauguauauauuucc

SEQ ID NO: 3123067 - RNA, 21 nt, Human
cuuaccucggugccuuccucu

SEQ ID NO: 3123068 - RNA, 19 nt, Human
cuuaccucggugccuuccu

SEQ ID NO: 3123069 - RNA, 13 nt, Human
cuuaccucggugc

SEQ ID NO: 3123070 - RNA, 17 nt, Human
cuuacccucauguucuu

SEQ ID NO: 3123071 - RNA, 18 nt, Human
cuuacccucauguucuua

SEQ ID NO: 3123072 - RNA, 19 nt, Human
cuuacccucauguucuuaa

SEQ ID NO: 3123073 - RNA, 16 nt, Human
cuguugggccaggagc

SEQ ID NO: 3123074 - RNA, 20 nt, Human
cuguugggccaggagccucc

SEQ ID NO: 3123075 - RNA, 17 nt, Human
cuguugggccaggagcc

SEQ ID NO: 3123076 - RNA, 13 nt, Human
cuuacacaauggu

SEQ ID NO: 3123077 - RNA, 22 nt, Human
cuuugacgccaucccagcccca

SEQ ID NO: 3123078 - RNA, 21 nt, Human
cuuugacgccaucccagcccc

SEQ ID NO: 3123079 - RNA, 19 nt, Human
cuuugacgccaucccagcc

SEQ ID NO: 3123080 - RNA, 18 nt, Human
cuuugacgccaucccagc

SEQ ID NO: 3123081 - RNA, 15 nt, Human
cuuuucaaaacauuu

SEQ ID NO: 3123082 - RNA, 20 nt, Human
cuuuggucuacacugugcug

SEQ ID NO: 3123083 - RNA, 16 nt, Human
cuuuggucuacacugu

SEQ ID NO: 3123084 - RNA, 14 nt, Human
cuuuuauaaacuuu

SEQ ID NO: 3123085 - RNA, 16 nt, Human
cuuuuauaaacuuuac

SEQ ID NO: 3123086 - RNA, 18 nt, Human
cuuuuauaaacuuuaccu

SEQ ID NO: 3123087 - RNA, 15 nt, Human
cuuuuauaaacuuua

SEQ ID NO: 3123088 - RNA, 13 nt, Human
cuuguggacacag

SEQ ID NO: 3123089 - RNA, 14 nt, Human
cuuguggacacagc

SEQ ID NO: 3123090 - RNA, 15 nt, Human
cuuguggacacagcu

SEQ ID NO: 3123091 - RNA, 22 nt, Human
cuuucaauaggaaaaacugauu

SEQ ID NO: 3123092 - RNA, 21 nt, Human
cuuucaauaggaaaaacugau

SEQ ID NO: 3123093 - RNA, 20 nt, Human
cuuucaauaggaaaaacuga

SEQ ID NO: 3123094 - RNA, 18 nt, Human
cuuucaauaggaaaaacu

SEQ ID NO: 3123095 - RNA, 12 nt, Human
cuugcucugcug

SEQ ID NO: 3123096 - RNA, 23 nt, Human
cuugccgucuaccugaggggccu

SEQ ID NO: 3123097 - RNA, 19 nt, Human
cuugccgucuaccugaggg

SEQ ID NO: 3123098 - RNA, 12 nt, Human
cuugacagggca

SEQ ID NO: 3123099 - RNA, 20 nt, Human
cuugccgucuaccugagggg

SEQ ID NO: 3123100 - RNA, 20 nt, Human
cuugaaugaugccaugagga

SEQ ID NO: 3123101 - RNA, 18 nt, Human
cuucuucagagacuccug

SEQ ID NO: 3123102 - RNA, 22 nt, Human
cuucuucagagacuccugcagg

SEQ ID NO: 3123103 - RNA, 23 nt, Human
cuucugacccaugcugcccugug

SEQ ID NO: 3123104 - RNA, 21 nt, Human
cuucuucagagacuccugcag

SEQ ID NO: 3123105 - RNA, 20 nt, Human
cuucuucagagacuccugca

SEQ ID NO: 3123106 - RNA, 16 nt, Human
gaugagugagcaugcc

SEQ ID NO: 3123107 - RNA, 15 nt, Human
gaugaucuaggaaga

SEQ ID NO: 3123108 - RNA, 21 nt, Human
gaugaucuaggaagacuuugg

SEQ ID NO: 3123109 - RNA, 14 nt, Human
gaugauccuaggca

SEQ ID NO: 3123110 - RNA, 17 nt, Human
gauucuuccucccuccc

SEQ ID NO: 3123111 - RNA, 18 nt, Human
gauucuuccucccucccu

SEQ ID NO: 3123112 - RNA, 15 nt, Human
gauucuccugccuca

SEQ ID NO: 3123113 - RNA, 17 nt, Human
gauucuccugccucagc

SEQ ID NO: 3123114 - RNA, 18 nt, Human
gauucuccugccucagcc

SEQ ID NO: 3123115 - RNA, 14 nt, Human
gauucuccugccuc

SEQ ID NO: 3123116 - RNA, 12 nt, Human
gauuauuggaaa

SEQ ID NO: 3123117 - RNA, 19 nt, Human
gcaagugagagcugggugu

SEQ ID NO: 3123118 - RNA, 14 nt, Human
gcacacauuuuuua

SEQ ID NO: 3123119 - RNA, 14 nt, Human
gcacaccgggcacu

SEQ ID NO: 3123120 - RNA, 22 nt, Human
gcacaagcugcacccucaggca

SEQ ID NO: 3123121 - RNA, 14 nt, Human
gcaccgggccacag

SEQ ID NO: 3123122 - RNA, 22 nt, Human
gcacaucagcacgauuucuguu

SEQ ID NO: 3123123 - RNA, 23 nt, Human
gcacaucagcacgauuucuguuu

SEQ ID NO: 3123124 - RNA, 23 nt, Human
gcaccgggccacagagaaaguac

SEQ ID NO: 3123125 - RNA, 16 nt, Human
gcacuugcagacucua

SEQ ID NO: 3123126 - RNA, 16 nt, Human
gcacuccccugcuggg

SEQ ID NO: 3123127 - RNA, 22 nt, Human
gcacuccccugcuggguguggc

SEQ ID NO: 3123128 - RNA, 13 nt, Human
gcacucagaagac

SEQ ID NO: 3123129 - RNA, 16 nt, Human
gcacucagaagacacu

SEQ ID NO: 3123130 - RNA, 17 nt, Human
gcacuccccugcugggu

SEQ ID NO: 3123131 - RNA, 15 nt, Human
gaggucgaggcagga

SEQ ID NO: 3123132 - RNA, 23 nt, Human
gaggugaccccagguuucuaugu

SEQ ID NO: 3123133 - RNA, 20 nt, Human
gagugacagaggcagcccca

SEQ ID NO: 3123134 - RNA, 22 nt, Human
gaguugauagcacagacccugc

SEQ ID NO: 3123135 - RNA, 17 nt, Human
gaguugauucagcucug

SEQ ID NO: 3123136 - RNA, 16 nt, Human
gaguugauucagcucu

SEQ ID NO: 3123137 - RNA, 15 nt, Human
gaguugauucagcuc

SEQ ID NO: 3123138 - RNA, 12 nt, Human
gagucccaccuu

SEQ ID NO: 3123139 - RNA, 18 nt, Human
gagugacagaggcagccc

SEQ ID NO: 3123140 - RNA, 22 nt, Human
gagucagaaguuucugccgcag

SEQ ID NO: 3123141 - RNA, 15 nt, Human
gagucaccaagccca

SEQ ID NO: 3123142 - RNA, 16 nt, Human
gagucaccaagcccag

SEQ ID NO: 3123143 - RNA, 17 nt, Human
gagucaccaagcccagu

SEQ ID NO: 3123144 - RNA, 18 nt, Human
gaguugauucagcucugc

SEQ ID NO: 3123145 - RNA, 22 nt, Human
gaguuguuacauuuuuaagugc

SEQ ID NO: 3123146 - RNA, 14 nt, Human
gaggcagggucuca

SEQ ID NO: 3123147 - RNA, 22 nt, Human
gaggccaaggugggaggauugc

SEQ ID NO: 3123148 - RNA, 17 nt, Human
gaggccaaggugggagg

SEQ ID NO: 3123149 - RNA, 15 nt, Human
gaggcagggucucac

SEQ ID NO: 3123150 - RNA, 22 nt, Human
gaggcagggucucacucugucg

SEQ ID NO: 3123151 - RNA, 22 nt, Human
gaggcuagugugguguuuccug

SEQ ID NO: 3123152 - RNA, 14 nt, Human
gaggccagagacac

SEQ ID NO: 3123153 - RNA, 13 nt, Human
gaggccagagaca

SEQ ID NO: 3123154 - RNA, 20 nt, Human
gagccuuccaggggugggac

SEQ ID NO: 3123155 - RNA, 23 nt, Human
gagccuuccaggggugggacacc

SEQ ID NO: 3123156 - RNA, 13 nt, Human
gagccuugaacuu

SEQ ID NO: 3123157 - RNA, 19 nt, Human
gacauuguuggccaaagcc

SEQ ID NO: 3123158 - RNA, 14 nt, Human
gacauugcggacag

SEQ ID NO: 3123159 - RNA, 15 nt, Human
gacauugcggacagc

SEQ ID NO: 3123160 - RNA, 19 nt, Human
gacagcccgggcucugccu

SEQ ID NO: 3123161 - RNA, 18 nt, Human
gacagcccgggcucugcc

SEQ ID NO: 3123162 - RNA, 18 nt, Human
gaccagggauuuccauga

SEQ ID NO: 3123163 - RNA, 20 nt, Human
gaccagggauuuccaugaug

SEQ ID NO: 3123164 - RNA, 19 nt, Human
gaccaucccugaaggcccc

SEQ ID NO: 3123165 - RNA, 18 nt, Human
gaccaucccugaaggccc

SEQ ID NO: 3123166 - RNA, 13 nt, Human
gaccaucccugaa

SEQ ID NO: 3123167 - RNA, 12 nt, Human
gaccaucccuga

SEQ ID NO: 3123168 - RNA, 17 nt, Human
gacagcccgggcucugc

SEQ ID NO: 3123169 - RNA, 13 nt, Human
gacacagcucuuc

SEQ ID NO: 3123170 - RNA, 14 nt, Human
gacacagcucuucu

SEQ ID NO: 3123171 - RNA, 16 nt, Human
gacacagcucuucucc

SEQ ID NO: 3123172 - RNA, 22 nt, Human
gacacagcucuucuccaggcug

SEQ ID NO: 3123173 - RNA, 23 nt, Human
gacacagcucuucuccaggcugu

SEQ ID NO: 3123174 - RNA, 19 nt, Human
gacucugucucaaaaaaac

SEQ ID NO: 3123175 - RNA, 14 nt, Human
gacugaauuucuuu

SEQ ID NO: 3123176 - RNA, 15 nt, Human
gacgccaucccagcc

SEQ ID NO: 3123177 - RNA, 18 nt, Human
gacgccaucccagcccca

SEQ ID NO: 3123178 - RNA, 17 nt, Human
gacgccaucccagcccc

SEQ ID NO: 3123179 - RNA, 19 nt, Human
gacgcuacccgggaagggg

SEQ ID NO: 3123180 - RNA, 18 nt, Human
gacgcuacccgggaaggg

SEQ ID NO: 3123181 - RNA, 16 nt, Human
gacgcuacccgggaag

SEQ ID NO: 3123182 - RNA, 16 nt, Human
gacgccaucccagccc

SEQ ID NO: 3123183 - RNA, 13 nt, Human
gaccugaggcccu

SEQ ID NO: 3123184 - RNA, 11 nt, Human
gaccugaggcc

SEQ ID NO: 3123185 - RNA, 20 nt, Human
gaccaucccugaaggccccg

SEQ ID NO: 3123186 - RNA, 13 nt, Human
gaccucugccuga

SEQ ID NO: 3123187 - RNA, 14 nt, Human
gaccucugcagcaa

SEQ ID NO: 3123188 - RNA, 15 nt, Human
gaacuccuggccuca

SEQ ID NO: 3123189 - RNA, 11 nt, Human
gaacuggcugc

SEQ ID NO: 3123190 - RNA, 12 nt, Human
gaacuggcugca

SEQ ID NO: 3123191 - RNA, 15 nt, Human
gaagcagaggaagga

SEQ ID NO: 3123192 - RNA, 14 nt, Human
gaagcacaugccuc

SEQ ID NO: 3123193 - RNA, 16 nt, Human
gaagacaaugacuuac

SEQ ID NO: 3123194 - RNA, 22 nt, Human
gaagacaaugacuuacuguaca

SEQ ID NO: 3123195 - RNA, 23 nt, Human
gaagacaaugugaaaagaaaaau

SEQ ID NO: 3123196 - RNA, 23 nt, Human
gaagauuuugaaauuuuuauuaa

SEQ ID NO: 3123197 - RNA, 15 nt, Human
gaagcacaugccucu

SEQ ID NO: 3123198 - RNA, 20 nt, Human
gaagcacaugccucucucag

SEQ ID NO: 3123199 - RNA, 17 nt, Human
gaagcacaugccucucu

SEQ ID NO: 3123200 - RNA, 19 nt, Human
gaauauugcugauggugca

SEQ ID NO: 3123201 - RNA, 15 nt, Human
gaauauugcugaugg

SEQ ID NO: 3123202 - RNA, 14 nt, Human
gaauauugcugaug

SEQ ID NO: 3123203 - RNA, 22 nt, Human
gaaggggagauaaggguaucug

SEQ ID NO: 3123204 - RNA, 19 nt, Human
gaagcuccgcuuucuaccc

SEQ ID NO: 3123205 - RNA, 22 nt, Human
gaagcuccgcuuucuacccagc

SEQ ID NO: 3123206 - RNA, 17 nt, Human
gaaggccccgcccaggc

SEQ ID NO: 3123207 - RNA, 22 nt, Human
gaaggcuggguucugauccuag

SEQ ID NO: 3123208 - RNA, 20 nt, Human
gaaggcuggguucugauccu

SEQ ID NO: 3123209 - RNA, 21 nt, Human
gaaggcucgagcaugccugga

SEQ ID NO: 3123210 - RNA, 19 nt, Human
gaaggccccgcccaggcuu

SEQ ID NO: 3123211 - RNA, 18 nt, Human
gaaggccccgcccaggcu

SEQ ID NO: 3123212 - RNA, 19 nt, Human
gaaggcucgagcaugccug

SEQ ID NO: 3123213 - RNA, 19 nt, Human
gaaggcuggguucugaucc

SEQ ID NO: 3123214 - RNA, 15 nt, Human
gaaggcuggguucug

SEQ ID NO: 3123215 - RNA, 18 nt, Human
uuuaccugaagucuuugu

SEQ ID NO: 3123216 - RNA, 11 nt, Human
uuuacuuaaac

SEQ ID NO: 3123217 - RNA, 16 nt, Human
uuuacugcagcuuugu

SEQ ID NO: 3123218 - RNA, 14 nt, Human
uuuacuucuuauac

SEQ ID NO: 3123219 - RNA, 13 nt, Human
uuuacuucuuaua

SEQ ID NO: 3123220 - RNA, 17 nt, Human
augcccagccccuucug

SEQ ID NO: 3123221 - RNA, 15 nt, Human
augcccagccccuuc

SEQ ID NO: 3123222 - RNA, 16 nt, Human
augcccagccccuucu

SEQ ID NO: 3123223 - RNA, 21 nt, Human
augccaugaggaacaaggcaa

SEQ ID NO: 3123224 - RNA, 21 nt, Human
uuuaaugaaagacuguacaaa

SEQ ID NO: 3123225 - RNA, 23 nt, Human
uuuaaugaaagacuguacaaagu

SEQ ID NO: 3123226 - RNA, 14 nt, Human
augccucucucagg

SEQ ID NO: 3123227 - RNA, 13 nt, Human
augccucucucag

SEQ ID NO: 3123228 - RNA, 15 nt, Human
augccucucucaggc

SEQ ID NO: 3123229 - RNA, 20 nt, Human
augcgugcauaccacuuuug

SEQ ID NO: 3123230 - RNA, 22 nt, Human
augcgugcauaccacuuuuguu

SEQ ID NO: 3123231 - RNA, 14 nt, Human
uuuaucagaauucu

SEQ ID NO: 3123232 - RNA, 14 nt, Human
augcuccuggccca

SEQ ID NO: 3123233 - RNA, 18 nt, Human
augcuggcuguuggcugg

SEQ ID NO: 3123234 - RNA, 19 nt, Human
augcuggcuguuggcuggg

SEQ ID NO: 3123235 - RNA, 20 nt, Human
augcuggcuguuggcugggg

SEQ ID NO: 3123236 - RNA, 18 nt, Human
auggaagacagcucuuau

SEQ ID NO: 3123237 - RNA, 17 nt, Human
auggaagacagcucuua

SEQ ID NO: 3123238 - RNA, 20 nt, Human
augcuucucacugccaugcc

SEQ ID NO: 3123239 - RNA, 16 nt, Human
augcuucucacugcca

SEQ ID NO: 3123240 - RNA, 16 nt, Human
uuucccuauuagagaa

SEQ ID NO: 3123241 - RNA, 11 nt, Human
uuucagaaaug

SEQ ID NO: 3123242 - RNA, 12 nt, Human
uuucagaaaugu

SEQ ID NO: 3123243 - RNA, 12 nt, Human
uuucaaacuuua

SEQ ID NO: 3123244 - RNA, 19 nt, Human
augaggucagagccugcag

SEQ ID NO: 3123245 - RNA, 20 nt, Human
augaggucagagccugcagu

SEQ ID NO: 3123246 - RNA, 15 nt, Human
augaggucagagccu

SEQ ID NO: 3123247 - RNA, 16 nt, Human
augaggucagagccug

SEQ ID NO: 3123248 - RNA, 18 nt, Human
augaggucagagccugca

SEQ ID NO: 3123249 - RNA, 21 nt, Human
uugucauauaagauucauauu

SEQ ID NO: 3123250 - RNA, 17 nt, Human
uugucacacacuuuggc

SEQ ID NO: 3123251 - RNA, 13 nt, Human
augaguccccugu

SEQ ID NO: 3123252 - RNA, 15 nt, Human
uuguccccgacccuu

SEQ ID NO: 3123253 - RNA, 20 nt, Human
uuguccccaccgcagacagg

SEQ ID NO: 3123254 - RNA, 18 nt, Human
uuguccccaccgcagaca

SEQ ID NO: 3123255 - RNA, 13 nt, Human
uugugaggaagcc

SEQ ID NO: 3123256 - RNA, 19 nt, Human
uugugauacaaugcugugc

SEQ ID NO: 3123257 - RNA, 20 nt, Human
uugugauacaaugcugugcc

SEQ ID NO: 3123258 - RNA, 18 nt, Human
uugugaggaagccgcugg

SEQ ID NO: 3123259 - RNA, 17 nt, Human
uugugaggaagccgcug

SEQ ID NO: 3123260 - RNA, 17 nt, Human
uuguucuugguuuguaa

SEQ ID NO: 3123261 - RNA, 19 nt, Human
uuguucuugguuuguaaau

SEQ ID NO: 3123262 - RNA, 21 nt, Human
augcacuuuguucuggcucuu

SEQ ID NO: 3123263 - RNA, 23 nt, Human
augcacuuuguucuggcucuucc

SEQ ID NO: 3123264 - RNA, 11 nt, Human
uuuaaaugcac

SEQ ID NO: 3123265 - RNA, 16 nt, Human
uuuaaugaaagacugu

SEQ ID NO: 3123266 - RNA, 22 nt, Human
uuuaaggaugcuuguacauaau

SEQ ID NO: 3123267 - RNA, 20 nt, Human
uuuaaggaugcuuguacaua

SEQ ID NO: 3123268 - RNA, 21 nt, Human
uuuaaggaugcuuguacauaa

SEQ ID NO: 3123269 - RNA, 19 nt, Human
uuuaaggaugcuuguacau

SEQ ID NO: 3123270 - RNA, 21 nt, Human
uuuaagcuguuacugucuuca

SEQ ID NO: 3123271 - RNA, 12 nt, Human
uuuaagagaaau

SEQ ID NO: 3123272 - RNA, 20 nt, Human
uugcuuugugauuuuuguaa

SEQ ID NO: 3123273 - RNA, 17 nt, Human
uuggaaaauaaauuauu

SEQ ID NO: 3123274 - RNA, 15 nt, Human
uugcuuugugauuuu

SEQ ID NO: 3123275 - RNA, 14 nt, Human
aucuugcucugcug

SEQ ID NO: 3123276 - RNA, 15 nt, Human
aucuugcucugcuga

SEQ ID NO: 3123277 - RNA, 16 nt, Human
aucuugcucugcugac

SEQ ID NO: 3123278 - RNA, 12 nt, Human
aucugucauuug

SEQ ID NO: 3123279 - RNA, 17 nt, Human
aucugucauuugagcag

SEQ ID NO: 3123280 - RNA, 18 nt, Human
uuggugguuucagaaaug

SEQ ID NO: 3123281 - RNA, 19 nt, Human
uuggugguuucagaaaugu

SEQ ID NO: 3123282 - RNA, 18 nt, Human
augaaugucagugugacu

SEQ ID NO: 3123283 - RNA, 16 nt, Human
augaaugucaguguga

SEQ ID NO: 3123284 - RNA, 17 nt, Human
uuggugucgggcaugac

SEQ ID NO: 3123285 - RNA, 19 nt, Human
uuggugucgggcaugacac

SEQ ID NO: 3123286 - RNA, 18 nt, Human
uuggugucgggcaugaca

SEQ ID NO: 3123287 - RNA, 14 nt, Human
uugguuuguaaauu

SEQ ID NO: 3123288 - RNA, 17 nt, Human
augaaugaaacauuuug

SEQ ID NO: 3123289 - RNA, 23 nt, Human
augaaccacaucuugcucugcug

SEQ ID NO: 3123290 - RNA, 22 nt, Human
augaaccacaucuugcucugcu

SEQ ID NO: 3123291 - RNA, 19 nt, Human
uugacaggauuauuggaaa

SEQ ID NO: 3123292 - RNA, 10 nt, Human
uugacagggc

SEQ ID NO: 3123293 - RNA, 12 nt, Human
uugacagggcac

SEQ ID NO: 3123294 - RNA, 16 nt, Human
uugacaucaacugcau

SEQ ID NO: 3123295 - RNA, 13 nt, Human
uugacaucaacug

SEQ ID NO: 3123296 - RNA, 11 nt, Human
uugagacagag

SEQ ID NO: 3123297 - RNA, 12 nt, Human
uugagcagggcu

SEQ ID NO: 3123298 - RNA, 16 nt, Human
uugagcagggcucagc

SEQ ID NO: 3123299 - RNA, 11 nt, Human
uugagugccuu

SEQ ID NO: 3123300 - RNA, 21 nt, Human
uugagugcugucuccauguuu

SEQ ID NO: 3123301 - RNA, 15 nt, Human
uugauacuacaguuu

SEQ ID NO: 3123302 - RNA, 17 nt, Human
uugauacuacaguuugu

SEQ ID NO: 3123303 - RNA, 20 nt, Human
aucuaauauguaacaagcca

SEQ ID NO: 3123304 - RNA, 23 nt, Human
aucuaauauguaacaagccaccc

SEQ ID NO: 3123305 - RNA, 18 nt, Human
aucuagauacuguaucau

SEQ ID NO: 3123306 - RNA, 19 nt, Human
aucuagauacuguaucaug

SEQ ID NO: 3123307 - RNA, 19 nt, Human
aucuaggaagacuuuggaa

SEQ ID NO: 3123308 - RNA, 18 nt, Human
aucuaggaagacuuugga

SEQ ID NO: 3123309 - RNA, 17 nt, Human
aucuaggaagacuuugg

SEQ ID NO: 3123310 - RNA, 14 nt, Human
aucucaaauuucua

SEQ ID NO: 3123311 - RNA, 23 nt, Human
aucucaaauaacuaaaagguaug

SEQ ID NO: 3123312 - RNA, 14 nt, Human
aucucaaauaacua

SEQ ID NO: 3123313 - RNA, 21 nt, Human
aucucaaauaacuaaaaggua

SEQ ID NO: 3123314 - RNA, 13 nt, Human
uugcccaggcagg

SEQ ID NO: 3123315 - RNA, 14 nt, Human
uugcccaggcaggu

SEQ ID NO: 3123316 - RNA, 16 nt, Human
uugcccaggcaggucu

SEQ ID NO: 3123317 - RNA, 18 nt, Human
uugcccaggcaggucuug

SEQ ID NO: 3123318 - RNA, 11 nt, Human
uugcccaggcu

SEQ ID NO: 3123319 - RNA, 12 nt, Human
uugcccaggcug

SEQ ID NO: 3123320 - RNA, 14 nt, Human
uugcccaggcuggc

SEQ ID NO: 3123321 - RNA, 23 nt, Human
uugcccaggcuggcgugcagugg

SEQ ID NO: 3123322 - RNA, 11 nt, Human
uugcccaggca

SEQ ID NO: 3123323 - RNA, 21 nt, Human
uugcaccacugcacuccagcc

SEQ ID NO: 3123324 - RNA, 14 nt, Human
uugcaauggcagcc

SEQ ID NO: 3123325 - RNA, 12 nt, Human
uugcaugaggcu

SEQ ID NO: 3123326 - RNA, 14 nt, Human
uugcaugaggcuag

SEQ ID NO: 3123327 - RNA, 18 nt, Human
aucucuugagccugggag

SEQ ID NO: 3123328 - RNA, 23 nt, Human
aucucacacaugagcaucaggcc

SEQ ID NO: 3123329 - RNA, 16 nt, Human
aucucaaauuucuaaa

SEQ ID NO: 3123330 - RNA, 17 nt, Human
aucucaaauuucuaaau

SEQ ID NO: 3123331 - RNA, 23 nt, Human
uugauguucuuucacccuuuucu

SEQ ID NO: 3123332 - RNA, 15 nt, Human
uugauuaaauucuug

SEQ ID NO: 3123333 - RNA, 16 nt, Human
uugauuaaauucuugc

SEQ ID NO: 3123334 - RNA, 20 nt, Human
uugauuaaauucuugcaaag

SEQ ID NO: 3123335 - RNA, 23 nt, Human
uucucagaaucucaaauaacuaa

SEQ ID NO: 3123336 - RNA, 13 nt, Human
uucucagaaucuc

SEQ ID NO: 3123337 - RNA, 19 nt, Human
uucucagaaucucaaauaa

SEQ ID NO: 3123338 - RNA, 22 nt, Human
uucucagaaucucaaauaacua

SEQ ID NO: 3123339 - RNA, 13 nt, Human
uucuaggccuggg

SEQ ID NO: 3123340 - RNA, 13 nt, Human
aucauugaaaucu

SEQ ID NO: 3123341 - RNA, 15 nt, Human
aucauugaaaucuuu

SEQ ID NO: 3123342 - RNA, 14 nt, Human
aucauugaaaucuu

SEQ ID NO: 3123343 - RNA, 15 nt, Human
aucagcacgauuucu

SEQ ID NO: 3123344 - RNA, 16 nt, Human
aucagcacgauuucug

SEQ ID NO: 3123345 - RNA, 17 nt, Human
aucagcacgauuucugu

SEQ ID NO: 3123346 - RNA, 18 nt, Human
aucagcacgauuucuguu

SEQ ID NO: 3123347 - RNA, 10 nt, Human
uucugggaca

SEQ ID NO: 3123348 - RNA, 11 nt, Human
uucugggacac

SEQ ID NO: 3123349 - RNA, 22 nt, Human
uucugggacacaguucaauucu

SEQ ID NO: 3123350 - RNA, 16 nt, Human
uucugccgcagcccug

SEQ ID NO: 3123351 - RNA, 23 nt, Human
uucugccgcagcccugcagaggg

SEQ ID NO: 3123352 - RNA, 23 nt, Human
uucugaacuuggcgcugccccug

SEQ ID NO: 3123353 - RNA, 19 nt, Human
aucauugaaaucuuuuugc

SEQ ID NO: 3123354 - RNA, 15 nt, Human
uucugaaagggacgc

SEQ ID NO: 3123355 - RNA, 16 nt, Human
aucccauaugccuggg

SEQ ID NO: 3123356 - RNA, 17 nt, Human
aucccauaugccugggc

SEQ ID NO: 3123357 - RNA, 15 nt, Human
auccagguucagcuu

SEQ ID NO: 3123358 - RNA, 16 nt, Human
auccagguucagcuug

SEQ ID NO: 3123359 - RNA, 14 nt, Human
uuccuucagugccu

SEQ ID NO: 3123360 - RNA, 11 nt, Human
uuccuucagug

SEQ ID NO: 3123361 - RNA, 17 nt, Human
uuccuguucccaugaga

SEQ ID NO: 3123362 - RNA, 11 nt, Human
uuccugugucu

SEQ ID NO: 3123363 - RNA, 11 nt, Human
uuccucuuucc

SEQ ID NO: 3123364 - RNA, 15 nt, Human
uuccuaauccucuag

SEQ ID NO: 3123365 - RNA, 13 nt, Human
uuccuaauccucu

SEQ ID NO: 3123366 - RNA, 13 nt, Human
aucaaguauuaua

SEQ ID NO: 3123367 - RNA, 14 nt, Human
aucaaguauuauac

SEQ ID NO: 3123368 - RNA, 18 nt, Human
aucaaguauuauaccuuu

SEQ ID NO: 3123369 - RNA, 22 nt, Human
aucacggcucacugcagccuca

SEQ ID NO: 3123370 - RNA, 19 nt, Human
aucacggcucacugcagcc

SEQ ID NO: 3123371 - RNA, 22 nt, Human
auauuaagaaagacuaucuaaa

SEQ ID NO: 3123372 - RNA, 24 nt, Human
auauuaagaaagacuaucuaaaug

SEQ ID NO: 3123373 - RNA, 22 nt, Human
auauuaaggaagacaaugugaa

SEQ ID NO: 3123374 - RNA, 20 nt, Human
auauguuuuaagaggcaggg

SEQ ID NO: 3123375 - RNA, 18 nt, Human
auauguuuuaagaggcag

SEQ ID NO: 3123376 - RNA, 16 nt, Human
auauucuguuggccag

SEQ ID NO: 3123377 - RNA, 19 nt, Human
auauugauuuccguuaaaa

SEQ ID NO: 3123378 - RNA, 21 nt, Human
auauugauuuccguuaaaaua

SEQ ID NO: 3123379 - RNA, 22 nt, Human
auauugauuuccguuaaaauac

SEQ ID NO: 3123380 - RNA, 17 nt, Human
auauuguuuucagugua

SEQ ID NO: 3123381 - RNA, 20 nt, Human
auauuguuuucaguguacau

SEQ ID NO: 3123382 - RNA, 21 nt, Human
auauugcugauggugcaauga

SEQ ID NO: 3123383 - RNA, 17 nt, Human
auauugcugauggugca

SEQ ID NO: 3123384 - RNA, 14 nt, Human
auaugucaagccau

SEQ ID NO: 3123385 - RNA, 20 nt, Human
auaugauuuaaaucagccgu

SEQ ID NO: 3123386 - RNA, 22 nt, Human
auaucugaaaauguauguguaa

SEQ ID NO: 3123387 - RNA, 16 nt, Human
uucauauuuacuucuu

SEQ ID NO: 3123388 - RNA, 21 nt, Human
uucauauuuacuucuuauaca

SEQ ID NO: 3123389 - RNA, 14 nt, Human
uucaguaauaacuc

SEQ ID NO: 3123390 - RNA, 18 nt, Human
uucaucauccuaagcuau

SEQ ID NO: 3123391 - RNA, 21 nt, Human
uucaucauccuaagcuauuca

SEQ ID NO: 3123392 - RNA, 19 nt, Human
uucagccaagaauucuuaa

SEQ ID NO: 3123393 - RNA, 14 nt, Human
uucagccaagaauu

SEQ ID NO: 3123394 - RNA, 17 nt, Human
uucagaucucuaacuuc

SEQ ID NO: 3123395 - RNA, 17 nt, Human
auagcugggacuacagg

SEQ ID NO: 3123396 - RNA, 14 nt, Human
uuauuuaaauuuua

SEQ ID NO: 3123397 - RNA, 18 nt, Human
uuauuuaaugaaagacug

SEQ ID NO: 3123398 - RNA, 22 nt, Human
uuauuuaaugaaagacuguaca

SEQ ID NO: 3123399 - RNA, 16 nt, Human
uuauuuaguuccuuga

SEQ ID NO: 3123400 - RNA, 22 nt, Human
auagcucaggugucccugcacu

SEQ ID NO: 3123401 - RNA, 20 nt, Human
auagcucaggugucccugca

SEQ ID NO: 3123402 - RNA, 21 nt, Human
auagcucaggugucccugcac

SEQ ID NO: 3123403 - RNA, 12 nt, Human
auagcugggacu

SEQ ID NO: 3123404 - RNA, 19 nt, Human
auagcucaggugucccugc

SEQ ID NO: 3123405 - RNA, 13 nt, Human
auaagauaaaugu

SEQ ID NO: 3123406 - RNA, 17 nt, Human
auaagauaaaugugcug

SEQ ID NO: 3123407 - RNA, 18 nt, Human
auagccugccucuucucu

SEQ ID NO: 3123408 - RNA, 22 nt, Human
uucaccacaugugcacaugcac

SEQ ID NO: 3123409 - RNA, 17 nt, Human
uucacauauugauuucc

SEQ ID NO: 3123410 - RNA, 19 nt, Human
auaggaacuuaaauaaugu

SEQ ID NO: 3123411 - RNA, 21 nt, Human
uucaaggauccugagccagau

SEQ ID NO: 3123412 - RNA, 19 nt, Human
uucaaggauccugagccag

SEQ ID NO: 3123413 - RNA, 18 nt, Human
uucaaggauccugagcca

SEQ ID NO: 3123414 - RNA, 16 nt, Human
uucaaggauccugagc

SEQ ID NO: 3123415 - RNA, 15 nt, Human
uucaaggauccugag

SEQ ID NO: 3123416 - RNA, 17 nt, Human
uucaaaauaaaaaugag

SEQ ID NO: 3123417 - RNA, 23 nt, Human
uuucccucccuuccucuuuccau

SEQ ID NO: 3123418 - RNA, 19 nt, Human
uuugaccucugcagcaaua

SEQ ID NO: 3123419 - RNA, 21 nt, Human
uuugaccucugcagcaauaaa

SEQ ID NO: 3123420 - RNA, 14 nt, Human
uuugacaaggggca

SEQ ID NO: 3123421 - RNA, 15 nt, Human
uuugauucagacagc

SEQ ID NO: 3123422 - RNA, 23 nt, Human
uuugauuaaauucuugcaaagua

SEQ ID NO: 3123423 - RNA, 15 nt, Human
uuugauccaagcugg

SEQ ID NO: 3123424 - RNA, 14 nt, Human
uuugauccaagcug

SEQ ID NO: 3123425 - RNA, 13 nt, Human
uuugagacagagu

SEQ ID NO: 3123426 - RNA, 18 nt, Human
uuugaccucugcagcaau

SEQ ID NO: 3123427 - RNA, 22 nt, Human
uuuggauuggaugaauuccaaa

SEQ ID NO: 3123428 - RNA, 13 nt, Human
uuuggcugcugaa

SEQ ID NO: 3123429 - RNA, 12 nt, Human
uuuggcugcuga

SEQ ID NO: 3123430 - RNA, 22 nt, Human
uuugggguacccacugcucugg

SEQ ID NO: 3123431 - RNA, 21 nt, Human
uuugggguacccacugcucug

SEQ ID NO: 3123432 - RNA, 16 nt, Human
uuuguuucugaaaggg

SEQ ID NO: 3123433 - RNA, 14 nt, Human
uuuguuucugaaag

SEQ ID NO: 3123434 - RNA, 22 nt, Human
uuugugcauuaucuagauacug

SEQ ID NO: 3123435 - RNA, 15 nt, Human
uuugugauacaaugc

SEQ ID NO: 3123436 - RNA, 22 nt, Human
uuugugauacaaugcugugccc

SEQ ID NO: 3123437 - RNA, 19 nt, Human
uuugugcauuaucuagaua

SEQ ID NO: 3123438 - RNA, 14 nt, Human
uuugucuuaaaaag

SEQ ID NO: 3123439 - RNA, 13 nt, Human
uuugucuuaaaaa

SEQ ID NO: 3123440 - RNA, 16 nt, Human
uuugugauacaaugcu

SEQ ID NO: 3123441 - RNA, 23 nt, Human
uuugucuuaaaaaguggaaaaau

SEQ ID NO: 3123442 - RNA, 16 nt, Human
uuuguaauuuuuuuau

SEQ ID NO: 3123443 - RNA, 14 nt, Human
uuuguacagacaac

SEQ ID NO: 3123444 - RNA, 17 nt, Human
auguccaagaagcccag

SEQ ID NO: 3123445 - RNA, 16 nt, Human
auguccaagaagccca

SEQ ID NO: 3123446 - RNA, 12 nt, Human
auguaucaauga

SEQ ID NO: 3123447 - RNA, 14 nt, Human
augugagacugguu

SEQ ID NO: 3123448 - RNA, 13 nt, Human
augugagaccauu

SEQ ID NO: 3123449 - RNA, 15 nt, Human
uuuuaguagagacag

SEQ ID NO: 3123450 - RNA, 18 nt, Human
uuuuauggcuuuugugca

SEQ ID NO: 3123451 - RNA, 19 nt, Human
uuuuauggcuuuugugcau

SEQ ID NO: 3123452 - RNA, 12 nt, Human
uuuuauuaaauu

SEQ ID NO: 3123453 - RNA, 21 nt, Human
uuuuauggcuuuugugcauua

SEQ ID NO: 3123454 - RNA, 23 nt, Human
uuuucuacucgaguuacagacaa

SEQ ID NO: 3123455 - RNA, 17 nt, Human
auguuggccaggcuggu

SEQ ID NO: 3123456 - RNA, 16 nt, Human
auguuggccaggcugg

SEQ ID NO: 3123457 - RNA, 13 nt, Human
uuuucuguucuuu

SEQ ID NO: 3123458 - RNA, 19 nt, Human
auuaaaacacaacaucuuu

SEQ ID NO: 3123459 - RNA, 22 nt, Human
auuaaaaaucucaaauuucuaa

SEQ ID NO: 3123460 - RNA, 23 nt, Human
auuaaaaaucucaaauuucuaaa

SEQ ID NO: 3123461 - RNA, 18 nt, Human
uuuuaaaaaacugcugac

SEQ ID NO: 3123462 - RNA, 17 nt, Human
uuuuagaguugauacua

SEQ ID NO: 3123463 - RNA, 21 nt, Human
uuuuagacccuauugcugcuu

SEQ ID NO: 3123464 - RNA, 12 nt, Human
auguugaaagau

SEQ ID NO: 3123465 - RNA, 20 nt, Human
auguucuuucacccuuuucu

SEQ ID NO: 3123466 - RNA, 13 nt, Human
auguugcccaggc

SEQ ID NO: 3123467 - RNA, 18 nt, Human
auguugaaagaucaaaag

SEQ ID NO: 3123468 - RNA, 14 nt, Human
auguugcccaggca

SEQ ID NO: 3123469 - RNA, 15 nt, Human
auguugcccaggcag

SEQ ID NO: 3123470 - RNA, 20 nt, Human
auguuacauaagauaaaugu

SEQ ID NO: 3123471 - RNA, 19 nt, Human
auguuacauaagauaaaug

SEQ ID NO: 3123472 - RNA, 14 nt, Human
auuacuucugcuac

SEQ ID NO: 3123473 - RNA, 12 nt, Human
auuacuucugcu

SEQ ID NO: 3123474 - RNA, 13 nt, Human
auuacuucugcua

SEQ ID NO: 3123475 - RNA, 23 nt, Human
uuuugugcauuaucuagauacug

SEQ ID NO: 3123476 - RNA, 23 nt, Human
uuuuuauacauaaacaagaccac

SEQ ID NO: 3123477 - RNA, 16 nt, Human
uuuuguuuuugucuua

SEQ ID NO: 3123478 - RNA, 18 nt, Human
auuaaguacuauguauca

SEQ ID NO: 3123479 - RNA, 16 nt, Human
auuaaguacuauguau

SEQ ID NO: 3123480 - RNA, 19 nt, Human
auuaaguacuauguaucaa

SEQ ID NO: 3123481 - RNA, 13 nt, Human
auuaaggaagaca

SEQ ID NO: 3123482 - RNA, 22 nt, Human
auuccccaggaggccagccuug

SEQ ID NO: 3123483 - RNA, 20 nt, Human
auuccccaggaggccagccu

SEQ ID NO: 3123484 - RNA, 19 nt, Human
auuccccaggaggccagcc

SEQ ID NO: 3123485 - RNA, 18 nt, Human
auucccaagcucugcucc

SEQ ID NO: 3123486 - RNA, 19 nt, Human
auucccaagcucugcuccu

SEQ ID NO: 3123487 - RNA, 17 nt, Human
auucccaagcucugcuc

SEQ ID NO: 3123488 - RNA, 19 nt, Human
auuggcuagagguucaaag

SEQ ID NO: 3123489 - RNA, 20 nt, Human
auuggcuagagguucaaaga

SEQ ID NO: 3123490 - RNA, 22 nt, Human
auuggcuagagguucaaagaua

SEQ ID NO: 3123491 - RNA, 23 nt, Human
auuggcuagagguucaaagauau

SEQ ID NO: 3123492 - RNA, 16 nt, Human
auugcaacaggcuggg

SEQ ID NO: 3123493 - RNA, 19 nt, Human
auugcaacaggcugggcuu

SEQ ID NO: 3123494 - RNA, 12 nt, Human
auugcaccacug

SEQ ID NO: 3123495 - RNA, 17 nt, Human
auugcaacaggcugggc

SEQ ID NO: 3123496 - RNA, 18 nt, Human
auugcaacaggcugggcu

SEQ ID NO: 3123497 - RNA, 21 nt, Human
auuuggugguuucagaaaugu

SEQ ID NO: 3123498 - RNA, 21 nt, Human
auuugaggucuguucuuucca

SEQ ID NO: 3123499 - RNA, 15 nt, Human
auuugagcagggcuc

SEQ ID NO: 3123500 - RNA, 15 nt, Human
auuugaggucuguuc

SEQ ID NO: 3123501 - RNA, 17 nt, Human
auuugaggucuguucuu

SEQ ID NO: 3123502 - RNA, 18 nt, Human
auuugaggucuguucuuu

SEQ ID NO: 3123503 - RNA, 16 nt, Human
auuucccaaagcagug

SEQ ID NO: 3123504 - RNA, 14 nt, Human
auuucccaaagcag

SEQ ID NO: 3123505 - RNA, 17 nt, Human
auuuccguuaaaauacc

SEQ ID NO: 3123506 - RNA, 19 nt, Human
auuuacuucuuauacauuu

SEQ ID NO: 3123507 - RNA, 20 nt, Human
auuuacuucuuauacauuug

SEQ ID NO: 3123508 - RNA, 18 nt, Human
auuguuuucaguguacau

SEQ ID NO: 3123509 - RNA, 19 nt, Human
auuguuuucaguguacaug

SEQ ID NO: 3123510 - RNA, 17 nt, Human
auuguuuucaguguaca

SEQ ID NO: 3123511 - RNA, 17 nt, Human
auuuacuucuuauacau

SEQ ID NO: 3123512 - RNA, 22 nt, Human
auuuacaacugggggaggguga

SEQ ID NO: 3123513 - RNA, 22 nt, Human
agcauuuugcuaaaugugaaug

SEQ ID NO: 3123514 - RNA, 15 nt, Human
agcauuuugcuaaau

SEQ ID NO: 3123515 - RNA, 19 nt, Human
agcauggcugccaauggga

SEQ ID NO: 3123516 - RNA, 23 nt, Human
agcaucaggccaggcccucugcc

SEQ ID NO: 3123517 - RNA, 21 nt, Human
agcaucaggccaggcccucug

SEQ ID NO: 3123518 - RNA, 22 nt, Human
agcaucaggccaggcccucugc

SEQ ID NO: 3123519 - RNA, 16 nt, Human
agcauauucaggaagc

SEQ ID NO: 3123520 - RNA, 13 nt, Human
agcauggcugcca

SEQ ID NO: 3123521 - RNA, 15 nt, Human
ugaucacggcucacu

SEQ ID NO: 3123522 - RNA, 13 nt, Human
ugaucacggcuca

SEQ ID NO: 3123523 - RNA, 14 nt, Human
ugaucacggcucac

SEQ ID NO: 3123524 - RNA, 19 nt, Human
agcauauucaggaagcuca

SEQ ID NO: 3123525 - RNA, 17 nt, Human
agcauauucaggaagcu

SEQ ID NO: 3123526 - RNA, 21 nt, Human
agcauauucaggaagcucagg

SEQ ID NO: 3123527 - RNA, 16 nt, Human
ugauccucccaccuca

SEQ ID NO: 3123528 - RNA, 13 nt, Human
ugaucuaggaaga

SEQ ID NO: 3123529 - RNA, 19 nt, Human
ugauccucccaccucagcc

SEQ ID NO: 3123530 - RNA, 20 nt, Human
ugauccucccaccucagccu

SEQ ID NO: 3123531 - RNA, 18 nt, Human
ugauccucccaccucagc

SEQ ID NO: 3123532 - RNA, 20 nt, Human
ugauuaaccacuucagcuga

SEQ ID NO: 3123533 - RNA, 17 nt, Human
ugauuaaauucuugcaa

SEQ ID NO: 3123534 - RNA, 13 nt, Human
ugauuaaauucuu

SEQ ID NO: 3123535 - RNA, 16 nt, Human
ugauuaaauucuugca

SEQ ID NO: 3123536 - RNA, 16 nt, Human
agccacggccaggcca

SEQ ID NO: 3123537 - RNA, 19 nt, Human
ugauguuuuccaugagucc

SEQ ID NO: 3123538 - RNA, 18 nt, Human
ugauguuuuaaggaugcu

SEQ ID NO: 3123539 - RNA, 17 nt, Human
ugauguuuuccaugagu

SEQ ID NO: 3123540 - RNA, 21 nt, Human
ugauguuuuaaggaugcuugu

SEQ ID NO: 3123541 - RNA, 22 nt, Human
ugauggggcccugccuccuuug

SEQ ID NO: 3123542 - RNA, 21 nt, Human
ugaugggcaacccccagccug

SEQ ID NO: 3123543 - RNA, 22 nt, Human
ugaugggcaacccccagccugc

SEQ ID NO: 3123544 - RNA, 13 nt, Human
ugauggggcccug

SEQ ID NO: 3123545 - RNA, 21 nt, Human
ugaugaucuuugcagacaggc

SEQ ID NO: 3123546 - RNA, 19 nt, Human
ugaugaucuuugcagacag

SEQ ID NO: 3123547 - RNA, 20 nt, Human
ugaugaucuuugcagacagg

SEQ ID NO: 3123548 - RNA, 23 nt, Human
ugaugaaaugaggucagagccug

SEQ ID NO: 3123549 - RNA, 14 nt, Human
ugaucuaggaagac

SEQ ID NO: 3123550 - RNA, 22 nt, Human
ugaugaaaugaggucagagccu

SEQ ID NO: 3123551 - RNA, 13 nt, Human
agcaggacaugga

SEQ ID NO: 3123552 - RNA, 11 nt, Human
agcagccacau

SEQ ID NO: 3123553 - RNA, 16 nt, Human
agcagcagggagggcu

SEQ ID NO: 3123554 - RNA, 17 nt, Human
ugacccaugcugcccug

SEQ ID NO: 3123555 - RNA, 19 nt, Human
ugacccaugcugcccugug

SEQ ID NO: 3123556 - RNA, 18 nt, Human
ugacccaugcugcccugu

SEQ ID NO: 3123557 - RNA, 20 nt, Human
ugacccaugcugcccuguga

SEQ ID NO: 3123558 - RNA, 13 nt, Human
agcagggaaacag

SEQ ID NO: 3123559 - RNA, 14 nt, Human
agcagggaaacagc

SEQ ID NO: 3123560 - RNA, 15 nt, Human
agcagggaaacagcu

SEQ ID NO: 3123561 - RNA, 23 nt, Human
agcaggcucucaggccagcugcu

SEQ ID NO: 3123562 - RNA, 22 nt, Human
agcaggcucucaggccagcugc

SEQ ID NO: 3123563 - RNA, 21 nt, Human
agcaggcucucaggccagcug

SEQ ID NO: 3123564 - RNA, 19 nt, Human
agcaggcucucaggccagc

SEQ ID NO: 3123565 - RNA, 18 nt, Human
agcaggcucucaggccag

SEQ ID NO: 3123566 - RNA, 17 nt, Human
agcaggcucucaggcca

SEQ ID NO: 3123567 - RNA, 16 nt, Human
agcaggcucucaggcc

SEQ ID NO: 3123568 - RNA, 15 nt, Human
agcaggcucucaggc

SEQ ID NO: 3123569 - RNA, 14 nt, Human
agcaggcucucagg

SEQ ID NO: 3123570 - RNA, 13 nt, Human
agcaggcucucag

SEQ ID NO: 3123571 - RNA, 17 nt, Human
agcaggcucgggcuccc

SEQ ID NO: 3123572 - RNA, 13 nt, Human
agcagggcucagc

SEQ ID NO: 3123573 - RNA, 14 nt, Human
agcagggcucagcg

SEQ ID NO: 3123574 - RNA, 15 nt, Human
agcagggcucagcgg

SEQ ID NO: 3123575 - RNA, 20 nt, Human
agcagggagggcuucugcca

SEQ ID NO: 3123576 - RNA, 22 nt, Human
agcagggcucagcggggacagc

SEQ ID NO: 3123577 - RNA, 19 nt, Human
agcauaaaaauuagccaag

SEQ ID NO: 3123578 - RNA, 16 nt, Human
ugaguacguugugcau

SEQ ID NO: 3123579 - RNA, 17 nt, Human
ugaguacguugugcauu

SEQ ID NO: 3123580 - RNA, 18 nt, Human
ugaguacguugugcauuu

SEQ ID NO: 3123581 - RNA, 19 nt, Human
ugaguacguugugcauuug

SEQ ID NO: 3123582 - RNA, 23 nt, Human
agcauaaaaauuagccaagugug

SEQ ID NO: 3123583 - RNA, 18 nt, Human
ugagucaccaagcccagu

SEQ ID NO: 3123584 - RNA, 20 nt, Human
ugaguacguugugcauuugg

SEQ ID NO: 3123585 - RNA, 14 nt, Human
ugagugagcaugcc

SEQ ID NO: 3123586 - RNA, 14 nt, Human
ugagugccuuacac

SEQ ID NO: 3123587 - RNA, 13 nt, Human
ugagugccuuaca

SEQ ID NO: 3123588 - RNA, 17 nt, Human
ugagugcagcucuggag

SEQ ID NO: 3123589 - RNA, 21 nt, Human
ugagugggggaucacagccuc

SEQ ID NO: 3123590 - RNA, 18 nt, Human
ugaguucauacccuguua

SEQ ID NO: 3123591 - RNA, 14 nt, Human
ugauacaaugcugu

SEQ ID NO: 3123592 - RNA, 15 nt, Human
ugauacaaugcugug

SEQ ID NO: 3123593 - RNA, 18 nt, Human
ugcaaaccaucauugaaa

SEQ ID NO: 3123594 - RNA, 21 nt, Human
ugcaaaggguaucaggugcug

SEQ ID NO: 3123595 - RNA, 20 nt, Human
ugcaaaguaucccuacugua

SEQ ID NO: 3123596 - RNA, 17 nt, Human
agccacggccaggccag

SEQ ID NO: 3123597 - RNA, 18 nt, Human
agccacggccaggccaga

SEQ ID NO: 3123598 - RNA, 13 nt, Human
ugcaaaccaucau

SEQ ID NO: 3123599 - RNA, 12 nt, Human
ugcaaaccauca

SEQ ID NO: 3123600 - RNA, 12 nt, Human
agcccaggccuc

SEQ ID NO: 3123601 - RNA, 15 nt, Human
ugcaaggucauuuuu

SEQ ID NO: 3123602 - RNA, 13 nt, Human
ugcaacaggcugg

SEQ ID NO: 3123603 - RNA, 22 nt, Human
agccccuggaugcagccucaca

SEQ ID NO: 3123604 - RNA, 19 nt, Human
agcccaggccuccuacagc

SEQ ID NO: 3123605 - RNA, 14 nt, Human
agcccaggccuccu

SEQ ID NO: 3123606 - RNA, 14 nt, Human
agccccgaggccuu

SEQ ID NO: 3123607 - RNA, 14 nt, Human
agccccuucugacc

SEQ ID NO: 3123608 - RNA, 16 nt, Human
agccccuucugaccca

SEQ ID NO: 3123609 - RNA, 15 nt, Human
agccccuucugaccc

SEQ ID NO: 3123610 - RNA, 15 nt, Human
agcccgggcucugcc

SEQ ID NO: 3123611 - RNA, 14 nt, Human
agcccgggcucugc

SEQ ID NO: 3123612 - RNA, 13 nt, Human
agcccgggcucug

SEQ ID NO: 3123613 - RNA, 19 nt, Human
agccccuucugacccaugc

SEQ ID NO: 3123614 - RNA, 19 nt, Human
agcccugcagagggcacag

SEQ ID NO: 3123615 - RNA, 16 nt, Human
agcccugcagagggca

SEQ ID NO: 3123616 - RNA, 15 nt, Human
agcccugcagagggc

SEQ ID NO: 3123617 - RNA, 14 nt, Human
agcccugcagaggg

SEQ ID NO: 3123618 - RNA, 16 nt, Human
agcccgggcucugccu

SEQ ID NO: 3123619 - RNA, 15 nt, Human
ugcaccggcuggccu

SEQ ID NO: 3123620 - RNA, 14 nt, Human
ugcaccggcuggcc

SEQ ID NO: 3123621 - RNA, 16 nt, Human
ugcaccggcuggccug

SEQ ID NO: 3123622 - RNA, 14 nt, Human
ugcacuccagccug

SEQ ID NO: 3123623 - RNA, 16 nt, Human
ugcacuccagccuggg

SEQ ID NO: 3123624 - RNA, 15 nt, Human
ugcacuccagccugg

SEQ ID NO: 3123625 - RNA, 15 nt, Human
ugcaccacugcacuc

SEQ ID NO: 3123626 - RNA, 13 nt, Human
ugcaccagcccuu

SEQ ID NO: 3123627 - RNA, 21 nt, Human
ugcaccacugcacuccagccu

SEQ ID NO: 3123628 - RNA, 13 nt, Human
agccuccugcccu

SEQ ID NO: 3123629 - RNA, 18 nt, Human
agccuccugcccuuaccu

SEQ ID NO: 3123630 - RNA, 14 nt, Human
agccuccugcccuu

SEQ ID NO: 3123631 - RNA, 12 nt, Human
ugcagacaggca

SEQ ID NO: 3123632 - RNA, 13 nt, Human
ugcagacaggcaa

SEQ ID NO: 3123633 - RNA, 21 nt, Human
ugcagacaggcaagcaccucc

SEQ ID NO: 3123634 - RNA, 18 nt, Human
ugcagccucacaguccuu

SEQ ID NO: 3123635 - RNA, 21 nt, Human
ugcagccucacaguccuuacc

SEQ ID NO: 3123636 - RNA, 17 nt, Human
ugcagccucacaguccu

SEQ ID NO: 3123637 - RNA, 17 nt, Human
ugcaucguuucaucuuc

SEQ ID NO: 3123638 - RNA, 18 nt, Human
ugcaugcugucccuuacg

SEQ ID NO: 3123639 - RNA, 21 nt, Human
ugcaugcugucccuuacguga

SEQ ID NO: 3123640 - RNA, 19 nt, Human
ugcaugcugucccuuacgu

SEQ ID NO: 3123641 - RNA, 16 nt, Human
ugcauaccacuuuugu

SEQ ID NO: 3123642 - RNA, 18 nt, Human
ugcauaccacuuuuguuc

SEQ ID NO: 3123643 - RNA, 20 nt, Human
ugcauaccacuuuuguucuu

SEQ ID NO: 3123644 - RNA, 14 nt, Human
ugcauaccacuuuu

SEQ ID NO: 3123645 - RNA, 14 nt, Human
ugccaaugggagcu

SEQ ID NO: 3123646 - RNA, 13 nt, Human
ugccaauggacua

SEQ ID NO: 3123647 - RNA, 16 nt, Human
ugcauuuaaaagauac

SEQ ID NO: 3123648 - RNA, 22 nt, Human
ugccagccgagauagccaaggc

SEQ ID NO: 3123649 - RNA, 17 nt, Human
ugccagccgagauagcc

SEQ ID NO: 3123650 - RNA, 17 nt, Human
agccugugccucuggga

SEQ ID NO: 3123651 - RNA, 18 nt, Human
agccugugccucugggac

SEQ ID NO: 3123652 - RNA, 19 nt, Human
agccuugaccauucuccac

SEQ ID NO: 3123653 - RNA, 18 nt, Human
agccuugaccauucucca

SEQ ID NO: 3123654 - RNA, 21 nt, Human
agccuugaccauucuccaccu

SEQ ID NO: 3123655 - RNA, 19 nt, Human
agccuugcggaagguucua

SEQ ID NO: 3123656 - RNA, 23 nt, Human
agccuugaacuuugaccucugca

SEQ ID NO: 3123657 - RNA, 20 nt, Human
agccuuagaagucacacagu

SEQ ID NO: 3123658 - RNA, 14 nt, Human
ugcgguccacccag

SEQ ID NO: 3123659 - RNA, 15 nt, Human
ugcgguccacccagg

SEQ ID NO: 3123660 - RNA, 20 nt, Human
agcuuaaaggggcuagagug

SEQ ID NO: 3123661 - RNA, 11 nt, Human
ugcuacacacu

SEQ ID NO: 3123662 - RNA, 19 nt, Human
agcuugaccgugaggccag

SEQ ID NO: 3123663 - RNA, 22 nt, Human
agcuugaccgugaggccagaga

SEQ ID NO: 3123664 - RNA, 20 nt, Human
agcuugaccgugaggccaga

SEQ ID NO: 3123665 - RNA, 22 nt, Human
agcuugaggguugggcuggugu

SEQ ID NO: 3123666 - RNA, 23 nt, Human
agcuugaccgugaggccagagac

SEQ ID NO: 3123667 - RNA, 14 nt, Human
aggaaaagcugcug

SEQ ID NO: 3123668 - RNA, 15 nt, Human
aggaagcucagggcc

SEQ ID NO: 3123669 - RNA, 12 nt, Human
aggaagcucagg

SEQ ID NO: 3123670 - RNA, 14 nt, Human
aggaagcucagggc

SEQ ID NO: 3123671 - RNA, 13 nt, Human
aggaagcucaggg

SEQ ID NO: 3123672 - RNA, 23 nt, Human
aggaaaggcuccaggagcagcca

SEQ ID NO: 3123673 - RNA, 14 nt, Human
ugcucugcugacag

SEQ ID NO: 3123674 - RNA, 15 nt, Human
ugcucugcugacaga

SEQ ID NO: 3123675 - RNA, 20 nt, Human
ugcuccagcuguucagcugg

SEQ ID NO: 3123676 - RNA, 21 nt, Human
ugcuccagcuguucagcuggu

SEQ ID NO: 3123677 - RNA, 13 nt, Human
ugcuaucuccccc

SEQ ID NO: 3123678 - RNA, 17 nt, Human
ugcuaucucccccagcc

SEQ ID NO: 3123679 - RNA, 14 nt, Human
ugcuaucuccccca

SEQ ID NO: 3123680 - RNA, 16 nt, Human
agcucuguccugggag

SEQ ID NO: 3123681 - RNA, 21 nt, Human
agcucuguccugggagugagc

SEQ ID NO: 3123682 - RNA, 14 nt, Human
agcugccagccgag

SEQ ID NO: 3123683 - RNA, 20 nt, Human
agcugccagccgagauagcc

SEQ ID NO: 3123684 - RNA, 18 nt, Human
ugcccuuaccugccagga

SEQ ID NO: 3123685 - RNA, 12 nt, Human
ugccucagccuc

SEQ ID NO: 3123686 - RNA, 13 nt, Human
ugccucagccucc

SEQ ID NO: 3123687 - RNA, 12 nt, Human
ugccgcagcccu

SEQ ID NO: 3123688 - RNA, 16 nt, Human
agcuccuucuguccua

SEQ ID NO: 3123689 - RNA, 21 nt, Human
agcuccuucuguccuacucug

SEQ ID NO: 3123690 - RNA, 16 nt, Human
agcucucuccucccuu

SEQ ID NO: 3123691 - RNA, 14 nt, Human
agcucuguccuggg

SEQ ID NO: 3123692 - RNA, 17 nt, Human
agcucugguccauagag

SEQ ID NO: 3123693 - RNA, 12 nt, Human
agcucuggucca

SEQ ID NO: 3123694 - RNA, 13 nt, Human
agcucccaggcau

SEQ ID NO: 3123695 - RNA, 15 nt, Human
agcuccuucuguccu

SEQ ID NO: 3123696 - RNA, 23 nt, Human
agcucccaggcauuccccaggag

SEQ ID NO: 3123697 - RNA, 20 nt, Human
agcugggacuacaggcaccc

SEQ ID NO: 3123698 - RNA, 23 nt, Human
agcugggacuacaggcacccacc

SEQ ID NO: 3123699 - RNA, 16 nt, Human
agcugggacuacaggu

SEQ ID NO: 3123700 - RNA, 20 nt, Human
agcugggguggggaccucag

SEQ ID NO: 3123701 - RNA, 23 nt, Human
agcugggguggggaccucaggcc

SEQ ID NO: 3123702 - RNA, 22 nt, Human
agcugggguggggaccucaggc

SEQ ID NO: 3123703 - RNA, 19 nt, Human
agcugggacuacaggcacc

SEQ ID NO: 3123704 - RNA, 17 nt, Human
agcugugcucuggacag

SEQ ID NO: 3123705 - RNA, 18 nt, Human
agcugugcucuggacagg

SEQ ID NO: 3123706 - RNA, 23 nt, Human
agcugugcucuggacaggcaugu

SEQ ID NO: 3123707 - RNA, 14 nt, Human
agcuguuacugucu

SEQ ID NO: 3123708 - RNA, 18 nt, Human
agcuguuacugucuucag

SEQ ID NO: 3123709 - RNA, 21 nt, Human
ugccuuacccucauguucuua

SEQ ID NO: 3123710 - RNA, 16 nt, Human
ugccuuggggacaaga

SEQ ID NO: 3123711 - RNA, 20 nt, Human
ugccuuacccucauguucuu

SEQ ID NO: 3123712 - RNA, 17 nt, Human
ugccuguugggccagga

SEQ ID NO: 3123713 - RNA, 16 nt, Human
ugccuguugggccagg

SEQ ID NO: 3123714 - RNA, 19 nt, Human
agcuguuacugucuucagu

SEQ ID NO: 3123715 - RNA, 16 nt, Human
agcugcuugggcuuca

SEQ ID NO: 3123716 - RNA, 18 nt, Human
agcugccuguucagcucc

SEQ ID NO: 3123717 - RNA, 14 nt, Human
agcugccuguucag

SEQ ID NO: 3123718 - RNA, 16 nt, Human
agcugccuguucagcu

SEQ ID NO: 3123719 - RNA, 20 nt, Human
ugccuggauggggcugcacc

SEQ ID NO: 3123720 - RNA, 17 nt, Human
ugccuggauggggcugc

SEQ ID NO: 3123721 - RNA, 16 nt, Human
ugccuggauggggcug

SEQ ID NO: 3123722 - RNA, 14 nt, Human
ugccucagccuccc

SEQ ID NO: 3123723 - RNA, 18 nt, Human
ugccucugccucugacac

SEQ ID NO: 3123724 - RNA, 20 nt, Human
ugccucugccucugacacac

SEQ ID NO: 3123725 - RNA, 17 nt, Human
ugccucugccucugaca

SEQ ID NO: 3123726 - RNA, 20 nt, Human
ugccugcccaggccccugcc

SEQ ID NO: 3123727 - RNA, 22 nt, Human
ugccugcccaggccccugccac

SEQ ID NO: 3123728 - RNA, 23 nt, Human
ugccugcccaggccccugccacc

SEQ ID NO: 3123729 - RNA, 22 nt, Human
aggcaggucuugaacuccuggc

SEQ ID NO: 3123730 - RNA, 12 nt, Human
aggcagggucuc

SEQ ID NO: 3123731 - RNA, 15 nt, Human
aggcauaaagucagg

SEQ ID NO: 3123732 - RNA, 17 nt, Human
aggcaggugggauggau

SEQ ID NO: 3123733 - RNA, 18 nt, Human
aggcauugugggaagggg

SEQ ID NO: 3123734 - RNA, 22 nt, Human
aggcauaaagucagggguuccc

SEQ ID NO: 3123735 - RNA, 16 nt, Human
aggcaaggcugucaau

SEQ ID NO: 3123736 - RNA, 18 nt, Human
aggcaagcaccuccugcc

SEQ ID NO: 3123737 - RNA, 19 nt, Human
aggcaagcaccuccugccu

SEQ ID NO: 3123738 - RNA, 20 nt, Human
aggcaagcaccuccugccuc

SEQ ID NO: 3123739 - RNA, 17 nt, Human
aggcaagcaccuccugc

SEQ ID NO: 3123740 - RNA, 14 nt, Human
uggagaaaauggac

SEQ ID NO: 3123741 - RNA, 15 nt, Human
aggauugcuacuguc

SEQ ID NO: 3123742 - RNA, 17 nt, Human
aggauugcuacuguccu

SEQ ID NO: 3123743 - RNA, 18 nt, Human
aggauugcuacuguccua

SEQ ID NO: 3123744 - RNA, 16 nt, Human
uggcacccggccccug

SEQ ID NO: 3123745 - RNA, 18 nt, Human
uggcacccggccccugcu

SEQ ID NO: 3123746 - RNA, 19 nt, Human
uggcacccggccccugcug

SEQ ID NO: 3123747 - RNA, 20 nt, Human
uggcacccggccccugcugg

SEQ ID NO: 3123748 - RNA, 22 nt, Human
uggcagcucaccucucccuugg

SEQ ID NO: 3123749 - RNA, 21 nt, Human
uggcagcucaccucucccuug

SEQ ID NO: 3123750 - RNA, 23 nt, Human
uggcagcucaccucucccuugga

SEQ ID NO: 3123751 - RNA, 15 nt, Human
aggccagccuugacc

SEQ ID NO: 3123752 - RNA, 13 nt, Human
aggccagccuuga

SEQ ID NO: 3123753 - RNA, 13 nt, Human
aggcccagagggc

SEQ ID NO: 3123754 - RNA, 13 nt, Human
aggcccggcucca

SEQ ID NO: 3123755 - RNA, 17 nt, Human
aggcccggcuccaggcu

SEQ ID NO: 3123756 - RNA, 14 nt, Human
aggccccgcccagg

SEQ ID NO: 3123757 - RNA, 20 nt, Human
uggaugccugguggcagcug

SEQ ID NO: 3123758 - RNA, 21 nt, Human
uggaugccugguggcagcugc

SEQ ID NO: 3123759 - RNA, 23 nt, Human
uggaugccugguggcagcugcgg

SEQ ID NO: 3123760 - RNA, 23 nt, Human
uggcacaucagcacgauuucugu

SEQ ID NO: 3123761 - RNA, 21 nt, Human
uggcacaucagcacgauuucu

SEQ ID NO: 3123762 - RNA, 20 nt, Human
uggagguacgaaaagagggg

SEQ ID NO: 3123763 - RNA, 20 nt, Human
aggcauuugcugaauacaga

SEQ ID NO: 3123764 - RNA, 16 nt, Human
aggcauuugcugaaua

SEQ ID NO: 3123765 - RNA, 14 nt, Human
uggagugcagugag

SEQ ID NO: 3123766 - RNA, 17 nt, Human
aggacuuuucuuugugg

SEQ ID NO: 3123767 - RNA, 19 nt, Human
aggacuuuucuuuguggcu

SEQ ID NO: 3123768 - RNA, 22 nt, Human
aggacuuuucuuuguggcuucc

SEQ ID NO: 3123769 - RNA, 16 nt, Human
aggagccuccugcccu

SEQ ID NO: 3123770 - RNA, 17 nt, Human
aggagccccgaggccuu

SEQ ID NO: 3123771 - RNA, 13 nt, Human
aggagcagccaca

SEQ ID NO: 3123772 - RNA, 12 nt, Human
aggagcagccac

SEQ ID NO: 3123773 - RNA, 16 nt, Human
uggaagcacagcuuca

SEQ ID NO: 3123774 - RNA, 16 nt, Human
aggauucuuccucccu

SEQ ID NO: 3123775 - RNA, 22 nt, Human
aggaugcacagaguuguuacau

SEQ ID NO: 3123776 - RNA, 23 nt, Human
aggaugaucuaggaagacuuugg

SEQ ID NO: 3123777 - RNA, 22 nt, Human
aggaugaucuaggaagacuuug

SEQ ID NO: 3123778 - RNA, 17 nt, Human
aggauucuuccucccuc

SEQ ID NO: 3123779 - RNA, 19 nt, Human
aggauucuuccucccuccc

SEQ ID NO: 3123780 - RNA, 13 nt, Human
aggaucagucuga

SEQ ID NO: 3123781 - RNA, 12 nt, Human
aggaucagucug

SEQ ID NO: 3123782 - RNA, 15 nt, Human
ugcuugagcucagga

SEQ ID NO: 3123783 - RNA, 17 nt, Human
ugcuuugugauuuuugu

SEQ ID NO: 3123784 - RNA, 22 nt, Human
ugcuuugugauuuuuguaauuu

SEQ ID NO: 3123785 - RNA, 20 nt, Human
ugcuuuugucuaugggacuc

SEQ ID NO: 3123786 - RNA, 23 nt, Human
ugcuuuuuaauauugauaugcuu

SEQ ID NO: 3123787 - RNA, 18 nt, Human
ugcuuuuggucuguguga

SEQ ID NO: 3123788 - RNA, 21 nt, Human
uggaaauuuguuauaaugaau

SEQ ID NO: 3123789 - RNA, 23 nt, Human
uggaaauuuguuauaaugaauga

SEQ ID NO: 3123790 - RNA, 15 nt, Human
uggaagacagcucuu

SEQ ID NO: 3123791 - RNA, 16 nt, Human
uggaagacagcucuua

SEQ ID NO: 3123792 - RNA, 14 nt, Human
aguaauaugcacac

SEQ ID NO: 3123793 - RNA, 15 nt, Human
aguaauaugcacaca

SEQ ID NO: 3123794 - RNA, 16 nt, Human
uguagagccagggucu

SEQ ID NO: 3123795 - RNA, 18 nt, Human
uguagagccagggucuca

SEQ ID NO: 3123796 - RNA, 11 nt, Human
aguagagacag

SEQ ID NO: 3123797 - RNA, 20 nt, Human
uguaggcauaaagucagggg

SEQ ID NO: 3123798 - RNA, 17 nt, Human
uguaggcauaaagucag

SEQ ID NO: 3123799 - RNA, 17 nt, Human
aguagaagucuuagaug

SEQ ID NO: 3123800 - RNA, 21 nt, Human
aguagaagucuuagauguaua

SEQ ID NO: 3123801 - RNA, 19 nt, Human
aguagaagucuuagaugua

SEQ ID NO: 3123802 - RNA, 20 nt, Human
aguagaagucuuagauguau

SEQ ID NO: 3123803 - RNA, 14 nt, Human
aguaugguggcugg

SEQ ID NO: 3123804 - RNA, 23 nt, Human
agucacacaguauuacuucugcu

SEQ ID NO: 3123805 - RNA, 19 nt, Human
agucaccccggccaccugc

SEQ ID NO: 3123806 - RNA, 15 nt, Human
agucacacagugagu

SEQ ID NO: 3123807 - RNA, 23 nt, Human
agucacacagugagucgaggaca

SEQ ID NO: 3123808 - RNA, 15 nt, Human
aguauuacuucugcu

SEQ ID NO: 3123809 - RNA, 17 nt, Human
aguaugguggcuggguu

SEQ ID NO: 3123810 - RNA, 18 nt, Human
aguauuacuucugcuaca

SEQ ID NO: 3123811 - RNA, 15 nt, Human
aguaugguggcuggg

SEQ ID NO: 3123812 - RNA, 16 nt, Human
aguaugguggcugggu

SEQ ID NO: 3123813 - RNA, 15 nt, Human
ugucaauuacaggaa

SEQ ID NO: 3123814 - RNA, 14 nt, Human
ugucaauuacagga

SEQ ID NO: 3123815 - RNA, 17 nt, Human
ugucaauuacaggaagu

SEQ ID NO: 3123816 - RNA, 17 nt, Human
uguaucaaugaguaaca

SEQ ID NO: 3123817 - RNA, 19 nt, Human
uguauucucuccuguaccu

SEQ ID NO: 3123818 - RNA, 16 nt, Human
uguauuuuuuuacuaa

SEQ ID NO: 3123819 - RNA, 20 nt, Human
ugguuaggcauugugggaag

SEQ ID NO: 3123820 - RNA, 18 nt, Human
ugguuaggcauuguggga

SEQ ID NO: 3123821 - RNA, 14 nt, Human
ugguggcagcugcg

SEQ ID NO: 3123822 - RNA, 13 nt, Human
ugguggcagcugc

SEQ ID NO: 3123823 - RNA, 15 nt, Human
ugguggcagcugcgg

SEQ ID NO: 3123824 - RNA, 19 nt, Human
uggugucgggcaugacacg

SEQ ID NO: 3123825 - RNA, 16 nt, Human
uggugcgaucuggguu

SEQ ID NO: 3123826 - RNA, 17 nt, Human
uggugcgaucuggguuc

SEQ ID NO: 3123827 - RNA, 22 nt, Human
aggugacagagugagacucugu

SEQ ID NO: 3123828 - RNA, 13 nt, Human
aggugaccccagg

SEQ ID NO: 3123829 - RNA, 17 nt, Human
aggucuugaacuccugg

SEQ ID NO: 3123830 - RNA, 13 nt, Human
aggugacagagug

SEQ ID NO: 3123831 - RNA, 15 nt, Human
aggugacagagugag

SEQ ID NO: 3123832 - RNA, 23 nt, Human
aggugagaagcagaggaaggaga

SEQ ID NO: 3123833 - RNA, 21 nt, Human
aggugagaagcagaggaagga

SEQ ID NO: 3123834 - RNA, 16 nt, Human
aggugagaagcagagg

SEQ ID NO: 3123835 - RNA, 16 nt, Human
aggucuugaacuccug

SEQ ID NO: 3123836 - RNA, 14 nt, Human
aggucagagccugc

SEQ ID NO: 3123837 - RNA, 15 nt, Human
aggucagagccugca

SEQ ID NO: 3123838 - RNA, 17 nt, Human
aggucagagccugcagu

SEQ ID NO: 3123839 - RNA, 18 nt, Human
aggucagagccugcaguu

SEQ ID NO: 3123840 - RNA, 13 nt, Human
aggucagagccug

SEQ ID NO: 3123841 - RNA, 16 nt, Human
uggucagauuugaacu

SEQ ID NO: 3123842 - RNA, 15 nt, Human
uggucagauuugaac

SEQ ID NO: 3123843 - RNA, 15 nt, Human
ugguuuguaaauuaa

SEQ ID NO: 3123844 - RNA, 14 nt, Human
ugguuuucaaaaua

SEQ ID NO: 3123845 - RNA, 15 nt, Human
ugguuuucaaaauaa

SEQ ID NO: 3123846 - RNA, 17 nt, Human
ugguuuucaaaauaaaa

SEQ ID NO: 3123847 - RNA, 15 nt, Human
uguaaauagcucagg

SEQ ID NO: 3123848 - RNA, 16 nt, Human
uguaaauagcucaggu

SEQ ID NO: 3123849 - RNA, 12 nt, Human
aggugugcucug

SEQ ID NO: 3123850 - RNA, 14 nt, Human
agguuuaagcuguu

SEQ ID NO: 3123851 - RNA, 20 nt, Human
aggugucccugcacuugcag

SEQ ID NO: 3123852 - RNA, 19 nt, Human
agguggggucacucuggca

SEQ ID NO: 3123853 - RNA, 17 nt, Human
aggugugaaccaccaca

SEQ ID NO: 3123854 - RNA, 15 nt, Human
aggugugcucugauc

SEQ ID NO: 3123855 - RNA, 20 nt, Human
aggugugcucugaucaucca

SEQ ID NO: 3123856 - RNA, 15 nt, Human
aggugggauccucca

SEQ ID NO: 3123857 - RNA, 18 nt, Human
aggugccucaagagaagg

SEQ ID NO: 3123858 - RNA, 16 nt, Human
agguggggcagcuuga

SEQ ID NO: 3123859 - RNA, 23 nt, Human
agguggggcagcuugaggguugg

SEQ ID NO: 3123860 - RNA, 17 nt, Human
aggugggauccuccagg

SEQ ID NO: 3123861 - RNA, 16 nt, Human
aggugggauccuccag

SEQ ID NO: 3123862 - RNA, 14 nt, Human
aggugauccaccca

SEQ ID NO: 3123863 - RNA, 20 nt, Human
aggugauccacccaccucag

SEQ ID NO: 3123864 - RNA, 22 nt, Human
agggaaggauacaaaagcaugu

SEQ ID NO: 3123865 - RNA, 21 nt, Human
aggcccggcuccaggcuccuu

SEQ ID NO: 3123866 - RNA, 18 nt, Human
aggcccggcuccaggcuc

SEQ ID NO: 3123867 - RNA, 20 nt, Human
aggcccggcuccaggcuccu

SEQ ID NO: 3123868 - RNA, 14 nt, Human
ugggacuacaggca

SEQ ID NO: 3123869 - RNA, 15 nt, Human
ugggacuacaggcac

SEQ ID NO: 3123870 - RNA, 16 nt, Human
ugggacuacaggcacc

SEQ ID NO: 3123871 - RNA, 16 nt, Human
ugggagagccuuccag

SEQ ID NO: 3123872 - RNA, 18 nt, Human
ugggaggaucucuugagc

SEQ ID NO: 3123873 - RNA, 21 nt, Human
ugggagagaagagaaugcaca

SEQ ID NO: 3123874 - RNA, 19 nt, Human
ugggagagaagagaaugca

SEQ ID NO: 3123875 - RNA, 20 nt, Human
ugggacucaaugcacugaca

SEQ ID NO: 3123876 - RNA, 18 nt, Human
ugggacucaaugcacuga

SEQ ID NO: 3123877 - RNA, 22 nt, Human
ugggagaaccaaaaagaggcua

SEQ ID NO: 3123878 - RNA, 19 nt, Human
agggcucagcggggacagc

SEQ ID NO: 3123879 - RNA, 20 nt, Human
agggcucagcggggacagcu

SEQ ID NO: 3123880 - RNA, 22 nt, Human
agggcucagcggggacagcucc

SEQ ID NO: 3123881 - RNA, 23 nt, Human
agggcucagcggggacagcuccu

SEQ ID NO: 3123882 - RNA, 16 nt, Human
agggagggcuccagac

SEQ ID NO: 3123883 - RNA, 15 nt, Human
agggagggcuccaga

SEQ ID NO: 3123884 - RNA, 14 nt, Human
agggagggcuccag

SEQ ID NO: 3123885 - RNA, 20 nt, Human
ugggaggccaaggugggagg

SEQ ID NO: 3123886 - RNA, 19 nt, Human
ugggaggccaaggugggag

SEQ ID NO: 3123887 - RNA, 21 nt, Human
ugggaggaucucuugagccug

SEQ ID NO: 3123888 - RNA, 20 nt, Human
ugggaggaucucuugagccu

SEQ ID NO: 3123889 - RNA, 23 nt, Human
ugggcagaaggaagacuucaucc

SEQ ID NO: 3123890 - RNA, 12 nt, Human
ugggcagaagga

SEQ ID NO: 3123891 - RNA, 18 nt, Human
ugggccaggagccuccug

SEQ ID NO: 3123892 - RNA, 12 nt, Human
ugggcagagcag

SEQ ID NO: 3123893 - RNA, 11 nt, Human
ugggcagagca

SEQ ID NO: 3123894 - RNA, 16 nt, Human
ugggcccccaaaugga

SEQ ID NO: 3123895 - RNA, 21 nt, Human
ugggcccccaaauggaaaugg

SEQ ID NO: 3123896 - RNA, 13 nt, Human
agggagggcucca

SEQ ID NO: 3123897 - RNA, 15 nt, Human
agggagggagggcuc

SEQ ID NO: 3123898 - RNA, 13 nt, Human
aggggaaaagagg

SEQ ID NO: 3123899 - RNA, 14 nt, Human
aggggaacagacug

SEQ ID NO: 3123900 - RNA, 22 nt, Human
aggggaaaaucagccugcucca

SEQ ID NO: 3123901 - RNA, 18 nt, Human
aggggaaaaucagccugc

SEQ ID NO: 3123902 - RNA, 13 nt, Human
aggggaauguuug

SEQ ID NO: 3123903 - RNA, 17 nt, Human
ugggguacccacugcuc

SEQ ID NO: 3123904 - RNA, 18 nt, Human
ugggguacccacugcucu

SEQ ID NO: 3123905 - RNA, 19 nt, Human
ugggguacccacugcucug

SEQ ID NO: 3123906 - RNA, 15 nt, Human
ugggguaugggagag

SEQ ID NO: 3123907 - RNA, 14 nt, Human
uggggucacucugg

SEQ ID NO: 3123908 - RNA, 13 nt, Human
uggggucacucug

SEQ ID NO: 3123909 - RNA, 20 nt, Human
uggggucacucuggcagcuc

SEQ ID NO: 3123910 - RNA, 16 nt, Human
uggggucacucuggca

SEQ ID NO: 3123911 - RNA, 22 nt, Human
uggggucacucuggcagcucag

SEQ ID NO: 3123912 - RNA, 15 nt, Human
uggggaccucaggcc

SEQ ID NO: 3123913 - RNA, 14 nt, Human
uggggaccucaggc

SEQ ID NO: 3123914 - RNA, 12 nt, Human
agggcuccagac

SEQ ID NO: 3123915 - RNA, 17 nt, Human
uggggaccucaggccug

SEQ ID NO: 3123916 - RNA, 16 nt, Human
uggggaccucaggccu

SEQ ID NO: 3123917 - RNA, 12 nt, Human
uggggcccugcc

SEQ ID NO: 3123918 - RNA, 21 nt, Human
uggggccaguuggucccccuu

SEQ ID NO: 3123919 - RNA, 23 nt, Human
uggggcugcaccggcuggccugg

SEQ ID NO: 3123920 - RNA, 22 nt, Human
uggggcugcaccggcuggccug

SEQ ID NO: 3123921 - RNA, 20 nt, Human
aggggguggccucccaacuc

SEQ ID NO: 3123922 - RNA, 15 nt, Human
aggguaaggcugugg

SEQ ID NO: 3123923 - RNA, 14 nt, Human
agggucucacucug

SEQ ID NO: 3123924 - RNA, 15 nt, Human
agggucucacucugu

SEQ ID NO: 3123925 - RNA, 16 nt, Human
agggucucacucuguc

SEQ ID NO: 3123926 - RNA, 21 nt, Human
aggggaauguuugccucugcc

SEQ ID NO: 3123927 - RNA, 19 nt, Human
aggggaauguuugccucug

SEQ ID NO: 3123928 - RNA, 20 nt, Human
aggggaauguuugccucugc

SEQ ID NO: 3123929 - RNA, 21 nt, Human
uggguggcaccagcagccugg

SEQ ID NO: 3123930 - RNA, 20 nt, Human
uggguggcaccagcagccug

SEQ ID NO: 3123931 - RNA, 17 nt, Human
uggguggcaccagcagc

SEQ ID NO: 3123932 - RNA, 20 nt, Human
ugguagagugugccugaagu

SEQ ID NO: 3123933 - RNA, 16 nt, Human
aggguggugaccucug

SEQ ID NO: 3123934 - RNA, 15 nt, Human
agggugggagugggc

SEQ ID NO: 3123935 - RNA, 16 nt, Human
aguuggcuaggacccc

SEQ ID NO: 3123936 - RNA, 17 nt, Human
aguuggguggaugccug

SEQ ID NO: 3123937 - RNA, 21 nt, Human
aguuggguggaugccuggugg

SEQ ID NO: 3123938 - RNA, 18 nt, Human
aguuggucccccuuccau

SEQ ID NO: 3123939 - RNA, 23 nt, Human
aguuguuugauucagacagcugc

SEQ ID NO: 3123940 - RNA, 21 nt, Human
aguuguuugauucagacagcu

SEQ ID NO: 3123941 - RNA, 20 nt, Human
uuaaauucuugcaaaguauc

SEQ ID NO: 3123942 - RNA, 14 nt, Human
aguucugguuccua

SEQ ID NO: 3123943 - RNA, 17 nt, Human
uguuuucaguguacaug

SEQ ID NO: 3123944 - RNA, 20 nt, Human
uguuuuccaugaguccccug

SEQ ID NO: 3123945 - RNA, 22 nt, Human
uguuugauucagacagcugccu

SEQ ID NO: 3123946 - RNA, 17 nt, Human
uguuugauucagacagc

SEQ ID NO: 3123947 - RNA, 19 nt, Human
uguuuauugucaaaguggu

SEQ ID NO: 3123948 - RNA, 17 nt, Human
uguuuauugucaaagug

SEQ ID NO: 3123949 - RNA, 19 nt, Human
uguugcccaggcaggucuu

SEQ ID NO: 3123950 - RNA, 16 nt, Human
auaacuaaaagguaug

SEQ ID NO: 3123951 - RNA, 14 nt, Human
uuacaggaaguacu

SEQ ID NO: 3123952 - RNA, 20 nt, Human
uuacauaagauaaaugugcu

SEQ ID NO: 3123953 - RNA, 19 nt, Human
uuacuauggcccuggccua

SEQ ID NO: 3123954 - RNA, 18 nt, Human
uuacucagaauucucuag

SEQ ID NO: 3123955 - RNA, 23 nt, Human
uuacucagaauucucuaguuuga

SEQ ID NO: 3123956 - RNA, 11 nt, Human
uuagaaauaua

SEQ ID NO: 3123957 - RNA, 12 nt, Human
uuagaaauauaa

SEQ ID NO: 3123958 - RNA, 14 nt, Human
uuagaaauauaauu

SEQ ID NO: 3123959 - RNA, 11 nt, Human
uuagacagagu

SEQ ID NO: 3123960 - RNA, 23 nt, Human
uuaaugaaagacuguacaaagua

SEQ ID NO: 3123961 - RNA, 20 nt, Human
uuaaugaaagacuguacaaa

SEQ ID NO: 3123962 - RNA, 15 nt, Human
uuaauucuuagcuca

SEQ ID NO: 3123963 - RNA, 19 nt, Human
uuaauuuuuuugagacaga

SEQ ID NO: 3123964 - RNA, 23 nt, Human
auaaacaagaccacguuucuaaa

SEQ ID NO: 3123965 - RNA, 15 nt, Human
auaaacaagaccacg

SEQ ID NO: 3123966 - RNA, 22 nt, Human
auaaacaagaccacguuucuaa

SEQ ID NO: 3123967 - RNA, 22 nt, Human
uuaagugcugcauuuaaaagau

SEQ ID NO: 3123968 - RNA, 17 nt, Human
uuaaguacuauguauca

SEQ ID NO: 3123969 - RNA, 13 nt, Human
uuaagaggcaggg

SEQ ID NO: 3123970 - RNA, 15 nt, Human
uuaagaggcaggguc

SEQ ID NO: 3123971 - RNA, 16 nt, Human
uuaagaggcagggucu

SEQ ID NO: 3123972 - RNA, 16 nt, Human
ugugacugaauuucuu

SEQ ID NO: 3123973 - RNA, 15 nt, Human
ugugacugaauuucu

SEQ ID NO: 3123974 - RNA, 23 nt, Human
agucuuagauguauauauuuccu

SEQ ID NO: 3123975 - RNA, 14 nt, Human
agucuuuguacaga

SEQ ID NO: 3123976 - RNA, 17 nt, Human
ugugaaccaccacaccc

SEQ ID NO: 3123977 - RNA, 20 nt, Human
ugugaaccaccacacccagc

SEQ ID NO: 3123978 - RNA, 19 nt, Human
ugugaaccaccacacccag

SEQ ID NO: 3123979 - RNA, 15 nt, Human
ugugaaaggaaagag

SEQ ID NO: 3123980 - RNA, 21 nt, Human
ugugaaaggaaagagggaggu

SEQ ID NO: 3123981 - RNA, 18 nt, Human
ugugaaaggaaagaggcu

SEQ ID NO: 3123982 - RNA, 15 nt, Human
agugagucgaggaca

SEQ ID NO: 3123983 - RNA, 21 nt, Human
agugaguugauagcacagacc

SEQ ID NO: 3123984 - RNA, 21 nt, Human
agugaggcucugcccuugguu

SEQ ID NO: 3123985 - RNA, 20 nt, Human
agugaggcucugcccuuggu

SEQ ID NO: 3123986 - RNA, 19 nt, Human
agugaggcucugcccuugg

SEQ ID NO: 3123987 - RNA, 17 nt, Human
agugaggcucugcccuu

SEQ ID NO: 3123988 - RNA, 16 nt, Human
agugaggcucugcccu

SEQ ID NO: 3123989 - RNA, 14 nt, Human
agugaggcucugcc

SEQ ID NO: 3123990 - RNA, 15 nt, Human
agugaggcucugccc

SEQ ID NO: 3123991 - RNA, 21 nt, Human
ugugcugcccugcccaccugg

SEQ ID NO: 3123992 - RNA, 21 nt, Human
ugugcccccauguaagcaccc

SEQ ID NO: 3123993 - RNA, 17 nt, Human
uguggaguucaucuuga

SEQ ID NO: 3123994 - RNA, 21 nt, Human
uguggaguucaucuugaauug

SEQ ID NO: 3123995 - RNA, 12 nt, Human
ugugccaugugc

SEQ ID NO: 3123996 - RNA, 16 nt, Human
ugugccaugugccagg

SEQ ID NO: 3123997 - RNA, 20 nt, Human
ugugccagguuuuuggucug

SEQ ID NO: 3123998 - RNA, 23 nt, Human
ugugcauuuggugguuucagaaa

SEQ ID NO: 3123999 - RNA, 18 nt, Human
ugugauggggcccugccu

SEQ ID NO: 3124000 - RNA, 20 nt, Human
ugugauggggcccugccucc

SEQ ID NO: 3124001 - RNA, 19 nt, Human
ugugauggggcccugccuc

SEQ ID NO: 3124002 - RNA, 20 nt, Human
agugcugggauuacaggugu

SEQ ID NO: 3124003 - RNA, 19 nt, Human
agugcugcauuuaaaagau

SEQ ID NO: 3124004 - RNA, 16 nt, Human
agugcugcauuuaaaa

SEQ ID NO: 3124005 - RNA, 17 nt, Human
agugcugcauuuaaaag

SEQ ID NO: 3124006 - RNA, 21 nt, Human
agugcugggauuacaggugug

SEQ ID NO: 3124007 - RNA, 12 nt, Human
agugcugcauuu

SEQ ID NO: 3124008 - RNA, 13 nt, Human
agugcugcauuua

SEQ ID NO: 3124009 - RNA, 23 nt, Human
agugaguugauagcacagacccu

SEQ ID NO: 3124010 - RNA, 22 nt, Human
agugaguugauagcacagaccc

SEQ ID NO: 3124011 - RNA, 15 nt, Human
uguggucccacccca

SEQ ID NO: 3124012 - RNA, 13 nt, Human
uguggucccaccc

SEQ ID NO: 3124013 - RNA, 16 nt, Human
ugugguguuuccuggc

SEQ ID NO: 3124014 - RNA, 14 nt, Human
ugugguguuuccug

SEQ ID NO: 3124015 - RNA, 21 nt, Human
uguggguuucuaaagcugcca

SEQ ID NO: 3124016 - RNA, 23 nt, Human
uguggguuucuaaagcugccagc

SEQ ID NO: 3124017 - RNA, 16 nt, Human
ugugucucuugguccu

SEQ ID NO: 3124018 - RNA, 21 nt, Human
ugugucuugcaauggcagccu

SEQ ID NO: 3124019 - RNA, 20 nt, Human
ugugucuugcaauggcagcc

SEQ ID NO: 3124020 - RNA, 21 nt, Human
ugugucucuugguccugcugc

SEQ ID NO: 3124021 - RNA, 20 nt, Human
ugugucucuugguccugcug

SEQ ID NO: 3124022 - RNA, 17 nt, Human
ugugucucuugguccug

SEQ ID NO: 3124023 - RNA, 11 nt, Human
uguguguuuau

SEQ ID NO: 3124024 - RNA, 23 nt, Human
uguguguuuauugucaaaguggu

SEQ ID NO: 3124025 - RNA, 19 nt, Human
uguguguuuauugucaaag

SEQ ID NO: 3124026 - RNA, 16 nt, Human
aguggugcgaucuggg

SEQ ID NO: 3124027 - RNA, 17 nt, Human
aguggugcgaucugggu

SEQ ID NO: 3124028 - RNA, 21 nt, Human
agugguggugaacagaacaaa

SEQ ID NO: 3124029 - RNA, 17 nt, Human
aguggugguuuucuguu

SEQ ID NO: 3124030 - RNA, 18 nt, Human
aguggugguuuucuguuc

SEQ ID NO: 3124031 - RNA, 19 nt, Human
aguggugguuuucuguucu

SEQ ID NO: 3124032 - RNA, 20 nt, Human
aguggugguuuucuguucuu

SEQ ID NO: 3124033 - RNA, 21 nt, Human
aguggugguuuucuguucuuu

SEQ ID NO: 3124034 - RNA, 23 nt, Human
aguggugguuuucuguucuuucu

SEQ ID NO: 3124035 - RNA, 17 nt, Human
agugugguguuuccugg

SEQ ID NO: 3124036 - RNA, 19 nt, Human
agugugguguuuccuggca

SEQ ID NO: 3124037 - RNA, 16 nt, Human
agugugguguuuccug

SEQ ID NO: 3124038 - RNA, 13 nt, Human
uguugcccaggca

SEQ ID NO: 3124039 - RNA, 12 nt, Human
uguugcccaggc

SEQ ID NO: 3124040 - RNA, 15 nt, Human
uguugcccaggcagg

SEQ ID NO: 3124041 - RNA, 16 nt, Human
uguugcccaggcaggu

SEQ ID NO: 3124042 - RNA, 17 nt, Human
uguugcccaggcagguc

SEQ ID NO: 3124043 - RNA, 18 nt, Human
uguugcccaggcaggucu

SEQ ID NO: 3124044 - RNA, 16 nt, Human
uguucugggacacagu

SEQ ID NO: 3124045 - RNA, 19 nt, Human
uguuccacaaguuaaauaa

SEQ ID NO: 3124046 - RNA, 20 nt, Human
uguuccacaaguuaaauaaa

SEQ ID NO: 3124047 - RNA, 20 nt, Human
agugugucuuagugugugca

SEQ ID NO: 3124048 - RNA, 18 nt, Human
ucagaaucucaaauaacu

SEQ ID NO: 3124049 - RNA, 19 nt, Human
ucagaaucucaaauaacua

SEQ ID NO: 3124050 - RNA, 16 nt, Human
ucagagacuccugcag

SEQ ID NO: 3124051 - RNA, 21 nt, Human
ucagagacuccugcaggcagc

SEQ ID NO: 3124052 - RNA, 20 nt, Human
ucagagacuccugcaggcag

SEQ ID NO: 3124053 - RNA, 17 nt, Human
ucagagacuccugcagg

SEQ ID NO: 3124054 - RNA, 12 nt, Human
ucagagccugca

SEQ ID NO: 3124055 - RNA, 23 nt, Human
ucagagagggugggagugggccc

SEQ ID NO: 3124056 - RNA, 21 nt, Human
ucagagagggugggagugggc

SEQ ID NO: 3124057 - RNA, 16 nt, Human
ucagagagggugggag

SEQ ID NO: 3124058 - RNA, 13 nt, Human
ucagagccugcag

SEQ ID NO: 3124059 - RNA, 14 nt, Human
ucagagccugcagu

SEQ ID NO: 3124060 - RNA, 15 nt, Human
ucagagccugcaguu

SEQ ID NO: 3124061 - RNA, 18 nt, Human
ucagagccugcaguuauu

SEQ ID NO: 3124062 - RNA, 14 nt, Human
ucagaagacacuga

SEQ ID NO: 3124063 - RNA, 22 nt, Human
ucagaaguuucugccgcagccc

SEQ ID NO: 3124064 - RNA, 19 nt, Human
ucagaaguuucugccgcag

SEQ ID NO: 3124065 - RNA, 13 nt, Human
acccacugcucug

SEQ ID NO: 3124066 - RNA, 14 nt, Human
acccacugcucugg

SEQ ID NO: 3124067 - RNA, 15 nt, Human
acccacugcucuggu

SEQ ID NO: 3124068 - RNA, 11 nt, Human
acccacugcuu

SEQ ID NO: 3124069 - RNA, 10 nt, Human
acccacugcu

SEQ ID NO: 3124070 - RNA, 11 nt, Human
acccacugcuc

SEQ ID NO: 3124071 - RNA, 22 nt, Human
accauggucggaaaacaugcua

SEQ ID NO: 3124072 - RNA, 21 nt, Human
ucacucuuauugcccacgcug

SEQ ID NO: 3124073 - RNA, 23 nt, Human
ucacucuuauugcccacgcugga

SEQ ID NO: 3124074 - RNA, 16 nt, Human
accccuucgcuccugu

SEQ ID NO: 3124075 - RNA, 14 nt, Human
accccuucgcuccu

SEQ ID NO: 3124076 - RNA, 15 nt, Human
accccuucgcuccug

SEQ ID NO: 3124077 - RNA, 12 nt, Human
acccccacccaa

SEQ ID NO: 3124078 - RNA, 14 nt, Human
ucagcggggacagc

SEQ ID NO: 3124079 - RNA, 20 nt, Human
ucagcuuguaaauagcucag

SEQ ID NO: 3124080 - RNA, 24 nt, Human
acccagcgagcccugguggcagug

SEQ ID NO: 3124081 - RNA, 22 nt, Human
ucagccaagaauucuuaaauau

SEQ ID NO: 3124082 - RNA, 19 nt, Human
acccagcgagcccuggugg

SEQ ID NO: 3124083 - RNA, 23 nt, Human
acccagcgagcccugguggcagu

SEQ ID NO: 3124084 - RNA, 23 nt, Human
ucagccguguaaccauggaccca

SEQ ID NO: 3124085 - RNA, 15 nt, Human
ucaccugccccucaa

SEQ ID NO: 3124086 - RNA, 13 nt, Human
ucaccugccccuc

SEQ ID NO: 3124087 - RNA, 15 nt, Human
ucaccucucccuugg

SEQ ID NO: 3124088 - RNA, 18 nt, Human
ucacuauguugcccaggc

SEQ ID NO: 3124089 - RNA, 17 nt, Human
ucacuauguugcccagg

SEQ ID NO: 3124090 - RNA, 19 nt, Human
ucacuauguugcccaggca

SEQ ID NO: 3124091 - RNA, 21 nt, Human
accacugcacuccagccuggg

SEQ ID NO: 3124092 - RNA, 18 nt, Human
ucaccccggccaccugcg

SEQ ID NO: 3124093 - RNA, 17 nt, Human
ucaccccggccaccugc

SEQ ID NO: 3124094 - RNA, 20 nt, Human
accacugcacuccagccugg

SEQ ID NO: 3124095 - RNA, 17 nt, Human
accacugcacuccagcc

SEQ ID NO: 3124096 - RNA, 15 nt, Human
accacuuuuguucuu

SEQ ID NO: 3124097 - RNA, 16 nt, Human
accacuuuuguucuug

SEQ ID NO: 3124098 - RNA, 21 nt, Human
accacuuuuguucuugguuug

SEQ ID NO: 3124099 - RNA, 14 nt, Human
accagacaccuuga

SEQ ID NO: 3124100 - RNA, 11 nt, Human
accagacaggu

SEQ ID NO: 3124101 - RNA, 12 nt, Human
accagagcccac

SEQ ID NO: 3124102 - RNA, 14 nt, Human
accagagcccaccu

SEQ ID NO: 3124103 - RNA, 16 nt, Human
accagagcccaccuug

SEQ ID NO: 3124104 - RNA, 22 nt, Human
accacuuuuguucuugguuugu

SEQ ID NO: 3124105 - RNA, 13 nt, Human
ucaccccagcccc

SEQ ID NO: 3124106 - RNA, 20 nt, Human
ucaccccagccccaaaacuc

SEQ ID NO: 3124107 - RNA, 14 nt, Human
ucaccccagcccca

SEQ ID NO: 3124108 - RNA, 15 nt, Human
ucaccccggccaccu

SEQ ID NO: 3124109 - RNA, 12 nt, Human
ucacauaucugu

SEQ ID NO: 3124110 - RNA, 15 nt, Human
ucacauaucugucau

SEQ ID NO: 3124111 - RNA, 15 nt, Human
ucacaguucucuccu

SEQ ID NO: 3124112 - RNA, 15 nt, Human
accaauguucucucu

SEQ ID NO: 3124113 - RNA, 15 nt, Human
ucaagugaaaaagga

SEQ ID NO: 3124114 - RNA, 23 nt, Human
ucaagugaaaaaggaggaagaga

SEQ ID NO: 3124115 - RNA, 22 nt, Human
accaacauacucccaucuguga

SEQ ID NO: 3124116 - RNA, 21 nt, Human
accaacauacucccaucugug

SEQ ID NO: 3124117 - RNA, 19 nt, Human
accaacauacucccaucug

SEQ ID NO: 3124118 - RNA, 17 nt, Human
accaacauacucccauc

SEQ ID NO: 3124119 - RNA, 11 nt, Human
ucaaguauuau

SEQ ID NO: 3124120 - RNA, 15 nt, Human
ucaaguauuauaccu

SEQ ID NO: 3124121 - RNA, 23 nt, Human
ucaaguauuauaccuuuuuuaga

SEQ ID NO: 3124122 - RNA, 16 nt, Human
ucaaguauuauaccuu

SEQ ID NO: 3124123 - RNA, 21 nt, Human
ucaaguauuauaccuuuuuua

SEQ ID NO: 3124124 - RNA, 19 nt, Human
acauguccaagaagcccag

SEQ ID NO: 3124125 - RNA, 21 nt, Human
acauguccaagaagcccagga

SEQ ID NO: 3124126 - RNA, 12 nt, Human
acauucuguuaa

SEQ ID NO: 3124127 - RNA, 15 nt, Human
ucaaauuucuaaauc

SEQ ID NO: 3124128 - RNA, 16 nt, Human
ucaaauuucuaaaucu

SEQ ID NO: 3124129 - RNA, 15 nt, Human
acauucuguuaauca

SEQ ID NO: 3124130 - RNA, 14 nt, Human
ucaaauuucuaaau

SEQ ID NO: 3124131 - RNA, 17 nt, Human
ucaaauuucuaaaucuc

SEQ ID NO: 3124132 - RNA, 16 nt, Human
ucaacagguuuuccug

SEQ ID NO: 3124133 - RNA, 18 nt, Human
ucaaauaacuaaaaggua

SEQ ID NO: 3124134 - RNA, 22 nt, Human
acaugcuacacacugcauguuu

SEQ ID NO: 3124135 - RNA, 15 nt, Human
acaugaucuucuuua

SEQ ID NO: 3124136 - RNA, 17 nt, Human
acaugaucuucuuuaua

SEQ ID NO: 3124137 - RNA, 19 nt, Human
acaugagcaucaggccagg

SEQ ID NO: 3124138 - RNA, 18 nt, Human
acaugagcaucaggccag

SEQ ID NO: 3124139 - RNA, 17 nt, Human
acaugagcaucaggcca

SEQ ID NO: 3124140 - RNA, 17 nt, Human
acauacucccaucugug

SEQ ID NO: 3124141 - RNA, 14 nt, Human
acauacucugcuua

SEQ ID NO: 3124142 - RNA, 13 nt, Human
acauacuaaccag

SEQ ID NO: 3124143 - RNA, 21 nt, Human
acauacuaaccagcagaaaug

SEQ ID NO: 3124144 - RNA, 22 nt, Human
acauacuaaccagcagaaaugc

SEQ ID NO: 3124145 - RNA, 13 nt, Human
acauacucccauc

SEQ ID NO: 3124146 - RNA, 16 nt, Human
acaguuuguuaguaug

SEQ ID NO: 3124147 - RNA, 20 nt, Human
acaguuuguuaguaugaggc

SEQ ID NO: 3124148 - RNA, 20 nt, Human
acaguugaaaaacagcugag

SEQ ID NO: 3124149 - RNA, 16 nt, Human
acaguugaaaaacagc

SEQ ID NO: 3124150 - RNA, 15 nt, Human
acaguugaaaaacag

SEQ ID NO: 3124151 - RNA, 23 nt, Human
uauuuccuauauuguuuucagug

SEQ ID NO: 3124152 - RNA, 22 nt, Human
uauuucccucaccuuucccauc

SEQ ID NO: 3124153 - RNA, 13 nt, Human
acaucuugcucug

SEQ ID NO: 3124154 - RNA, 16 nt, Human
acaugaaaacacauuu

SEQ ID NO: 3124155 - RNA, 18 nt, Human
acaugaaaacacauuuuu

SEQ ID NO: 3124156 - RNA, 19 nt, Human
acaugaaaacacauuuuuc

SEQ ID NO: 3124157 - RNA, 21 nt, Human
acaucuugcucugcugacaga

SEQ ID NO: 3124158 - RNA, 17 nt, Human
acaugaaaacacauuuu

SEQ ID NO: 3124159 - RNA, 18 nt, Human
acaucuugcucugcugac

SEQ ID NO: 3124160 - RNA, 19 nt, Human
acaucuugcucugcugaca

SEQ ID NO: 3124161 - RNA, 16 nt, Human
acaucaacaucuuggu

SEQ ID NO: 3124162 - RNA, 18 nt, Human
acaucaacaucuugguca

SEQ ID NO: 3124163 - RNA, 14 nt, Human
acauauugauuucc

SEQ ID NO: 3124164 - RNA, 16 nt, Human
acauauugauuuccgu

SEQ ID NO: 3124165 - RNA, 23 nt, Human
acauauugauuuccguuaaaaua

SEQ ID NO: 3124166 - RNA, 18 nt, Human
acauauugauuuccguua

SEQ ID NO: 3124167 - RNA, 22 nt, Human
acauauugauuuccguuaaaau

SEQ ID NO: 3124168 - RNA, 19 nt, Human
uccagacccggcugcgugg

SEQ ID NO: 3124169 - RNA, 15 nt, Human
uccagacccggcugc

SEQ ID NO: 3124170 - RNA, 18 nt, Human
uccagacccggcugcgug

SEQ ID NO: 3124171 - RNA, 16 nt, Human
uccagaauuucccaaa

SEQ ID NO: 3124172 - RNA, 22 nt, Human
uccagaauuucccaaagcagug

SEQ ID NO: 3124173 - RNA, 20 nt, Human
uccagaauuucccaaagcag

SEQ ID NO: 3124174 - RNA, 14 nt, Human
uccagacccggcug

SEQ ID NO: 3124175 - RNA, 14 nt, Human
accuuuugagugcc

SEQ ID NO: 3124176 - RNA, 20 nt, Human
accuuuugagugccuuacac

SEQ ID NO: 3124177 - RNA, 17 nt, Human
accuuuugagugccuua

SEQ ID NO: 3124178 - RNA, 16 nt, Human
acgagcaggcuucuuc

SEQ ID NO: 3124179 - RNA, 17 nt, Human
acgccagauucuuuccu

SEQ ID NO: 3124180 - RNA, 19 nt, Human
acgccagauucuuuccuga

SEQ ID NO: 3124181 - RNA, 21 nt, Human
uccaggcuguaucccaugagc

SEQ ID NO: 3124182 - RNA, 19 nt, Human
accuuuuuuauacauaaac

SEQ ID NO: 3124183 - RNA, 20 nt, Human
accuuuuuuauacauaaaca

SEQ ID NO: 3124184 - RNA, 21 nt, Human
accuuuuuuauacauaaacaa

SEQ ID NO: 3124185 - RNA, 13 nt, Human
uccagccccugga

SEQ ID NO: 3124186 - RNA, 12 nt, Human
uccagccccugg

SEQ ID NO: 3124187 - RNA, 14 nt, Human
uccaggcuguaucc

SEQ ID NO: 3124188 - RNA, 17 nt, Human
uccacccaccucagccu

SEQ ID NO: 3124189 - RNA, 18 nt, Human
uccacccaccucagccuc

SEQ ID NO: 3124190 - RNA, 19 nt, Human
uccacccaccucagccucc

SEQ ID NO: 3124191 - RNA, 12 nt, Human
uccacccaggag

SEQ ID NO: 3124192 - RNA, 14 nt, Human
uccacccaggagcc

SEQ ID NO: 3124193 - RNA, 15 nt, Human
uccacccaggagccc

SEQ ID NO: 3124194 - RNA, 14 nt, Human
accuggccucugca

SEQ ID NO: 3124195 - RNA, 17 nt, Human
accuggccucugcacuc

SEQ ID NO: 3124196 - RNA, 16 nt, Human
accuggccucugcacu

SEQ ID NO: 3124197 - RNA, 20 nt, Human
accuggccucugcacucccc

SEQ ID NO: 3124198 - RNA, 18 nt, Human
accuggccucugcacucc

SEQ ID NO: 3124199 - RNA, 23 nt, Human
accuggccucugcacuccccugc

SEQ ID NO: 3124200 - RNA, 19 nt, Human
accuguuucugcagccacu

SEQ ID NO: 3124201 - RNA, 18 nt, Human
accuuagacagucccugc

SEQ ID NO: 3124202 - RNA, 20 nt, Human
accuuagacagucccugcca

SEQ ID NO: 3124203 - RNA, 19 nt, Human
accuuagacagucccugcc

SEQ ID NO: 3124204 - RNA, 21 nt, Human
uccaagcuggucccacucagu

SEQ ID NO: 3124205 - RNA, 18 nt, Human
uccaaggguacuaaggaa

SEQ ID NO: 3124206 - RNA, 16 nt, Human
uccaagcuggucccac

SEQ ID NO: 3124207 - RNA, 20 nt, Human
uccaagcuggucccacucag

SEQ ID NO: 3124208 - RNA, 14 nt, Human
accugccaggaagc

SEQ ID NO: 3124209 - RNA, 12 nt, Human
accugccaggaa

SEQ ID NO: 3124210 - RNA, 14 nt, Human
uccaacccucauca

SEQ ID NO: 3124211 - RNA, 17 nt, Human
uccaacccucaucacca

SEQ ID NO: 3124212 - RNA, 16 nt, Human
uccaacccucaucacc

SEQ ID NO: 3124213 - RNA, 23 nt, Human
uccaacccucaucaccaacgucu

SEQ ID NO: 3124214 - RNA, 12 nt, Human
ucauucuucugu

SEQ ID NO: 3124215 - RNA, 13 nt, Human
ucauugaaaucuu

SEQ ID NO: 3124216 - RNA, 12 nt, Human
ucauugaaaucu

SEQ ID NO: 3124217 - RNA, 15 nt, Human
ucauugaccugaggc

SEQ ID NO: 3124218 - RNA, 14 nt, Human
ucauugaccugagg

SEQ ID NO: 3124219 - RNA, 12 nt, Human
ucauugaccuga

SEQ ID NO: 3124220 - RNA, 22 nt, Human
ucauugaaaucuuuuugcuuug

SEQ ID NO: 3124221 - RNA, 13 nt, Human
accuccugggcua

SEQ ID NO: 3124222 - RNA, 19 nt, Human
accucggugccuuccucuu

SEQ ID NO: 3124223 - RNA, 14 nt, Human
accugauugugucu

SEQ ID NO: 3124224 - RNA, 18 nt, Human
accugauugugucucuug

SEQ ID NO: 3124225 - RNA, 17 nt, Human
accugauugugucucuu

SEQ ID NO: 3124226 - RNA, 15 nt, Human
accugauugugucuc

SEQ ID NO: 3124227 - RNA, 16 nt, Human
accugaggggccucuu

SEQ ID NO: 3124228 - RNA, 22 nt, Human
accugaggcccuucucuccagc

SEQ ID NO: 3124229 - RNA, 21 nt, Human
accugaggcccuucucuccag

SEQ ID NO: 3124230 - RNA, 20 nt, Human
accugaggcccuucucucca

SEQ ID NO: 3124231 - RNA, 16 nt, Human
accugaggcccuucuc

SEQ ID NO: 3124232 - RNA, 15 nt, Human
accugaggcccuucu

SEQ ID NO: 3124233 - RNA, 21 nt, Human
accucuugagccuugaacuuu

SEQ ID NO: 3124234 - RNA, 14 nt, Human
accugaggcccuuc

SEQ ID NO: 3124235 - RNA, 15 nt, Human
ucaggaagcucaggg

SEQ ID NO: 3124236 - RNA, 14 nt, Human
ucaggaagcucagg

SEQ ID NO: 3124237 - RNA, 13 nt, Human
ucaggaagcucag

SEQ ID NO: 3124238 - RNA, 12 nt, Human
ucaggaagcuca

SEQ ID NO: 3124239 - RNA, 23 nt, Human
accuccugccucgaacuggcugc

SEQ ID NO: 3124240 - RNA, 15 nt, Human
ucauccuaagcuauu

SEQ ID NO: 3124241 - RNA, 13 nt, Human
accuccugccucg

SEQ ID NO: 3124242 - RNA, 12 nt, Human
accuccugccuc

SEQ ID NO: 3124243 - RNA, 14 nt, Human
ucauccuucuggaa

SEQ ID NO: 3124244 - RNA, 18 nt, Human
ucauccucauacccaccc

SEQ ID NO: 3124245 - RNA, 19 nt, Human
ucauccuccucagaucuuc

SEQ ID NO: 3124246 - RNA, 13 nt, Human
ucauccuccucag

SEQ ID NO: 3124247 - RNA, 22 nt, Human
ucauccuucuggaauaaggaga

SEQ ID NO: 3124248 - RNA, 17 nt, Human
acuccagaauuucccaa

SEQ ID NO: 3124249 - RNA, 15 nt, Human
acuccagaauuuccc

SEQ ID NO: 3124250 - RNA, 15 nt, Human
acucauugaccugag

SEQ ID NO: 3124251 - RNA, 15 nt, Human
acucauucuucugua

SEQ ID NO: 3124252 - RNA, 14 nt, Human
acucauugaccuga

SEQ ID NO: 3124253 - RNA, 17 nt, Human
acuccugcaggcagcca

SEQ ID NO: 3124254 - RNA, 19 nt, Human
acuccugcaggcagccagg

SEQ ID NO: 3124255 - RNA, 18 nt, Human
acuccugcaggcagccag

SEQ ID NO: 3124256 - RNA, 23 nt, Human
acuccagaauuucccaaagcagu

SEQ ID NO: 3124257 - RNA, 12 nt, Human
acuccagccugg

SEQ ID NO: 3124258 - RNA, 13 nt, Human
acuccagccuggg

SEQ ID NO: 3124259 - RNA, 17 nt, Human
ucccuuacgugaguccu

SEQ ID NO: 3124260 - RNA, 15 nt, Human
ucccugguggcagcu

SEQ ID NO: 3124261 - RNA, 12 nt, Human
ucccugucccag

SEQ ID NO: 3124262 - RNA, 21 nt, Human
acuccugcaggcagccaggcc

SEQ ID NO: 3124263 - RNA, 12 nt, Human
ucccuuuuccuu

SEQ ID NO: 3124264 - RNA, 16 nt, Human
uccuagaaauucccca

SEQ ID NO: 3124265 - RNA, 17 nt, Human
uccggucccugucccag

SEQ ID NO: 3124266 - RNA, 14 nt, Human
ucccucuuucccuc

SEQ ID NO: 3124267 - RNA, 18 nt, Human
ucccucuuucccucccuu

SEQ ID NO: 3124268 - RNA, 20 nt, Human
ucccucuuucccucccuucc

SEQ ID NO: 3124269 - RNA, 15 nt, Human
ucccugaaggccccg

SEQ ID NO: 3124270 - RNA, 11 nt, Human
ucccugaaggc

SEQ ID NO: 3124271 - RNA, 16 nt, Human
ucccugaaggccccgc

SEQ ID NO: 3124272 - RNA, 20 nt, Human
ucccgaauagcugggacuac

SEQ ID NO: 3124273 - RNA, 18 nt, Human
ucccgaauagcugggacu

SEQ ID NO: 3124274 - RNA, 15 nt, Human
ucccgaguagcuggg

SEQ ID NO: 3124275 - RNA, 18 nt, Human
ucccgaguagcugggacu

SEQ ID NO: 3124276 - RNA, 16 nt, Human
ucccgaguagcuggga

SEQ ID NO: 3124277 - RNA, 17 nt, Human
ucccgaguagcugggac

SEQ ID NO: 3124278 - RNA, 12 nt, Human
acucaccccagc

SEQ ID NO: 3124279 - RNA, 21 nt, Human
acucacauuuauucugcucac

SEQ ID NO: 3124280 - RNA, 17 nt, Human
acuacucccccaggugg

SEQ ID NO: 3124281 - RNA, 11 nt, Human
acuacaggcac

SEQ ID NO: 3124282 - RNA, 15 nt, Human
acuacaggcacccac

SEQ ID NO: 3124283 - RNA, 17 nt, Human
acuacaguccucccauc

SEQ ID NO: 3124284 - RNA, 13 nt, Human
acuacaguuuguu

SEQ ID NO: 3124285 - RNA, 14 nt, Human
acuacaguuuguua

SEQ ID NO: 3124286 - RNA, 14 nt, Human
acuacauucuguua

SEQ ID NO: 3124287 - RNA, 15 nt, Human
acuacaguuuguuag

SEQ ID NO: 3124288 - RNA, 11 nt, Human
acuacauucug

SEQ ID NO: 3124289 - RNA, 12 nt, Human
acuacauucugu

SEQ ID NO: 3124290 - RNA, 13 nt, Human
acuacauucuguu

SEQ ID NO: 3124291 - RNA, 17 nt, Human
ucccagcugugcucugg

SEQ ID NO: 3124292 - RNA, 15 nt, Human
acuacauucuguuaa

SEQ ID NO: 3124293 - RNA, 17 nt, Human
uccccaccgcagacagg

SEQ ID NO: 3124294 - RNA, 21 nt, Human
uccccaccgcagacaggacca

SEQ ID NO: 3124295 - RNA, 18 nt, Human
uccccaccgcagacagga

SEQ ID NO: 3124296 - RNA, 22 nt, Human
ucccauaugccugggcagaagg

SEQ ID NO: 3124297 - RNA, 16 nt, Human
ucccauaugccugggc

SEQ ID NO: 3124298 - RNA, 15 nt, Human
ucccaucacccgcua

SEQ ID NO: 3124299 - RNA, 16 nt, Human
ucccaaagcagugcau

SEQ ID NO: 3124300 - RNA, 18 nt, Human
ucccaaacccuucagugc

SEQ ID NO: 3124301 - RNA, 13 nt, Human
ucccaaagugcug

SEQ ID NO: 3124302 - RNA, 14 nt, Human
ucccaaagugcugg

SEQ ID NO: 3124303 - RNA, 18 nt, Human
ucccaaagcagugcaugc

SEQ ID NO: 3124304 - RNA, 17 nt, Human
ucccaaagcagugcaug

SEQ ID NO: 3124305 - RNA, 21 nt, Human
ucccaaagcagugcaugcugu

SEQ ID NO: 3124306 - RNA, 23 nt, Human
acgccagauucuuuccugaggcu

SEQ ID NO: 3124307 - RNA, 22 nt, Human
acgccagauucuuuccugaggc

SEQ ID NO: 3124308 - RNA, 20 nt, Human
acgggaggguaaggcugugg

SEQ ID NO: 3124309 - RNA, 16 nt, Human
ucccacaaaggagagc

SEQ ID NO: 3124310 - RNA, 20 nt, Human
ucccaccccacacacgccag

SEQ ID NO: 3124311 - RNA, 15 nt, Human
ucccaccccacacac

SEQ ID NO: 3124312 - RNA, 23 nt, Human
acguggcugcuucaaggauccug

SEQ ID NO: 3124313 - RNA, 15 nt, Human
acgguuuuacugcag

SEQ ID NO: 3124314 - RNA, 14 nt, Human
acguacacauuuua

SEQ ID NO: 3124315 - RNA, 23 nt, Human
ucucacacaugagcaucaggcca

SEQ ID NO: 3124316 - RNA, 16 nt, Human
acuucagcugacuuuu

SEQ ID NO: 3124317 - RNA, 11 nt, Human
acuucagcuga

SEQ ID NO: 3124318 - RNA, 11 nt, Human
ucucacuccuu

SEQ ID NO: 3124319 - RNA, 22 nt, Human
acuucgggaggucgaggcagga

SEQ ID NO: 3124320 - RNA, 13 nt, Human
ucucacuccuuga

SEQ ID NO: 3124321 - RNA, 12 nt, Human
ucucacucuguc

SEQ ID NO: 3124322 - RNA, 14 nt, Human
acuucuccacccug

SEQ ID NO: 3124323 - RNA, 19 nt, Human
acuugagaauuacccuuuu

SEQ ID NO: 3124324 - RNA, 19 nt, Human
acuugagcccagagugaac

SEQ ID NO: 3124325 - RNA, 15 nt, Human
acuucuccacccugc

SEQ ID NO: 3124326 - RNA, 16 nt, Human
acuucuccacccugcu

SEQ ID NO: 3124327 - RNA, 17 nt, Human
acuuguggacacagcuc

SEQ ID NO: 3124328 - RNA, 18 nt, Human
acuuguggacacagcucu

SEQ ID NO: 3124329 - RNA, 16 nt, Human
acuuguggacacagcu

SEQ ID NO: 3124330 - RNA, 21 nt, Human
ucuccuccuuuucacaguucu

SEQ ID NO: 3124331 - RNA, 14 nt, Human
acuuugaccucugc

SEQ ID NO: 3124332 - RNA, 17 nt, Human
acuuucuagccagagga

SEQ ID NO: 3124333 - RNA, 16 nt, Human
acuuucuagccagagg

SEQ ID NO: 3124334 - RNA, 16 nt, Human
ucuccauguuugaugu

SEQ ID NO: 3124335 - RNA, 11 nt, Human
ucuccaggcug

SEQ ID NO: 3124336 - RNA, 17 nt, Human
ucuccaaaauaaaacuu

SEQ ID NO: 3124337 - RNA, 19 nt, Human
ucuccaaaauaaaacuuuu

SEQ ID NO: 3124338 - RNA, 22 nt, Human
ucuccaaaauaaaacuuuuuaa

SEQ ID NO: 3124339 - RNA, 13 nt, Human
ucuccaaaauaaa

SEQ ID NO: 3124340 - RNA, 16 nt, Human
ucuccaggcuguaucc

SEQ ID NO: 3124341 - RNA, 13 nt, Human
ucucagggccugg

SEQ ID NO: 3124342 - RNA, 12 nt, Human
ucucagggccug

SEQ ID NO: 3124343 - RNA, 15 nt, Human
acuuguggacacagc

SEQ ID NO: 3124344 - RNA, 19 nt, Human
ucucagggccuggucguuu

SEQ ID NO: 3124345 - RNA, 15 nt, Human
ucucagggccugguc

SEQ ID NO: 3124346 - RNA, 14 nt, Human
ucucagggccuggu

SEQ ID NO: 3124347 - RNA, 17 nt, Human
ucugcacuccccugcug

SEQ ID NO: 3124348 - RNA, 19 nt, Human
ucugcacuccccugcuggg

SEQ ID NO: 3124349 - RNA, 18 nt, Human
ucugcacuccccugcugg

SEQ ID NO: 3124350 - RNA, 23 nt, Human
ucugagacucgcgacaaugcaaa

SEQ ID NO: 3124351 - RNA, 22 nt, Human
ucugagacucgcgacaaugcaa

SEQ ID NO: 3124352 - RNA, 18 nt, Human
ucugcagcaauaaagcag

SEQ ID NO: 3124353 - RNA, 20 nt, Human
ucugcacuccccugcugggu

SEQ ID NO: 3124354 - RNA, 14 nt, Human
agaaauauaauuga

SEQ ID NO: 3124355 - RNA, 19 nt, Human
agaaauaucugaaaaugua

SEQ ID NO: 3124356 - RNA, 20 nt, Human
agaaauaucugaaaauguau

SEQ ID NO: 3124357 - RNA, 21 nt, Human
ucugaacuuggcgcugccccu

SEQ ID NO: 3124358 - RNA, 13 nt, Human
agaaaaagaaaaa

SEQ ID NO: 3124359 - RNA, 20 nt, Human
ucucuuuaaugucacaggca

SEQ ID NO: 3124360 - RNA, 21 nt, Human
ucucuuuaaugucacaggcag

SEQ ID NO: 3124361 - RNA, 18 nt, Human
ucucuugagccugggagg

SEQ ID NO: 3124362 - RNA, 16 nt, Human
ucucuugauucauaau

SEQ ID NO: 3124363 - RNA, 14 nt, Human
ucucuugauucaua

SEQ ID NO: 3124364 - RNA, 17 nt, Human
ucucuugagccugggag

SEQ ID NO: 3124365 - RNA, 17 nt, Human
agaaaaaggaugcacag

SEQ ID NO: 3124366 - RNA, 19 nt, Human
ucucuccagccccuggaug

SEQ ID NO: 3124367 - RNA, 18 nt, Human
ucucuccagccccuggau

SEQ ID NO: 3124368 - RNA, 16 nt, Human
ucucuccagccccugg

SEQ ID NO: 3124369 - RNA, 17 nt, Human
ucucuccagccccugga

SEQ ID NO: 3124370 - RNA, 21 nt, Human
ucucucaggccaaacucaccu

SEQ ID NO: 3124371 - RNA, 15 nt, Human
ucucucacuccuuga

SEQ ID NO: 3124372 - RNA, 13 nt, Human
ucucucacuccuu

SEQ ID NO: 3124373 - RNA, 18 nt, Human
acuuugaccucugcagca

SEQ ID NO: 3124374 - RNA, 15 nt, Human
acuuugaccucugca

SEQ ID NO: 3124375 - RNA, 16 nt, Human
acuuugaccucugcag

SEQ ID NO: 3124376 - RNA, 16 nt, Human
ucucuccuguaccucu

SEQ ID NO: 3124377 - RNA, 14 nt, Human
ucucuccuguaccu

SEQ ID NO: 3124378 - RNA, 17 nt, Human
ucucugcccuccaagac

SEQ ID NO: 3124379 - RNA, 16 nt, Human
ucucugcccuccaaga

SEQ ID NO: 3124380 - RNA, 15 nt, Human
ucucugcccuccaag

SEQ ID NO: 3124381 - RNA, 11 nt, Human
ucucugcccuc

SEQ ID NO: 3124382 - RNA, 19 nt, Human
ucgcgacaaugcaaaccau

SEQ ID NO: 3124383 - RNA, 14 nt, Human
ucgcgacaaugcaa

SEQ ID NO: 3124384 - RNA, 16 nt, Human
ucgcgacaaugcaaac

SEQ ID NO: 3124385 - RNA, 15 nt, Human
ucgagcaugccugga

SEQ ID NO: 3124386 - RNA, 18 nt, Human
ucgagcaugccuggaugg

SEQ ID NO: 3124387 - RNA, 16 nt, Human
ucgagcaugccuggau

SEQ ID NO: 3124388 - RNA, 22 nt, Human
uccuuuagcgcccaguugggug

SEQ ID NO: 3124389 - RNA, 15 nt, Human
uccuuuagcgcccag

SEQ ID NO: 3124390 - RNA, 19 nt, Human
uccuuuagcgcccaguugg

SEQ ID NO: 3124391 - RNA, 14 nt, Human
uccuuguguuacua

SEQ ID NO: 3124392 - RNA, 23 nt, Human
uccuuguguuacuaaguuuuuau

SEQ ID NO: 3124393 - RNA, 22 nt, Human
uccuuggugucgggcaugacac

SEQ ID NO: 3124394 - RNA, 17 nt, Human
uccuucagugccuuaug

SEQ ID NO: 3124395 - RNA, 16 nt, Human
uccuucagugccuuau

SEQ ID NO: 3124396 - RNA, 15 nt, Human
uccuucagugccuua

SEQ ID NO: 3124397 - RNA, 14 nt, Human
uccuucagugccuu

SEQ ID NO: 3124398 - RNA, 22 nt, Human
acugcaucaagaugugacaugu

SEQ ID NO: 3124399 - RNA, 20 nt, Human
acugcaucaagaugugacau

SEQ ID NO: 3124400 - RNA, 15 nt, Human
acugcauguuuguga

SEQ ID NO: 3124401 - RNA, 16 nt, Human
acugcauguuugugau

SEQ ID NO: 3124402 - RNA, 22 nt, Human
uccuagaaauuccccacccuga

SEQ ID NO: 3124403 - RNA, 21 nt, Human
uccuagaaauuccccacccug

SEQ ID NO: 3124404 - RNA, 16 nt, Human
acugcauaugaaagga

SEQ ID NO: 3124405 - RNA, 20 nt, Human
acugcuuaacuucacauauu

SEQ ID NO: 3124406 - RNA, 21 nt, Human
acugcuugugaaaggaaagag

SEQ ID NO: 3124407 - RNA, 15 nt, Human
acuggauuaaacuua

SEQ ID NO: 3124408 - RNA, 18 nt, Human
acugcuuaacuucacaua

SEQ ID NO: 3124409 - RNA, 13 nt, Human
acuuaaucuaaau

SEQ ID NO: 3124410 - RNA, 15 nt, Human
acuuaaucuaaaugg

SEQ ID NO: 3124411 - RNA, 16 nt, Human
acuuaaucuaaaugga

SEQ ID NO: 3124412 - RNA, 17 nt, Human
acuguugcccaggcugg

SEQ ID NO: 3124413 - RNA, 18 nt, Human
acuguugcccaggcuggc

SEQ ID NO: 3124414 - RNA, 12 nt, Human
acuguugcccag

SEQ ID NO: 3124415 - RNA, 13 nt, Human
acuguugcccagg

SEQ ID NO: 3124416 - RNA, 14 nt, Human
acuguugcccaggc

SEQ ID NO: 3124417 - RNA, 17 nt, Human
acuuaaauaaugugaaa

SEQ ID NO: 3124418 - RNA, 18 nt, Human
acuuaaauaaugugaaac

SEQ ID NO: 3124419 - RNA, 16 nt, Human
acuuaaauaaugugaa

SEQ ID NO: 3124420 - RNA, 15 nt, Human
acuuaaauaauguga

SEQ ID NO: 3124421 - RNA, 15 nt, Human
ucuaaagcugccagc

SEQ ID NO: 3124422 - RNA, 14 nt, Human
ucuaaagcugccag

SEQ ID NO: 3124423 - RNA, 13 nt, Human
ucuaaagcugcca

SEQ ID NO: 3124424 - RNA, 19 nt, Human
acuguucucugcccuccaa

SEQ ID NO: 3124425 - RNA, 21 nt, Human
acuguucucugcccuccaaga

SEQ ID NO: 3124426 - RNA, 20 nt, Human
acuguucucugcccuccaag

SEQ ID NO: 3124427 - RNA, 14 nt, Human
acuguucucugccc

SEQ ID NO: 3124428 - RNA, 17 nt, Human
ucgggaggucgaggcag

SEQ ID NO: 3124429 - RNA, 21 nt, Human
ucgggaggucgaggcaggagg

SEQ ID NO: 3124430 - RNA, 19 nt, Human
ucgggaggucgaggcagga

SEQ ID NO: 3124431 - RNA, 12 nt, Human
ucgggcaugaca

SEQ ID NO: 3124432 - RNA, 11 nt, Human
ucgggcaugac

SEQ ID NO: 3124433 - RNA, 22 nt, Human
acugugcugagucugaaggcug

SEQ ID NO: 3124434 - RNA, 18 nt, Human
acuguccuacccacccuc

SEQ ID NO: 3124435 - RNA, 17 nt, Human
acuguccuacccacccu

SEQ ID NO: 3124436 - RNA, 24 nt, Human
agaggcagccccauucugccugcc

SEQ ID NO: 3124437 - RNA, 13 nt, Human
agaggcagcccca

SEQ ID NO: 3124438 - RNA, 19 nt, Human
agaggcagccccauucugc

SEQ ID NO: 3124439 - RNA, 10 nt, Human
agaggcaggg

SEQ ID NO: 3124440 - RNA, 13 nt, Human
agaggcagggucu

SEQ ID NO: 3124441 - RNA, 17 nt, Human
agaggcuaugugagcac

SEQ ID NO: 3124442 - RNA, 19 nt, Human
agaggccaugggccuccug

SEQ ID NO: 3124443 - RNA, 19 nt, Human
ugaacuuugaccucugcag

SEQ ID NO: 3124444 - RNA, 20 nt, Human
ugaacuuugaccucugcagc

SEQ ID NO: 3124445 - RNA, 17 nt, Human
ugaacuuugaccucugc

SEQ ID NO: 3124446 - RNA, 22 nt, Human
ugaacuuugaccucugcagcaa

SEQ ID NO: 3124447 - RNA, 22 nt, Human
ugaaccgaugagaaauaaaguu

SEQ ID NO: 3124448 - RNA, 15 nt, Human
ugaaauuuuuauuaa

SEQ ID NO: 3124449 - RNA, 14 nt, Human
ugaacuccuggccu

SEQ ID NO: 3124450 - RNA, 15 nt, Human
ugaacuccuggccuc

SEQ ID NO: 3124451 - RNA, 11 nt, Human
ugaacuccugg

SEQ ID NO: 3124452 - RNA, 12 nt, Human
ugaacuccuggc

SEQ ID NO: 3124453 - RNA, 16 nt, Human
agagauugugguuuca

SEQ ID NO: 3124454 - RNA, 16 nt, Human
ucuuuggacccugagg

SEQ ID NO: 3124455 - RNA, 21 nt, Human
ucuuuggacccugaggcccag

SEQ ID NO: 3124456 - RNA, 17 nt, Human
ucuuuggacccugaggc

SEQ ID NO: 3124457 - RNA, 12 nt, Human
agagcagagacc

SEQ ID NO: 3124458 - RNA, 20 nt, Human
agagcagagaccaucccuga

SEQ ID NO: 3124459 - RNA, 18 nt, Human
agagcagagaccaucccu

SEQ ID NO: 3124460 - RNA, 17 nt, Human
agagcagagaccauccc

SEQ ID NO: 3124461 - RNA, 11 nt, Human
agagccuugcg

SEQ ID NO: 3124462 - RNA, 21 nt, Human
agagccuugcggaagguucua

SEQ ID NO: 3124463 - RNA, 18 nt, Human
agagcugccaccugccug

SEQ ID NO: 3124464 - RNA, 19 nt, Human
ugaaugucagugugacuga

SEQ ID NO: 3124465 - RNA, 20 nt, Human
ugaaugguuuucaaaauaaa

SEQ ID NO: 3124466 - RNA, 22 nt, Human
agagucagaaguuucugccgca

SEQ ID NO: 3124467 - RNA, 17 nt, Human
agaguugauacuacagu

SEQ ID NO: 3124468 - RNA, 20 nt, Human
agaguugauacuacaguuug

SEQ ID NO: 3124469 - RNA, 22 nt, Human
agaguugauacuacaguuuguu

SEQ ID NO: 3124470 - RNA, 22 nt, Human
agagucucacuguugcccaggc

SEQ ID NO: 3124471 - RNA, 21 nt, Human
agaguuguuacauuuuuaagu

SEQ ID NO: 3124472 - RNA, 12 nt, Human
agaguuguuaca

SEQ ID NO: 3124473 - RNA, 20 nt, Human
ugacacacagcucuguccug

SEQ ID NO: 3124474 - RNA, 15 nt, Human
ugaauuucuuuugcc

SEQ ID NO: 3124475 - RNA, 17 nt, Human
agaucacgccacugcac

SEQ ID NO: 3124476 - RNA, 18 nt, Human
agaucacgccacugcacu

SEQ ID NO: 3124477 - RNA, 14 nt, Human
agaucacgccacug

SEQ ID NO: 3124478 - RNA, 15 nt, Human
agaucacgccacugc

SEQ ID NO: 3124479 - RNA, 16 nt, Human
agaucacgccacugca

SEQ ID NO: 3124480 - RNA, 12 nt, Human
agauaaaugugc

SEQ ID NO: 3124481 - RNA, 14 nt, Human
agaugcaccagccc

SEQ ID NO: 3124482 - RNA, 15 nt, Human
agaugcaccagcccu

SEQ ID NO: 3124483 - RNA, 12 nt, Human
ugacccacugcu

SEQ ID NO: 3124484 - RNA, 13 nt, Human
ugacccacugcuu

SEQ ID NO: 3124485 - RNA, 23 nt, Human
ugaccauucuccaccugccaggg

SEQ ID NO: 3124486 - RNA, 15 nt, Human
agaugcuucucacug

SEQ ID NO: 3124487 - RNA, 15 nt, Human
agaucagccugggca

SEQ ID NO: 3124488 - RNA, 13 nt, Human
agaucagccuggg

SEQ ID NO: 3124489 - RNA, 18 nt, Human
ugaccaaugauggucacc

SEQ ID NO: 3124490 - RNA, 20 nt, Human
ugacauuguuggccaaagcc

SEQ ID NO: 3124491 - RNA, 21 nt, Human
ugacauuguuggccaaagcca

SEQ ID NO: 3124492 - RNA, 20 nt, Human
ugacaggcaaugcuggcugu

SEQ ID NO: 3124493 - RNA, 21 nt, Human
ugacacacagcucuguccugg

SEQ ID NO: 3124494 - RNA, 11 nt, Human
ugacagggcac

SEQ ID NO: 3124495 - RNA, 16 nt, Human
ugacagggcacaccgg

SEQ ID NO: 3124496 - RNA, 20 nt, Human
ugacagggcacaccgggcac

SEQ ID NO: 3124497 - RNA, 23 nt, Human
agacuccugcaggcagccaggcc

SEQ ID NO: 3124498 - RNA, 19 nt, Human
agacucgcgacaaugcaaa

SEQ ID NO: 3124499 - RNA, 18 nt, Human
agacucgcgacaaugcaa

SEQ ID NO: 3124500 - RNA, 17 nt, Human
agacucgcgacaaugca

SEQ ID NO: 3124501 - RNA, 15 nt, Human
agacucgcgacaaug

SEQ ID NO: 3124502 - RNA, 13 nt, Human
ucuuucugcuuug

SEQ ID NO: 3124503 - RNA, 20 nt, Human
ucuuuauaauucuacuuuga

SEQ ID NO: 3124504 - RNA, 18 nt, Human
ucuuucuggcuaugcauu

SEQ ID NO: 3124505 - RNA, 16 nt, Human
ucuugguuuguaaauu

SEQ ID NO: 3124506 - RNA, 20 nt, Human
ucuuuaaugucacaggcagg

SEQ ID NO: 3124507 - RNA, 19 nt, Human
ucuuuaaugucacaggcag

SEQ ID NO: 3124508 - RNA, 22 nt, Human
ucuuuaaugucacaggcagguc

SEQ ID NO: 3124509 - RNA, 14 nt, Human
ucuugguuuguaaa

SEQ ID NO: 3124510 - RNA, 22 nt, Human
agagaaaaaauauuuuccugcc

SEQ ID NO: 3124511 - RNA, 19 nt, Human
agacuuuucuuucagccaa

SEQ ID NO: 3124512 - RNA, 20 nt, Human
agacucgcgacaaugcaaac

SEQ ID NO: 3124513 - RNA, 14 nt, Human
agacuguacaaagu

SEQ ID NO: 3124514 - RNA, 15 nt, Human
agacuguacaaagua

SEQ ID NO: 3124515 - RNA, 16 nt, Human
agacuguacaaaguag

SEQ ID NO: 3124516 - RNA, 18 nt, Human
ucuugagccuugaacuuu

SEQ ID NO: 3124517 - RNA, 19 nt, Human
ucuugagccuugaacuuug

SEQ ID NO: 3124518 - RNA, 17 nt, Human
ucuugagccuugaacuu

SEQ ID NO: 3124519 - RNA, 16 nt, Human
ucuugagccuugaacu

SEQ ID NO: 3124520 - RNA, 14 nt, Human
agacccggcugcgu

SEQ ID NO: 3124521 - RNA, 22 nt, Human
ucuucugcuucagccucccgag

SEQ ID NO: 3124522 - RNA, 19 nt, Human
ucuucugcuucagccuccc

SEQ ID NO: 3124523 - RNA, 21 nt, Human
ucuucuguacgucugacaggc

SEQ ID NO: 3124524 - RNA, 22 nt, Human
ucuucuguacgucugacaggca

SEQ ID NO: 3124525 - RNA, 17 nt, Human
ucuuauuuaaugaaaga

SEQ ID NO: 3124526 - RNA, 20 nt, Human
ucuucuguacgucugacagg

SEQ ID NO: 3124527 - RNA, 23 nt, Human
agacauacuaaccagcagaaaug

SEQ ID NO: 3124528 - RNA, 19 nt, Human
agacagucccugccaaugg

SEQ ID NO: 3124529 - RNA, 13 nt, Human
agacagucccugc

SEQ ID NO: 3124530 - RNA, 16 nt, Human
agacagcugccuggga

SEQ ID NO: 3124531 - RNA, 15 nt, Human
agacagcugccuggg

SEQ ID NO: 3124532 - RNA, 12 nt, Human
agacagucccug

SEQ ID NO: 3124533 - RNA, 18 nt, Human
ucuuaugggcuggguucu

SEQ ID NO: 3124534 - RNA, 12 nt, Human
ucuuagauguau

SEQ ID NO: 3124535 - RNA, 19 nt, Human
agacacaggcccggcucca

SEQ ID NO: 3124536 - RNA, 20 nt, Human
agacacaggcccggcuccag

SEQ ID NO: 3124537 - RNA, 21 nt, Human
agacacaggcccggcuccagg

SEQ ID NO: 3124538 - RNA, 22 nt, Human
agacacaggcccggcuccaggc

SEQ ID NO: 3124539 - RNA, 17 nt, Human
agacacaggcccggcuc

SEQ ID NO: 3124540 - RNA, 17 nt, Human
agaauucucuuauccaa

SEQ ID NO: 3124541 - RNA, 18 nt, Human
agaauucucuaguuugau

SEQ ID NO: 3124542 - RNA, 19 nt, Human
agaauucucuaguuugauu

SEQ ID NO: 3124543 - RNA, 14 nt, Human
agacacaagccuuc

SEQ ID NO: 3124544 - RNA, 13 nt, Human
agacacaagccuu

SEQ ID NO: 3124545 - RNA, 20 nt, Human
agacacauguccaagaagcc

SEQ ID NO: 3124546 - RNA, 22 nt, Human
agacaccuugacagggcacacc

SEQ ID NO: 3124547 - RNA, 19 nt, Human
agacaccuugacagggcac

SEQ ID NO: 3124548 - RNA, 24 nt, Human
agacacauguccaagaagcccagg

SEQ ID NO: 3124549 - RNA, 23 nt, Human
agacacaggcccggcuccaggcu

SEQ ID NO: 3124550 - RNA, 16 nt, Human
agacacaggcccggcu

SEQ ID NO: 3124551 - RNA, 22 nt, Human
agacacauguccaagaagccca

SEQ ID NO: 3124552 - RNA, 21 nt, Human
agacacauguccaagaagccc

SEQ ID NO: 3124553 - RNA, 14 nt, Human
agacagcugccugg

SEQ ID NO: 3124554 - RNA, 13 nt, Human
agacagcugccug

SEQ ID NO: 3124555 - RNA, 18 nt, Human
ucuguacgucugacaggc

SEQ ID NO: 3124556 - RNA, 13 nt, Human
ucuguuuagauaa

SEQ ID NO: 3124557 - RNA, 23 nt, Human
ucuguuuagauaauacaccacua

SEQ ID NO: 3124558 - RNA, 16 nt, Human
ucuguuuagauaauac

SEQ ID NO: 3124559 - RNA, 19 nt, Human
ucuguuuagauaauacacc

SEQ ID NO: 3124560 - RNA, 20 nt, Human
agaauucucagaaucucaaa

SEQ ID NO: 3124561 - RNA, 20 nt, Human
agaauuauaauuaguuccuc

SEQ ID NO: 3124562 - RNA, 14 nt, Human
agaauucucuaguu

SEQ ID NO: 3124563 - RNA, 23 nt, Human
agaaccccaggguccuguagccc

SEQ ID NO: 3124564 - RNA, 21 nt, Human
agaauguguuuaaacuugguu

SEQ ID NO: 3124565 - RNA, 21 nt, Human
aacacuguucucugcccucca

SEQ ID NO: 3124566 - RNA, 21 nt, Human
gucauuugagcagggcucagc

SEQ ID NO: 3124567 - RNA, 22 nt, Human
gucauuugagcagggcucagcg

SEQ ID NO: 3124568 - RNA, 19 nt, Human
gucauuugagcagggcuca

SEQ ID NO: 3124569 - RNA, 14 nt, Human
aacacucugagacu

SEQ ID NO: 3124570 - RNA, 13 nt, Human
aacacucugagac

SEQ ID NO: 3124571 - RNA, 12 nt, Human
aacacucugaga

SEQ ID NO: 3124572 - RNA, 11 nt, Human
aacacucugag

SEQ ID NO: 3124573 - RNA, 12 nt, Human
aacacuccuuca

SEQ ID NO: 3124574 - RNA, 21 nt, Human
aacacucauugaccugaggcc

SEQ ID NO: 3124575 - RNA, 17 nt, Human
aacacucauugaccuga

SEQ ID NO: 3124576 - RNA, 20 nt, Human
aacacuguucucugcccucc

SEQ ID NO: 3124577 - RNA, 15 nt, Human
aacacuguucucugc

SEQ ID NO: 3124578 - RNA, 19 nt, Human
aacaagaccacguuucuaa

SEQ ID NO: 3124579 - RNA, 16 nt, Human
aacaagaccacguuuc

SEQ ID NO: 3124580 - RNA, 17 nt, Human
aacaagaccacguuucu

SEQ ID NO: 3124581 - RNA, 12 nt, Human
gucacaggcagg

SEQ ID NO: 3124582 - RNA, 16 nt, Human
gucacaggcaggucca

SEQ ID NO: 3124583 - RNA, 13 nt, Human
gucacaggcaggu

SEQ ID NO: 3124584 - RNA, 15 nt, Human
gucacaggcaggucc

SEQ ID NO: 3124585 - RNA, 23 nt, Human
aacaaggcaaggcugucaauuac

SEQ ID NO: 3124586 - RNA, 19 nt, Human
aacagguuuuccugaagaa

SEQ ID NO: 3124587 - RNA, 23 nt, Human
aacaggcugggcuucaguggcag

SEQ ID NO: 3124588 - RNA, 19 nt, Human
aacagacuggaagcacagc

SEQ ID NO: 3124589 - RNA, 22 nt, Human
aacaggcugggcuucaguggca

SEQ ID NO: 3124590 - RNA, 13 nt, Human
aacaggcugggcu

SEQ ID NO: 3124591 - RNA, 13 nt, Human
guccgagcuuuga

SEQ ID NO: 3124592 - RNA, 21 nt, Human
guccggucccugucccagugc

SEQ ID NO: 3124593 - RNA, 21 nt, Human
aacagaaauguacagcaagga

SEQ ID NO: 3124594 - RNA, 10 nt, Human
aacagaaaug

SEQ ID NO: 3124595 - RNA, 15 nt, Human
aacagaaauguacag

SEQ ID NO: 3124596 - RNA, 15 nt, Human
aacauacucccaucu

SEQ ID NO: 3124597 - RNA, 14 nt, Human
aacauacucccauc

SEQ ID NO: 3124598 - RNA, 15 nt, Human
aacguggcugcuuca

SEQ ID NO: 3124599 - RNA, 19 nt, Human
aacguggcugcuucaagga

SEQ ID NO: 3124600 - RNA, 16 nt, Human
aacguggcugcuucaa

SEQ ID NO: 3124601 - RNA, 22 nt, Human
aacguggcugcuucaaggaucc

SEQ ID NO: 3124602 - RNA, 19 nt, Human
gugaaccaccacacccagc

SEQ ID NO: 3124603 - RNA, 15 nt, Human
gucuuagauguauau

SEQ ID NO: 3124604 - RNA, 24 nt, Human
gucuuuucuugcaugaggcuagug

SEQ ID NO: 3124605 - RNA, 19 nt, Human
gucuuuucuugcaugaggc

SEQ ID NO: 3124606 - RNA, 14 nt, Human
gucuuuucuugcau

SEQ ID NO: 3124607 - RNA, 17 nt, Human
gucuuuggacccugagg

SEQ ID NO: 3124608 - RNA, 15 nt, Human
gucuuuggacccuga

SEQ ID NO: 3124609 - RNA, 14 nt, Human
gucuuuggacccug

SEQ ID NO: 3124610 - RNA, 13 nt, Human
gucuccauguuug

SEQ ID NO: 3124611 - RNA, 16 nt, Human
aacauuuugucauaua

SEQ ID NO: 3124612 - RNA, 20 nt, Human
aaccacaucuugcucugcug

SEQ ID NO: 3124613 - RNA, 22 nt, Human
aaccacaucuugcucugcugac

SEQ ID NO: 3124614 - RNA, 20 nt, Human
aaccaucauugaaaucuuuu

SEQ ID NO: 3124615 - RNA, 19 nt, Human
aaccaucauugaaaucuuu

SEQ ID NO: 3124616 - RNA, 21 nt, Human
aaccaucauugaaaucuuuuu

SEQ ID NO: 3124617 - RNA, 18 nt, Human
aaccacaucuugcucugc

SEQ ID NO: 3124618 - RNA, 17 nt, Human
aacccagcucuggucca

SEQ ID NO: 3124619 - RNA, 11 nt, Human
aacccagcucu

SEQ ID NO: 3124620 - RNA, 14 nt, Human
aacccagcucuggu

SEQ ID NO: 3124621 - RNA, 13 nt, Human
aacccagcucugg

SEQ ID NO: 3124622 - RNA, 23 nt, Human
aaccauuuugcugucccuuuucc

SEQ ID NO: 3124623 - RNA, 17 nt, Human
aaccuccgccucuuggg

SEQ ID NO: 3124624 - RNA, 14 nt, Human
aaccuccugggcua

SEQ ID NO: 3124625 - RNA, 13 nt, Human
aacccccagccug

SEQ ID NO: 3124626 - RNA, 14 nt, Human
aacccccagccugc

SEQ ID NO: 3124627 - RNA, 15 nt, Human
aacccccagccugcu

SEQ ID NO: 3124628 - RNA, 15 nt, Human
guaucccuacuguaa

SEQ ID NO: 3124629 - RNA, 22 nt, Human
guaugaucacggcucacugcag

SEQ ID NO: 3124630 - RNA, 21 nt, Human
guaucccaugagccucagcau

SEQ ID NO: 3124631 - RNA, 14 nt, Human
guaugggagagaag

SEQ ID NO: 3124632 - RNA, 15 nt, Human
guauucuuauuuaau

SEQ ID NO: 3124633 - RNA, 21 nt, Human
guauucucuccuguaccucuu

SEQ ID NO: 3124634 - RNA, 15 nt, Human
guaugggagagaaga

SEQ ID NO: 3124635 - RNA, 17 nt, Human
aaaugggggugcauuug

SEQ ID NO: 3124636 - RNA, 18 nt, Human
aaaugggggugcauuuga

SEQ ID NO: 3124637 - RNA, 15 nt, Human
aaaugggggugcauu

SEQ ID NO: 3124638 - RNA, 16 nt, Human
aaaugggggugcauuu

SEQ ID NO: 3124639 - RNA, 19 nt, Human
aaauuaacuuuuauaaacu

SEQ ID NO: 3124640 - RNA, 21 nt, Human
aaauuaacuuuuauaaacuuu

SEQ ID NO: 3124641 - RNA, 22 nt, Human
aaauuaacuuuuauaaacuuua

SEQ ID NO: 3124642 - RNA, 23 nt, Human
aaauuaacuuuuauaaacuuuac

SEQ ID NO: 3124643 - RNA, 22 nt, Human
guauuggcuagagguucaaaga

SEQ ID NO: 3124644 - RNA, 16 nt, Human
aaauuccccacccuga

SEQ ID NO: 3124645 - RNA, 14 nt, Human
aaauucaugcugcu

SEQ ID NO: 3124646 - RNA, 16 nt, Human
gucacacacuuuggcu

SEQ ID NO: 3124647 - RNA, 20 nt, Human
gucacacaguauuacuucug

SEQ ID NO: 3124648 - RNA, 17 nt, Human
guauuuuuuuacuaaua

SEQ ID NO: 3124649 - RNA, 21 nt, Human
guauuuuuuuacuaauagaca

SEQ ID NO: 3124650 - RNA, 18 nt, Human
gucaaaguggugagaggc

SEQ ID NO: 3124651 - RNA, 19 nt, Human
gucaaaguggugagaggca

SEQ ID NO: 3124652 - RNA, 14 nt, Human
guauuuuuuuacua

SEQ ID NO: 3124653 - RNA, 15 nt, Human
guauuuuuuuacuaa

SEQ ID NO: 3124654 - RNA, 13 nt, Human
aaaucgaugcagu

SEQ ID NO: 3124655 - RNA, 18 nt, Human
aaaucccuuaccucggug

SEQ ID NO: 3124656 - RNA, 15 nt, Human
aaaucccauuuaaaa

SEQ ID NO: 3124657 - RNA, 15 nt, Human
aaaucucaaauuucu

SEQ ID NO: 3124658 - RNA, 16 nt, Human
aaaucucaaauuucua

SEQ ID NO: 3124659 - RNA, 17 nt, Human
aaaucucaaauuucuaa

SEQ ID NO: 3124660 - RNA, 17 nt, Human
aaaugaaaaucgugaca

SEQ ID NO: 3124661 - RNA, 22 nt, Human
guagcucuaggagggcuggcaa

SEQ ID NO: 3124662 - RNA, 12 nt, Human
guagcugggacu

SEQ ID NO: 3124663 - RNA, 18 nt, Human
guagcugggacuacaggc

SEQ ID NO: 3124664 - RNA, 19 nt, Human
guagcugggacuacaggca

SEQ ID NO: 3124665 - RNA, 21 nt, Human
guagcugggacuacaggcacc

SEQ ID NO: 3124666 - RNA, 18 nt, Human
guaggaagguuaauguuc

SEQ ID NO: 3124667 - RNA, 15 nt, Human
guaggaagacuuugg

SEQ ID NO: 3124668 - RNA, 17 nt, Human
aaaugaggucagagccu

SEQ ID NO: 3124669 - RNA, 19 nt, Human
aaaugaggucagagccugc

SEQ ID NO: 3124670 - RNA, 16 nt, Human
aaaugagguacucucc

SEQ ID NO: 3124671 - RNA, 23 nt, Human
aaaugagguacucuccuggaaau

SEQ ID NO: 3124672 - RNA, 19 nt, Human
aaaugagccuggcaagaau

SEQ ID NO: 3124673 - RNA, 13 nt, Human
aaaugagccuggc

SEQ ID NO: 3124674 - RNA, 15 nt, Human
aaaugggcagagcag

SEQ ID NO: 3124675 - RNA, 20 nt, Human
aaaugggcagagcagagacc

SEQ ID NO: 3124676 - RNA, 18 nt, Human
aaaugggcagagcagaga

SEQ ID NO: 3124677 - RNA, 15 nt, Human
aaaugcccagccccu

SEQ ID NO: 3124678 - RNA, 14 nt, Human
aaaugcccagcccc

SEQ ID NO: 3124679 - RNA, 18 nt, Human
aaaugcccagccccuucu

SEQ ID NO: 3124680 - RNA, 13 nt, Human
aaaugcccagcuu

SEQ ID NO: 3124681 - RNA, 13 nt, Human
aaaugcccagccc

SEQ ID NO: 3124682 - RNA, 14 nt, Human
aaaugcaccuggaa

SEQ ID NO: 3124683 - RNA, 18 nt, Human
aaaugcaccuggaauaua

SEQ ID NO: 3124684 - RNA, 22 nt, Human
aaaugcaccuggaauauauaac

SEQ ID NO: 3124685 - RNA, 16 nt, Human
guggcagcucaccucu

SEQ ID NO: 3124686 - RNA, 14 nt, Human
guggcagcucaccu

SEQ ID NO: 3124687 - RNA, 19 nt, Human
guggcaccagcagccugga

SEQ ID NO: 3124688 - RNA, 18 nt, Human
guggauuuaacagaaaug

SEQ ID NO: 3124689 - RNA, 19 nt, Human
guggauuuaacagaaaugu

SEQ ID NO: 3124690 - RNA, 18 nt, Human
guggcaccagcagccugg

SEQ ID NO: 3124691 - RNA, 16 nt, Human
aagaauugaagcagga

SEQ ID NO: 3124692 - RNA, 21 nt, Human
guggaugccugguggcagcug

SEQ ID NO: 3124693 - RNA, 18 nt, Human
guggacacagcucuucuc

SEQ ID NO: 3124694 - RNA, 22 nt, Human
guggacacagcucuucuccagg

SEQ ID NO: 3124695 - RNA, 23 nt, Human
guggacacagcucuucuccaggc

SEQ ID NO: 3124696 - RNA, 17 nt, Human
guggacacagcucuucu

SEQ ID NO: 3124697 - RNA, 21 nt, Human
gugcugggauuacaagcguga

SEQ ID NO: 3124698 - RNA, 22 nt, Human
gugcugggauuacaagcgugag

SEQ ID NO: 3124699 - RNA, 20 nt, Human
gugcugggauuacaggugug

SEQ ID NO: 3124700 - RNA, 22 nt, Human
gugcuaucucccccagccccau

SEQ ID NO: 3124701 - RNA, 19 nt, Human
gugcuaucucccccagccc

SEQ ID NO: 3124702 - RNA, 12 nt, Human
gugcuauguucu

SEQ ID NO: 3124703 - RNA, 18 nt, Human
gugcuaggaacacuccuu

SEQ ID NO: 3124704 - RNA, 17 nt, Human
gugcuaggaacacuccu

SEQ ID NO: 3124705 - RNA, 22 nt, Human
gugcuaggaacacuccuucaca

SEQ ID NO: 3124706 - RNA, 21 nt, Human
gugcuaucucccccagcccca

SEQ ID NO: 3124707 - RNA, 15 nt, Human
aagaaaaaggaugca

SEQ ID NO: 3124708 - RNA, 17 nt, Human
aagaaaaaggaugcaca

SEQ ID NO: 3124709 - RNA, 18 nt, Human
aagaaaaagaaaaagaaa

SEQ ID NO: 3124710 - RNA, 18 nt, Human
aagaaaaaggaugcacag

SEQ ID NO: 3124711 - RNA, 20 nt, Human
aagaaagacuaucuaaaugu

SEQ ID NO: 3124712 - RNA, 22 nt, Human
aagaaagacuaucuaaauguug

SEQ ID NO: 3124713 - RNA, 15 nt, Human
gugccucaagagaag

SEQ ID NO: 3124714 - RNA, 21 nt, Human
gugaaccaccacacccagccc

SEQ ID NO: 3124715 - RNA, 22 nt, Human
gugccgagaaggaagccuccca

SEQ ID NO: 3124716 - RNA, 12 nt, Human
gugccucuggga

SEQ ID NO: 3124717 - RNA, 13 nt, Human
gugccucugggac

SEQ ID NO: 3124718 - RNA, 14 nt, Human
gugccuuauggaac

SEQ ID NO: 3124719 - RNA, 23 nt, Human
gugccuuauggaacacucugaga

SEQ ID NO: 3124720 - RNA, 21 nt, Human
gugccuuauggaacacucuga

SEQ ID NO: 3124721 - RNA, 13 nt, Human
aacuuuaccuuuu

SEQ ID NO: 3124722 - RNA, 17 nt, Human
aacuuggcgcugccccu

SEQ ID NO: 3124723 - RNA, 11 nt, Human
gugccuuaugg

SEQ ID NO: 3124724 - RNA, 18 nt, Human
aacuugucuuuggacccu

SEQ ID NO: 3124725 - RNA, 22 nt, Human
aagacccuuguggucccacccc

SEQ ID NO: 3124726 - RNA, 21 nt, Human
aagacccuuguggucccaccc

SEQ ID NO: 3124727 - RNA, 18 nt, Human
aagacccuugugguccca

SEQ ID NO: 3124728 - RNA, 16 nt, Human
aagacuaucuaaaugu

SEQ ID NO: 3124729 - RNA, 17 nt, Human
aagacuaucuaaauguu

SEQ ID NO: 3124730 - RNA, 18 nt, Human
aagacuaucuaaauguug

SEQ ID NO: 3124731 - RNA, 17 nt, Human
aagacugaguacguugu

SEQ ID NO: 3124732 - RNA, 17 nt, Human
aagacuguacaaaguag

SEQ ID NO: 3124733 - RNA, 21 nt, Human
aagacugaguacguugugcau

SEQ ID NO: 3124734 - RNA, 16 nt, Human
aagacuguacaaagua

SEQ ID NO: 3124735 - RNA, 14 nt, Human
guggguacgggagg

SEQ ID NO: 3124736 - RNA, 20 nt, Human
gugggggaucacagccucug

SEQ ID NO: 3124737 - RNA, 16 nt, Human
gugguuucagaaaugu

SEQ ID NO: 3124738 - RNA, 14 nt, Human
guggugguuuucug

SEQ ID NO: 3124739 - RNA, 23 nt, Human
guggcgcagcauauucaggaagc

SEQ ID NO: 3124740 - RNA, 22 nt, Human
guggcgcagcauauucaggaag

SEQ ID NO: 3124741 - RNA, 22 nt, Human
gugggacacccugugauggggc

SEQ ID NO: 3124742 - RNA, 23 nt, Human
gugggaggaucucuugagccugg

SEQ ID NO: 3124743 - RNA, 14 nt, Human
gugggagugggccc

SEQ ID NO: 3124744 - RNA, 13 nt, Human
gugggagugggcc

SEQ ID NO: 3124745 - RNA, 18 nt, Human
aagaugugacauguuuua

SEQ ID NO: 3124746 - RNA, 14 nt, Human
aagaugugacaugu

SEQ ID NO: 3124747 - RNA, 13 nt, Human
aagcaaaggagau

SEQ ID NO: 3124748 - RNA, 12 nt, Human
aagcaaaggaga

SEQ ID NO: 3124749 - RNA, 12 nt, Human
aagaugcagccg

SEQ ID NO: 3124750 - RNA, 18 nt, Human
aagagguuuuaaaaaaau

SEQ ID NO: 3124751 - RNA, 17 nt, Human
gugguuuucuguucuuu

SEQ ID NO: 3124752 - RNA, 18 nt, Human
gugucuuuuuucacuaca

SEQ ID NO: 3124753 - RNA, 17 nt, Human
gugugacuacuccccca

SEQ ID NO: 3124754 - RNA, 17 nt, Human
gugucuugcaauggcag

SEQ ID NO: 3124755 - RNA, 18 nt, Human
gugucuugcaauggcagc

SEQ ID NO: 3124756 - RNA, 23 nt, Human
guguuuccuggcacugcuuccag

SEQ ID NO: 3124757 - RNA, 20 nt, Human
guuaguaugaggcauuuguu

SEQ ID NO: 3124758 - RNA, 17 nt, Human
guuaguaugaggcauuu

SEQ ID NO: 3124759 - RNA, 18 nt, Human
guuaaugauagcuacugu

SEQ ID NO: 3124760 - RNA, 18 nt, Human
guuaaucauuagguguga

SEQ ID NO: 3124761 - RNA, 17 nt, Human
aagcuaggccuggccag

SEQ ID NO: 3124762 - RNA, 18 nt, Human
aagcuaggccuggccaga

SEQ ID NO: 3124763 - RNA, 16 nt, Human
aagcuaggccuggcca

SEQ ID NO: 3124764 - RNA, 19 nt, Human
aagccuccuccagccgcca

SEQ ID NO: 3124765 - RNA, 15 nt, Human
guucagcuccagcuc

SEQ ID NO: 3124766 - RNA, 18 nt, Human
guucagcuccagcucacc

SEQ ID NO: 3124767 - RNA, 16 nt, Human
guucagcuccagcuca

SEQ ID NO: 3124768 - RNA, 17 nt, Human
guucagcuccagcucac

SEQ ID NO: 3124769 - RNA, 17 nt, Human
guucaggguuggccccu

SEQ ID NO: 3124770 - RNA, 18 nt, Human
guucaggguuggccccug

SEQ ID NO: 3124771 - RNA, 19 nt, Human
guucaggguuggccccugc

SEQ ID NO: 3124772 - RNA, 21 nt, Human
guucuugguuuguaaauuaac

SEQ ID NO: 3124773 - RNA, 17 nt, Human
guucuuaguuugcaguu

SEQ ID NO: 3124774 - RNA, 22 nt, Human
guugaugaucuuugcagacagg

SEQ ID NO: 3124775 - RNA, 23 nt, Human
guucugggacacaguucaauucu

SEQ ID NO: 3124776 - RNA, 16 nt, Human
guucuacccaggugcu

SEQ ID NO: 3124777 - RNA, 21 nt, Human
guucccuuugacgccauccca

SEQ ID NO: 3124778 - RNA, 20 nt, Human
guucccuuugacgccauccc

SEQ ID NO: 3124779 - RNA, 20 nt, Human
guuccauggccucuucagau

SEQ ID NO: 3124780 - RNA, 16 nt, Human
guucccauuugcuccu

SEQ ID NO: 3124781 - RNA, 20 nt, Human
guucccauuugcuccuuucu

SEQ ID NO: 3124782 - RNA, 22 nt, Human
aagcuauucaguaauaacucua

SEQ ID NO: 3124783 - RNA, 13 nt, Human
aagggccuggccu

SEQ ID NO: 3124784 - RNA, 17 nt, Human
aagggccuggccugagc

SEQ ID NO: 3124785 - RNA, 14 nt, Human
aagggccuggccug

SEQ ID NO: 3124786 - RNA, 19 nt, Human
aagggccuggccugagcug

SEQ ID NO: 3124787 - RNA, 22 nt, Human
aaggggaauguuugccucugcc

SEQ ID NO: 3124788 - RNA, 23 nt, Human
aaggggaauguuugccucugccu

SEQ ID NO: 3124789 - RNA, 16 nt, Human
aaggguaucaggugcu

SEQ ID NO: 3124790 - RNA, 15 nt, Human
aaguaauaugcacac

SEQ ID NO: 3124791 - RNA, 16 nt, Human
aaguaauaugcacaca

SEQ ID NO: 3124792 - RNA, 20 nt, Human
guuucuaaagcugccagccg

SEQ ID NO: 3124793 - RNA, 19 nt, Human
guuucuaaaggcuaccuuu

SEQ ID NO: 3124794 - RNA, 12 nt, Human
aaguaauaugca

SEQ ID NO: 3124795 - RNA, 22 nt, Human
guuugauucagacagcugccug

SEQ ID NO: 3124796 - RNA, 21 nt, Human
guuugauucagacagcugccu

SEQ ID NO: 3124797 - RNA, 22 nt, Human
guuucuaaaggcuaccuuugua

SEQ ID NO: 3124798 - RNA, 23 nt, Human
guuucuaaaggcuaccuuuguau

SEQ ID NO: 3124799 - RNA, 13 nt, Human
guuugccucugcc

SEQ ID NO: 3124800 - RNA, 16 nt, Human
guuugccucugccucu

SEQ ID NO: 3124801 - RNA, 11 nt, Human
guuuucuguuc

SEQ ID NO: 3124802 - RNA, 19 nt, Human
guuuucuguucuuucuggc

SEQ ID NO: 3124803 - RNA, 17 nt, Human
aaggaugcuuguacaua

SEQ ID NO: 3124804 - RNA, 19 nt, Human
aaggaugcuuguacauaau

SEQ ID NO: 3124805 - RNA, 18 nt, Human
aaggaugcacagaguugu

SEQ ID NO: 3124806 - RNA, 19 nt, Human
aaggaugcccaaagaugca

SEQ ID NO: 3124807 - RNA, 15 nt, Human
aaggaugcuuguaca

SEQ ID NO: 3124808 - RNA, 16 nt, Human
aaggaugcuuguacau

SEQ ID NO: 3124809 - RNA, 23 nt, Human
guugaugaucuuugcagacaggc

SEQ ID NO: 3124810 - RNA, 13 nt, Human
aaggauccugagc

SEQ ID NO: 3124811 - RNA, 14 nt, Human
aaggauccugagcc

SEQ ID NO: 3124812 - RNA, 23 nt, Human
aaggaugaucuaggaagacuuug

SEQ ID NO: 3124813 - RNA, 18 nt, Human
aaggaugaucuaggaaga

SEQ ID NO: 3124814 - RNA, 17 nt, Human
aaggauccugagccaga

SEQ ID NO: 3124815 - RNA, 15 nt, Human
aaggauccugagcca

SEQ ID NO: 3124816 - RNA, 17 nt, Human
guugcccaggcaggucu

SEQ ID NO: 3124817 - RNA, 14 nt, Human
aaggcuccaggagc

SEQ ID NO: 3124818 - RNA, 18 nt, Human
guugcccaggcaggucuu

SEQ ID NO: 3124819 - RNA, 21 nt, Human
guugcccaggcuggcgugcag

SEQ ID NO: 3124820 - RNA, 15 nt, Human
guugcccaggcaggu

SEQ ID NO: 3124821 - RNA, 17 nt, Human
guugcccaggcuggcgu

SEQ ID NO: 3124822 - RNA, 18 nt, Human
aaggccaaaggaagcaca

SEQ ID NO: 3124823 - RNA, 16 nt, Human
aaggccaaaggaagca

SEQ ID NO: 3124824 - RNA, 19 nt, Human
aaggcuaccuuuguauucu

SEQ ID NO: 3124825 - RNA, 13 nt, Human
guuggguggaugc

SEQ ID NO: 3124826 - RNA, 18 nt, Human
guuggucccccuuccaug

SEQ ID NO: 3124827 - RNA, 22 nt, Human
uauaaccaguguuguggauuua

SEQ ID NO: 3124828 - RNA, 20 nt, Human
uauaaccaguguuguggauu

SEQ ID NO: 3124829 - RNA, 16 nt, Human
acacuaaccacgcugg

SEQ ID NO: 3124830 - RNA, 17 nt, Human
acacuaaccacgcugga

SEQ ID NO: 3124831 - RNA, 19 nt, Human
acacuaaccacgcuggacc

SEQ ID NO: 3124832 - RNA, 14 nt, Human
acaccuugacaggg

SEQ ID NO: 3124833 - RNA, 15 nt, Human
acaccuugacagggc

SEQ ID NO: 3124834 - RNA, 16 nt, Human
acaccuugacagggca

SEQ ID NO: 3124835 - RNA, 18 nt, Human
acaccucugcacaagcug

SEQ ID NO: 3124836 - RNA, 12 nt, Human
acacccagccca

SEQ ID NO: 3124837 - RNA, 13 nt, Human
acacccagcccac

SEQ ID NO: 3124838 - RNA, 22 nt, Human
acacauguccaagaagcccagg

SEQ ID NO: 3124839 - RNA, 21 nt, Human
acacauguccaagaagcccag

SEQ ID NO: 3124840 - RNA, 13 nt, Human
acacauguccaag

SEQ ID NO: 3124841 - RNA, 19 nt, Human
acacauguccaagaagccc

SEQ ID NO: 3124842 - RNA, 18 nt, Human
acacauguccaagaagcc

SEQ ID NO: 3124843 - RNA, 11 nt, Human
acacacagcuc

SEQ ID NO: 3124844 - RNA, 12 nt, Human
acacacagcucu

SEQ ID NO: 3124845 - RNA, 19 nt, Human
acacacagcucuguccugg

SEQ ID NO: 3124846 - RNA, 15 nt, Human
acaaugguuuucuug

SEQ ID NO: 3124847 - RNA, 21 nt, Human
acaaugguuuucuuguguguu

SEQ ID NO: 3124848 - RNA, 22 nt, Human
acacaguauuacuucugcuaca

SEQ ID NO: 3124849 - RNA, 11 nt, Human
acacagugagu

SEQ ID NO: 3124850 - RNA, 22 nt, Human
acacagcucuucuccaggcugu

SEQ ID NO: 3124851 - RNA, 21 nt, Human
uagguuggcaaaaaggcagga

SEQ ID NO: 3124852 - RNA, 13 nt, Human
uaguagagacagg

SEQ ID NO: 3124853 - RNA, 15 nt, Human
uaucucagggccugg

SEQ ID NO: 3124854 - RNA, 13 nt, Human
uaucucagggccu

SEQ ID NO: 3124855 - RNA, 19 nt, Human
uaucccuacuguaauuugu

SEQ ID NO: 3124856 - RNA, 20 nt, Human
uaucccuacuguaauuugug

SEQ ID NO: 3124857 - RNA, 16 nt, Human
acagaguuguuacauu

SEQ ID NO: 3124858 - RNA, 17 nt, Human
acagaguuguuacauuu

SEQ ID NO: 3124859 - RNA, 18 nt, Human
acagaguuguuacauuuu

SEQ ID NO: 3124860 - RNA, 19 nt, Human
acagaguuguuacauuuuu

SEQ ID NO: 3124861 - RNA, 20 nt, Human
acagaguuguuacauuuuua

SEQ ID NO: 3124862 - RNA, 18 nt, Human
acagagcuacacagggga

SEQ ID NO: 3124863 - RNA, 21 nt, Human
acagagcaagugagacccugu

SEQ ID NO: 3124864 - RNA, 23 nt, Human
acagaugggugcuuggaggaagg

SEQ ID NO: 3124865 - RNA, 20 nt, Human
acagauagauauaugcucug

SEQ ID NO: 3124866 - RNA, 21 nt, Human
acagaguuguuacauuuuuaa

SEQ ID NO: 3124867 - RNA, 22 nt, Human
acagaguuguuacauuuuuaag

SEQ ID NO: 3124868 - RNA, 15 nt, Human
acagaguuguuacau

SEQ ID NO: 3124869 - RNA, 20 nt, Human
acagcccgggcucugccucc

SEQ ID NO: 3124870 - RNA, 22 nt, Human
acagcccgggcucugccuccca

SEQ ID NO: 3124871 - RNA, 21 nt, Human
acagcccgggcucugccuccc

SEQ ID NO: 3124872 - RNA, 23 nt, Human
acagcccgggcucugccucccau

SEQ ID NO: 3124873 - RNA, 23 nt, Human
acacuguuucaaacuuuacuaug

SEQ ID NO: 3124874 - RNA, 15 nt, Human
acacuguuucaaacu

SEQ ID NO: 3124875 - RNA, 18 nt, Human
acagaaaauucuucucca

SEQ ID NO: 3124876 - RNA, 21 nt, Human
acagacuggaagcacagcuuc

SEQ ID NO: 3124877 - RNA, 17 nt, Human
acagacuggaagcacag

SEQ ID NO: 3124878 - RNA, 19 nt, Human
acagacuggaagcacagcu

SEQ ID NO: 3124879 - RNA, 18 nt, Human
acagacacaggcccggcu

SEQ ID NO: 3124880 - RNA, 22 nt, Human
acagacacaggcccggcuccag

SEQ ID NO: 3124881 - RNA, 17 nt, Human
acagacacaggcccggc

SEQ ID NO: 3124882 - RNA, 15 nt, Human
acagacacaggcccg

SEQ ID NO: 3124883 - RNA, 15 nt, Human
acacuguucucugcc

SEQ ID NO: 3124884 - RNA, 14 nt, Human
acacuguucucugc

SEQ ID NO: 3124885 - RNA, 20 nt, Human
acacuguucucugcccucca

SEQ ID NO: 3124886 - RNA, 18 nt, Human
acacuguucucugcccuc

SEQ ID NO: 3124887 - RNA, 17 nt, Human
acacuguucucugcccu

SEQ ID NO: 3124888 - RNA, 16 nt, Human
acacuguucucugccc

SEQ ID NO: 3124889 - RNA, 23 nt, Human
acacuguucucugcccuccaaga

SEQ ID NO: 3124890 - RNA, 22 nt, Human
acacuguucucugcccuccaag

SEQ ID NO: 3124891 - RNA, 13 nt, Human
acacucugagacu

SEQ ID NO: 3124892 - RNA, 11 nt, Human
acacucugaga

SEQ ID NO: 3124893 - RNA, 13 nt, Human
acacuccuucaca

SEQ ID NO: 3124894 - RNA, 22 nt, Human
acacucacauuuauucugcuca

SEQ ID NO: 3124895 - RNA, 17 nt, Human
acaagcgugagccacug

SEQ ID NO: 3124896 - RNA, 13 nt, Human
acaagcuccaagc

SEQ ID NO: 3124897 - RNA, 16 nt, Human
acaagaccacguuucu

SEQ ID NO: 3124898 - RNA, 17 nt, Human
acaagaccacguuucua

SEQ ID NO: 3124899 - RNA, 18 nt, Human
acaagagcccaggccucc

SEQ ID NO: 3124900 - RNA, 22 nt, Human
acaagagcccaggccuccuaca

SEQ ID NO: 3124901 - RNA, 17 nt, Human
acaacaucuuuuucuac

SEQ ID NO: 3124902 - RNA, 22 nt, Human
acaagcuccaagcucccaggca

SEQ ID NO: 3124903 - RNA, 19 nt, Human
acaagcuccaagcucccag

SEQ ID NO: 3124904 - RNA, 17 nt, Human
acaagcuccaagcuccc

SEQ ID NO: 3124905 - RNA, 16 nt, Human
acaagcuccaagcucc

SEQ ID NO: 3124906 - RNA, 15 nt, Human
acaagcuccaagcuc

SEQ ID NO: 3124907 - RNA, 16 nt, Human
uagcucaggugucccu

SEQ ID NO: 3124908 - RNA, 21 nt, Human
acaaagcgugguggacaugca

SEQ ID NO: 3124909 - RNA, 14 nt, Human
acaaaacuuuucua

SEQ ID NO: 3124910 - RNA, 18 nt, Human
aauuugggggaaaauuua

SEQ ID NO: 3124911 - RNA, 16 nt, Human
aauuuguuauaaugaa

SEQ ID NO: 3124912 - RNA, 20 nt, Human
aauuugugauacaaugcugu

SEQ ID NO: 3124913 - RNA, 13 nt, Human
uacuucuccaccc

SEQ ID NO: 3124914 - RNA, 18 nt, Human
uacuucuccacccugcuc

SEQ ID NO: 3124915 - RNA, 20 nt, Human
uacuucuccacccugcucuc

SEQ ID NO: 3124916 - RNA, 15 nt, Human
uacuucugcuacaua

SEQ ID NO: 3124917 - RNA, 14 nt, Human
uacuucuuauacau

SEQ ID NO: 3124918 - RNA, 15 nt, Human
uacuucuuauacauu

SEQ ID NO: 3124919 - RNA, 16 nt, Human
uacuucuuauacauuu

SEQ ID NO: 3124920 - RNA, 17 nt, Human
aauuuaccugaagucuu

SEQ ID NO: 3124921 - RNA, 15 nt, Human
aauuuaccugaaguc

SEQ ID NO: 3124922 - RNA, 13 nt, Human
aauuuauuauggc

SEQ ID NO: 3124923 - RNA, 14 nt, Human
aauuuauuauggca

SEQ ID NO: 3124924 - RNA, 15 nt, Human
uacgucugacaggca

SEQ ID NO: 3124925 - RNA, 16 nt, Human
uacgucugacaggcaa

SEQ ID NO: 3124926 - RNA, 13 nt, Human
uacgugaguccug

SEQ ID NO: 3124927 - RNA, 22 nt, Human
uacucuacccucuuagaaaaac

SEQ ID NO: 3124928 - RNA, 16 nt, Human
uacucuacccucuuag

SEQ ID NO: 3124929 - RNA, 15 nt, Human
uacuguaauuuguga

SEQ ID NO: 3124930 - RNA, 16 nt, Human
uacuguaauuugugau

SEQ ID NO: 3124931 - RNA, 17 nt, Human
uacuguaauuugugaua

SEQ ID NO: 3124932 - RNA, 23 nt, Human
uacuguaauuugugauacaaugc

SEQ ID NO: 3124933 - RNA, 20 nt, Human
aaguuuuuauggcuuuugug

SEQ ID NO: 3124934 - RNA, 18 nt, Human
aauaaaacuuuuuaaaau

SEQ ID NO: 3124935 - RNA, 12 nt, Human
aauaaaacuuuu

SEQ ID NO: 3124936 - RNA, 14 nt, Human
aauaaaacuuuuua

SEQ ID NO: 3124937 - RNA, 15 nt, Human
aauaaaacuuuuuaa

SEQ ID NO: 3124938 - RNA, 16 nt, Human
aauaaaucauaaaacu

SEQ ID NO: 3124939 - RNA, 22 nt, Human
aauaacauguaauuaaguacua

SEQ ID NO: 3124940 - RNA, 19 nt, Human
uaaauaaugugaaacugga

SEQ ID NO: 3124941 - RNA, 14 nt, Human
uaaaucuccaaaau

SEQ ID NO: 3124942 - RNA, 15 nt, Human
uaaaucuccaaaaua

SEQ ID NO: 3124943 - RNA, 22 nt, Human
uaaaucuccaaaauaaaacuuu

SEQ ID NO: 3124944 - RNA, 23 nt, Human
uaaaugcaccuggaauauauaac

SEQ ID NO: 3124945 - RNA, 15 nt, Human
uaaauguugaaagau

SEQ ID NO: 3124946 - RNA, 20 nt, Human
uaaauguugaaagaucaaaa

SEQ ID NO: 3124947 - RNA, 15 nt, Human
uaaauuaacuuuuau

SEQ ID NO: 3124948 - RNA, 16 nt, Human
uaaauuaacuuuuaua

SEQ ID NO: 3124949 - RNA, 17 nt, Human
uaaauuaacuuuuauaa

SEQ ID NO: 3124950 - RNA, 12 nt, Human
uaaauuaacuuu

SEQ ID NO: 3124951 - RNA, 14 nt, Human
uaaauuaacuuuua

SEQ ID NO: 3124952 - RNA, 17 nt, Human
aauauugauaugcuuau

SEQ ID NO: 3124953 - RNA, 18 nt, Human
aauauugauaugcuuaua

SEQ ID NO: 3124954 - RNA, 22 nt, Human
aauauugcugauggugcaauga

SEQ ID NO: 3124955 - RNA, 21 nt, Human
aauauugcugauggugcaaug

SEQ ID NO: 3124956 - RNA, 18 nt, Human
aauauugcugauggugca

SEQ ID NO: 3124957 - RNA, 15 nt, Human
aauauugcugauggu

SEQ ID NO: 3124958 - RNA, 13 nt, Human
aauauugcugaug

SEQ ID NO: 3124959 - RNA, 12 nt, Human
aauauugcugau

SEQ ID NO: 3124960 - RNA, 11 nt, Human
aauauugcuga

SEQ ID NO: 3124961 - RNA, 16 nt, Human
aauaucugaaaaugua

SEQ ID NO: 3124962 - RNA, 17 nt, Human
aauaucugaaaauguau

SEQ ID NO: 3124963 - RNA, 18 nt, Human
aauaucugaaaauguaug

SEQ ID NO: 3124964 - RNA, 19 nt, Human
aauaucugaaaauguaugu

SEQ ID NO: 3124965 - RNA, 20 nt, Human
aauaucugaaaauguaugug

SEQ ID NO: 3124966 - RNA, 15 nt, Human
uaacuuuuauaaacu

SEQ ID NO: 3124967 - RNA, 17 nt, Human
uaacuuuuauaaacuuu

SEQ ID NO: 3124968 - RNA, 18 nt, Human
uaacuuuuauaaacuuua

SEQ ID NO: 3124969 - RNA, 19 nt, Human
aauaggaaaaacugauuuu

SEQ ID NO: 3124970 - RNA, 18 nt, Human
aauaggaaaaacugauuu

SEQ ID NO: 3124971 - RNA, 17 nt, Human
aauaggaaaaacugauu

SEQ ID NO: 3124972 - RNA, 16 nt, Human
aauaggaaaaacugau

SEQ ID NO: 3124973 - RNA, 15 nt, Human
aauaggaaaaacuga

SEQ ID NO: 3124974 - RNA, 13 nt, Human
aauagcugggacu

SEQ ID NO: 3124975 - RNA, 14 nt, Human
aauagcugggacua

SEQ ID NO: 3124976 - RNA, 23 nt, Human
aauagacaauuuauuauggcaca

SEQ ID NO: 3124977 - RNA, 18 nt, Human
aauagacaauuuauuaug

SEQ ID NO: 3124978 - RNA, 15 nt, Human
uaacauggaaguacu

SEQ ID NO: 3124979 - RNA, 15 nt, Human
uaacuaaaagguaug

SEQ ID NO: 3124980 - RNA, 14 nt, Human
uaacuaaaagguau

SEQ ID NO: 3124981 - RNA, 14 nt, Human
uaacauggaaguac

SEQ ID NO: 3124982 - RNA, 18 nt, Human
aaucuaaauggaaccacu

SEQ ID NO: 3124983 - RNA, 13 nt, Human
aaucuaaauggaa

SEQ ID NO: 3124984 - RNA, 15 nt, Human
aaucuaaauggaacc

SEQ ID NO: 3124985 - RNA, 12 nt, Human
aaucuaaaugga

SEQ ID NO: 3124986 - RNA, 13 nt, Human
aaucucaaauaac

SEQ ID NO: 3124987 - RNA, 14 nt, Human
aaucucaaauuucu

SEQ ID NO: 3124988 - RNA, 12 nt, Human
aaucucaaauuu

SEQ ID NO: 3124989 - RNA, 15 nt, Human
aaucucaaauaacua

SEQ ID NO: 3124990 - RNA, 20 nt, Human
uaaguuuuuauggcuuuugu

SEQ ID NO: 3124991 - RNA, 19 nt, Human
uaaguacuauguaucaaug

SEQ ID NO: 3124992 - RNA, 20 nt, Human
aaucuucugaacuuggcgcu

SEQ ID NO: 3124993 - RNA, 13 nt, Human
aaucuucugaacu

SEQ ID NO: 3124994 - RNA, 14 nt, Human
uaaugaaagacugu

SEQ ID NO: 3124995 - RNA, 17 nt, Human
uaaugaaagacuguaca

SEQ ID NO: 3124996 - RNA, 18 nt, Human
uaaugaaagacuguacaa

SEQ ID NO: 3124997 - RNA, 19 nt, Human
uaaugaaagacuguacaaa

SEQ ID NO: 3124998 - RNA, 21 nt, Human
uaaugacuuaagcacacuuga

SEQ ID NO: 3124999 - RNA, 15 nt, Human
uaaugacuuaagcac

SEQ ID NO: 3125000 - RNA, 22 nt, Human
uaaugaaagacuguacaaagua

SEQ ID NO: 3125001 - RNA, 23 nt, Human
uaaugaaagacuguacaaaguag

SEQ ID NO: 3125002 - RNA, 13 nt, Human
uaaugaggaaacu

SEQ ID NO: 3125003 - RNA, 18 nt, Human
aaugacuuacuguacaug

SEQ ID NO: 3125004 - RNA, 14 nt, Human
aaugacuuacugua

SEQ ID NO: 3125005 - RNA, 17 nt, Human
aaugacuuacuguacau

SEQ ID NO: 3125006 - RNA, 15 nt, Human
aaugagccuggcaag

SEQ ID NO: 3125007 - RNA, 12 nt, Human
aauguaugugua

SEQ ID NO: 3125008 - RNA, 14 nt, Human
aauguauguguaag

SEQ ID NO: 3125009 - RNA, 14 nt, Human
aauguacugcauau

SEQ ID NO: 3125010 - RNA, 18 nt, Human
aauguacugcauaugaaa

SEQ ID NO: 3125011 - RNA, 15 nt, Human
uacauaaugcgugca

SEQ ID NO: 3125012 - RNA, 19 nt, Human
uacauaaugcgugcauacc

SEQ ID NO: 3125013 - RNA, 20 nt, Human
uacauaaugcgugcauacca

SEQ ID NO: 3125014 - RNA, 17 nt, Human
uacauaaugcgugcaua

SEQ ID NO: 3125015 - RNA, 15 nt, Human
uacaguaucucaggg

SEQ ID NO: 3125016 - RNA, 12 nt, Human
aauguacugcau

SEQ ID NO: 3125017 - RNA, 23 nt, Human
uacagagcccacgcccccacugg

SEQ ID NO: 3125018 - RNA, 19 nt, Human
uacaccacuacauucuguu

SEQ ID NO: 3125019 - RNA, 20 nt, Human
uacaccacuacauucuguua

SEQ ID NO: 3125020 - RNA, 15 nt, Human
uacaccacuacauuc

SEQ ID NO: 3125021 - RNA, 16 nt, Human
uacaccacuacauucu

SEQ ID NO: 3125022 - RNA, 17 nt, Human
uacaccacuacauucug

SEQ ID NO: 3125023 - RNA, 18 nt, Human
uacaccacuacauucugu

SEQ ID NO: 3125024 - RNA, 23 nt, Human
uacacauuuuauuuuauuaugca

SEQ ID NO: 3125025 - RNA, 21 nt, Human
uacaagcgugagccacugcac

SEQ ID NO: 3125026 - RNA, 13 nt, Human
aaugcccagcccc

SEQ ID NO: 3125027 - RNA, 15 nt, Human
aaugcccagccccuu

SEQ ID NO: 3125028 - RNA, 14 nt, Human
aaugcccagccccu

SEQ ID NO: 3125029 - RNA, 18 nt, Human
aauggaagacagcucuua

SEQ ID NO: 3125030 - RNA, 16 nt, Human
aauggacguguuauga

SEQ ID NO: 3125031 - RNA, 13 nt, Human
aaugcugugcccu

SEQ ID NO: 3125032 - RNA, 20 nt, Human
aaugcugugcccuaaagugu

SEQ ID NO: 3125033 - RNA, 21 nt, Human
aaugcugugcccuaaagugua

SEQ ID NO: 3125034 - RNA, 24 nt, Human
aaugcccagccccuucugacccau

SEQ ID NO: 3125035 - RNA, 23 nt, Human
aaugcccagccccuucugaccca

SEQ ID NO: 3125036 - RNA, 22 nt, Human
aaugcccagccccuucugaccc

SEQ ID NO: 3125037 - RNA, 20 nt, Human
aaugcccagccccuucugac

SEQ ID NO: 3125038 - RNA, 15 nt, Human
uacaaaagcauguga

SEQ ID NO: 3125039 - RNA, 20 nt, Human
uacaaaaagcauaaaaauua

SEQ ID NO: 3125040 - RNA, 15 nt, Human
uacaaaaagcauaaa

SEQ ID NO: 3125041 - RNA, 14 nt, Human
aaugagccuggcaa

SEQ ID NO: 3125042 - RNA, 17 nt, Human
aaaacacauuuuucuua

SEQ ID NO: 3125043 - RNA, 19 nt, Human
aaaacacuguucucugccc

SEQ ID NO: 3125044 - RNA, 11 nt, Human
aaaagaaaaag

SEQ ID NO: 3125045 - RNA, 21 nt, Human
aaaaucagccugcuccagcug

SEQ ID NO: 3125046 - RNA, 17 nt, Human
aaaaucagccugcucca

SEQ ID NO: 3125047 - RNA, 13 nt, Human
aaaaucagccugc

SEQ ID NO: 3125048 - RNA, 14 nt, Human
aaaauaaaacuuuu

SEQ ID NO: 3125049 - RNA, 23 nt, Human
aaacugauuuuuuuuuccuucag

SEQ ID NO: 3125050 - RNA, 22 nt, Human
aaacugauuuuuuuuuccuuca

SEQ ID NO: 3125051 - RNA, 23 nt, Human
aaacucuuaaaacccaagugccu

SEQ ID NO: 3125052 - RNA, 12 nt, Human
aaacucuuaaaa

SEQ ID NO: 3125053 - RNA, 16 nt, Human
aaacccagcucugguc

SEQ ID NO: 3125054 - RNA, 12 nt, Human
aaacccagcucu

SEQ ID NO: 3125055 - RNA, 16 nt, Human
aaaccgccaaggcugg

SEQ ID NO: 3125056 - RNA, 15 nt, Human
aaaccgccaaggcug

SEQ ID NO: 3125057 - RNA, 15 nt, Human
aaaaucucaaauuuc

SEQ ID NO: 3125058 - RNA, 16 nt, Human
aaaaucucaaauuucu

SEQ ID NO: 3125059 - RNA, 18 nt, Human
aaaaucucaaauuucuaa

SEQ ID NO: 3125060 - RNA, 20 nt, Human
aaagauauuuugcuuuguga

SEQ ID NO: 3125061 - RNA, 16 nt, Human
aaagccuccuccagcc

SEQ ID NO: 3125062 - RNA, 23 nt, Human
aaauucuucuccacuuucuagcc

SEQ ID NO: 3125063 - RNA, 15 nt, Human
aaauucuugcaaagu

SEQ ID NO: 3125064 - RNA, 11 nt, Human
aacaggcagau

SEQ ID NO: 3125065 - RNA, 23 nt, Human
aaccuuuugagugccuuacacaa

SEQ ID NO: 3125066 - RNA, 16 nt, Human
aaccuuuugagugccu

SEQ ID NO: 3125067 - RNA, 20 nt, Human
aaaggaugcccaaagaugca

SEQ ID NO: 3125068 - RNA, 14 nt, Human
aaaggaugcacaga

SEQ ID NO: 3125069 - RNA, 14 nt, Human
aaaucuuuuugcuu

SEQ ID NO: 3125070 - RNA, 13 nt, Human
aaaucuuuuugcu

SEQ ID NO: 3125071 - RNA, 19 nt, Human
aaaucucaaauuucuaaau

SEQ ID NO: 3125072 - RNA, 15 nt, Human
aaggcaaggcuguca

SEQ ID NO: 3125073 - RNA, 13 nt, Human
aaggcaaggcugu

SEQ ID NO: 3125074 - RNA, 19 nt, Human
aagcugcacccucaggcag

SEQ ID NO: 3125075 - RNA, 13 nt, Human
aagcugcacccuc

SEQ ID NO: 3125076 - RNA, 14 nt, Human
aagauaaaugugcu

SEQ ID NO: 3125077 - RNA, 21 nt, Human
aagauaauauuaaggaagaca

SEQ ID NO: 3125078 - RNA, 19 nt, Human
aagauaauauuaaggaaga

SEQ ID NO: 3125079 - RNA, 17 nt, Human
aagauacaguuacucag

SEQ ID NO: 3125080 - RNA, 14 nt, Human
aagcggcuggcagc

SEQ ID NO: 3125081 - RNA, 15 nt, Human
aagcgugagccacug

SEQ ID NO: 3125082 - RNA, 15 nt, Human
aagaccacguuucua

SEQ ID NO: 3125083 - RNA, 17 nt, Human
aagaccacguuucuaaa

SEQ ID NO: 3125084 - RNA, 12 nt, Human
aagacuuuucuu

SEQ ID NO: 3125085 - RNA, 21 nt, Human
aagacuuuuccaacccucauc

SEQ ID NO: 3125086 - RNA, 19 nt, Human
aagacuuuucuuucagcca

SEQ ID NO: 3125087 - RNA, 13 nt, Human
aagagaaaaaaua

SEQ ID NO: 3125088 - RNA, 17 nt, Human
aagacuuuuccaacccu

SEQ ID NO: 3125089 - RNA, 22 nt, Human
aagacaaugacuuacuguacau

SEQ ID NO: 3125090 - RNA, 19 nt, Human
aagacaaugugaaaagaaa

SEQ ID NO: 3125091 - RNA, 20 nt, Human
aagacaaugugaaaagaaaa

SEQ ID NO: 3125092 - RNA, 20 nt, Human
aagaguaggaagacuuugga

SEQ ID NO: 3125093 - RNA, 17 nt, Human
aauaaugugaaacugga

SEQ ID NO: 3125094 - RNA, 22 nt, Human
aauaaugugaaacuggauuaaa

SEQ ID NO: 3125095 - RNA, 14 nt, Human
aauaaagcagcguu

SEQ ID NO: 3125096 - RNA, 16 nt, Human
aauaaugugaaacugg

SEQ ID NO: 3125097 - RNA, 12 nt, Human
aagugcugggau

SEQ ID NO: 3125098 - RNA, 14 nt, Human
aagugcugcauuua

SEQ ID NO: 3125099 - RNA, 22 nt, Human
aagugcugcauuuaaaagauac

SEQ ID NO: 3125100 - RNA, 21 nt, Human
aaucaccgaaaacguggcugc

SEQ ID NO: 3125101 - RNA, 23 nt, Human
aaucaccgaaaacguggcugcuu

SEQ ID NO: 3125102 - RNA, 15 nt, Human
aaucaccgaaaacgu

SEQ ID NO: 3125103 - RNA, 23 nt, Human
aauauguggaguucaucuugaau

SEQ ID NO: 3125104 - RNA, 13 nt, Human
aauauuaagaaag

SEQ ID NO: 3125105 - RNA, 20 nt, Human
aaugaugccaugaggaacaa

SEQ ID NO: 3125106 - RNA, 21 nt, Human
aaugaaagacuguacaaagua

SEQ ID NO: 3125107 - RNA, 18 nt, Human
aaugaaagacuguacaaa

SEQ ID NO: 3125108 - RNA, 20 nt, Human
aaugaaagacuguacaaagu

SEQ ID NO: 3125109 - RNA, 23 nt, Human
acugaugggcaacccccagccug

SEQ ID NO: 3125110 - RNA, 16 nt, Human
acugauuuuuuuuucc

SEQ ID NO: 3125111 - RNA, 20 nt, Human
acugauuuuuuuuuccuuca

SEQ ID NO: 3125112 - RNA, 19 nt, Human
acugauuuuuuuuuccuuc

SEQ ID NO: 3125113 - RNA, 18 nt, Human
acugauuuuuuuuuccuu

SEQ ID NO: 3125114 - RNA, 17 nt, Human
acugauuuuuuuuuccu

SEQ ID NO: 3125115 - RNA, 12 nt, Human
acugaauuucuu

SEQ ID NO: 3125116 - RNA, 23 nt, Human
acugaauuucuuuugccguuauu

SEQ ID NO: 3125117 - RNA, 17 nt, Human
acugacauuguuggcca

SEQ ID NO: 3125118 - RNA, 18 nt, Human
acugacauuguuggccaa

SEQ ID NO: 3125119 - RNA, 15 nt, Human
acucuacagaggcca

SEQ ID NO: 3125120 - RNA, 22 nt, Human
acucccaucugugaaaggaaag

SEQ ID NO: 3125121 - RNA, 14 nt, Human
acugccaugccagc

SEQ ID NO: 3125122 - RNA, 17 nt, Human
acugugccaugugccag

SEQ ID NO: 3125123 - RNA, 18 nt, Human
acugugccaugugccagg

SEQ ID NO: 3125124 - RNA, 16 nt, Human
acugugccaugugcca

SEQ ID NO: 3125125 - RNA, 19 nt, Human
acuguuucaaacuuuacua

SEQ ID NO: 3125126 - RNA, 13 nt, Human
acuguuucaaacu

SEQ ID NO: 3125127 - RNA, 15 nt, Human
acuguuucaaacuuu

SEQ ID NO: 3125128 - RNA, 18 nt, Human
acuguuucaaacuuuacu

SEQ ID NO: 3125129 - RNA, 23 nt, Human
acuuggggggcugaggugggagg

SEQ ID NO: 3125130 - RNA, 20 nt, Human
acgauuucuguuuagauaau

SEQ ID NO: 3125131 - RNA, 23 nt, Human
acgauuucuguuuagauaauaca

SEQ ID NO: 3125132 - RNA, 19 nt, Human
acgauuucuguuuagauaa

SEQ ID NO: 3125133 - RNA, 17 nt, Human
acggacacucaaaagcu

SEQ ID NO: 3125134 - RNA, 19 nt, Human
acggaauaguuggcuagga

SEQ ID NO: 3125135 - RNA, 15 nt, Human
acggaauaguuggcu

SEQ ID NO: 3125136 - RNA, 13 nt, Human
acgucugugccau

SEQ ID NO: 3125137 - RNA, 12 nt, Human
acgucugugcca

SEQ ID NO: 3125138 - RNA, 19 nt, Human
acgcugugcugcccugccc

SEQ ID NO: 3125139 - RNA, 22 nt, Human
acgcugugcugcccugcccacc

SEQ ID NO: 3125140 - RNA, 18 nt, Human
acuaauggggcggugaga

SEQ ID NO: 3125141 - RNA, 15 nt, Human
accugccccucaacu

SEQ ID NO: 3125142 - RNA, 12 nt, Human
accugccccuca

SEQ ID NO: 3125143 - RNA, 22 nt, Human
accugccaggaagccagcaggc

SEQ ID NO: 3125144 - RNA, 21 nt, Human
accugccaggaagccagcagg

SEQ ID NO: 3125145 - RNA, 23 nt, Human
accugccaggaagccagcaggcu

SEQ ID NO: 3125146 - RNA, 19 nt, Human
accugccaggaagccagca

SEQ ID NO: 3125147 - RNA, 20 nt, Human
accucugccugaagucacac

SEQ ID NO: 3125148 - RNA, 12 nt, Human
accucugccuga

SEQ ID NO: 3125149 - RNA, 13 nt, Human
acccuauugcugc

SEQ ID NO: 3125150 - RNA, 19 nt, Human
acccuauugcugcuugagg

SEQ ID NO: 3125151 - RNA, 14 nt, Human
acccuauugcugcu

SEQ ID NO: 3125152 - RNA, 16 nt, Human
acccuggggagaaagu

SEQ ID NO: 3125153 - RNA, 16 nt, Human
acccugugauggggcc

SEQ ID NO: 3125154 - RNA, 14 nt, Human
acccucaggcaggu

SEQ ID NO: 3125155 - RNA, 13 nt, Human
acccucaggcagg

SEQ ID NO: 3125156 - RNA, 13 nt, Human
acccucaucacca

SEQ ID NO: 3125157 - RNA, 16 nt, Human
acccucaggcaggugg

SEQ ID NO: 3125158 - RNA, 15 nt, Human
acccucaggcaggug

SEQ ID NO: 3125159 - RNA, 23 nt, Human
acccuggcacuauaauguaagcu

SEQ ID NO: 3125160 - RNA, 23 nt, Human
acccucaucaccaacgucugugc

SEQ ID NO: 3125161 - RNA, 11 nt, Human
accucaggccu

SEQ ID NO: 3125162 - RNA, 20 nt, Human
accucaggugauccacccac

SEQ ID NO: 3125163 - RNA, 21 nt, Human
accucaggugauccacccacc

SEQ ID NO: 3125164 - RNA, 12 nt, Human
accgggcacuca

SEQ ID NO: 3125165 - RNA, 14 nt, Human
accgggcacucaga

SEQ ID NO: 3125166 - RNA, 20 nt, Human
accgggccacagagaaagua

SEQ ID NO: 3125167 - RNA, 16 nt, Human
accgggcacucagaag

SEQ ID NO: 3125168 - RNA, 21 nt, Human
acccugugauggggcccugcc

SEQ ID NO: 3125169 - RNA, 20 nt, Human
acccugugauggggcccugc

SEQ ID NO: 3125170 - RNA, 19 nt, Human
acccugugauggggcccug

SEQ ID NO: 3125171 - RNA, 17 nt, Human
acccugugauggggccc

SEQ ID NO: 3125172 - RNA, 23 nt, Human
accgugaggccagagacacaagc

SEQ ID NO: 3125173 - RNA, 12 nt, Human
accucagccucc

SEQ ID NO: 3125174 - RNA, 11 nt, Human
accucagccuc

SEQ ID NO: 3125175 - RNA, 18 nt, Human
accgugaggccagagaca

SEQ ID NO: 3125176 - RNA, 19 nt, Human
accggcuggccuggccccu

SEQ ID NO: 3125177 - RNA, 23 nt, Human
acaggcacccaccaucaugucug

SEQ ID NO: 3125178 - RNA, 19 nt, Human
acagcucuucuccaggcug

SEQ ID NO: 3125179 - RNA, 20 nt, Human
acagcucuucuccaggcugu

SEQ ID NO: 3125180 - RNA, 18 nt, Human
acagcucuucuccaggcu

SEQ ID NO: 3125181 - RNA, 15 nt, Human
acaggcaaugcuggc

SEQ ID NO: 3125182 - RNA, 16 nt, Human
acaggcaaugcuggcu

SEQ ID NO: 3125183 - RNA, 14 nt, Human
acaggcacccacca

SEQ ID NO: 3125184 - RNA, 17 nt, Human
acaggcaaugcuggcug

SEQ ID NO: 3125185 - RNA, 14 nt, Human
acaggcaaugcugg

SEQ ID NO: 3125186 - RNA, 23 nt, Human
acaugcacagcuaacauggaagu

SEQ ID NO: 3125187 - RNA, 13 nt, Human
acaugcacgugug

SEQ ID NO: 3125188 - RNA, 20 nt, Human
acaugccucucucaggccaa

SEQ ID NO: 3125189 - RNA, 20 nt, Human
acauacaggaagguagaaau

SEQ ID NO: 3125190 - RNA, 16 nt, Human
acauacaauuccaaac

SEQ ID NO: 3125191 - RNA, 12 nt, Human
accagagcugcc

SEQ ID NO: 3125192 - RNA, 13 nt, Human
accagagcugcca

SEQ ID NO: 3125193 - RNA, 16 nt, Human
accagagcugccaccu

SEQ ID NO: 3125194 - RNA, 14 nt, Human
accagagcugccac

SEQ ID NO: 3125195 - RNA, 17 nt, Human
accaacgucugugccau

SEQ ID NO: 3125196 - RNA, 14 nt, Human
accaacgucugugc

SEQ ID NO: 3125197 - RNA, 13 nt, Human
accacguuucuaa

SEQ ID NO: 3125198 - RNA, 14 nt, Human
accacguuucuaaa

SEQ ID NO: 3125199 - RNA, 18 nt, Human
accacgcuggaccuugaa

SEQ ID NO: 3125200 - RNA, 14 nt, Human
accacgcuggaccu

SEQ ID NO: 3125201 - RNA, 16 nt, Human
accacgcuggaccuug

SEQ ID NO: 3125202 - RNA, 12 nt, Human
accaagcccagu

SEQ ID NO: 3125203 - RNA, 15 nt, Human
acaaguuaaauaaau

SEQ ID NO: 3125204 - RNA, 15 nt, Human
acaaggcaaggcugu

SEQ ID NO: 3125205 - RNA, 19 nt, Human
acaaggcaaggcugucaau

SEQ ID NO: 3125206 - RNA, 17 nt, Human
acaaggcaaggcuguca

SEQ ID NO: 3125207 - RNA, 16 nt, Human
acaaggcaaggcuguc

SEQ ID NO: 3125208 - RNA, 18 nt, Human
acacagcucuucuccagg

SEQ ID NO: 3125209 - RNA, 18 nt, Human
acaccagagcccaccuug

SEQ ID NO: 3125210 - RNA, 23 nt, Human
acaccagagcccaccuuggcuca

SEQ ID NO: 3125211 - RNA, 13 nt, Human
acaccagagccca

SEQ ID NO: 3125212 - RNA, 14 nt, Human
acacagcucuucuc

SEQ ID NO: 3125213 - RNA, 16 nt, Human
acacagcucuucucca

SEQ ID NO: 3125214 - RNA, 17 nt, Human
aauuucccaaagcagug

SEQ ID NO: 3125215 - RNA, 15 nt, Human
aauuucccaaagcag

SEQ ID NO: 3125216 - RNA, 22 nt, Human
aauuguaaggaaugauuaauua

SEQ ID NO: 3125217 - RNA, 16 nt, Human
aauuguaaggaaugau

SEQ ID NO: 3125218 - RNA, 18 nt, Human
aauucuguuuuucuaggc

SEQ ID NO: 3125219 - RNA, 14 nt, Human
aauucuguuuuucu

SEQ ID NO: 3125220 - RNA, 21 nt, Human
aauucucauuugucacacacu

SEQ ID NO: 3125221 - RNA, 15 nt, Human
aauucucuuauccaa

SEQ ID NO: 3125222 - RNA, 15 nt, Human
aauucucuaguuuga

SEQ ID NO: 3125223 - RNA, 17 nt, Human
aauucucuaguuugauu

SEQ ID NO: 3125224 - RNA, 14 nt, Human
aauucuacuuugag

SEQ ID NO: 3125225 - RNA, 19 nt, Human
aauucucagaaucucaaau

SEQ ID NO: 3125226 - RNA, 19 nt, Human
aauuaugaguuauuuuuau

SEQ ID NO: 3125227 - RNA, 14 nt, Human
agaagucacacagu

SEQ ID NO: 3125228 - RNA, 17 nt, Human
agaagucuuagauguau

SEQ ID NO: 3125229 - RNA, 19 nt, Human
agaagucuuagauguauau

SEQ ID NO: 3125230 - RNA, 15 nt, Human
agaagagaaugcaca

SEQ ID NO: 3125231 - RNA, 21 nt, Human
agaaccaaaaagaggcuaugu

SEQ ID NO: 3125232 - RNA, 17 nt, Human
agaaucucaaauaacua

SEQ ID NO: 3125233 - RNA, 18 nt, Human
agaaugcucuuuacuuca

SEQ ID NO: 3125234 - RNA, 22 nt, Human
agaaugcacaaacagaggccgc

SEQ ID NO: 3125235 - RNA, 23 nt, Human
agaaugcacaaacagaggccgcc

SEQ ID NO: 3125236 - RNA, 18 nt, Human
agaaccaaaaagaggcua

SEQ ID NO: 3125237 - RNA, 17 nt, Human
agaaccaaaaagaggcu

SEQ ID NO: 3125238 - RNA, 16 nt, Human
agacucuuuggacacu

SEQ ID NO: 3125239 - RNA, 18 nt, Human
agagaaaguacuucucca

SEQ ID NO: 3125240 - RNA, 17 nt, Human
agagcccacgcccccac

SEQ ID NO: 3125241 - RNA, 19 nt, Human
agagagcaagacgcugugc

SEQ ID NO: 3125242 - RNA, 11 nt, Human
agagagcaaga

SEQ ID NO: 3125243 - RNA, 18 nt, Human
agagcccacgcccccacu

SEQ ID NO: 3125244 - RNA, 20 nt, Human
agacaaugugaaaagaaaaa

SEQ ID NO: 3125245 - RNA, 23 nt, Human
agacaaugacuuacuguacauga

SEQ ID NO: 3125246 - RNA, 17 nt, Human
agacgcugugcugcccu

SEQ ID NO: 3125247 - RNA, 19 nt, Human
agacgcugugcugcccugc

SEQ ID NO: 3125248 - RNA, 18 nt, Human
agacgcugugcugcccug

SEQ ID NO: 3125249 - RNA, 23 nt, Human
agacagcccgggcucugccuccc

SEQ ID NO: 3125250 - RNA, 22 nt, Human
agacagcccgggcucugccucc

SEQ ID NO: 3125251 - RNA, 21 nt, Human
agacagcccgggcucugccuc

SEQ ID NO: 3125252 - RNA, 23 nt, Human
agaccaucccugaaggccccgcc

SEQ ID NO: 3125253 - RNA, 14 nt, Human
agaccacguuucua

SEQ ID NO: 3125254 - RNA, 21 nt, Human
agcacagacccugcccugugg

SEQ ID NO: 3125255 - RNA, 20 nt, Human
agcacuaaggugugcucuga

SEQ ID NO: 3125256 - RNA, 20 nt, Human
agcagccuggacccugugga

SEQ ID NO: 3125257 - RNA, 18 nt, Human
agcagcguuucuaugaca

SEQ ID NO: 3125258 - RNA, 19 nt, Human
agcagcguuucuaugacac

SEQ ID NO: 3125259 - RNA, 16 nt, Human
agcagugcaugcuguc

SEQ ID NO: 3125260 - RNA, 13 nt, Human
agcagugcaugcu

SEQ ID NO: 3125261 - RNA, 16 nt, Human
agcagccuggacccug

SEQ ID NO: 3125262 - RNA, 17 nt, Human
agcagugcaugcugucc

SEQ ID NO: 3125263 - RNA, 16 nt, Human
agcaucuaugugagac

SEQ ID NO: 3125264 - RNA, 13 nt, Human
agcccaccuuggc

SEQ ID NO: 3125265 - RNA, 23 nt, Human
agcccaccccucaacaccucugc

SEQ ID NO: 3125266 - RNA, 19 nt, Human
agcccacgcccccacuggu

SEQ ID NO: 3125267 - RNA, 15 nt, Human
agcccacgcccccac

SEQ ID NO: 3125268 - RNA, 18 nt, Human
agcccacgcccccacugg

SEQ ID NO: 3125269 - RNA, 17 nt, Human
agcccacgcccccacug

SEQ ID NO: 3125270 - RNA, 23 nt, Human
agccagcaggcucucaggccagc

SEQ ID NO: 3125271 - RNA, 21 nt, Human
agccagcaggcucucaggcca

SEQ ID NO: 3125272 - RNA, 22 nt, Human
agccagcaggcucucaggccag

SEQ ID NO: 3125273 - RNA, 20 nt, Human
agccagauuucacucuccuu

SEQ ID NO: 3125274 - RNA, 17 nt, Human
agccagauuucacucuc

SEQ ID NO: 3125275 - RNA, 14 nt, Human
agccagauuucacu

SEQ ID NO: 3125276 - RNA, 15 nt, Human
agaguugaagacaga

SEQ ID NO: 3125277 - RNA, 14 nt, Human
agaguugaagacag

SEQ ID NO: 3125278 - RNA, 13 nt, Human
agaguugaagaca

SEQ ID NO: 3125279 - RNA, 20 nt, Human
agauagccaaggccaaagga

SEQ ID NO: 3125280 - RNA, 23 nt, Human
agaggggguggccucccaacuca

SEQ ID NO: 3125281 - RNA, 20 nt, Human
agagggucugaggaauccag

SEQ ID NO: 3125282 - RNA, 14 nt, Human
agauucuuuccuga

SEQ ID NO: 3125283 - RNA, 22 nt, Human
agaugggugcuuggaggaagga

SEQ ID NO: 3125284 - RNA, 20 nt, Human
agaugggugcuuggaggaag

SEQ ID NO: 3125285 - RNA, 18 nt, Human
agaugacaucugucuagg

SEQ ID NO: 3125286 - RNA, 18 nt, Human
agaucucuaacuucacca

SEQ ID NO: 3125287 - RNA, 16 nt, Human
agauucuuuccugagg

SEQ ID NO: 3125288 - RNA, 15 nt, Human
agauucuuuccugag

SEQ ID NO: 3125289 - RNA, 16 nt, Human
agauugcaacaggcug

SEQ ID NO: 3125290 - RNA, 17 nt, Human
agauugcaacaggcugg

SEQ ID NO: 3125291 - RNA, 16 nt, Human
agauugcaccacugca

SEQ ID NO: 3125292 - RNA, 19 nt, Human
agcaaauucuguuuuucua

SEQ ID NO: 3125293 - RNA, 20 nt, Human
aggcccucugcccacucccu

SEQ ID NO: 3125294 - RNA, 19 nt, Human
aggcccucugcccacuccc

SEQ ID NO: 3125295 - RNA, 23 nt, Human
aggcuguaucccaugagccucag

SEQ ID NO: 3125296 - RNA, 19 nt, Human
aggcugcagugagccgaga

SEQ ID NO: 3125297 - RNA, 17 nt, Human
aggcugcagugagccga

SEQ ID NO: 3125298 - RNA, 12 nt, Human
aggcugucaauu

SEQ ID NO: 3125299 - RNA, 24 nt, Human
aggcuguaucccaugagccucagc

SEQ ID NO: 3125300 - RNA, 18 nt, Human
agggccuggcucaggugg

SEQ ID NO: 3125301 - RNA, 14 nt, Human
agggccuggcucag

SEQ ID NO: 3125302 - RNA, 13 nt, Human
agggccuggcuca

SEQ ID NO: 3125303 - RNA, 18 nt, Human
agggccuggccugagcug

SEQ ID NO: 3125304 - RNA, 12 nt, Human
aggccagcugcu

SEQ ID NO: 3125305 - RNA, 23 nt, Human
aggcauuccccaggaggccagcc

SEQ ID NO: 3125306 - RNA, 22 nt, Human
aggcauuccccaggaggccagc

SEQ ID NO: 3125307 - RNA, 21 nt, Human
aggcauuccccaggaggccag

SEQ ID NO: 3125308 - RNA, 20 nt, Human
aggcauguucucugaggaca

SEQ ID NO: 3125309 - RNA, 22 nt, Human
aggcauguucucugaggacacu

SEQ ID NO: 3125310 - RNA, 24 nt, Human
aggcaugugaugagaggaaaucac

SEQ ID NO: 3125311 - RNA, 23 nt, Human
aggcaugugaugagaggaaauca

SEQ ID NO: 3125312 - RNA, 23 nt, Human
aggccaggcccucugcccacucc

SEQ ID NO: 3125313 - RNA, 19 nt, Human
aggccaggcccucugccca

SEQ ID NO: 3125314 - RNA, 18 nt, Human
aggccaggcccucugccc

SEQ ID NO: 3125315 - RNA, 17 nt, Human
aggccaggcccucugcc

SEQ ID NO: 3125316 - RNA, 16 nt, Human
aggccaggcccucugc

SEQ ID NO: 3125317 - RNA, 16 nt, Human
aggccagcugcuuggg

SEQ ID NO: 3125318 - RNA, 14 nt, Human
aggccagcugcuug

SEQ ID NO: 3125319 - RNA, 13 nt, Human
aggccagcugcuu

SEQ ID NO: 3125320 - RNA, 14 nt, Human
aggccaugggccuc

SEQ ID NO: 3125321 - RNA, 16 nt, Human
aggccaugggccuccu

SEQ ID NO: 3125322 - RNA, 15 nt, Human
aggcccucugcccac

SEQ ID NO: 3125323 - RNA, 17 nt, Human
aggcccucugcccacuc

SEQ ID NO: 3125324 - RNA, 14 nt, Human
aggcagccaggcca

SEQ ID NO: 3125325 - RNA, 16 nt, Human
aggcagccaggccaca

SEQ ID NO: 3125326 - RNA, 15 nt, Human
aggcagccaggccac

SEQ ID NO: 3125327 - RNA, 13 nt, Human
aggcagauacagg

SEQ ID NO: 3125328 - RNA, 19 nt, Human
aggaaguacuggagaaaau

SEQ ID NO: 3125329 - RNA, 14 nt, Human
aggaggucucuaag

SEQ ID NO: 3125330 - RNA, 15 nt, Human
aggaggucucuaaga

SEQ ID NO: 3125331 - RNA, 12 nt, Human
aggagugagcac

SEQ ID NO: 3125332 - RNA, 14 nt, Human
aggagugagcacua

SEQ ID NO: 3125333 - RNA, 13 nt, Human
agcucaccagccc

SEQ ID NO: 3125334 - RNA, 14 nt, Human
agcucaccagcccc

SEQ ID NO: 3125335 - RNA, 21 nt, Human
agcucaccagccccagugccc

SEQ ID NO: 3125336 - RNA, 13 nt, Human
agcuaaugggaca

SEQ ID NO: 3125337 - RNA, 14 nt, Human
agcuaaugggacac

SEQ ID NO: 3125338 - RNA, 15 nt, Human
agcuaaugggacacu

SEQ ID NO: 3125339 - RNA, 20 nt, Human
agcuaacauggaaguacuau

SEQ ID NO: 3125340 - RNA, 19 nt, Human
agcuaacauggaaguacua

SEQ ID NO: 3125341 - RNA, 17 nt, Human
agcgauucuucugcuuc

SEQ ID NO: 3125342 - RNA, 19 nt, Human
agcgauucuucugcuucag

SEQ ID NO: 3125343 - RNA, 15 nt, Human
agcgauucuucugcu

SEQ ID NO: 3125344 - RNA, 20 nt, Human
agccugggaggucaaggcug

SEQ ID NO: 3125345 - RNA, 18 nt, Human
agccugggcaaugugaua

SEQ ID NO: 3125346 - RNA, 14 nt, Human
agccuggacccugu

SEQ ID NO: 3125347 - RNA, 22 nt, Human
agcucaccagccccagugccca

SEQ ID NO: 3125348 - RNA, 23 nt, Human
agcucaccagccccagugcccac

SEQ ID NO: 3125349 - RNA, 21 nt, Human
agcugacuuuucuguccgagc

SEQ ID NO: 3125350 - RNA, 15 nt, Human
agcugacuuuucugu

SEQ ID NO: 3125351 - RNA, 15 nt, Human
agcuggucccacuca

SEQ ID NO: 3125352 - RNA, 22 nt, Human
agcugccuguucagcuccagcu

SEQ ID NO: 3125353 - RNA, 15 nt, Human
aggaaguacuggaga

SEQ ID NO: 3125354 - RNA, 11 nt, Human
aggaaguacug

SEQ ID NO: 3125355 - RNA, 14 nt, Human
aggaagguagaaau

SEQ ID NO: 3125356 - RNA, 23 nt, Human
aggaacaaggcaaggcugucaau

SEQ ID NO: 3125357 - RNA, 12 nt, Human
aggaacacuccu

SEQ ID NO: 3125358 - RNA, 23 nt, Human
aggaacuuaaauaaugugaaacu

SEQ ID NO: 3125359 - RNA, 15 nt, Human
aggaacacuccuuca

SEQ ID NO: 3125360 - RNA, 21 nt, Human
agcuuuguuuguugucagcug

SEQ ID NO: 3125361 - RNA, 21 nt, Human
augccugguggcagcugcggu

SEQ ID NO: 3125362 - RNA, 11 nt, Human
augccuggugg

SEQ ID NO: 3125363 - RNA, 12 nt, Human
augccugguggc

SEQ ID NO: 3125364 - RNA, 13 nt, Human
augccugguggca

SEQ ID NO: 3125365 - RNA, 19 nt, Human
augccugguggcagcugcg

SEQ ID NO: 3125366 - RNA, 18 nt, Human
augccugguggcagcugc

SEQ ID NO: 3125367 - RNA, 18 nt, Human
auggcuuuugugcauuau

SEQ ID NO: 3125368 - RNA, 21 nt, Human
augggaaugaaugucagugug

SEQ ID NO: 3125369 - RNA, 15 nt, Human
augcucugcauguua

SEQ ID NO: 3125370 - RNA, 18 nt, Human
augcucugcauguuacau

SEQ ID NO: 3125371 - RNA, 19 nt, Human
augcucugcauguuacaua

SEQ ID NO: 3125372 - RNA, 20 nt, Human
augcuucuucagagacuccu

SEQ ID NO: 3125373 - RNA, 17 nt, Human
augcuucuucagagacu

SEQ ID NO: 3125374 - RNA, 14 nt, Human
augcuucuucagag

SEQ ID NO: 3125375 - RNA, 16 nt, Human
augcuuugaucccuuc

SEQ ID NO: 3125376 - RNA, 23 nt, Human
aucuaggaagacuuuggaaagag

SEQ ID NO: 3125377 - RNA, 23 nt, Human
augaaguaauaugcacacauuuu

SEQ ID NO: 3125378 - RNA, 14 nt, Human
augaaguaauaugc

SEQ ID NO: 3125379 - RNA, 21 nt, Human
augaaguaauaugcacacauu

SEQ ID NO: 3125380 - RNA, 23 nt, Human
augaagcauuuacuuuguguuca

SEQ ID NO: 3125381 - RNA, 12 nt, Human
augaaagacugu

SEQ ID NO: 3125382 - RNA, 21 nt, Human
augagccucagcauccuggca

SEQ ID NO: 3125383 - RNA, 19 nt, Human
augagccucagcauccugg

SEQ ID NO: 3125384 - RNA, 11 nt, Human
augagccuggc

SEQ ID NO: 3125385 - RNA, 13 nt, Human
augaccuuucaau

SEQ ID NO: 3125386 - RNA, 15 nt, Human
augaccuuucaauag

SEQ ID NO: 3125387 - RNA, 22 nt, Human
augaggcauuuguuugaacuga

SEQ ID NO: 3125388 - RNA, 22 nt, Human
aucuaggaagacuuuggaaaga

SEQ ID NO: 3125389 - RNA, 20 nt, Human
aucaugacaaagacugagua

SEQ ID NO: 3125390 - RNA, 15 nt, Human
aucauccuaagcuau

SEQ ID NO: 3125391 - RNA, 21 nt, Human
auccacugugccaugugccag

SEQ ID NO: 3125392 - RNA, 14 nt, Human
auagcacagacccu

SEQ ID NO: 3125393 - RNA, 18 nt, Human
auauuuuuuucuuuucuu

SEQ ID NO: 3125394 - RNA, 20 nt, Human
aucaaaagguuaauaaagua

SEQ ID NO: 3125395 - RNA, 19 nt, Human
aucaaagagguuuuaaaaa

SEQ ID NO: 3125396 - RNA, 11 nt, Human
aguuugcaguu

SEQ ID NO: 3125397 - RNA, 14 nt, Human
aguuugauuaaauu

SEQ ID NO: 3125398 - RNA, 17 nt, Human
aguugaaaaacagcuga

SEQ ID NO: 3125399 - RNA, 17 nt, Human
aguugaagacagagcua

SEQ ID NO: 3125400 - RNA, 16 nt, Human
aguugaagacagagcu

SEQ ID NO: 3125401 - RNA, 18 nt, Human
aguugaaaaacagcugag

SEQ ID NO: 3125402 - RNA, 21 nt, Human
aguuccaccaucaagccacca

SEQ ID NO: 3125403 - RNA, 18 nt, Human
aguuccaccaucaagcca

SEQ ID NO: 3125404 - RNA, 14 nt, Human
aguucauacccugu

SEQ ID NO: 3125405 - RNA, 22 nt, Human
aguuguuagugugucuuagugu

SEQ ID NO: 3125406 - RNA, 17 nt, Human
aguuguuagugugucuu

SEQ ID NO: 3125407 - RNA, 17 nt, Human
auacaccacuacauucu

SEQ ID NO: 3125408 - RNA, 21 nt, Human
auaaagaugagugagcaugcc

SEQ ID NO: 3125409 - RNA, 12 nt, Human
auaauguuaaca

SEQ ID NO: 3125410 - RNA, 23 nt, Human
auacaaugcugugcccuaaagug

SEQ ID NO: 3125411 - RNA, 17 nt, Human
auacaaugcugugcccu

SEQ ID NO: 3125412 - RNA, 15 nt, Human
auacaccacuacauu

SEQ ID NO: 3125413 - RNA, 17 nt, Human
aguaacuuacuuaggug

SEQ ID NO: 3125414 - RNA, 21 nt, Human
aguaaaugggggugcauuuga

SEQ ID NO: 3125415 - RNA, 19 nt, Human
aguaaaugggggugcauuu

SEQ ID NO: 3125416 - RNA, 20 nt, Human
aguaaaugggggugcauuug

SEQ ID NO: 3125417 - RNA, 18 nt, Human
aguaaaugggggugcauu

SEQ ID NO: 3125418 - RNA, 15 nt, Human
aguacuggagaaaau

SEQ ID NO: 3125419 - RNA, 20 nt, Human
aguacuucuccacccugcuc

SEQ ID NO: 3125420 - RNA, 19 nt, Human
aguacuucuccacccugcu

SEQ ID NO: 3125421 - RNA, 21 nt, Human
aguacuucuccacccugcucu

SEQ ID NO: 3125422 - RNA, 18 nt, Human
agucuggcccuuccuuuu

SEQ ID NO: 3125423 - RNA, 21 nt, Human
agucugauucccaagcucugc

SEQ ID NO: 3125424 - RNA, 22 nt, Human
agucugauucccaagcucugcu

SEQ ID NO: 3125425 - RNA, 20 nt, Human
agucugauucccaagcucug

SEQ ID NO: 3125426 - RNA, 18 nt, Human
agucuggaaugcaguggu

SEQ ID NO: 3125427 - RNA, 16 nt, Human
agucgaggacagggag

SEQ ID NO: 3125428 - RNA, 14 nt, Human
aguccucuuuucug

SEQ ID NO: 3125429 - RNA, 18 nt, Human
aguccuuaccagcagagc

SEQ ID NO: 3125430 - RNA, 16 nt, Human
aguccuuaccagcaga

SEQ ID NO: 3125431 - RNA, 19 nt, Human
agugauccucccaccucag

SEQ ID NO: 3125432 - RNA, 20 nt, Human
agugauccucccaccucagc

SEQ ID NO: 3125433 - RNA, 22 nt, Human
agugauccucccaccucagccu

SEQ ID NO: 3125434 - RNA, 19 nt, Human
agugauucuccugccucag

SEQ ID NO: 3125435 - RNA, 18 nt, Human
agugauucuccugccuca

SEQ ID NO: 3125436 - RNA, 20 nt, Human
agugauucuccugccucagc

SEQ ID NO: 3125437 - RNA, 18 nt, Human
agugccuuauggaacacu

SEQ ID NO: 3125438 - RNA, 22 nt, Human
agugccuuauggaacacucuga

SEQ ID NO: 3125439 - RNA, 21 nt, Human
agugccuuauggaacacucug

SEQ ID NO: 3125440 - RNA, 20 nt, Human
agugccuuauggaacacucu

SEQ ID NO: 3125441 - RNA, 19 nt, Human
agugccuuauggaacacuc

SEQ ID NO: 3125442 - RNA, 16 nt, Human
agugacagaggcagcc

SEQ ID NO: 3125443 - RNA, 19 nt, Human
agugacagaggcagcccca

SEQ ID NO: 3125444 - RNA, 14 nt, Human
agugacagaggcag

SEQ ID NO: 3125445 - RNA, 20 nt, Human
caaaggguaucaggugcugc

SEQ ID NO: 3125446 - RNA, 21 nt, Human
caaaggguaucaggugcugcc

SEQ ID NO: 3125447 - RNA, 23 nt, Human
caaaggguaucaggugcugccau

SEQ ID NO: 3125448 - RNA, 17 nt, Human
caaaguggugagaggca

SEQ ID NO: 3125449 - RNA, 16 nt, Human
caaaguggugagaggc

SEQ ID NO: 3125450 - RNA, 20 nt, Human
caaaggagauuggaaggaac

SEQ ID NO: 3125451 - RNA, 14 nt, Human
caaaggagauugga

SEQ ID NO: 3125452 - RNA, 21 nt, Human
caaagagguuuuaaaaaaauc

SEQ ID NO: 3125453 - RNA, 14 nt, Human
caaagagguuuuaa

SEQ ID NO: 3125454 - RNA, 20 nt, Human
caacaggcugggcuucagug

SEQ ID NO: 3125455 - RNA, 17 nt, Human
caacugcaucaagaugu

SEQ ID NO: 3125456 - RNA, 23 nt, Human
caacugcaucaagaugugacaug

SEQ ID NO: 3125457 - RNA, 20 nt, Human
caacugcaucaagaugugac

SEQ ID NO: 3125458 - RNA, 17 nt, Human
caaccugauugugucuc

SEQ ID NO: 3125459 - RNA, 21 nt, Human
caaccugauugugucucuugg

SEQ ID NO: 3125460 - RNA, 19 nt, Human
caaccugauugugucucuu

SEQ ID NO: 3125461 - RNA, 15 nt, Human
caacauacucccauc

SEQ ID NO: 3125462 - RNA, 14 nt, Human
caacauacucccau

SEQ ID NO: 3125463 - RNA, 16 nt, Human
caacauacucccaucu

SEQ ID NO: 3125464 - RNA, 13 nt, Human
caacaggcugggc

SEQ ID NO: 3125465 - RNA, 17 nt, Human
caacaggcugggcuuca

SEQ ID NO: 3125466 - RNA, 14 nt, Human
caacaggcugggcu

SEQ ID NO: 3125467 - RNA, 14 nt, Human
caagugagacccug

SEQ ID NO: 3125468 - RNA, 23 nt, Human
caagugaaaaaggaggaagagaa

SEQ ID NO: 3125469 - RNA, 22 nt, Human
caagugaaaaaggaggaagaga

SEQ ID NO: 3125470 - RNA, 19 nt, Human
caagugauucuccugccuc

SEQ ID NO: 3125471 - RNA, 18 nt, Human
caagugauucuccugccu

SEQ ID NO: 3125472 - RNA, 15 nt, Human
caagugagacccugu

SEQ ID NO: 3125473 - RNA, 20 nt, Human
caagugauucuccugccuca

SEQ ID NO: 3125474 - RNA, 21 nt, Human
caaggggaauguuugccucug

SEQ ID NO: 3125475 - RNA, 15 nt, Human
caagggccuggccug

SEQ ID NO: 3125476 - RNA, 14 nt, Human
caagggccuggccu

SEQ ID NO: 3125477 - RNA, 13 nt, Human
caagggccuggcc

SEQ ID NO: 3125478 - RNA, 23 nt, Human
caaggggaauguuugccucugcc

SEQ ID NO: 3125479 - RNA, 23 nt, Human
caagacccuuguggucccacccc

SEQ ID NO: 3125480 - RNA, 22 nt, Human
caagacgcugugcugcccugcc

SEQ ID NO: 3125481 - RNA, 21 nt, Human
caagacgcugugcugcccugc

SEQ ID NO: 3125482 - RNA, 20 nt, Human
caagacgcugugcugcccug

SEQ ID NO: 3125483 - RNA, 19 nt, Human
caagacgcugugcugcccu

SEQ ID NO: 3125484 - RNA, 13 nt, Human
caagaccuucucc

SEQ ID NO: 3125485 - RNA, 12 nt, Human
caagagggucug

SEQ ID NO: 3125486 - RNA, 16 nt, Human
caagagggucugagga

SEQ ID NO: 3125487 - RNA, 17 nt, Human
caagagggucugaggaa

SEQ ID NO: 3125488 - RNA, 17 nt, Human
caagagcccaggccucc

SEQ ID NO: 3125489 - RNA, 14 nt, Human
caaggcugucaauu

SEQ ID NO: 3125490 - RNA, 13 nt, Human
caaggcugucaau

SEQ ID NO: 3125491 - RNA, 21 nt, Human
caaggcugggggaagaagcuc

SEQ ID NO: 3125492 - RNA, 18 nt, Human
caaggcugggggaagaag

SEQ ID NO: 3125493 - RNA, 16 nt, Human
caaggauccugagcca

SEQ ID NO: 3125494 - RNA, 15 nt, Human
caaggauccugagcc

SEQ ID NO: 3125495 - RNA, 14 nt, Human
caaggauccugagc

SEQ ID NO: 3125496 - RNA, 20 nt, Human
caaugcaaaccaucauugaa

SEQ ID NO: 3125497 - RNA, 23 nt, Human
caaugcaaaccaucauugaaauc

SEQ ID NO: 3125498 - RNA, 14 nt, Human
caaugcacugacau

SEQ ID NO: 3125499 - RNA, 13 nt, Human
caaugcacuuugu

SEQ ID NO: 3125500 - RNA, 14 nt, Human
caaugauggucacc

SEQ ID NO: 3125501 - RNA, 22 nt, Human
caaugcaaaccaucauugaaau

SEQ ID NO: 3125502 - RNA, 21 nt, Human
caaugcaaaccaucauugaaa

SEQ ID NO: 3125503 - RNA, 13 nt, Human
caaugaccuuuca

SEQ ID NO: 3125504 - RNA, 14 nt, Human
caaugaccuuucaa

SEQ ID NO: 3125505 - RNA, 13 nt, Human
caaugauggucac

SEQ ID NO: 3125506 - RNA, 16 nt, Human
caaugaccuuucaaua

SEQ ID NO: 3125507 - RNA, 15 nt, Human
caaugaccuuucaau

SEQ ID NO: 3125508 - RNA, 17 nt, Human
cacaaagguagcuuuuc

SEQ ID NO: 3125509 - RNA, 17 nt, Human
cacaaacgggcucagca

SEQ ID NO: 3125510 - RNA, 15 nt, Human
cacaaacagaggccg

SEQ ID NO: 3125511 - RNA, 14 nt, Human
caaugcacuuuguu

SEQ ID NO: 3125512 - RNA, 18 nt, Human
caaugguuuucuugugug

SEQ ID NO: 3125513 - RNA, 17 nt, Human
cacaccgggcacucaga

SEQ ID NO: 3125514 - RNA, 14 nt, Human
cacacccagcccac

SEQ ID NO: 3125515 - RNA, 20 nt, Human
cacacccagcccacuucugc

SEQ ID NO: 3125516 - RNA, 13 nt, Human
cacacagcucugu

SEQ ID NO: 3125517 - RNA, 14 nt, Human
cacacagcucuguc

SEQ ID NO: 3125518 - RNA, 15 nt, Human
cacacagcucugucc

SEQ ID NO: 3125519 - RNA, 21 nt, Human
cacaccagagcccaccuuggc

SEQ ID NO: 3125520 - RNA, 22 nt, Human
cacaccagagcccaccuuggcu

SEQ ID NO: 3125521 - RNA, 13 nt, Human
cacacccagccca

SEQ ID NO: 3125522 - RNA, 15 nt, Human
cacacaccagagccc

SEQ ID NO: 3125523 - RNA, 16 nt, Human
cacacaccagagccca

SEQ ID NO: 3125524 - RNA, 20 nt, Human
cacacaccagagcccaccuu

SEQ ID NO: 3125525 - RNA, 21 nt, Human
cacacagaggcugccucuccc

SEQ ID NO: 3125526 - RNA, 14 nt, Human
cacacacuuuggcu

SEQ ID NO: 3125527 - RNA, 13 nt, Human
cacccaagggccu

SEQ ID NO: 3125528 - RNA, 21 nt, Human
cacaugccucucucaggccaa

SEQ ID NO: 3125529 - RNA, 20 nt, Human
cacaugccucucucaggcca

SEQ ID NO: 3125530 - RNA, 17 nt, Human
cacauguccaagaagcc

SEQ ID NO: 3125531 - RNA, 16 nt, Human
cacauguccaagaagc

SEQ ID NO: 3125532 - RNA, 18 nt, Human
cacaugcacgugugugca

SEQ ID NO: 3125533 - RNA, 20 nt, Human
cacaugcaaggucauuuuuu

SEQ ID NO: 3125534 - RNA, 17 nt, Human
cacaugcaaggucauuu

SEQ ID NO: 3125535 - RNA, 19 nt, Human
cacaugcaaggucauuuuu

SEQ ID NO: 3125536 - RNA, 21 nt, Human
cacaugagcaucaggccaggc

SEQ ID NO: 3125537 - RNA, 20 nt, Human
cacaugagcaucaggccagg

SEQ ID NO: 3125538 - RNA, 19 nt, Human
cacaugagcaucaggccag

SEQ ID NO: 3125539 - RNA, 18 nt, Human
cacaugagcaucaggcca

SEQ ID NO: 3125540 - RNA, 17 nt, Human
cacaugagcaucaggcc

SEQ ID NO: 3125541 - RNA, 13 nt, Human
cacaugagcauca

SEQ ID NO: 3125542 - RNA, 17 nt, Human
cacaggaucagucugau

SEQ ID NO: 3125543 - RNA, 19 nt, Human
cacagcucuucuccaggcu

SEQ ID NO: 3125544 - RNA, 20 nt, Human
cacagcucuucuccaggcug

SEQ ID NO: 3125545 - RNA, 14 nt, Human
cacaggcccggcuc

SEQ ID NO: 3125546 - RNA, 23 nt, Human
cacaguccuuaccagcagagcac

SEQ ID NO: 3125547 - RNA, 19 nt, Human
cacaggcagguccaggguu

SEQ ID NO: 3125548 - RNA, 18 nt, Human
cacagcucuucuccaggc

SEQ ID NO: 3125549 - RNA, 22 nt, Human
cacacggacacucaaaagcugg

SEQ ID NO: 3125550 - RNA, 18 nt, Human
caccaucaugucuggcua

SEQ ID NO: 3125551 - RNA, 15 nt, Human
caccaucaugucugg

SEQ ID NO: 3125552 - RNA, 17 nt, Human
caccaucaugucuggcu

SEQ ID NO: 3125553 - RNA, 24 nt, Human
caccaucaagccaccaacauacuc

SEQ ID NO: 3125554 - RNA, 19 nt, Human
caccaucaagccaccaaca

SEQ ID NO: 3125555 - RNA, 17 nt, Human
caccaucaagccaccaa

SEQ ID NO: 3125556 - RNA, 16 nt, Human
caccaucaagccacca

SEQ ID NO: 3125557 - RNA, 13 nt, Human
caccaucaagcca

SEQ ID NO: 3125558 - RNA, 15 nt, Human
caccaucaagccacc

SEQ ID NO: 3125559 - RNA, 14 nt, Human
caccaucaagccac

SEQ ID NO: 3125560 - RNA, 21 nt, Human
caccauauuaccacagacaua

SEQ ID NO: 3125561 - RNA, 12 nt, Human
caccaagcccag

SEQ ID NO: 3125562 - RNA, 13 nt, Human
caccaagcccagu

SEQ ID NO: 3125563 - RNA, 17 nt, Human
caccaacgucugugcca

SEQ ID NO: 3125564 - RNA, 16 nt, Human
caccaacgucugugcc

SEQ ID NO: 3125565 - RNA, 22 nt, Human
cacauguccaagaagcccagga

SEQ ID NO: 3125566 - RNA, 21 nt, Human
cacauguccaagaagcccagg

SEQ ID NO: 3125567 - RNA, 19 nt, Human
cacauguccaagaagccca

SEQ ID NO: 3125568 - RNA, 18 nt, Human
cacauguccaagaagccc

SEQ ID NO: 3125569 - RNA, 17 nt, Human
caccagagcccaccuug

SEQ ID NO: 3125570 - RNA, 18 nt, Human
caccagagcccaccuugg

SEQ ID NO: 3125571 - RNA, 20 nt, Human
caccagagcccaccuuggcu

SEQ ID NO: 3125572 - RNA, 22 nt, Human
caccagagcccaccuuggcuca

SEQ ID NO: 3125573 - RNA, 15 nt, Human
caccagagcccaccu

SEQ ID NO: 3125574 - RNA, 19 nt, Human
caccacacccagcccacuu

SEQ ID NO: 3125575 - RNA, 17 nt, Human
caccacacccagcccac

SEQ ID NO: 3125576 - RNA, 15 nt, Human
ucccucccucuuucc

SEQ ID NO: 3125577 - RNA, 17 nt, Human
ucccucccucuuucccu

SEQ ID NO: 3125578 - RNA, 15 nt, Human
ucccuacuguaauuu

SEQ ID NO: 3125579 - RNA, 19 nt, Human
uccccuguagagugggagc

SEQ ID NO: 3125580 - RNA, 24 nt, Human
uccccugcuggguguggcgcagca

SEQ ID NO: 3125581 - RNA, 23 nt, Human
uccccuguccccgcacugggcuu

SEQ ID NO: 3125582 - RNA, 22 nt, Human
uccccuguagagugggagcuga

SEQ ID NO: 3125583 - RNA, 21 nt, Human
uccccugcuggguguggcgca

SEQ ID NO: 3125584 - RNA, 20 nt, Human
uccccugcuggguguggcgc

SEQ ID NO: 3125585 - RNA, 15 nt, Human
uccccugcugggugu

SEQ ID NO: 3125586 - RNA, 14 nt, Human
uccccugcugggug

SEQ ID NO: 3125587 - RNA, 21 nt, Human
ucccccuuccauggacuuugu

SEQ ID NO: 3125588 - RNA, 20 nt, Human
uccccgcacugggcuugggg

SEQ ID NO: 3125589 - RNA, 22 nt, Human
ucccccagccccauccucugua

SEQ ID NO: 3125590 - RNA, 23 nt, Human
uccagcucaccagccccagugcc

SEQ ID NO: 3125591 - RNA, 21 nt, Human
ucccaaagugcugggauuaca

SEQ ID NO: 3125592 - RNA, 15 nt, Human
uccauggacuuuguu

SEQ ID NO: 3125593 - RNA, 14 nt, Human
uccauggacuuugu

SEQ ID NO: 3125594 - RNA, 13 nt, Human
uccauggacuuug

SEQ ID NO: 3125595 - RNA, 17 nt, Human
ucccaagcucugcuccu

SEQ ID NO: 3125596 - RNA, 12 nt, Human
ucccaagcucug

SEQ ID NO: 3125597 - RNA, 13 nt, Human
ucccaagcucugc

SEQ ID NO: 3125598 - RNA, 14 nt, Human
ucccaagcucugcu

SEQ ID NO: 3125599 - RNA, 15 nt, Human
ucccaagcucugcuc

SEQ ID NO: 3125600 - RNA, 16 nt, Human
ucccaacucaccccag

SEQ ID NO: 3125601 - RNA, 15 nt, Human
ucccaacucacccca

SEQ ID NO: 3125602 - RNA, 14 nt, Human
ucccaacucacccc

SEQ ID NO: 3125603 - RNA, 13 nt, Human
ucccaacucaccc

SEQ ID NO: 3125604 - RNA, 13 nt, Human
ucccaccucagcc

SEQ ID NO: 3125605 - RNA, 14 nt, Human
ucccaccucagccu

SEQ ID NO: 3125606 - RNA, 15 nt, Human
ucccaccucagccuc

SEQ ID NO: 3125607 - RNA, 21 nt, Human
ucccaggcauuccccaggagg

SEQ ID NO: 3125608 - RNA, 20 nt, Human
ucccaggcauuccccaggag

SEQ ID NO: 3125609 - RNA, 19 nt, Human
ucccaggcauuccccagga

SEQ ID NO: 3125610 - RNA, 22 nt, Human
ucccaggcauuccccaggaggc

SEQ ID NO: 3125611 - RNA, 23 nt, Human
ucccaucucacacaugagcauca

SEQ ID NO: 3125612 - RNA, 20 nt, Human
ucccaucucacacaugagca

SEQ ID NO: 3125613 - RNA, 22 nt, Human
uccccacuugagaauuacccuu

SEQ ID NO: 3125614 - RNA, 13 nt, Human
uccaccugccagg

SEQ ID NO: 3125615 - RNA, 14 nt, Human
uccacaagagccca

SEQ ID NO: 3125616 - RNA, 22 nt, Human
uccaagcaggacauggacaagg

SEQ ID NO: 3125617 - RNA, 12 nt, Human
uccaccugccag

SEQ ID NO: 3125618 - RNA, 17 nt, Human
uccaaaauaaaacuuuu

SEQ ID NO: 3125619 - RNA, 16 nt, Human
uccaaaauaaaacuuu

SEQ ID NO: 3125620 - RNA, 19 nt, Human
uccaagaagcccaggaaag

SEQ ID NO: 3125621 - RNA, 22 nt, Human
uccaagaagcccaggaaaggcu

SEQ ID NO: 3125622 - RNA, 20 nt, Human
uccaagaagcccaggaaagg

SEQ ID NO: 3125623 - RNA, 15 nt, Human
ucauacccaccccca

SEQ ID NO: 3125624 - RNA, 14 nt, Human
ucauacccaccccc

SEQ ID NO: 3125625 - RNA, 20 nt, Human
ucauacccacccccacccaa

SEQ ID NO: 3125626 - RNA, 16 nt, Human
ucauuaggugugacug

SEQ ID NO: 3125627 - RNA, 18 nt, Human
ucauuaggugugacugaa

SEQ ID NO: 3125628 - RNA, 21 nt, Human
ucauuaggugugacugaauuu

SEQ ID NO: 3125629 - RNA, 24 nt, Human
ucagucugauucccaagcucugcu

SEQ ID NO: 3125630 - RNA, 15 nt, Human
ucagucuggcccuuc

SEQ ID NO: 3125631 - RNA, 23 nt, Human
ucagugguuggcaauuguuucaa

SEQ ID NO: 3125632 - RNA, 13 nt, Human
ucagugugacuga

SEQ ID NO: 3125633 - RNA, 17 nt, Human
ucagugugacugaucuc

SEQ ID NO: 3125634 - RNA, 13 nt, Human
ucauacccacccc

SEQ ID NO: 3125635 - RNA, 13 nt, Human
ucauaaugacuua

SEQ ID NO: 3125636 - RNA, 14 nt, Human
ucacggaagagccu

SEQ ID NO: 3125637 - RNA, 17 nt, Human
ucacggaagagccuugc

SEQ ID NO: 3125638 - RNA, 16 nt, Human
ucacggaagagccuug

SEQ ID NO: 3125639 - RNA, 13 nt, Human
ucacggcucacug

SEQ ID NO: 3125640 - RNA, 15 nt, Human
ucacggcucacugca

SEQ ID NO: 3125641 - RNA, 20 nt, Human
ucacggcucacugcagccuc

SEQ ID NO: 3125642 - RNA, 13 nt, Human
ucacuccuugaaa

SEQ ID NO: 3125643 - RNA, 23 nt, Human
ucacucuccuuggugucgggcau

SEQ ID NO: 3125644 - RNA, 13 nt, Human
ucacucuggcagc

SEQ ID NO: 3125645 - RNA, 12 nt, Human
ucacucuggcag

SEQ ID NO: 3125646 - RNA, 14 nt, Human
ucacucuccuuggu

SEQ ID NO: 3125647 - RNA, 12 nt, Human
ucacucuccuug

SEQ ID NO: 3125648 - RNA, 22 nt, Human
ucacucuggcagcucagagagg

SEQ ID NO: 3125649 - RNA, 20 nt, Human
ucacucuggcagcucagaga

SEQ ID NO: 3125650 - RNA, 19 nt, Human
ucacucuggcagcucagag

SEQ ID NO: 3125651 - RNA, 18 nt, Human
ucacucuggcagcucaga

SEQ ID NO: 3125652 - RNA, 17 nt, Human
ucacucuggcagcucag

SEQ ID NO: 3125653 - RNA, 16 nt, Human
ucacucuggcagcuca

SEQ ID NO: 3125654 - RNA, 15 nt, Human
ucacucuggcagcuc

SEQ ID NO: 3125655 - RNA, 14 nt, Human
ucacucuggcagcu

SEQ ID NO: 3125656 - RNA, 12 nt, Human
ucaccuuugucc

SEQ ID NO: 3125657 - RNA, 14 nt, Human
ucaccuuucccauc

SEQ ID NO: 3125658 - RNA, 19 nt, Human
ucacaggcagguccagggu

SEQ ID NO: 3125659 - RNA, 12 nt, Human
ucacaggcaggu

SEQ ID NO: 3125660 - RNA, 15 nt, Human
ucacaggcaggucca

SEQ ID NO: 3125661 - RNA, 22 nt, Human
ucaccuuuguccccaccgcaga

SEQ ID NO: 3125662 - RNA, 18 nt, Human
ucaccuuuguccccaccg

SEQ ID NO: 3125663 - RNA, 17 nt, Human
ucaccuuuguccccacc

SEQ ID NO: 3125664 - RNA, 15 nt, Human
ucaccuuugucccca

SEQ ID NO: 3125665 - RNA, 14 nt, Human
ucaccuuugucccc

SEQ ID NO: 3125666 - RNA, 19 nt, Human
ucacgccuguaauccuagc

SEQ ID NO: 3125667 - RNA, 20 nt, Human
ucacgccuguaauccuagca

SEQ ID NO: 3125668 - RNA, 13 nt, Human
ucacgccacugca

SEQ ID NO: 3125669 - RNA, 14 nt, Human
ucacgccacugcac

SEQ ID NO: 3125670 - RNA, 16 nt, Human
ucacgccacugcacua

SEQ ID NO: 3125671 - RNA, 14 nt, Human
ucagacagcugccu

SEQ ID NO: 3125672 - RNA, 20 nt, Human
ucagacagcugccugggauc

SEQ ID NO: 3125673 - RNA, 19 nt, Human
ucagacagcugccugggau

SEQ ID NO: 3125674 - RNA, 18 nt, Human
ucagacagcugccuggga

SEQ ID NO: 3125675 - RNA, 17 nt, Human
ucagacagcugccuggg

SEQ ID NO: 3125676 - RNA, 16 nt, Human
ucagacagcugccugg

SEQ ID NO: 3125677 - RNA, 15 nt, Human
ucagacagcugccug

SEQ ID NO: 3125678 - RNA, 18 nt, Human
ucagcacgauuucuguuu

SEQ ID NO: 3125679 - RNA, 19 nt, Human
ucagcacgauuucuguuua

SEQ ID NO: 3125680 - RNA, 19 nt, Human
ucacucugucgcccagucu

SEQ ID NO: 3125681 - RNA, 12 nt, Human
ucacucugucgc

SEQ ID NO: 3125682 - RNA, 16 nt, Human
ucacucugucgcccag

SEQ ID NO: 3125683 - RNA, 15 nt, Human
ucacugcuuaacuuc

SEQ ID NO: 3125684 - RNA, 17 nt, Human
ucacugcuuaacuucac

SEQ ID NO: 3125685 - RNA, 18 nt, Human
ucacugcuuaacuucaca

SEQ ID NO: 3125686 - RNA, 19 nt, Human
ucaauuacaggaaguacug

SEQ ID NO: 3125687 - RNA, 21 nt, Human
ucacacaguauuacuucugcu

SEQ ID NO: 3125688 - RNA, 22 nt, Human
ucacacaguauuacuucugcua

SEQ ID NO: 3125689 - RNA, 13 nt, Human
ucacacagugagu

SEQ ID NO: 3125690 - RNA, 21 nt, Human
ucacacaugagcaucaggcca

SEQ ID NO: 3125691 - RNA, 22 nt, Human
ucacacagugagucgaggacag

SEQ ID NO: 3125692 - RNA, 23 nt, Human
ucacacagugagucgaggacagg

SEQ ID NO: 3125693 - RNA, 11 nt, Human
ucacaggcagg

SEQ ID NO: 3125694 - RNA, 13 nt, Human
ucaauaggaaaaa

SEQ ID NO: 3125695 - RNA, 14 nt, Human
ucaaugcacugaca

SEQ ID NO: 3125696 - RNA, 14 nt, Human
ucaauaggaaaaac

SEQ ID NO: 3125697 - RNA, 18 nt, Human
ucaaugcacugacauugu

SEQ ID NO: 3125698 - RNA, 18 nt, Human
ucaauuacaggaaguacu

SEQ ID NO: 3125699 - RNA, 13 nt, Human
ucaauuacaggaa

SEQ ID NO: 3125700 - RNA, 19 nt, Human
ucaaggauccugagccaga

SEQ ID NO: 3125701 - RNA, 18 nt, Human
ucaaggauccugagccag

SEQ ID NO: 3125702 - RNA, 22 nt, Human
ucaagugauucuccugccucag

SEQ ID NO: 3125703 - RNA, 17 nt, Human
ucaaggauccugagcca

SEQ ID NO: 3125704 - RNA, 21 nt, Human
ucaagugauucuccugccuca

SEQ ID NO: 3125705 - RNA, 20 nt, Human
ucaaggauccugagccagau

SEQ ID NO: 3125706 - RNA, 16 nt, Human
ucaagcgauucuucug

SEQ ID NO: 3125707 - RNA, 21 nt, Human
ucaagcgauucuucugcuuca

SEQ ID NO: 3125708 - RNA, 13 nt, Human
ucaaccuccuggg

SEQ ID NO: 3125709 - RNA, 14 nt, Human
ucaaccuccugggc

SEQ ID NO: 3125710 - RNA, 22 nt, Human
ucaaacucuugaccucagguga

SEQ ID NO: 3125711 - RNA, 15 nt, Human
ucaaacuuuacuaug

SEQ ID NO: 3125712 - RNA, 13 nt, Human
ucaaacuuuacua

SEQ ID NO: 3125713 - RNA, 16 nt, Human
ucaaacuuuacuaugg

SEQ ID NO: 3125714 - RNA, 20 nt, Human
uaucugaaaauguaugugua

SEQ ID NO: 3125715 - RNA, 14 nt, Human
uaucugaaaaugua

SEQ ID NO: 3125716 - RNA, 15 nt, Human
uaucugaaaauguau

SEQ ID NO: 3125717 - RNA, 23 nt, Human
uauuuauuaaaugcccagccccu

SEQ ID NO: 3125718 - RNA, 14 nt, Human
ucaaacucuuaaaa

SEQ ID NO: 3125719 - RNA, 22 nt, Human
ucaaaacgguuuuacugcagcu

SEQ ID NO: 3125720 - RNA, 15 nt, Human
uauuuuuuuacuaau

SEQ ID NO: 3125721 - RNA, 23 nt, Human
ucgcugugucagcauagaaguaa

SEQ ID NO: 3125722 - RNA, 17 nt, Human
ucgaguuacagacaaag

SEQ ID NO: 3125723 - RNA, 15 nt, Human
ucgaguuacagacaa

SEQ ID NO: 3125724 - RNA, 15 nt, Human
uccugguguggaaga

SEQ ID NO: 3125725 - RNA, 17 nt, Human
uccuggcccacugcauc

SEQ ID NO: 3125726 - RNA, 22 nt, Human
uccuggcaugggaaugaauguc

SEQ ID NO: 3125727 - RNA, 10 nt, Human
ucccucccuu

SEQ ID NO: 3125728 - RNA, 12 nt, Human
uccuucuguccu

SEQ ID NO: 3125729 - RNA, 19 nt, Human
uccuucuguccuacucugu

SEQ ID NO: 3125730 - RNA, 19 nt, Human
ucuagggaaaaaccagcgu

SEQ ID NO: 3125731 - RNA, 22 nt, Human
ucuagggaaaaaccagcgugug

SEQ ID NO: 3125732 - RNA, 22 nt, Human
ucuacugaggugcuauguucuu

SEQ ID NO: 3125733 - RNA, 15 nt, Human
ucuacacugugcuga

SEQ ID NO: 3125734 - RNA, 18 nt, Human
ucuacugaggugcuaugu

SEQ ID NO: 3125735 - RNA, 19 nt, Human
ucuacugaggugcuauguu

SEQ ID NO: 3125736 - RNA, 14 nt, Human
ucuacacugugcug

SEQ ID NO: 3125737 - RNA, 12 nt, Human
ucuacacugugc

SEQ ID NO: 3125738 - RNA, 15 nt, Human
ucuaacuucaccaua

SEQ ID NO: 3125739 - RNA, 16 nt, Human
ucuaacuucaccauau

SEQ ID NO: 3125740 - RNA, 22 nt, Human
ucuaaaucuccaaaauaaaacu

SEQ ID NO: 3125741 - RNA, 17 nt, Human
ucucacuguugcccagg

SEQ ID NO: 3125742 - RNA, 17 nt, Human
ucucagaaucucaaaua

SEQ ID NO: 3125743 - RNA, 21 nt, Human
ucucagaaucucaaauaacua

SEQ ID NO: 3125744 - RNA, 18 nt, Human
ucucacuguugcccaggc

SEQ ID NO: 3125745 - RNA, 19 nt, Human
ucucacuguugcccaggcu

SEQ ID NO: 3125746 - RNA, 20 nt, Human
ucucacuguugcccaggcug

SEQ ID NO: 3125747 - RNA, 21 nt, Human
ucucacuguugcccaggcugg

SEQ ID NO: 3125748 - RNA, 18 nt, Human
ucucacucugucgcccag

SEQ ID NO: 3125749 - RNA, 16 nt, Human
ucucacucugucgccc

SEQ ID NO: 3125750 - RNA, 17 nt, Human
ucucacucugucgccca

SEQ ID NO: 3125751 - RNA, 22 nt, Human
ucucaaacucuugaccucaggu

SEQ ID NO: 3125752 - RNA, 13 nt, Human
ucucaaacucuug

SEQ ID NO: 3125753 - RNA, 21 nt, Human
ucucaaacucuugaccucagg

SEQ ID NO: 3125754 - RNA, 14 nt, Human
ucugacccaugcug

SEQ ID NO: 3125755 - RNA, 15 nt, Human
ucugacccacugcuu

SEQ ID NO: 3125756 - RNA, 20 nt, Human
ucugaacuuggcgcugcccc

SEQ ID NO: 3125757 - RNA, 24 nt, Human
ucugagaucaaaacgguuuuacug

SEQ ID NO: 3125758 - RNA, 18 nt, Human
ucugacccaugcugcccu

SEQ ID NO: 3125759 - RNA, 17 nt, Human
ucugacccaugcugccc

SEQ ID NO: 3125760 - RNA, 16 nt, Human
ucugacccaugcugcc

SEQ ID NO: 3125761 - RNA, 15 nt, Human
ucugacccaugcugc

SEQ ID NO: 3125762 - RNA, 19 nt, Human
ucugcacaagcugcacccu

SEQ ID NO: 3125763 - RNA, 14 nt, Human
ucugcacaagcugc

SEQ ID NO: 3125764 - RNA, 23 nt, Human
ucugauucccaagcucugcuccu

SEQ ID NO: 3125765 - RNA, 16 nt, Human
ucugaggaauccagac

SEQ ID NO: 3125766 - RNA, 17 nt, Human
ucugaggaauccagacc

SEQ ID NO: 3125767 - RNA, 20 nt, Human
ucugaggacacuaaccacgc

SEQ ID NO: 3125768 - RNA, 23 nt, Human
ucugaggacacuaaccacgcugg

SEQ ID NO: 3125769 - RNA, 16 nt, Human
ucugaaaauguaugug

SEQ ID NO: 3125770 - RNA, 15 nt, Human
ucucuuuucaaaaca

SEQ ID NO: 3125771 - RNA, 16 nt, Human
ucucuuuucaaaacau

SEQ ID NO: 3125772 - RNA, 14 nt, Human
ucugaaaauguaug

SEQ ID NO: 3125773 - RNA, 23 nt, Human
ucugaaaauguauguguaaguau

SEQ ID NO: 3125774 - RNA, 13 nt, Human
ucugaaagggacg

SEQ ID NO: 3125775 - RNA, 15 nt, Human
ucucuacaaaaagca

SEQ ID NO: 3125776 - RNA, 16 nt, Human
ucucuaguuugauuaa

SEQ ID NO: 3125777 - RNA, 18 nt, Human
ucucuaguuugauuaaau

SEQ ID NO: 3125778 - RNA, 19 nt, Human
ucucuaguuugauuaaauu

SEQ ID NO: 3125779 - RNA, 13 nt, Human
ucucugaggacac

SEQ ID NO: 3125780 - RNA, 22 nt, Human
ucuccugccucagccucccaaa

SEQ ID NO: 3125781 - RNA, 19 nt, Human
ucuccugccucagccuccc

SEQ ID NO: 3125782 - RNA, 20 nt, Human
ucucccccagccccauccuc

SEQ ID NO: 3125783 - RNA, 18 nt, Human
ucucccccagccccaucc

SEQ ID NO: 3125784 - RNA, 13 nt, Human
ucucccccagccc

SEQ ID NO: 3125785 - RNA, 22 nt, Human
ucucccccagccccauccucug

SEQ ID NO: 3125786 - RNA, 14 nt, Human
ucucccccagcccc

SEQ ID NO: 3125787 - RNA, 17 nt, Human
ucucccccagccccauc

SEQ ID NO: 3125788 - RNA, 15 nt, Human
ucucccccagcccca

SEQ ID NO: 3125789 - RNA, 16 nt, Human
ucuuuuugcuuugcuu

SEQ ID NO: 3125790 - RNA, 17 nt, Human
ucuuuugccguuauuaa

SEQ ID NO: 3125791 - RNA, 19 nt, Human
ucuuuugccguuauuaaaa

SEQ ID NO: 3125792 - RNA, 12 nt, Human
ugaaaggaaaga

SEQ ID NO: 3125793 - RNA, 17 nt, Human
ugaaaggaaagaggcuc

SEQ ID NO: 3125794 - RNA, 19 nt, Human
ugaaaugaggucagagccu

SEQ ID NO: 3125795 - RNA, 20 nt, Human
ugaaaugaggucagagccug

SEQ ID NO: 3125796 - RNA, 23 nt, Human
ugaaaugaggucagagccugcag

SEQ ID NO: 3125797 - RNA, 21 nt, Human
ugaaaugaggucagagccugc

SEQ ID NO: 3125798 - RNA, 22 nt, Human
ugaaaugaggucagagccugca

SEQ ID NO: 3125799 - RNA, 15 nt, Human
ugaaagggcccagag

SEQ ID NO: 3125800 - RNA, 16 nt, Human
ugaaagggcccagaga

SEQ ID NO: 3125801 - RNA, 17 nt, Human
ugaaagggcccagagag

SEQ ID NO: 3125802 - RNA, 17 nt, Human
ugaaaucuuuuugcuuu

SEQ ID NO: 3125803 - RNA, 20 nt, Human
ugaaggcucgagcaugccug

SEQ ID NO: 3125804 - RNA, 21 nt, Human
ugaaggcucgagcaugccugg

SEQ ID NO: 3125805 - RNA, 14 nt, Human
ugaagacuuuucuu

SEQ ID NO: 3125806 - RNA, 22 nt, Human
ugaagacuuuucuuucagccaa

SEQ ID NO: 3125807 - RNA, 17 nt, Human
ugaagacuuuucuuuca

SEQ ID NO: 3125808 - RNA, 19 nt, Human
ugaacuggguacuugugga

SEQ ID NO: 3125809 - RNA, 12 nt, Human
ugaacuugguuc

SEQ ID NO: 3125810 - RNA, 14 nt, Human
ugaacuuggcgcug

SEQ ID NO: 3125811 - RNA, 13 nt, Human
ugaagacagagcu

SEQ ID NO: 3125812 - RNA, 16 nt, Human
ugaagacagagcuaca

SEQ ID NO: 3125813 - RNA, 14 nt, Human
ugaagacagagcua

SEQ ID NO: 3125814 - RNA, 19 nt, Human
ugaaccacaucuugcucug

SEQ ID NO: 3125815 - RNA, 18 nt, Human
ugaacucuucaaucucuu

SEQ ID NO: 3125816 - RNA, 20 nt, Human
ugaaccacaucuugcucugc

SEQ ID NO: 3125817 - RNA, 21 nt, Human
ugaaccacaucuugcucugcu

SEQ ID NO: 3125818 - RNA, 22 nt, Human
ugaaccacaucuugcucugcug

SEQ ID NO: 3125819 - RNA, 15 nt, Human
ugaacucuucaaucu

SEQ ID NO: 3125820 - RNA, 13 nt, Human
ugaacugauaaag

SEQ ID NO: 3125821 - RNA, 15 nt, Human
ugaacugauaaagau

SEQ ID NO: 3125822 - RNA, 15 nt, Human
ucuucaguaagccgu

SEQ ID NO: 3125823 - RNA, 13 nt, Human
ucuuaaaaagugg

SEQ ID NO: 3125824 - RNA, 14 nt, Human
ucuuagugugugca

SEQ ID NO: 3125825 - RNA, 16 nt, Human
ucuuaguggauguucu

SEQ ID NO: 3125826 - RNA, 15 nt, Human
ucuuauacauuugau

SEQ ID NO: 3125827 - RNA, 14 nt, Human
ucuuauacauuuga

SEQ ID NO: 3125828 - RNA, 21 nt, Human
ucuucuccacuuucuagccag

SEQ ID NO: 3125829 - RNA, 19 nt, Human
ucuucuccacuuucuagcc

SEQ ID NO: 3125830 - RNA, 14 nt, Human
ucuuccaggcuggg

SEQ ID NO: 3125831 - RNA, 21 nt, Human
ucuuccacaagagcccaggcc

SEQ ID NO: 3125832 - RNA, 16 nt, Human
ucuucaguaagccgug

SEQ ID NO: 3125833 - RNA, 12 nt, Human
ucuugcucugcu

SEQ ID NO: 3125834 - RNA, 13 nt, Human
ucuugcucugcug

SEQ ID NO: 3125835 - RNA, 11 nt, Human
ucuugcucugc

SEQ ID NO: 3125836 - RNA, 16 nt, Human
ucuugaacuccuggcc

SEQ ID NO: 3125837 - RNA, 17 nt, Human
ucuugaacuccuggccu

SEQ ID NO: 3125838 - RNA, 18 nt, Human
ucuugaacuccuggccuc

SEQ ID NO: 3125839 - RNA, 13 nt, Human
ucuucuccaggcu

SEQ ID NO: 3125840 - RNA, 14 nt, Human
ucuucuccaggcug

SEQ ID NO: 3125841 - RNA, 12 nt, Human
ucuucuccaggc

SEQ ID NO: 3125842 - RNA, 21 nt, Human
ucuugaauuguaaggaaugau

SEQ ID NO: 3125843 - RNA, 17 nt, Human
ucuugaauuguaaggaa

SEQ ID NO: 3125844 - RNA, 23 nt, Human
ucuguacagagcccacgccccca

SEQ ID NO: 3125845 - RNA, 17 nt, Human
ucuggcucuuccaggcu

SEQ ID NO: 3125846 - RNA, 16 nt, Human
ucuggcucuuccaggc

SEQ ID NO: 3125847 - RNA, 15 nt, Human
ucuggcucuuccagg

SEQ ID NO: 3125848 - RNA, 12 nt, Human
ucugggacacag

SEQ ID NO: 3125849 - RNA, 14 nt, Human
ucuggcuaugcauu

SEQ ID NO: 3125850 - RNA, 19 nt, Human
ucuguccgagcuuugaaaa

SEQ ID NO: 3125851 - RNA, 22 nt, Human
ucuguggguuucuaaagcugcc

SEQ ID NO: 3125852 - RNA, 17 nt, Human
ucuguacgucugacagg

SEQ ID NO: 3125853 - RNA, 22 nt, Human
ucugugucagguggggcagcuu

SEQ ID NO: 3125854 - RNA, 23 nt, Human
ucuguggguuucuaaagcugcca

SEQ ID NO: 3125855 - RNA, 18 nt, Human
ucuuaaaaaguggaaaaa

SEQ ID NO: 3125856 - RNA, 15 nt, Human
uagaaauauaauuga

SEQ ID NO: 3125857 - RNA, 20 nt, Human
uagaaauaucugaaaaugua

SEQ ID NO: 3125858 - RNA, 21 nt, Human
uagaaauaucugaaaauguau

SEQ ID NO: 3125859 - RNA, 23 nt, Human
uagaaauaucugaaaauguaugu

SEQ ID NO: 3125860 - RNA, 21 nt, Human
uacuguaucaugacaaagacu

SEQ ID NO: 3125861 - RNA, 19 nt, Human
uacuuguggacacagcucu

SEQ ID NO: 3125862 - RNA, 15 nt, Human
uacuuguggacacag

SEQ ID NO: 3125863 - RNA, 18 nt, Human
uacuuguggacacagcuc

SEQ ID NO: 3125864 - RNA, 14 nt, Human
uacuuguggacaca

SEQ ID NO: 3125865 - RNA, 17 nt, Human
uacucccaucugugaaa

SEQ ID NO: 3125866 - RNA, 16 nt, Human
uacucccaucugugaa

SEQ ID NO: 3125867 - RNA, 14 nt, Human
uacucccaucugug

SEQ ID NO: 3125868 - RNA, 12 nt, Human
uacucccaucug

SEQ ID NO: 3125869 - RNA, 15 nt, Human
uacugaggugcuaug

SEQ ID NO: 3125870 - RNA, 16 nt, Human
uacucagaauucucua

SEQ ID NO: 3125871 - RNA, 22 nt, Human
uacucagaauucucuaguuuga

SEQ ID NO: 3125872 - RNA, 12 nt, Human
uacucaccucac

SEQ ID NO: 3125873 - RNA, 14 nt, Human
uacucaccucaccc

SEQ ID NO: 3125874 - RNA, 20 nt, Human
uacuacaguuuguuaguaug

SEQ ID NO: 3125875 - RNA, 17 nt, Human
uacuacaguccucccau

SEQ ID NO: 3125876 - RNA, 12 nt, Human
uacuacaguccu

SEQ ID NO: 3125877 - RNA, 15 nt, Human
uacuaauagacaauu

SEQ ID NO: 3125878 - RNA, 17 nt, Human
uacuaauagacaauuua

SEQ ID NO: 3125879 - RNA, 22 nt, Human
uacuaauaaaauuuaaaagucu

SEQ ID NO: 3125880 - RNA, 19 nt, Human
uacuaaccagcagaaaugc

SEQ ID NO: 3125881 - RNA, 18 nt, Human
uacuaaccagcagaaaug

SEQ ID NO: 3125882 - RNA, 17 nt, Human
uacuaaccagcagaaau

SEQ ID NO: 3125883 - RNA, 22 nt, Human
uacccaucccauaugccugggc

SEQ ID NO: 3125884 - RNA, 18 nt, Human
uaccuuuuuuauacauaa

SEQ ID NO: 3125885 - RNA, 19 nt, Human
uaccuuuuuuauacauaaa

SEQ ID NO: 3125886 - RNA, 20 nt, Human
uaccuuuuuuauacauaaac

SEQ ID NO: 3125887 - RNA, 20 nt, Human
uaccuuuguauucucuccug

SEQ ID NO: 3125888 - RNA, 22 nt, Human
uacacacugcauguuugugauu

SEQ ID NO: 3125889 - RNA, 16 nt, Human
uacacugugcugaguc

SEQ ID NO: 3125890 - RNA, 14 nt, Human
uacacuguuucaaa

SEQ ID NO: 3125891 - RNA, 17 nt, Human
uacacaaugguuuucuu

SEQ ID NO: 3125892 - RNA, 21 nt, Human
uacacaaugguuuucuugugu

SEQ ID NO: 3125893 - RNA, 21 nt, Human
uacacacacacgcgugcacac

SEQ ID NO: 3125894 - RNA, 15 nt, Human
uacacacacauacac

SEQ ID NO: 3125895 - RNA, 17 nt, Human
uacacacugcauguuug

SEQ ID NO: 3125896 - RNA, 17 nt, Human
uacacuguuucaaacuu

SEQ ID NO: 3125897 - RNA, 18 nt, Human
uacacuguuucaaacuuu

SEQ ID NO: 3125898 - RNA, 13 nt, Human
uacacuuuaugca

SEQ ID NO: 3125899 - RNA, 24 nt, Human
uacagcaaggagauuuacaacugg

SEQ ID NO: 3125900 - RNA, 19 nt, Human
uacaggaaaagcugcugac

SEQ ID NO: 3125901 - RNA, 16 nt, Human
uacaggcacccaccau

SEQ ID NO: 3125902 - RNA, 23 nt, Human
uacagcuugaccgugaggccaga

SEQ ID NO: 3125903 - RNA, 17 nt, Human
uacaggaaaagcugcug

SEQ ID NO: 3125904 - RNA, 18 nt, Human
uacaggaaaagcugcuga

SEQ ID NO: 3125905 - RNA, 22 nt, Human
uacagcuugaccgugaggccag

SEQ ID NO: 3125906 - RNA, 21 nt, Human
uacagcuugaccgugaggcca

SEQ ID NO: 3125907 - RNA, 13 nt, Human
uaccacagacaua

SEQ ID NO: 3125908 - RNA, 23 nt, Human
uaccauuuugggguacccacugc

SEQ ID NO: 3125909 - RNA, 15 nt, Human
uacccacccccaccc

SEQ ID NO: 3125910 - RNA, 12 nt, Human
uacccaccccca

SEQ ID NO: 3125911 - RNA, 23 nt, Human
uacccacccccacccaagggccu

SEQ ID NO: 3125912 - RNA, 19 nt, Human
uacccacccccacccaagg

SEQ ID NO: 3125913 - RNA, 17 nt, Human
uacccacccccacccaa

SEQ ID NO: 3125914 - RNA, 11 nt, Human
uacccacugcu

SEQ ID NO: 3125915 - RNA, 12 nt, Human
uacccacugcuc

SEQ ID NO: 3125916 - RNA, 13 nt, Human
uacccacugcucu

SEQ ID NO: 3125917 - RNA, 14 nt, Human
uacccacugcucug

SEQ ID NO: 3125918 - RNA, 16 nt, Human
uacccagcgagcccug

SEQ ID NO: 3125919 - RNA, 18 nt, Human
uacccagcgagcccuggu

SEQ ID NO: 3125920 - RNA, 22 nt, Human
uacccaggugcuaggaacacuc

SEQ ID NO: 3125921 - RNA, 22 nt, Human
uacauaagauaaaugugcugaa

SEQ ID NO: 3125922 - RNA, 18 nt, Human
uacauaagauaaaugugc

SEQ ID NO: 3125923 - RNA, 19 nt, Human
uacauaagauaaaugugcu

SEQ ID NO: 3125924 - RNA, 23 nt, Human
uacaguuacucagaauucucuag

SEQ ID NO: 3125925 - RNA, 19 nt, Human
uacaguuacucagaauucu

SEQ ID NO: 3125926 - RNA, 13 nt, Human
uaguuucuccaag

SEQ ID NO: 3125927 - RNA, 23 nt, Human
uaguuugauuaaauucuugcaaa

SEQ ID NO: 3125928 - RNA, 12 nt, Human
uaguuugcaguu

SEQ ID NO: 3125929 - RNA, 15 nt, Human
uaguggauguucuga

SEQ ID NO: 3125930 - RNA, 18 nt, Human
uauaaugaaugaaacauu

SEQ ID NO: 3125931 - RNA, 20 nt, Human
uauaaugaaugaaacauuuu

SEQ ID NO: 3125932 - RNA, 21 nt, Human
uaguuugauuaaauucuugca

SEQ ID NO: 3125933 - RNA, 14 nt, Human
uauaauguaagcuc

SEQ ID NO: 3125934 - RNA, 19 nt, Human
uauaauguaagcucuacug

SEQ ID NO: 3125935 - RNA, 20 nt, Human
uauaauguaagcucuacuga

SEQ ID NO: 3125936 - RNA, 17 nt, Human
uauaauucuacuuugag

SEQ ID NO: 3125937 - RNA, 16 nt, Human
uaucaugacaaagacu

SEQ ID NO: 3125938 - RNA, 19 nt, Human
uaucgucacugcuuaacuu

SEQ ID NO: 3125939 - RNA, 16 nt, Human
uaucgucacugcuuaa

SEQ ID NO: 3125940 - RNA, 15 nt, Human
uaucuaaauguugaa

SEQ ID NO: 3125941 - RNA, 11 nt, Human
uagagacaggg

SEQ ID NO: 3125942 - RNA, 21 nt, Human
uagagguucaaagauauuuug

SEQ ID NO: 3125943 - RNA, 19 nt, Human
uagagguucaaagauauuu

SEQ ID NO: 3125944 - RNA, 16 nt, Human
uagagguucaaagaua

SEQ ID NO: 3125945 - RNA, 16 nt, Human
uagagagagaccacuu

SEQ ID NO: 3125946 - RNA, 19 nt, Human
uagcagagaaugaaagggc

SEQ ID NO: 3125947 - RNA, 23 nt, Human
uagcagagaaugaaagggcccag

SEQ ID NO: 3125948 - RNA, 16 nt, Human
uagcacuuugggaggc

SEQ ID NO: 3125949 - RNA, 12 nt, Human
uagauguauaua

SEQ ID NO: 3125950 - RNA, 18 nt, Human
uagauaauacaccacuac

SEQ ID NO: 3125951 - RNA, 11 nt, Human
uagcugggacu

SEQ ID NO: 3125952 - RNA, 18 nt, Human
uagcugggacuacaggug

SEQ ID NO: 3125953 - RNA, 20 nt, Human
uagcugggacuacaggcacc

SEQ ID NO: 3125954 - RNA, 19 nt, Human
uagcugggacuacaggcac

SEQ ID NO: 3125955 - RNA, 22 nt, Human
uagcucauucuccuuguguuac

SEQ ID NO: 3125956 - RNA, 17 nt, Human
uagccugccucuucucu

SEQ ID NO: 3125957 - RNA, 21 nt, Human
uagcucuaggagggcuggcaa

SEQ ID NO: 3125958 - RNA, 14 nt, Human
uagcccaaaaccaa

SEQ ID NO: 3125959 - RNA, 16 nt, Human
uagccuaggugacaga

SEQ ID NO: 3125960 - RNA, 13 nt, Human
uaggccuggccag

SEQ ID NO: 3125961 - RNA, 14 nt, Human
uaggccuggccaga

SEQ ID NO: 3125962 - RNA, 15 nt, Human
uaggaagguuaaugu

SEQ ID NO: 3125963 - RNA, 13 nt, Human
uaggaagacuuug

SEQ ID NO: 3125964 - RNA, 15 nt, Human
uaggaagacuuugga

SEQ ID NO: 3125965 - RNA, 14 nt, Human
uaggaagacuuugg

SEQ ID NO: 3125966 - RNA, 17 nt, Human
uaggaagacuuuggaaa

SEQ ID NO: 3125967 - RNA, 16 nt, Human
uaggaagacuuuggaa

SEQ ID NO: 3125968 - RNA, 14 nt, Human
uaggaacacuccuu

SEQ ID NO: 3125969 - RNA, 13 nt, Human
uaggaacacuccu

SEQ ID NO: 3125970 - RNA, 17 nt, Human
uaggaacacuccuucac

SEQ ID NO: 3125971 - RNA, 21 nt, Human
uaggaacuuaaauaaugugaa

SEQ ID NO: 3125972 - RNA, 19 nt, Human
uaacaggcagauacaggaa

SEQ ID NO: 3125973 - RNA, 16 nt, Human
uaaccagcagaaaugc

SEQ ID NO: 3125974 - RNA, 19 nt, Human
uaaccagcagaaaugccuu

SEQ ID NO: 3125975 - RNA, 14 nt, Human
uaaccagcagaaau

SEQ ID NO: 3125976 - RNA, 20 nt, Human
uaacuuuuauaaacuuuacc

SEQ ID NO: 3125977 - RNA, 12 nt, Human
uaacagaaaugu

SEQ ID NO: 3125978 - RNA, 14 nt, Human
uaacagaaauguac

SEQ ID NO: 3125979 - RNA, 15 nt, Human
uaacagaaauguaca

SEQ ID NO: 3125980 - RNA, 13 nt, Human
uaacagaaaugua

SEQ ID NO: 3125981 - RNA, 22 nt, Human
uaagaggcagggucucacucug

SEQ ID NO: 3125982 - RNA, 22 nt, Human
uaagaaccuuuugagugccuua

SEQ ID NO: 3125983 - RNA, 21 nt, Human
uaacuuuuauaaacuuuaccu

SEQ ID NO: 3125984 - RNA, 22 nt, Human
uaacuuuuauaaacuuuaccuu

SEQ ID NO: 3125985 - RNA, 19 nt, Human
uaacuuuuauaaacuuuac

SEQ ID NO: 3125986 - RNA, 24 nt, Human
uaagaaagacuaucuaaauguuga

SEQ ID NO: 3125987 - RNA, 16 nt, Human
uaagauaaaugugcug

SEQ ID NO: 3125988 - RNA, 17 nt, Human
uaagauaaaugugcuga

SEQ ID NO: 3125989 - RNA, 14 nt, Human
uaagauaaaugugc

SEQ ID NO: 3125990 - RNA, 23 nt, Human
uaagagggagggagggcuccaga

SEQ ID NO: 3125991 - RNA, 22 nt, Human
uaagagggagggagggcuccag

SEQ ID NO: 3125992 - RNA, 12 nt, Human
uaagagggaggg

SEQ ID NO: 3125993 - RNA, 19 nt, Human
uaaggaugcuuguacauaa

SEQ ID NO: 3125994 - RNA, 20 nt, Human
uaaggaugcuuguacauaau

SEQ ID NO: 3125995 - RNA, 21 nt, Human
uaaggaugcuuguacauaaug

SEQ ID NO: 3125996 - RNA, 22 nt, Human
uaaggaugcuuguacauaaugc

SEQ ID NO: 3125997 - RNA, 23 nt, Human
uaaggaugcuuguacauaaugcg

SEQ ID NO: 3125998 - RNA, 18 nt, Human
uaaggaugcuuguacaua

SEQ ID NO: 3125999 - RNA, 21 nt, Human
uaauaguucagguaacaggca

SEQ ID NO: 3126000 - RNA, 20 nt, Human
uaauccucuaggaggucucu

SEQ ID NO: 3126001 - RNA, 11 nt, Human
uaaucuaaaug

SEQ ID NO: 3126002 - RNA, 18 nt, Human
uaauucuuagcucauucu

SEQ ID NO: 3126003 - RNA, 22 nt, Human
uaauugacaggauuauuggaaa

SEQ ID NO: 3126004 - RNA, 20 nt, Human
uaauugacaggauuauugga

SEQ ID NO: 3126005 - RNA, 14 nt, Human
uaaugcgugcauac

SEQ ID NO: 3126006 - RNA, 20 nt, Human
uaauuaaguacuauguauca

SEQ ID NO: 3126007 - RNA, 17 nt, Human
uaauuaaaacacaacau

SEQ ID NO: 3126008 - RNA, 14 nt, Human
uaauuugugauaca

SEQ ID NO: 3126009 - RNA, 15 nt, Human
uaauuugugauacaa

SEQ ID NO: 3126010 - RNA, 18 nt, Human
uaauuugugauacaaugc

SEQ ID NO: 3126011 - RNA, 19 nt, Human
uaauuugugauacaaugcu

SEQ ID NO: 3126012 - RNA, 22 nt, Human
uaauuugugauacaaugcugug

SEQ ID NO: 3126013 - RNA, 22 nt, Human
guuugauuaaauucuugcaaag

SEQ ID NO: 3126014 - RNA, 17 nt, Human
guuugauuaaauucuug

SEQ ID NO: 3126015 - RNA, 19 nt, Human
guuugauuaaauucuugca

SEQ ID NO: 3126016 - RNA, 17 nt, Human
guuuguaaauuaacuuu

SEQ ID NO: 3126017 - RNA, 19 nt, Human
guuuguaaauuaacuuuua

SEQ ID NO: 3126018 - RNA, 16 nt, Human
guuucuaaagcugcca

SEQ ID NO: 3126019 - RNA, 15 nt, Human
guuucuaaagcugcc

SEQ ID NO: 3126020 - RNA, 14 nt, Human
guuucuaaagcugc

SEQ ID NO: 3126021 - RNA, 18 nt, Human
guuugagaucagccuggg

SEQ ID NO: 3126022 - RNA, 16 nt, Human
guuugaaccaagaacu

SEQ ID NO: 3126023 - RNA, 14 nt, Human
guuucagaaaugug

SEQ ID NO: 3126024 - RNA, 18 nt, Human
guuucagaaauguguuau

SEQ ID NO: 3126025 - RNA, 20 nt, Human
guuuccuggcacugcuucca

SEQ ID NO: 3126026 - RNA, 16 nt, Human
guuuccuggcacugcu

SEQ ID NO: 3126027 - RNA, 22 nt, Human
guuuccuggcacugcuuccagu

SEQ ID NO: 3126028 - RNA, 21 nt, Human
guuuccuggcacugcuuccag

SEQ ID NO: 3126029 - RNA, 18 nt, Human
gguuggcaaaaaggcagg

SEQ ID NO: 3126030 - RNA, 21 nt, Human
gguuggccccugcccggcugc

SEQ ID NO: 3126031 - RNA, 15 nt, Human
guuuagauaauacac

SEQ ID NO: 3126032 - RNA, 19 nt, Human
guuuucucuugagagggug

SEQ ID NO: 3126033 - RNA, 12 nt, Human
guuuucucuuga

SEQ ID NO: 3126034 - RNA, 19 nt, Human
guuuuuauggcuuuugugc

SEQ ID NO: 3126035 - RNA, 22 nt, Human
guuuuuauggcuuuugugcauu

SEQ ID NO: 3126036 - RNA, 23 nt, Human
guuuuuauggcuuuugugcauua

SEQ ID NO: 3126037 - RNA, 13 nt, Human
guuuuccugaaga

SEQ ID NO: 3126038 - RNA, 17 nt, Human
guuuucaguguacaugg

SEQ ID NO: 3126039 - RNA, 16 nt, Human
guuuucaguguacaug

SEQ ID NO: 3126040 - RNA, 23 nt, Human
uaaaaaacugcugacuguuuucu

SEQ ID NO: 3126041 - RNA, 20 nt, Human
uaaaaaacugcugacuguuu

SEQ ID NO: 3126042 - RNA, 21 nt, Human
uaaaguguauuuuuuuacuaa

SEQ ID NO: 3126043 - RNA, 22 nt, Human
uaaaguguauuuuuuuacuaau

SEQ ID NO: 3126044 - RNA, 23 nt, Human
uaaaguguauuuuuuuacuaaua

SEQ ID NO: 3126045 - RNA, 20 nt, Human
uaaaguguauuuuuuuacua

SEQ ID NO: 3126046 - RNA, 13 nt, Human
uaaaguuucuguu

SEQ ID NO: 3126047 - RNA, 19 nt, Human
uaaaucagccguguaacca

SEQ ID NO: 3126048 - RNA, 16 nt, Human
uaaacuuuaccuuuuu

SEQ ID NO: 3126049 - RNA, 22 nt, Human
uaaacuuuaccuuuuuuauaca

SEQ ID NO: 3126050 - RNA, 14 nt, Human
uaaacuuaaucuaa

SEQ ID NO: 3126051 - RNA, 13 nt, Human
uaaacuuaaucua

SEQ ID NO: 3126052 - RNA, 18 nt, Human
uaaacuuaaucuaaaugg

SEQ ID NO: 3126053 - RNA, 19 nt, Human
uaaacuuaaucuaaaugga

SEQ ID NO: 3126054 - RNA, 18 nt, Human
uaaacaagaccacguuuc

SEQ ID NO: 3126055 - RNA, 23 nt, Human
uaaacaagaccacguuucuaaag

SEQ ID NO: 3126056 - RNA, 18 nt, Human
ugcuuccagugaggcucu

SEQ ID NO: 3126057 - RNA, 20 nt, Human
ugcuuccagugaggcucugc

SEQ ID NO: 3126058 - RNA, 19 nt, Human
ugcuuccagugaggcucug

SEQ ID NO: 3126059 - RNA, 16 nt, Human
ugcuucuucagagacu

SEQ ID NO: 3126060 - RNA, 15 nt, Human
uggaaaauaaauuau

SEQ ID NO: 3126061 - RNA, 16 nt, Human
uggaaaauaaauuauu

SEQ ID NO: 3126062 - RNA, 12 nt, Human
uggaagacagcu

SEQ ID NO: 3126063 - RNA, 11 nt, Human
uggaagacagc

SEQ ID NO: 3126064 - RNA, 14 nt, Human
uggaagacagcucu

SEQ ID NO: 3126065 - RNA, 20 nt, Human
uggcagugggagcugccugu

SEQ ID NO: 3126066 - RNA, 13 nt, Human
uggcagugggagc

SEQ ID NO: 3126067 - RNA, 14 nt, Human
uggcagugggagcu

SEQ ID NO: 3126068 - RNA, 15 nt, Human
uggcagugggagcug

SEQ ID NO: 3126069 - RNA, 16 nt, Human
uggcagugggagcugc

SEQ ID NO: 3126070 - RNA, 19 nt, Human
uggcagugggagcugccug

SEQ ID NO: 3126071 - RNA, 18 nt, Human
uggcacugcuuccaguga

SEQ ID NO: 3126072 - RNA, 16 nt, Human
uggcacugcuuccagu

SEQ ID NO: 3126073 - RNA, 14 nt, Human
uggcacugcuucca

SEQ ID NO: 3126074 - RNA, 14 nt, Human
uggaugccuggugg

SEQ ID NO: 3126075 - RNA, 19 nt, Human
uggcagcugcgguccaccc

SEQ ID NO: 3126076 - RNA, 21 nt, Human
uggcagcugcgguccacccag

SEQ ID NO: 3126077 - RNA, 22 nt, Human
uggcagcugcgguccacccagg

SEQ ID NO: 3126078 - RNA, 22 nt, Human
uggaggcaugugaugagaggaa

SEQ ID NO: 3126079 - RNA, 12 nt, Human
uggacaggcaug

SEQ ID NO: 3126080 - RNA, 16 nt, Human
uggacaggcauguucu

SEQ ID NO: 3126081 - RNA, 14 nt, Human
uggcugggggccuc

SEQ ID NO: 3126082 - RNA, 22 nt, Human
uggcugguuagagguucccuuu

SEQ ID NO: 3126083 - RNA, 22 nt, Human
ugggaaugaaugucagugugac

SEQ ID NO: 3126084 - RNA, 21 nt, Human
ugggaaugaaugucaguguga

SEQ ID NO: 3126085 - RNA, 23 nt, Human
ugggagcugccuguucagcucca

SEQ ID NO: 3126086 - RNA, 16 nt, Human
ugggacaugggaaagg

SEQ ID NO: 3126087 - RNA, 22 nt, Human
uggcucagguggggucacucug

SEQ ID NO: 3126088 - RNA, 20 nt, Human
uggcucagguggggucacuc

SEQ ID NO: 3126089 - RNA, 16 nt, Human
uggcucuuccaggcug

SEQ ID NO: 3126090 - RNA, 12 nt, Human
uggcugggggcc

SEQ ID NO: 3126091 - RNA, 15 nt, Human
uggcucuuccaggcu

SEQ ID NO: 3126092 - RNA, 13 nt, Human
uggcucuuccagg

SEQ ID NO: 3126093 - RNA, 22 nt, Human
uggcgugcaguggugcgaucug

SEQ ID NO: 3126094 - RNA, 14 nt, Human
uggcgcugccccug

SEQ ID NO: 3126095 - RNA, 15 nt, Human
uggccagaugcacca

SEQ ID NO: 3126096 - RNA, 14 nt, Human
ugggccuccugugu

SEQ ID NO: 3126097 - RNA, 16 nt, Human
ugggccuccugugugu

SEQ ID NO: 3126098 - RNA, 22 nt, Human
ugggccuccugugugugcgccu

SEQ ID NO: 3126099 - RNA, 24 nt, Human
ugggagcugccuguucagcuccag

SEQ ID NO: 3126100 - RNA, 20 nt, Human
ugggcuucaguggcagcugc

SEQ ID NO: 3126101 - RNA, 19 nt, Human
ugggcuuggggaccagagc

SEQ ID NO: 3126102 - RNA, 16 nt, Human
uggggcagcuugaggg

SEQ ID NO: 3126103 - RNA, 21 nt, Human
ugggcuuggggaccagagcug

SEQ ID NO: 3126104 - RNA, 13 nt, Human
uggggcagcuuga

SEQ ID NO: 3126105 - RNA, 18 nt, Human
ugggcuucaguggcagcu

SEQ ID NO: 3126106 - RNA, 19 nt, Human
ugggcuucaguggcagcug

SEQ ID NO: 3126107 - RNA, 23 nt, Human
uggguucaagcgauucuucugcu

SEQ ID NO: 3126108 - RNA, 16 nt, Human
uggguucacugcaacc

SEQ ID NO: 3126109 - RNA, 21 nt, Human
ugggugucaagagggucugag

SEQ ID NO: 3126110 - RNA, 23 nt, Human
ugggugucaagagggucugagga

SEQ ID NO: 3126111 - RNA, 17 nt, Human
ugggguggggaccucag

SEQ ID NO: 3126112 - RNA, 19 nt, Human
ugcauguuacauaagauaa

SEQ ID NO: 3126113 - RNA, 15 nt, Human
ugcaucguuucaucu

SEQ ID NO: 3126114 - RNA, 16 nt, Human
ugcaggcagccaggcc

SEQ ID NO: 3126115 - RNA, 18 nt, Human
ugcaggcagccaggccac

SEQ ID NO: 3126116 - RNA, 17 nt, Human
ugcaggcagccaggcca

SEQ ID NO: 3126117 - RNA, 22 nt, Human
ugccagggacagaggggguggc

SEQ ID NO: 3126118 - RNA, 11 nt, Human
ugccagggaca

SEQ ID NO: 3126119 - RNA, 24 nt, Human
ugccagguuuuuggucugacccac

SEQ ID NO: 3126120 - RNA, 14 nt, Human
ugccagucaccccg

SEQ ID NO: 3126121 - RNA, 10 nt, Human
ugcccagccc

SEQ ID NO: 3126122 - RNA, 14 nt, Human
ugcccaccuggccu

SEQ ID NO: 3126123 - RNA, 18 nt, Human
ugcccaccuggccucugc

SEQ ID NO: 3126124 - RNA, 17 nt, Human
ugcccaccuggccucug

SEQ ID NO: 3126125 - RNA, 15 nt, Human
ugcccaccuggccuc

SEQ ID NO: 3126126 - RNA, 23 nt, Human
ugcacagcuaacauggaaguacu

SEQ ID NO: 3126127 - RNA, 20 nt, Human
ugcacagcuaacauggaagu

SEQ ID NO: 3126128 - RNA, 18 nt, Human
ugcacagcuaacauggaa

SEQ ID NO: 3126129 - RNA, 22 nt, Human
ugaagucuuuguacagacaaca

SEQ ID NO: 3126130 - RNA, 20 nt, Human
ugaagucuuuguacagacaa

SEQ ID NO: 3126131 - RNA, 17 nt, Human
ugaagucuuuguacaga

SEQ ID NO: 3126132 - RNA, 17 nt, Human
ugcacagcuaacaugga

SEQ ID NO: 3126133 - RNA, 23 nt, Human
ugcacagaguuguuacauuuuua

SEQ ID NO: 3126134 - RNA, 21 nt, Human
ugcacagaguuguuacauuuu

SEQ ID NO: 3126135 - RNA, 22 nt, Human
ugcacagaguuguuacauuuuu

SEQ ID NO: 3126136 - RNA, 20 nt, Human
ugcacagaguuguuacauuu

SEQ ID NO: 3126137 - RNA, 21 nt, Human
ugcacuugcagacucuacaga

SEQ ID NO: 3126138 - RNA, 16 nt, Human
ugcacuugcagacucu

SEQ ID NO: 3126139 - RNA, 16 nt, Human
ugcacguacacacaca

SEQ ID NO: 3126140 - RNA, 19 nt, Human
ugcacuuuguucuggcucu

SEQ ID NO: 3126141 - RNA, 18 nt, Human
ugcacuuuguucuggcuc

SEQ ID NO: 3126142 - RNA, 15 nt, Human
ugcacuuuguucugg

SEQ ID NO: 3126143 - RNA, 14 nt, Human
ugcagcaauaaagc

SEQ ID NO: 3126144 - RNA, 15 nt, Human
ugcagcaauaaagca

SEQ ID NO: 3126145 - RNA, 16 nt, Human
ugcagcaauaaagcag

SEQ ID NO: 3126146 - RNA, 18 nt, Human
ugcaggaccucaggugag

SEQ ID NO: 3126147 - RNA, 16 nt, Human
ugcaggaccucaggug

SEQ ID NO: 3126148 - RNA, 15 nt, Human
ugcaggaccucaggu

SEQ ID NO: 3126149 - RNA, 14 nt, Human
ugcaggaccucagg

SEQ ID NO: 3126150 - RNA, 23 nt, Human
ugcccaggcuggcgugcaguggu

SEQ ID NO: 3126151 - RNA, 11 nt, Human
ugcccagcccc

SEQ ID NO: 3126152 - RNA, 14 nt, Human
ugccucugggacug

SEQ ID NO: 3126153 - RNA, 16 nt, Human
ugccuccuuugugagg

SEQ ID NO: 3126154 - RNA, 18 nt, Human
ugccuccuuugugaggaa

SEQ ID NO: 3126155 - RNA, 17 nt, Human
ugccuccuuugugagga

SEQ ID NO: 3126156 - RNA, 22 nt, Human
ugccugaagucacacagugagu

SEQ ID NO: 3126157 - RNA, 18 nt, Human
ugccugaagucacacagu

SEQ ID NO: 3126158 - RNA, 17 nt, Human
ugccugaagucacacag

SEQ ID NO: 3126159 - RNA, 21 nt, Human
ugccuggauggggcugcaccg

SEQ ID NO: 3126160 - RNA, 22 nt, Human
ugccuuauggaacacucugaga

SEQ ID NO: 3126161 - RNA, 21 nt, Human
ugccuuauggaacacucugag

SEQ ID NO: 3126162 - RNA, 20 nt, Human
ugccuuauggaacacucuga

SEQ ID NO: 3126163 - RNA, 18 nt, Human
ugccuuauggaacacucu

SEQ ID NO: 3126164 - RNA, 23 nt, Human
ugcggugcuaucucccccagccc

SEQ ID NO: 3126165 - RNA, 21 nt, Human
ugcggugcuaucucccccagc

SEQ ID NO: 3126166 - RNA, 21 nt, Human
ugcugaaggcucgagcaugcc

SEQ ID NO: 3126167 - RNA, 23 nt, Human
ugcugaauacagaggcaacugca

SEQ ID NO: 3126168 - RNA, 18 nt, Human
ugcugaauacagaggcaa

SEQ ID NO: 3126169 - RNA, 17 nt, Human
ugcugaaugguuuucaa

SEQ ID NO: 3126170 - RNA, 18 nt, Human
ugcugaaugguuuucaaa

SEQ ID NO: 3126171 - RNA, 22 nt, Human
ugcugaaugguuuucaaaauaa

SEQ ID NO: 3126172 - RNA, 19 nt, Human
ugcuccuggcccacugcau

SEQ ID NO: 3126173 - RNA, 15 nt, Human
ugcugcaguugccag

SEQ ID NO: 3126174 - RNA, 23 nt, Human
ugcugauggugcaaugaccuuuc

SEQ ID NO: 3126175 - RNA, 20 nt, Human
ugcugauggugcaaugaccu

SEQ ID NO: 3126176 - RNA, 18 nt, Human
ugcugauggugcaaugac

SEQ ID NO: 3126177 - RNA, 15 nt, Human
ugcugacagacacag

SEQ ID NO: 3126178 - RNA, 23 nt, Human
ugcugagucugaaggcuggguuc

SEQ ID NO: 3126179 - RNA, 16 nt, Human
ugcugacagacacagg

SEQ ID NO: 3126180 - RNA, 16 nt, Human
ugcuaggaacacuccu

SEQ ID NO: 3126181 - RNA, 19 nt, Human
ugcuaggaacacuccuuca

SEQ ID NO: 3126182 - RNA, 17 nt, Human
ugcuaggaacacuccuu

SEQ ID NO: 3126183 - RNA, 15 nt, Human
ugcgugcauaccacu

SEQ ID NO: 3126184 - RNA, 18 nt, Human
ugcuccucuccccagcaa

SEQ ID NO: 3126185 - RNA, 19 nt, Human
ugcuccucuccccagcaag

SEQ ID NO: 3126186 - RNA, 20 nt, Human
ugucagugugacugaucucu

SEQ ID NO: 3126187 - RNA, 12 nt, Human
ugucagugugac

SEQ ID NO: 3126188 - RNA, 16 nt, Human
uguaucccaugagccu

SEQ ID NO: 3126189 - RNA, 19 nt, Human
uguaucccaugagccucag

SEQ ID NO: 3126190 - RNA, 23 nt, Human
uguaucccaugagccucagcauc

SEQ ID NO: 3126191 - RNA, 23 nt, Human
uguaccucuugagccuugaacuu

SEQ ID NO: 3126192 - RNA, 22 nt, Human
uguaccucuugagccuugaacu

SEQ ID NO: 3126193 - RNA, 14 nt, Human
uguaccucuugagc

SEQ ID NO: 3126194 - RNA, 17 nt, Human
uguacgucugacaggca

SEQ ID NO: 3126195 - RNA, 16 nt, Human
uguacgucugacaggc

SEQ ID NO: 3126196 - RNA, 14 nt, Human
uguagagugggagc

SEQ ID NO: 3126197 - RNA, 13 nt, Human
uguaaauuaacuu

SEQ ID NO: 3126198 - RNA, 14 nt, Human
uguaaauuaacuuu

SEQ ID NO: 3126199 - RNA, 15 nt, Human
uguaaauuaacuuuu

SEQ ID NO: 3126200 - RNA, 16 nt, Human
uguaaauuaacuuuua

SEQ ID NO: 3126201 - RNA, 17 nt, Human
uguaaauuaacuuuuau

SEQ ID NO: 3126202 - RNA, 21 nt, Human
ugugacaaggauugcuacugu

SEQ ID NO: 3126203 - RNA, 21 nt, Human
ugugauacaaugcugugcccu

SEQ ID NO: 3126204 - RNA, 23 nt, Human
ugugaguacuacaguccucccau

SEQ ID NO: 3126205 - RNA, 20 nt, Human
ugugaguacuacaguccucc

SEQ ID NO: 3126206 - RNA, 19 nt, Human
ugugaguacuacaguccuc

SEQ ID NO: 3126207 - RNA, 18 nt, Human
ugugaguacuacaguccu

SEQ ID NO: 3126208 - RNA, 18 nt, Human
ugucuuuggacccugagg

SEQ ID NO: 3126209 - RNA, 17 nt, Human
ugucuuuggacccugag

SEQ ID NO: 3126210 - RNA, 22 nt, Human
ugucuuuggacccugaggccca

SEQ ID NO: 3126211 - RNA, 19 nt, Human
ugucuuuggacccugaggc

SEQ ID NO: 3126212 - RNA, 16 nt, Human
ugucuuuuuucacuac

SEQ ID NO: 3126213 - RNA, 13 nt, Human
ugugaaaggaaag

SEQ ID NO: 3126214 - RNA, 14 nt, Human
ugugaaaggaaaga

SEQ ID NO: 3126215 - RNA, 20 nt, Human
ugugcgugcauguguguuca

SEQ ID NO: 3126216 - RNA, 17 nt, Human
ugugccucugggacugg

SEQ ID NO: 3126217 - RNA, 16 nt, Human
ugugcacaugcacgug

SEQ ID NO: 3126218 - RNA, 22 nt, Human
ugugcacaugcacgugugugca

SEQ ID NO: 3126219 - RNA, 13 nt, Human
ugugccucuggga

SEQ ID NO: 3126220 - RNA, 15 nt, Human
ugugccucugggacu

SEQ ID NO: 3126221 - RNA, 16 nt, Human
ugugccucugggacug

SEQ ID NO: 3126222 - RNA, 15 nt, Human
uguggacacagcucu

SEQ ID NO: 3126223 - RNA, 12 nt, Human
uguggagaagcg

SEQ ID NO: 3126224 - RNA, 14 nt, Human
uguggacacagcuc

SEQ ID NO: 3126225 - RNA, 13 nt, Human
uguggacacagcu

SEQ ID NO: 3126226 - RNA, 22 nt, Human
ugugggcuaguugggcuuccuc

SEQ ID NO: 3126227 - RNA, 12 nt, Human
ugugggaagggg

SEQ ID NO: 3126228 - RNA, 16 nt, Human
uguuacugucuucagu

SEQ ID NO: 3126229 - RNA, 15 nt, Human
uguuacugucuucag

SEQ ID NO: 3126230 - RNA, 22 nt, Human
uguuacauuuuuaagugcugca

SEQ ID NO: 3126231 - RNA, 13 nt, Human
uguuacauuuuua

SEQ ID NO: 3126232 - RNA, 19 nt, Human
uguuacauaagauaaaugu

SEQ ID NO: 3126233 - RNA, 15 nt, Human
uguucagcuccagcu

SEQ ID NO: 3126234 - RNA, 16 nt, Human
uguucagcuccagcuc

SEQ ID NO: 3126235 - RNA, 22 nt, Human
uguucagcuccagcucaccagc

SEQ ID NO: 3126236 - RNA, 11 nt, Human
uguucagcugg

SEQ ID NO: 3126237 - RNA, 14 nt, Human
uguucagcuccagc

SEQ ID NO: 3126238 - RNA, 16 nt, Human
uguguagggcgggagg

SEQ ID NO: 3126239 - RNA, 15 nt, Human
uguuggccaaagcca

SEQ ID NO: 3126240 - RNA, 11 nt, Human
uguuggccagg

SEQ ID NO: 3126241 - RNA, 14 nt, Human
uguuggccaggcug

SEQ ID NO: 3126242 - RNA, 11 nt, Human
uguugaaagau

SEQ ID NO: 3126243 - RNA, 20 nt, Human
uguucuuuccaaaguacacu

SEQ ID NO: 3126244 - RNA, 20 nt, Human
uguucuuucuggcuaugcau

SEQ ID NO: 3126245 - RNA, 22 nt, Human
uguucuuucuggcuaugcauuu

SEQ ID NO: 3126246 - RNA, 14 nt, Human
uguucuuucuggcu

SEQ ID NO: 3126247 - RNA, 18 nt, Human
uguucugacccugcuuca

SEQ ID NO: 3126248 - RNA, 19 nt, Human
uguucucugcccuccaaga

SEQ ID NO: 3126249 - RNA, 15 nt, Human
uguucugacccugcu

SEQ ID NO: 3126250 - RNA, 13 nt, Human
uguucucugagga

SEQ ID NO: 3126251 - RNA, 16 nt, Human
uguucucugaggacac

SEQ ID NO: 3126252 - RNA, 18 nt, Human
uguucucugaggacacua

SEQ ID NO: 3126253 - RNA, 12 nt, Human
uguucucugccc

SEQ ID NO: 3126254 - RNA, 21 nt, Human
uuaaggaagacaaugugaaaa

SEQ ID NO: 3126255 - RNA, 17 nt, Human
uuaaggaugcuuguaca

SEQ ID NO: 3126256 - RNA, 18 nt, Human
uuaaggaugcuuguacau

SEQ ID NO: 3126257 - RNA, 19 nt, Human
uuaaggaugcuuguacaua

SEQ ID NO: 3126258 - RNA, 20 nt, Human
uuaaggaugcuuguacauaa

SEQ ID NO: 3126259 - RNA, 22 nt, Human
uuaaggaugcuuguacauaaug

SEQ ID NO: 3126260 - RNA, 18 nt, Human
uuaaugucacaggcaggu

SEQ ID NO: 3126261 - RNA, 17 nt, Human
uuaaugucacaggcagg

SEQ ID NO: 3126262 - RNA, 20 nt, Human
uuacgguuuuccagguuuaa

SEQ ID NO: 3126263 - RNA, 22 nt, Human
uuaccuuuuuuauacauaaaca

SEQ ID NO: 3126264 - RNA, 19 nt, Human
uuaccuuuuuuauacauaa

SEQ ID NO: 3126265 - RNA, 20 nt, Human
uuaccuuuuuuauacauaaa

SEQ ID NO: 3126266 - RNA, 20 nt, Human
uuacauuuuuaagugcugca

SEQ ID NO: 3126267 - RNA, 21 nt, Human
uuacauuuuuaagugcugcau

SEQ ID NO: 3126268 - RNA, 22 nt, Human
uuacauuuuuaagugcugcauu

SEQ ID NO: 3126269 - RNA, 18 nt, Human
uuaaaugcccagccccuu

SEQ ID NO: 3126270 - RNA, 17 nt, Human
uuaaaugcccagccccu

SEQ ID NO: 3126271 - RNA, 17 nt, Human
uuaaaugcaccuggaau

SEQ ID NO: 3126272 - RNA, 18 nt, Human
uuaaaugcaccuggaaua

SEQ ID NO: 3126273 - RNA, 16 nt, Human
uuaaaugcaccuggaa

SEQ ID NO: 3126274 - RNA, 11 nt, Human
uuaaaugcacc

SEQ ID NO: 3126275 - RNA, 16 nt, Human
uuaaacuuaaucuaaa

SEQ ID NO: 3126276 - RNA, 18 nt, Human
uuaaacuuaaucuaaaug

SEQ ID NO: 3126277 - RNA, 20 nt, Human
uuaaacuuaaucuaaaugga

SEQ ID NO: 3126278 - RNA, 15 nt, Human
uguuuccuggcacug

SEQ ID NO: 3126279 - RNA, 22 nt, Human
uguuuccuggcacugcuuccag

SEQ ID NO: 3126280 - RNA, 21 nt, Human
uguuuccuggcacugcuucca

SEQ ID NO: 3126281 - RNA, 20 nt, Human
uguuuccuggcacugcuucc

SEQ ID NO: 3126282 - RNA, 16 nt, Human
uguuuguugucagcug

SEQ ID NO: 3126283 - RNA, 17 nt, Human
uguuuguugucagcuga

SEQ ID NO: 3126284 - RNA, 13 nt, Human
uguuuuugucuua

SEQ ID NO: 3126285 - RNA, 19 nt, Human
uugcugauggugcaaugac

SEQ ID NO: 3126286 - RNA, 20 nt, Human
uugcugauggugcaaugacc

SEQ ID NO: 3126287 - RNA, 22 nt, Human
uugcugauggugcaaugaccuu

SEQ ID NO: 3126288 - RNA, 23 nt, Human
uugcccacgcuggagugcaguga

SEQ ID NO: 3126289 - RNA, 13 nt, Human
uugccagucaccc

SEQ ID NO: 3126290 - RNA, 18 nt, Human
uugccagucaccccggcc

SEQ ID NO: 3126291 - RNA, 11 nt, Human
uugccucugcc

SEQ ID NO: 3126292 - RNA, 14 nt, Human
uugccucugccucu

SEQ ID NO: 3126293 - RNA, 16 nt, Human
uugccucugccucuga

SEQ ID NO: 3126294 - RNA, 18 nt, Human
uugccucugccucugaca

SEQ ID NO: 3126295 - RNA, 23 nt, Human
uuggaaagaguaggaagacuuug

SEQ ID NO: 3126296 - RNA, 19 nt, Human
uuggaaggaacguccccug

SEQ ID NO: 3126297 - RNA, 11 nt, Human
uuggaaggaac

SEQ ID NO: 3126298 - RNA, 17 nt, Human
uuggcaaaaaggcagga

SEQ ID NO: 3126299 - RNA, 22 nt, Human
uuggcuuuggguugcaggaccu

SEQ ID NO: 3126300 - RNA, 16 nt, Human
uugggaggccauuugu

SEQ ID NO: 3126301 - RNA, 16 nt, Human
uuggguggaugccugg

SEQ ID NO: 3126302 - RNA, 16 nt, Human
uuggcugcugaaggcu

SEQ ID NO: 3126303 - RNA, 18 nt, Human
uuggcugggggccucagu

SEQ ID NO: 3126304 - RNA, 21 nt, Human
uuggcugggggccucagugcc

SEQ ID NO: 3126305 - RNA, 22 nt, Human
uuggcugggggccucagugcca

SEQ ID NO: 3126306 - RNA, 14 nt, Human
uuggccaggcuggu

SEQ ID NO: 3126307 - RNA, 24 nt, Human
uuggccaaagccaaagcuaggccu

SEQ ID NO: 3126308 - RNA, 13 nt, Human
uuggcauucccca

SEQ ID NO: 3126309 - RNA, 14 nt, Human
uuguagagccaggg

SEQ ID NO: 3126310 - RNA, 15 nt, Human
uuguagagccagggu

SEQ ID NO: 3126311 - RNA, 21 nt, Human
uuguauucucuccuguaccuc

SEQ ID NO: 3126312 - RNA, 13 nt, Human
uuguacagacaac

SEQ ID NO: 3126313 - RNA, 12 nt, Human
uuguacagacaa

SEQ ID NO: 3126314 - RNA, 16 nt, Human
uuggucccccuuccau

SEQ ID NO: 3126315 - RNA, 22 nt, Human
uuggucccccuuccauggacuu

SEQ ID NO: 3126316 - RNA, 12 nt, Human
uugguccugcug

SEQ ID NO: 3126317 - RNA, 19 nt, Human
uucuuauuuaaugaaagac

SEQ ID NO: 3126318 - RNA, 23 nt, Human
uucuuauuuaaugaaagacugua

SEQ ID NO: 3126319 - RNA, 13 nt, Human
uucuugguuugua

SEQ ID NO: 3126320 - RNA, 16 nt, Human
uucuugguuuguaaau

SEQ ID NO: 3126321 - RNA, 23 nt, Human
uucuugguuuguaaauuaacuuu

SEQ ID NO: 3126322 - RNA, 17 nt, Human
uucuugguuuguaaauu

SEQ ID NO: 3126323 - RNA, 18 nt, Human
uucuugguuuguaaauua

SEQ ID NO: 3126324 - RNA, 17 nt, Human
uucuguccuacucugug

SEQ ID NO: 3126325 - RNA, 23 nt, Human
uucuguggguuucuaaagcugcc

SEQ ID NO: 3126326 - RNA, 21 nt, Human
uucuguccgagcuuugaaaau

SEQ ID NO: 3126327 - RNA, 17 nt, Human
uucuguccgagcuuuga

SEQ ID NO: 3126328 - RNA, 19 nt, Human
uugaagacuuuucuuucag

SEQ ID NO: 3126329 - RNA, 17 nt, Human
uugaagacagagcuaca

SEQ ID NO: 3126330 - RNA, 22 nt, Human
uugaacuuugaccucugcagca

SEQ ID NO: 3126331 - RNA, 20 nt, Human
uugaacuuugaccucugcag

SEQ ID NO: 3126332 - RNA, 19 nt, Human
uugaacucuucaaucucuu

SEQ ID NO: 3126333 - RNA, 16 nt, Human
uugaacugauaaagau

SEQ ID NO: 3126334 - RNA, 18 nt, Human
uucuuuauaauucuacuu

SEQ ID NO: 3126335 - RNA, 21 nt, Human
uugaaaacacuguucucugcc

SEQ ID NO: 3126336 - RNA, 19 nt, Human
uugaaaacacuguucucug

SEQ ID NO: 3126337 - RNA, 21 nt, Human
uugauagcacagacccugccc

SEQ ID NO: 3126338 - RNA, 18 nt, Human
uugauagcacagacccug

SEQ ID NO: 3126339 - RNA, 14 nt, Human
uugcaacaggcugg

SEQ ID NO: 3126340 - RNA, 17 nt, Human
uugcaacaggcugggcu

SEQ ID NO: 3126341 - RNA, 18 nt, Human
uugauuuccguuaaaaua

SEQ ID NO: 3126342 - RNA, 16 nt, Human
uugcagacaggcaagc

SEQ ID NO: 3126343 - RNA, 20 nt, Human
uugacgccaucccagcccca

SEQ ID NO: 3126344 - RNA, 20 nt, Human
uugauagcacagacccugcc

SEQ ID NO: 3126345 - RNA, 19 nt, Human
uugauagcacagacccugc

SEQ ID NO: 3126346 - RNA, 22 nt, Human
uugaccugaggcccuucucucc

SEQ ID NO: 3126347 - RNA, 19 nt, Human
uugaccugaggcccuucuc

SEQ ID NO: 3126348 - RNA, 12 nt, Human
uugaccugaggc

SEQ ID NO: 3126349 - RNA, 22 nt, Human
uugacgccaucccagccccaau

SEQ ID NO: 3126350 - RNA, 14 nt, Human
uugacgccauccca

SEQ ID NO: 3126351 - RNA, 16 nt, Human
uugaccucugcagcaa

SEQ ID NO: 3126352 - RNA, 15 nt, Human
uugaccucaggugau

SEQ ID NO: 3126353 - RNA, 21 nt, Human
uugaccgugaggccagagaca

SEQ ID NO: 3126354 - RNA, 20 nt, Human
uugaccgugaggccagagac

SEQ ID NO: 3126355 - RNA, 23 nt, Human
uucagcuccagcucaccagcccc

SEQ ID NO: 3126356 - RNA, 24 nt, Human
uucagcucugcaagaauugaagca

SEQ ID NO: 3126357 - RNA, 17 nt, Human
uucagcucugcaagaau

SEQ ID NO: 3126358 - RNA, 16 nt, Human
uucaggaagcucaggg

SEQ ID NO: 3126359 - RNA, 17 nt, Human
uucagcugacuuuucug

SEQ ID NO: 3126360 - RNA, 19 nt, Human
uucaggaagcucagggccu

SEQ ID NO: 3126361 - RNA, 17 nt, Human
uucaggaagcucagggc

SEQ ID NO: 3126362 - RNA, 20 nt, Human
uucaggaagcucagggccug

SEQ ID NO: 3126363 - RNA, 15 nt, Human
uucaggaagcucagg

SEQ ID NO: 3126364 - RNA, 15 nt, Human
uucagagacuccugc

SEQ ID NO: 3126365 - RNA, 22 nt, Human
uucagcuccagcucaccagccc

SEQ ID NO: 3126366 - RNA, 14 nt, Human
uucacucuccuugg

SEQ ID NO: 3126367 - RNA, 18 nt, Human
uucaauucucauuuguca

SEQ ID NO: 3126368 - RNA, 14 nt, Human
uuacgugaguccug

SEQ ID NO: 3126369 - RNA, 13 nt, Human
uuacgugaguccu

SEQ ID NO: 3126370 - RNA, 13 nt, Human
uucaaagauauuu

SEQ ID NO: 3126371 - RNA, 17 nt, Human
uuccaugaguccccugu

SEQ ID NO: 3126372 - RNA, 18 nt, Human
uucauuuaggugaggaag

SEQ ID NO: 3126373 - RNA, 19 nt, Human
uucauuuaggugaggaagc

SEQ ID NO: 3126374 - RNA, 11 nt, Human
uucaucuugaa

SEQ ID NO: 3126375 - RNA, 20 nt, Human
uucaucuuccaacucaaacu

SEQ ID NO: 3126376 - RNA, 12 nt, Human
uucaucuugaau

SEQ ID NO: 3126377 - RNA, 18 nt, Human
uucagugccuuauggaac

SEQ ID NO: 3126378 - RNA, 21 nt, Human
uucagugccuuauggaacacu

SEQ ID NO: 3126379 - RNA, 19 nt, Human
uucagugccuuauggaaca

SEQ ID NO: 3126380 - RNA, 23 nt, Human
uucauaaugacuuaagcacacuu

SEQ ID NO: 3126381 - RNA, 13 nt, Human
uucauaaugacuu

SEQ ID NO: 3126382 - RNA, 11 nt, Human
uucuccaggcu

SEQ ID NO: 3126383 - RNA, 13 nt, Human
uucuccacccugc

SEQ ID NO: 3126384 - RNA, 16 nt, Human
uucuccaagcaggaca

SEQ ID NO: 3126385 - RNA, 16 nt, Human
uucucuccagccccug

SEQ ID NO: 3126386 - RNA, 18 nt, Human
uucucuccagccccugga

SEQ ID NO: 3126387 - RNA, 22 nt, Human
uucucuccuguaccucuugagc

SEQ ID NO: 3126388 - RNA, 17 nt, Human
uucucugcccuccaaga

SEQ ID NO: 3126389 - RNA, 20 nt, Human
uucucugaggacacuaacca

SEQ ID NO: 3126390 - RNA, 21 nt, Human
uucugacccugcuucaaauau

SEQ ID NO: 3126391 - RNA, 21 nt, Human
uucugacccaugcugcccugu

SEQ ID NO: 3126392 - RNA, 20 nt, Human
uucugacccaugcugcccug

SEQ ID NO: 3126393 - RNA, 18 nt, Human
uucugacccaugcugccc

SEQ ID NO: 3126394 - RNA, 16 nt, Human
uucugacccaugcugc

SEQ ID NO: 3126395 - RNA, 14 nt, Human
uucuauuguuucuu

SEQ ID NO: 3126396 - RNA, 16 nt, Human
uucuaugacacaugca

SEQ ID NO: 3126397 - RNA, 17 nt, Human
uucuaugacacaugcaa

SEQ ID NO: 3126398 - RNA, 12 nt, Human
uuccucccuccc

SEQ ID NO: 3126399 - RNA, 19 nt, Human
uuccucccucccucuuucc

SEQ ID NO: 3126400 - RNA, 21 nt, Human
uuccucccucccucuuucccu

SEQ ID NO: 3126401 - RNA, 22 nt, Human
uuccucccucccucuuucccuc

SEQ ID NO: 3126402 - RNA, 23 nt, Human
uuccucauaguaugguggcuggg

SEQ ID NO: 3126403 - RNA, 22 nt, Human
uuccccacuugagaauuacccu

SEQ ID NO: 3126404 - RNA, 19 nt, Human
uucccuuugacgccauccc

SEQ ID NO: 3126405 - RNA, 17 nt, Human
uucuaaaggcuaccuuu

SEQ ID NO: 3126406 - RNA, 18 nt, Human
uucuaaaggcuaccuuug

SEQ ID NO: 3126407 - RNA, 16 nt, Human
uucuaaaggcuaccuu

SEQ ID NO: 3126408 - RNA, 19 nt, Human
uuccuucagugccuuaugg

SEQ ID NO: 3126409 - RNA, 16 nt, Human
uuccuucagugccuua

SEQ ID NO: 3126410 - RNA, 23 nt, Human
uuccuucagugccuuauggaaca

SEQ ID NO: 3126411 - RNA, 19 nt, Human
uuccuucauucaacccacc

SEQ ID NO: 3126412 - RNA, 15 nt, Human
uuccuucagugccuu

SEQ ID NO: 3126413 - RNA, 17 nt, Human
uuuuuuccuucagugcc

SEQ ID NO: 3126414 - RNA, 12 nt, Human
uuuuuuacuaau

SEQ ID NO: 3126415 - RNA, 21 nt, Human
uuuaucgucacugcuuaacuu

SEQ ID NO: 3126416 - RNA, 16 nt, Human
uuuaucgucacugcuu

SEQ ID NO: 3126417 - RNA, 16 nt, Human
uuuauaaacuuuaccu

SEQ ID NO: 3126418 - RNA, 14 nt, Human
uuuauaaacuuuac

SEQ ID NO: 3126419 - RNA, 19 nt, Human
uuuauuuaguuccuugagu

SEQ ID NO: 3126420 - RNA, 16 nt, Human
uuuauugucaaagugg

SEQ ID NO: 3126421 - RNA, 14 nt, Human
uuuauugucaaagu

SEQ ID NO: 3126422 - RNA, 15 nt, Human
uuuacuuuguguuca

SEQ ID NO: 3126423 - RNA, 21 nt, Human
uuuccucuuuggucuacacug

SEQ ID NO: 3126424 - RNA, 14 nt, Human
uuucuaaaggcuac

SEQ ID NO: 3126425 - RNA, 17 nt, Human
uuucuaaagcugccagc

SEQ ID NO: 3126426 - RNA, 14 nt, Human
uuucuaaagcugcc

SEQ ID NO: 3126427 - RNA, 15 nt, Human
uuucuagccagagga

SEQ ID NO: 3126428 - RNA, 15 nt, Human
uuucagccaagaauu

SEQ ID NO: 3126429 - RNA, 22 nt, Human
uuucauugcugggcuugucugu

SEQ ID NO: 3126430 - RNA, 13 nt, Human
uuuccaggaaggc

SEQ ID NO: 3126431 - RNA, 12 nt, Human
uuuccaaaguac

SEQ ID NO: 3126432 - RNA, 15 nt, Human
uuuccaaaguacacu

SEQ ID NO: 3126433 - RNA, 19 nt, Human
uuucaauaggaaaaacuga

SEQ ID NO: 3126434 - RNA, 22 nt, Human
uuucaauaggaaaaacugauuu

SEQ ID NO: 3126435 - RNA, 20 nt, Human
uuucaauaggaaaaacugau

SEQ ID NO: 3126436 - RNA, 18 nt, Human
uuuuaucgucacugcuua

SEQ ID NO: 3126437 - RNA, 15 nt, Human
uuuuccuucagugcc

SEQ ID NO: 3126438 - RNA, 17 nt, Human
uuuucuugcaugaggcu

SEQ ID NO: 3126439 - RNA, 14 nt, Human
uuuucuucucccuc

SEQ ID NO: 3126440 - RNA, 19 nt, Human
uuuuccaugaguccccugu

SEQ ID NO: 3126441 - RNA, 18 nt, Human
uuuuccaugaguccccug

SEQ ID NO: 3126442 - RNA, 15 nt, Human
uuuucacaguucucu

SEQ ID NO: 3126443 - RNA, 19 nt, Human
uuuggugguuucagaaaug

SEQ ID NO: 3126444 - RNA, 16 nt, Human
uuuguaaauuaacuuu

SEQ ID NO: 3126445 - RNA, 17 nt, Human
uuuguaaauuaacuuuu

SEQ ID NO: 3126446 - RNA, 15 nt, Human
uuuguaaauuaacuu

SEQ ID NO: 3126447 - RNA, 21 nt, Human
uuuguccccaccgcagacagg

SEQ ID NO: 3126448 - RNA, 13 nt, Human
uuuguccccaccg

SEQ ID NO: 3126449 - RNA, 16 nt, Human
uuuguugucagcugaa

SEQ ID NO: 3126450 - RNA, 15 nt, Human
uuugagcagggcuca

SEQ ID NO: 3126451 - RNA, 17 nt, Human
uuugaggucuguucuuu

SEQ ID NO: 3126452 - RNA, 22 nt, Human
uuugaggucuguucuuuccaaa

SEQ ID NO: 3126453 - RNA, 18 nt, Human
uuugccauguuggccagg

SEQ ID NO: 3126454 - RNA, 14 nt, Human
uuugcagacaggca

SEQ ID NO: 3126455 - RNA, 20 nt, Human
ccauccucuguacagagccc

SEQ ID NO: 3126456 - RNA, 13 nt, Human
ccaugcugcccug

SEQ ID NO: 3126457 - RNA, 11 nt, Human
ccaugcugccc

SEQ ID NO: 3126458 - RNA, 14 nt, Human
ccaugcugcccugu

SEQ ID NO: 3126459 - RNA, 18 nt, Human
ccaugauguuuuccauga

SEQ ID NO: 3126460 - RNA, 21 nt, Human
ccaugauuaaccacuucagcu

SEQ ID NO: 3126461 - RNA, 19 nt, Human
ccaugauuaaccacuucag

SEQ ID NO: 3126462 - RNA, 19 nt, Human
ccagugaggcucugcccuu

SEQ ID NO: 3126463 - RNA, 18 nt, Human
ccagugaggcucugcccu

SEQ ID NO: 3126464 - RNA, 20 nt, Human
ccagugaggcucugcccuug

SEQ ID NO: 3126465 - RNA, 17 nt, Human
ccagugaggcucugccc

SEQ ID NO: 3126466 - RNA, 19 nt, Human
ccauccucuguacagagcc

SEQ ID NO: 3126467 - RNA, 12 nt, Human
ccauccucugua

SEQ ID NO: 3126468 - RNA, 22 nt, Human
ccaucauugaaaucuuuuugcu

SEQ ID NO: 3126469 - RNA, 16 nt, Human
ccauucuccaccugcc

SEQ ID NO: 3126470 - RNA, 15 nt, Human
ccauucuccaccugc

SEQ ID NO: 3126471 - RNA, 14 nt, Human
ccauggacuuuguu

SEQ ID NO: 3126472 - RNA, 13 nt, Human
ccauggacuuugu

SEQ ID NO: 3126473 - RNA, 21 nt, Human
ccauucugccugcccaggccc

SEQ ID NO: 3126474 - RNA, 14 nt, Human
ccauucuccaccug

SEQ ID NO: 3126475 - RNA, 19 nt, Human
ccauucugccugcccaggc

SEQ ID NO: 3126476 - RNA, 20 nt, Human
ccauucugccugcccaggcc

SEQ ID NO: 3126477 - RNA, 16 nt, Human
ccauucugccugccca

SEQ ID NO: 3126478 - RNA, 17 nt, Human
ccauucuccaccugcca

SEQ ID NO: 3126479 - RNA, 17 nt, Human
ccauucugccugcccag

SEQ ID NO: 3126480 - RNA, 18 nt, Human
ccauucugccugcccagg

SEQ ID NO: 3126481 - RNA, 22 nt, Human
ccauuuugggguacccacugcu

SEQ ID NO: 3126482 - RNA, 20 nt, Human
ccauuuugggguacccacug

SEQ ID NO: 3126483 - RNA, 23 nt, Human
ccauuuuggauucuuauggacaa

SEQ ID NO: 3126484 - RNA, 20 nt, Human
cccaaaacucuccucugcug

SEQ ID NO: 3126485 - RNA, 16 nt, Human
cccaaagcagugcaug

SEQ ID NO: 3126486 - RNA, 15 nt, Human
cccaaagaugcagcc

SEQ ID NO: 3126487 - RNA, 12 nt, Human
cccaaagaugca

SEQ ID NO: 3126488 - RNA, 13 nt, Human
ccaggaggccagc

SEQ ID NO: 3126489 - RNA, 12 nt, Human
ccaggaggccag

SEQ ID NO: 3126490 - RNA, 12 nt, Human
ccaggagccucc

SEQ ID NO: 3126491 - RNA, 18 nt, Human
ccaggagccuccugcccu

SEQ ID NO: 3126492 - RNA, 14 nt, Human
ccaggagccuccug

SEQ ID NO: 3126493 - RNA, 13 nt, Human
ccaggagccuccu

SEQ ID NO: 3126494 - RNA, 22 nt, Human
ccaggcauuccccaggaggcca

SEQ ID NO: 3126495 - RNA, 23 nt, Human
ccaggcauuccccaggaggccag

SEQ ID NO: 3126496 - RNA, 24 nt, Human
ccaggcauuccccaggaggccagc

SEQ ID NO: 3126497 - RNA, 14 nt, Human
ccaggcauucccca

SEQ ID NO: 3126498 - RNA, 13 nt, Human
ccaggcauggugg

SEQ ID NO: 3126499 - RNA, 15 nt, Human
ccaggagccccgagg

SEQ ID NO: 3126500 - RNA, 16 nt, Human
ccaggagcagccacau

SEQ ID NO: 3126501 - RNA, 15 nt, Human
ccaggagcagccaca

SEQ ID NO: 3126502 - RNA, 19 nt, Human
ccaggugcuaggaacacuc

SEQ ID NO: 3126503 - RNA, 23 nt, Human
ccaguaaaugggggugcauuuga

SEQ ID NO: 3126504 - RNA, 14 nt, Human
ccagguucagcuug

SEQ ID NO: 3126505 - RNA, 20 nt, Human
ccaggcuguaucccaugagc

SEQ ID NO: 3126506 - RNA, 14 nt, Human
ccaggcuggucuca

SEQ ID NO: 3126507 - RNA, 19 nt, Human
ccaggcuggucucaaacuc

SEQ ID NO: 3126508 - RNA, 13 nt, Human
ccaggccccugcc

SEQ ID NO: 3126509 - RNA, 11 nt, Human
ccagcucuggu

SEQ ID NO: 3126510 - RNA, 13 nt, Human
ccagcucuggucc

SEQ ID NO: 3126511 - RNA, 12 nt, Human
ccagcucugguc

SEQ ID NO: 3126512 - RNA, 14 nt, Human
ccagcgagcccugg

SEQ ID NO: 3126513 - RNA, 13 nt, Human
ccagcgagcccug

SEQ ID NO: 3126514 - RNA, 15 nt, Human
ccagcgagcccuggu

SEQ ID NO: 3126515 - RNA, 16 nt, Human
ccagcgagcccuggug

SEQ ID NO: 3126516 - RNA, 22 nt, Human
ccagagcccaccuuggcucaag

SEQ ID NO: 3126517 - RNA, 16 nt, Human
ccagagcccaccuugg

SEQ ID NO: 3126518 - RNA, 20 nt, Human
ccagccuugaccauucucca

SEQ ID NO: 3126519 - RNA, 19 nt, Human
ccagccuugaccauucucc

SEQ ID NO: 3126520 - RNA, 23 nt, Human
ccagcugcuugggcuucauccuc

SEQ ID NO: 3126521 - RNA, 20 nt, Human
ccagcugcuugggcuucauc

SEQ ID NO: 3126522 - RNA, 22 nt, Human
ccagcucugguccauagagagc

SEQ ID NO: 3126523 - RNA, 21 nt, Human
ccagcucugguccauagagag

SEQ ID NO: 3126524 - RNA, 17 nt, Human
ccagcucugguccauag

SEQ ID NO: 3126525 - RNA, 14 nt, Human
ccagcucuggucca

SEQ ID NO: 3126526 - RNA, 22 nt, Human
ccaggaagccagcaggcucuca

SEQ ID NO: 3126527 - RNA, 20 nt, Human
ccaggaagccagcaggcucu

SEQ ID NO: 3126528 - RNA, 22 nt, Human
ccccaaauggaaaugggcagag

SEQ ID NO: 3126529 - RNA, 20 nt, Human
ccccacccaagggccuggcc

SEQ ID NO: 3126530 - RNA, 14 nt, Human
ccccacccaagggc

SEQ ID NO: 3126531 - RNA, 15 nt, Human
cccagugcccacagg

SEQ ID NO: 3126532 - RNA, 20 nt, Human
cccagugcccacaggaucag

SEQ ID NO: 3126533 - RNA, 17 nt, Human
cccagugccgagaagga

SEQ ID NO: 3126534 - RNA, 18 nt, Human
cccagugccgagaaggaa

SEQ ID NO: 3126535 - RNA, 16 nt, Human
cccaugcugcccugug

SEQ ID NO: 3126536 - RNA, 15 nt, Human
cccaugcugcccugu

SEQ ID NO: 3126537 - RNA, 17 nt, Human
cccaugcugcccuguga

SEQ ID NO: 3126538 - RNA, 17 nt, Human
ccccaggaggccagccu

SEQ ID NO: 3126539 - RNA, 11 nt, Human
cccaggcaggu

SEQ ID NO: 3126540 - RNA, 13 nt, Human
cccaggcaggucu

SEQ ID NO: 3126541 - RNA, 21 nt, Human
cccaggagccccgaggccuuc

SEQ ID NO: 3126542 - RNA, 18 nt, Human
cccaggagccccgaggcc

SEQ ID NO: 3126543 - RNA, 22 nt, Human
cccaggaggccagccuugacca

SEQ ID NO: 3126544 - RNA, 13 nt, Human
cccaggaggccag

SEQ ID NO: 3126545 - RNA, 18 nt, Human
cccaggaggccagccuug

SEQ ID NO: 3126546 - RNA, 17 nt, Human
cccaggcaggucuugaa

SEQ ID NO: 3126547 - RNA, 18 nt, Human
cccaggcauuccccagga

SEQ ID NO: 3126548 - RNA, 21 nt, Human
cccaggcauuccccaggaggc

SEQ ID NO: 3126549 - RNA, 20 nt, Human
cccaggcauuccccaggagg

SEQ ID NO: 3126550 - RNA, 23 nt, Human
cccaggcauuccccaggaggcca

SEQ ID NO: 3126551 - RNA, 22 nt, Human
cccaggcauuccccaggaggcc

SEQ ID NO: 3126552 - RNA, 11 nt, Human
cccaggccccu

SEQ ID NO: 3126553 - RNA, 16 nt, Human
cccaggccccugccac

SEQ ID NO: 3126554 - RNA, 18 nt, Human
cccaggccccugccaccc

SEQ ID NO: 3126555 - RNA, 21 nt, Human
cccaggccccugccacccugg

SEQ ID NO: 3126556 - RNA, 22 nt, Human
cccaggccccugccacccuggg

SEQ ID NO: 3126557 - RNA, 20 nt, Human
cccagucuggaaugcagugg

SEQ ID NO: 3126558 - RNA, 13 nt, Human
cccagugcccaca

SEQ ID NO: 3126559 - RNA, 23 nt, Human
cccaggugcuaggaacacuccuu

SEQ ID NO: 3126560 - RNA, 22 nt, Human
cccaggugcuaggaacacuccu

SEQ ID NO: 3126561 - RNA, 18 nt, Human
cccaggccuccuacagcu

SEQ ID NO: 3126562 - RNA, 17 nt, Human
cccaggccuccuacagc

SEQ ID NO: 3126563 - RNA, 11 nt, Human
cccagccccuu

SEQ ID NO: 3126564 - RNA, 19 nt, Human
cccagcaagugagagcugg

SEQ ID NO: 3126565 - RNA, 20 nt, Human
cccagcaagugagagcuggg

SEQ ID NO: 3126566 - RNA, 21 nt, Human
cccagcaagugagagcugggu

SEQ ID NO: 3126567 - RNA, 22 nt, Human
cccagcaagugagagcugggug

SEQ ID NO: 3126568 - RNA, 12 nt, Human
cccagccugcua

SEQ ID NO: 3126569 - RNA, 19 nt, Human
cccagcgagcccugguggc

SEQ ID NO: 3126570 - RNA, 23 nt, Human
cccagcgagcccugguggcagug

SEQ ID NO: 3126571 - RNA, 17 nt, Human
cccagcgagcccuggug

SEQ ID NO: 3126572 - RNA, 18 nt, Human
cccagcgagcccuggugg

SEQ ID NO: 3126573 - RNA, 15 nt, Human
cccagcgagcccugg

SEQ ID NO: 3126574 - RNA, 18 nt, Human
cccagagggccugcaagg

SEQ ID NO: 3126575 - RNA, 20 nt, Human
cccagagggccugcaaggga

SEQ ID NO: 3126576 - RNA, 20 nt, Human
cccagauugcaacaggcugg

SEQ ID NO: 3126577 - RNA, 21 nt, Human
cccagauugcaacaggcuggg

SEQ ID NO: 3126578 - RNA, 22 nt, Human
cccagauugcaacaggcugggc

SEQ ID NO: 3126579 - RNA, 16 nt, Human
cccagcaagugagagc

SEQ ID NO: 3126580 - RNA, 18 nt, Human
cccagcaagugagagcug

SEQ ID NO: 3126581 - RNA, 23 nt, Human
cccaaugcacuuuguucuggcuc

SEQ ID NO: 3126582 - RNA, 23 nt, Human
cccaagggccuggccugagcugg

SEQ ID NO: 3126583 - RNA, 19 nt, Human
cccaagggccuggccugag

SEQ ID NO: 3126584 - RNA, 18 nt, Human
cccaagggccuggccuga

SEQ ID NO: 3126585 - RNA, 23 nt, Human
cccaaauggaaaugggcagagca

SEQ ID NO: 3126586 - RNA, 17 nt, Human
cccaagggccuggccug

SEQ ID NO: 3126587 - RNA, 22 nt, Human
ccaacauacucccaucugugaa

SEQ ID NO: 3126588 - RNA, 21 nt, Human
ccaacauacucccaucuguga

SEQ ID NO: 3126589 - RNA, 16 nt, Human
ccaacauacucccauc

SEQ ID NO: 3126590 - RNA, 20 nt, Human
ccaacauacucccaucugug

SEQ ID NO: 3126591 - RNA, 19 nt, Human
ccaacauacucccaucugu

SEQ ID NO: 3126592 - RNA, 18 nt, Human
ccaacauacucccaucug

SEQ ID NO: 3126593 - RNA, 17 nt, Human
ccaacauacucccaucu

SEQ ID NO: 3126594 - RNA, 15 nt, Human
ccaaaguacacuguu

SEQ ID NO: 3126595 - RNA, 18 nt, Human
ccaaaguacacuguuuca

SEQ ID NO: 3126596 - RNA, 23 nt, Human
ccaaaggaagcacaugccucucu

SEQ ID NO: 3126597 - RNA, 15 nt, Human
ccaaaggaagcacau

SEQ ID NO: 3126598 - RNA, 21 nt, Human
ccaaagcuaggccuggccaga

SEQ ID NO: 3126599 - RNA, 16 nt, Human
ccaaagcuaggccugg

SEQ ID NO: 3126600 - RNA, 17 nt, Human
ccaaagcuaggccuggc

SEQ ID NO: 3126601 - RNA, 15 nt, Human
ccaaagcuaggccug

SEQ ID NO: 3126602 - RNA, 20 nt, Human
ccaaacucaccugccccuca

SEQ ID NO: 3126603 - RNA, 19 nt, Human
ccaaagccaaagcuaggcc

SEQ ID NO: 3126604 - RNA, 23 nt, Human
ccaaagcagugcaugcugucccu

SEQ ID NO: 3126605 - RNA, 19 nt, Human
ccaaagcagugcaugcugu

SEQ ID NO: 3126606 - RNA, 22 nt, Human
ccaaagccuccuccagccgcca

SEQ ID NO: 3126607 - RNA, 17 nt, Human
ccaaagccuccuccagc

SEQ ID NO: 3126608 - RNA, 20 nt, Human
ccaagaagcccaggaaaggc

SEQ ID NO: 3126609 - RNA, 19 nt, Human
ccaagaagcccaggaaagg

SEQ ID NO: 3126610 - RNA, 12 nt, Human
ccaacccucauc

SEQ ID NO: 3126611 - RNA, 15 nt, Human
ccaagaagcccagga

SEQ ID NO: 3126612 - RNA, 15 nt, Human
ccaagggccuggccu

SEQ ID NO: 3126613 - RNA, 21 nt, Human
ccaaggccaaaggaagcacau

SEQ ID NO: 3126614 - RNA, 18 nt, Human
ccaaggccaaaggaagca

SEQ ID NO: 3126615 - RNA, 22 nt, Human
ccaaggggaauguuugccucug

SEQ ID NO: 3126616 - RNA, 18 nt, Human
ccaagggccuggccugag

SEQ ID NO: 3126617 - RNA, 16 nt, Human
ccaagggccuggccug

SEQ ID NO: 3126618 - RNA, 19 nt, Human
ccaagggccuggccugagc

SEQ ID NO: 3126619 - RNA, 20 nt, Human
ccaagucaagugaaaaagga

SEQ ID NO: 3126620 - RNA, 13 nt, Human
ccaaggugggagg

SEQ ID NO: 3126621 - RNA, 23 nt, Human
ccaagguuuggggaagaacgaag

SEQ ID NO: 3126622 - RNA, 14 nt, Human
ccaagcucccaggc

SEQ ID NO: 3126623 - RNA, 17 nt, Human
ccaaggccaaaggaagc

SEQ ID NO: 3126624 - RNA, 22 nt, Human
ccaagcucccaggcauucccca

SEQ ID NO: 3126625 - RNA, 16 nt, Human
ccaagcucccaggcau

SEQ ID NO: 3126626 - RNA, 15 nt, Human
ccaagcucccaggca

SEQ ID NO: 3126627 - RNA, 16 nt, Human
cauuugagcagggcuc

SEQ ID NO: 3126628 - RNA, 20 nt, Human
cauuugagcagggcucagcg

SEQ ID NO: 3126629 - RNA, 17 nt, Human
cauuugagcagggcuca

SEQ ID NO: 3126630 - RNA, 18 nt, Human
cauuugagcagggcucag

SEQ ID NO: 3126631 - RNA, 17 nt, Human
cauuuguuugaacugau

SEQ ID NO: 3126632 - RNA, 20 nt, Human
cauuuguuugaacugauaaa

SEQ ID NO: 3126633 - RNA, 22 nt, Human
cauuuguuugaacugauaaaga

SEQ ID NO: 3126634 - RNA, 14 nt, Human
cauuugcuccuuuc

SEQ ID NO: 3126635 - RNA, 13 nt, Human
cauuugcuccuuu

SEQ ID NO: 3126636 - RNA, 22 nt, Human
cauuugaaaauuuugauguuuu

SEQ ID NO: 3126637 - RNA, 20 nt, Human
cauuugaaaauuuugauguu

SEQ ID NO: 3126638 - RNA, 17 nt, Human
ccaaacucaccugcccc

SEQ ID NO: 3126639 - RNA, 15 nt, Human
cacccaagggccugg

SEQ ID NO: 3126640 - RNA, 14 nt, Human
cacccaagggccug

SEQ ID NO: 3126641 - RNA, 17 nt, Human
cauuguuggccaaagcc

SEQ ID NO: 3126642 - RNA, 18 nt, Human
cauuguuggccaaagcca

SEQ ID NO: 3126643 - RNA, 12 nt, Human
cauuuccugugu

SEQ ID NO: 3126644 - RNA, 13 nt, Human
cauuuccuguguc

SEQ ID NO: 3126645 - RNA, 12 nt, Human
cauuuaaaagau

SEQ ID NO: 3126646 - RNA, 15 nt, Human
cauuuaaaagauaca

SEQ ID NO: 3126647 - RNA, 16 nt, Human
cauuuaaaagauacag

SEQ ID NO: 3126648 - RNA, 16 nt, Human
ccacuacauucuguua

SEQ ID NO: 3126649 - RNA, 17 nt, Human
ccacuacauucuguuaa

SEQ ID NO: 3126650 - RNA, 11 nt, Human
ccacuacauuc

SEQ ID NO: 3126651 - RNA, 15 nt, Human
ccacuacauucuguu

SEQ ID NO: 3126652 - RNA, 14 nt, Human
ccacuacauucugu

SEQ ID NO: 3126653 - RNA, 15 nt, Human
ccaccccacacacgc

SEQ ID NO: 3126654 - RNA, 16 nt, Human
ccacgcuggagugcag

SEQ ID NO: 3126655 - RNA, 13 nt, Human
ccacgcuggagug

SEQ ID NO: 3126656 - RNA, 15 nt, Human
ccacccccacccaag

SEQ ID NO: 3126657 - RNA, 18 nt, Human
ccacgcuggagugcagug

SEQ ID NO: 3126658 - RNA, 19 nt, Human
ccacgcuggagugcaguga

SEQ ID NO: 3126659 - RNA, 16 nt, Human
ccacggccaggccaga

SEQ ID NO: 3126660 - RNA, 18 nt, Human
ccacggccaggccagagg

SEQ ID NO: 3126661 - RNA, 23 nt, Human
ccacggccaggccagagggagug

SEQ ID NO: 3126662 - RNA, 19 nt, Human
ccagaauuucccaaagcag

SEQ ID NO: 3126663 - RNA, 12 nt, Human
ccagaauuuccc

SEQ ID NO: 3126664 - RNA, 18 nt, Human
ccagaauuucccaaagca

SEQ ID NO: 3126665 - RNA, 21 nt, Human
ccagaauuucccaaagcagug

SEQ ID NO: 3126666 - RNA, 21 nt, Human
ccagacaccuugacagggcac

SEQ ID NO: 3126667 - RNA, 20 nt, Human
ccagacaccuugacagggca

SEQ ID NO: 3126668 - RNA, 14 nt, Human
ccacuucagcugac

SEQ ID NO: 3126669 - RNA, 13 nt, Human
ccacuucagcuga

SEQ ID NO: 3126670 - RNA, 23 nt, Human
ccacugcacuccagccuggguga

SEQ ID NO: 3126671 - RNA, 23 nt, Human
ccagaaguuugagaucagccugg

SEQ ID NO: 3126672 - RNA, 22 nt, Human
ccagaaguuugagaucagccug

SEQ ID NO: 3126673 - RNA, 21 nt, Human
ccacccaggagccccgaggcc

SEQ ID NO: 3126674 - RNA, 23 nt, Human
ccacccaggagccccgaggccuu

SEQ ID NO: 3126675 - RNA, 17 nt, Human
ccacccccacccaaggg

SEQ ID NO: 3126676 - RNA, 16 nt, Human
ccacaugugcacaugc

SEQ ID NO: 3126677 - RNA, 16 nt, Human
ccacauuccugaugcu

SEQ ID NO: 3126678 - RNA, 19 nt, Human
ccacaucuugcucugcuga

SEQ ID NO: 3126679 - RNA, 18 nt, Human
ccacaucuugcucugcug

SEQ ID NO: 3126680 - RNA, 17 nt, Human
ccacaucuugcucugcu

SEQ ID NO: 3126681 - RNA, 21 nt, Human
ccaccaacauacucccaucug

SEQ ID NO: 3126682 - RNA, 16 nt, Human
ccacaggaucagucug

SEQ ID NO: 3126683 - RNA, 20 nt, Human
ccacacccagcccacuucug

SEQ ID NO: 3126684 - RNA, 15 nt, Human
ccacacccagcccac

SEQ ID NO: 3126685 - RNA, 21 nt, Human
ccacacccagcccacuucugc

SEQ ID NO: 3126686 - RNA, 22 nt, Human
ccacacccagcccacuucugcc

SEQ ID NO: 3126687 - RNA, 14 nt, Human
ccuggcaugggaau

SEQ ID NO: 3126688 - RNA, 17 nt, Human
ccuggcaugggaaugaa

SEQ ID NO: 3126689 - RNA, 16 nt, Human
ccuggcaugggaauga

SEQ ID NO: 3126690 - RNA, 16 nt, Human
ccuggcagccccuguu

SEQ ID NO: 3126691 - RNA, 14 nt, Human
ccuggcagccccug

SEQ ID NO: 3126692 - RNA, 21 nt, Human
ccuggcacugcuuccagugag

SEQ ID NO: 3126693 - RNA, 17 nt, Human
ccuggcacugcuuccag

SEQ ID NO: 3126694 - RNA, 20 nt, Human
ccuggcacugcuuccaguga

SEQ ID NO: 3126695 - RNA, 14 nt, Human
ccuggacccugugg

SEQ ID NO: 3126696 - RNA, 13 nt, Human
ccuggacccugug

SEQ ID NO: 3126697 - RNA, 14 nt, Human
ccugggcagaagga

SEQ ID NO: 3126698 - RNA, 12 nt, Human
ccugggcagaag

SEQ ID NO: 3126699 - RNA, 20 nt, Human
ccugggaggucaaggcugca

SEQ ID NO: 3126700 - RNA, 20 nt, Human
ccugggaucccucauccuca

SEQ ID NO: 3126701 - RNA, 16 nt, Human
ccugggaucccucauc

SEQ ID NO: 3126702 - RNA, 18 nt, Human
ccuggcaugggaaugaau

SEQ ID NO: 3126703 - RNA, 14 nt, Human
ccuggccccucagg

SEQ ID NO: 3126704 - RNA, 12 nt, Human
ccugcuccagcu

SEQ ID NO: 3126705 - RNA, 22 nt, Human
ccugcuccagcuguucagcugg

SEQ ID NO: 3126706 - RNA, 14 nt, Human
ccugcuccagcugu

SEQ ID NO: 3126707 - RNA, 13 nt, Human
ccugcuccagcug

SEQ ID NO: 3126708 - RNA, 18 nt, Human
ccugcaacaccuuguuuc

SEQ ID NO: 3126709 - RNA, 16 nt, Human
ccugcaaccugauugu

SEQ ID NO: 3126710 - RNA, 19 nt, Human
ccugcaacaccuuguuucc

SEQ ID NO: 3126711 - RNA, 23 nt, Human
ccugcgucucauacucaccucac

SEQ ID NO: 3126712 - RNA, 19 nt, Human
ccugcugguucaggguugg

SEQ ID NO: 3126713 - RNA, 13 nt, Human
ccugcugguucag

SEQ ID NO: 3126714 - RNA, 21 nt, Human
ccugcuggguguggcgcagca

SEQ ID NO: 3126715 - RNA, 23 nt, Human
ccuguagagugggagcugagugg

SEQ ID NO: 3126716 - RNA, 19 nt, Human
ccuguagagugggagcuga

SEQ ID NO: 3126717 - RNA, 21 nt, Human
ccuguagagugggagcugagu

SEQ ID NO: 3126718 - RNA, 20 nt, Human
ccuguaauccuagcacuuug

SEQ ID NO: 3126719 - RNA, 12 nt, Human
ccuguaccucuu

SEQ ID NO: 3126720 - RNA, 18 nt, Human
ccugguggcagcucaccu

SEQ ID NO: 3126721 - RNA, 17 nt, Human
ccugguggcagcucacc

SEQ ID NO: 3126722 - RNA, 16 nt, Human
ccugguggcagcucac

SEQ ID NO: 3126723 - RNA, 14 nt, Human
ccugguggcagcuc

SEQ ID NO: 3126724 - RNA, 12 nt, Human
ccugguggcagc

SEQ ID NO: 3126725 - RNA, 13 nt, Human
ccugguggcagcu

SEQ ID NO: 3126726 - RNA, 17 nt, Human
ccugugauggggcccug

SEQ ID NO: 3126727 - RNA, 19 nt, Human
ccugugauggggcccugcc

SEQ ID NO: 3126728 - RNA, 18 nt, Human
ccugugauggggcccugc

SEQ ID NO: 3126729 - RNA, 22 nt, Human
ccugugauggggcccugccucc

SEQ ID NO: 3126730 - RNA, 21 nt, Human
ccugugauggggcccugccuc

SEQ ID NO: 3126731 - RNA, 20 nt, Human
ccugugauggggcccugccu

SEQ ID NO: 3126732 - RNA, 19 nt, Human
ccugugccucugggacugg

SEQ ID NO: 3126733 - RNA, 15 nt, Human
ccugugccucuggga

SEQ ID NO: 3126734 - RNA, 17 nt, Human
ccugugccucugggacu

SEQ ID NO: 3126735 - RNA, 18 nt, Human
ccuguccccgcacugggc

SEQ ID NO: 3126736 - RNA, 16 nt, Human
ccugucccccugacaa

SEQ ID NO: 3126737 - RNA, 17 nt, Human
ccugucccccugacaac

SEQ ID NO: 3126738 - RNA, 20 nt, Human
ccugugaguacuacaguccu

SEQ ID NO: 3126739 - RNA, 12 nt, Human
ccuucagugccu

SEQ ID NO: 3126740 - RNA, 14 nt, Human
ccuucagugccuua

SEQ ID NO: 3126741 - RNA, 13 nt, Human
ccuucagugccuu

SEQ ID NO: 3126742 - RNA, 19 nt, Human
ccuucagugccuuauggaa

SEQ ID NO: 3126743 - RNA, 15 nt, Human
ccuucagugccuuau

SEQ ID NO: 3126744 - RNA, 20 nt, Human
ccuucagugccuuauggaac

SEQ ID NO: 3126745 - RNA, 14 nt, Human
ccuuccucuuucca

SEQ ID NO: 3126746 - RNA, 18 nt, Human
ccuuccaggggugggaca

SEQ ID NO: 3126747 - RNA, 16 nt, Human
ccuuccagggguggga

SEQ ID NO: 3126748 - RNA, 15 nt, Human
ccuuccagggguggg

SEQ ID NO: 3126749 - RNA, 17 nt, Human
ccuuagacagucccugc

SEQ ID NO: 3126750 - RNA, 16 nt, Human
ccuuagacagucccug

SEQ ID NO: 3126751 - RNA, 19 nt, Human
ccuuagacagucccugcca

SEQ ID NO: 3126752 - RNA, 18 nt, Human
ccuuagacagucccugcc

SEQ ID NO: 3126753 - RNA, 21 nt, Human
ccuuagacagucccugccaau

SEQ ID NO: 3126754 - RNA, 14 nt, Human
ccuuagacaguccc

SEQ ID NO: 3126755 - RNA, 20 nt, Human
ccuuaccucggugccuuccu

SEQ ID NO: 3126756 - RNA, 19 nt, Human
ccuuacccucauguucuua

SEQ ID NO: 3126757 - RNA, 16 nt, Human
ccuuaccagcagagca

SEQ ID NO: 3126758 - RNA, 15 nt, Human
ccuuaccagcagagc

SEQ ID NO: 3126759 - RNA, 14 nt, Human
ccuuaccagcagag

SEQ ID NO: 3126760 - RNA, 11 nt, Human
ccuuuggcuuc

SEQ ID NO: 3126761 - RNA, 15 nt, Human
ccuugaaaacacugu

SEQ ID NO: 3126762 - RNA, 13 nt, Human
ccuucgcuccugu

SEQ ID NO: 3126763 - RNA, 14 nt, Human
ccuucgcuccugug

SEQ ID NO: 3126764 - RNA, 15 nt, Human
ccuucgcuccugugu

SEQ ID NO: 3126765 - RNA, 18 nt, Human
ccuucgcuccugugucuu

SEQ ID NO: 3126766 - RNA, 14 nt, Human
ccuugaacugggua

SEQ ID NO: 3126767 - RNA, 22 nt, Human
ccuugaaaacacuguucucugc

SEQ ID NO: 3126768 - RNA, 21 nt, Human
ccuugaaaacacuguucucug

SEQ ID NO: 3126769 - RNA, 19 nt, Human
ccuugaaaacacuguucuc

SEQ ID NO: 3126770 - RNA, 16 nt, Human
ccuugaacuggguacu

SEQ ID NO: 3126771 - RNA, 17 nt, Human
ccuugaacuuugaccuc

SEQ ID NO: 3126772 - RNA, 17 nt, Human
ccuugaaugaugccaug

SEQ ID NO: 3126773 - RNA, 20 nt, Human
ccuugaguugauucagcucu

SEQ ID NO: 3126774 - RNA, 21 nt, Human
ccuugaccauucuccaccugc

SEQ ID NO: 3126775 - RNA, 23 nt, Human
ccuugaguugauucagcucugca

SEQ ID NO: 3126776 - RNA, 22 nt, Human
ccuugaguugauucagcucugc

SEQ ID NO: 3126777 - RNA, 19 nt, Human
ccuuggauuguccccgacc

SEQ ID NO: 3126778 - RNA, 15 nt, Human
ccuugacagggcaca

SEQ ID NO: 3126779 - RNA, 17 nt, Human
ccuugacagggcacacc

SEQ ID NO: 3126780 - RNA, 20 nt, Human
ccuugaccauucuccaccug

SEQ ID NO: 3126781 - RNA, 19 nt, Human
ccuugaccauucuccaccu

SEQ ID NO: 3126782 - RNA, 14 nt, Human
ccuugacagggcac

SEQ ID NO: 3126783 - RNA, 13 nt, Human
ccuugacagggca

SEQ ID NO: 3126784 - RNA, 20 nt, Human
cguuucuaugacacaugcaa

SEQ ID NO: 3126785 - RNA, 19 nt, Human
cguuucuaaaggcuaccuu

SEQ ID NO: 3126786 - RNA, 21 nt, Human
cguuucuaaaggcuaccuuug

SEQ ID NO: 3126787 - RNA, 15 nt, Human
cguggcugcuucaag

SEQ ID NO: 3126788 - RNA, 14 nt, Human
cguggcugcuucaa

SEQ ID NO: 3126789 - RNA, 12 nt, Human
cguggcugcuuc

SEQ ID NO: 3126790 - RNA, 22 nt, Human
cgugcaguggugcgaucugggu

SEQ ID NO: 3126791 - RNA, 22 nt, Human
cgugcacacaccagagcccacc

SEQ ID NO: 3126792 - RNA, 14 nt, Human
cgugcauaccacuu

SEQ ID NO: 3126793 - RNA, 18 nt, Human
cgugcauaccacuuuugu

SEQ ID NO: 3126794 - RNA, 19 nt, Human
cgugcauaccacuuuuguu

SEQ ID NO: 3126795 - RNA, 20 nt, Human
cgugcacacaccagagccca

SEQ ID NO: 3126796 - RNA, 21 nt, Human
cgugcacacaccagagcccac

SEQ ID NO: 3126797 - RNA, 14 nt, Human
cguccccugucccc

SEQ ID NO: 3126798 - RNA, 11 nt, Human
cguccccuguc

SEQ ID NO: 3126799 - RNA, 13 nt, Human
cgucugacaggca

SEQ ID NO: 3126800 - RNA, 14 nt, Human
cgucugacaggcaa

SEQ ID NO: 3126801 - RNA, 14 nt, Human
cgucuaccugaggg

SEQ ID NO: 3126802 - RNA, 23 nt, Human
cggugcuaucucccccagcccca

SEQ ID NO: 3126803 - RNA, 13 nt, Human
cgcuccugugucu

SEQ ID NO: 3126804 - RNA, 15 nt, Human
cggacagccacggcc

SEQ ID NO: 3126805 - RNA, 16 nt, Human
cggacagccacggcca

SEQ ID NO: 3126806 - RNA, 18 nt, Human
cggacagccacggccagg

SEQ ID NO: 3126807 - RNA, 20 nt, Human
cggaaugaaccacaucuugc

SEQ ID NO: 3126808 - RNA, 18 nt, Human
cggcuggccuggccccuc

SEQ ID NO: 3126809 - RNA, 14 nt, Human
cggcuggccuggcc

SEQ ID NO: 3126810 - RNA, 16 nt, Human
cggcuggccuggcccc

SEQ ID NO: 3126811 - RNA, 15 nt, Human
cggcuggccuggccc

SEQ ID NO: 3126812 - RNA, 16 nt, Human
cgggaggucgaggcag

SEQ ID NO: 3126813 - RNA, 17 nt, Human
cgggaggucgaggcagg

SEQ ID NO: 3126814 - RNA, 15 nt, Human
cgggcaugacacgaa

SEQ ID NO: 3126815 - RNA, 12 nt, Human
cgggcaugacac

SEQ ID NO: 3126816 - RNA, 20 nt, Human
cgggaggauguucugggaca

SEQ ID NO: 3126817 - RNA, 14 nt, Human
cgcagacaggacca

SEQ ID NO: 3126818 - RNA, 13 nt, Human
cgcagacaggacc

SEQ ID NO: 3126819 - RNA, 15 nt, Human
cgcccccacugguga

SEQ ID NO: 3126820 - RNA, 15 nt, Human
cgcgacaaugcaaac

SEQ ID NO: 3126821 - RNA, 17 nt, Human
cgcgacaaugcaaacca

SEQ ID NO: 3126822 - RNA, 16 nt, Human
cgcgacaaugcaaacc

SEQ ID NO: 3126823 - RNA, 14 nt, Human
cgcuaagagggagg

SEQ ID NO: 3126824 - RNA, 16 nt, Human
cgcuaagagggaggga

SEQ ID NO: 3126825 - RNA, 15 nt, Human
cgcuaagagggaggg

SEQ ID NO: 3126826 - RNA, 16 nt, Human
cgcgugcacacaccag

SEQ ID NO: 3126827 - RNA, 19 nt, Human
cgcgugcacacaccagagc

SEQ ID NO: 3126828 - RNA, 20 nt, Human
cgcgugcacacaccagagcc

SEQ ID NO: 3126829 - RNA, 15 nt, Human
ccuuuguauucucuc

SEQ ID NO: 3126830 - RNA, 18 nt, Human
ccuuuguauucucuccug

SEQ ID NO: 3126831 - RNA, 20 nt, Human
ccuuuguauucucuccugua

SEQ ID NO: 3126832 - RNA, 18 nt, Human
cgaggccuucucugaagg

SEQ ID NO: 3126833 - RNA, 19 nt, Human
cgaggccuucucugaagga

SEQ ID NO: 3126834 - RNA, 13 nt, Human
cgaggacagggag

SEQ ID NO: 3126835 - RNA, 12 nt, Human
cgaggacaggga

SEQ ID NO: 3126836 - RNA, 23 nt, Human
cgcacuucgggaggucgaggcag

SEQ ID NO: 3126837 - RNA, 12 nt, Human
cgauuucuguuu

SEQ ID NO: 3126838 - RNA, 19 nt, Human
cgaucuggguucacugcaa

SEQ ID NO: 3126839 - RNA, 13 nt, Human
cgauucuucugcu

SEQ ID NO: 3126840 - RNA, 19 nt, Human
cgauucuucugcuucagcc

SEQ ID NO: 3126841 - RNA, 21 nt, Human
cgauucuucugcuucagccuc

SEQ ID NO: 3126842 - RNA, 12 nt, Human
ccuuggcugcag

SEQ ID NO: 3126843 - RNA, 13 nt, Human
ccuuggcugcagg

SEQ ID NO: 3126844 - RNA, 20 nt, Human
ccuuguggucccaccccaca

SEQ ID NO: 3126845 - RNA, 19 nt, Human
ccuuguggucccaccccac

SEQ ID NO: 3126846 - RNA, 16 nt, Human
ccuuguggucccaccc

SEQ ID NO: 3126847 - RNA, 13 nt, Human
ccuuuaagagaaa

SEQ ID NO: 3126848 - RNA, 23 nt, Human
ccuuugacgccaucccagcccca

SEQ ID NO: 3126849 - RNA, 17 nt, Human
ccucugacacacagcuc

SEQ ID NO: 3126850 - RNA, 18 nt, Human
ccucugacacacagcucu

SEQ ID NO: 3126851 - RNA, 15 nt, Human
ccucugcacaagcug

SEQ ID NO: 3126852 - RNA, 11 nt, Human
ccucugcacaa

SEQ ID NO: 3126853 - RNA, 19 nt, Human
ccucugcacaagcugcacc

SEQ ID NO: 3126854 - RNA, 17 nt, Human
ccucugcacaagcugca

SEQ ID NO: 3126855 - RNA, 20 nt, Human
ccucugcacaagcugcaccc

SEQ ID NO: 3126856 - RNA, 19 nt, Human
ccucugcagcaauaaagca

SEQ ID NO: 3126857 - RNA, 22 nt, Human
ccucugcacuccccugcugggu

SEQ ID NO: 3126858 - RNA, 21 nt, Human
ccucugcacuccccugcuggg

SEQ ID NO: 3126859 - RNA, 20 nt, Human
ccucugcacuccccugcugg

SEQ ID NO: 3126860 - RNA, 19 nt, Human
ccucugcacuccccugcug

SEQ ID NO: 3126861 - RNA, 14 nt, Human
ccucugcacucccc

SEQ ID NO: 3126862 - RNA, 12 nt, Human
ccucugggacug

SEQ ID NO: 3126863 - RNA, 16 nt, Human
ccucugacacacagcu

SEQ ID NO: 3126864 - RNA, 15 nt, Human
ccucugacacacagc

SEQ ID NO: 3126865 - RNA, 23 nt, Human
ccucugaaaaccaauguucucuc

SEQ ID NO: 3126866 - RNA, 12 nt, Human
ccucucccauca

SEQ ID NO: 3126867 - RNA, 23 nt, Human
ccuccugugugugcgccuacagg

SEQ ID NO: 3126868 - RNA, 14 nt, Human
ccucagggucccug

SEQ ID NO: 3126869 - RNA, 11 nt, Human
ccucaggccug

SEQ ID NO: 3126870 - RNA, 10 nt, Human
ccucaggccu

SEQ ID NO: 3126871 - RNA, 21 nt, Human
ccucaggccugggggcugggc

SEQ ID NO: 3126872 - RNA, 14 nt, Human
ccucaggccugggg

SEQ ID NO: 3126873 - RNA, 16 nt, Human
ccucagcauccuggca

SEQ ID NO: 3126874 - RNA, 17 nt, Human
ccucagcauccuggcac

SEQ ID NO: 3126875 - RNA, 14 nt, Human
ccucagcauccugg

SEQ ID NO: 3126876 - RNA, 16 nt, Human
ccucaggugagaagca

SEQ ID NO: 3126877 - RNA, 22 nt, Human
ccucagggucccugguggcagc

SEQ ID NO: 3126878 - RNA, 15 nt, Human
ccucagggucccugg

SEQ ID NO: 3126879 - RNA, 22 nt, Human
ccucaggugauccacccaccuc

SEQ ID NO: 3126880 - RNA, 22 nt, Human
ccucaggugagaagcagaggaa

SEQ ID NO: 3126881 - RNA, 17 nt, Human
ccucaggugauccaccc

SEQ ID NO: 3126882 - RNA, 19 nt, Human
ccucaggugauccacccac

SEQ ID NO: 3126883 - RNA, 15 nt, Human
ccucagucuggcccu

SEQ ID NO: 3126884 - RNA, 16 nt, Human
ccucccucccucuuuc

SEQ ID NO: 3126885 - RNA, 13 nt, Human
ccucccucccucu

SEQ ID NO: 3126886 - RNA, 15 nt, Human
ccucccucccucuuu

SEQ ID NO: 3126887 - RNA, 13 nt, Human
ccuccugugugug

SEQ ID NO: 3126888 - RNA, 15 nt, Human
ccuccugugugugcg

SEQ ID NO: 3126889 - RNA, 22 nt, Human
ccuccugugugugcgccuacag

SEQ ID NO: 3126890 - RNA, 13 nt, Human
ccuccugggcuaa

SEQ ID NO: 3126891 - RNA, 18 nt, Human
ccugaugcuucuucagag

SEQ ID NO: 3126892 - RNA, 17 nt, Human
ccugaugcuucuucaga

SEQ ID NO: 3126893 - RNA, 23 nt, Human
ccugauugugucucuugguccug

SEQ ID NO: 3126894 - RNA, 14 nt, Human
ccugaugcuucuuc

SEQ ID NO: 3126895 - RNA, 14 nt, Human
ccugaggcccuucu

SEQ ID NO: 3126896 - RNA, 20 nt, Human
ccugaggcccuucucuccag

SEQ ID NO: 3126897 - RNA, 19 nt, Human
ccugaggcccuucucucca

SEQ ID NO: 3126898 - RNA, 17 nt, Human
ccugaggcccuucucuc

SEQ ID NO: 3126899 - RNA, 16 nt, Human
ccugaggcccuucucu

SEQ ID NO: 3126900 - RNA, 22 nt, Human
ccugaggcccuucucuccagcc

SEQ ID NO: 3126901 - RNA, 21 nt, Human
ccugaggcccuucucuccagc

SEQ ID NO: 3126902 - RNA, 23 nt, Human
ccugaggcccuucucuccagccc

SEQ ID NO: 3126903 - RNA, 16 nt, Human
ccugacaacacucauu

SEQ ID NO: 3126904 - RNA, 15 nt, Human
ccugacaacacucau

SEQ ID NO: 3126905 - RNA, 14 nt, Human
ccugacaacacuca

SEQ ID NO: 3126906 - RNA, 12 nt, Human
ccugacaacacu

SEQ ID NO: 3126907 - RNA, 14 nt, Human
ccugaggcccagag

SEQ ID NO: 3126908 - RNA, 13 nt, Human
ccugaggcccaga

SEQ ID NO: 3126909 - RNA, 12 nt, Human
ccugaggcccag

SEQ ID NO: 3126910 - RNA, 23 nt, Human
ccucuguacagagcccacgcccc

SEQ ID NO: 3126911 - RNA, 18 nt, Human
ccucuguacagagcccac

SEQ ID NO: 3126912 - RNA, 17 nt, Human
ccucuguacagagccca

SEQ ID NO: 3126913 - RNA, 16 nt, Human
ccucuguacagagccc

SEQ ID NO: 3126914 - RNA, 15 nt, Human
ccucuguacagagcc

SEQ ID NO: 3126915 - RNA, 14 nt, Human
ccucuguacagagc

SEQ ID NO: 3126916 - RNA, 14 nt, Human
ccucuuagaaaaac

SEQ ID NO: 3126917 - RNA, 14 nt, Human
ccucuuaugggcug

SEQ ID NO: 3126918 - RNA, 16 nt, Human
ccucuuaugggcuggg

SEQ ID NO: 3126919 - RNA, 15 nt, Human
ccucuuaugggcugg

SEQ ID NO: 3126920 - RNA, 17 nt, Human
ccucuuaugggcugggu

SEQ ID NO: 3126921 - RNA, 22 nt, Human
ccucuuuggucuacacugugcu

SEQ ID NO: 3126922 - RNA, 15 nt, Human
ccugaagucacacag

SEQ ID NO: 3126923 - RNA, 13 nt, Human
ccugaaggccccg

SEQ ID NO: 3126924 - RNA, 16 nt, Human
ccugaagucacacagu

SEQ ID NO: 3126925 - RNA, 17 nt, Human
ccugaagucacacagug

SEQ ID NO: 3126926 - RNA, 17 nt, Human
ccucacaguccuuacca

SEQ ID NO: 3126927 - RNA, 17 nt, Human
ccucaccuuucccaucu

SEQ ID NO: 3126928 - RNA, 15 nt, Human
ccucaccccacugug

SEQ ID NO: 3126929 - RNA, 12 nt, Human
ccucaccccacu

SEQ ID NO: 3126930 - RNA, 22 nt, Human
ccucacaguccuuaccagcaga

SEQ ID NO: 3126931 - RNA, 20 nt, Human
ccucacaguccuuaccagca

SEQ ID NO: 3126932 - RNA, 12 nt, Human
ccggcuggccug

SEQ ID NO: 3126933 - RNA, 15 nt, Human
ccgggcacucagaag

SEQ ID NO: 3126934 - RNA, 13 nt, Human
ccggcuggccugg

SEQ ID NO: 3126935 - RNA, 23 nt, Human
ccgcuuucuacccagcgagcccu

SEQ ID NO: 3126936 - RNA, 22 nt, Human
ccccaggaggccagccuugacc

SEQ ID NO: 3126937 - RNA, 21 nt, Human
ccccaggaggccagccuugac

SEQ ID NO: 3126938 - RNA, 15 nt, Human
ccccaggaggccagc

SEQ ID NO: 3126939 - RNA, 14 nt, Human
ccccaggaggccag

SEQ ID NO: 3126940 - RNA, 13 nt, Human
ccccaggaggcca

SEQ ID NO: 3126941 - RNA, 13 nt, Human
ccccacuggugac

SEQ ID NO: 3126942 - RNA, 12 nt, Human
ccccacugguga

SEQ ID NO: 3126943 - RNA, 21 nt, Human
cccccgcugucagccauuccu

SEQ ID NO: 3126944 - RNA, 12 nt, Human
cccccagcccca

SEQ ID NO: 3126945 - RNA, 18 nt, Human
cccugugggcccccaaau

SEQ ID NO: 3126946 - RNA, 15 nt, Human
cccuguuuguuucug

SEQ ID NO: 3126947 - RNA, 15 nt, Human
cccugugggccccca

SEQ ID NO: 3126948 - RNA, 16 nt, Human
cccugugggcccccaa

SEQ ID NO: 3126949 - RNA, 15 nt, Human
cccugguggcagugg

SEQ ID NO: 3126950 - RNA, 16 nt, Human
cccugguggcaguggg

SEQ ID NO: 3126951 - RNA, 19 nt, Human
cccugguggcagugggagc

SEQ ID NO: 3126952 - RNA, 17 nt, Human
ccccucagggucccugg

SEQ ID NO: 3126953 - RNA, 20 nt, Human
ccccucagggucccuggugg

SEQ ID NO: 3126954 - RNA, 18 nt, Human
ccccucagggucccuggu

SEQ ID NO: 3126955 - RNA, 20 nt, Human
cccuuugacgccaucccagc

SEQ ID NO: 3126956 - RNA, 18 nt, Human
cccuuguggucccacccc

SEQ ID NO: 3126957 - RNA, 16 nt, Human
cccuuguggucccacc

SEQ ID NO: 3126958 - RNA, 14 nt, Human
cccuugugguccca

SEQ ID NO: 3126959 - RNA, 18 nt, Human
cccuuggggagcaggcuc

SEQ ID NO: 3126960 - RNA, 18 nt, Human
cccuugccgucuaccuga

SEQ ID NO: 3126961 - RNA, 17 nt, Human
cccuugccgucuaccug

SEQ ID NO: 3126962 - RNA, 18 nt, Human
ccgagaucacgccacugc

SEQ ID NO: 3126963 - RNA, 17 nt, Human
ccgaggccuucucugaa

SEQ ID NO: 3126964 - RNA, 18 nt, Human
cccuuuuuuggcugcuga

SEQ ID NO: 3126965 - RNA, 17 nt, Human
cccuuuuuuggcugcug

SEQ ID NO: 3126966 - RNA, 13 nt, Human
cccuuuucuguuu

SEQ ID NO: 3126967 - RNA, 11 nt, Human
cccuuuuccuu

SEQ ID NO: 3126968 - RNA, 22 nt, Human
ccgagauagccaaggccaaagg

SEQ ID NO: 3126969 - RNA, 19 nt, Human
ccgagauagccaaggccaa

SEQ ID NO: 3126970 - RNA, 18 nt, Human
ccgagauagccaaggcca

SEQ ID NO: 3126971 - RNA, 17 nt, Human
ccgagaaggaagccucc

SEQ ID NO: 3126972 - RNA, 19 nt, Human
cccuuuuuuggcugcugaa

SEQ ID NO: 3126973 - RNA, 14 nt, Human
cuggaaugcagugg

SEQ ID NO: 3126974 - RNA, 15 nt, Human
cuggaaugcaguggu

SEQ ID NO: 3126975 - RNA, 14 nt, Human
cuggaagcacagcu

SEQ ID NO: 3126976 - RNA, 18 nt, Human
cuggaagcacagcuucau

SEQ ID NO: 3126977 - RNA, 15 nt, Human
cuggaagcacagcuu

SEQ ID NO: 3126978 - RNA, 14 nt, Human
cuggccuagcauac

SEQ ID NO: 3126979 - RNA, 23 nt, Human
cuggccuagcauacguacacauu

SEQ ID NO: 3126980 - RNA, 13 nt, Human
cuggcccacugca

SEQ ID NO: 3126981 - RNA, 12 nt, Human
cuggcccacugc

SEQ ID NO: 3126982 - RNA, 17 nt, Human
cuggccuagcauacgua

SEQ ID NO: 3126983 - RNA, 21 nt, Human
cuggccagaugcaccagcccu

SEQ ID NO: 3126984 - RNA, 17 nt, Human
cuggccagaugcaccag

SEQ ID NO: 3126985 - RNA, 18 nt, Human
cuggccagaugcaccagc

SEQ ID NO: 3126986 - RNA, 19 nt, Human
cuggccagaugcaccagcc

SEQ ID NO: 3126987 - RNA, 20 nt, Human
cuggccagaugcaccagccc

SEQ ID NO: 3126988 - RNA, 17 nt, Human
cuggcacugcuuccagu

SEQ ID NO: 3126989 - RNA, 16 nt, Human
cuggcacugcuuccag

SEQ ID NO: 3126990 - RNA, 15 nt, Human
cuggcacugcuucca

SEQ ID NO: 3126991 - RNA, 16 nt, Human
cuggccagaugcacca

SEQ ID NO: 3126992 - RNA, 14 nt, Human
cuggcacugcuucc

SEQ ID NO: 3126993 - RNA, 13 nt, Human
cuggcacugcuuc

SEQ ID NO: 3126994 - RNA, 23 nt, Human
cuggcacuauaauguaagcucua

SEQ ID NO: 3126995 - RNA, 22 nt, Human
cuggcacuauaauguaagcucu

SEQ ID NO: 3126996 - RNA, 15 nt, Human
cuggauggggcugca

SEQ ID NO: 3126997 - RNA, 13 nt, Human
cuggauuaaacuu

SEQ ID NO: 3126998 - RNA, 23 nt, Human
cuggauuaaacuuaaucuaaaug

SEQ ID NO: 3126999 - RNA, 16 nt, Human
cuggauggggcugcac

SEQ ID NO: 3127000 - RNA, 21 nt, Human
cugggcuucaguggcagcugc

SEQ ID NO: 3127001 - RNA, 22 nt, Human
cugggcuucaguggcagcugcu

SEQ ID NO: 3127002 - RNA, 13 nt, Human
cugggcuugggga

SEQ ID NO: 3127003 - RNA, 20 nt, Human
cugggcuuggggaccagagc

SEQ ID NO: 3127004 - RNA, 17 nt, Human
cugggcuuggggaccag

SEQ ID NO: 3127005 - RNA, 21 nt, Human
cugggcuuggggaccagagcu

SEQ ID NO: 3127006 - RNA, 18 nt, Human
cugggcuucaguggcagc

SEQ ID NO: 3127007 - RNA, 17 nt, Human
cugggcuucaguggcag

SEQ ID NO: 3127008 - RNA, 19 nt, Human
cugggcuucaguggcagcu

SEQ ID NO: 3127009 - RNA, 20 nt, Human
cugggcuucaguggcagcug

SEQ ID NO: 3127010 - RNA, 19 nt, Human
cuggguacuuguggacaca

SEQ ID NO: 3127011 - RNA, 21 nt, Human
cuggguacuuguggacacagc

SEQ ID NO: 3127012 - RNA, 23 nt, Human
cuggguacuuguggacacagcuc

SEQ ID NO: 3127013 - RNA, 20 nt, Human
cuggguacuuguggacacag

SEQ ID NO: 3127014 - RNA, 23 nt, Human
cugggguggggaccucaggccug

SEQ ID NO: 3127015 - RNA, 22 nt, Human
cugggguggggaccucaggccu

SEQ ID NO: 3127016 - RNA, 21 nt, Human
cugggguggggaccucaggcc

SEQ ID NO: 3127017 - RNA, 13 nt, Human
cugggggccucag

SEQ ID NO: 3127018 - RNA, 17 nt, Human
cugggggccucagugcc

SEQ ID NO: 3127019 - RNA, 17 nt, Human
cugggguggggaccuca

SEQ ID NO: 3127020 - RNA, 19 nt, Human
cugggguggggaccucagg

SEQ ID NO: 3127021 - RNA, 18 nt, Human
cugggguggggaccucag

SEQ ID NO: 3127022 - RNA, 19 nt, Human
cugguggcagugggagcug

SEQ ID NO: 3127023 - RNA, 23 nt, Human
cugguggcagugggagcugccug

SEQ ID NO: 3127024 - RNA, 19 nt, Human
cuggguucuacccaggugc

SEQ ID NO: 3127025 - RNA, 13 nt, Human
cuggguuggaggg

SEQ ID NO: 3127026 - RNA, 17 nt, Human
cugguccauagagagca

SEQ ID NO: 3127027 - RNA, 15 nt, Human
cugguccauagagag

SEQ ID NO: 3127028 - RNA, 15 nt, Human
cuggucccacucagu

SEQ ID NO: 3127029 - RNA, 18 nt, Human
cuggucccacucagucca

SEQ ID NO: 3127030 - RNA, 14 nt, Human
cuggucccacucag

SEQ ID NO: 3127031 - RNA, 18 nt, Human
cugguccauagagagcaa

SEQ ID NO: 3127032 - RNA, 13 nt, Human
cuggccugagcug

SEQ ID NO: 3127033 - RNA, 17 nt, Human
cuggcucuuccaggcug

SEQ ID NO: 3127034 - RNA, 19 nt, Human
cuggcucuuccaggcuggg

SEQ ID NO: 3127035 - RNA, 18 nt, Human
cuggcucuuccaggcugg

SEQ ID NO: 3127036 - RNA, 19 nt, Human
cuggcuguuggcugggggc

SEQ ID NO: 3127037 - RNA, 21 nt, Human
cuggcuggguggcaccagcag

SEQ ID NO: 3127038 - RNA, 18 nt, Human
cuggcuguuggcuggggg

SEQ ID NO: 3127039 - RNA, 20 nt, Human
cuggcuguuggcugggggcc

SEQ ID NO: 3127040 - RNA, 18 nt, Human
cugggaggucaaggcugc

SEQ ID NO: 3127041 - RNA, 16 nt, Human
cugggagugagcuggu

SEQ ID NO: 3127042 - RNA, 13 nt, Human
cugggagugagcu

SEQ ID NO: 3127043 - RNA, 12 nt, Human
cugggagugagc

SEQ ID NO: 3127044 - RNA, 20 nt, Human
cugggcaaugugauaaaacc

SEQ ID NO: 3127045 - RNA, 20 nt, Human
cugcccggcaggguccuaga

SEQ ID NO: 3127046 - RNA, 16 nt, Human
cugccccuggcagccc

SEQ ID NO: 3127047 - RNA, 15 nt, Human
cugccccuggcagcc

SEQ ID NO: 3127048 - RNA, 14 nt, Human
cugccccuggcagc

SEQ ID NO: 3127049 - RNA, 16 nt, Human
cugccauuucugagau

SEQ ID NO: 3127050 - RNA, 16 nt, Human
cugcccugcccaccug

SEQ ID NO: 3127051 - RNA, 15 nt, Human
cugcccugcccaccu

SEQ ID NO: 3127052 - RNA, 14 nt, Human
cugcccugcccacc

SEQ ID NO: 3127053 - RNA, 13 nt, Human
cugcccugcccac

SEQ ID NO: 3127054 - RNA, 11 nt, Human
cugcccggcug

SEQ ID NO: 3127055 - RNA, 15 nt, Human
cugcccggcugcgga

SEQ ID NO: 3127056 - RNA, 19 nt, Human
cugcccuccaagaccuucu

SEQ ID NO: 3127057 - RNA, 15 nt, Human
cugccacccugggga

SEQ ID NO: 3127058 - RNA, 16 nt, Human
cugccacccuggggag

SEQ ID NO: 3127059 - RNA, 20 nt, Human
cugccacccuggggagaaag

SEQ ID NO: 3127060 - RNA, 14 nt, Human
cugccacccugggg

SEQ ID NO: 3127061 - RNA, 19 nt, Human
cugccagccgagauagcca

SEQ ID NO: 3127062 - RNA, 19 nt, Human
cugccaggaagccagcagg

SEQ ID NO: 3127063 - RNA, 18 nt, Human
cugccaggaagccagcag

SEQ ID NO: 3127064 - RNA, 16 nt, Human
cugccaggaagccagc

SEQ ID NO: 3127065 - RNA, 15 nt, Human
cugccaggaagccag

SEQ ID NO: 3127066 - RNA, 19 nt, Human
cugccaugccagcuuaucu

SEQ ID NO: 3127067 - RNA, 17 nt, Human
cugccaugccagcuuau

SEQ ID NO: 3127068 - RNA, 15 nt, Human
cugccaugccagcuu

SEQ ID NO: 3127069 - RNA, 14 nt, Human
cugcuccagcuguu

SEQ ID NO: 3127070 - RNA, 16 nt, Human
cugcgguccacccagg

SEQ ID NO: 3127071 - RNA, 21 nt, Human
cugcggaaugaaccacaucuu

SEQ ID NO: 3127072 - RNA, 15 nt, Human
cugcgguccacccag

SEQ ID NO: 3127073 - RNA, 20 nt, Human
cugcggaaugaaccacaucu

SEQ ID NO: 3127074 - RNA, 16 nt, Human
cugcuccucuccccag

SEQ ID NO: 3127075 - RNA, 17 nt, Human
cugcuccucuccccagc

SEQ ID NO: 3127076 - RNA, 18 nt, Human
cugcuccucuccccagca

SEQ ID NO: 3127077 - RNA, 13 nt, Human
cugccucagccuc

SEQ ID NO: 3127078 - RNA, 13 nt, Human
cugccugcccagg

SEQ ID NO: 3127079 - RNA, 14 nt, Human
cugccugcccaggc

SEQ ID NO: 3127080 - RNA, 23 nt, Human
cugccuguugggccaggagccuc

SEQ ID NO: 3127081 - RNA, 23 nt, Human
cugccugaagucacacagugagu

SEQ ID NO: 3127082 - RNA, 13 nt, Human
cugccucuucucu

SEQ ID NO: 3127083 - RNA, 16 nt, Human
cugcaccggcuggccu

SEQ ID NO: 3127084 - RNA, 14 nt, Human
cugcacuugcagac

SEQ ID NO: 3127085 - RNA, 16 nt, Human
cugcacuugcagacuc

SEQ ID NO: 3127086 - RNA, 17 nt, Human
cugcacuugcagacucu

SEQ ID NO: 3127087 - RNA, 19 nt, Human
cugcaccggcuggccuggc

SEQ ID NO: 3127088 - RNA, 18 nt, Human
cugcaccggcuggccugg

SEQ ID NO: 3127089 - RNA, 17 nt, Human
cugcaccggcuggccug

SEQ ID NO: 3127090 - RNA, 22 nt, Human
cugcagggaguccgaaagggac

SEQ ID NO: 3127091 - RNA, 22 nt, Human
cugcagccucaaccuccugggc

SEQ ID NO: 3127092 - RNA, 19 nt, Human
cugcagccucaaccuccug

SEQ ID NO: 3127093 - RNA, 20 nt, Human
cugcagccucaaccuccugg

SEQ ID NO: 3127094 - RNA, 11 nt, Human
cugcagccuca

SEQ ID NO: 3127095 - RNA, 16 nt, Human
cugcacaagcugcacc

SEQ ID NO: 3127096 - RNA, 15 nt, Human
cugcacaagcugcac

SEQ ID NO: 3127097 - RNA, 14 nt, Human
cugcacaagcugca

SEQ ID NO: 3127098 - RNA, 13 nt, Human
cugcacaagcugc

SEQ ID NO: 3127099 - RNA, 18 nt, Human
cugcacccucaggcaggu

SEQ ID NO: 3127100 - RNA, 16 nt, Human
cugcacccucaggcag

SEQ ID NO: 3127101 - RNA, 17 nt, Human
cugcacccucaggcagg

SEQ ID NO: 3127102 - RNA, 13 nt, Human
cugauaaagauga

SEQ ID NO: 3127103 - RNA, 16 nt, Human
cugagucugaaggcug

SEQ ID NO: 3127104 - RNA, 15 nt, Human
cugagucugaaggcu

SEQ ID NO: 3127105 - RNA, 14 nt, Human
cugagucugaaggc

SEQ ID NO: 3127106 - RNA, 13 nt, Human
cugagucugaagg

SEQ ID NO: 3127107 - RNA, 22 nt, Human
cugauucccaagcucugcuccu

SEQ ID NO: 3127108 - RNA, 19 nt, Human
cugauucccaagcucugcu

SEQ ID NO: 3127109 - RNA, 20 nt, Human
cugauucccaagcucugcuc

SEQ ID NO: 3127110 - RNA, 17 nt, Human
cugauucccaagcucug

SEQ ID NO: 3127111 - RNA, 18 nt, Human
cugauucccaagcucugc

SEQ ID NO: 3127112 - RNA, 15 nt, Human
cugauucccaagcuc

SEQ ID NO: 3127113 - RNA, 13 nt, Human
cucccuuccucuu

SEQ ID NO: 3127114 - RNA, 14 nt, Human
cucccuuccucuuu

SEQ ID NO: 3127115 - RNA, 17 nt, Human
cucccuuggauuguccc

SEQ ID NO: 3127116 - RNA, 23 nt, Human
cucccuucccaccucucucacuc

SEQ ID NO: 3127117 - RNA, 10 nt, Human
cucccuuccu

SEQ ID NO: 3127118 - RNA, 18 nt, Human
cucccaucucacacauga

SEQ ID NO: 3127119 - RNA, 15 nt, Human
cucccaucucacaca

SEQ ID NO: 3127120 - RNA, 14 nt, Human
cucccaucucacac

SEQ ID NO: 3127121 - RNA, 12 nt, Human
cuccugcaggca

SEQ ID NO: 3127122 - RNA, 14 nt, Human
cuccugcaggcagc

SEQ ID NO: 3127123 - RNA, 13 nt, Human
cuccugcaggcag

SEQ ID NO: 3127124 - RNA, 14 nt, Human
cuccucagaucuuc

SEQ ID NO: 3127125 - RNA, 12 nt, Human
cuccucagaucu

SEQ ID NO: 3127126 - RNA, 20 nt, Human
cucgaguuacagacaaagcg

SEQ ID NO: 3127127 - RNA, 16 nt, Human
cucgaguuacagacaa

SEQ ID NO: 3127128 - RNA, 15 nt, Human
cucgcgacaaugcaa

SEQ ID NO: 3127129 - RNA, 13 nt, Human
cucgcgacaaugc

SEQ ID NO: 3127130 - RNA, 21 nt, Human
cuccuugaaaacacuguucuc

SEQ ID NO: 3127131 - RNA, 11 nt, Human
cuccuucuucc

SEQ ID NO: 3127132 - RNA, 16 nt, Human
cucgaacuggcugcaa

SEQ ID NO: 3127133 - RNA, 13 nt, Human
cuccuucaccuuu

SEQ ID NO: 3127134 - RNA, 14 nt, Human
cuccuucuguccua

SEQ ID NO: 3127135 - RNA, 15 nt, Human
cuccuucuguccuac

SEQ ID NO: 3127136 - RNA, 20 nt, Human
cuccuucuguccuacucugu

SEQ ID NO: 3127137 - RNA, 15 nt, Human
cuccugugucuugca

SEQ ID NO: 3127138 - RNA, 23 nt, Human
cuccugugucuugcaauggcagc

SEQ ID NO: 3127139 - RNA, 11 nt, Human
cuccugugugu

SEQ ID NO: 3127140 - RNA, 22 nt, Human
cuccugcaggcagccaggccac

SEQ ID NO: 3127141 - RNA, 21 nt, Human
cuccugcaggcagccaggcca

SEQ ID NO: 3127142 - RNA, 15 nt, Human
cuccugcaggcagcc

SEQ ID NO: 3127143 - RNA, 21 nt, Human
cuccuucaccuuuguccccac

SEQ ID NO: 3127144 - RNA, 19 nt, Human
cuccuucaccuuugucccc

SEQ ID NO: 3127145 - RNA, 16 nt, Human
cuccuucaccuuuguc

SEQ ID NO: 3127146 - RNA, 14 nt, Human
cuccuucaccuuug

SEQ ID NO: 3127147 - RNA, 19 nt, Human
cuccagcuguucagcuggu

SEQ ID NO: 3127148 - RNA, 18 nt, Human
cuccagcuguucagcugg

SEQ ID NO: 3127149 - RNA, 13 nt, Human
cuccagcuguuca

SEQ ID NO: 3127150 - RNA, 11 nt, Human
cuccaggcucc

SEQ ID NO: 3127151 - RNA, 22 nt, Human
cucccaggcauuccccaggagg

SEQ ID NO: 3127152 - RNA, 21 nt, Human
cucccaggcauuccccaggag

SEQ ID NO: 3127153 - RNA, 20 nt, Human
cucccaggcauuccccagga

SEQ ID NO: 3127154 - RNA, 19 nt, Human
cucccaggcauuccccagg

SEQ ID NO: 3127155 - RNA, 17 nt, Human
cucccaggcauucccca

SEQ ID NO: 3127156 - RNA, 15 nt, Human
cucccaggcauuccc

SEQ ID NO: 3127157 - RNA, 21 nt, Human
cucccaaggggcccaaauucu

SEQ ID NO: 3127158 - RNA, 22 nt, Human
cucccaaggggcccaaauucuu

SEQ ID NO: 3127159 - RNA, 14 nt, Human
cuccaugugggcua

SEQ ID NO: 3127160 - RNA, 11 nt, Human
cuccacccugc

SEQ ID NO: 3127161 - RNA, 12 nt, Human
cuccacccugcu

SEQ ID NO: 3127162 - RNA, 21 nt, Human
cuccaccugccagggacagag

SEQ ID NO: 3127163 - RNA, 18 nt, Human
cuccaccugccagggaca

SEQ ID NO: 3127164 - RNA, 17 nt, Human
cuccaccugccagggac

SEQ ID NO: 3127165 - RNA, 15 nt, Human
cuccaccugccaggg

SEQ ID NO: 3127166 - RNA, 19 nt, Human
cuccagcucaccagcccca

SEQ ID NO: 3127167 - RNA, 20 nt, Human
cuccagcucaccagccccag

SEQ ID NO: 3127168 - RNA, 23 nt, Human
cuaaaagguaugcaaucaaaucu

SEQ ID NO: 3127169 - RNA, 12 nt, Human
cucagggucccu

SEQ ID NO: 3127170 - RNA, 15 nt, Human
cucaggugucccugc

SEQ ID NO: 3127171 - RNA, 16 nt, Human
cucaggugucccugca

SEQ ID NO: 3127172 - RNA, 23 nt, Human
cucagguggggucacucuggcag

SEQ ID NO: 3127173 - RNA, 22 nt, Human
cucagguggggucacucuggca

SEQ ID NO: 3127174 - RNA, 18 nt, Human
cucauaguaugguggcug

SEQ ID NO: 3127175 - RNA, 19 nt, Human
cucauaguaugguggcugg

SEQ ID NO: 3127176 - RNA, 17 nt, Human
cucaggugucccugcac

SEQ ID NO: 3127177 - RNA, 18 nt, Human
cucaggugucccugcacu

SEQ ID NO: 3127178 - RNA, 19 nt, Human
cucaggugucccugcacuu

SEQ ID NO: 3127179 - RNA, 21 nt, Human
cucauuagcauuuugcuaaau

SEQ ID NO: 3127180 - RNA, 16 nt, Human
cucauugaccugaggc

SEQ ID NO: 3127181 - RNA, 23 nt, Human
cucauucuucuguacgucugaca

SEQ ID NO: 3127182 - RNA, 15 nt, Human
cucauugaccugagg

SEQ ID NO: 3127183 - RNA, 13 nt, Human
cucauugaccuga

SEQ ID NO: 3127184 - RNA, 13 nt, Human
cucauucuucugu

SEQ ID NO: 3127185 - RNA, 14 nt, Human
cucauucuucugua

SEQ ID NO: 3127186 - RNA, 12 nt, Human
cucauucuucug

SEQ ID NO: 3127187 - RNA, 13 nt, Human
cucucccaucacu

SEQ ID NO: 3127188 - RNA, 20 nt, Human
cucucccaucacuucccuac

SEQ ID NO: 3127189 - RNA, 14 nt, Human
cucucccaucacuu

SEQ ID NO: 3127190 - RNA, 18 nt, Human
cucucccaucacuucccu

SEQ ID NO: 3127191 - RNA, 12 nt, Human
cucuccagcccc

SEQ ID NO: 3127192 - RNA, 13 nt, Human
cucuccagccccu

SEQ ID NO: 3127193 - RNA, 22 nt, Human
cucucaggccagcugcuugggc

SEQ ID NO: 3127194 - RNA, 23 nt, Human
cucucaggccagcugcuugggcu

SEQ ID NO: 3127195 - RNA, 22 nt, Human
cucuccuguaccucuugagccu

SEQ ID NO: 3127196 - RNA, 17 nt, Human
cucuccuguaccucuug

SEQ ID NO: 3127197 - RNA, 18 nt, Human
cucuccuguaccucuuga

SEQ ID NO: 3127198 - RNA, 13 nt, Human
cucuccuguaccu

SEQ ID NO: 3127199 - RNA, 14 nt, Human
cucuccuguaccuc

SEQ ID NO: 3127200 - RNA, 15 nt, Human
cucuccuguaccucu

SEQ ID NO: 3127201 - RNA, 14 nt, Human
cucucucacuccuu

SEQ ID NO: 3127202 - RNA, 12 nt, Human
cucucucaggcc

SEQ ID NO: 3127203 - RNA, 16 nt, Human
cucucucacuccuuga

SEQ ID NO: 3127204 - RNA, 15 nt, Human
cucucucacuccuug

SEQ ID NO: 3127205 - RNA, 16 nt, Human
cucugaggacacuaac

SEQ ID NO: 3127206 - RNA, 22 nt, Human
cucugcaagaauugaagcagga

SEQ ID NO: 3127207 - RNA, 23 nt, Human
cucugcccuccaagaccuucucc

SEQ ID NO: 3127208 - RNA, 16 nt, Human
cucugcccuccaagac

SEQ ID NO: 3127209 - RNA, 15 nt, Human
cucugcccuccaaga

SEQ ID NO: 3127210 - RNA, 14 nt, Human
cucugcccuccaag

SEQ ID NO: 3127211 - RNA, 14 nt, Human
cucugccucugaca

SEQ ID NO: 3127212 - RNA, 11 nt, Human
cugacccacug

SEQ ID NO: 3127213 - RNA, 17 nt, Human
cugacauuguuggccaa

SEQ ID NO: 3127214 - RNA, 20 nt, Human
cugacaggcaaugcuggcug

SEQ ID NO: 3127215 - RNA, 16 nt, Human
cugacaggcaaugcug

SEQ ID NO: 3127216 - RNA, 17 nt, Human
cugacaggcaaugcugg

SEQ ID NO: 3127217 - RNA, 18 nt, Human
cugacaggcaaugcuggc

SEQ ID NO: 3127218 - RNA, 19 nt, Human
cugacaggcaaugcuggcu

SEQ ID NO: 3127219 - RNA, 11 nt, Human
cugacaggcaa

SEQ ID NO: 3127220 - RNA, 21 nt, Human
cugacagacacaggcccggcu

SEQ ID NO: 3127221 - RNA, 19 nt, Human
cugacagacacaggcccgg

SEQ ID NO: 3127222 - RNA, 14 nt, Human
cugaagucacacag

SEQ ID NO: 3127223 - RNA, 15 nt, Human
cugaagucacacagu

SEQ ID NO: 3127224 - RNA, 24 nt, Human
cugaagucuuuguacagacaacaa

SEQ ID NO: 3127225 - RNA, 16 nt, Human
cugaauacagaggcaa

SEQ ID NO: 3127226 - RNA, 21 nt, Human
cugaaccuggguaacuaggga

SEQ ID NO: 3127227 - RNA, 18 nt, Human
cucuuugggccuggcucc

SEQ ID NO: 3127228 - RNA, 21 nt, Human
cucuuuggucuacacugugcu

SEQ ID NO: 3127229 - RNA, 19 nt, Human
cucuuuggucuacacugug

SEQ ID NO: 3127230 - RNA, 15 nt, Human
cugaacuuggcgcug

SEQ ID NO: 3127231 - RNA, 21 nt, Human
cugaacuuggcgcugccccug

SEQ ID NO: 3127232 - RNA, 16 nt, Human
cugaacuuggcgcugc

SEQ ID NO: 3127233 - RNA, 19 nt, Human
cugaagacucauucuucug

SEQ ID NO: 3127234 - RNA, 21 nt, Human
cugaagacucauucuucugua

SEQ ID NO: 3127235 - RNA, 17 nt, Human
cucuuucuauuguuucu

SEQ ID NO: 3127236 - RNA, 18 nt, Human
cucuuuggacacucacac

SEQ ID NO: 3127237 - RNA, 15 nt, Human
cucuuuggacacuca

SEQ ID NO: 3127238 - RNA, 17 nt, Human
cucuuuccaucuacccu

SEQ ID NO: 3127239 - RNA, 16 nt, Human
cucuugaccucaggug

SEQ ID NO: 3127240 - RNA, 13 nt, Human
cucuugaccucag

SEQ ID NO: 3127241 - RNA, 15 nt, Human
cucuugaccucaggu

SEQ ID NO: 3127242 - RNA, 17 nt, Human
cucuugguccugcugca

SEQ ID NO: 3127243 - RNA, 19 nt, Human
cucuugguccugcugcagu

SEQ ID NO: 3127244 - RNA, 18 nt, Human
cucuugguccugcugcag

SEQ ID NO: 3127245 - RNA, 12 nt, Human
cucuucuccagg

SEQ ID NO: 3127246 - RNA, 23 nt, Human
cucuuccaggcugggagagccuu

SEQ ID NO: 3127247 - RNA, 21 nt, Human
cucuuccaggcugggagagcc

SEQ ID NO: 3127248 - RNA, 22 nt, Human
cucuuccaggcugggagagccu

SEQ ID NO: 3127249 - RNA, 13 nt, Human
cucuuaaaaccca

SEQ ID NO: 3127250 - RNA, 24 nt, Human
cucuuaaaacccaagugccuuagc

SEQ ID NO: 3127251 - RNA, 19 nt, Human
cucuggcagcucagagagg

SEQ ID NO: 3127252 - RNA, 18 nt, Human
cucuggcagcucagagag

SEQ ID NO: 3127253 - RNA, 17 nt, Human
cucuggcagcucagaga

SEQ ID NO: 3127254 - RNA, 16 nt, Human
cucuggcagcucagag

SEQ ID NO: 3127255 - RNA, 17 nt, Human
cuucuccaggcuguauc

SEQ ID NO: 3127256 - RNA, 14 nt, Human
cuucuccaggcugu

SEQ ID NO: 3127257 - RNA, 14 nt, Human
cuucuccacccugc

SEQ ID NO: 3127258 - RNA, 15 nt, Human
cuucuccacccugcu

SEQ ID NO: 3127259 - RNA, 19 nt, Human
cuucuccuucaccuuuguc

SEQ ID NO: 3127260 - RNA, 22 nt, Human
cuucuccuucaccuuugucccc

SEQ ID NO: 3127261 - RNA, 18 nt, Human
cuucugcuucagccuccc

SEQ ID NO: 3127262 - RNA, 13 nt, Human
cuucugcuucagc

SEQ ID NO: 3127263 - RNA, 16 nt, Human
cuucugcuucagccuc

SEQ ID NO: 3127264 - RNA, 17 nt, Human
cuucugcuucagccucc

SEQ ID NO: 3127265 - RNA, 21 nt, Human
cuucugccauauucuguuggc

SEQ ID NO: 3127266 - RNA, 15 nt, Human
cuucugccauauucu

SEQ ID NO: 3127267 - RNA, 17 nt, Human
cuucugccauauucugu

SEQ ID NO: 3127268 - RNA, 21 nt, Human
cuucgggaggucgaggcagga

SEQ ID NO: 3127269 - RNA, 20 nt, Human
cuucgggaggucgaggcagg

SEQ ID NO: 3127270 - RNA, 13 nt, Human
cuucgcuccugug

SEQ ID NO: 3127271 - RNA, 14 nt, Human
cuucgcuccugugu

SEQ ID NO: 3127272 - RNA, 15 nt, Human
cuucgcuccuguguc

SEQ ID NO: 3127273 - RNA, 14 nt, Human
cuuccagugaggcu

SEQ ID NO: 3127274 - RNA, 15 nt, Human
cuuccagugaggcuc

SEQ ID NO: 3127275 - RNA, 24 nt, Human
cuuccaggggugggacacccugug

SEQ ID NO: 3127276 - RNA, 22 nt, Human
cuuccaggggugggacacccug

SEQ ID NO: 3127277 - RNA, 21 nt, Human
cuuccaggggugggacacccu

SEQ ID NO: 3127278 - RNA, 11 nt, Human
cuucagcugac

SEQ ID NO: 3127279 - RNA, 18 nt, Human
cuucauuuccugugucuu

SEQ ID NO: 3127280 - RNA, 14 nt, Human
cuucagugccuuau

SEQ ID NO: 3127281 - RNA, 13 nt, Human
cuucagugccuua

SEQ ID NO: 3127282 - RNA, 12 nt, Human
cuucagugccuu

SEQ ID NO: 3127283 - RNA, 11 nt, Human
cuucagugccu

SEQ ID NO: 3127284 - RNA, 23 nt, Human
cuuccacaagagcccaggccucc

SEQ ID NO: 3127285 - RNA, 22 nt, Human
cuuccacaagagcccaggccuc

SEQ ID NO: 3127286 - RNA, 11 nt, Human
cuuagacaguc

SEQ ID NO: 3127287 - RNA, 19 nt, Human
cuuagacagucccugccaa

SEQ ID NO: 3127288 - RNA, 18 nt, Human
cuuagacagucccugcca

SEQ ID NO: 3127289 - RNA, 17 nt, Human
cuuagacagucccugcc

SEQ ID NO: 3127290 - RNA, 15 nt, Human
cuuagaagucacaca

SEQ ID NO: 3127291 - RNA, 14 nt, Human
cuuagacagucccu

SEQ ID NO: 3127292 - RNA, 16 nt, Human
cuuagacagucccugc

SEQ ID NO: 3127293 - RNA, 15 nt, Human
cuuagacagucccug

SEQ ID NO: 3127294 - RNA, 15 nt, Human
cuuacgugaguccug

SEQ ID NO: 3127295 - RNA, 16 nt, Human
cuuacuguacaugaaa

SEQ ID NO: 3127296 - RNA, 13 nt, Human
cuuacuguacaug

SEQ ID NO: 3127297 - RNA, 17 nt, Human
cuuagguuggcaaaaag

SEQ ID NO: 3127298 - RNA, 15 nt, Human
cuuauuuaaugaaag

SEQ ID NO: 3127299 - RNA, 23 nt, Human
cuguuuguuucugaaagggacgc

SEQ ID NO: 3127300 - RNA, 21 nt, Human
cuguuuguuucugaaagggac

SEQ ID NO: 3127301 - RNA, 14 nt, Human
cuguuuucucuuga

SEQ ID NO: 3127302 - RNA, 13 nt, Human
cuguuuucucuug

SEQ ID NO: 3127303 - RNA, 17 nt, Human
cuguuuucucuugagag

SEQ ID NO: 3127304 - RNA, 18 nt, Human
cuguuuguuucugaaagg

SEQ ID NO: 3127305 - RNA, 12 nt, Human
cuguuuagauaa

SEQ ID NO: 3127306 - RNA, 14 nt, Human
cuuaaucuaaaugg

SEQ ID NO: 3127307 - RNA, 15 nt, Human
cuuaacuucacauau

SEQ ID NO: 3127308 - RNA, 16 nt, Human
cuuaacuucacauauu

SEQ ID NO: 3127309 - RNA, 17 nt, Human
cuuaacuucacauauug

SEQ ID NO: 3127310 - RNA, 22 nt, Human
cuuaacuucacauauugauuuc

SEQ ID NO: 3127311 - RNA, 12 nt, Human
cuuaacuucaca

SEQ ID NO: 3127312 - RNA, 14 nt, Human
cuuaacuucacaua

SEQ ID NO: 3127313 - RNA, 22 nt, Human
cuuuuguucuugguuuguaaau

SEQ ID NO: 3127314 - RNA, 20 nt, Human
cuuuuguucuugguuuguaa

SEQ ID NO: 3127315 - RNA, 23 nt, Human
cuuuucuguccgagcuuugaaaa

SEQ ID NO: 3127316 - RNA, 15 nt, Human
cuuuucuguuugcua

SEQ ID NO: 3127317 - RNA, 21 nt, Human
cuuuguuuguugucagcugaa

SEQ ID NO: 3127318 - RNA, 16 nt, Human
cuuuuuuagaguugau

SEQ ID NO: 3127319 - RNA, 19 nt, Human
gaaaacacuguucucugcc

SEQ ID NO: 3127320 - RNA, 18 nt, Human
gaaaacacuguucucugc

SEQ ID NO: 3127321 - RNA, 21 nt, Human
gaaaacacuguucucugcccu

SEQ ID NO: 3127322 - RNA, 20 nt, Human
gaaaacacuguucucugccc

SEQ ID NO: 3127323 - RNA, 16 nt, Human
gaaaacaugcuacaca

SEQ ID NO: 3127324 - RNA, 18 nt, Human
gaaaacaugcuacacacu

SEQ ID NO: 3127325 - RNA, 19 nt, Human
gaaaacaugcuacacacug

SEQ ID NO: 3127326 - RNA, 15 nt, Human
cuuuagcgcccaguu

SEQ ID NO: 3127327 - RNA, 23 nt, Human
cuuugggaggccaaggugggagg

SEQ ID NO: 3127328 - RNA, 23 nt, Human
cuuugugaggaagccgcuggggc

SEQ ID NO: 3127329 - RNA, 13 nt, Human
cuuuguggcuucc

SEQ ID NO: 3127330 - RNA, 19 nt, Human
cuuugugaggaagccgcug

SEQ ID NO: 3127331 - RNA, 12 nt, Human
cuuugugauuuu

SEQ ID NO: 3127332 - RNA, 21 nt, Human
cuuuguucuggcucuuccagg

SEQ ID NO: 3127333 - RNA, 16 nt, Human
cuuuguucuggcucuu

SEQ ID NO: 3127334 - RNA, 15 nt, Human
cuuuguucuggcucu

SEQ ID NO: 3127335 - RNA, 12 nt, Human
cuuuggaaagac

SEQ ID NO: 3127336 - RNA, 23 nt, Human
cuuuggaaagacuuuuccaaccc

SEQ ID NO: 3127337 - RNA, 21 nt, Human
cuugcagacucuacagaggcc

SEQ ID NO: 3127338 - RNA, 20 nt, Human
cuugcagacucuacagaggc

SEQ ID NO: 3127339 - RNA, 15 nt, Human
cuugcaauggcagcc

SEQ ID NO: 3127340 - RNA, 16 nt, Human
cuugcaauggcagccu

SEQ ID NO: 3127341 - RNA, 17 nt, Human
cuugcaauggcagccuu

SEQ ID NO: 3127342 - RNA, 18 nt, Human
cuugcaauggcagccuug

SEQ ID NO: 3127343 - RNA, 19 nt, Human
cuugaguugauucagcucu

SEQ ID NO: 3127344 - RNA, 18 nt, Human
cuugaguugauucagcuc

SEQ ID NO: 3127345 - RNA, 20 nt, Human
cuugaguugauucagcucug

SEQ ID NO: 3127346 - RNA, 15 nt, Human
cuugaggguugggcu

SEQ ID NO: 3127347 - RNA, 17 nt, Human
cuugaggguugggcugg

SEQ ID NO: 3127348 - RNA, 15 nt, Human
cuugagccugggagg

SEQ ID NO: 3127349 - RNA, 12 nt, Human
cuugagccuggg

SEQ ID NO: 3127350 - RNA, 14 nt, Human
cuugcaugaggcua

SEQ ID NO: 3127351 - RNA, 13 nt, Human
cuugcaugaggcu

SEQ ID NO: 3127352 - RNA, 17 nt, Human
cuugcucugcugacaga

SEQ ID NO: 3127353 - RNA, 22 nt, Human
cuugcucugcugacagacacag

SEQ ID NO: 3127354 - RNA, 20 nt, Human
cuugcuucaaccccaugaga

SEQ ID NO: 3127355 - RNA, 20 nt, Human
cuuggaagcuccgcuuucua

SEQ ID NO: 3127356 - RNA, 14 nt, Human
cuuggaagcuccgc

SEQ ID NO: 3127357 - RNA, 17 nt, Human
cuuuaccuuuuuuauac

SEQ ID NO: 3127358 - RNA, 19 nt, Human
cuuuaccuuuuuuauacau

SEQ ID NO: 3127359 - RNA, 20 nt, Human
cuuuaccuuuuuuauacaua

SEQ ID NO: 3127360 - RNA, 15 nt, Human
cuuguggucccaccc

SEQ ID NO: 3127361 - RNA, 19 nt, Human
cuuguggucccaccccaca

SEQ ID NO: 3127362 - RNA, 16 nt, Human
cuuguggucccacccc

SEQ ID NO: 3127363 - RNA, 16 nt, Human
cuuguuaagauaguua

SEQ ID NO: 3127364 - RNA, 20 nt, Human
cuugggccacugugaagaga

SEQ ID NO: 3127365 - RNA, 18 nt, Human
cuugggccacugugaaga

SEQ ID NO: 3127366 - RNA, 14 nt, Human
cuugguuuguaaau

SEQ ID NO: 3127367 - RNA, 15 nt, Human
cuugguuuguaaauu

SEQ ID NO: 3127368 - RNA, 20 nt, Human
gaaguuucugccgcagcccu

SEQ ID NO: 3127369 - RNA, 15 nt, Human
gaagucuuagaugua

SEQ ID NO: 3127370 - RNA, 21 nt, Human
gaaguuucugccgcagcccug

SEQ ID NO: 3127371 - RNA, 18 nt, Human
gaaguacuauaauuuacc

SEQ ID NO: 3127372 - RNA, 15 nt, Human
gaaguacuggagaaa

SEQ ID NO: 3127373 - RNA, 21 nt, Human
gaaguaauaugcacacauuuu

SEQ ID NO: 3127374 - RNA, 22 nt, Human
gaaguaauaugcacacauuuuu

SEQ ID NO: 3127375 - RNA, 15 nt, Human
gaagggggcugggac

SEQ ID NO: 3127376 - RNA, 14 nt, Human
gaagcggcuggcag

SEQ ID NO: 3127377 - RNA, 19 nt, Human
gaagggggcugggacaugg

SEQ ID NO: 3127378 - RNA, 16 nt, Human
gaagggggcugggaca

SEQ ID NO: 3127379 - RNA, 20 nt, Human
gaaguuugagaucagccugg

SEQ ID NO: 3127380 - RNA, 18 nt, Human
gaauaacauguaauuaag

SEQ ID NO: 3127381 - RNA, 19 nt, Human
gaauaacauguaauuaagu

SEQ ID NO: 3127382 - RNA, 21 nt, Human
gaauacagaggcaacugcauu

SEQ ID NO: 3127383 - RNA, 17 nt, Human
gaauaauacaguaucuc

SEQ ID NO: 3127384 - RNA, 13 nt, Human
gaauaccuguccc

SEQ ID NO: 3127385 - RNA, 15 nt, Human
gaauaccuguccccc

SEQ ID NO: 3127386 - RNA, 23 nt, Human
gaauagcugggacuacaggugug

SEQ ID NO: 3127387 - RNA, 22 nt, Human
gaauagcugggacuacaggugu

SEQ ID NO: 3127388 - RNA, 11 nt, Human
gaaugcagugg

SEQ ID NO: 3127389 - RNA, 22 nt, Human
gaaugaaccacaucuugcucug

SEQ ID NO: 3127390 - RNA, 18 nt, Human
gaaugaaccacaucuugc

SEQ ID NO: 3127391 - RNA, 23 nt, Human
gaaugaaccacaucuugcucugc

SEQ ID NO: 3127392 - RNA, 22 nt, Human
gaaugguuuucaaaauaaaaau

SEQ ID NO: 3127393 - RNA, 14 nt, Human
gaaugucaguguga

SEQ ID NO: 3127394 - RNA, 13 nt, Human
gaaugucagugug

SEQ ID NO: 3127395 - RNA, 15 nt, Human
gaauuucccaaagca

SEQ ID NO: 3127396 - RNA, 22 nt, Human
gaauuguaaggaaugauuaauu

SEQ ID NO: 3127397 - RNA, 15 nt, Human
gaauuguaaggaaug

SEQ ID NO: 3127398 - RNA, 21 nt, Human
gaaugucagugugacugaucu

SEQ ID NO: 3127399 - RNA, 20 nt, Human
gaaugucagugugacugauc

SEQ ID NO: 3127400 - RNA, 17 nt, Human
gaauucucuaguuugau

SEQ ID NO: 3127401 - RNA, 17 nt, Human
gaauucucagaaucuca

SEQ ID NO: 3127402 - RNA, 14 nt, Human
gaauugaaaaacca

SEQ ID NO: 3127403 - RNA, 19 nt, Human
gaauucucuaguuugauua

SEQ ID NO: 3127404 - RNA, 14 nt, Human
gaacacucugagac

SEQ ID NO: 3127405 - RNA, 13 nt, Human
gaacacucugaga

SEQ ID NO: 3127406 - RNA, 15 nt, Human
gaacacucugagacu

SEQ ID NO: 3127407 - RNA, 18 nt, Human
gaaccuuuugagugccuu

SEQ ID NO: 3127408 - RNA, 21 nt, Human
gaaccuuuugagugccuuaca

SEQ ID NO: 3127409 - RNA, 19 nt, Human
gaaccuuuugagugccuua

SEQ ID NO: 3127410 - RNA, 22 nt, Human
gaaccuuuugagugccuuacac

SEQ ID NO: 3127411 - RNA, 20 nt, Human
gaagacuuuucuuucagcca

SEQ ID NO: 3127412 - RNA, 19 nt, Human
gaagacuucaucccucugg

SEQ ID NO: 3127413 - RNA, 17 nt, Human
gaagacuuuggaaagag

SEQ ID NO: 3127414 - RNA, 14 nt, Human
gaagacuuuggaaa

SEQ ID NO: 3127415 - RNA, 19 nt, Human
gaagagaaugcacaaacag

SEQ ID NO: 3127416 - RNA, 13 nt, Human
gaagacuuuggaa

SEQ ID NO: 3127417 - RNA, 11 nt, Human
gaagacuuugg

SEQ ID NO: 3127418 - RNA, 23 nt, Human
gaacuuugaccucugcagcaaua

SEQ ID NO: 3127419 - RNA, 23 nt, Human
gaagcccaggaaaggcuccagga

SEQ ID NO: 3127420 - RNA, 23 nt, Human
gaagcccuucuaccuuccugcaa

SEQ ID NO: 3127421 - RNA, 19 nt, Human
gaagcccaggaaaggcucc

SEQ ID NO: 3127422 - RNA, 16 nt, Human
gaagcccaggaaaggc

SEQ ID NO: 3127423 - RNA, 15 nt, Human
gaagcccaggaaagg

SEQ ID NO: 3127424 - RNA, 13 nt, Human
gaagcccaggaaa

SEQ ID NO: 3127425 - RNA, 22 nt, Human
gaagccagcaggcucucaggcc

SEQ ID NO: 3127426 - RNA, 21 nt, Human
gaagccagcaggcucucaggc

SEQ ID NO: 3127427 - RNA, 19 nt, Human
gaagccagcaggcucucag

SEQ ID NO: 3127428 - RNA, 20 nt, Human
gaagccagcaggcucucagg

SEQ ID NO: 3127429 - RNA, 17 nt, Human
gaagcauuuacuuugug

SEQ ID NO: 3127430 - RNA, 20 nt, Human
gaagauaauauuaaggaaga

SEQ ID NO: 3127431 - RNA, 23 nt, Human
gacggagucccaccuuggcugca

SEQ ID NO: 3127432 - RNA, 13 nt, Human
gacggagucccac

SEQ ID NO: 3127433 - RNA, 21 nt, Human
gacgcugugcugcccugccca

SEQ ID NO: 3127434 - RNA, 22 nt, Human
gacgcugugcugcccugcccac

SEQ ID NO: 3127435 - RNA, 20 nt, Human
gaccuuucaauaggaaaaac

SEQ ID NO: 3127436 - RNA, 19 nt, Human
gaccuuucaauaggaaaaa

SEQ ID NO: 3127437 - RNA, 11 nt, Human
gaccuuucaau

SEQ ID NO: 3127438 - RNA, 22 nt, Human
gaccuuuaagagaaaugagcug

SEQ ID NO: 3127439 - RNA, 14 nt, Human
gacguguuaugacu

SEQ ID NO: 3127440 - RNA, 11 nt, Human
gacguguuaug

SEQ ID NO: 3127441 - RNA, 23 nt, Human
gacuaacuugucuuuggacccug

SEQ ID NO: 3127442 - RNA, 16 nt, Human
gacuaacuugucuuug

SEQ ID NO: 3127443 - RNA, 19 nt, Human
gacccuugccgucuaccug

SEQ ID NO: 3127444 - RNA, 23 nt, Human
gacccuugccgucuaccugaggg

SEQ ID NO: 3127445 - RNA, 20 nt, Human
gacccuugccgucuaccuga

SEQ ID NO: 3127446 - RNA, 14 nt, Human
gaccuucuccuuca

SEQ ID NO: 3127447 - RNA, 16 nt, Human
gaccuucuccuucacc

SEQ ID NO: 3127448 - RNA, 15 nt, Human
gaccuucuccuucac

SEQ ID NO: 3127449 - RNA, 14 nt, Human
gaccuugaacuggg

SEQ ID NO: 3127450 - RNA, 21 nt, Human
gaccuucuccuucaccuuugu

SEQ ID NO: 3127451 - RNA, 20 nt, Human
gaccuucuccuucaccuuug

SEQ ID NO: 3127452 - RNA, 23 nt, Human
gacuggccaagguuuggggaaga

SEQ ID NO: 3127453 - RNA, 18 nt, Human
gacuuacuguacaugaaa

SEQ ID NO: 3127454 - RNA, 23 nt, Human
gacuuacuguacaugaaaacaca

SEQ ID NO: 3127455 - RNA, 15 nt, Human
gacuuacuguacaug

SEQ ID NO: 3127456 - RNA, 16 nt, Human
gacuuacuguacauga

SEQ ID NO: 3127457 - RNA, 12 nt, Human
gacuuacuguac

SEQ ID NO: 3127458 - RNA, 20 nt, Human
gacuucaucccucuggggcu

SEQ ID NO: 3127459 - RNA, 12 nt, Human
gacuucaucccu

SEQ ID NO: 3127460 - RNA, 18 nt, Human
gacuacaggcacccacca

SEQ ID NO: 3127461 - RNA, 13 nt, Human
gacuacaggcacc

SEQ ID NO: 3127462 - RNA, 15 nt, Human
gacuacaggcaccca

SEQ ID NO: 3127463 - RNA, 20 nt, Human
gacuccugcaggcagccagg

SEQ ID NO: 3127464 - RNA, 19 nt, Human
gacuccugcaggcagccag

SEQ ID NO: 3127465 - RNA, 18 nt, Human
gacuccugcaggcagcca

SEQ ID NO: 3127466 - RNA, 15 nt, Human
gacucuacagaggcc

SEQ ID NO: 3127467 - RNA, 21 nt, Human
gacucuacagaggccaugggc

SEQ ID NO: 3127468 - RNA, 16 nt, Human
gacugaauuucuuuug

SEQ ID NO: 3127469 - RNA, 21 nt, Human
gaccagagcugccaccugccu

SEQ ID NO: 3127470 - RNA, 23 nt, Human
gaccagacaccuugacagggcac

SEQ ID NO: 3127471 - RNA, 19 nt, Human
gaccagagcugccaccugc

SEQ ID NO: 3127472 - RNA, 21 nt, Human
gaccagcaccaucucuccucc

SEQ ID NO: 3127473 - RNA, 20 nt, Human
gaccagcaccaucucuccuc

SEQ ID NO: 3127474 - RNA, 16 nt, Human
gaccacguuucuaaag

SEQ ID NO: 3127475 - RNA, 22 nt, Human
gaccagacaccuugacagggca

SEQ ID NO: 3127476 - RNA, 21 nt, Human
gaccagacaccuugacagggc

SEQ ID NO: 3127477 - RNA, 18 nt, Human
gaccacaaaacuuuucua

SEQ ID NO: 3127478 - RNA, 18 nt, Human
gacccaugcugcccugug

SEQ ID NO: 3127479 - RNA, 20 nt, Human
gacccaugcugcccugugag

SEQ ID NO: 3127480 - RNA, 19 nt, Human
gacccaugcugcccuguga

SEQ ID NO: 3127481 - RNA, 12 nt, Human
gacccacugcuu

SEQ ID NO: 3127482 - RNA, 17 nt, Human
gacccaugcugcccugu

SEQ ID NO: 3127483 - RNA, 22 nt, Human
gacccugcccugugggccccca

SEQ ID NO: 3127484 - RNA, 20 nt, Human
gacccugcccugugggcccc

SEQ ID NO: 3127485 - RNA, 17 nt, Human
gacccugcccugugggc

SEQ ID NO: 3127486 - RNA, 16 nt, Human
gacccugaggcccaga

SEQ ID NO: 3127487 - RNA, 12 nt, Human
gacccugaggcc

SEQ ID NO: 3127488 - RNA, 11 nt, Human
gacccugaggc

SEQ ID NO: 3127489 - RNA, 10 nt, Human
gacccugagg

SEQ ID NO: 3127490 - RNA, 20 nt, Human
gacagagcuacacaggggaa

SEQ ID NO: 3127491 - RNA, 14 nt, Human
gacagagucucacu

SEQ ID NO: 3127492 - RNA, 23 nt, Human
gacagaggcagccccauucugcc

SEQ ID NO: 3127493 - RNA, 21 nt, Human
gacagagucucacuguugccc

SEQ ID NO: 3127494 - RNA, 16 nt, Human
gacagagugagacucu

SEQ ID NO: 3127495 - RNA, 17 nt, Human
gacagacacaggcccgg

SEQ ID NO: 3127496 - RNA, 16 nt, Human
gacacuagaagauuuu

SEQ ID NO: 3127497 - RNA, 20 nt, Human
gacagacacaggcccggcuc

SEQ ID NO: 3127498 - RNA, 22 nt, Human
gacagacacaggcccggcucca

SEQ ID NO: 3127499 - RNA, 21 nt, Human
gacacuaaccacgcuggaccu

SEQ ID NO: 3127500 - RNA, 22 nt, Human
gacacgaauauugcugauggug

SEQ ID NO: 3127501 - RNA, 18 nt, Human
gaauuucccaaagcagug

SEQ ID NO: 3127502 - RNA, 16 nt, Human
gaauuucccaaagcag

SEQ ID NO: 3127503 - RNA, 22 nt, Human
gaauuucccaaagcagugcaug

SEQ ID NO: 3127504 - RNA, 23 nt, Human
gacaggcaaugcuggcuguuggc

SEQ ID NO: 3127505 - RNA, 20 nt, Human
gacaggcauguucucugagg

SEQ ID NO: 3127506 - RNA, 21 nt, Human
gacaggcauguucucugagga

SEQ ID NO: 3127507 - RNA, 20 nt, Human
gacaggcaagcaccuccugc

SEQ ID NO: 3127508 - RNA, 18 nt, Human
gacaggcaaugcuggcug

SEQ ID NO: 3127509 - RNA, 19 nt, Human
gacaggcaaugcuggcugu

SEQ ID NO: 3127510 - RNA, 13 nt, Human
gacaggcaagcac

SEQ ID NO: 3127511 - RNA, 17 nt, Human
gacaggcaagcaccucc

SEQ ID NO: 3127512 - RNA, 18 nt, Human
gacaggcaagcaccuccu

SEQ ID NO: 3127513 - RNA, 22 nt, Human
gacaguuaagagaaaugagcuu

SEQ ID NO: 3127514 - RNA, 22 nt, Human
gacaggcauguucucugaggac

SEQ ID NO: 3127515 - RNA, 23 nt, Human
gacaucaacugcaucaagaugug

SEQ ID NO: 3127516 - RNA, 16 nt, Human
gacaucaacugcauca

SEQ ID NO: 3127517 - RNA, 13 nt, Human
gaucauccacugu

SEQ ID NO: 3127518 - RNA, 16 nt, Human
gauccucccaccucag

SEQ ID NO: 3127519 - RNA, 14 nt, Human
gauccuccaggugc

SEQ ID NO: 3127520 - RNA, 21 nt, Human
gauccucccaccucagccucc

SEQ ID NO: 3127521 - RNA, 17 nt, Human
gauccucccaccucagc

SEQ ID NO: 3127522 - RNA, 13 nt, Human
gaucuaggaagac

SEQ ID NO: 3127523 - RNA, 18 nt, Human
gaucuaggaagacuuugg

SEQ ID NO: 3127524 - RNA, 14 nt, Human
gaucuaggaagacu

SEQ ID NO: 3127525 - RNA, 20 nt, Human
gaucuaggaagacuuuggaa

SEQ ID NO: 3127526 - RNA, 12 nt, Human
gauccugagcca

SEQ ID NO: 3127527 - RNA, 19 nt, Human
gaugcagccucacaguccu

SEQ ID NO: 3127528 - RNA, 14 nt, Human
gaugccugguggca

SEQ ID NO: 3127529 - RNA, 14 nt, Human
gaugcagugcuucc

SEQ ID NO: 3127530 - RNA, 15 nt, Human
gaugccugguggcag

SEQ ID NO: 3127531 - RNA, 16 nt, Human
gaugccugguggcagc

SEQ ID NO: 3127532 - RNA, 18 nt, Human
gaugaccuugaaugaugc

SEQ ID NO: 3127533 - RNA, 23 nt, Human
gaugagaaauaaaguuucuguug

SEQ ID NO: 3127534 - RNA, 14 nt, Human
gaugcaccagcccu

SEQ ID NO: 3127535 - RNA, 14 nt, Human
gaugagaggaaauc

SEQ ID NO: 3127536 - RNA, 15 nt, Human
gaugcaccagcccuu

SEQ ID NO: 3127537 - RNA, 23 nt, Human
gaugcaccagcccuuagcaggga

SEQ ID NO: 3127538 - RNA, 22 nt, Human
gaucuucuguggguuucuaaag

SEQ ID NO: 3127539 - RNA, 19 nt, Human
gaucuucuuuauaauucua

SEQ ID NO: 3127540 - RNA, 15 nt, Human
gaugaaaugagguca

SEQ ID NO: 3127541 - RNA, 21 nt, Human
gaugaaaugaggucagagccu

SEQ ID NO: 3127542 - RNA, 16 nt, Human
gauacaaaagcaugug

SEQ ID NO: 3127543 - RNA, 20 nt, Human
gauagugucccacggugccu

SEQ ID NO: 3127544 - RNA, 18 nt, Human
gauauaugcucugcaugu

SEQ ID NO: 3127545 - RNA, 14 nt, Human
gaucacagccucug

SEQ ID NO: 3127546 - RNA, 23 nt, Human
gaucacggcucacugcagccuca

SEQ ID NO: 3127547 - RNA, 20 nt, Human
gaucacggcucacugcagcc

SEQ ID NO: 3127548 - RNA, 12 nt, Human
gauaauacacca

SEQ ID NO: 3127549 - RNA, 23 nt, Human
gauaauacaccacuacauucugu

SEQ ID NO: 3127550 - RNA, 24 nt, Human
gauaauacaccacuacauucuguu

SEQ ID NO: 3127551 - RNA, 15 nt, Human
gauucccaagcucug

SEQ ID NO: 3127552 - RNA, 13 nt, Human
gauuacaagcgug

SEQ ID NO: 3127553 - RNA, 21 nt, Human
gauuacaagcgugagccacug

SEQ ID NO: 3127554 - RNA, 18 nt, Human
gauucagacagcugccug

SEQ ID NO: 3127555 - RNA, 17 nt, Human
gauucagacagcugccu

SEQ ID NO: 3127556 - RNA, 14 nt, Human
gauucagacagcug

SEQ ID NO: 3127557 - RNA, 13 nt, Human
gauucagacagcu

SEQ ID NO: 3127558 - RNA, 18 nt, Human
gauguucuagcauggcug

SEQ ID NO: 3127559 - RNA, 15 nt, Human
gauugcaacaggcug

SEQ ID NO: 3127560 - RNA, 17 nt, Human
gauugcaacaggcuggg

SEQ ID NO: 3127561 - RNA, 18 nt, Human
gauugcaacaggcugggc

SEQ ID NO: 3127562 - RNA, 16 nt, Human
gauugcaacaggcugg

SEQ ID NO: 3127563 - RNA, 22 nt, Human
gauucuuuccugaggcugggcu

SEQ ID NO: 3127564 - RNA, 20 nt, Human
gauucuuuccugaggcuggg

SEQ ID NO: 3127565 - RNA, 16 nt, Human
gauucccaagcucugc

SEQ ID NO: 3127566 - RNA, 17 nt, Human
gauucccaagcucugcu

SEQ ID NO: 3127567 - RNA, 19 nt, Human
gauucuuuccugaggcugg

SEQ ID NO: 3127568 - RNA, 19 nt, Human
gauuuguuaaugauagcua

SEQ ID NO: 3127569 - RNA, 22 nt, Human
gauuucuguuuagauaauacac

SEQ ID NO: 3127570 - RNA, 21 nt, Human
gauuucuguuuagauaauaca

SEQ ID NO: 3127571 - RNA, 17 nt, Human
gcaauccugcaagaaca

SEQ ID NO: 3127572 - RNA, 13 nt, Human
gcaaggcugucaa

SEQ ID NO: 3127573 - RNA, 14 nt, Human
gcaaggucauuuuu

SEQ ID NO: 3127574 - RNA, 18 nt, Human
gcaaggcugucaauuaca

SEQ ID NO: 3127575 - RNA, 14 nt, Human
gcaaggcugucaau

SEQ ID NO: 3127576 - RNA, 18 nt, Human
gcaagcaccuccugccuc

SEQ ID NO: 3127577 - RNA, 20 nt, Human
gcaagcaccuccugccucga

SEQ ID NO: 3127578 - RNA, 15 nt, Human
gcaagcaccuccugc

SEQ ID NO: 3127579 - RNA, 16 nt, Human
gcaagcaccuccugcc

SEQ ID NO: 3127580 - RNA, 18 nt, Human
gcaacugcauuggcuuug

SEQ ID NO: 3127581 - RNA, 16 nt, Human
gcaaaccaucauugaa

SEQ ID NO: 3127582 - RNA, 21 nt, Human
gcaaaccaucauugaaaucuu

SEQ ID NO: 3127583 - RNA, 20 nt, Human
gcaaaccaucauugaaaucu

SEQ ID NO: 3127584 - RNA, 19 nt, Human
gcaaaccaucauugaaauc

SEQ ID NO: 3127585 - RNA, 17 nt, Human
gcaaaccaucauugaaa

SEQ ID NO: 3127586 - RNA, 15 nt, Human
gcaaaccaucauuga

SEQ ID NO: 3127587 - RNA, 17 nt, Human
gcacuaaggugugcucu

SEQ ID NO: 3127588 - RNA, 18 nt, Human
gcacuaaggugugcucug

SEQ ID NO: 3127589 - RNA, 14 nt, Human
gcacugggcuuggg

SEQ ID NO: 3127590 - RNA, 23 nt, Human
gcacugggcuuggggaccagagc

SEQ ID NO: 3127591 - RNA, 22 nt, Human
gcacugggcuuggggaccagag

SEQ ID NO: 3127592 - RNA, 12 nt, Human
gcagaaggaaga

SEQ ID NO: 3127593 - RNA, 14 nt, Human
gcagaaggaagacu

SEQ ID NO: 3127594 - RNA, 13 nt, Human
gcagaaggaagac

SEQ ID NO: 3127595 - RNA, 14 nt, Human
gcacccggccccug

SEQ ID NO: 3127596 - RNA, 15 nt, Human
gcacccggccccugc

SEQ ID NO: 3127597 - RNA, 17 nt, Human
gcacccggccccugcug

SEQ ID NO: 3127598 - RNA, 14 nt, Human
gcaccuccugccuc

SEQ ID NO: 3127599 - RNA, 15 nt, Human
gcaccuccugccucg

SEQ ID NO: 3127600 - RNA, 19 nt, Human
gcaccacugcacuccagcc

SEQ ID NO: 3127601 - RNA, 16 nt, Human
gcacagcuucauuucc

SEQ ID NO: 3127602 - RNA, 22 nt, Human
gcacaugccucucucaggccaa

SEQ ID NO: 3127603 - RNA, 14 nt, Human
gcaaugaccuuuca

SEQ ID NO: 3127604 - RNA, 13 nt, Human
gcaaugaccuuuc

SEQ ID NO: 3127605 - RNA, 19 nt, Human
gcacagcuaacauggaagu

SEQ ID NO: 3127606 - RNA, 20 nt, Human
gcagcagggagggcuucugc

SEQ ID NO: 3127607 - RNA, 19 nt, Human
gcagccucaaccuccuggg

SEQ ID NO: 3127608 - RNA, 20 nt, Human
gcagccucaaccuccugggc

SEQ ID NO: 3127609 - RNA, 21 nt, Human
gcagccucaaccuccugggcu

SEQ ID NO: 3127610 - RNA, 22 nt, Human
gcagccucaaccuccugggcua

SEQ ID NO: 3127611 - RNA, 14 nt, Human
gcagccuggacccu

SEQ ID NO: 3127612 - RNA, 19 nt, Human
gcagagaaugaaagggccc

SEQ ID NO: 3127613 - RNA, 20 nt, Human
gcagagaaugaaagggccca

SEQ ID NO: 3127614 - RNA, 21 nt, Human
gcagagaaugaaagggcccag

SEQ ID NO: 3127615 - RNA, 21 nt, Human
gcagagaauucucuuauccaa

SEQ ID NO: 3127616 - RNA, 22 nt, Human
gcagagaaugaaagggcccaga

SEQ ID NO: 3127617 - RNA, 23 nt, Human
gcagagaaugaaagggcccagag

SEQ ID NO: 3127618 - RNA, 15 nt, Human
gcagaguugaagaca

SEQ ID NO: 3127619 - RNA, 15 nt, Human
gcagagaccaucccu

SEQ ID NO: 3127620 - RNA, 14 nt, Human
gcagagaccauccc

SEQ ID NO: 3127621 - RNA, 17 nt, Human
gcagagaccaucccuga

SEQ ID NO: 3127622 - RNA, 19 nt, Human
gcagaguugaagacagagc

SEQ ID NO: 3127623 - RNA, 17 nt, Human
gcagaguugaagacaga

SEQ ID NO: 3127624 - RNA, 16 nt, Human
gcagaguugaagacag

SEQ ID NO: 3127625 - RNA, 17 nt, Human
gcauguuugugauugac

SEQ ID NO: 3127626 - RNA, 15 nt, Human
gcaugccuggauggg

SEQ ID NO: 3127627 - RNA, 15 nt, Human
gcaugcugucccuua

SEQ ID NO: 3127628 - RNA, 15 nt, Human
gcaucaggccaggcc

SEQ ID NO: 3127629 - RNA, 13 nt, Human
gcaucaggccagg

SEQ ID NO: 3127630 - RNA, 17 nt, Human
gcaucaggccaggcccu

SEQ ID NO: 3127631 - RNA, 16 nt, Human
gcaucaggccaggccc

SEQ ID NO: 3127632 - RNA, 23 nt, Human
gcaugaaguaauaugcacacauu

SEQ ID NO: 3127633 - RNA, 22 nt, Human
gcaugccuggauggggcugcac

SEQ ID NO: 3127634 - RNA, 17 nt, Human
gcaugccuggauggggc

SEQ ID NO: 3127635 - RNA, 19 nt, Human
gccaaacucaccugccccu

SEQ ID NO: 3127636 - RNA, 21 nt, Human
gccaaacucaccugccccuca

SEQ ID NO: 3127637 - RNA, 14 nt, Human
gccaaaggaagcac

SEQ ID NO: 3127638 - RNA, 20 nt, Human
gccaaaggaagcacaugccu

SEQ ID NO: 3127639 - RNA, 16 nt, Human
gccaaaggaagcacau

SEQ ID NO: 3127640 - RNA, 22 nt, Human
gcauuuugcuaaaugugaauga

SEQ ID NO: 3127641 - RNA, 12 nt, Human
gcauuccccacu

SEQ ID NO: 3127642 - RNA, 23 nt, Human
gcauuugcugaauacagaggcaa

SEQ ID NO: 3127643 - RNA, 21 nt, Human
gcauuuggugguuucagaaau

SEQ ID NO: 3127644 - RNA, 17 nt, Human
gcauuugcugaauacag

SEQ ID NO: 3127645 - RNA, 17 nt, Human
gcagugggagcugccug

SEQ ID NO: 3127646 - RNA, 18 nt, Human
gcagugggagcugccugu

SEQ ID NO: 3127647 - RNA, 21 nt, Human
gcaucaagaugugacauguuu

SEQ ID NO: 3127648 - RNA, 20 nt, Human
gcauauucaggaagcucagg

SEQ ID NO: 3127649 - RNA, 18 nt, Human
gcauauucaggaagcuca

SEQ ID NO: 3127650 - RNA, 17 nt, Human
gcauauucaggaagcuc

SEQ ID NO: 3127651 - RNA, 15 nt, Human
gcauauucaggaagc

SEQ ID NO: 3127652 - RNA, 16 nt, Human
gcagggagggcuucug

SEQ ID NO: 3127653 - RNA, 12 nt, Human
gcagggcucagc

SEQ ID NO: 3127654 - RNA, 20 nt, Human
gcaggauucuuccucccucc

SEQ ID NO: 3127655 - RNA, 16 nt, Human
gcagugggagcugccu

SEQ ID NO: 3127656 - RNA, 23 nt, Human
gcagugcuuccaaggauggacca

SEQ ID NO: 3127657 - RNA, 19 nt, Human
gccccuucugacccaugcu

SEQ ID NO: 3127658 - RNA, 12 nt, Human
gcccggcuccag

SEQ ID NO: 3127659 - RNA, 13 nt, Human
gcccggcuccagg

SEQ ID NO: 3127660 - RNA, 14 nt, Human
gcccggcuccaggc

SEQ ID NO: 3127661 - RNA, 12 nt, Human
gcccgggcucug

SEQ ID NO: 3127662 - RNA, 18 nt, Human
gcccgggcucugccuccc

SEQ ID NO: 3127663 - RNA, 15 nt, Human
gcccgggcucugccu

SEQ ID NO: 3127664 - RNA, 14 nt, Human
gcccgggcucugcc

SEQ ID NO: 3127665 - RNA, 13 nt, Human
gcccgggcucugc

SEQ ID NO: 3127666 - RNA, 21 nt, Human
gcccgggcucugccucccauc

SEQ ID NO: 3127667 - RNA, 20 nt, Human
gcccgggcucugccucccau

SEQ ID NO: 3127668 - RNA, 19 nt, Human
gcccgggcucugccuccca

SEQ ID NO: 3127669 - RNA, 22 nt, Human
gcccucugcccacucccugcaa

SEQ ID NO: 3127670 - RNA, 19 nt, Human
gcccucugcccacucccug

SEQ ID NO: 3127671 - RNA, 15 nt, Human
gccccauucugccug

SEQ ID NO: 3127672 - RNA, 23 nt, Human
gccccgaggccuucucugaagga

SEQ ID NO: 3127673 - RNA, 22 nt, Human
gccccauucugccugcccaggc

SEQ ID NO: 3127674 - RNA, 23 nt, Human
gccccauucugccugcccaggcc

SEQ ID NO: 3127675 - RNA, 22 nt, Human
gccccgaggccuucucugaagg

SEQ ID NO: 3127676 - RNA, 14 nt, Human
gccccgcccaggcu

SEQ ID NO: 3127677 - RNA, 18 nt, Human
gccccucagggucccugg

SEQ ID NO: 3127678 - RNA, 21 nt, Human
gccccucagggucccuggugg

SEQ ID NO: 3127679 - RNA, 19 nt, Human
gccccucagggucccuggu

SEQ ID NO: 3127680 - RNA, 23 nt, Human
gccccuggcagccccuguucugg

SEQ ID NO: 3127681 - RNA, 11 nt, Human
gcccaggcugg

SEQ ID NO: 3127682 - RNA, 18 nt, Human
gcccaggccuccuacagc

SEQ ID NO: 3127683 - RNA, 16 nt, Human
gcccaggaaaggcucc

SEQ ID NO: 3127684 - RNA, 15 nt, Human
gcccaggaaaggcuc

SEQ ID NO: 3127685 - RNA, 12 nt, Human
gcccaggaaagg

SEQ ID NO: 3127686 - RNA, 22 nt, Human
gcccagucuggaaugcaguggu

SEQ ID NO: 3127687 - RNA, 20 nt, Human
gcccagucuggaaugcagug

SEQ ID NO: 3127688 - RNA, 16 nt, Human
gcccaggcuggcgugc

SEQ ID NO: 3127689 - RNA, 14 nt, Human
gcccaggcuggcgu

SEQ ID NO: 3127690 - RNA, 15 nt, Human
gcccaggcuggcgug

SEQ ID NO: 3127691 - RNA, 23 nt, Human
gccccauccucuguacagagccc

SEQ ID NO: 3127692 - RNA, 17 nt, Human
gccccauucugccugcc

SEQ ID NO: 3127693 - RNA, 18 nt, Human
gccccauucugccugccc

SEQ ID NO: 3127694 - RNA, 20 nt, Human
gccccauucugccugcccag

SEQ ID NO: 3127695 - RNA, 21 nt, Human
gccccauucugccugcccagg

SEQ ID NO: 3127696 - RNA, 15 nt, Human
gccccagugcccaca

SEQ ID NO: 3127697 - RNA, 16 nt, Human
gccccagugcccacag

SEQ ID NO: 3127698 - RNA, 17 nt, Human
gccccagugcccacagg

SEQ ID NO: 3127699 - RNA, 23 nt, Human
gccaggggaaaaucagccugcuc

SEQ ID NO: 3127700 - RNA, 17 nt, Human
gccaggggaaaaucagc

SEQ ID NO: 3127701 - RNA, 22 nt, Human
gccaggggaaaaucagccugcu

SEQ ID NO: 3127702 - RNA, 21 nt, Human
gccaggggaaaaucagccugc

SEQ ID NO: 3127703 - RNA, 19 nt, Human
gccaggaagccagcaggcu

SEQ ID NO: 3127704 - RNA, 15 nt, Human
gccaggaagccagca

SEQ ID NO: 3127705 - RNA, 18 nt, Human
gccaggaagccagcaggc

SEQ ID NO: 3127706 - RNA, 17 nt, Human
gccaggaagccagcagg

SEQ ID NO: 3127707 - RNA, 19 nt, Human
gccauccagguucagcuug

SEQ ID NO: 3127708 - RNA, 20 nt, Human
gccauccagguucagcuugu

SEQ ID NO: 3127709 - RNA, 14 nt, Human
gccauccagguuca

SEQ ID NO: 3127710 - RNA, 17 nt, Human
gccaucccagccccaau

SEQ ID NO: 3127711 - RNA, 16 nt, Human
gccaucccagccccaa

SEQ ID NO: 3127712 - RNA, 15 nt, Human
gccaucccagcccca

SEQ ID NO: 3127713 - RNA, 14 nt, Human
gccaucccagcccc

SEQ ID NO: 3127714 - RNA, 13 nt, Human
gccaucccagccc

SEQ ID NO: 3127715 - RNA, 15 nt, Human
gcccaccccucaaca

SEQ ID NO: 3127716 - RNA, 19 nt, Human
gcccacaggaucagucuga

SEQ ID NO: 3127717 - RNA, 13 nt, Human
gcccacaggauca

SEQ ID NO: 3127718 - RNA, 18 nt, Human
gcccacaggaucagucug

SEQ ID NO: 3127719 - RNA, 16 nt, Human
gcccaaagaugcagcc

SEQ ID NO: 3127720 - RNA, 15 nt, Human
gcccaaagaugcagc

SEQ ID NO: 3127721 - RNA, 17 nt, Human
gccauuucuuccacaag

SEQ ID NO: 3127722 - RNA, 22 nt, Human
gccauuucuuccacaagagccc

SEQ ID NO: 3127723 - RNA, 20 nt, Human
gccauuucuuccacaagagc

SEQ ID NO: 3127724 - RNA, 17 nt, Human
gccagauucuuuccuga

SEQ ID NO: 3127725 - RNA, 19 nt, Human
gccagagggagugacagag

SEQ ID NO: 3127726 - RNA, 20 nt, Human
gccagagggagugacagagg

SEQ ID NO: 3127727 - RNA, 16 nt, Human
gccagauucuuuccug

SEQ ID NO: 3127728 - RNA, 12 nt, Human
gccagccuugac

SEQ ID NO: 3127729 - RNA, 20 nt, Human
gccagccgagauagccaagg

SEQ ID NO: 3127730 - RNA, 22 nt, Human
gccagccuugaccauucuccac

SEQ ID NO: 3127731 - RNA, 21 nt, Human
gccagccuugaccauucucca

SEQ ID NO: 3127732 - RNA, 20 nt, Human
gccagccuugaccauucucc

SEQ ID NO: 3127733 - RNA, 14 nt, Human
gccagccuugacca

SEQ ID NO: 3127734 - RNA, 15 nt, Human
gccagcugcuugggc

SEQ ID NO: 3127735 - RNA, 14 nt, Human
gccagcugcuuggg

SEQ ID NO: 3127736 - RNA, 20 nt, Human
gccacuauuguuagucucuu

SEQ ID NO: 3127737 - RNA, 21 nt, Human
gccacuauuguuagucucuug

SEQ ID NO: 3127738 - RNA, 16 nt, Human
gccacggccaggccag

SEQ ID NO: 3127739 - RNA, 12 nt, Human
gccaaaggaagc

SEQ ID NO: 3127740 - RNA, 14 nt, Human
gccacggccaggcc

SEQ ID NO: 3127741 - RNA, 15 nt, Human
gccacggccaggcca

SEQ ID NO: 3127742 - RNA, 15 nt, Human
gccagagacacaagc

SEQ ID NO: 3127743 - RNA, 12 nt, Human
gccagagacaca

SEQ ID NO: 3127744 - RNA, 17 nt, Human
gccagagggagugacag

SEQ ID NO: 3127745 - RNA, 18 nt, Human
gccagagggagugacaga

SEQ ID NO: 3127746 - RNA, 17 nt, Human
gccacugcaccgggcca

SEQ ID NO: 3127747 - RNA, 18 nt, Human
gccacugcaccgggccac

SEQ ID NO: 3127748 - RNA, 17 nt, Human
gccgagauagccaaggc

SEQ ID NO: 3127749 - RNA, 15 nt, Human
gccgcagcccugcag

SEQ ID NO: 3127750 - RNA, 17 nt, Human
gccgcagcccugcagag

SEQ ID NO: 3127751 - RNA, 16 nt, Human
gccgcagcccugcaga

SEQ ID NO: 3127752 - RNA, 13 nt, Human
gccgcagcccugc

SEQ ID NO: 3127753 - RNA, 23 nt, Human
gcccuucucuccagccccuggau

SEQ ID NO: 3127754 - RNA, 13 nt, Human
gcccuucucucca

SEQ ID NO: 3127755 - RNA, 16 nt, Human
gccgagauagccaagg

SEQ ID NO: 3127756 - RNA, 23 nt, Human
gccgucuaccugaggggccucuu

SEQ ID NO: 3127757 - RNA, 22 nt, Human
gccgucuaccugaggggccucu

SEQ ID NO: 3127758 - RNA, 20 nt, Human
gccgucuaccugaggggccu

SEQ ID NO: 3127759 - RNA, 18 nt, Human
gccgucuaccugaggggc

SEQ ID NO: 3127760 - RNA, 22 nt, Human
gccucaagugauucuccugccu

SEQ ID NO: 3127761 - RNA, 24 nt, Human
gccucaagugauucuccugccuca

SEQ ID NO: 3127762 - RNA, 18 nt, Human
gccucagcauccuggcac

SEQ ID NO: 3127763 - RNA, 17 nt, Human
gccucagcauccuggca

SEQ ID NO: 3127764 - RNA, 21 nt, Human
gccucagcauccuggcacccg

SEQ ID NO: 3127765 - RNA, 17 nt, Human
gccucccaucacccgcu

SEQ ID NO: 3127766 - RNA, 12 nt, Human
gccucagccucc

SEQ ID NO: 3127767 - RNA, 14 nt, Human
gccucagccuccca

SEQ ID NO: 3127768 - RNA, 20 nt, Human
gccucccgaguagcugggac

SEQ ID NO: 3127769 - RNA, 20 nt, Human
gccucccgaauagcugggac

SEQ ID NO: 3127770 - RNA, 21 nt, Human
gccucccgaguagcugggacu

SEQ ID NO: 3127771 - RNA, 23 nt, Human
gccucccgaguagcugggacuac

SEQ ID NO: 3127772 - RNA, 18 nt, Human
gccucccgaauagcuggg

SEQ ID NO: 3127773 - RNA, 19 nt, Human
gccucccgaauagcuggga

SEQ ID NO: 3127774 - RNA, 15 nt, Human
gccucucccaucacu

SEQ ID NO: 3127775 - RNA, 15 nt, Human
gccucugacacacag

SEQ ID NO: 3127776 - RNA, 16 nt, Human
gccucugcacuccccu

SEQ ID NO: 3127777 - RNA, 20 nt, Human
gccucugcacuccccugcug

SEQ ID NO: 3127778 - RNA, 19 nt, Human
gccucugcacuccccugcu

SEQ ID NO: 3127779 - RNA, 18 nt, Human
gccucugcacuccccugc

SEQ ID NO: 3127780 - RNA, 17 nt, Human
gccucugcacuccccug

SEQ ID NO: 3127781 - RNA, 15 nt, Human
gccucugcacucccc

SEQ ID NO: 3127782 - RNA, 21 nt, Human
gccucugcacuccccugcugg

SEQ ID NO: 3127783 - RNA, 11 nt, Human
gccugcccagg

SEQ ID NO: 3127784 - RNA, 14 nt, Human
gccuggacccugug

SEQ ID NO: 3127785 - RNA, 21 nt, Human
gccuuccaggggugggacacc

SEQ ID NO: 3127786 - RNA, 23 nt, Human
gccuuauggaacacucugagacu

SEQ ID NO: 3127787 - RNA, 22 nt, Human
gccuuauggaacacucugagac

SEQ ID NO: 3127788 - RNA, 21 nt, Human
gccuuauggaacacucugaga

SEQ ID NO: 3127789 - RNA, 19 nt, Human
gccuuacccucauguucuu

SEQ ID NO: 3127790 - RNA, 20 nt, Human
gccuuagaagucacacagua

SEQ ID NO: 3127791 - RNA, 14 nt, Human
gccugguggcagcu

SEQ ID NO: 3127792 - RNA, 15 nt, Human
gccugguggcagcug

SEQ ID NO: 3127793 - RNA, 16 nt, Human
gccugguggcagcugc

SEQ ID NO: 3127794 - RNA, 17 nt, Human
gccugguggcagcugcg

SEQ ID NO: 3127795 - RNA, 14 nt, Human
gcgcugccccuggc

SEQ ID NO: 3127796 - RNA, 20 nt, Human
gcgccuacaggagugagcac

SEQ ID NO: 3127797 - RNA, 21 nt, Human
gcgccuacaggagugagcacu

SEQ ID NO: 3127798 - RNA, 18 nt, Human
gcgccuacaggagugagc

SEQ ID NO: 3127799 - RNA, 23 nt, Human
gcggggacagcuccuucuguccu

SEQ ID NO: 3127800 - RNA, 20 nt, Human
gcgguccacccaggagcccc

SEQ ID NO: 3127801 - RNA, 23 nt, Human
gcgguccacccaggagccccgag

SEQ ID NO: 3127802 - RNA, 19 nt, Human
gcggaaugaaccacaucuu

SEQ ID NO: 3127803 - RNA, 16 nt, Human
gcggacagccacggcc

SEQ ID NO: 3127804 - RNA, 19 nt, Human
gcggacagccacggccagg

SEQ ID NO: 3127805 - RNA, 18 nt, Human
gcggggacagcuccuucu

SEQ ID NO: 3127806 - RNA, 19 nt, Human
gcggggacagcuccuucug

SEQ ID NO: 3127807 - RNA, 23 nt, Human
gcggacagccacggccaggccag

SEQ ID NO: 3127808 - RNA, 22 nt, Human
gcuagacgagcaggcuucuucc

SEQ ID NO: 3127809 - RNA, 21 nt, Human
gcuagacgagcaggcuucuuc

SEQ ID NO: 3127810 - RNA, 14 nt, Human
gcgugagccacugc

SEQ ID NO: 3127811 - RNA, 15 nt, Human
gcgugagccacugca

SEQ ID NO: 3127812 - RNA, 14 nt, Human
gcuaacauggaagu

SEQ ID NO: 3127813 - RNA, 18 nt, Human
gcuaacauggaaguacua

SEQ ID NO: 3127814 - RNA, 17 nt, Human
gcuaacauggaaguacu

SEQ ID NO: 3127815 - RNA, 22 nt, Human
gcuacacaggggaaaagaggag

SEQ ID NO: 3127816 - RNA, 20 nt, Human
ggaagccagcaggcucucag

SEQ ID NO: 3127817 - RNA, 21 nt, Human
ggagaccccuuggggagcagg

SEQ ID NO: 3127818 - RNA, 21 nt, Human
ggagagcuagcagcagggagg

SEQ ID NO: 3127819 - RNA, 17 nt, Human
ggagagcuagcagcagg

SEQ ID NO: 3127820 - RNA, 20 nt, Human
ggagauuuacaacuggggga

SEQ ID NO: 3127821 - RNA, 15 nt, Human
ggagaggggcacagg

SEQ ID NO: 3127822 - RNA, 20 nt, Human
ggagcaaaaucgaugcagug

SEQ ID NO: 3127823 - RNA, 21 nt, Human
ggaggaucucuugagccuggg

SEQ ID NO: 3127824 - RNA, 17 nt, Human
ggaggaucucuugagcc

SEQ ID NO: 3127825 - RNA, 23 nt, Human
ggaggaucacuugaguccagaag

SEQ ID NO: 3127826 - RNA, 13 nt, Human
ggagggcuccaga

SEQ ID NO: 3127827 - RNA, 12 nt, Human
ggagggcuccag

SEQ ID NO: 3127828 - RNA, 12 nt, Human
ggagggagggcu

SEQ ID NO: 3127829 - RNA, 15 nt, Human
ggagggcuccagaca

SEQ ID NO: 3127830 - RNA, 14 nt, Human
ggagggcuccagac

SEQ ID NO: 3127831 - RNA, 17 nt, Human
ggagggcuccagacaca

SEQ ID NO: 3127832 - RNA, 20 nt, Human
ggagucccaccuuggcugca

SEQ ID NO: 3127833 - RNA, 11 nt, Human
ggagugacaga

SEQ ID NO: 3127834 - RNA, 16 nt, Human
ggagugacagaggcag

SEQ ID NO: 3127835 - RNA, 12 nt, Human
ggagugagcugg

SEQ ID NO: 3127836 - RNA, 14 nt, Human
ggagugagcugguu

SEQ ID NO: 3127837 - RNA, 21 nt, Human
ggagugaguugauagcacaga

SEQ ID NO: 3127838 - RNA, 17 nt, Human
ggagugacagaggcagc

SEQ ID NO: 3127839 - RNA, 18 nt, Human
ggagugacagaggcagcc

SEQ ID NO: 3127840 - RNA, 19 nt, Human
ggagugacagaggcagccc

SEQ ID NO: 3127841 - RNA, 21 nt, Human
ggagugacagaggcagcccca

SEQ ID NO: 3127842 - RNA, 16 nt, Human
ggaucacagccucuga

SEQ ID NO: 3127843 - RNA, 22 nt, Human
ggccaccugcggugcuaucucc

SEQ ID NO: 3127844 - RNA, 16 nt, Human
ggccaccugcggugcu

SEQ ID NO: 3127845 - RNA, 17 nt, Human
ggccacaagacccuugu

SEQ ID NO: 3127846 - RNA, 16 nt, Human
ggccacaagacccuug

SEQ ID NO: 3127847 - RNA, 15 nt, Human
ggcauuccccaggag

SEQ ID NO: 3127848 - RNA, 23 nt, Human
ggcauguucucugaggacacuaa

SEQ ID NO: 3127849 - RNA, 15 nt, Human
ggcagguuggugggg

SEQ ID NO: 3127850 - RNA, 11 nt, Human
ggccacuguga

SEQ ID NO: 3127851 - RNA, 16 nt, Human
ggccaggagccuccug

SEQ ID NO: 3127852 - RNA, 14 nt, Human
ggccaggagccucc

SEQ ID NO: 3127853 - RNA, 16 nt, Human
ggccacugugaagaga

SEQ ID NO: 3127854 - RNA, 14 nt, Human
ggccaggccagagg

SEQ ID NO: 3127855 - RNA, 16 nt, Human
ggccaggccagaggga

SEQ ID NO: 3127856 - RNA, 11 nt, Human
ggccaggcugg

SEQ ID NO: 3127857 - RNA, 13 nt, Human
ggccaugggccuc

SEQ ID NO: 3127858 - RNA, 21 nt, Human
ggccccucagggucccuggug

SEQ ID NO: 3127859 - RNA, 20 nt, Human
ggccccucagggucccuggu

SEQ ID NO: 3127860 - RNA, 19 nt, Human
ggccccucagggucccugg

SEQ ID NO: 3127861 - RNA, 16 nt, Human
ggccccucaggguccc

SEQ ID NO: 3127862 - RNA, 13 nt, Human
ggccccugccacc

SEQ ID NO: 3127863 - RNA, 16 nt, Human
ggccccugccacccug

SEQ ID NO: 3127864 - RNA, 12 nt, Human
ggccccugccac

SEQ ID NO: 3127865 - RNA, 17 nt, Human
ggccccugccacccugg

SEQ ID NO: 3127866 - RNA, 18 nt, Human
ggccccugccacccuggg

SEQ ID NO: 3127867 - RNA, 13 nt, Human
ggccccugcccgg

SEQ ID NO: 3127868 - RNA, 16 nt, Human
ggcaaggcugucaauu

SEQ ID NO: 3127869 - RNA, 15 nt, Human
ggcacccggccccug

SEQ ID NO: 3127870 - RNA, 16 nt, Human
ggcacccggccccugc

SEQ ID NO: 3127871 - RNA, 12 nt, Human
ggcagagcagag

SEQ ID NO: 3127872 - RNA, 16 nt, Human
ggcagagcagagacca

SEQ ID NO: 3127873 - RNA, 15 nt, Human
ggcagagcagagacc

SEQ ID NO: 3127874 - RNA, 20 nt, Human
ggcagagcagagaccauccc

SEQ ID NO: 3127875 - RNA, 21 nt, Human
ggaucagucugauucccaagc

SEQ ID NO: 3127876 - RNA, 19 nt, Human
ggcaacccccagccugcua

SEQ ID NO: 3127877 - RNA, 15 nt, Human
ggcaaggcugucaau

SEQ ID NO: 3127878 - RNA, 19 nt, Human
ggcaacugcauuggcuuug

SEQ ID NO: 3127879 - RNA, 18 nt, Human
ggcaacugcauuggcuuu

SEQ ID NO: 3127880 - RNA, 17 nt, Human
ggcagaggaaagcaaag

SEQ ID NO: 3127881 - RNA, 21 nt, Human
ggcagaguugaagacagagcu

SEQ ID NO: 3127882 - RNA, 23 nt, Human
ggcagauacaggaaaagcugcug

SEQ ID NO: 3127883 - RNA, 23 nt, Human
ggcagaguugaagacagagcuac

SEQ ID NO: 3127884 - RNA, 19 nt, Human
ggcagcugcgguccaccca

SEQ ID NO: 3127885 - RNA, 21 nt, Human
ggcagcuugaggguugggcug

SEQ ID NO: 3127886 - RNA, 16 nt, Human
ggcagcucaccucucc

SEQ ID NO: 3127887 - RNA, 22 nt, Human
ggcagcucaccucucccuugga

SEQ ID NO: 3127888 - RNA, 21 nt, Human
ggcagcucaccucucccuugg

SEQ ID NO: 3127889 - RNA, 18 nt, Human
ggcagcucaccucucccu

SEQ ID NO: 3127890 - RNA, 13 nt, Human
ggcagguccaggg

SEQ ID NO: 3127891 - RNA, 23 nt, Human
ggcaggucuugaacuccuggccu

SEQ ID NO: 3127892 - RNA, 18 nt, Human
gcuuccagugaggcucug

SEQ ID NO: 3127893 - RNA, 20 nt, Human
gcuuccagugaggcucugcc

SEQ ID NO: 3127894 - RNA, 19 nt, Human
gcuuccagugaggcucugc

SEQ ID NO: 3127895 - RNA, 21 nt, Human
gcuuccagugaggcucugccc

SEQ ID NO: 3127896 - RNA, 15 nt, Human
gcuuggaggaaggaa

SEQ ID NO: 3127897 - RNA, 14 nt, Human
gcuuggaggaagga

SEQ ID NO: 3127898 - RNA, 13 nt, Human
gcuuggaggaagg

SEQ ID NO: 3127899 - RNA, 22 nt, Human
gcuugaggguugggcugguguc

SEQ ID NO: 3127900 - RNA, 13 nt, Human
ggaaaaauagccu

SEQ ID NO: 3127901 - RNA, 14 nt, Human
ggaaaaacugauuu

SEQ ID NO: 3127902 - RNA, 15 nt, Human
ggaaaaauagccugc

SEQ ID NO: 3127903 - RNA, 14 nt, Human
gcuuuuacuuaaac

SEQ ID NO: 3127904 - RNA, 14 nt, Human
ggaaaauaaauuau

SEQ ID NO: 3127905 - RNA, 15 nt, Human
ggaaaaucagccugc

SEQ ID NO: 3127906 - RNA, 17 nt, Human
ggaacagacuggaagca

SEQ ID NO: 3127907 - RNA, 19 nt, Human
ggaacagacuggaagcaca

SEQ ID NO: 3127908 - RNA, 20 nt, Human
ggaacagacuggaagcacag

SEQ ID NO: 3127909 - RNA, 14 nt, Human
ggaagccagcaggc

SEQ ID NO: 3127910 - RNA, 13 nt, Human
ggaagccagcagg

SEQ ID NO: 3127911 - RNA, 18 nt, Human
ggaagccagcaggcucuc

SEQ ID NO: 3127912 - RNA, 17 nt, Human
ggaagccagcaggcucu

SEQ ID NO: 3127913 - RNA, 16 nt, Human
ggaagccagcaggcuc

SEQ ID NO: 3127914 - RNA, 15 nt, Human
ggaagccagcaggcu

SEQ ID NO: 3127915 - RNA, 23 nt, Human
ggaagcacaugccucucucaggc

SEQ ID NO: 3127916 - RNA, 22 nt, Human
ggaagcacaugccucucucagg

SEQ ID NO: 3127917 - RNA, 21 nt, Human
ggaagcacaugccucucucag

SEQ ID NO: 3127918 - RNA, 17 nt, Human
ggaagcacagcuucauu

SEQ ID NO: 3127919 - RNA, 17 nt, Human
ggaagcacaugccucuc

SEQ ID NO: 3127920 - RNA, 15 nt, Human
ggaagcacaugccuc

SEQ ID NO: 3127921 - RNA, 14 nt, Human
ggaagcacaugccu

SEQ ID NO: 3127922 - RNA, 13 nt, Human
ggaagcacaugcc

SEQ ID NO: 3127923 - RNA, 13 nt, Human
ggaagagccuugc

SEQ ID NO: 3127924 - RNA, 17 nt, Human
gcugucuccauguuuga

SEQ ID NO: 3127925 - RNA, 19 nt, Human
gcugucccuuacgugaguc

SEQ ID NO: 3127926 - RNA, 21 nt, Human
gcugucccuuacgugaguccu

SEQ ID NO: 3127927 - RNA, 23 nt, Human
gcugucaauuacaggaaguacug

SEQ ID NO: 3127928 - RNA, 22 nt, Human
gcugucaauuacaggaaguacu

SEQ ID NO: 3127929 - RNA, 19 nt, Human
gcugucaauuacaggaagu

SEQ ID NO: 3127930 - RNA, 17 nt, Human
gcugucaauuacaggaa

SEQ ID NO: 3127931 - RNA, 16 nt, Human
gcuggugucaccugaa

SEQ ID NO: 3127932 - RNA, 18 nt, Human
gcuggugucaccugaaga

SEQ ID NO: 3127933 - RNA, 20 nt, Human
gcuggucccacucaguccau

SEQ ID NO: 3127934 - RNA, 14 nt, Human
gcuggucccacuca

SEQ ID NO: 3127935 - RNA, 15 nt, Human
gcugguucaggguug

SEQ ID NO: 3127936 - RNA, 21 nt, Human
gcugguuagagguucccuuug

SEQ ID NO: 3127937 - RNA, 16 nt, Human
gcugucaauuacagga

SEQ ID NO: 3127938 - RNA, 22 nt, Human
gcugguucaggguuggccccug

SEQ ID NO: 3127939 - RNA, 22 nt, Human
gcugggagagccuuccaggggu

SEQ ID NO: 3127940 - RNA, 19 nt, Human
gcugggagagccuuccagg

SEQ ID NO: 3127941 - RNA, 18 nt, Human
gcugggagagccuuccag

SEQ ID NO: 3127942 - RNA, 17 nt, Human
gcugggagagccuucca

SEQ ID NO: 3127943 - RNA, 13 nt, Human
gcugggagagccu

SEQ ID NO: 3127944 - RNA, 12 nt, Human
gcugggagagcc

SEQ ID NO: 3127945 - RNA, 17 nt, Human
gcugggcuucaguggca

SEQ ID NO: 3127946 - RNA, 21 nt, Human
gcugggaugauuggagggggg

SEQ ID NO: 3127947 - RNA, 19 nt, Human
gcugggggccucagugcca

SEQ ID NO: 3127948 - RNA, 20 nt, Human
gcugggggccucagugccac

SEQ ID NO: 3127949 - RNA, 15 nt, Human
gcuggucccacucag

SEQ ID NO: 3127950 - RNA, 19 nt, Human
gcuggucccacucagucca

SEQ ID NO: 3127951 - RNA, 12 nt, Human
gcuggggccagu

SEQ ID NO: 3127952 - RNA, 23 nt, Human
gcugggggaagaagcucucuccu

SEQ ID NO: 3127953 - RNA, 18 nt, Human
gcugggcuucaguggcag

SEQ ID NO: 3127954 - RNA, 16 nt, Human
gcuggaccuugaacug

SEQ ID NO: 3127955 - RNA, 18 nt, Human
gcuggaccuugaacuggg

SEQ ID NO: 3127956 - RNA, 17 nt, Human
gcugcuugggcuucauc

SEQ ID NO: 3127957 - RNA, 21 nt, Human
gcuggaccuugaacuggguac

SEQ ID NO: 3127958 - RNA, 19 nt, Human
gcugggacuacagguguga

SEQ ID NO: 3127959 - RNA, 13 nt, Human
gcugggacuacag

SEQ ID NO: 3127960 - RNA, 18 nt, Human
gcugggacuacaggcacc

SEQ ID NO: 3127961 - RNA, 19 nt, Human
gcugggacuacaggcaccc

SEQ ID NO: 3127962 - RNA, 20 nt, Human
gcugggacuacaggcaccca

SEQ ID NO: 3127963 - RNA, 20 nt, Human
gcugggacaugggaaagggg

SEQ ID NO: 3127964 - RNA, 23 nt, Human
gcugcuucaaggauccugagcca

SEQ ID NO: 3127965 - RNA, 22 nt, Human
gcugcuucaaggauccugagcc

SEQ ID NO: 3127966 - RNA, 21 nt, Human
gcugcuucaaggauccugagc

SEQ ID NO: 3127967 - RNA, 16 nt, Human
gcugcuugggcuucau

SEQ ID NO: 3127968 - RNA, 17 nt, Human
gcugcgguccacccagg

SEQ ID NO: 3127969 - RNA, 18 nt, Human
gcugcgguccacccagga

SEQ ID NO: 3127970 - RNA, 13 nt, Human
gcugcuucaagga

SEQ ID NO: 3127971 - RNA, 11 nt, Human
gcugcccugug

SEQ ID NO: 3127972 - RNA, 14 nt, Human
gcugcccugugagu

SEQ ID NO: 3127973 - RNA, 12 nt, Human
gcugcccuguga

SEQ ID NO: 3127974 - RNA, 16 nt, Human
gcugcgguccacccag

SEQ ID NO: 3127975 - RNA, 17 nt, Human
gggaagggggcugggac

SEQ ID NO: 3127976 - RNA, 16 nt, Human
gggaagggggcuggga

SEQ ID NO: 3127977 - RNA, 14 nt, Human
gggaagggggcugg

SEQ ID NO: 3127978 - RNA, 16 nt, Human
gggaaggauacaaaag

SEQ ID NO: 3127979 - RNA, 14 nt, Human
ggcuuuugugcauu

SEQ ID NO: 3127980 - RNA, 21 nt, Human
gggaaggauacaaaagcaugu

SEQ ID NO: 3127981 - RNA, 23 nt, Human
gggaaggauacaaaagcauguga

SEQ ID NO: 3127982 - RNA, 17 nt, Human
gggacuacaggcaccca

SEQ ID NO: 3127983 - RNA, 15 nt, Human
gggaccucaggccug

SEQ ID NO: 3127984 - RNA, 13 nt, Human
gggaccucaggcc

SEQ ID NO: 3127985 - RNA, 12 nt, Human
gggaccucaggc

SEQ ID NO: 3127986 - RNA, 17 nt, Human
ggcugggcucccuuccc

SEQ ID NO: 3127987 - RNA, 12 nt, Human
ggcugggcuuca

SEQ ID NO: 3127988 - RNA, 15 nt, Human
ggcuuaaaacaacac

SEQ ID NO: 3127989 - RNA, 13 nt, Human
ggcugggcuucag

SEQ ID NO: 3127990 - RNA, 17 nt, Human
ggcugggcuucaguggc

SEQ ID NO: 3127991 - RNA, 21 nt, Human
ggcuuagucacugagacagcc

SEQ ID NO: 3127992 - RNA, 15 nt, Human
ggcuuagucacugag

SEQ ID NO: 3127993 - RNA, 10 nt, Human
ggcuuuugug

SEQ ID NO: 3127994 - RNA, 21 nt, Human
ggcuuggggaccagagcugcc

SEQ ID NO: 3127995 - RNA, 19 nt, Human
ggcuuggggaccagagcug

SEQ ID NO: 3127996 - RNA, 22 nt, Human
ggcugcuucaaggauccugagc

SEQ ID NO: 3127997 - RNA, 14 nt, Human
ggcugcuucaagga

SEQ ID NO: 3127998 - RNA, 12 nt, Human
ggcugcuucaag

SEQ ID NO: 3127999 - RNA, 11 nt, Human
ggcugcuucaa

SEQ ID NO: 3128000 - RNA, 12 nt, Human
ggcugcagggag

SEQ ID NO: 3128001 - RNA, 13 nt, Human
ggcugcagggagu

SEQ ID NO: 3128002 - RNA, 14 nt, Human
ggcugcugaaggcu

SEQ ID NO: 3128003 - RNA, 17 nt, Human
ggcugcugaaggcucga

SEQ ID NO: 3128004 - RNA, 15 nt, Human
ggcugcugaaggcuc

SEQ ID NO: 3128005 - RNA, 18 nt, Human
ggcugcugaaggcucgag

SEQ ID NO: 3128006 - RNA, 13 nt, Human
ggcugcugaaggc

SEQ ID NO: 3128007 - RNA, 23 nt, Human
ggcugggagagccuuccaggggu

SEQ ID NO: 3128008 - RNA, 20 nt, Human
ggcugggagagccuuccagg

SEQ ID NO: 3128009 - RNA, 14 nt, Human
ggcugggcagagga

SEQ ID NO: 3128010 - RNA, 13 nt, Human
ggcugggcagagg

SEQ ID NO: 3128011 - RNA, 19 nt, Human
ggcugggcagaggaaagca

SEQ ID NO: 3128012 - RNA, 15 nt, Human
ggcugggcagaggaa

SEQ ID NO: 3128013 - RNA, 18 nt, Human
ggcugggagagccuucca

SEQ ID NO: 3128014 - RNA, 19 nt, Human
ggcugggagagccuuccag

SEQ ID NO: 3128015 - RNA, 21 nt, Human
ggcugcuucaaggauccugag

SEQ ID NO: 3128016 - RNA, 23 nt, Human
ggcugcuucaaggauccugagcc

SEQ ID NO: 3128017 - RNA, 18 nt, Human
ggcugcaaaggguaucag

SEQ ID NO: 3128018 - RNA, 22 nt, Human
ggcugcaaaggguaucaggugc

SEQ ID NO: 3128019 - RNA, 23 nt, Human
ggcugcaaaggguaucaggugcu

SEQ ID NO: 3128020 - RNA, 24 nt, Human
ggcugcaaaggguaucaggugcug

SEQ ID NO: 3128021 - RNA, 17 nt, Human
ggcugcaccggcuggcc

SEQ ID NO: 3128022 - RNA, 19 nt, Human
ggcugcaccggcuggccug

SEQ ID NO: 3128023 - RNA, 18 nt, Human
ggcugcaccggcuggccu

SEQ ID NO: 3128024 - RNA, 15 nt, Human
ggcugaggugggagg

SEQ ID NO: 3128025 - RNA, 13 nt, Human
ggcugagguggga

SEQ ID NO: 3128026 - RNA, 20 nt, Human
ggccccugcccggcugcgga

SEQ ID NO: 3128027 - RNA, 17 nt, Human
ggcucugccucccauca

SEQ ID NO: 3128028 - RNA, 16 nt, Human
ggccccugcccggcug

SEQ ID NO: 3128029 - RNA, 17 nt, Human
ggccccugcccggcugc

SEQ ID NO: 3128030 - RNA, 16 nt, Human
gggcacagggucucua

SEQ ID NO: 3128031 - RNA, 13 nt, Human
gggcacagggucu

SEQ ID NO: 3128032 - RNA, 16 nt, Human
gggcacucagaagaca

SEQ ID NO: 3128033 - RNA, 19 nt, Human
gggcacucagaagacacug

SEQ ID NO: 3128034 - RNA, 21 nt, Human
gggcacagaaaauggaagaca

SEQ ID NO: 3128035 - RNA, 20 nt, Human
gggcacagaaaauggaagac

SEQ ID NO: 3128036 - RNA, 18 nt, Human
gggcacagaaaauggaag

SEQ ID NO: 3128037 - RNA, 23 nt, Human
gggcacaccgggcacucagaaga

SEQ ID NO: 3128038 - RNA, 20 nt, Human
gggcacucagaagacacuga

SEQ ID NO: 3128039 - RNA, 14 nt, Human
gggcagaaggaaga

SEQ ID NO: 3128040 - RNA, 18 nt, Human
gggcagaaggaagacuuc

SEQ ID NO: 3128041 - RNA, 11 nt, Human
gggcagagcag

SEQ ID NO: 3128042 - RNA, 17 nt, Human
gggcagguugguggggg

SEQ ID NO: 3128043 - RNA, 16 nt, Human
gggaggugaccccagg

SEQ ID NO: 3128044 - RNA, 17 nt, Human
gggaggugggauccucc

SEQ ID NO: 3128045 - RNA, 17 nt, Human
gggagugacagaggcag

SEQ ID NO: 3128046 - RNA, 18 nt, Human
gggagugacagaggcagc

SEQ ID NO: 3128047 - RNA, 11 nt, Human
gggagugagcu

SEQ ID NO: 3128048 - RNA, 14 nt, Human
gggagugagcuggu

SEQ ID NO: 3128049 - RNA, 23 nt, Human
gggauccuggaguucugguuccu

SEQ ID NO: 3128050 - RNA, 20 nt, Human
gggcaacccccagccugcua

SEQ ID NO: 3128051 - RNA, 18 nt, Human
gggcaacccuggugacca

SEQ ID NO: 3128052 - RNA, 16 nt, Human
gggauccuccaggugc

SEQ ID NO: 3128053 - RNA, 15 nt, Human
gggauccuccaggug

SEQ ID NO: 3128054 - RNA, 21 nt, Human
gggauaugauuuaaaucagcc

SEQ ID NO: 3128055 - RNA, 13 nt, Human
gggauagagagag

SEQ ID NO: 3128056 - RNA, 13 nt, Human
gggccuggcuccc

SEQ ID NO: 3128057 - RNA, 17 nt, Human
gggccuggcucaggugg

SEQ ID NO: 3128058 - RNA, 18 nt, Human
gggccuggccugagcugg

SEQ ID NO: 3128059 - RNA, 14 nt, Human
gggccuggccugag

SEQ ID NO: 3128060 - RNA, 12 nt, Human
gggccuggccug

SEQ ID NO: 3128061 - RNA, 13 nt, Human
gggccuggccuga

SEQ ID NO: 3128062 - RNA, 13 nt, Human
gggcccugccucc

SEQ ID NO: 3128063 - RNA, 17 nt, Human
gggcccagagagggugg

SEQ ID NO: 3128064 - RNA, 16 nt, Human
gggccacagagaaagu

SEQ ID NO: 3128065 - RNA, 23 nt, Human
gggccacagagaaaguacuucuc

SEQ ID NO: 3128066 - RNA, 12 nt, Human
gggcaugacacg

SEQ ID NO: 3128067 - RNA, 14 nt, Human
gguggugaccucug

SEQ ID NO: 3128068 - RNA, 15 nt, Human
gguggugaccucugc

SEQ ID NO: 3128069 - RNA, 16 nt, Human
gguggugaccucugcc

SEQ ID NO: 3128070 - RNA, 19 nt, Human
ggugucaccugaagacuca

SEQ ID NO: 3128071 - RNA, 19 nt, Human
ggugucaagagggucugag

SEQ ID NO: 3128072 - RNA, 17 nt, Human
ggugucaagagggucug

SEQ ID NO: 3128073 - RNA, 15 nt, Human
ggugguuuucuguuc

SEQ ID NO: 3128074 - RNA, 18 nt, Human
ggugguuuucuguucuuu

SEQ ID NO: 3128075 - RNA, 17 nt, Human
ggugguuucagaaaugu

SEQ ID NO: 3128076 - RNA, 18 nt, Human
ggugguuucagaaaugug

SEQ ID NO: 3128077 - RNA, 21 nt, Human
ggugguuauggagaggguguc

SEQ ID NO: 3128078 - RNA, 13 nt, Human
gguuauggagagg

SEQ ID NO: 3128079 - RNA, 17 nt, Human
gguuaggcauuguggga

SEQ ID NO: 3128080 - RNA, 21 nt, Human
gguuacccaguuagcucucaa

SEQ ID NO: 3128081 - RNA, 13 nt, Human
gguugagguuuca

SEQ ID NO: 3128082 - RNA, 13 nt, Human
gguucaaagauau

SEQ ID NO: 3128083 - RNA, 21 nt, Human
gguucaaagauauuuugcuuu

SEQ ID NO: 3128084 - RNA, 15 nt, Human
ggugcugccauccag

SEQ ID NO: 3128085 - RNA, 19 nt, Human
gguggcagugggagcugcc

SEQ ID NO: 3128086 - RNA, 22 nt, Human
gguggcagugggagcugccugu

SEQ ID NO: 3128087 - RNA, 16 nt, Human
gguggcagugggagcu

SEQ ID NO: 3128088 - RNA, 22 nt, Human
gguggccucccaacucacccca

SEQ ID NO: 3128089 - RNA, 23 nt, Human
gguggccucccaacucaccccag

SEQ ID NO: 3128090 - RNA, 15 nt, Human
ggugagaagcagagg

SEQ ID NO: 3128091 - RNA, 16 nt, Human
ggugagaggggaacag

SEQ ID NO: 3128092 - RNA, 20 nt, Human
ggugcuaucucccccagccc

SEQ ID NO: 3128093 - RNA, 19 nt, Human
ggugcuaucucccccagcc

SEQ ID NO: 3128094 - RNA, 17 nt, Human
ggugcuaucucccccag

SEQ ID NO: 3128095 - RNA, 16 nt, Human
ggugcuaucuccccca

SEQ ID NO: 3128096 - RNA, 16 nt, Human
ggucucacucugucgc

SEQ ID NO: 3128097 - RNA, 22 nt, Human
ggucucacucugucgcccaguc

SEQ ID NO: 3128098 - RNA, 23 nt, Human
ggucucacucugucgcccagucu

SEQ ID NO: 3128099 - RNA, 14 nt, Human
ggucccaccccaca

SEQ ID NO: 3128100 - RNA, 17 nt, Human
ggucccaccccacacac

SEQ ID NO: 3128101 - RNA, 21 nt, Human
ggugacagagugagacucugu

SEQ ID NO: 3128102 - RNA, 14 nt, Human
ggucugacccacug

SEQ ID NO: 3128103 - RNA, 22 nt, Human
ggugaccagcaccaucucuccu

SEQ ID NO: 3128104 - RNA, 21 nt, Human
ggugaccucugccugaaguca

SEQ ID NO: 3128105 - RNA, 17 nt, Human
ggggcugaggugggagg

SEQ ID NO: 3128106 - RNA, 16 nt, Human
ggggcaacccugguga

SEQ ID NO: 3128107 - RNA, 16 nt, Human
ggggaaaaucagccug

SEQ ID NO: 3128108 - RNA, 19 nt, Human
ggggaaaaucagccugcuc

SEQ ID NO: 3128109 - RNA, 17 nt, Human
ggggaaaaucagccugc

SEQ ID NO: 3128110 - RNA, 22 nt, Human
gggcuuggggaccagagcugcc

SEQ ID NO: 3128111 - RNA, 21 nt, Human
ggggaaaaucagccugcucca

SEQ ID NO: 3128112 - RNA, 12 nt, Human
gggucugaggaa

SEQ ID NO: 3128113 - RNA, 21 nt, Human
gggucugaggaauccagaccc

SEQ ID NO: 3128114 - RNA, 12 nt, Human
gggucucacucu

SEQ ID NO: 3128115 - RNA, 14 nt, Human
gggucucacucugu

SEQ ID NO: 3128116 - RNA, 17 nt, Human
ggguaagugagagaggg

SEQ ID NO: 3128117 - RNA, 22 nt, Human
ggggcugcaccggcuggccugg

SEQ ID NO: 3128118 - RNA, 21 nt, Human
ggggcugcaccggcuggccug

SEQ ID NO: 3128119 - RNA, 12 nt, Human
ggggcugcaccg

SEQ ID NO: 3128120 - RNA, 19 nt, Human
ggggcugaggugggaggau

SEQ ID NO: 3128121 - RNA, 22 nt, Human
gggggaggugggauccuccagg

SEQ ID NO: 3128122 - RNA, 17 nt, Human
gggguggggaccucagg

SEQ ID NO: 3128123 - RNA, 12 nt, Human
gggguggccucc

SEQ ID NO: 3128124 - RNA, 22 nt, Human
gguagaagcccuucuaccuucc

SEQ ID NO: 3128125 - RNA, 23 nt, Human
gguagaaauaucugaaaauguau

SEQ ID NO: 3128126 - RNA, 16 nt, Human
gguacuuguggacaca

SEQ ID NO: 3128127 - RNA, 17 nt, Human
gguacuuguggacacag

SEQ ID NO: 3128128 - RNA, 22 nt, Human
gguagaaauaucugaaaaugua

SEQ ID NO: 3128129 - RNA, 11 nt, Human
gguacccacug

SEQ ID NO: 3128130 - RNA, 13 nt, Human
gguacccacugcu

SEQ ID NO: 3128131 - RNA, 16 nt, Human
ggucccaccccacaca

SEQ ID NO: 3128132 - RNA, 15 nt, Human
ggucccaccccacac

SEQ ID NO: 3128133 - RNA, 19 nt, Human
gggugacagagcaagugag

SEQ ID NO: 3128134 - RNA, 17 nt, Human
gggugaagugaagacaa

SEQ ID NO: 3128135 - RNA, 12 nt, Human
ggguucuaccca

SEQ ID NO: 3128136 - RNA, 23 nt, Human
ggguucaagcgauucuucugcuu

SEQ ID NO: 3128137 - RNA, 22 nt, Human
ggguucaagcgauucuucugcu

SEQ ID NO: 3128138 - RNA, 16 nt, Human
acuauuguuagucucu

SEQ ID NO: 3128139 - RNA, 17 nt, Human
acuagggaagauaauau

SEQ ID NO: 3128140 - RNA, 11 nt, Human
accugugucuc

SEQ ID NO: 3128141 - RNA, 15 nt, Human
acuaauagacaauuu

SEQ ID NO: 3128142 - RNA, 15 nt, Human
acgucugacaggcaa

SEQ ID NO: 3128143 - RNA, 23 nt, Human
acgucugacaggcaaugcuggcu

SEQ ID NO: 3128144 - RNA, 16 nt, Human
acggaagagccuugcg

SEQ ID NO: 3128145 - RNA, 15 nt, Human
acggaagagccuugc

SEQ ID NO: 3128146 - RNA, 19 nt, Human
acggacacucaaaagcugg

SEQ ID NO: 3128147 - RNA, 19 nt, Human
acgcuggagugcagugagc

SEQ ID NO: 3128148 - RNA, 18 nt, Human
acgcuggagugcagugag

SEQ ID NO: 3128149 - RNA, 18 nt, Human
accugccagggacagagg

SEQ ID NO: 3128150 - RNA, 16 nt, Human
accugccagggacaga

SEQ ID NO: 3128151 - RNA, 15 nt, Human
accugccagggacag

SEQ ID NO: 3128152 - RNA, 13 nt, Human
accugccagggac

SEQ ID NO: 3128153 - RNA, 12 nt, Human
accugccaggga

SEQ ID NO: 3128154 - RNA, 11 nt, Human
accugccaggg

SEQ ID NO: 3128155 - RNA, 17 nt, Human
accucuugagccuugaa

SEQ ID NO: 3128156 - RNA, 19 nt, Human
accucuugagccuugaacu

SEQ ID NO: 3128157 - RNA, 20 nt, Human
accucuugagccuugaacuu

SEQ ID NO: 3128158 - RNA, 18 nt, Human
accucaggugagaagcag

SEQ ID NO: 3128159 - RNA, 22 nt, Human
accucaggccugggggcugggc

SEQ ID NO: 3128160 - RNA, 14 nt, Human
accucaggccuggg

SEQ ID NO: 3128161 - RNA, 13 nt, Human
accucaggccugg

SEQ ID NO: 3128162 - RNA, 12 nt, Human
accucaggccug

SEQ ID NO: 3128163 - RNA, 17 nt, Human
accgugaggccagagac

SEQ ID NO: 3128164 - RNA, 16 nt, Human
accgugaggccagaga

SEQ ID NO: 3128165 - RNA, 15 nt, Human
acccaugcugcccug

SEQ ID NO: 3128166 - RNA, 14 nt, Human
acccaugcugcccu

SEQ ID NO: 3128167 - RNA, 16 nt, Human
accccacacacgccag

SEQ ID NO: 3128168 - RNA, 22 nt, Human
acccugugauggggcccugccu

SEQ ID NO: 3128169 - RNA, 17 nt, Human
acccuguuaccauuuug

SEQ ID NO: 3128170 - RNA, 20 nt, Human
accgggcacucagaagacac

SEQ ID NO: 3128171 - RNA, 18 nt, Human
accggcuggccuggcccc

SEQ ID NO: 3128172 - RNA, 17 nt, Human
accggcuggccuggccc

SEQ ID NO: 3128173 - RNA, 15 nt, Human
accggcuggccuggc

SEQ ID NO: 3128174 - RNA, 14 nt, Human
accggcuggccugg

SEQ ID NO: 3128175 - RNA, 14 nt, Human
accgugaggccaga

SEQ ID NO: 3128176 - RNA, 15 nt, Human
accgggccacagaga

SEQ ID NO: 3128177 - RNA, 19 nt, Human
accgggccacagagaaagu

SEQ ID NO: 3128178 - RNA, 22 nt, Human
acugcccggcaggguccuagaa

SEQ ID NO: 3128179 - RNA, 14 nt, Human
acugcuuuuggucu

SEQ ID NO: 3128180 - RNA, 15 nt, Human
acugcuuuuggucug

SEQ ID NO: 3128181 - RNA, 16 nt, Human
acugcuuuuggucugu

SEQ ID NO: 3128182 - RNA, 20 nt, Human
acugcuuuuggucuguguga

SEQ ID NO: 3128183 - RNA, 15 nt, Human
acugcccggcagggu

SEQ ID NO: 3128184 - RNA, 19 nt, Human
acucugucucaaaaaaaca

SEQ ID NO: 3128185 - RNA, 21 nt, Human
acucugugucagguggggcag

SEQ ID NO: 3128186 - RNA, 19 nt, Human
acucugugucagguggggc

SEQ ID NO: 3128187 - RNA, 22 nt, Human
acugauuuuuuuuuccuucagu

SEQ ID NO: 3128188 - RNA, 21 nt, Human
acugauuuuuuuuuccuucag

SEQ ID NO: 3128189 - RNA, 23 nt, Human
acugauuuuuuuuuccuucagug

SEQ ID NO: 3128190 - RNA, 12 nt, Human
acugaugggcaa

SEQ ID NO: 3128191 - RNA, 22 nt, Human
acugaugggcaacccccagccu

SEQ ID NO: 3128192 - RNA, 22 nt, Human
acugauggcuaauguacugcau

SEQ ID NO: 3128193 - RNA, 13 nt, Human
acugaucucucgu

SEQ ID NO: 3128194 - RNA, 22 nt, Human
acugacauuguuggccaaagcc

SEQ ID NO: 3128195 - RNA, 23 nt, Human
acugacauuguuggccaaagcca

SEQ ID NO: 3128196 - RNA, 17 nt, Human
acuucuuauacauuuga

SEQ ID NO: 3128197 - RNA, 19 nt, Human
acuucugccauauucuguu

SEQ ID NO: 3128198 - RNA, 20 nt, Human
acuucugccauauucuguug

SEQ ID NO: 3128199 - RNA, 14 nt, Human
acuuaaauaaugug

SEQ ID NO: 3128200 - RNA, 23 nt, Human
acagugagucgaggacagggagg

SEQ ID NO: 3128201 - RNA, 22 nt, Human
acagugagucgaggacagggag

SEQ ID NO: 3128202 - RNA, 19 nt, Human
acaggugugaaccaccaca

SEQ ID NO: 3128203 - RNA, 22 nt, Human
acaggugugagucaccaagccc

SEQ ID NO: 3128204 - RNA, 23 nt, Human
acaggugugagucaccaagccca

SEQ ID NO: 3128205 - RNA, 19 nt, Human
acaggcaagcaccuccugc

SEQ ID NO: 3128206 - RNA, 15 nt, Human
acagcuccuucuguc

SEQ ID NO: 3128207 - RNA, 19 nt, Human
acagaggggguggccuccc

SEQ ID NO: 3128208 - RNA, 18 nt, Human
acagaggggguggccucc

SEQ ID NO: 3128209 - RNA, 17 nt, Human
acagaggggguggccuc

SEQ ID NO: 3128210 - RNA, 16 nt, Human
acagcuccuucugucc

SEQ ID NO: 3128211 - RNA, 18 nt, Human
acagcuccuucuguccua

SEQ ID NO: 3128212 - RNA, 14 nt, Human
acagcucuguccug

SEQ ID NO: 3128213 - RNA, 20 nt, Human
acaggcaagcaccuccugcc

SEQ ID NO: 3128214 - RNA, 23 nt, Human
acaggcaagcaccuccugccucg

SEQ ID NO: 3128215 - RNA, 16 nt, Human
acagcucuguccuggg

SEQ ID NO: 3128216 - RNA, 13 nt, Human
acagcucuguccu

SEQ ID NO: 3128217 - RNA, 17 nt, Human
acaugcaaggucauuuu

SEQ ID NO: 3128218 - RNA, 18 nt, Human
acaugccucucucaggcc

SEQ ID NO: 3128219 - RNA, 17 nt, Human
acaugccucucucaggc

SEQ ID NO: 3128220 - RNA, 16 nt, Human
acaugccucucucagg

SEQ ID NO: 3128221 - RNA, 15 nt, Human
acaugccucucucag

SEQ ID NO: 3128222 - RNA, 16 nt, Human
acaugcaaggucauuu

SEQ ID NO: 3128223 - RNA, 16 nt, Human
acauaagauaaaugug

SEQ ID NO: 3128224 - RNA, 15 nt, Human
acauaagauaaaugu

SEQ ID NO: 3128225 - RNA, 13 nt, Human
acccaugcugccc

SEQ ID NO: 3128226 - RNA, 15 nt, Human
acccacccuccuuuc

SEQ ID NO: 3128227 - RNA, 17 nt, Human
acccacccccacccaag

SEQ ID NO: 3128228 - RNA, 15 nt, Human
acccacccccaccca

SEQ ID NO: 3128229 - RNA, 14 nt, Human
accaucaagccacc

SEQ ID NO: 3128230 - RNA, 15 nt, Human
accaucaagccacca

SEQ ID NO: 3128231 - RNA, 12 nt, Human
accaucauugaa

SEQ ID NO: 3128232 - RNA, 15 nt, Human
accaucauugaaauc

SEQ ID NO: 3128233 - RNA, 23 nt, Human
accaucauugaaaucuuuuugcu

SEQ ID NO: 3128234 - RNA, 20 nt, Human
accagccccagugcccacag

SEQ ID NO: 3128235 - RNA, 18 nt, Human
accagccccagugcccac

SEQ ID NO: 3128236 - RNA, 19 nt, Human
accagccccagugcccaca

SEQ ID NO: 3128237 - RNA, 16 nt, Human
accagccccagugccc

SEQ ID NO: 3128238 - RNA, 17 nt, Human
accagccccagugccca

SEQ ID NO: 3128239 - RNA, 14 nt, Human
accagcagaaaugc

SEQ ID NO: 3128240 - RNA, 13 nt, Human
accagcagagcac

SEQ ID NO: 3128241 - RNA, 12 nt, Human
accagcagagca

SEQ ID NO: 3128242 - RNA, 19 nt, Human
acaugccucucucaggcca

SEQ ID NO: 3128243 - RNA, 23 nt, Human
acaugucuuuucuugcaugaggc

SEQ ID NO: 3128244 - RNA, 12 nt, Human
aauuguaaggaa

SEQ ID NO: 3128245 - RNA, 16 nt, Human
aaugucacaggcaggu

SEQ ID NO: 3128246 - RNA, 19 nt, Human
aaugucacaggcaggucca

SEQ ID NO: 3128247 - RNA, 20 nt, Human
aauuuauuuaugggauccug

SEQ ID NO: 3128248 - RNA, 17 nt, Human
aauuuauuauggcacau

SEQ ID NO: 3128249 - RNA, 14 nt, Human
aauuuugauguuuu

SEQ ID NO: 3128250 - RNA, 22 nt, Human
acaaaaugaaacgcaaccacca

SEQ ID NO: 3128251 - RNA, 13 nt, Human
acaaaaugaaacg

SEQ ID NO: 3128252 - RNA, 13 nt, Human
acagacaaagcgu

SEQ ID NO: 3128253 - RNA, 14 nt, Human
acagacaaagcgug

SEQ ID NO: 3128254 - RNA, 23 nt, Human
acagaggcagccccauucugccu

SEQ ID NO: 3128255 - RNA, 17 nt, Human
acagaggccaugggccu

SEQ ID NO: 3128256 - RNA, 14 nt, Human
acagaggggguggc

SEQ ID NO: 3128257 - RNA, 21 nt, Human
acagaggccaugggccuccug

SEQ ID NO: 3128258 - RNA, 13 nt, Human
acagaggcagccc

SEQ ID NO: 3128259 - RNA, 22 nt, Human
acacugugcugagucugaaggc

SEQ ID NO: 3128260 - RNA, 17 nt, Human
acacugugcugagucug

SEQ ID NO: 3128261 - RNA, 13 nt, Human
acaauuuauuaug

SEQ ID NO: 3128262 - RNA, 16 nt, Human
acaaggauugcuacug

SEQ ID NO: 3128263 - RNA, 20 nt, Human
acaaggaugaucuaggaaga

SEQ ID NO: 3128264 - RNA, 19 nt, Human
acacagcucuucuccaggc

SEQ ID NO: 3128265 - RNA, 19 nt, Human
acacaaaaguuucucuuuu

SEQ ID NO: 3128266 - RNA, 20 nt, Human
acacagcucuucuccaggcu

SEQ ID NO: 3128267 - RNA, 21 nt, Human
acacagcucuucuccaggcug

SEQ ID NO: 3128268 - RNA, 14 nt, Human
acacauuuuuuaaa

SEQ ID NO: 3128269 - RNA, 12 nt, Human
acacauuuuucu

SEQ ID NO: 3128270 - RNA, 16 nt, Human
acacauuuuuuaaaug

SEQ ID NO: 3128271 - RNA, 18 nt, Human
acacauuuuuuaaaugca

SEQ ID NO: 3128272 - RNA, 14 nt, Human
acaccacuacauuc

SEQ ID NO: 3128273 - RNA, 15 nt, Human
acaccacuacauucu

SEQ ID NO: 3128274 - RNA, 14 nt, Human
acacgaauauugcu

SEQ ID NO: 3128275 - RNA, 12 nt, Human
acacgaauauug

SEQ ID NO: 3128276 - RNA, 17 nt, Human
acaccacuacauucugu

SEQ ID NO: 3128277 - RNA, 20 nt, Human
acaccacuacauucuguuaa

SEQ ID NO: 3128278 - RNA, 21 nt, Human
acacgaauauugcugauggug

SEQ ID NO: 3128279 - RNA, 15 nt, Human
acacgaauauugcug

SEQ ID NO: 3128280 - RNA, 21 nt, Human
aauaccugucccccugacaac

SEQ ID NO: 3128281 - RNA, 19 nt, Human
aauaauguuaacauggaca

SEQ ID NO: 3128282 - RNA, 13 nt, Human
aagugcugcauuu

SEQ ID NO: 3128283 - RNA, 21 nt, Human
aaugcgugcauaccacuuuug

SEQ ID NO: 3128284 - RNA, 23 nt, Human
aaugcgugcauaccacuuuuguu

SEQ ID NO: 3128285 - RNA, 13 nt, Human
aaugggacacuaa

SEQ ID NO: 3128286 - RNA, 14 nt, Human
aaugggagcucaug

SEQ ID NO: 3128287 - RNA, 23 nt, Human
aaugcucuuuacuucauggacuu

SEQ ID NO: 3128288 - RNA, 15 nt, Human
aaugucacaggcagg

SEQ ID NO: 3128289 - RNA, 15 nt, Human
aaugggggugcauuu

SEQ ID NO: 3128290 - RNA, 17 nt, Human
aaugggggugcauuuga

SEQ ID NO: 3128291 - RNA, 15 nt, Human
aaugauagcuacugu

SEQ ID NO: 3128292 - RNA, 13 nt, Human
aaugauuaauuaa

SEQ ID NO: 3128293 - RNA, 12 nt, Human
aaugauuaauua

SEQ ID NO: 3128294 - RNA, 18 nt, Human
aaucuccaaaauaaaacu

SEQ ID NO: 3128295 - RNA, 20 nt, Human
aagggacuuggaagcuccgc

SEQ ID NO: 3128296 - RNA, 18 nt, Human
aagggacgcuacccggga

SEQ ID NO: 3128297 - RNA, 15 nt, Human
aagcgauucuucugc

SEQ ID NO: 3128298 - RNA, 14 nt, Human
aagcgauucuucug

SEQ ID NO: 3128299 - RNA, 16 nt, Human
aagcgugagccacugc

SEQ ID NO: 3128300 - RNA, 16 nt, Human
aagcgauucuucugcu

SEQ ID NO: 3128301 - RNA, 15 nt, Human
aagccagcaggcucu

SEQ ID NO: 3128302 - RNA, 18 nt, Human
aagccagcaggcucucag

SEQ ID NO: 3128303 - RNA, 21 nt, Human
aagccaccaacauacucccau

SEQ ID NO: 3128304 - RNA, 23 nt, Human
aaggaaugauuaauuaaaacaca

SEQ ID NO: 3128305 - RNA, 16 nt, Human
aagcugcugacagugu

SEQ ID NO: 3128306 - RNA, 17 nt, Human
aagcgugagccacugca

SEQ ID NO: 3128307 - RNA, 20 nt, Human
aagcgugagccacugcaccg

SEQ ID NO: 3128308 - RNA, 14 nt, Human
aagcugcugacagu

SEQ ID NO: 3128309 - RNA, 22 nt, Human
aagcugccagccgagauagcca

SEQ ID NO: 3128310 - RNA, 12 nt, Human
aagcugccagcc

SEQ ID NO: 3128311 - RNA, 11 nt, Human
aagcugccagc

SEQ ID NO: 3128312 - RNA, 16 nt, Human
aagacuuuggaaagac

SEQ ID NO: 3128313 - RNA, 16 nt, Human
aagacuuuggaaagag

SEQ ID NO: 3128314 - RNA, 20 nt, Human
aagauucauauuuacuucuu

SEQ ID NO: 3128315 - RNA, 21 nt, Human
aagcagaggaaggagaggaga

SEQ ID NO: 3128316 - RNA, 19 nt, Human
aagccaccaacauacuccc

SEQ ID NO: 3128317 - RNA, 19 nt, Human
aagauuuugaaauuuuuau

SEQ ID NO: 3128318 - RNA, 19 nt, Human
aaacugauuuuuuuuuccu

SEQ ID NO: 3128319 - RNA, 13 nt, Human
aaacugauuuuuu

SEQ ID NO: 3128320 - RNA, 20 nt, Human
aaacugauuuuuuuuuccuu

SEQ ID NO: 3128321 - RNA, 18 nt, Human
aaacccagcucuggucca

SEQ ID NO: 3128322 - RNA, 17 nt, Human
aaaccccaucucuacaa

SEQ ID NO: 3128323 - RNA, 14 nt, Human
aaacccuucagugc

SEQ ID NO: 3128324 - RNA, 17 nt, Human
aaacucuugaccucagg

SEQ ID NO: 3128325 - RNA, 15 nt, Human
aaagauacaguuacu

SEQ ID NO: 3128326 - RNA, 15 nt, Human
aaagccaaagcuagg

SEQ ID NO: 3128327 - RNA, 14 nt, Human
aaaggcuccaggag

SEQ ID NO: 3128328 - RNA, 17 nt, Human
aaaggcuaccuuuguau

SEQ ID NO: 3128329 - RNA, 14 nt, Human
aaaggcuaccuuug

SEQ ID NO: 3128330 - RNA, 21 nt, Human
aaaggcuccaggagcagccac

SEQ ID NO: 3128331 - RNA, 22 nt, Human
aaaggcuccaggagcagccaca

SEQ ID NO: 3128332 - RNA, 11 nt, Human
aaauaaauuau

SEQ ID NO: 3128333 - RNA, 15 nt, Human
aaaauuagccaagug

SEQ ID NO: 3128334 - RNA, 17 nt, Human
aaacagcuaaugggaca

SEQ ID NO: 3128335 - RNA, 22 nt, Human
aacaugcuacacacugcauguu

SEQ ID NO: 3128336 - RNA, 15 nt, Human
aacauggaaguacua

SEQ ID NO: 3128337 - RNA, 13 nt, Human
aacccuucagugc

SEQ ID NO: 3128338 - RNA, 19 nt, Human
aaccaguguuguggauuua

SEQ ID NO: 3128339 - RNA, 17 nt, Human
aaccaguguuguggauu

SEQ ID NO: 3128340 - RNA, 16 nt, Human
aacagcuaaugggaca

SEQ ID NO: 3128341 - RNA, 17 nt, Human
aacucaaacucuuaaaa

SEQ ID NO: 3128342 - RNA, 17 nt, Human
aacucaccccagcccca

SEQ ID NO: 3128343 - RNA, 16 nt, Human
aacucaccccagcccc

SEQ ID NO: 3128344 - RNA, 18 nt, Human
aacucaccccagccccaa

SEQ ID NO: 3128345 - RNA, 15 nt, Human
aacucaccccagccc

SEQ ID NO: 3128346 - RNA, 14 nt, Human
aaauggacguguua

SEQ ID NO: 3128347 - RNA, 17 nt, Human
aaauggacguguuauga

SEQ ID NO: 3128348 - RNA, 15 nt, Human
aaauggacguguuau

SEQ ID NO: 3128349 - RNA, 22 nt, Human
aaaucuccaaaauaaaacuuuu

SEQ ID NO: 3128350 - RNA, 19 nt, Human
aaaucuccaaaauaaaacu

SEQ ID NO: 3128351 - RNA, 22 nt, Human
aacaaaccuguuucugcagcca

SEQ ID NO: 3128352 - RNA, 21 nt, Human
aacacauacaggaagguagaa

SEQ ID NO: 3128353 - RNA, 13 nt, Human
aaauuaacuuuua

SEQ ID NO: 3128354 - RNA, 14 nt, Human
aaauuaacuuuuau

SEQ ID NO: 3128355 - RNA, 12 nt, Human
aaauuaacuuuu

SEQ ID NO: 3128356 - RNA, 18 nt, Human
agcaaaagaugcuucuca

SEQ ID NO: 3128357 - RNA, 18 nt, Human
agauucuuuccugaggcu

SEQ ID NO: 3128358 - RNA, 21 nt, Human
agauucuuuccugaggcuggg

SEQ ID NO: 3128359 - RNA, 19 nt, Human
agauucuuuccugaggcug

SEQ ID NO: 3128360 - RNA, 19 nt, Human
agauugcaacaggcugggc

SEQ ID NO: 3128361 - RNA, 23 nt, Human
agauugcaacaggcugggcuuca

SEQ ID NO: 3128362 - RNA, 20 nt, Human
agauugcaacaggcugggcu

SEQ ID NO: 3128363 - RNA, 21 nt, Human
agauugcaacaggcugggcuu

SEQ ID NO: 3128364 - RNA, 20 nt, Human
agcaaaggagauuggaagga

SEQ ID NO: 3128365 - RNA, 14 nt, Human
agaugagugagcau

SEQ ID NO: 3128366 - RNA, 12 nt, Human
agcacagacccu

SEQ ID NO: 3128367 - RNA, 15 nt, Human
agcacagacccugcc

SEQ ID NO: 3128368 - RNA, 14 nt, Human
agcacagacccugc

SEQ ID NO: 3128369 - RNA, 16 nt, Human
agcacagacccugccc

SEQ ID NO: 3128370 - RNA, 17 nt, Human
agcacgauuucuguuua

SEQ ID NO: 3128371 - RNA, 19 nt, Human
agcacgauuucuguuuaga

SEQ ID NO: 3128372 - RNA, 21 nt, Human
agcacgauuucuguuuagaua

SEQ ID NO: 3128373 - RNA, 24 nt, Human
agccccaaaacucuccucugcugc

SEQ ID NO: 3128374 - RNA, 20 nt, Human
agcccgggcucugccuccca

SEQ ID NO: 3128375 - RNA, 18 nt, Human
agcccgggcucugccucc

SEQ ID NO: 3128376 - RNA, 17 nt, Human
agcccgggcucugccuc

SEQ ID NO: 3128377 - RNA, 15 nt, Human
agccccauccucugu

SEQ ID NO: 3128378 - RNA, 23 nt, Human
agccccauccucuguacagagcc

SEQ ID NO: 3128379 - RNA, 17 nt, Human
agccccauccucuguac

SEQ ID NO: 3128380 - RNA, 17 nt, Human
agccccauucugccugc

SEQ ID NO: 3128381 - RNA, 18 nt, Human
agccccauucugccugcc

SEQ ID NO: 3128382 - RNA, 19 nt, Human
agccccauucugccugccc

SEQ ID NO: 3128383 - RNA, 13 nt, Human
agcauccuggcac

SEQ ID NO: 3128384 - RNA, 23 nt, Human
agcccacgcccccacuggugaca

SEQ ID NO: 3128385 - RNA, 20 nt, Human
agcccacgcccccacuggug

SEQ ID NO: 3128386 - RNA, 14 nt, Human
agcccacgccccca

SEQ ID NO: 3128387 - RNA, 16 nt, Human
agcccaccuuggcuca

SEQ ID NO: 3128388 - RNA, 14 nt, Human
agcccaccuuggcu

SEQ ID NO: 3128389 - RNA, 15 nt, Human
agcccaccccucaac

SEQ ID NO: 3128390 - RNA, 16 nt, Human
agccagcaggcucuca

SEQ ID NO: 3128391 - RNA, 15 nt, Human
agccagaggagagag

SEQ ID NO: 3128392 - RNA, 13 nt, Human
agccagaggagag

SEQ ID NO: 3128393 - RNA, 14 nt, Human
agccagcaggcucu

SEQ ID NO: 3128394 - RNA, 17 nt, Human
agccagaggagagagga

SEQ ID NO: 3128395 - RNA, 14 nt, Human
agcauccuggcacc

SEQ ID NO: 3128396 - RNA, 17 nt, Human
agcauccuggcacccgg

SEQ ID NO: 3128397 - RNA, 16 nt, Human
agccaaagcuaggccu

SEQ ID NO: 3128398 - RNA, 14 nt, Human
agaggacuuuucuu

SEQ ID NO: 3128399 - RNA, 21 nt, Human
agaggacuuuucuuuguggcu

SEQ ID NO: 3128400 - RNA, 22 nt, Human
agaggacuuuucuuuguggcuu

SEQ ID NO: 3128401 - RNA, 19 nt, Human
agaggggguggccucccaa

SEQ ID NO: 3128402 - RNA, 17 nt, Human
agaggggguggccuccc

SEQ ID NO: 3128403 - RNA, 16 nt, Human
agagggccugcaaggg

SEQ ID NO: 3128404 - RNA, 13 nt, Human
agagggccugcaa

SEQ ID NO: 3128405 - RNA, 18 nt, Human
agacucugucucaaaaaa

SEQ ID NO: 3128406 - RNA, 13 nt, Human
agacucugucuca

SEQ ID NO: 3128407 - RNA, 22 nt, Human
agacugaguacguugugcauuu

SEQ ID NO: 3128408 - RNA, 20 nt, Human
agacugaguacguugugcau

SEQ ID NO: 3128409 - RNA, 16 nt, Human
agacgcugugcugccc

SEQ ID NO: 3128410 - RNA, 16 nt, Human
agagagaccacuuuuc

SEQ ID NO: 3128411 - RNA, 13 nt, Human
agagccagggucu

SEQ ID NO: 3128412 - RNA, 16 nt, Human
agaaugaaagggccca

SEQ ID NO: 3128413 - RNA, 18 nt, Human
agaaugaaagggcccaga

SEQ ID NO: 3128414 - RNA, 19 nt, Human
agaaugcacaaacagaggc

SEQ ID NO: 3128415 - RNA, 23 nt, Human
agaagagaaugcacaaacagagg

SEQ ID NO: 3128416 - RNA, 21 nt, Human
agaagagauugugguuucauu

SEQ ID NO: 3128417 - RNA, 21 nt, Human
acuuuccucuuuggucuacac

SEQ ID NO: 3128418 - RNA, 13 nt, Human
agaagacacugau

SEQ ID NO: 3128419 - RNA, 21 nt, Human
agaagacacugaugggcaacc

SEQ ID NO: 3128420 - RNA, 14 nt, Human
agaaguaacuuacu

SEQ ID NO: 3128421 - RNA, 20 nt, Human
agacaaugacuuacuguaca

SEQ ID NO: 3128422 - RNA, 11 nt, Human
agacagagucu

SEQ ID NO: 3128423 - RNA, 13 nt, Human
agacagagcuaca

SEQ ID NO: 3128424 - RNA, 19 nt, Human
agacagagucucacuguug

SEQ ID NO: 3128425 - RNA, 20 nt, Human
agacagagucucacuguugc

SEQ ID NO: 3128426 - RNA, 15 nt, Human
agacagagcuacaca

SEQ ID NO: 3128427 - RNA, 19 nt, Human
agacaaugacuuacuguac

SEQ ID NO: 3128428 - RNA, 21 nt, Human
agacaaugacuuacuguacau

SEQ ID NO: 3128429 - RNA, 22 nt, Human
agacaaugacuuacuguacaug

SEQ ID NO: 3128430 - RNA, 21 nt, Human
agacagagucucacuguugcc

SEQ ID NO: 3128431 - RNA, 15 nt, Human
agaccacguuucuaa

SEQ ID NO: 3128432 - RNA, 15 nt, Human
aggagaggagagggg

SEQ ID NO: 3128433 - RNA, 18 nt, Human
agcuucauuuccuguguc

SEQ ID NO: 3128434 - RNA, 23 nt, Human
agcuuuguuuguugucagcugaa

SEQ ID NO: 3128435 - RNA, 22 nt, Human
agcuuuguuuguugucagcuga

SEQ ID NO: 3128436 - RNA, 19 nt, Human
agcuucauuuccugugucu

SEQ ID NO: 3128437 - RNA, 22 nt, Human
aggaauaccugucccccugaca

SEQ ID NO: 3128438 - RNA, 18 nt, Human
aggaauaccugucccccu

SEQ ID NO: 3128439 - RNA, 15 nt, Human
aggaauaccuguccc

SEQ ID NO: 3128440 - RNA, 21 nt, Human
aggaacuuaaauaaugugaaa

SEQ ID NO: 3128441 - RNA, 20 nt, Human
aggaacaaggcaaggcuguc

SEQ ID NO: 3128442 - RNA, 19 nt, Human
aggaacaaggcaaggcugu

SEQ ID NO: 3128443 - RNA, 17 nt, Human
aggaacaaggcaaggcu

SEQ ID NO: 3128444 - RNA, 16 nt, Human
aggaacaaggcaaggc

SEQ ID NO: 3128445 - RNA, 13 nt, Human
aggaacaaggcaa

SEQ ID NO: 3128446 - RNA, 12 nt, Human
aggaacaaggca

SEQ ID NO: 3128447 - RNA, 15 nt, Human
agcugaaccugggua

SEQ ID NO: 3128448 - RNA, 22 nt, Human
agcugguuuuuagcggagacgg

SEQ ID NO: 3128449 - RNA, 16 nt, Human
agcugguugagguuuc

SEQ ID NO: 3128450 - RNA, 18 nt, Human
agcuggucccacucaguc

SEQ ID NO: 3128451 - RNA, 13 nt, Human
agcugcugacagu

SEQ ID NO: 3128452 - RNA, 14 nt, Human
agcugcugacagug

SEQ ID NO: 3128453 - RNA, 16 nt, Human
agcuggucccacucag

SEQ ID NO: 3128454 - RNA, 17 nt, Human
agcuggucccacucagu

SEQ ID NO: 3128455 - RNA, 13 nt, Human
agcugcgguccac

SEQ ID NO: 3128456 - RNA, 16 nt, Human
agcugcgguccaccca

SEQ ID NO: 3128457 - RNA, 17 nt, Human
agcugcgguccacccag

SEQ ID NO: 3128458 - RNA, 18 nt, Human
agcugcgguccacccagg

SEQ ID NO: 3128459 - RNA, 19 nt, Human
agcugcgguccacccagga

SEQ ID NO: 3128460 - RNA, 20 nt, Human
agcugcgguccacccaggag

SEQ ID NO: 3128461 - RNA, 12 nt, Human
agcugcugacag

SEQ ID NO: 3128462 - RNA, 19 nt, Human
agcgagcccugguggcagu

SEQ ID NO: 3128463 - RNA, 13 nt, Human
agcgagcccuggu

SEQ ID NO: 3128464 - RNA, 12 nt, Human
agccugggaggu

SEQ ID NO: 3128465 - RNA, 12 nt, Human
agcucagagagg

SEQ ID NO: 3128466 - RNA, 14 nt, Human
agcucagagagggu

SEQ ID NO: 3128467 - RNA, 18 nt, Human
agcucagagaggguggga

SEQ ID NO: 3128468 - RNA, 19 nt, Human
agcucaccagccccagugc

SEQ ID NO: 3128469 - RNA, 20 nt, Human
agcucaccagccccagugcc

SEQ ID NO: 3128470 - RNA, 15 nt, Human
agcucaccagcccca

SEQ ID NO: 3128471 - RNA, 12 nt, Human
agcucaccucuc

SEQ ID NO: 3128472 - RNA, 19 nt, Human
agcucaccucucccuugga

SEQ ID NO: 3128473 - RNA, 18 nt, Human
agcucaccucucccuugg

SEQ ID NO: 3128474 - RNA, 15 nt, Human
agcucaccucucccu

SEQ ID NO: 3128475 - RNA, 16 nt, Human
agcucaccagccccag

SEQ ID NO: 3128476 - RNA, 22 nt, Human
aggguuuugccauguuggccag

SEQ ID NO: 3128477 - RNA, 22 nt, Human
agguacgaaaagaggggaagag

SEQ ID NO: 3128478 - RNA, 16 nt, Human
agguaacaggcagaua

SEQ ID NO: 3128479 - RNA, 13 nt, Human
agguaacaggcag

SEQ ID NO: 3128480 - RNA, 14 nt, Human
agguaacaggcaga

SEQ ID NO: 3128481 - RNA, 13 nt, Human
agguacucuccug

SEQ ID NO: 3128482 - RNA, 14 nt, Human
agguacucuccugg

SEQ ID NO: 3128483 - RNA, 15 nt, Human
aggguaucuggugac

SEQ ID NO: 3128484 - RNA, 21 nt, Human
aggguaucuggugacuuuccu

SEQ ID NO: 3128485 - RNA, 13 nt, Human
aggguauuccaga

SEQ ID NO: 3128486 - RNA, 14 nt, Human
agggucccuggugg

SEQ ID NO: 3128487 - RNA, 12 nt, Human
agggucccuggu

SEQ ID NO: 3128488 - RNA, 22 nt, Human
agggucccugguggcagcucac

SEQ ID NO: 3128489 - RNA, 20 nt, Human
agggucccugguggcagcuc

SEQ ID NO: 3128490 - RNA, 17 nt, Human
agggucccugguggcag

SEQ ID NO: 3128491 - RNA, 16 nt, Human
agggucccugguggca

SEQ ID NO: 3128492 - RNA, 22 nt, Human
aggggcccaaauucuuucagug

SEQ ID NO: 3128493 - RNA, 16 nt, Human
agggauacccauccca

SEQ ID NO: 3128494 - RNA, 14 nt, Human
agggccugcaaggg

SEQ ID NO: 3128495 - RNA, 15 nt, Human
agggccugcaaggga

SEQ ID NO: 3128496 - RNA, 13 nt, Human
agggccuggccug

SEQ ID NO: 3128497 - RNA, 12 nt, Human
agggccuggccu

SEQ ID NO: 3128498 - RNA, 15 nt, Human
aggcaugguggccca

SEQ ID NO: 3128499 - RNA, 17 nt, Human
aggcaugugaugagagg

SEQ ID NO: 3128500 - RNA, 17 nt, Human
aggcauguucucugagg

SEQ ID NO: 3128501 - RNA, 21 nt, Human
aggcaugugaugagaggaaau

SEQ ID NO: 3128502 - RNA, 20 nt, Human
aggcaugugaugagaggaaa

SEQ ID NO: 3128503 - RNA, 19 nt, Human
aggcaugugaugagaggaa

SEQ ID NO: 3128504 - RNA, 18 nt, Human
aggcauguucucugagga

SEQ ID NO: 3128505 - RNA, 19 nt, Human
aggcauguucucugaggac

SEQ ID NO: 3128506 - RNA, 12 nt, Human
aggcauguucuc

SEQ ID NO: 3128507 - RNA, 17 nt, Human
aggcauuccccaggagg

SEQ ID NO: 3128508 - RNA, 18 nt, Human
aggcauuccccaggaggc

SEQ ID NO: 3128509 - RNA, 15 nt, Human
aggccaggcccucug

SEQ ID NO: 3128510 - RNA, 14 nt, Human
aggccaggcccucu

SEQ ID NO: 3128511 - RNA, 13 nt, Human
aggccaggcccuc

SEQ ID NO: 3128512 - RNA, 23 nt, Human
aggccagcugcuugggcuucauc

SEQ ID NO: 3128513 - RNA, 20 nt, Human
aggcauuccccaggaggcca

SEQ ID NO: 3128514 - RNA, 19 nt, Human
aggcauuccccaggaggcc

SEQ ID NO: 3128515 - RNA, 12 nt, Human
aggcccuucucu

SEQ ID NO: 3128516 - RNA, 19 nt, Human
aggcccuucucuccagccc

SEQ ID NO: 3128517 - RNA, 15 nt, Human
aggcccuucucucca

SEQ ID NO: 3128518 - RNA, 21 nt, Human
aggcccucugcccacucccug

SEQ ID NO: 3128519 - RNA, 23 nt, Human
aggcccucugcccacucccugca

SEQ ID NO: 3128520 - RNA, 22 nt, Human
aggcccucugcccacucccugc

SEQ ID NO: 3128521 - RNA, 18 nt, Human
aggcuggguucugauccu

SEQ ID NO: 3128522 - RNA, 13 nt, Human
aggcuaccuuugu

SEQ ID NO: 3128523 - RNA, 14 nt, Human
aggcuaccuuugua

SEQ ID NO: 3128524 - RNA, 15 nt, Human
aggcuaccuuuguau

SEQ ID NO: 3128525 - RNA, 17 nt, Human
aggcuuagucacugaga

SEQ ID NO: 3128526 - RNA, 22 nt, Human
aggcuguaucccaugagccuca

SEQ ID NO: 3128527 - RNA, 20 nt, Human
aggcuguaucccaugagccu

SEQ ID NO: 3128528 - RNA, 21 nt, Human
aggcuguaucccaugagccuc

SEQ ID NO: 3128529 - RNA, 18 nt, Human
aggcuuagucacugagac

SEQ ID NO: 3128530 - RNA, 15 nt, Human
agggacccuccacca

SEQ ID NO: 3128531 - RNA, 22 nt, Human
aguccucuuuucugagaggacu

SEQ ID NO: 3128532 - RNA, 20 nt, Human
aguccuuaccagcagagcac

SEQ ID NO: 3128533 - RNA, 19 nt, Human
aguccucuuuucugagagg

SEQ ID NO: 3128534 - RNA, 19 nt, Human
aguccuuaccagcagagca

SEQ ID NO: 3128535 - RNA, 17 nt, Human
agucugaaggcuggguu

SEQ ID NO: 3128536 - RNA, 22 nt, Human
agucacacaguauuacuucugc

SEQ ID NO: 3128537 - RNA, 20 nt, Human
aguaugaggcauuuguuuga

SEQ ID NO: 3128538 - RNA, 21 nt, Human
aguaugaggcauuuguuugaa

SEQ ID NO: 3128539 - RNA, 23 nt, Human
aguaugaggcauuuguuugaacu

SEQ ID NO: 3128540 - RNA, 17 nt, Human
aguaugaggcauuuguu

SEQ ID NO: 3128541 - RNA, 18 nt, Human
aguacguugugcauuugg

SEQ ID NO: 3128542 - RNA, 16 nt, Human
aguacguugugcauuu

SEQ ID NO: 3128543 - RNA, 17 nt, Human
aguacguugugcauuug

SEQ ID NO: 3128544 - RNA, 14 nt, Human
aguacuauaauuua

SEQ ID NO: 3128545 - RNA, 22 nt, Human
aguacuacaguccucccaucuc

SEQ ID NO: 3128546 - RNA, 19 nt, Human
aguacuacaguccucccau

SEQ ID NO: 3128547 - RNA, 17 nt, Human
aguacuucuccacccug

SEQ ID NO: 3128548 - RNA, 12 nt, Human
aguacuucuuuu

SEQ ID NO: 3128549 - RNA, 22 nt, Human
aguacuucuccacccugcucuc

SEQ ID NO: 3128550 - RNA, 12 nt, Human
aguacuauguau

SEQ ID NO: 3128551 - RNA, 14 nt, Human
aguacuauguauca

SEQ ID NO: 3128552 - RNA, 15 nt, Human
aguacguugugcauu

SEQ ID NO: 3128553 - RNA, 14 nt, Human
aguacguugugcau

SEQ ID NO: 3128554 - RNA, 16 nt, Human
aggucuguucuuucca

SEQ ID NO: 3128555 - RNA, 13 nt, Human
aggucuguucuuu

SEQ ID NO: 3128556 - RNA, 15 nt, Human
aggucuguucuuucc

SEQ ID NO: 3128557 - RNA, 16 nt, Human
agugggagcugccugu

SEQ ID NO: 3128558 - RNA, 14 nt, Human
agugauucuccugc

SEQ ID NO: 3128559 - RNA, 18 nt, Human
agugccuuacacaauggu

SEQ ID NO: 3128560 - RNA, 15 nt, Human
agugauucuccugcc

SEQ ID NO: 3128561 - RNA, 17 nt, Human
agugauucuccugccuc

SEQ ID NO: 3128562 - RNA, 14 nt, Human
agugauccucccac

SEQ ID NO: 3128563 - RNA, 15 nt, Human
agugauccucccacc

SEQ ID NO: 3128564 - RNA, 18 nt, Human
agugauccucccaccuca

SEQ ID NO: 3128565 - RNA, 23 nt, Human
agugauccucccaccucagccuc

SEQ ID NO: 3128566 - RNA, 24 nt, Human
agugauccucccaccucagccucc

SEQ ID NO: 3128567 - RNA, 15 nt, Human
agugccuuauggaac

SEQ ID NO: 3128568 - RNA, 14 nt, Human
agugccuuauggaa

SEQ ID NO: 3128569 - RNA, 13 nt, Human
agugccuuaugga

SEQ ID NO: 3128570 - RNA, 10 nt, Human
agugccuuau

SEQ ID NO: 3128571 - RNA, 16 nt, Human
agugccuuauggaaca

SEQ ID NO: 3128572 - RNA, 16 nt, Human
aguugauacuacaguu

SEQ ID NO: 3128573 - RNA, 13 nt, Human
aguucaucuugaa

SEQ ID NO: 3128574 - RNA, 19 nt, Human
aguucaucuugaauuguaa

SEQ ID NO: 3128575 - RNA, 15 nt, Human
aguucaucuugaauu

SEQ ID NO: 3128576 - RNA, 16 nt, Human
auaccugucccccuga

SEQ ID NO: 3128577 - RNA, 15 nt, Human
auaccugucccccug

SEQ ID NO: 3128578 - RNA, 14 nt, Human
auaccugucccccu

SEQ ID NO: 3128579 - RNA, 13 nt, Human
auaccuguccccc

SEQ ID NO: 3128580 - RNA, 14 nt, Human
auacaaugcugugc

SEQ ID NO: 3128581 - RNA, 13 nt, Human
auacacuuacacu

SEQ ID NO: 3128582 - RNA, 22 nt, Human
auacacuuacacuuuaugcaca

SEQ ID NO: 3128583 - RNA, 13 nt, Human
auacccaccccca

SEQ ID NO: 3128584 - RNA, 16 nt, Human
auacccacccccaccc

SEQ ID NO: 3128585 - RNA, 14 nt, Human
auacccacccccac

SEQ ID NO: 3128586 - RNA, 17 nt, Human
auacccacccccaccca

SEQ ID NO: 3128587 - RNA, 18 nt, Human
auaaggguaucuggugac

SEQ ID NO: 3128588 - RNA, 12 nt, Human
auaacauguaau

SEQ ID NO: 3128589 - RNA, 13 nt, Human
auaacauguaauu

SEQ ID NO: 3128590 - RNA, 18 nt, Human
auaacauguaauuaagua

SEQ ID NO: 3128591 - RNA, 22 nt, Human
aguuguuacauuuuuaagugcu

SEQ ID NO: 3128592 - RNA, 19 nt, Human
aguuguuacauuuuuaagu

SEQ ID NO: 3128593 - RNA, 20 nt, Human
aguuguuacauuuuuaagug

SEQ ID NO: 3128594 - RNA, 17 nt, Human
aguuugauuaaauucuu

SEQ ID NO: 3128595 - RNA, 18 nt, Human
aguuugauuaaauucuug

SEQ ID NO: 3128596 - RNA, 20 nt, Human
aguuugauuaaauucuugca

SEQ ID NO: 3128597 - RNA, 22 nt, Human
aguuugauuaaauucuugcaaa

SEQ ID NO: 3128598 - RNA, 19 nt, Human
aguuugagaucagccuggg

SEQ ID NO: 3128599 - RNA, 18 nt, Human
aguuugagaucagccugg

SEQ ID NO: 3128600 - RNA, 16 nt, Human
aguuugauuaaauucu

SEQ ID NO: 3128601 - RNA, 20 nt, Human
aguuugagaucagccugggc

SEQ ID NO: 3128602 - RNA, 23 nt, Human
aguuugauuaaauucuugcaaag

SEQ ID NO: 3128603 - RNA, 15 nt, Human
auagcacagacccug

SEQ ID NO: 3128604 - RNA, 18 nt, Human
auagcacagacccugccc

SEQ ID NO: 3128605 - RNA, 17 nt, Human
auagcacagacccugcc

SEQ ID NO: 3128606 - RNA, 15 nt, Human
auagccuaggugaca

SEQ ID NO: 3128607 - RNA, 17 nt, Human
auagccuaggugacaga

SEQ ID NO: 3128608 - RNA, 20 nt, Human
auaugcucugcauguuacau

SEQ ID NO: 3128609 - RNA, 22 nt, Human
auaugcacacauuuuuuaaaug

SEQ ID NO: 3128610 - RNA, 16 nt, Human
auaugcucugcauguu

SEQ ID NO: 3128611 - RNA, 17 nt, Human
auaugcucugcauguua

SEQ ID NO: 3128612 - RNA, 17 nt, Human
auauucaggaagcucag

SEQ ID NO: 3128613 - RNA, 19 nt, Human
auauucaggaagcucaggg

SEQ ID NO: 3128614 - RNA, 17 nt, Human
auccucauacccacccc

SEQ ID NO: 3128615 - RNA, 19 nt, Human
auccagacccggcugcgug

SEQ ID NO: 3128616 - RNA, 19 nt, Human
aucccaugagccucagcau

SEQ ID NO: 3128617 - RNA, 20 nt, Human
aucaccaacgucugugccau

SEQ ID NO: 3128618 - RNA, 13 nt, Human
aucaccagacagg

SEQ ID NO: 3128619 - RNA, 23 nt, Human
aucaaagagguuuuaaaaaaauc

SEQ ID NO: 3128620 - RNA, 20 nt, Human
aucaaagagguuuuaaaaaa

SEQ ID NO: 3128621 - RNA, 24 nt, Human
aucaaaagguuaauaaaguaauua

SEQ ID NO: 3128622 - RNA, 14 nt, Human
aucaugucuggcua

SEQ ID NO: 3128623 - RNA, 14 nt, Human
augaaaacacauuu

SEQ ID NO: 3128624 - RNA, 15 nt, Human
augaaaacacauuuu

SEQ ID NO: 3128625 - RNA, 16 nt, Human
augaaaacacauuuuu

SEQ ID NO: 3128626 - RNA, 13 nt, Human
augaggcauuugu

SEQ ID NO: 3128627 - RNA, 14 nt, Human
augaggcauuuguu

SEQ ID NO: 3128628 - RNA, 21 nt, Human
augaggcauuuguuugaacug

SEQ ID NO: 3128629 - RNA, 16 nt, Human
augcugcccugugagu

SEQ ID NO: 3128630 - RNA, 15 nt, Human
augcugcccugugag

SEQ ID NO: 3128631 - RNA, 14 nt, Human
augcugcccuguga

SEQ ID NO: 3128632 - RNA, 12 nt, Human
augcugcccugu

SEQ ID NO: 3128633 - RNA, 13 nt, Human
augcugcccugug

SEQ ID NO: 3128634 - RNA, 16 nt, Human
auggcuuuugugcauu

SEQ ID NO: 3128635 - RNA, 17 nt, Human
auggcuuuugugcauua

SEQ ID NO: 3128636 - RNA, 16 nt, Human
augcuuguacauaaug

SEQ ID NO: 3128637 - RNA, 15 nt, Human
augcuuguacauaau

SEQ ID NO: 3128638 - RNA, 15 nt, Human
augcacacauuuuuu

SEQ ID NO: 3128639 - RNA, 18 nt, Human
augcacagaguuguuaca

SEQ ID NO: 3128640 - RNA, 13 nt, Human
augcacacauuuu

SEQ ID NO: 3128641 - RNA, 14 nt, Human
augcacacauuuuu

SEQ ID NO: 3128642 - RNA, 19 nt, Human
augcacagaguuguuacau

SEQ ID NO: 3128643 - RNA, 21 nt, Human
augcacagaguuguuacauuu

SEQ ID NO: 3128644 - RNA, 22 nt, Human
augcacagaguuguuacauuuu

SEQ ID NO: 3128645 - RNA, 20 nt, Human
augccuggauggggcugcac

SEQ ID NO: 3128646 - RNA, 19 nt, Human
augccuggauggggcugca

SEQ ID NO: 3128647 - RNA, 17 nt, Human
augaucuuugcagacag

SEQ ID NO: 3128648 - RNA, 18 nt, Human
augaucuucuuuauaauu

SEQ ID NO: 3128649 - RNA, 18 nt, Human
augaucuuugcagacagg

SEQ ID NO: 3128650 - RNA, 19 nt, Human
augaucuuugcagacaggc

SEQ ID NO: 3128651 - RNA, 21 nt, Human
augaucuuugcagacaggcaa

SEQ ID NO: 3128652 - RNA, 15 nt, Human
augaugauccuaggc

SEQ ID NO: 3128653 - RNA, 23 nt, Human
augaugaaaugaggucagagccu

SEQ ID NO: 3128654 - RNA, 18 nt, Human
augaugaaaugaggucag

SEQ ID NO: 3128655 - RNA, 18 nt, Human
augcacaaacagaggccg

SEQ ID NO: 3128656 - RNA, 14 nt, Human
auguuugccucugc

SEQ ID NO: 3128657 - RNA, 15 nt, Human
auguuugccucugcc

SEQ ID NO: 3128658 - RNA, 17 nt, Human
auguuugccucugccuc

SEQ ID NO: 3128659 - RNA, 15 nt, Human
auguucugggacaca

SEQ ID NO: 3128660 - RNA, 14 nt, Human
auguucugggacac

SEQ ID NO: 3128661 - RNA, 13 nt, Human
auguucucugagg

SEQ ID NO: 3128662 - RNA, 17 nt, Human
auguucucucuucucca

SEQ ID NO: 3128663 - RNA, 16 nt, Human
auguucucucuucucc

SEQ ID NO: 3128664 - RNA, 13 nt, Human
auguguaaguauu

SEQ ID NO: 3128665 - RNA, 23 nt, Human
augggugcuuggaggaaggaaac

SEQ ID NO: 3128666 - RNA, 21 nt, Human
augggugcuuggaggaaggaa

SEQ ID NO: 3128667 - RNA, 20 nt, Human
augggugcuuggaggaagga

SEQ ID NO: 3128668 - RNA, 23 nt, Human
auguaauuaaguacuauguauca

SEQ ID NO: 3128669 - RNA, 13 nt, Human
augucacaggcag

SEQ ID NO: 3128670 - RNA, 17 nt, Human
augucacaggcaggucc

SEQ ID NO: 3128671 - RNA, 19 nt, Human
augucacaggcagguccag

SEQ ID NO: 3128672 - RNA, 19 nt, Human
cuccgcuuucuacccagcg

SEQ ID NO: 3128673 - RNA, 12 nt, Human
cucccaccucag

SEQ ID NO: 3128674 - RNA, 11 nt, Human
cuccaggugca

SEQ ID NO: 3128675 - RNA, 20 nt, Human
cuccacuuucuagccagagg

SEQ ID NO: 3128676 - RNA, 22 nt, Human
cuccacuuucuagccagaggag

SEQ ID NO: 3128677 - RNA, 15 nt, Human
cuccaagaccuucuc

SEQ ID NO: 3128678 - RNA, 16 nt, Human
cuccaagaccuucucc

SEQ ID NO: 3128679 - RNA, 18 nt, Human
cuccaagaccuucuccuu

SEQ ID NO: 3128680 - RNA, 17 nt, Human
cuccaagaccuucuccu

SEQ ID NO: 3128681 - RNA, 18 nt, Human
cuccagaauuucccaaag

SEQ ID NO: 3128682 - RNA, 15 nt, Human
cuccagaauuuccca

SEQ ID NO: 3128683 - RNA, 19 nt, Human
cuccagacacauguccaag

SEQ ID NO: 3128684 - RNA, 17 nt, Human
cuccagacacaugucca

SEQ ID NO: 3128685 - RNA, 16 nt, Human
cuccagacacaugucc

SEQ ID NO: 3128686 - RNA, 17 nt, Human
cucagucuggcccuucc

SEQ ID NO: 3128687 - RNA, 18 nt, Human
cucagucuggcccuuccu

SEQ ID NO: 3128688 - RNA, 13 nt, Human
cucagugccacua

SEQ ID NO: 3128689 - RNA, 12 nt, Human
cucauguucuua

SEQ ID NO: 3128690 - RNA, 14 nt, Human
cucauguucuuaau

SEQ ID NO: 3128691 - RNA, 18 nt, Human
cucauguucuuaauucuu

SEQ ID NO: 3128692 - RNA, 19 nt, Human
cucauguucuuaauucuua

SEQ ID NO: 3128693 - RNA, 23 nt, Human
cucagccucccgaauagcuggga

SEQ ID NO: 3128694 - RNA, 22 nt, Human
cucagccucccaaagugcuggg

SEQ ID NO: 3128695 - RNA, 13 nt, Human
cucagccucccga

SEQ ID NO: 3128696 - RNA, 21 nt, Human
cucagccucccaaagugcugg

SEQ ID NO: 3128697 - RNA, 14 nt, Human
cucagccucccaaa

SEQ ID NO: 3128698 - RNA, 16 nt, Human
cucagccucccaaagu

SEQ ID NO: 3128699 - RNA, 13 nt, Human
cucagccucccaa

SEQ ID NO: 3128700 - RNA, 13 nt, Human
cucaggccagcug

SEQ ID NO: 3128701 - RNA, 22 nt, Human
cucaggccagcugcuugggcuu

SEQ ID NO: 3128702 - RNA, 21 nt, Human
cucaggccagcugcuugggcu

SEQ ID NO: 3128703 - RNA, 20 nt, Human
cucaggccagcugcuugggc

SEQ ID NO: 3128704 - RNA, 14 nt, Human
cucaggccagcugc

SEQ ID NO: 3128705 - RNA, 21 nt, Human
cucaggccugggggcugggca

SEQ ID NO: 3128706 - RNA, 20 nt, Human
cucaggccugggggcugggc

SEQ ID NO: 3128707 - RNA, 14 nt, Human
cucaggccuggggg

SEQ ID NO: 3128708 - RNA, 13 nt, Human
cucaggccugggg

SEQ ID NO: 3128709 - RNA, 13 nt, Human
cucugcagcaaua

SEQ ID NO: 3128710 - RNA, 23 nt, Human
cucugcagcaauaaagcagcguu

SEQ ID NO: 3128711 - RNA, 18 nt, Human
cucugcagcaauaaagca

SEQ ID NO: 3128712 - RNA, 19 nt, Human
cucugcagcaauaaagcag

SEQ ID NO: 3128713 - RNA, 15 nt, Human
cucugguuaucuaau

SEQ ID NO: 3128714 - RNA, 19 nt, Human
cucugguccauagagagca

SEQ ID NO: 3128715 - RNA, 18 nt, Human
cucugguccauagagagc

SEQ ID NO: 3128716 - RNA, 16 nt, Human
cucugguccauagaga

SEQ ID NO: 3128717 - RNA, 17 nt, Human
cucugcugacagacaca

SEQ ID NO: 3128718 - RNA, 18 nt, Human
cucugcugacagacacag

SEQ ID NO: 3128719 - RNA, 19 nt, Human
cucugcugacagacacagg

SEQ ID NO: 3128720 - RNA, 15 nt, Human
cucugguccauagag

SEQ ID NO: 3128721 - RNA, 21 nt, Human
cucuguacagagcccacgccc

SEQ ID NO: 3128722 - RNA, 17 nt, Human
cucuguacagagcccac

SEQ ID NO: 3128723 - RNA, 14 nt, Human
cucucacuccuuga

SEQ ID NO: 3128724 - RNA, 12 nt, Human
cucucacuccuu

SEQ ID NO: 3128725 - RNA, 15 nt, Human
cucucacuccuugaa

SEQ ID NO: 3128726 - RNA, 19 nt, Human
cucucagauuguaccauug

SEQ ID NO: 3128727 - RNA, 15 nt, Human
cucugaaggacauug

SEQ ID NO: 3128728 - RNA, 21 nt, Human
cucuccgaccagacaccuuga

SEQ ID NO: 3128729 - RNA, 24 nt, Human
cucuccccagcaagugagagcugg

SEQ ID NO: 3128730 - RNA, 23 nt, Human
cugacccugcuucaaauauuucc

SEQ ID NO: 3128731 - RNA, 20 nt, Human
cugacccaugcugcccugug

SEQ ID NO: 3128732 - RNA, 19 nt, Human
cugacccaugcugcccugu

SEQ ID NO: 3128733 - RNA, 17 nt, Human
cugacccaugcugcccu

SEQ ID NO: 3128734 - RNA, 18 nt, Human
cugacccaugcugcccug

SEQ ID NO: 3128735 - RNA, 12 nt, Human
cugacagacaca

SEQ ID NO: 3128736 - RNA, 14 nt, Human
cugacagacacagg

SEQ ID NO: 3128737 - RNA, 14 nt, Human
cugaaaauguaugu

SEQ ID NO: 3128738 - RNA, 16 nt, Human
cugaaaauguaugugu

SEQ ID NO: 3128739 - RNA, 19 nt, Human
cugaaggacauugcggaca

SEQ ID NO: 3128740 - RNA, 20 nt, Human
cugaaggacauugcggacag

SEQ ID NO: 3128741 - RNA, 17 nt, Human
cugaaggccccgcccag

SEQ ID NO: 3128742 - RNA, 17 nt, Human
cugaaggcuggguucug

SEQ ID NO: 3128743 - RNA, 14 nt, Human
cugaaggccccgcc

SEQ ID NO: 3128744 - RNA, 13 nt, Human
cugaaggccccgc

SEQ ID NO: 3128745 - RNA, 14 nt, Human
ccuuuagcgcccag

SEQ ID NO: 3128746 - RNA, 20 nt, Human
ccuuuagcgcccaguugggu

SEQ ID NO: 3128747 - RNA, 20 nt, Human
ccuuuucgcaggauucuucc

SEQ ID NO: 3128748 - RNA, 12 nt, Human
ccuuuuuuauac

SEQ ID NO: 3128749 - RNA, 21 nt, Human
ccuuuuuuagaguugauacua

SEQ ID NO: 3128750 - RNA, 23 nt, Human
cgaccagacaccuugacagggca

SEQ ID NO: 3128751 - RNA, 17 nt, Human
ccuuuuuuauacauaaa

SEQ ID NO: 3128752 - RNA, 18 nt, Human
ccuuuuuuauacauaaac

SEQ ID NO: 3128753 - RNA, 20 nt, Human
ccuugccgucuaccugaggg

SEQ ID NO: 3128754 - RNA, 17 nt, Human
ccuugccgucuaccuga

SEQ ID NO: 3128755 - RNA, 15 nt, Human
ccuggccugagcugg

SEQ ID NO: 3128756 - RNA, 14 nt, Human
ccuggccugagcug

SEQ ID NO: 3128757 - RNA, 20 nt, Human
ccuucugacccaugcugccc

SEQ ID NO: 3128758 - RNA, 17 nt, Human
ccuucugacccaugcug

SEQ ID NO: 3128759 - RNA, 16 nt, Human
ccuucugacccaugcu

SEQ ID NO: 3128760 - RNA, 12 nt, Human
ccuucugaccca

SEQ ID NO: 3128761 - RNA, 22 nt, Human
ccuucuggaauaaggagaauga

SEQ ID NO: 3128762 - RNA, 23 nt, Human
ccuucugacccaugcugcccugu

SEQ ID NO: 3128763 - RNA, 22 nt, Human
ccuucugacccaugcugcccug

SEQ ID NO: 3128764 - RNA, 21 nt, Human
ccuucugacccaugcugcccu

SEQ ID NO: 3128765 - RNA, 18 nt, Human
cgaguuacagacaaagcg

SEQ ID NO: 3128766 - RNA, 17 nt, Human
cgaguuacagacaaagc

SEQ ID NO: 3128767 - RNA, 13 nt, Human
cgaguagcuggga

SEQ ID NO: 3128768 - RNA, 14 nt, Human
cgaguagcugggac

SEQ ID NO: 3128769 - RNA, 15 nt, Human
cgaguagcugggacu

SEQ ID NO: 3128770 - RNA, 12 nt, Human
cgccaaggcugg

SEQ ID NO: 3128771 - RNA, 16 nt, Human
cgccaaggcuggggga

SEQ ID NO: 3128772 - RNA, 13 nt, Human
cgccaaggcuggg

SEQ ID NO: 3128773 - RNA, 15 nt, Human
cggccuuuggcuuca

SEQ ID NO: 3128774 - RNA, 17 nt, Human
cggcucacugcagccuc

SEQ ID NO: 3128775 - RNA, 19 nt, Human
cggcucacugcagccucaa

SEQ ID NO: 3128776 - RNA, 18 nt, Human
cggcucacugcagccuca

SEQ ID NO: 3128777 - RNA, 16 nt, Human
cuaacuucaccauauu

SEQ ID NO: 3128778 - RNA, 16 nt, Human
cuaacuuuccuucauu

SEQ ID NO: 3128779 - RNA, 15 nt, Human
cuaacuucaccauau

SEQ ID NO: 3128780 - RNA, 18 nt, Human
cuaagugaggaugaaaaa

SEQ ID NO: 3128781 - RNA, 20 nt, Human
cuaagugauccucccaccuc

SEQ ID NO: 3128782 - RNA, 22 nt, Human
cuaagugauccucccaccucag

SEQ ID NO: 3128783 - RNA, 13 nt, Human
cuacaguugaaaa

SEQ ID NO: 3128784 - RNA, 17 nt, Human
cuacaguccucccaucu

SEQ ID NO: 3128785 - RNA, 16 nt, Human
cuacaguccucccauc

SEQ ID NO: 3128786 - RNA, 15 nt, Human
cuacaguccucccau

SEQ ID NO: 3128787 - RNA, 22 nt, Human
cuaguuccaccaucaagccacc

SEQ ID NO: 3128788 - RNA, 14 nt, Human
cuaguuccaccauc

SEQ ID NO: 3128789 - RNA, 20 nt, Human
cuaguuccaccaucaagcca

SEQ ID NO: 3128790 - RNA, 18 nt, Human
cuaguuccaccaucaagc

SEQ ID NO: 3128791 - RNA, 21 nt, Human
cuagggaaaaaccagcgugug

SEQ ID NO: 3128792 - RNA, 19 nt, Human
cuagggaaaaaccagcgug

SEQ ID NO: 3128793 - RNA, 14 nt, Human
cuaccugaggggcc

SEQ ID NO: 3128794 - RNA, 11 nt, Human
cuaccugaggg

SEQ ID NO: 3128795 - RNA, 19 nt, Human
cuagaaauuccccacccug

SEQ ID NO: 3128796 - RNA, 12 nt, Human
cuagcagcaggg

SEQ ID NO: 3128797 - RNA, 22 nt, Human
cuagcagcagggagggcuucug

SEQ ID NO: 3128798 - RNA, 17 nt, Human
cuagcauggcugccaau

SEQ ID NO: 3128799 - RNA, 23 nt, Human
cuagcagcagggagggcuucugc

SEQ ID NO: 3128800 - RNA, 16 nt, Human
ccgccaugcuccuggc

SEQ ID NO: 3128801 - RNA, 20 nt, Human
ccgcccaggcuuagucacug

SEQ ID NO: 3128802 - RNA, 18 nt, Human
ccgaccagacaccuugac

SEQ ID NO: 3128803 - RNA, 20 nt, Human
ccgaauagcugggacuacag

SEQ ID NO: 3128804 - RNA, 17 nt, Human
ccgaauagcugggacua

SEQ ID NO: 3128805 - RNA, 16 nt, Human
ccgacccuugccgucu

SEQ ID NO: 3128806 - RNA, 17 nt, Human
ccgccaaggcuggggga

SEQ ID NO: 3128807 - RNA, 21 nt, Human
cccuucugacccaugcugccc

SEQ ID NO: 3128808 - RNA, 23 nt, Human
cccuucugacccaugcugcccug

SEQ ID NO: 3128809 - RNA, 22 nt, Human
cccuucugacccaugcugcccu

SEQ ID NO: 3128810 - RNA, 16 nt, Human
cccuucgcuccugugu

SEQ ID NO: 3128811 - RNA, 18 nt, Human
cccuucgcuccugugucu

SEQ ID NO: 3128812 - RNA, 16 nt, Human
cccuucuaccuuccug

SEQ ID NO: 3128813 - RNA, 13 nt, Human
cccugcccugugg

SEQ ID NO: 3128814 - RNA, 12 nt, Human
cccugcccugug

SEQ ID NO: 3128815 - RNA, 11 nt, Human
cccugcccugu

SEQ ID NO: 3128816 - RNA, 14 nt, Human
cccugcccuguggg

SEQ ID NO: 3128817 - RNA, 15 nt, Human
cccugcccugugggc

SEQ ID NO: 3128818 - RNA, 20 nt, Human
cccugcccugugggccccca

SEQ ID NO: 3128819 - RNA, 16 nt, Human
cccugcccugugggcc

SEQ ID NO: 3128820 - RNA, 13 nt, Human
cccuggcagcccc

SEQ ID NO: 3128821 - RNA, 12 nt, Human
cccuggcagccc

SEQ ID NO: 3128822 - RNA, 16 nt, Human
cccuggcagccccugu

SEQ ID NO: 3128823 - RNA, 14 nt, Human
cccuggcagccccu

SEQ ID NO: 3128824 - RNA, 20 nt, Human
ccuccaagaccuucuccuuc

SEQ ID NO: 3128825 - RNA, 19 nt, Human
ccucauguucuuaauucuu

SEQ ID NO: 3128826 - RNA, 23 nt, Human
ccucccaacucaccccagcccca

SEQ ID NO: 3128827 - RNA, 22 nt, Human
ccucccaaggggcccaaauucu

SEQ ID NO: 3128828 - RNA, 13 nt, Human
ccucauguucuua

SEQ ID NO: 3128829 - RNA, 23 nt, Human
ccucagccucccaaagugcuggg

SEQ ID NO: 3128830 - RNA, 22 nt, Human
ccucagccucccgaauagcugg

SEQ ID NO: 3128831 - RNA, 11 nt, Human
ccucagccucc

SEQ ID NO: 3128832 - RNA, 22 nt, Human
ccucagccucccaaagugcugg

SEQ ID NO: 3128833 - RNA, 15 nt, Human
ccucaagagaaggca

SEQ ID NO: 3128834 - RNA, 15 nt, Human
ccucaacucuccucc

SEQ ID NO: 3128835 - RNA, 16 nt, Human
ccucaaccuccugggc

SEQ ID NO: 3128836 - RNA, 15 nt, Human
ccuggaguucugguu

SEQ ID NO: 3128837 - RNA, 17 nt, Human
ccuggaguucugguucc

SEQ ID NO: 3128838 - RNA, 16 nt, Human
ccuggaguucugguuc

SEQ ID NO: 3128839 - RNA, 13 nt, Human
ccuggaugcagcc

SEQ ID NO: 3128840 - RNA, 19 nt, Human
ccuggaugcagccucacag

SEQ ID NO: 3128841 - RNA, 17 nt, Human
ccuggaugcagccucac

SEQ ID NO: 3128842 - RNA, 14 nt, Human
ccuggaugcagccu

SEQ ID NO: 3128843 - RNA, 20 nt, Human
ccugcuggguguggcgcagc

SEQ ID NO: 3128844 - RNA, 14 nt, Human
ccugcugggugugg

SEQ ID NO: 3128845 - RNA, 12 nt, Human
ccugcugggugu

SEQ ID NO: 3128846 - RNA, 14 nt, Human
ccugcccaggcccc

SEQ ID NO: 3128847 - RNA, 15 nt, Human
ccugcccaggccccu

SEQ ID NO: 3128848 - RNA, 22 nt, Human
ccugcccaggccccugccaccc

SEQ ID NO: 3128849 - RNA, 16 nt, Human
ccugcccaggccccug

SEQ ID NO: 3128850 - RNA, 12 nt, Human
ccuggccucugc

SEQ ID NO: 3128851 - RNA, 13 nt, Human
ccuggccugagcu

SEQ ID NO: 3128852 - RNA, 15 nt, Human
ccuggccucugcacu

SEQ ID NO: 3128853 - RNA, 14 nt, Human
ccuggccucugcac

SEQ ID NO: 3128854 - RNA, 13 nt, Human
ccucuugagccuu

SEQ ID NO: 3128855 - RNA, 19 nt, Human
ccucuugagccuugaacuu

SEQ ID NO: 3128856 - RNA, 13 nt, Human
ccucuuggguuca

SEQ ID NO: 3128857 - RNA, 19 nt, Human
ccugcacuugcagacucua

SEQ ID NO: 3128858 - RNA, 22 nt, Human
ccugcacuugcagacucuacag

SEQ ID NO: 3128859 - RNA, 12 nt, Human
ccucucucaggc

SEQ ID NO: 3128860 - RNA, 17 nt, Human
ccucucucacuccuuga

SEQ ID NO: 3128861 - RNA, 15 nt, Human
ccucucucacuccuu

SEQ ID NO: 3128862 - RNA, 14 nt, Human
ccucucucacuccu

SEQ ID NO: 3128863 - RNA, 13 nt, Human
ccucucucacucc

SEQ ID NO: 3128864 - RNA, 12 nt, Human
ccucucucacuc

SEQ ID NO: 3128865 - RNA, 14 nt, Human
ccucucucaggcca

SEQ ID NO: 3128866 - RNA, 14 nt, Human
ccucugcugcuggc

SEQ ID NO: 3128867 - RNA, 13 nt, Human
ccucugcugcugg

SEQ ID NO: 3128868 - RNA, 18 nt, Human
ccucugcugcuggcuggu

SEQ ID NO: 3128869 - RNA, 17 nt, Human
ccucugcugcuggcugg

SEQ ID NO: 3128870 - RNA, 16 nt, Human
ccucugcugcuggcug

SEQ ID NO: 3128871 - RNA, 15 nt, Human
ccucugcugcuggcu

SEQ ID NO: 3128872 - RNA, 22 nt, Human
ccucugccugaagucacacagu

SEQ ID NO: 3128873 - RNA, 21 nt, Human
ccucugccugaagucacacag

SEQ ID NO: 3128874 - RNA, 17 nt, Human
ccaggcuggcgugcagu

SEQ ID NO: 3128875 - RNA, 18 nt, Human
ccaggcuggcgugcagug

SEQ ID NO: 3128876 - RNA, 16 nt, Human
ccaggcuggcgugcag

SEQ ID NO: 3128877 - RNA, 20 nt, Human
ccaggcuccuuuagcgccca

SEQ ID NO: 3128878 - RNA, 21 nt, Human
ccaggcuccuuuagcgcccag

SEQ ID NO: 3128879 - RNA, 19 nt, Human
ccaggggaaaaucagccug

SEQ ID NO: 3128880 - RNA, 13 nt, Human
ccaggggugggac

SEQ ID NO: 3128881 - RNA, 20 nt, Human
ccaggggaaaaucagccugc

SEQ ID NO: 3128882 - RNA, 17 nt, Human
ccaggggugggacaccc

SEQ ID NO: 3128883 - RNA, 14 nt, Human
ccaggggugggaca

SEQ ID NO: 3128884 - RNA, 23 nt, Human
ccaggggugggacacccugugau

SEQ ID NO: 3128885 - RNA, 17 nt, Human
ccaucccugaaggcccc

SEQ ID NO: 3128886 - RNA, 15 nt, Human
ccaucccugaaggcc

SEQ ID NO: 3128887 - RNA, 14 nt, Human
ccaucccugaaggc

SEQ ID NO: 3128888 - RNA, 23 nt, Human
ccaguuggucccccuuccaugga

SEQ ID NO: 3128889 - RNA, 15 nt, Human
ccaucccagccccaa

SEQ ID NO: 3128890 - RNA, 13 nt, Human
ccaucccagcccc

SEQ ID NO: 3128891 - RNA, 14 nt, Human
ccaucccagcccca

SEQ ID NO: 3128892 - RNA, 20 nt, Human
ccauggucggaaaacaugcu

SEQ ID NO: 3128893 - RNA, 21 nt, Human
ccaugagccucagcauccugg

SEQ ID NO: 3128894 - RNA, 23 nt, Human
ccaugagccucagcauccuggca

SEQ ID NO: 3128895 - RNA, 17 nt, Human
ccaguuggguggaugcc

SEQ ID NO: 3128896 - RNA, 19 nt, Human
ccaguuggguggaugccug

SEQ ID NO: 3128897 - RNA, 20 nt, Human
ccaguuggguggaugccugg

SEQ ID NO: 3128898 - RNA, 16 nt, Human
ccaggaaaggcuccag

SEQ ID NO: 3128899 - RNA, 15 nt, Human
ccaggaaaggcucca

SEQ ID NO: 3128900 - RNA, 14 nt, Human
ccaggaaaggcucc

SEQ ID NO: 3128901 - RNA, 12 nt, Human
ccaggaagccag

SEQ ID NO: 3128902 - RNA, 13 nt, Human
ccaggaagccagc

SEQ ID NO: 3128903 - RNA, 19 nt, Human
ccagcuuaaaggggcuaga

SEQ ID NO: 3128904 - RNA, 17 nt, Human
ccagcuguucagcuggu

SEQ ID NO: 3128905 - RNA, 22 nt, Human
ccagcucaccagccccagugcc

SEQ ID NO: 3128906 - RNA, 16 nt, Human
ccagcuguucagcugg

SEQ ID NO: 3128907 - RNA, 15 nt, Human
ccagcucaccagccc

SEQ ID NO: 3128908 - RNA, 16 nt, Human
ccagcucaccagcccc

SEQ ID NO: 3128909 - RNA, 12 nt, Human
ccagccccugga

SEQ ID NO: 3128910 - RNA, 11 nt, Human
ccagccccugg

SEQ ID NO: 3128911 - RNA, 20 nt, Human
ccagcagccuggacccugug

SEQ ID NO: 3128912 - RNA, 15 nt, Human
ccagcaggcucucag

SEQ ID NO: 3128913 - RNA, 13 nt, Human
ccagcaggcucuc

SEQ ID NO: 3128914 - RNA, 18 nt, Human
ccagaugcaccagcccuu

SEQ ID NO: 3128915 - RNA, 17 nt, Human
ccagaugcaccagcccu

SEQ ID NO: 3128916 - RNA, 15 nt, Human
ccagaugcaccagcc

SEQ ID NO: 3128917 - RNA, 16 nt, Human
ccaccuuggcucaagu

SEQ ID NO: 3128918 - RNA, 17 nt, Human
ccagagggccugcaagg

SEQ ID NO: 3128919 - RNA, 19 nt, Human
ccagagggccugcaaggga

SEQ ID NO: 3128920 - RNA, 18 nt, Human
ccagagggccugcaaggg

SEQ ID NO: 3128921 - RNA, 17 nt, Human
cccacccccacccaagg

SEQ ID NO: 3128922 - RNA, 15 nt, Human
cccacccccacccaa

SEQ ID NO: 3128923 - RNA, 12 nt, Human
cccacccccacc

SEQ ID NO: 3128924 - RNA, 18 nt, Human
cccacccaagggccuggc

SEQ ID NO: 3128925 - RNA, 18 nt, Human
cccacccugaaagcccug

SEQ ID NO: 3128926 - RNA, 22 nt, Human
cccacccaagggccuggccuga

SEQ ID NO: 3128927 - RNA, 21 nt, Human
cccacccaagggccuggccug

SEQ ID NO: 3128928 - RNA, 20 nt, Human
cccacccaagggccuggccu

SEQ ID NO: 3128929 - RNA, 19 nt, Human
cccacugcuuuuggucugu

SEQ ID NO: 3128930 - RNA, 12 nt, Human
cccacugcucug

SEQ ID NO: 3128931 - RNA, 13 nt, Human
cccacugcucugg

SEQ ID NO: 3128932 - RNA, 13 nt, Human
cccaggcuggcgu

SEQ ID NO: 3128933 - RNA, 17 nt, Human
cccaggcuggcgugcag

SEQ ID NO: 3128934 - RNA, 13 nt, Human
cccauccucugua

SEQ ID NO: 3128935 - RNA, 22 nt, Human
cccagcuuaaaggggcuagagu

SEQ ID NO: 3128936 - RNA, 23 nt, Human
cccagcucugguccauagagagc

SEQ ID NO: 3128937 - RNA, 14 nt, Human
cccgaauagcuggg

SEQ ID NO: 3128938 - RNA, 11 nt, Human
cccggcuccag

SEQ ID NO: 3128939 - RNA, 12 nt, Human
cccggcuccagg

SEQ ID NO: 3128940 - RNA, 14 nt, Human
cccggccaccugcg

SEQ ID NO: 3128941 - RNA, 13 nt, Human
cccggccaccugc

SEQ ID NO: 3128942 - RNA, 13 nt, Human
cccggcuccaggc

SEQ ID NO: 3128943 - RNA, 14 nt, Human
cccggcuccaggcu

SEQ ID NO: 3128944 - RNA, 15 nt, Human
cccggcuccaggcuc

SEQ ID NO: 3128945 - RNA, 16 nt, Human
cccggcuccaggcucc

SEQ ID NO: 3128946 - RNA, 18 nt, Human
cccuauuagagaagagau

SEQ ID NO: 3128947 - RNA, 22 nt, Human
cccgggaagggggcugggacau

SEQ ID NO: 3128948 - RNA, 23 nt, Human
ccccgacccuugccgucuaccug

SEQ ID NO: 3128949 - RNA, 22 nt, Human
cccccaaauggaaaugggcaga

SEQ ID NO: 3128950 - RNA, 21 nt, Human
ccccagcaagugagagcuggg

SEQ ID NO: 3128951 - RNA, 22 nt, Human
ccccagcaagugagagcugggu

SEQ ID NO: 3128952 - RNA, 22 nt, Human
ccccaaaacucuccucugcugc

SEQ ID NO: 3128953 - RNA, 23 nt, Human
ccccaaaacucuccucugcugcu

SEQ ID NO: 3128954 - RNA, 21 nt, Human
ccccaaaacucuccucugcug

SEQ ID NO: 3128955 - RNA, 17 nt, Human
auuacaggaaguacugg

SEQ ID NO: 3128956 - RNA, 16 nt, Human
auuacaggugugaacc

SEQ ID NO: 3128957 - RNA, 21 nt, Human
auuaggugugacugaauuucu

SEQ ID NO: 3128958 - RNA, 16 nt, Human
auuaggugugacugaa

SEQ ID NO: 3128959 - RNA, 18 nt, Human
auuaggugugacugaauu

SEQ ID NO: 3128960 - RNA, 15 nt, Human
auucauaaugacuua

SEQ ID NO: 3128961 - RNA, 14 nt, Human
auucauaaugacuu

SEQ ID NO: 3128962 - RNA, 19 nt, Human
auucauaaugacuuaagca

SEQ ID NO: 3128963 - RNA, 11 nt, Human
auucuucugcu

SEQ ID NO: 3128964 - RNA, 12 nt, Human
auucuucugcuu

SEQ ID NO: 3128965 - RNA, 11 nt, Human
auucuuuccug

SEQ ID NO: 3128966 - RNA, 14 nt, Human
auugcuacuguccu

SEQ ID NO: 3128967 - RNA, 15 nt, Human
auugcuacuguccua

SEQ ID NO: 3128968 - RNA, 17 nt, Human
auugauaugcuuauaca

SEQ ID NO: 3128969 - RNA, 20 nt, Human
auugcuacuguccuacccac

SEQ ID NO: 3128970 - RNA, 22 nt, Human
auugcuacuguccuacccaccc

SEQ ID NO: 3128971 - RNA, 21 nt, Human
auugauaagaaccuuuugagu

SEQ ID NO: 3128972 - RNA, 12 nt, Human
auugcugcuuga

SEQ ID NO: 3128973 - RNA, 23 nt, Human
auugcugauggugcaaugaccuu

SEQ ID NO: 3128974 - RNA, 14 nt, Human
auugcuugagcuca

SEQ ID NO: 3128975 - RNA, 19 nt, Human
auugcugauggugcaauga

SEQ ID NO: 3128976 - RNA, 18 nt, Human
auugcugauggugcaaug

SEQ ID NO: 3128977 - RNA, 16 nt, Human
auugcugauggugcaa

SEQ ID NO: 3128978 - RNA, 15 nt, Human
auugcugauggugca

SEQ ID NO: 3128979 - RNA, 16 nt, Human
auuguuagucucuuga

SEQ ID NO: 3128980 - RNA, 23 nt, Human
auugugucucuugguccugcugc

SEQ ID NO: 3128981 - RNA, 21 nt, Human
auugugucucuugguccugcu

SEQ ID NO: 3128982 - RNA, 18 nt, Human
caaagauauuuugcuuug

SEQ ID NO: 3128983 - RNA, 20 nt, Human
caaagauauuuugcuuugug

SEQ ID NO: 3128984 - RNA, 23 nt, Human
auuuuuuuuuccuucagugccuu

SEQ ID NO: 3128985 - RNA, 18 nt, Human
caaaagaugcuucucacu

SEQ ID NO: 3128986 - RNA, 16 nt, Human
caaaagaugcuucuca

SEQ ID NO: 3128987 - RNA, 19 nt, Human
caaaccaucauugaaaucu

SEQ ID NO: 3128988 - RNA, 21 nt, Human
caaaccaucauugaaaucuuu

SEQ ID NO: 3128989 - RNA, 15 nt, Human
caaacagaggccgcc

SEQ ID NO: 3128990 - RNA, 14 nt, Human
caaagaugcagccg

SEQ ID NO: 3128991 - RNA, 22 nt, Human
caaagauauuuugcuuugugau

SEQ ID NO: 3128992 - RNA, 23 nt, Human
caaagauauuuugcuuugugauu

SEQ ID NO: 3128993 - RNA, 22 nt, Human
caaaguacacuguuucaaacuu

SEQ ID NO: 3128994 - RNA, 17 nt, Human
caaagcagugcaugcug

SEQ ID NO: 3128995 - RNA, 15 nt, Human
caaagcagugcaugc

SEQ ID NO: 3128996 - RNA, 14 nt, Human
caaaguagaagucu

SEQ ID NO: 3128997 - RNA, 21 nt, Human
caaaguagaagucuuagaugu

SEQ ID NO: 3128998 - RNA, 20 nt, Human
caaauggaaaugggcagagc

SEQ ID NO: 3128999 - RNA, 21 nt, Human
caaauggaaaugggcagagca

SEQ ID NO: 3129000 - RNA, 13 nt, Human
auuugcuccuuuc

SEQ ID NO: 3129001 - RNA, 15 nt, Human
auuugugauacaaug

SEQ ID NO: 3129002 - RNA, 17 nt, Human
auuugugauacaaugcu

SEQ ID NO: 3129003 - RNA, 20 nt, Human
auuugugauacaaugcugug

SEQ ID NO: 3129004 - RNA, 20 nt, Human
auuuguuugaacugauaaag

SEQ ID NO: 3129005 - RNA, 22 nt, Human
auuuguuugaacugauaaagau

SEQ ID NO: 3129006 - RNA, 23 nt, Human
auuuguuugaacugauaaagaug

SEQ ID NO: 3129007 - RNA, 17 nt, Human
caccugccuguugggcc

SEQ ID NO: 3129008 - RNA, 24 nt, Human
caccugccuguugggccaggagcc

SEQ ID NO: 3129009 - RNA, 19 nt, Human
caccugccuguugggccag

SEQ ID NO: 3129010 - RNA, 14 nt, Human
caccuuggcugcag

SEQ ID NO: 3129011 - RNA, 14 nt, Human
caccuuggcucaag

SEQ ID NO: 3129012 - RNA, 15 nt, Human
caccuuggcucaagu

SEQ ID NO: 3129013 - RNA, 13 nt, Human
caccuuggcugca

SEQ ID NO: 3129014 - RNA, 14 nt, Human
caccucagccuccc

SEQ ID NO: 3129015 - RNA, 12 nt, Human
caccucagccuc

SEQ ID NO: 3129016 - RNA, 13 nt, Human
caccucagccucc

SEQ ID NO: 3129017 - RNA, 14 nt, Human
caccugccccucaa

SEQ ID NO: 3129018 - RNA, 15 nt, Human
caccugccccucaac

SEQ ID NO: 3129019 - RNA, 17 nt, Human
cacccugaaagcccuga

SEQ ID NO: 3129020 - RNA, 15 nt, Human
cacccuggggagaaa

SEQ ID NO: 3129021 - RNA, 16 nt, Human
cacccuggggagaaag

SEQ ID NO: 3129022 - RNA, 14 nt, Human
cacccucaggcagg

SEQ ID NO: 3129023 - RNA, 11 nt, Human
caccccagccc

SEQ ID NO: 3129024 - RNA, 16 nt, Human
cacuuacacuuuaugc

SEQ ID NO: 3129025 - RNA, 18 nt, Human
cacuuacacuuuaugcac

SEQ ID NO: 3129026 - RNA, 19 nt, Human
cacugcacuauagccuagg

SEQ ID NO: 3129027 - RNA, 16 nt, Human
cacugcacuccagccu

SEQ ID NO: 3129028 - RNA, 15 nt, Human
cacugcacuccagcc

SEQ ID NO: 3129029 - RNA, 18 nt, Human
cacugcacuccagccugg

SEQ ID NO: 3129030 - RNA, 19 nt, Human
cacugcacuccagccuggg

SEQ ID NO: 3129031 - RNA, 20 nt, Human
cacugcacuccagccugggu

SEQ ID NO: 3129032 - RNA, 12 nt, Human
cacugcagccuc

SEQ ID NO: 3129033 - RNA, 13 nt, Human
cacugcagccuca

SEQ ID NO: 3129034 - RNA, 16 nt, Human
cacugcauguuuguga

SEQ ID NO: 3129035 - RNA, 16 nt, Human
cacuccagccugggug

SEQ ID NO: 3129036 - RNA, 13 nt, Human
cacuccccugcug

SEQ ID NO: 3129037 - RNA, 12 nt, Human
cacuccccugcu

SEQ ID NO: 3129038 - RNA, 14 nt, Human
cacuccccugcugg

SEQ ID NO: 3129039 - RNA, 19 nt, Human
caauaaagcagcguuucua

SEQ ID NO: 3129040 - RNA, 13 nt, Human
caagcucugcucc

SEQ ID NO: 3129041 - RNA, 12 nt, Human
caagcuccaagc

SEQ ID NO: 3129042 - RNA, 14 nt, Human
caagcucugcuccu

SEQ ID NO: 3129043 - RNA, 13 nt, Human
caagcugcacccu

SEQ ID NO: 3129044 - RNA, 18 nt, Human
caagcugcacccucaggc

SEQ ID NO: 3129045 - RNA, 14 nt, Human
caagcugcacccuc

SEQ ID NO: 3129046 - RNA, 18 nt, Human
caaggccaaaggaagcac

SEQ ID NO: 3129047 - RNA, 17 nt, Human
caaggccaaaggaagca

SEQ ID NO: 3129048 - RNA, 16 nt, Human
caaggccaaaggaagc

SEQ ID NO: 3129049 - RNA, 15 nt, Human
caaggccaaaggaag

SEQ ID NO: 3129050 - RNA, 17 nt, Human
caagucaagugaaaaag

SEQ ID NO: 3129051 - RNA, 13 nt, Human
caagucaagugaa

SEQ ID NO: 3129052 - RNA, 18 nt, Human
caagcgugagccacugca

SEQ ID NO: 3129053 - RNA, 20 nt, Human
cacaguauuacuucugcuac

SEQ ID NO: 3129054 - RNA, 21 nt, Human
cacaguauuacuucugcuaca

SEQ ID NO: 3129055 - RNA, 19 nt, Human
cacaguauuacuucugcua

SEQ ID NO: 3129056 - RNA, 19 nt, Human
cacaggggaaaagaggagu

SEQ ID NO: 3129057 - RNA, 18 nt, Human
cacaggggaaaagaggag

SEQ ID NO: 3129058 - RNA, 17 nt, Human
cacaggggaaaagagga

SEQ ID NO: 3129059 - RNA, 15 nt, Human
cacacauacacacac

SEQ ID NO: 3129060 - RNA, 21 nt, Human
cacacagugagucgaggacag

SEQ ID NO: 3129061 - RNA, 23 nt, Human
cacacagugagucgaggacaggg

SEQ ID NO: 3129062 - RNA, 20 nt, Human
cacacaugagcaucaggcca

SEQ ID NO: 3129063 - RNA, 18 nt, Human
cacacagugagucgagga

SEQ ID NO: 3129064 - RNA, 20 nt, Human
cacacaguauuacuucugcu

SEQ ID NO: 3129065 - RNA, 23 nt, Human
cacacaguauuacuucugcuaca

SEQ ID NO: 3129066 - RNA, 16 nt, Human
cacacagcucuguccu

SEQ ID NO: 3129067 - RNA, 22 nt, Human
cacagaaaauggaagacagcuc

SEQ ID NO: 3129068 - RNA, 20 nt, Human
cacagaaaauggaagacagc

SEQ ID NO: 3129069 - RNA, 19 nt, Human
cacagaaaauggaagacag

SEQ ID NO: 3129070 - RNA, 18 nt, Human
cacagaaaauggaagaca

SEQ ID NO: 3129071 - RNA, 22 nt, Human
cacacaugagcaucaggccagg

SEQ ID NO: 3129072 - RNA, 21 nt, Human
cacacaugagcaucaggccag

SEQ ID NO: 3129073 - RNA, 11 nt, Human
cacagccucug

SEQ ID NO: 3129074 - RNA, 13 nt, Human
cacagacccugcc

SEQ ID NO: 3129075 - RNA, 19 nt, Human
cacagacauacuaaccagc

SEQ ID NO: 3129076 - RNA, 21 nt, Human
cacagacauacuaaccagcag

SEQ ID NO: 3129077 - RNA, 19 nt, Human
cacagaaaauucuucucca

SEQ ID NO: 3129078 - RNA, 23 nt, Human
cacagaaaauggaagacagcucu

SEQ ID NO: 3129079 - RNA, 18 nt, Human
cacagacauacuaaccag

SEQ ID NO: 3129080 - RNA, 17 nt, Human
cacacagcucuguccug

SEQ ID NO: 3129081 - RNA, 20 nt, Human
cacacagcucuguccuggga

SEQ ID NO: 3129082 - RNA, 14 nt, Human
cacaagagcccagg

SEQ ID NO: 3129083 - RNA, 15 nt, Human
cacaagcuccaagcu

SEQ ID NO: 3129084 - RNA, 14 nt, Human
cacaagcuccaagc

SEQ ID NO: 3129085 - RNA, 13 nt, Human
cacaagcuccaag

SEQ ID NO: 3129086 - RNA, 16 nt, Human
cacaagagcccaggcc

SEQ ID NO: 3129087 - RNA, 21 nt, Human
cacaagcuccaagcucccagg

SEQ ID NO: 3129088 - RNA, 23 nt, Human
cacaagcuccaagcucccaggca

SEQ ID NO: 3129089 - RNA, 17 nt, Human
cacaagcuccaagcucc

SEQ ID NO: 3129090 - RNA, 23 nt, Human
cacaagcugcacccucaggcagg

SEQ ID NO: 3129091 - RNA, 17 nt, Human
cacaagcugcacccuca

SEQ ID NO: 3129092 - RNA, 11 nt, Human
caauggcagcc

SEQ ID NO: 3129093 - RNA, 12 nt, Human
caauggcagccu

SEQ ID NO: 3129094 - RNA, 21 nt, Human
cagauugcaacaggcugggcu

SEQ ID NO: 3129095 - RNA, 13 nt, Human
cagauuucacucu

SEQ ID NO: 3129096 - RNA, 18 nt, Human
cagauuucacucuccuug

SEQ ID NO: 3129097 - RNA, 19 nt, Human
cagauuugaacucuucaau

SEQ ID NO: 3129098 - RNA, 16 nt, Human
cagauuucacucuccu

SEQ ID NO: 3129099 - RNA, 15 nt, Human
cagauuucacucucc

SEQ ID NO: 3129100 - RNA, 18 nt, Human
cagcauauucaggaagcu

SEQ ID NO: 3129101 - RNA, 17 nt, Human
cagcauauucaggaagc

SEQ ID NO: 3129102 - RNA, 16 nt, Human
cagcauauucaggaag

SEQ ID NO: 3129103 - RNA, 17 nt, Human
cagcauagaaguaacuu

SEQ ID NO: 3129104 - RNA, 23 nt, Human
cagccccauucugccugcccagg

SEQ ID NO: 3129105 - RNA, 24 nt, Human
cagccccauucugccugcccaggc

SEQ ID NO: 3129106 - RNA, 19 nt, Human
cagccccauucugccugcc

SEQ ID NO: 3129107 - RNA, 20 nt, Human
cagccccauucugccugccc

SEQ ID NO: 3129108 - RNA, 22 nt, Human
cagccccauucugccugcccag

SEQ ID NO: 3129109 - RNA, 23 nt, Human
cagccgccaugcuccuggcccac

SEQ ID NO: 3129110 - RNA, 13 nt, Human
cagcccuuagcag

SEQ ID NO: 3129111 - RNA, 16 nt, Human
cagcguuucuaugaca

SEQ ID NO: 3129112 - RNA, 14 nt, Human
cagcguuucuauga

SEQ ID NO: 3129113 - RNA, 20 nt, Human
cagagacuccugcaggcagc

SEQ ID NO: 3129114 - RNA, 22 nt, Human
cagagacuccugcaggcagcca

SEQ ID NO: 3129115 - RNA, 21 nt, Human
cagagacuccugcaggcagcc

SEQ ID NO: 3129116 - RNA, 19 nt, Human
cagagacuccugcaggcag

SEQ ID NO: 3129117 - RNA, 14 nt, Human
cagagccugcaguu

SEQ ID NO: 3129118 - RNA, 22 nt, Human
cagagagggugggagugggccc

SEQ ID NO: 3129119 - RNA, 20 nt, Human
cagagagggugggagugggc

SEQ ID NO: 3129120 - RNA, 13 nt, Human
cagagaggguggg

SEQ ID NO: 3129121 - RNA, 16 nt, Human
cagagagggugggagu

SEQ ID NO: 3129122 - RNA, 22 nt, Human
cagagcuacacaggggaaaaga

SEQ ID NO: 3129123 - RNA, 17 nt, Human
cagagcuacacagggga

SEQ ID NO: 3129124 - RNA, 23 nt, Human
cagauacaggaaaagcugcugac

SEQ ID NO: 3129125 - RNA, 13 nt, Human
caggaccucaggu

SEQ ID NO: 3129126 - RNA, 13 nt, Human
caggaccagggau

SEQ ID NO: 3129127 - RNA, 16 nt, Human
caggccaggcccucug

SEQ ID NO: 3129128 - RNA, 15 nt, Human
caggccaggcccucu

SEQ ID NO: 3129129 - RNA, 14 nt, Human
caggccaggcccuc

SEQ ID NO: 3129130 - RNA, 13 nt, Human
caggccaggcccu

SEQ ID NO: 3129131 - RNA, 17 nt, Human
caggcaaugcuggcugu

SEQ ID NO: 3129132 - RNA, 21 nt, Human
caggcaaugcuggcuguuggc

SEQ ID NO: 3129133 - RNA, 19 nt, Human
caggcaaugcuggcuguug

SEQ ID NO: 3129134 - RNA, 20 nt, Human
caggcaaugcuggcuguugg

SEQ ID NO: 3129135 - RNA, 13 nt, Human
caggaggccagcc

SEQ ID NO: 3129136 - RNA, 12 nt, Human
caggaggccagc

SEQ ID NO: 3129137 - RNA, 15 nt, Human
caggccagcugcuug

SEQ ID NO: 3129138 - RNA, 13 nt, Human
caggccagcugcu

SEQ ID NO: 3129139 - RNA, 23 nt, Human
caggccagagggagugacagagg

SEQ ID NO: 3129140 - RNA, 23 nt, Human
caggaaaggcuccaggagcagcc

SEQ ID NO: 3129141 - RNA, 22 nt, Human
caggaaaggcuccaggagcagc

SEQ ID NO: 3129142 - RNA, 21 nt, Human
caggaaaggcuccaggagcag

SEQ ID NO: 3129143 - RNA, 19 nt, Human
caggaaaagcugcugacag

SEQ ID NO: 3129144 - RNA, 20 nt, Human
caggaaaagcugcugacagu

SEQ ID NO: 3129145 - RNA, 20 nt, Human
caggaaaggcuccaggagca

SEQ ID NO: 3129146 - RNA, 15 nt, Human
cagcuguucagcugg

SEQ ID NO: 3129147 - RNA, 16 nt, Human
cagcuguucagcuggu

SEQ ID NO: 3129148 - RNA, 15 nt, Human
caggcuggcgugcag

SEQ ID NO: 3129149 - RNA, 19 nt, Human
caggcugggagagccuucc

SEQ ID NO: 3129150 - RNA, 18 nt, Human
caggcugggagagccuuc

SEQ ID NO: 3129151 - RNA, 16 nt, Human
caggcugggagagccu

SEQ ID NO: 3129152 - RNA, 17 nt, Human
caggcuggcgugcagug

SEQ ID NO: 3129153 - RNA, 23 nt, Human
caggccugggggcugggcagagg

SEQ ID NO: 3129154 - RNA, 18 nt, Human
caggcuggcgugcagugg

SEQ ID NO: 3129155 - RNA, 19 nt, Human
caggcuggcgugcaguggu

SEQ ID NO: 3129156 - RNA, 22 nt, Human
caggccugggggcugggcagag

SEQ ID NO: 3129157 - RNA, 20 nt, Human
caggccugggggcugggcag

SEQ ID NO: 3129158 - RNA, 12 nt, Human
cagggcucagcg

SEQ ID NO: 3129159 - RNA, 15 nt, Human
cagggcucagcgggg

SEQ ID NO: 3129160 - RNA, 16 nt, Human
cagggagggcuucugc

SEQ ID NO: 3129161 - RNA, 15 nt, Human
caggcugggagagcc

SEQ ID NO: 3129162 - RNA, 14 nt, Human
caggcugggcuuca

SEQ ID NO: 3129163 - RNA, 15 nt, Human
caggguuggccccug

SEQ ID NO: 3129164 - RNA, 16 nt, Human
caggguuggccccugc

SEQ ID NO: 3129165 - RNA, 21 nt, Human
cagggucucuaccauccccug

SEQ ID NO: 3129166 - RNA, 22 nt, Human
cagggucucacucugucgccca

SEQ ID NO: 3129167 - RNA, 23 nt, Human
cagggucucacucugucgcccag

SEQ ID NO: 3129168 - RNA, 23 nt, Human
cagguuuuuggucugacccacug

SEQ ID NO: 3129169 - RNA, 13 nt, Human
caggugcugccau

SEQ ID NO: 3129170 - RNA, 14 nt, Human
caggugcugccauc

SEQ ID NO: 3129171 - RNA, 14 nt, Human
caggguuggccccu

SEQ ID NO: 3129172 - RNA, 17 nt, Human
caggguuggccccugcc

SEQ ID NO: 3129173 - RNA, 21 nt, Human
caggguuggccccugcccggc

SEQ ID NO: 3129174 - RNA, 18 nt, Human
caguaaaugggggugcau

SEQ ID NO: 3129175 - RNA, 19 nt, Human
caguauuacuucugcuaca

SEQ ID NO: 3129176 - RNA, 19 nt, Human
caguaaaugggggugcauu

SEQ ID NO: 3129177 - RNA, 14 nt, Human
cagucaccccggcc

SEQ ID NO: 3129178 - RNA, 17 nt, Human
cagucaccccggccacc

SEQ ID NO: 3129179 - RNA, 16 nt, Human
cagucaccccggccac

SEQ ID NO: 3129180 - RNA, 20 nt, Human
ccaauguucucucuucucca

SEQ ID NO: 3129181 - RNA, 23 nt, Human
ccaaugcacuuuguucuggcucu

SEQ ID NO: 3129182 - RNA, 22 nt, Human
ccaaugcacuuuguucuggcuc

SEQ ID NO: 3129183 - RNA, 20 nt, Human
ccaaugcacuuuguucuggc

SEQ ID NO: 3129184 - RNA, 20 nt, Human
ccaagcuggucccacucagu

SEQ ID NO: 3129185 - RNA, 14 nt, Human
ccaaagugcuggga

SEQ ID NO: 3129186 - RNA, 16 nt, Human
ccaacgucugugccau

SEQ ID NO: 3129187 - RNA, 16 nt, Human
ccaaaucauaguggcu

SEQ ID NO: 3129188 - RNA, 13 nt, Human
ccaccuuggcuca

SEQ ID NO: 3129189 - RNA, 14 nt, Human
ccaccuuggcucaa

SEQ ID NO: 3129190 - RNA, 15 nt, Human
ccaccuuggcucaag

SEQ ID NO: 3129191 - RNA, 13 nt, Human
ccaccgcagacag

SEQ ID NO: 3129192 - RNA, 18 nt, Human
ccaccgcagacaggacca

SEQ ID NO: 3129193 - RNA, 13 nt, Human
ccacccugcucuc

SEQ ID NO: 3129194 - RNA, 15 nt, Human
ccaccaucaagccac

SEQ ID NO: 3129195 - RNA, 20 nt, Human
ccaccaucaagccaccaaca

SEQ ID NO: 3129196 - RNA, 17 nt, Human
ccaccgcagacaggacc

SEQ ID NO: 3129197 - RNA, 14 nt, Human
ccaccgcagacagg

SEQ ID NO: 3129198 - RNA, 17 nt, Human
ccaccaucaagccacca

SEQ ID NO: 3129199 - RNA, 16 nt, Human
ccaccaucaagccacc

SEQ ID NO: 3129200 - RNA, 18 nt, Human
cauuaucuagauacugua

SEQ ID NO: 3129201 - RNA, 16 nt, Human
cauucuccuuguguua

SEQ ID NO: 3129202 - RNA, 21 nt, Human
cauucuccaccugccagggac

SEQ ID NO: 3129203 - RNA, 22 nt, Human
cauggccucuucagaucucuaa

SEQ ID NO: 3129204 - RNA, 22 nt, Human
cauggcugccaaugggagcuca

SEQ ID NO: 3129205 - RNA, 17 nt, Human
cauggcugccaauggga

SEQ ID NO: 3129206 - RNA, 15 nt, Human
cauguucucugagga

SEQ ID NO: 3129207 - RNA, 12 nt, Human
cauuaucuagau

SEQ ID NO: 3129208 - RNA, 16 nt, Human
cauuaucuagauacug

SEQ ID NO: 3129209 - RNA, 17 nt, Human
cauuaucuagauacugu

SEQ ID NO: 3129210 - RNA, 18 nt, Human
cauugcugggcuugucug

SEQ ID NO: 3129211 - RNA, 14 nt, Human
cauugcggacagcc

SEQ ID NO: 3129212 - RNA, 15 nt, Human
cauugcggacagcca

SEQ ID NO: 3129213 - RNA, 17 nt, Human
cauugcggacagccacg

SEQ ID NO: 3129214 - RNA, 21 nt, Human
cauugcggacagccacggcca

SEQ ID NO: 3129215 - RNA, 21 nt, Human
cauuuggugguuucagaaaug

SEQ ID NO: 3129216 - RNA, 22 nt, Human
cauuuggugguuucagaaaugu

SEQ ID NO: 3129217 - RNA, 23 nt, Human
cauuuggugguuucagaaaugug

SEQ ID NO: 3129218 - RNA, 23 nt, Human
cauuuuucuuagggaaggauaca

SEQ ID NO: 3129219 - RNA, 17 nt, Human
ccaaaaaaugcuugcuu

SEQ ID NO: 3129220 - RNA, 17 nt, Human
ccaaaacucuccucugc

SEQ ID NO: 3129221 - RNA, 16 nt, Human
cauuuauucugcucac

SEQ ID NO: 3129222 - RNA, 15 nt, Human
cauuuauucugcuca

SEQ ID NO: 3129223 - RNA, 18 nt, Human
cagucaccccggccaccu

SEQ ID NO: 3129224 - RNA, 20 nt, Human
cauauuaccacagacauacu

SEQ ID NO: 3129225 - RNA, 21 nt, Human
cauauuaccacagacauacua

SEQ ID NO: 3129226 - RNA, 17 nt, Human
cauauuaccacagacau

SEQ ID NO: 3129227 - RNA, 16 nt, Human
cauauuaccacagaca

SEQ ID NO: 3129228 - RNA, 21 nt, Human
cauaaugcgugcauaccacuu

SEQ ID NO: 3129229 - RNA, 15 nt, Human
cauacaauuccaaac

SEQ ID NO: 3129230 - RNA, 14 nt, Human
cauaaugcgugcau

SEQ ID NO: 3129231 - RNA, 17 nt, Human
cauaaugcgugcauacc

SEQ ID NO: 3129232 - RNA, 22 nt, Human
caucuuagguuggcaaaaaggc

SEQ ID NO: 3129233 - RNA, 21 nt, Human
caucuuagguuggcaaaaagg

SEQ ID NO: 3129234 - RNA, 19 nt, Human
caucugugaaaggaaagag

SEQ ID NO: 3129235 - RNA, 18 nt, Human
caucugugaaaggaaaga

SEQ ID NO: 3129236 - RNA, 23 nt, Human
cauccuggcacccggccccugcu

SEQ ID NO: 3129237 - RNA, 13 nt, Human
caucccagcccca

SEQ ID NO: 3129238 - RNA, 14 nt, Human
caucccagccccaa

SEQ ID NO: 3129239 - RNA, 16 nt, Human
caucccagccccaaug

SEQ ID NO: 3129240 - RNA, 12 nt, Human
caucccagcccc

SEQ ID NO: 3129241 - RNA, 23 nt, Human
caucaggccaggcccucugccca

SEQ ID NO: 3129242 - RNA, 22 nt, Human
caucaggccaggcccucugccc

SEQ ID NO: 3129243 - RNA, 21 nt, Human
caucaggccaggcccucugcc

SEQ ID NO: 3129244 - RNA, 20 nt, Human
caucaggccaggcccucugc

SEQ ID NO: 3129245 - RNA, 17 nt, Human
caucagcacgauuucug

SEQ ID NO: 3129246 - RNA, 18 nt, Human
caucagcacgauuucugu

SEQ ID NO: 3129247 - RNA, 13 nt, Human
caucaggccaggc

SEQ ID NO: 3129248 - RNA, 18 nt, Human
caugcugcccugugagua

SEQ ID NO: 3129249 - RNA, 16 nt, Human
caugcugcccugugag

SEQ ID NO: 3129250 - RNA, 22 nt, Human
caugcaaggucauuuuuuuuaa

SEQ ID NO: 3129251 - RNA, 15 nt, Human
caugcaaggucauuu

SEQ ID NO: 3129252 - RNA, 17 nt, Human
caugcaaggucauuuuu

SEQ ID NO: 3129253 - RNA, 18 nt, Human
caugcaaggucauuuuuu

SEQ ID NO: 3129254 - RNA, 18 nt, Human
caugacacgaauauugcu

SEQ ID NO: 3129255 - RNA, 17 nt, Human
caugacacgaauauugc

SEQ ID NO: 3129256 - RNA, 14 nt, Human
caugacacgaauau

SEQ ID NO: 3129257 - RNA, 19 nt, Human
cugagacucgcgacaaugc

SEQ ID NO: 3129258 - RNA, 17 nt, Human
cugagacucgcgacaau

SEQ ID NO: 3129259 - RNA, 15 nt, Human
cugcauguuugugau

SEQ ID NO: 3129260 - RNA, 13 nt, Human
cugcauguuacau

SEQ ID NO: 3129261 - RNA, 20 nt, Human
cugcauuuaaaagauacagu

SEQ ID NO: 3129262 - RNA, 22 nt, Human
cugcauuuaaaagauacaguua

SEQ ID NO: 3129263 - RNA, 18 nt, Human
cugcauuuaaaagauaca

SEQ ID NO: 3129264 - RNA, 15 nt, Human
cugccaaugggagcu

SEQ ID NO: 3129265 - RNA, 12 nt, Human
cugcccugugag

SEQ ID NO: 3129266 - RNA, 18 nt, Human
cugcccugugggccccca

SEQ ID NO: 3129267 - RNA, 16 nt, Human
cugcccugugggcccc

SEQ ID NO: 3129268 - RNA, 15 nt, Human
cugcccugugggccc

SEQ ID NO: 3129269 - RNA, 22 nt, Human
cugccccucaacucuccuccag

SEQ ID NO: 3129270 - RNA, 14 nt, Human
cugccccucaacuc

SEQ ID NO: 3129271 - RNA, 11 nt, Human
cugccagggac

SEQ ID NO: 3129272 - RNA, 15 nt, Human
cugccagggacagag

SEQ ID NO: 3129273 - RNA, 12 nt, Human
cugccagggaca

SEQ ID NO: 3129274 - RNA, 20 nt, Human
cugccauauucuguuggcca

SEQ ID NO: 3129275 - RNA, 21 nt, Human
cugccauauucuguuggccag

SEQ ID NO: 3129276 - RNA, 22 nt, Human
cugccauauucuguuggccagu

SEQ ID NO: 3129277 - RNA, 23 nt, Human
cugccauauucuguuggccagug

SEQ ID NO: 3129278 - RNA, 13 nt, Human
cugcuuaacuuca

SEQ ID NO: 3129279 - RNA, 13 nt, Human
cugcuucagccuc

SEQ ID NO: 3129280 - RNA, 15 nt, Human
cugcuuaacuucaca

SEQ ID NO: 3129281 - RNA, 17 nt, Human
cugcuuaacuucacaua

SEQ ID NO: 3129282 - RNA, 14 nt, Human
cugcuucagccucc

SEQ ID NO: 3129283 - RNA, 16 nt, Human
cugcuucagccucccg

SEQ ID NO: 3129284 - RNA, 22 nt, Human
cugcuuuuuaaagaaugcucuu

SEQ ID NO: 3129285 - RNA, 17 nt, Human
cuggaacacuaaugagg

SEQ ID NO: 3129286 - RNA, 16 nt, Human
cuggaaauauuaagaa

SEQ ID NO: 3129287 - RNA, 19 nt, Human
cugcuuuuuaaagaaugcu

SEQ ID NO: 3129288 - RNA, 21 nt, Human
cugcugacagacacaggcccg

SEQ ID NO: 3129289 - RNA, 23 nt, Human
cugcugacagacacaggcccggc

SEQ ID NO: 3129290 - RNA, 15 nt, Human
cugcugacagacaca

SEQ ID NO: 3129291 - RNA, 18 nt, Human
cugcugacagacacaggc

SEQ ID NO: 3129292 - RNA, 19 nt, Human
cugcugacagacacaggcc

SEQ ID NO: 3129293 - RNA, 20 nt, Human
cugcugacagacacaggccc

SEQ ID NO: 3129294 - RNA, 23 nt, Human
cugccugggaucccucauccuca

SEQ ID NO: 3129295 - RNA, 14 nt, Human
cugccuguucagcu

SEQ ID NO: 3129296 - RNA, 15 nt, Human
cugccucgaacuggc

SEQ ID NO: 3129297 - RNA, 17 nt, Human
cugccucgaacuggcug

SEQ ID NO: 3129298 - RNA, 18 nt, Human
cugccucgaacuggcugc

SEQ ID NO: 3129299 - RNA, 22 nt, Human
cugccugggaucccucauccuc

SEQ ID NO: 3129300 - RNA, 16 nt, Human
cugcuaauuccccaga

SEQ ID NO: 3129301 - RNA, 19 nt, Human
cugccuguugggccaggag

SEQ ID NO: 3129302 - RNA, 18 nt, Human
cugccuguugggccagga

SEQ ID NO: 3129303 - RNA, 14 nt, Human
cugccuguugggcc

SEQ ID NO: 3129304 - RNA, 16 nt, Human
cugccuguugggccag

SEQ ID NO: 3129305 - RNA, 15 nt, Human
cugcuacagagcaga

SEQ ID NO: 3129306 - RNA, 14 nt, Human
cugcccugugggcc

SEQ ID NO: 3129307 - RNA, 18 nt, Human
cugucagccauuccuguu

SEQ ID NO: 3129308 - RNA, 17 nt, Human
cugucauuugagcaggg

SEQ ID NO: 3129309 - RNA, 18 nt, Human
cugucauuugagcagggc

SEQ ID NO: 3129310 - RNA, 16 nt, Human
cugucauuugagcagg

SEQ ID NO: 3129311 - RNA, 18 nt, Human
cuguaggaagguuaaugu

SEQ ID NO: 3129312 - RNA, 21 nt, Human
cuguaggaagguuaauguuca

SEQ ID NO: 3129313 - RNA, 13 nt, Human
cugucgcccaguc

SEQ ID NO: 3129314 - RNA, 15 nt, Human
cugugaagagaacca

SEQ ID NO: 3129315 - RNA, 14 nt, Human
cugugcucuggaca

SEQ ID NO: 3129316 - RNA, 19 nt, Human
cugugcucuggacaggcau

SEQ ID NO: 3129317 - RNA, 21 nt, Human
cuggccccucagggucccugg

SEQ ID NO: 3129318 - RNA, 20 nt, Human
cuggccccucagggucccug

SEQ ID NO: 3129319 - RNA, 18 nt, Human
cuggccccucaggguccc

SEQ ID NO: 3129320 - RNA, 17 nt, Human
cuggccccucagggucc

SEQ ID NO: 3129321 - RNA, 11 nt, Human
cugggacacag

SEQ ID NO: 3129322 - RNA, 12 nt, Human
cugggacacagu

SEQ ID NO: 3129323 - RNA, 13 nt, Human
cugggacacaguu

SEQ ID NO: 3129324 - RNA, 13 nt, Human
cuggccccucagg

SEQ ID NO: 3129325 - RNA, 14 nt, Human
cuggcagcucagag

SEQ ID NO: 3129326 - RNA, 13 nt, Human
cuggcagcucaga

SEQ ID NO: 3129327 - RNA, 12 nt, Human
cuggcagcucag

SEQ ID NO: 3129328 - RNA, 17 nt, Human
cugggcagaaggaagac

SEQ ID NO: 3129329 - RNA, 18 nt, Human
cugggcagaaggaagacu

SEQ ID NO: 3129330 - RNA, 16 nt, Human
cugggcagaaggaaga

SEQ ID NO: 3129331 - RNA, 23 nt, Human
cuggugacuuuccucuuuggucu

SEQ ID NO: 3129332 - RNA, 16 nt, Human
cuggguguggcgcagc

SEQ ID NO: 3129333 - RNA, 17 nt, Human
cuggguguggcgcagca

SEQ ID NO: 3129334 - RNA, 22 nt, Human
cuggguggcaccagcagccugg

SEQ ID NO: 3129335 - RNA, 23 nt, Human
cuggguggcaccagcagccugga

SEQ ID NO: 3129336 - RNA, 14 nt, Human
cuggguucacugca

SEQ ID NO: 3129337 - RNA, 15 nt, Human
cuggugacuuuccuc

SEQ ID NO: 3129338 - RNA, 21 nt, Human
cuggugacuuuccucuuuggu

SEQ ID NO: 3129339 - RNA, 20 nt, Human
cuggugacuuuccucuuugg

SEQ ID NO: 3129340 - RNA, 13 nt, Human
cuuuuauaaacuu

SEQ ID NO: 3129341 - RNA, 17 nt, Human
cuuugggccuggcuccc

SEQ ID NO: 3129342 - RNA, 17 nt, Human
cuuucuacccagcgagc

SEQ ID NO: 3129343 - RNA, 15 nt, Human
cuuucuagccagagg

SEQ ID NO: 3129344 - RNA, 16 nt, Human
cuuucuagccagagga

SEQ ID NO: 3129345 - RNA, 20 nt, Human
cuuucagccaagaauucuua

SEQ ID NO: 3129346 - RNA, 23 nt, Human
cuuucagccaagaauucuuaaau

SEQ ID NO: 3129347 - RNA, 23 nt, Human
cuuucaauaggaaaaacugauuu

SEQ ID NO: 3129348 - RNA, 22 nt, Human
cuuuccugaggcugggcucccu

SEQ ID NO: 3129349 - RNA, 23 nt, Human
cuuuugcccacacuugggagcaa

SEQ ID NO: 3129350 - RNA, 18 nt, Human
cuuuugucuaugggacuc

SEQ ID NO: 3129351 - RNA, 23 nt, Human
cuuuuuuggcugcugaaggcucg

SEQ ID NO: 3129352 - RNA, 12 nt, Human
cuuuugugcauu

SEQ ID NO: 3129353 - RNA, 13 nt, Human
cuuuugugcauua

SEQ ID NO: 3129354 - RNA, 18 nt, Human
gaaaagaaaaaugagccu

SEQ ID NO: 3129355 - RNA, 21 nt, Human
gaaaauggaagacagcucuua

SEQ ID NO: 3129356 - RNA, 14 nt, Human
gaaaaacugauuuu

SEQ ID NO: 3129357 - RNA, 23 nt, Human
gaaaauggacguguuaugacucc

SEQ ID NO: 3129358 - RNA, 19 nt, Human
gaaaauggacguguuauga

SEQ ID NO: 3129359 - RNA, 15 nt, Human
gaaaauguaugugua

SEQ ID NO: 3129360 - RNA, 20 nt, Human
gaaagacuaucuaaauguug

SEQ ID NO: 3129361 - RNA, 21 nt, Human
gaaaggcuccaggagcagcca

SEQ ID NO: 3129362 - RNA, 22 nt, Human
gaaaggcuccaggagcagccac

SEQ ID NO: 3129363 - RNA, 20 nt, Human
gaaaggcuccaggagcagcc

SEQ ID NO: 3129364 - RNA, 19 nt, Human
gaaaucaccgaaaacgugg

SEQ ID NO: 3129365 - RNA, 19 nt, Human
gaaagggacuuggaagcuc

SEQ ID NO: 3129366 - RNA, 20 nt, Human
gaaagggacgcuacccggga

SEQ ID NO: 3129367 - RNA, 22 nt, Human
gaaagggacuuggaagcuccgc

SEQ ID NO: 3129368 - RNA, 16 nt, Human
cuuauggaacacucug

SEQ ID NO: 3129369 - RNA, 13 nt, Human
cuuauggaacacu

SEQ ID NO: 3129370 - RNA, 20 nt, Human
cuuauggaacacucugagac

SEQ ID NO: 3129371 - RNA, 19 nt, Human
cuuauggaacacucugaga

SEQ ID NO: 3129372 - RNA, 17 nt, Human
cuuauggaacacucuga

SEQ ID NO: 3129373 - RNA, 22 nt, Human
cuucaccuuuguccccaccgca

SEQ ID NO: 3129374 - RNA, 19 nt, Human
cuucacggaagagccuugc

SEQ ID NO: 3129375 - RNA, 15 nt, Human
cuucacggaagagcc

SEQ ID NO: 3129376 - RNA, 21 nt, Human
cuucaccuuuguccccaccgc

SEQ ID NO: 3129377 - RNA, 12 nt, Human
cugugcugaguc

SEQ ID NO: 3129378 - RNA, 14 nt, Human
cugugcugagucug

SEQ ID NO: 3129379 - RNA, 23 nt, Human
cuucccaccucucucacuccuug

SEQ ID NO: 3129380 - RNA, 21 nt, Human
cuucccaccucucucacuccu

SEQ ID NO: 3129381 - RNA, 11 nt, Human
cuucccaccuc

SEQ ID NO: 3129382 - RNA, 23 nt, Human
cuuccagugaggcucugcccuug

SEQ ID NO: 3129383 - RNA, 22 nt, Human
cuuccagugaggcucugcccuu

SEQ ID NO: 3129384 - RNA, 21 nt, Human
cuuccagugaggcucugcccu

SEQ ID NO: 3129385 - RNA, 20 nt, Human
cuucagagacuccugcaggc

SEQ ID NO: 3129386 - RNA, 19 nt, Human
cuucagagacuccugcagg

SEQ ID NO: 3129387 - RNA, 18 nt, Human
cuucagagacuccugcag

SEQ ID NO: 3129388 - RNA, 17 nt, Human
cuucagagacuccugca

SEQ ID NO: 3129389 - RNA, 16 nt, Human
cuugaagacuuuucuu

SEQ ID NO: 3129390 - RNA, 18 nt, Human
cuugaauuguaaggaaug

SEQ ID NO: 3129391 - RNA, 19 nt, Human
cuugaauuguaaggaauga

SEQ ID NO: 3129392 - RNA, 14 nt, Human
cuugacagggcaca

SEQ ID NO: 3129393 - RNA, 15 nt, Human
cuugacagggcacac

SEQ ID NO: 3129394 - RNA, 13 nt, Human
cuugacagggcac

SEQ ID NO: 3129395 - RNA, 12 nt, Human
cuuggcgcugcc

SEQ ID NO: 3129396 - RNA, 17 nt, Human
cuuggcgcugccccugg

SEQ ID NO: 3129397 - RNA, 14 nt, Human
cuuggcgcugcccc

SEQ ID NO: 3129398 - RNA, 20 nt, Human
cuucugacccaugcugcccu

SEQ ID NO: 3129399 - RNA, 22 nt, Human
cuucugacccaugcugcccugu

SEQ ID NO: 3129400 - RNA, 21 nt, Human
cuucugacccaugcugcccug

SEQ ID NO: 3129401 - RNA, 23 nt, Human
cuucuucagagacuccugcaggc

SEQ ID NO: 3129402 - RNA, 18 nt, Human
cuuccucccucccucuuu

SEQ ID NO: 3129403 - RNA, 17 nt, Human
cuuccugcaacaccuug

SEQ ID NO: 3129404 - RNA, 13 nt, Human
gagauuuacaacu

SEQ ID NO: 3129405 - RNA, 18 nt, Human
gagauugcaccacugcac

SEQ ID NO: 3129406 - RNA, 14 nt, Human
gagaggcauccagu

SEQ ID NO: 3129407 - RNA, 17 nt, Human
gagacuccugcaggcag

SEQ ID NO: 3129408 - RNA, 16 nt, Human
gagacuccugcaggca

SEQ ID NO: 3129409 - RNA, 15 nt, Human
gagacuccugcaggc

SEQ ID NO: 3129410 - RNA, 14 nt, Human
gagacuccugcagg

SEQ ID NO: 3129411 - RNA, 21 nt, Human
gagaugaugccaugggcccuc

SEQ ID NO: 3129412 - RNA, 22 nt, Human
gagaggcauccaguaucuugaa

SEQ ID NO: 3129413 - RNA, 18 nt, Human
gagcugggugucaagagg

SEQ ID NO: 3129414 - RNA, 17 nt, Human
gagcggagaaaggaagg

SEQ ID NO: 3129415 - RNA, 21 nt, Human
gagcggagaaaggaagggcug

SEQ ID NO: 3129416 - RNA, 18 nt, Human
gagcggagaaaggaaggg

SEQ ID NO: 3129417 - RNA, 20 nt, Human
gagcugccuguucagcucca

SEQ ID NO: 3129418 - RNA, 21 nt, Human
gagcugccuguucagcuccag

SEQ ID NO: 3129419 - RNA, 22 nt, Human
gagcugccuguucagcuccagc

SEQ ID NO: 3129420 - RNA, 22 nt, Human
gagccuugaacuuugaccucug

SEQ ID NO: 3129421 - RNA, 19 nt, Human
gagccuugaacuuugaccu

SEQ ID NO: 3129422 - RNA, 17 nt, Human
gagccuuccaggggugg

SEQ ID NO: 3129423 - RNA, 16 nt, Human
gagccuuccaggggug

SEQ ID NO: 3129424 - RNA, 15 nt, Human
gagccuuccaggggu

SEQ ID NO: 3129425 - RNA, 14 nt, Human
gagccuuccagggg

SEQ ID NO: 3129426 - RNA, 14 nt, Human
gagcagggcucagc

SEQ ID NO: 3129427 - RNA, 12 nt, Human
gagcaucaggcc

SEQ ID NO: 3129428 - RNA, 21 nt, Human
gagcaugccuggauggggcug

SEQ ID NO: 3129429 - RNA, 22 nt, Human
gagcaugccuggauggggcugc

SEQ ID NO: 3129430 - RNA, 15 nt, Human
gagaagcggcuggca

SEQ ID NO: 3129431 - RNA, 13 nt, Human
gagaagcggcugg

SEQ ID NO: 3129432 - RNA, 12 nt, Human
gagaaggaagcc

SEQ ID NO: 3129433 - RNA, 23 nt, Human
gacuuuucuguccgagcuuugaa

SEQ ID NO: 3129434 - RNA, 21 nt, Human
gacuuuucuuuguggcuuccu

SEQ ID NO: 3129435 - RNA, 23 nt, Human
gacuuuucuuucagccaagaauu

SEQ ID NO: 3129436 - RNA, 22 nt, Human
gacuaucuaaauguugaaagau

SEQ ID NO: 3129437 - RNA, 12 nt, Human
gacucugucuca

SEQ ID NO: 3129438 - RNA, 15 nt, Human
gaagcucagggccug

SEQ ID NO: 3129439 - RNA, 14 nt, Human
gaagcucagggccu

SEQ ID NO: 3129440 - RNA, 23 nt, Human
gaagcucagggccuggcucaggu

SEQ ID NO: 3129441 - RNA, 21 nt, Human
gaagcucagggccuggcucag

SEQ ID NO: 3129442 - RNA, 20 nt, Human
gaagcucagggccuggcuca

SEQ ID NO: 3129443 - RNA, 19 nt, Human
gaagcucagggccuggcuc

SEQ ID NO: 3129444 - RNA, 18 nt, Human
gaagcucagggccuggcu

SEQ ID NO: 3129445 - RNA, 17 nt, Human
gaagcucagggccuggc

SEQ ID NO: 3129446 - RNA, 16 nt, Human
gaagcucagggccugg

SEQ ID NO: 3129447 - RNA, 17 nt, Human
gaaggcucgagcaugcc

SEQ ID NO: 3129448 - RNA, 16 nt, Human
gaaggcucgagcaugc

SEQ ID NO: 3129449 - RNA, 20 nt, Human
gaagucuuuguacagacaac

SEQ ID NO: 3129450 - RNA, 19 nt, Human
gaagucuuuguacagacaa

SEQ ID NO: 3129451 - RNA, 18 nt, Human
gaagucuuuguacagaca

SEQ ID NO: 3129452 - RNA, 22 nt, Human
gaaugaaugucagugugacuga

SEQ ID NO: 3129453 - RNA, 18 nt, Human
gaaugaaugucaguguga

SEQ ID NO: 3129454 - RNA, 14 nt, Human
gaaugaaugucagu

SEQ ID NO: 3129455 - RNA, 11 nt, Human
gaaugaauguc

SEQ ID NO: 3129456 - RNA, 21 nt, Human
gacacacagcucuguccuggg

SEQ ID NO: 3129457 - RNA, 21 nt, Human
gaauuuugugcccccauguaa

SEQ ID NO: 3129458 - RNA, 23 nt, Human
gaauuuuggcugugucucccuuc

SEQ ID NO: 3129459 - RNA, 20 nt, Human
gaauuuugugcccccaugua

SEQ ID NO: 3129460 - RNA, 14 nt, Human
gacacacagcucug

SEQ ID NO: 3129461 - RNA, 13 nt, Human
gacacacagcucu

SEQ ID NO: 3129462 - RNA, 15 nt, Human
gacacacagcucugu

SEQ ID NO: 3129463 - RNA, 17 nt, Human
gacacacagcucugucc

SEQ ID NO: 3129464 - RNA, 18 nt, Human
gacacacagcucuguccu

SEQ ID NO: 3129465 - RNA, 19 nt, Human
gacacacagcucuguccug

SEQ ID NO: 3129466 - RNA, 19 nt, Human
gaauuuuggcugugucucc

SEQ ID NO: 3129467 - RNA, 13 nt, Human
gacacugaugggc

SEQ ID NO: 3129468 - RNA, 15 nt, Human
gacacugaugggcaa

SEQ ID NO: 3129469 - RNA, 23 nt, Human
gacagcccgggcucugccuccca

SEQ ID NO: 3129470 - RNA, 22 nt, Human
gacagcccgggcucugccuccc

SEQ ID NO: 3129471 - RNA, 21 nt, Human
gacagcccgggcucugccucc

SEQ ID NO: 3129472 - RNA, 20 nt, Human
gacagcccgggcucugccuc

SEQ ID NO: 3129473 - RNA, 11 nt, Human
gacagcuccuu

SEQ ID NO: 3129474 - RNA, 20 nt, Human
gacaggguuuugccauguug

SEQ ID NO: 3129475 - RNA, 22 nt, Human
gacaggguuuugccauguuggc

SEQ ID NO: 3129476 - RNA, 16 nt, Human
gcauaccacuuuuguu

SEQ ID NO: 3129477 - RNA, 17 nt, Human
gcauaccacuuuuguuc

SEQ ID NO: 3129478 - RNA, 20 nt, Human
gcauaccacuuuuguucuug

SEQ ID NO: 3129479 - RNA, 18 nt, Human
gcaggcucucaggccagc

SEQ ID NO: 3129480 - RNA, 23 nt, Human
gcaggcucucaggccagcugcuu

SEQ ID NO: 3129481 - RNA, 17 nt, Human
gcagcugcgguccaccc

SEQ ID NO: 3129482 - RNA, 22 nt, Human
gcaggcucucaggccagcugcu

SEQ ID NO: 3129483 - RNA, 20 nt, Human
gcaggcucucaggccagcug

SEQ ID NO: 3129484 - RNA, 18 nt, Human
gcagcccaccccucaaca

SEQ ID NO: 3129485 - RNA, 14 nt, Human
gcagccaggccaca

SEQ ID NO: 3129486 - RNA, 13 nt, Human
gcagccaggccac

SEQ ID NO: 3129487 - RNA, 16 nt, Human
gcagccacauuccuga

SEQ ID NO: 3129488 - RNA, 15 nt, Human
gcagccacauuccug

SEQ ID NO: 3129489 - RNA, 14 nt, Human
gcagccacuauugu

SEQ ID NO: 3129490 - RNA, 12 nt, Human
gcagccaggcca

SEQ ID NO: 3129491 - RNA, 12 nt, Human
gcacugacauug

SEQ ID NO: 3129492 - RNA, 19 nt, Human
gcagagcaccuuagacagu

SEQ ID NO: 3129493 - RNA, 23 nt, Human
gcagagcaccuuagacagucccu

SEQ ID NO: 3129494 - RNA, 22 nt, Human
gcagagcaccuuagacaguccc

SEQ ID NO: 3129495 - RNA, 15 nt, Human
gcagagcagagacca

SEQ ID NO: 3129496 - RNA, 14 nt, Human
gcagagcagagacc

SEQ ID NO: 3129497 - RNA, 12 nt, Human
gcagagcagaga

SEQ ID NO: 3129498 - RNA, 24 nt, Human
gcagagcaccuuagacagucccug

SEQ ID NO: 3129499 - RNA, 20 nt, Human
gcagagcagagaccaucccu

SEQ ID NO: 3129500 - RNA, 19 nt, Human
gcagagcagagaccauccc

SEQ ID NO: 3129501 - RNA, 13 nt, Human
gcaagugagagcu

SEQ ID NO: 3129502 - RNA, 21 nt, Human
gcaauaaagcagcguuucuau

SEQ ID NO: 3129503 - RNA, 22 nt, Human
gcacaagcuccaagcucccagg

SEQ ID NO: 3129504 - RNA, 21 nt, Human
gcacaagcuccaagcucccag

SEQ ID NO: 3129505 - RNA, 23 nt, Human
gcacaagcuccaagcucccaggc

SEQ ID NO: 3129506 - RNA, 14 nt, Human
gcacaagcugcacc

SEQ ID NO: 3129507 - RNA, 13 nt, Human
gcacaugccucuc

SEQ ID NO: 3129508 - RNA, 21 nt, Human
gcacaucagcacgauuucugu

SEQ ID NO: 3129509 - RNA, 19 nt, Human
gcacaucagcacgauuucu

SEQ ID NO: 3129510 - RNA, 20 nt, Human
gcacaucagcacgauuucug

SEQ ID NO: 3129511 - RNA, 21 nt, Human
gcacaugccucucucaggcca

SEQ ID NO: 3129512 - RNA, 20 nt, Human
gcacaugccucucucaggcc

SEQ ID NO: 3129513 - RNA, 19 nt, Human
gcacaugccucucucaggc

SEQ ID NO: 3129514 - RNA, 18 nt, Human
gcacaugccucucucagg

SEQ ID NO: 3129515 - RNA, 17 nt, Human
gcacaugccucucucag

SEQ ID NO: 3129516 - RNA, 14 nt, Human
gcacaugccucucu

SEQ ID NO: 3129517 - RNA, 19 nt, Human
gcaccggcuggccuggccc

SEQ ID NO: 3129518 - RNA, 23 nt, Human
gcaccggcuggccuggccccuca

SEQ ID NO: 3129519 - RNA, 21 nt, Human
gcaccggcuggccuggccccu

SEQ ID NO: 3129520 - RNA, 18 nt, Human
gcaccggcuggccuggcc

SEQ ID NO: 3129521 - RNA, 14 nt, Human
gauacccaucccau

SEQ ID NO: 3129522 - RNA, 13 nt, Human
gauacccauccca

SEQ ID NO: 3129523 - RNA, 16 nt, Human
gauacuacaguuuguu

SEQ ID NO: 3129524 - RNA, 11 nt, Human
gauacuacagu

SEQ ID NO: 3129525 - RNA, 13 nt, Human
gaggucuguucuu

SEQ ID NO: 3129526 - RNA, 14 nt, Human
gaggucuguucuuu

SEQ ID NO: 3129527 - RNA, 11 nt, Human
gaggugggagg

SEQ ID NO: 3129528 - RNA, 12 nt, Human
gaggugggaucc

SEQ ID NO: 3129529 - RNA, 13 nt, Human
gagucaccaagcc

SEQ ID NO: 3129530 - RNA, 14 nt, Human
gagucaccaagccc

SEQ ID NO: 3129531 - RNA, 16 nt, Human
gagucccaccuuggcu

SEQ ID NO: 3129532 - RNA, 20 nt, Human
gagucccaccuuggcugcag

SEQ ID NO: 3129533 - RNA, 24 nt, Human
gagugagcacuaaggugugcucug

SEQ ID NO: 3129534 - RNA, 13 nt, Human
gagucccaccuug

SEQ ID NO: 3129535 - RNA, 12 nt, Human
gagugagcuggu

SEQ ID NO: 3129536 - RNA, 11 nt, Human
gagugcaguga

SEQ ID NO: 3129537 - RNA, 12 nt, Human
gagugcagugag

SEQ ID NO: 3129538 - RNA, 20 nt, Human
gaguuugggguaugggagag

SEQ ID NO: 3129539 - RNA, 18 nt, Human
gagugccuuacacaaugg

SEQ ID NO: 3129540 - RNA, 16 nt, Human
gaguuguuacauuuuu

SEQ ID NO: 3129541 - RNA, 20 nt, Human
gaguuguuacauuuuuaagu

SEQ ID NO: 3129542 - RNA, 20 nt, Human
gauuacaggugugaaccacc

SEQ ID NO: 3129543 - RNA, 17 nt, Human
gaucucuugagccuggg

SEQ ID NO: 3129544 - RNA, 16 nt, Human
gaucucuugagccugg

SEQ ID NO: 3129545 - RNA, 12 nt, Human
gaucucuugagc

SEQ ID NO: 3129546 - RNA, 15 nt, Human
gauauuuugcuuugu

SEQ ID NO: 3129547 - RNA, 16 nt, Human
gauauuuugcuuugug

SEQ ID NO: 3129548 - RNA, 15 nt, Human
gauauuuuuuucuuu

SEQ ID NO: 3129549 - RNA, 16 nt, Human
gaugagaggaaaucac

SEQ ID NO: 3129550 - RNA, 20 nt, Human
gaugaucuuugcagacaggc

SEQ ID NO: 3129551 - RNA, 21 nt, Human
gaugaucuuugcagacaggca

SEQ ID NO: 3129552 - RNA, 14 nt, Human
gaugaucuuugcag

SEQ ID NO: 3129553 - RNA, 13 nt, Human
gggaagagacuug

SEQ ID NO: 3129554 - RNA, 13 nt, Human
gggaaggauacaa

SEQ ID NO: 3129555 - RNA, 16 nt, Human
gggacagcuccuucug

SEQ ID NO: 3129556 - RNA, 23 nt, Human
gggacagaggggguggccuccca

SEQ ID NO: 3129557 - RNA, 22 nt, Human
gggacagaggggguggccuccc

SEQ ID NO: 3129558 - RNA, 13 nt, Human
gggacagaggggg

SEQ ID NO: 3129559 - RNA, 21 nt, Human
gggacagcuccuucuguccua

SEQ ID NO: 3129560 - RNA, 14 nt, Human
aaaaaucucaaauu

SEQ ID NO: 3129561 - RNA, 15 nt, Human
aaaacaugcuacaca

SEQ ID NO: 3129562 - RNA, 21 nt, Human
aaaaccaauguucucucuucu

SEQ ID NO: 3129563 - RNA, 22 nt, Human
aaaacugcugacuguuuucucu

SEQ ID NO: 3129564 - RNA, 20 nt, Human
aaaacugcugacuguuuucu

SEQ ID NO: 3129565 - RNA, 23 nt, Human
aaaacugcugacuguuuucucuu

SEQ ID NO: 3129566 - RNA, 13 nt, Human
aaaagaugcuucu

SEQ ID NO: 3129567 - RNA, 16 nt, Human
gggcaacccccagccu

SEQ ID NO: 3129568 - RNA, 18 nt, Human
gggcaacccccagccugc

SEQ ID NO: 3129569 - RNA, 12 nt, Human
gggcagagcaga

SEQ ID NO: 3129570 - RNA, 16 nt, Human
gggcagagcagagacc

SEQ ID NO: 3129571 - RNA, 14 nt, Human
gggcagaggaaagc

SEQ ID NO: 3129572 - RNA, 22 nt, Human
gggcagagcagagaccaucccu

SEQ ID NO: 3129573 - RNA, 17 nt, Human
gggcagagcagagacca

SEQ ID NO: 3129574 - RNA, 15 nt, Human
gggauuacaggugug

SEQ ID NO: 3129575 - RNA, 19 nt, Human
gggaggccaaggugggagg

SEQ ID NO: 3129576 - RNA, 19 nt, Human
gggaggucgaggcaggagg

SEQ ID NO: 3129577 - RNA, 18 nt, Human
gggaggucgaggcaggag

SEQ ID NO: 3129578 - RNA, 17 nt, Human
gggaggucgaggcagga

SEQ ID NO: 3129579 - RNA, 17 nt, Human
gggagggcuccagacac

SEQ ID NO: 3129580 - RNA, 15 nt, Human
gggagggcuccagac

SEQ ID NO: 3129581 - RNA, 14 nt, Human
gggagggcuccaga

SEQ ID NO: 3129582 - RNA, 15 nt, Human
gggaggucgaggcag

SEQ ID NO: 3129583 - RNA, 19 nt, Human
gggccucuuaugggcuggg

SEQ ID NO: 3129584 - RNA, 20 nt, Human
gggccucuuaugggcugggu

SEQ ID NO: 3129585 - RNA, 15 nt, Human
gggccuccugugugu

SEQ ID NO: 3129586 - RNA, 13 nt, Human
gggccuccugugu

SEQ ID NO: 3129587 - RNA, 15 nt, Human
gggccucagugccac

SEQ ID NO: 3129588 - RNA, 18 nt, Human
gggcuaguugggcuuccu

SEQ ID NO: 3129589 - RNA, 15 nt, Human
gggcgggaggauguu

SEQ ID NO: 3129590 - RNA, 23 nt, Human
gggccaguuggucccccuuccau

SEQ ID NO: 3129591 - RNA, 22 nt, Human
gggccaguuggucccccuucca

SEQ ID NO: 3129592 - RNA, 18 nt, Human
gggccaguuggucccccu

SEQ ID NO: 3129593 - RNA, 14 nt, Human
gggccaguuggucc

SEQ ID NO: 3129594 - RNA, 21 nt, Human
aaaaugagccuggcaagaaug

SEQ ID NO: 3129595 - RNA, 14 nt, Human
aaaaugagccuggc

SEQ ID NO: 3129596 - RNA, 11 nt, Human
gggccaggagc

SEQ ID NO: 3129597 - RNA, 22 nt, Human
gggcuggguucuacccaggugc

SEQ ID NO: 3129598 - RNA, 20 nt, Human
gggcuggguucuacccaggu

SEQ ID NO: 3129599 - RNA, 10 nt, Human
gggcucagca

SEQ ID NO: 3129600 - RNA, 22 nt, Human
gggcugcaccggcuggccuggc

SEQ ID NO: 3129601 - RNA, 21 nt, Human
gggcugcaugcgggcuuccuc

SEQ ID NO: 3129602 - RNA, 18 nt, Human
gggcugcaugcgggcuuc

SEQ ID NO: 3129603 - RNA, 12 nt, Human
ggggacagcucc

SEQ ID NO: 3129604 - RNA, 14 nt, Human
ggggacagcuccuu

SEQ ID NO: 3129605 - RNA, 20 nt, Human
ggggacagcuccuucugucc

SEQ ID NO: 3129606 - RNA, 15 nt, Human
ggggccucagugcca

SEQ ID NO: 3129607 - RNA, 18 nt, Human
aaacaagaccacguuucu

SEQ ID NO: 3129608 - RNA, 20 nt, Human
aaacaagaccacguuucuaa

SEQ ID NO: 3129609 - RNA, 12 nt, Human
aaacacauuuuu

SEQ ID NO: 3129610 - RNA, 16 nt, Human
aaacacauuuuucuua

SEQ ID NO: 3129611 - RNA, 17 nt, Human
ggguuucuaaagcugcc

SEQ ID NO: 3129612 - RNA, 14 nt, Human
gguaacaggcagau

SEQ ID NO: 3129613 - RNA, 20 nt, Human
gguaacaggcagauacagga

SEQ ID NO: 3129614 - RNA, 13 nt, Human
gguaacaggcaga

SEQ ID NO: 3129615 - RNA, 17 nt, Human
ggguggaugccuggugg

SEQ ID NO: 3129616 - RNA, 15 nt, Human
ggguggcaccagcag

SEQ ID NO: 3129617 - RNA, 13 nt, Human
ggguggaugccug

SEQ ID NO: 3129618 - RNA, 19 nt, Human
gggugggacacccugugau

SEQ ID NO: 3129619 - RNA, 20 nt, Human
ggguggggaccucaggccug

SEQ ID NO: 3129620 - RNA, 17 nt, Human
ggguguggcgcagcaua

SEQ ID NO: 3129621 - RNA, 17 nt, Human
aaagacuaucuaaaugu

SEQ ID NO: 3129622 - RNA, 12 nt, Human
aaacuuuacuau

SEQ ID NO: 3129623 - RNA, 15 nt, Human
gguccauagagagca

SEQ ID NO: 3129624 - RNA, 17 nt, Human
aaacuuuaccuuuuuua

SEQ ID NO: 3129625 - RNA, 22 nt, Human
aaacuuuaccuuuuuuauacau

SEQ ID NO: 3129626 - RNA, 17 nt, Human
gguccacccaggagccc

SEQ ID NO: 3129627 - RNA, 12 nt, Human
gguccacccagg

SEQ ID NO: 3129628 - RNA, 13 nt, Human
gguccacccagga

SEQ ID NO: 3129629 - RNA, 15 nt, Human
gguccacccaggagc

SEQ ID NO: 3129630 - RNA, 16 nt, Human
gguccacccaggagcc

SEQ ID NO: 3129631 - RNA, 22 nt, Human
gguaugaucacggcucacugca

SEQ ID NO: 3129632 - RNA, 14 nt, Human
gguaugcaaucaaa

SEQ ID NO: 3129633 - RNA, 16 nt, Human
aaagcagcguuucuau

SEQ ID NO: 3129634 - RNA, 18 nt, Human
aaagcagcguuucuauga

SEQ ID NO: 3129635 - RNA, 22 nt, Human
aaagcagcguuucuaugacaca

SEQ ID NO: 3129636 - RNA, 21 nt, Human
gguggaugccugguggcagcu

SEQ ID NO: 3129637 - RNA, 14 nt, Human
gguggaugccuggu

SEQ ID NO: 3129638 - RNA, 15 nt, Human
aaagcagcguuucua

SEQ ID NO: 3129639 - RNA, 18 nt, Human
ggugcaaugaccuuucaa

SEQ ID NO: 3129640 - RNA, 20 nt, Human
ggugcaaugaccuuucaaua

SEQ ID NO: 3129641 - RNA, 19 nt, Human
ggugcaaugaccuuucaau

SEQ ID NO: 3129642 - RNA, 16 nt, Human
ggugcaaugaccuuuc

SEQ ID NO: 3129643 - RNA, 21 nt, Human
ggugcauuugaggucuguucu

SEQ ID NO: 3129644 - RNA, 14 nt, Human
gguccugcugcagu

SEQ ID NO: 3129645 - RNA, 13 nt, Human
ggucggaaaacau

SEQ ID NO: 3129646 - RNA, 14 nt, Human
ggucggaaaacaug

SEQ ID NO: 3129647 - RNA, 17 nt, Human
ggucuacacugugcuga

SEQ ID NO: 3129648 - RNA, 23 nt, Human
gguccuagaaauuccccacccug

SEQ ID NO: 3129649 - RNA, 23 nt, Human
gguccugcugcaguugccaguca

SEQ ID NO: 3129650 - RNA, 21 nt, Human
gguccugcugcaguugccagu

SEQ ID NO: 3129651 - RNA, 13 nt, Human
aaagcaaaggaga

SEQ ID NO: 3129652 - RNA, 21 nt, Human
aaaguuucucuuuucaaaaca

SEQ ID NO: 3129653 - RNA, 23 nt, Human
aaaguuucucuuuucaaaacauu

SEQ ID NO: 3129654 - RNA, 12 nt, Human
aaaguggugaga

SEQ ID NO: 3129655 - RNA, 12 nt, Human
aaauaaugugaa

SEQ ID NO: 3129656 - RNA, 13 nt, Human
aaauaaugugaaa

SEQ ID NO: 3129657 - RNA, 14 nt, Human
gguuucagaaaugu

SEQ ID NO: 3129658 - RNA, 12 nt, Human
gguuucagaaau

SEQ ID NO: 3129659 - RNA, 13 nt, Human
gguuucagaaaug

SEQ ID NO: 3129660 - RNA, 21 nt, Human
gguucccuuugacgccauccc

SEQ ID NO: 3129661 - RNA, 22 nt, Human
gguucaggguuggccccugccc

SEQ ID NO: 3129662 - RNA, 18 nt, Human
gguucaggguuggccccu

SEQ ID NO: 3129663 - RNA, 21 nt, Human
gguucaggguuggccccugcc

SEQ ID NO: 3129664 - RNA, 12 nt, Human
gguucagcuugu

SEQ ID NO: 3129665 - RNA, 12 nt, Human
gguguggaagag

SEQ ID NO: 3129666 - RNA, 13 nt, Human
ggugugcucugau

SEQ ID NO: 3129667 - RNA, 21 nt, Human
ggugugcggccuuuggcuuca

SEQ ID NO: 3129668 - RNA, 18 nt, Human
ggugugagucaccaagcc

SEQ ID NO: 3129669 - RNA, 16 nt, Human
ggugugacugaauuuc

SEQ ID NO: 3129670 - RNA, 16 nt, Human
ggugucgggcaugaca

SEQ ID NO: 3129671 - RNA, 13 nt, Human
ggugucgggcaug

SEQ ID NO: 3129672 - RNA, 23 nt, Human
gguggggucacucuggcagcuca

SEQ ID NO: 3129673 - RNA, 15 nt, Human
gguggggucacucug

SEQ ID NO: 3129674 - RNA, 17 nt, Human
gguggggcagcuugagg

SEQ ID NO: 3129675 - RNA, 13 nt, Human
gguggggcagcuu

SEQ ID NO: 3129676 - RNA, 19 nt, Human
ggugggauccuccaggugc

SEQ ID NO: 3129677 - RNA, 20 nt, Human
ggugggaggaucucuugagc

SEQ ID NO: 3129678 - RNA, 20 nt, Human
ggugggaggauugcuugagc

SEQ ID NO: 3129679 - RNA, 15 nt, Human
ggugggauccuccag

SEQ ID NO: 3129680 - RNA, 14 nt, Human
ggugggauccucca

SEQ ID NO: 3129681 - RNA, 14 nt, Human
ggaggugaccccag

SEQ ID NO: 3129682 - RNA, 20 nt, Human
ggaggucaaggcugcaguga

SEQ ID NO: 3129683 - RNA, 16 nt, Human
ggaggggggagguggg

SEQ ID NO: 3129684 - RNA, 19 nt, Human
ggaggaaggaaacccagcu

SEQ ID NO: 3129685 - RNA, 23 nt, Human
ggaggaaggaaacccagcucugg

SEQ ID NO: 3129686 - RNA, 20 nt, Human
ggaggaaggaaacccagcuc

SEQ ID NO: 3129687 - RNA, 11 nt, Human
ggaggccagcc

SEQ ID NO: 3129688 - RNA, 20 nt, Human
ggaggccaaggugggaggau

SEQ ID NO: 3129689 - RNA, 21 nt, Human
ggagcugccuguucagcucca

SEQ ID NO: 3129690 - RNA, 16 nt, Human
ggagcugaguggggga

SEQ ID NO: 3129691 - RNA, 12 nt, Human
ggagcugccugu

SEQ ID NO: 3129692 - RNA, 16 nt, Human
ggagccccgaggccuu

SEQ ID NO: 3129693 - RNA, 22 nt, Human
ggagccccgaggccuucucuga

SEQ ID NO: 3129694 - RNA, 15 nt, Human
ggagugcagugagcc

SEQ ID NO: 3129695 - RNA, 15 nt, Human
ggaguucugguuccu

SEQ ID NO: 3129696 - RNA, 14 nt, Human
ggaguggccacaga

SEQ ID NO: 3129697 - RNA, 16 nt, Human
ggauggggcugcaccg

SEQ ID NO: 3129698 - RNA, 18 nt, Human
ggauggauuuccagccaa

SEQ ID NO: 3129699 - RNA, 14 nt, Human
ggauccugagccag

SEQ ID NO: 3129700 - RNA, 13 nt, Human
ggauccugagcca

SEQ ID NO: 3129701 - RNA, 14 nt, Human
ggauccuccaggug

SEQ ID NO: 3129702 - RNA, 15 nt, Human
ggauccuccaggugc

SEQ ID NO: 3129703 - RNA, 18 nt, Human
ggaucucuugagccuggg

SEQ ID NO: 3129704 - RNA, 24 nt, Human
ggcacagaaaauggaagacagcuc

SEQ ID NO: 3129705 - RNA, 13 nt, Human
ggauguucuggga

SEQ ID NO: 3129706 - RNA, 16 nt, Human
ggauguucugggacac

SEQ ID NO: 3129707 - RNA, 15 nt, Human
ggauguucugggaca

SEQ ID NO: 3129708 - RNA, 18 nt, Human
ggcccuucucuccagccc

SEQ ID NO: 3129709 - RNA, 14 nt, Human
ggcccuuccuuuuc

SEQ ID NO: 3129710 - RNA, 17 nt, Human
ggcccuucucuccagcc

SEQ ID NO: 3129711 - RNA, 16 nt, Human
ggcccuucucuccagc

SEQ ID NO: 3129712 - RNA, 16 nt, Human
ggccagugugacaagg

SEQ ID NO: 3129713 - RNA, 17 nt, Human
ggccaaacucaccugcc

SEQ ID NO: 3129714 - RNA, 16 nt, Human
ggccaggcuggucuca

SEQ ID NO: 3129715 - RNA, 18 nt, Human
ggccaggcuggucucaaa

SEQ ID NO: 3129716 - RNA, 12 nt, Human
ggccaggcuggu

SEQ ID NO: 3129717 - RNA, 14 nt, Human
ggccaggcuggucu

SEQ ID NO: 3129718 - RNA, 18 nt, Human
ggcagugggagcugccug

SEQ ID NO: 3129719 - RNA, 19 nt, Human
ggcagugggagcugccugu

SEQ ID NO: 3129720 - RNA, 18 nt, Human
ggcauccaguaucuugaa

SEQ ID NO: 3129721 - RNA, 24 nt, Human
ggcacugcuuccagugaggcucug

SEQ ID NO: 3129722 - RNA, 22 nt, Human
ggcacugcuuccagugaggcuc

SEQ ID NO: 3129723 - RNA, 16 nt, Human
ggcaccagcagccugg

SEQ ID NO: 3129724 - RNA, 15 nt, Human
ggcaccagcagccug

SEQ ID NO: 3129725 - RNA, 17 nt, Human
ggcagugggagcugccu

SEQ ID NO: 3129726 - RNA, 12 nt, Human
ggccugagcugg

SEQ ID NO: 3129727 - RNA, 15 nt, Human
ggccugagcugggau

SEQ ID NO: 3129728 - RNA, 14 nt, Human
ggccuuuggcuuca

SEQ ID NO: 3129729 - RNA, 13 nt, Human
ggccuuuggcuuc

SEQ ID NO: 3129730 - RNA, 15 nt, Human
ggccuucucugaagg

SEQ ID NO: 3129731 - RNA, 16 nt, Human
ggccuucucugaagga

SEQ ID NO: 3129732 - RNA, 16 nt, Human
ggccuggccagaugca

SEQ ID NO: 3129733 - RNA, 21 nt, Human
ggccuggccagaugcaccagc

SEQ ID NO: 3129734 - RNA, 12 nt, Human
ggccuucucuga

SEQ ID NO: 3129735 - RNA, 21 nt, Human
ggccugugucuaguuguuuga

SEQ ID NO: 3129736 - RNA, 23 nt, Human
ggcucagcggggacagcuccuuc

SEQ ID NO: 3129737 - RNA, 21 nt, Human
ggcucagcggggacagcuccu

SEQ ID NO: 3129738 - RNA, 22 nt, Human
ggcucagcggggacagcuccuu

SEQ ID NO: 3129739 - RNA, 19 nt, Human
ggcucagcaaaagaugcuu

SEQ ID NO: 3129740 - RNA, 23 nt, Human
ggcucagcaaaagaugcuucuca

SEQ ID NO: 3129741 - RNA, 19 nt, Human
ggcgugcaguggugcgauc

SEQ ID NO: 3129742 - RNA, 14 nt, Human
ggcgugcaguggug

SEQ ID NO: 3129743 - RNA, 16 nt, Human
ggcucacugcagccuc

SEQ ID NO: 3129744 - RNA, 17 nt, Human
ggcucacugcagccuca

SEQ ID NO: 3129745 - RNA, 15 nt, Human
gcuuuuggucugugu

SEQ ID NO: 3129746 - RNA, 18 nt, Human
gcuuuugucuaugggacu

SEQ ID NO: 3129747 - RNA, 18 nt, Human
ggaaaauuuuaaaaauac

SEQ ID NO: 3129748 - RNA, 16 nt, Human
ggaaacccagcucugg

SEQ ID NO: 3129749 - RNA, 17 nt, Human
gcuuugaucccuucuua

SEQ ID NO: 3129750 - RNA, 14 nt, Human
gcuuugaucccuuc

SEQ ID NO: 3129751 - RNA, 20 nt, Human
ggaagacuucaucccucugg

SEQ ID NO: 3129752 - RNA, 17 nt, Human
ggaagacuucaucccuc

SEQ ID NO: 3129753 - RNA, 14 nt, Human
ggaaaugggcagag

SEQ ID NO: 3129754 - RNA, 22 nt, Human
ggaaaugggcagagcagagacc

SEQ ID NO: 3129755 - RNA, 18 nt, Human
ggaaaugggcagagcaga

SEQ ID NO: 3129756 - RNA, 17 nt, Human
ggaaaugggcagagcag

SEQ ID NO: 3129757 - RNA, 16 nt, Human
ggaaaugggcagagca

SEQ ID NO: 3129758 - RNA, 15 nt, Human
ggaacaaggcaaggc

SEQ ID NO: 3129759 - RNA, 21 nt, Human
ggaacaaggcaaggcugucaa

SEQ ID NO: 3129760 - RNA, 17 nt, Human
ggaacaaggcaaggcug

SEQ ID NO: 3129761 - RNA, 23 nt, Human
ggaacaaggcaaggcugucaauu

SEQ ID NO: 3129762 - RNA, 15 nt, Human
ggaacacuccuucac

SEQ ID NO: 3129763 - RNA, 16 nt, Human
ggaagacaaugugaaa

SEQ ID NO: 3129764 - RNA, 14 nt, Human
ggaagacaauguga

SEQ ID NO: 3129765 - RNA, 14 nt, Human
gcuucaguggcagc

SEQ ID NO: 3129766 - RNA, 14 nt, Human
gcuucaaggauccu

SEQ ID NO: 3129767 - RNA, 13 nt, Human
gcuguuggcuggg

SEQ ID NO: 3129768 - RNA, 23 nt, Human
gcugguucaggguuggccccugc

SEQ ID NO: 3129769 - RNA, 22 nt, Human
gcuuccagugaggcucugcccu

SEQ ID NO: 3129770 - RNA, 20 nt, Human
gcuugaccgugaggccagag

SEQ ID NO: 3129771 - RNA, 15 nt, Human
gcuucuucagagacu

SEQ ID NO: 3129772 - RNA, 12 nt, Human
gcuucuucagag

SEQ ID NO: 3129773 - RNA, 23 nt, Human
gcuuccagugaggcucugcccuu

SEQ ID NO: 3129774 - RNA, 18 nt, Human
gcuuguaaauagcucagg

SEQ ID NO: 3129775 - RNA, 19 nt, Human
gcuuguaaauagcucaggu

SEQ ID NO: 3129776 - RNA, 17 nt, Human
gcuuguaaauagcucag

SEQ ID NO: 3129777 - RNA, 18 nt, Human
gcuugaccuuuaagagaa

SEQ ID NO: 3129778 - RNA, 23 nt, Human
gcuugaccgugaggccagagaca

SEQ ID NO: 3129779 - RNA, 23 nt, Human
gcuuucuacccagcgagcccugg

SEQ ID NO: 3129780 - RNA, 15 nt, Human
gcugcacccucaggc

SEQ ID NO: 3129781 - RNA, 13 nt, Human
gcugcacccucag

SEQ ID NO: 3129782 - RNA, 12 nt, Human
gcugccauccag

SEQ ID NO: 3129783 - RNA, 13 nt, Human
gcugccauccagg

SEQ ID NO: 3129784 - RNA, 15 nt, Human
gcugaggugggagga

SEQ ID NO: 3129785 - RNA, 18 nt, Human
gcugcugaaggcucgagc

SEQ ID NO: 3129786 - RNA, 12 nt, Human
gcugcugacagu

SEQ ID NO: 3129787 - RNA, 17 nt, Human
gcugccauccagguuca

SEQ ID NO: 3129788 - RNA, 13 nt, Human
gcugccccuggca

SEQ ID NO: 3129789 - RNA, 16 nt, Human
gcugccccuggcagcc

SEQ ID NO: 3129790 - RNA, 15 nt, Human
gcugccccuggcagc

SEQ ID NO: 3129791 - RNA, 19 nt, Human
gcucucaggccagcugcuu

SEQ ID NO: 3129792 - RNA, 18 nt, Human
gcucucaggccagcugcu

SEQ ID NO: 3129793 - RNA, 17 nt, Human
gcucucaggccagcugc

SEQ ID NO: 3129794 - RNA, 19 nt, Human
gcucuacugaggugcuaug

SEQ ID NO: 3129795 - RNA, 16 nt, Human
gcuccucuccccagca

SEQ ID NO: 3129796 - RNA, 19 nt, Human
gcuccucuccccagcaagu

SEQ ID NO: 3129797 - RNA, 18 nt, Human
gcucucaaguuaucaggg

SEQ ID NO: 3129798 - RNA, 23 nt, Human
gcuccagacacauguccaagaag

SEQ ID NO: 3129799 - RNA, 21 nt, Human
gcuccagacacauguccaaga

SEQ ID NO: 3129800 - RNA, 18 nt, Human
gcuccagacacaugucca

SEQ ID NO: 3129801 - RNA, 9 nt, Human
gcuccagac

SEQ ID NO: 3129802 - RNA, 13 nt, Human
gcuccagcucacc

SEQ ID NO: 3129803 - RNA, 14 nt, Human
gcuccagcucacca

SEQ ID NO: 3129804 - RNA, 23 nt, Human
gcucccaggcauuccccaggagg

SEQ ID NO: 3129805 - RNA, 15 nt, Human
gcuccucuccccagc

SEQ ID NO: 3129806 - RNA, 20 nt, Human
gcucugaucauccacugugc

SEQ ID NO: 3129807 - RNA, 21 nt, Human
gcucugaucauccacugugcc

SEQ ID NO: 3129808 - RNA, 22 nt, Human
gcucugaucauccacugugcca

SEQ ID NO: 3129809 - RNA, 17 nt, Human
gcugaauacagaggcaa

SEQ ID NO: 3129810 - RNA, 23 nt, Human
gcugaaggcucgagcaugccugg

SEQ ID NO: 3129811 - RNA, 13 nt, Human
gcugacagacaca

SEQ ID NO: 3129812 - RNA, 23 nt, Human
gcucugguccauagagagcaaga

SEQ ID NO: 3129813 - RNA, 23 nt, Human
gccagcaggcucucaggccagcu

SEQ ID NO: 3129814 - RNA, 14 nt, Human
gccaggcccucugc

SEQ ID NO: 3129815 - RNA, 13 nt, Human
gccaggcccucug

SEQ ID NO: 3129816 - RNA, 18 nt, Human
gccaggccacaagacccu

SEQ ID NO: 3129817 - RNA, 13 nt, Human
gccaggccacaag

SEQ ID NO: 3129818 - RNA, 22 nt, Human
gccaggccagagggagugacag

SEQ ID NO: 3129819 - RNA, 15 nt, Human
gccaggccagaggga

SEQ ID NO: 3129820 - RNA, 21 nt, Human
gccaggccacaagacccuugu

SEQ ID NO: 3129821 - RNA, 13 nt, Human
gccaguugguccc

SEQ ID NO: 3129822 - RNA, 13 nt, Human
gccagugugacaa

SEQ ID NO: 3129823 - RNA, 23 nt, Human
gccaguuggucccccuuccaugg

SEQ ID NO: 3129824 - RNA, 22 nt, Human
gccaguuggucccccuuccaug

SEQ ID NO: 3129825 - RNA, 21 nt, Human
gccaguuggucccccuuccau

SEQ ID NO: 3129826 - RNA, 20 nt, Human
gccaguuggucccccuucca

SEQ ID NO: 3129827 - RNA, 18 nt, Human
gccaguuggucccccuuc

SEQ ID NO: 3129828 - RNA, 16 nt, Human
gccaguuggucccccu

SEQ ID NO: 3129829 - RNA, 21 nt, Human
gccccugcugguucaggguug

SEQ ID NO: 3129830 - RNA, 22 nt, Human
gccccugcugguucaggguugg

SEQ ID NO: 3129831 - RNA, 15 nt, Human
gccccugcccggcug

SEQ ID NO: 3129832 - RNA, 17 nt, Human
gcccaggccccugccac

SEQ ID NO: 3129833 - RNA, 13 nt, Human
gcccaggcagguc

SEQ ID NO: 3129834 - RNA, 12 nt, Human
gcccaggcaggu

SEQ ID NO: 3129835 - RNA, 14 nt, Human
gcccaggcaggucu

SEQ ID NO: 3129836 - RNA, 15 nt, Human
gcccaggccccugcc

SEQ ID NO: 3129837 - RNA, 13 nt, Human
gcccaggccccug

SEQ ID NO: 3129838 - RNA, 14 nt, Human
gccaugugccaggu

SEQ ID NO: 3129839 - RNA, 19 nt, Human
gcuacuguccuacccaccc

SEQ ID NO: 3129840 - RNA, 20 nt, Human
gcuacuguccuacccacccu

SEQ ID NO: 3129841 - RNA, 17 nt, Human
gcguuucuaugacacau

SEQ ID NO: 3129842 - RNA, 16 nt, Human
gcuaauuuuucauuuu

SEQ ID NO: 3129843 - RNA, 14 nt, Human
gcgugcacacacca

SEQ ID NO: 3129844 - RNA, 18 nt, Human
gcgugcacacaccagagc

SEQ ID NO: 3129845 - RNA, 20 nt, Human
gcgugguggacaugcacagc

SEQ ID NO: 3129846 - RNA, 13 nt, Human
gcgauucuucugc

SEQ ID NO: 3129847 - RNA, 14 nt, Human
gcgauucuucugcu

SEQ ID NO: 3129848 - RNA, 13 nt, Human
gccugcuccagcu

SEQ ID NO: 3129849 - RNA, 17 nt, Human
gccugcuaauuccccag

SEQ ID NO: 3129850 - RNA, 23 nt, Human
gccugcuaauuccccagauugca

SEQ ID NO: 3129851 - RNA, 19 nt, Human
gccuccuuugugaggaagc

SEQ ID NO: 3129852 - RNA, 21 nt, Human
gccuccuuugugaggaagccg

SEQ ID NO: 3129853 - RNA, 20 nt, Human
gccuccuuugugaggaagcc

SEQ ID NO: 3129854 - RNA, 19 nt, Human
auuuaauuuuuuugagaca

SEQ ID NO: 3129855 - RNA, 23 nt, Human
auuuaauuuuuuugagacagagu

SEQ ID NO: 3129856 - RNA, 17 nt, Human
auuuaacagaaauguac

SEQ ID NO: 3129857 - RNA, 19 nt, Human
auuuaacagaaauguacag

SEQ ID NO: 3129858 - RNA, 20 nt, Human
auuuaacagaaauguacagc

SEQ ID NO: 3129859 - RNA, 15 nt, Human
auuuaacagaaaugu

SEQ ID NO: 3129860 - RNA, 16 nt, Human
auuuaacagaaaugua

SEQ ID NO: 3129861 - RNA, 23 nt, Human
auuggcuuuggguugcaggaccu

SEQ ID NO: 3129862 - RNA, 13 nt, Human
auucuccaccugc

SEQ ID NO: 3129863 - RNA, 18 nt, Human
auucucagaaucucaaau

SEQ ID NO: 3129864 - RNA, 20 nt, Human
auucucagaaucucaaauaa

SEQ ID NO: 3129865 - RNA, 17 nt, Human
auucuccaccugccagg

SEQ ID NO: 3129866 - RNA, 16 nt, Human
auucuccaccugccag

SEQ ID NO: 3129867 - RNA, 14 nt, Human
auucucagaaucuc

SEQ ID NO: 3129868 - RNA, 13 nt, Human
auucuacuuugag

SEQ ID NO: 3129869 - RNA, 16 nt, Human
auucuacuuugagugc

SEQ ID NO: 3129870 - RNA, 23 nt, Human
auugccauuucuuccacaagagc

SEQ ID NO: 3129871 - RNA, 17 nt, Human
auugcccacgcuggagu

SEQ ID NO: 3129872 - RNA, 21 nt, Human
auugcccacgcuggagugcag

SEQ ID NO: 3129873 - RNA, 16 nt, Human
auugcggacagccacg

SEQ ID NO: 3129874 - RNA, 18 nt, Human
auugcggacagccacggc

SEQ ID NO: 3129875 - RNA, 19 nt, Human
auugcggacagccacggcc

SEQ ID NO: 3129876 - RNA, 13 nt, Human
auugaccugaggc

SEQ ID NO: 3129877 - RNA, 15 nt, Human
auugcaacaggcugg

SEQ ID NO: 3129878 - RNA, 21 nt, Human
auugcaacaggcugggcuuca

SEQ ID NO: 3129879 - RNA, 23 nt, Human
auuucuuuugccguuauuaaaaa

SEQ ID NO: 3129880 - RNA, 13 nt, Human
auuuauuauggca

SEQ ID NO: 3129881 - RNA, 20 nt, Human
auuuauuaaaugcccagccc

SEQ ID NO: 3129882 - RNA, 21 nt, Human
auuucuaaaucuccaaaauaa

SEQ ID NO: 3129883 - RNA, 12 nt, Human
auuucuaaaucu

SEQ ID NO: 3129884 - RNA, 13 nt, Human
auuucuaaaucuc

SEQ ID NO: 3129885 - RNA, 14 nt, Human
auuuccugugucuu

SEQ ID NO: 3129886 - RNA, 16 nt, Human
auuuauuauggcacau

SEQ ID NO: 3129887 - RNA, 23 nt, Human
auuugaggucuguucuuuccaaa

SEQ ID NO: 3129888 - RNA, 17 nt, Human
auuugagcagggcucag

SEQ ID NO: 3129889 - RNA, 22 nt, Human
auuugaggucuguucuuuccaa

SEQ ID NO: 3129890 - RNA, 20 nt, Human
auuucuuuugccguuauuaa

SEQ ID NO: 3129891 - RNA, 16 nt, Human
auuugagcagggcuca

SEQ ID NO: 3129892 - RNA, 18 nt, Human
auuuggugguuucagaaa

SEQ ID NO: 3129893 - RNA, 20 nt, Human
auuuggugguuucagaaaug

SEQ ID NO: 3129894 - RNA, 17 nt, Human
auuuggugguuucagaa

SEQ ID NO: 3129895 - RNA, 17 nt, Human
auuuuauuaugcaugaa

SEQ ID NO: 3129896 - RNA, 14 nt, Human
auuuuauuaugcau

SEQ ID NO: 3129897 - RNA, 15 nt, Human
auuuuauuaugcaug

SEQ ID NO: 3129898 - RNA, 13 nt, Human
auuuuauuaugca

SEQ ID NO: 3129899 - RNA, 13 nt, Human
auuagagaagaga

SEQ ID NO: 3129900 - RNA, 23 nt, Human
auuauuuauuaaaugcccagccc

SEQ ID NO: 3129901 - RNA, 22 nt, Human
auuaccugaauuuuggcugugu

SEQ ID NO: 3129902 - RNA, 19 nt, Human
auuaccacagacauacuaa

SEQ ID NO: 3129903 - RNA, 22 nt, Human
uuuuuguuccacaaguuaaaua

SEQ ID NO: 3129904 - RNA, 20 nt, Human
auuccccagauugcaacagg

SEQ ID NO: 3129905 - RNA, 22 nt, Human
auuccccacccugaaagcccug

SEQ ID NO: 3129906 - RNA, 16 nt, Human
auuccccaggaggcca

SEQ ID NO: 3129907 - RNA, 20 nt, Human
auucaggaagcucagggccu

SEQ ID NO: 3129908 - RNA, 21 nt, Human
auucaguuguuagugugucuu

SEQ ID NO: 3129909 - RNA, 16 nt, Human
auucaguuguuagugu

SEQ ID NO: 3129910 - RNA, 23 nt, Human
auucaggaagcucagggccuggc

SEQ ID NO: 3129911 - RNA, 22 nt, Human
auucaggaagcucagggccugg

SEQ ID NO: 3129912 - RNA, 21 nt, Human
auucaggaagcucagggccug

SEQ ID NO: 3129913 - RNA, 18 nt, Human
auucagcucugcaagaau

SEQ ID NO: 3129914 - RNA, 14 nt, Human
auucagcucugcaa

SEQ ID NO: 3129915 - RNA, 17 nt, Human
auuaaacuuaaucuaaa

SEQ ID NO: 3129916 - RNA, 16 nt, Human
auuaaacuuaaucuaa

SEQ ID NO: 3129917 - RNA, 19 nt, Human
auuaaacuuaaucuaaaug

SEQ ID NO: 3129918 - RNA, 21 nt, Human
auuaaacuuaaucuaaaugga

SEQ ID NO: 3129919 - RNA, 20 nt, Human
auuaaccacuucagcugacu

SEQ ID NO: 3129920 - RNA, 18 nt, Human
auuaaccacuucagcuga

SEQ ID NO: 3129921 - RNA, 17 nt, Human
auuaaccacuucagcug

SEQ ID NO: 3129922 - RNA, 13 nt, Human
auuaagaaagacu

SEQ ID NO: 3129923 - RNA, 14 nt, Human
auuaagaaagacua

SEQ ID NO: 3129924 - RNA, 23 nt, Human
auuaacuuuuauaaacuuuaccu

SEQ ID NO: 3129925 - RNA, 12 nt, Human
auuaacuuuuau

SEQ ID NO: 3129926 - RNA, 16 nt, Human
auuaacuuuuauaaac

SEQ ID NO: 3129927 - RNA, 17 nt, Human
auuaacuuuuauaaacu

SEQ ID NO: 3129928 - RNA, 19 nt, Human
auuaacuuuuauaaacuuu

SEQ ID NO: 3129929 - RNA, 20 nt, Human
auuaacuuuuauaaacuuua

SEQ ID NO: 3129930 - RNA, 17 nt, Human
auguuuuucuucucccu

SEQ ID NO: 3129931 - RNA, 18 nt, Human
auguuuuucuucucccuc

SEQ ID NO: 3129932 - RNA, 14 nt, Human
auguuuuccaugag

SEQ ID NO: 3129933 - RNA, 21 nt, Human
uuuuaagugcugcauuuaaaa

SEQ ID NO: 3129934 - RNA, 16 nt, Human
uuuuaagugcugcauu

SEQ ID NO: 3129935 - RNA, 17 nt, Human
uuuuaagugcugcauuu

SEQ ID NO: 3129936 - RNA, 21 nt, Human
auguucaucauccuaagcuau

SEQ ID NO: 3129937 - RNA, 13 nt, Human
auguuggccaggc

SEQ ID NO: 3129938 - RNA, 14 nt, Human
auguuggccaggcu

SEQ ID NO: 3129939 - RNA, 23 nt, Human
uuuuagaguugauacuacaguuu

SEQ ID NO: 3129940 - RNA, 12 nt, Human
uuuuauaaacuu

SEQ ID NO: 3129941 - RNA, 13 nt, Human
uuuuauaaacuuu

SEQ ID NO: 3129942 - RNA, 19 nt, Human
uuuuauaaacuuuaccuuu

SEQ ID NO: 3129943 - RNA, 14 nt, Human
uuuuauaaacuuua

SEQ ID NO: 3129944 - RNA, 17 nt, Human
uuuuauaaacuuuaccu

SEQ ID NO: 3129945 - RNA, 19 nt, Human
uuuuccagguuuaagcugu

SEQ ID NO: 3129946 - RNA, 19 nt, Human
uuugugaggaagccgcugg

SEQ ID NO: 3129947 - RNA, 18 nt, Human
uuugugaggaagccgcug

SEQ ID NO: 3129948 - RNA, 12 nt, Human
uuuguuugaacu

SEQ ID NO: 3129949 - RNA, 13 nt, Human
uuuguuugaacug

SEQ ID NO: 3129950 - RNA, 14 nt, Human
uuuguuugaacuga

SEQ ID NO: 3129951 - RNA, 22 nt, Human
uuuguaaauuaacuuuuauaaa

SEQ ID NO: 3129952 - RNA, 13 nt, Human
uuuguagagccag

SEQ ID NO: 3129953 - RNA, 21 nt, Human
uuuuaaaaaacugcugacugu

SEQ ID NO: 3129954 - RNA, 18 nt, Human
uuuguuugaacugauaaa

SEQ ID NO: 3129955 - RNA, 15 nt, Human
uuuuaagugcugcau

SEQ ID NO: 3129956 - RNA, 16 nt, Human
uuuuaagaggcagggu

SEQ ID NO: 3129957 - RNA, 15 nt, Human
uuuuaagaggcaggg

SEQ ID NO: 3129958 - RNA, 15 nt, Human
auguaucaaugagua

SEQ ID NO: 3129959 - RNA, 22 nt, Human
uuugggggaaaauuuagaaaua

SEQ ID NO: 3129960 - RNA, 15 nt, Human
auguaucugagcagg

SEQ ID NO: 3129961 - RNA, 12 nt, Human
auguauguguaa

SEQ ID NO: 3129962 - RNA, 23 nt, Human
augucucuuuaaugucacaggca

SEQ ID NO: 3129963 - RNA, 23 nt, Human
auguccaagaagcccaggaaagg

SEQ ID NO: 3129964 - RNA, 18 nt, Human
auguccaagaagcccagg

SEQ ID NO: 3129965 - RNA, 19 nt, Human
auguccaagaagcccagga

SEQ ID NO: 3129966 - RNA, 16 nt, Human
augucagugugacuga

SEQ ID NO: 3129967 - RNA, 15 nt, Human
augucagugugacug

SEQ ID NO: 3129968 - RNA, 21 nt, Human
augucagugugacugaucucu

SEQ ID NO: 3129969 - RNA, 13 nt, Human
uuuggggaagaac

SEQ ID NO: 3129970 - RNA, 22 nt, Human
uuugggaggccaaggugggagg

SEQ ID NO: 3129971 - RNA, 14 nt, Human
uuuggggauauuuu

SEQ ID NO: 3129972 - RNA, 22 nt, Human
uuugccauguuggccaggcugg

SEQ ID NO: 3129973 - RNA, 16 nt, Human
uugauucagacagcug

SEQ ID NO: 3129974 - RNA, 15 nt, Human
uugauucagacagcu

SEQ ID NO: 3129975 - RNA, 14 nt, Human
uugauucagacagc

SEQ ID NO: 3129976 - RNA, 19 nt, Human
auccuaguuccaccaucaa

SEQ ID NO: 3129977 - RNA, 15 nt, Human
auccuaguuccacca

SEQ ID NO: 3129978 - RNA, 16 nt, Human
aucucacacaugagca

SEQ ID NO: 3129979 - RNA, 15 nt, Human
aucucacacaugagc

SEQ ID NO: 3129980 - RNA, 13 nt, Human
aucucccccagcc

SEQ ID NO: 3129981 - RNA, 12 nt, Human
aucucccccagc

SEQ ID NO: 3129982 - RNA, 18 nt, Human
aucuugaauuguaaggaa

SEQ ID NO: 3129983 - RNA, 17 nt, Human
aucuugaauuguaagga

SEQ ID NO: 3129984 - RNA, 17 nt, Human
aucuugcucugcugaca

SEQ ID NO: 3129985 - RNA, 19 nt, Human
aucuugcucugcugacaga

SEQ ID NO: 3129986 - RNA, 19 nt, Human
aucuggguucacugcaacc

SEQ ID NO: 3129987 - RNA, 17 nt, Human
aucuggguucacugcaa

SEQ ID NO: 3129988 - RNA, 23 nt, Human
aucugugaaaggaaagagggagg

SEQ ID NO: 3129989 - RNA, 18 nt, Human
uugccgucuaccugaggg

SEQ ID NO: 3129990 - RNA, 15 nt, Human
uugccgucuaccuga

SEQ ID NO: 3129991 - RNA, 19 nt, Human
uugccgucuaccugagggg

SEQ ID NO: 3129992 - RNA, 14 nt, Human
uugccguuauuaaa

SEQ ID NO: 3129993 - RNA, 13 nt, Human
uugccgucuaccu

SEQ ID NO: 3129994 - RNA, 14 nt, Human
augacacaugcaag

SEQ ID NO: 3129995 - RNA, 22 nt, Human
augacacaugcaaggucauuuu

SEQ ID NO: 3129996 - RNA, 16 nt, Human
augacuuacuguacau

SEQ ID NO: 3129997 - RNA, 17 nt, Human
augacuuacuguacaug

SEQ ID NO: 3129998 - RNA, 18 nt, Human
augacacgaauauugcug

SEQ ID NO: 3129999 - RNA, 22 nt, Human
augacuuaagcacacuugacau

SEQ ID NO: 3130000 - RNA, 14 nt, Human
augacuuacuguac

SEQ ID NO: 3130001 - RNA, 21 nt, Human
augagaaagguugaagcacca

SEQ ID NO: 3130002 - RNA, 22 nt, Human
augagaaagguugaagcaccaa

SEQ ID NO: 3130003 - RNA, 20 nt, Human
augaaugucagugugacuga

SEQ ID NO: 3130004 - RNA, 22 nt, Human
uuggggggcugaggugggagga

SEQ ID NO: 3130005 - RNA, 14 nt, Human
uuggggauauuuuu

SEQ ID NO: 3130006 - RNA, 18 nt, Human
uuggcuagagguucaaag

SEQ ID NO: 3130007 - RNA, 23 nt, Human
uuggcgcugccccuggcagcccc

SEQ ID NO: 3130008 - RNA, 22 nt, Human
uuggcgcugccccuggcagccc

SEQ ID NO: 3130009 - RNA, 18 nt, Human
aucuuugcagacaggcaa

SEQ ID NO: 3130010 - RNA, 24 nt, Human
uuuauggcuuuugugcauuaucua

SEQ ID NO: 3130011 - RNA, 20 nt, Human
uuuauggcuuuugugcauua

SEQ ID NO: 3130012 - RNA, 15 nt, Human
uuuaguagagacagg

SEQ ID NO: 3130013 - RNA, 19 nt, Human
augcuccuggcccacugca

SEQ ID NO: 3130014 - RNA, 15 nt, Human
auggaagacagcucu

SEQ ID NO: 3130015 - RNA, 16 nt, Human
auggaacacucugaga

SEQ ID NO: 3130016 - RNA, 15 nt, Human
auggaacacucugag

SEQ ID NO: 3130017 - RNA, 14 nt, Human
auggaacacucuga

SEQ ID NO: 3130018 - RNA, 11 nt, Human
auggaacacuc

SEQ ID NO: 3130019 - RNA, 19 nt, Human
augcugucccuuacgugag

SEQ ID NO: 3130020 - RNA, 23 nt, Human
augcugucccuuacgugaguccu

SEQ ID NO: 3130021 - RNA, 17 nt, Human
auggcacaucagcacga

SEQ ID NO: 3130022 - RNA, 23 nt, Human
auggcacaucagcacgauuucug

SEQ ID NO: 3130023 - RNA, 20 nt, Human
auggacguguuaugacucca

SEQ ID NO: 3130024 - RNA, 19 nt, Human
auggacguguuaugacucc

SEQ ID NO: 3130025 - RNA, 23 nt, Human
auggacguguuaugacuccagaa

SEQ ID NO: 3130026 - RNA, 18 nt, Human
auggauuuccagccaaag

SEQ ID NO: 3130027 - RNA, 21 nt, Human
auggccgggcgcgguggcuca

SEQ ID NO: 3130028 - RNA, 18 nt, Human
auggcuaauguacugcau

SEQ ID NO: 3130029 - RNA, 14 nt, Human
auggacaugaucuu

SEQ ID NO: 3130030 - RNA, 13 nt, Human
uuucagaaaugug

SEQ ID NO: 3130031 - RNA, 16 nt, Human
auggaagacagcucuu

SEQ ID NO: 3130032 - RNA, 21 nt, Human
uugugaggaagccgcuggggc

SEQ ID NO: 3130033 - RNA, 18 nt, Human
uugugauacaaugcugug

SEQ ID NO: 3130034 - RNA, 22 nt, Human
uuguucuggcucuuccaggcug

SEQ ID NO: 3130035 - RNA, 20 nt, Human
uuguucuggcucuuccaggc

SEQ ID NO: 3130036 - RNA, 19 nt, Human
uuguucuggcucuuccagg

SEQ ID NO: 3130037 - RNA, 17 nt, Human
uuguguguuuauuguca

SEQ ID NO: 3130038 - RNA, 13 nt, Human
uugugguuaaucu

SEQ ID NO: 3130039 - RNA, 12 nt, Human
augcacuuuguu

SEQ ID NO: 3130040 - RNA, 13 nt, Human
augcaccagcccu

SEQ ID NO: 3130041 - RNA, 19 nt, Human
augauuaaccacuucagcu

SEQ ID NO: 3130042 - RNA, 21 nt, Human
augauuaaccacuucagcuga

SEQ ID NO: 3130043 - RNA, 20 nt, Human
augauuaaccacuucagcug

SEQ ID NO: 3130044 - RNA, 21 nt, Human
augauucaacagguuuuccug

SEQ ID NO: 3130045 - RNA, 15 nt, Human
augcagccucacagu

SEQ ID NO: 3130046 - RNA, 14 nt, Human
augcagccucacag

SEQ ID NO: 3130047 - RNA, 13 nt, Human
augcagccucaca

SEQ ID NO: 3130048 - RNA, 14 nt, Human
uuuaagaggcaggg

SEQ ID NO: 3130049 - RNA, 15 nt, Human
augcacuuuguucug

SEQ ID NO: 3130050 - RNA, 13 nt, Human
uuguuuucagugu

SEQ ID NO: 3130051 - RNA, 16 nt, Human
uuguuuucaguguaca

SEQ ID NO: 3130052 - RNA, 17 nt, Human
uuuaagugcugcauuua

SEQ ID NO: 3130053 - RNA, 15 nt, Human
uuuaagugcugcauu

SEQ ID NO: 3130054 - RNA, 16 nt, Human
uuuaagugcugcauuu

SEQ ID NO: 3130055 - RNA, 12 nt, Human
uuuaauucaguu

SEQ ID NO: 3130056 - RNA, 21 nt, Human
uucucacugccaugccagcuu

SEQ ID NO: 3130057 - RNA, 13 nt, Human
aucaggccaggcc

SEQ ID NO: 3130058 - RNA, 21 nt, Human
uucgcaggauucuuccucccu

SEQ ID NO: 3130059 - RNA, 19 nt, Human
aucaaccccuucgcuccug

SEQ ID NO: 3130060 - RNA, 20 nt, Human
aucaaccccuucgcuccugu

SEQ ID NO: 3130061 - RNA, 22 nt, Human
aucaaccccuucgcuccugugu

SEQ ID NO: 3130062 - RNA, 18 nt, Human
uucccuuuuuuggcugcu

SEQ ID NO: 3130063 - RNA, 19 nt, Human
uucccuuuuuuggcugcug

SEQ ID NO: 3130064 - RNA, 20 nt, Human
uucuguuuuucuaggccugg

SEQ ID NO: 3130065 - RNA, 11 nt, Human
uucuguucuuu

SEQ ID NO: 3130066 - RNA, 18 nt, Human
uucuguucuuucuggcua

SEQ ID NO: 3130067 - RNA, 13 nt, Human
uucuuaauucuua

SEQ ID NO: 3130068 - RNA, 23 nt, Human
uucuuccucccucccucuuuccc

SEQ ID NO: 3130069 - RNA, 12 nt, Human
uucuugcaaagu

SEQ ID NO: 3130070 - RNA, 22 nt, Human
uucuuucuggcuaugcauuuga

SEQ ID NO: 3130071 - RNA, 21 nt, Human
uugaaauuuuuauuaaauuau

SEQ ID NO: 3130072 - RNA, 20 nt, Human
uugaaauauaggaacuuaaa

SEQ ID NO: 3130073 - RNA, 11 nt, Human
uugaaaucuuu

SEQ ID NO: 3130074 - RNA, 21 nt, Human
auccuaagcuauucaguaaua

SEQ ID NO: 3130075 - RNA, 21 nt, Human
auccuaggcauuugcugaaua

SEQ ID NO: 3130076 - RNA, 13 nt, Human
auccuaguuccac

SEQ ID NO: 3130077 - RNA, 16 nt, Human
uucuggcuaugcauuu

SEQ ID NO: 3130078 - RNA, 15 nt, Human
uucugccgcagcccu

SEQ ID NO: 3130079 - RNA, 14 nt, Human
uucugccgcagccc

SEQ ID NO: 3130080 - RNA, 18 nt, Human
uucuggcuaugcauuuga

SEQ ID NO: 3130081 - RNA, 20 nt, Human
uucuggcuaugcauuugaaa

SEQ ID NO: 3130082 - RNA, 21 nt, Human
auccaagcuggucccacucag

SEQ ID NO: 3130083 - RNA, 13 nt, Human
uucugccgcagcc

SEQ ID NO: 3130084 - RNA, 14 nt, Human
uucugacccaugcu

SEQ ID NO: 3130085 - RNA, 16 nt, Human
uucucuuuucaaaaca

SEQ ID NO: 3130086 - RNA, 17 nt, Human
uucucuacucuagggaa

SEQ ID NO: 3130087 - RNA, 20 nt, Human
aucaggccaggcccucugcc

SEQ ID NO: 3130088 - RNA, 20 nt, Human
aucauugaaaucuuuuugcu

SEQ ID NO: 3130089 - RNA, 23 nt, Human
aucaggccaggcccucugcccac

SEQ ID NO: 3130090 - RNA, 22 nt, Human
aucaggccaggcccucugccca

SEQ ID NO: 3130091 - RNA, 21 nt, Human
aucaggccaggcccucugccc

SEQ ID NO: 3130092 - RNA, 21 nt, Human
aucauugaaaucuuuuugcuu

SEQ ID NO: 3130093 - RNA, 12 nt, Human
auauauaaccag

SEQ ID NO: 3130094 - RNA, 13 nt, Human
auauauaaccagu

SEQ ID NO: 3130095 - RNA, 22 nt, Human
auaguuaagcgugcauaaguua

SEQ ID NO: 3130096 - RNA, 22 nt, Human
auaguuggcuaggaccccucca

SEQ ID NO: 3130097 - RNA, 15 nt, Human
auaguggugugauuu

SEQ ID NO: 3130098 - RNA, 17 nt, Human
auaguggcuuaaaacaa

SEQ ID NO: 3130099 - RNA, 13 nt, Human
uucacaguucucu

SEQ ID NO: 3130100 - RNA, 20 nt, Human
uucacaguucucuccuucuu

SEQ ID NO: 3130101 - RNA, 15 nt, Human
uucacaguucucucc

SEQ ID NO: 3130102 - RNA, 20 nt, Human
uucacagaugggugcuugga

SEQ ID NO: 3130103 - RNA, 17 nt, Human
auaggaaaaacugauuu

SEQ ID NO: 3130104 - RNA, 16 nt, Human
auaggaaaaacugauu

SEQ ID NO: 3130105 - RNA, 14 nt, Human
auaggaaaaacuga

SEQ ID NO: 3130106 - RNA, 12 nt, Human
auaggaaaaacu

SEQ ID NO: 3130107 - RNA, 18 nt, Human
uuauuuuuagacagaguc

SEQ ID NO: 3130108 - RNA, 17 nt, Human
uuauuuuuagacagagu

SEQ ID NO: 3130109 - RNA, 21 nt, Human
uucaagcgauucuucugcuuc

SEQ ID NO: 3130110 - RNA, 23 nt, Human
uucccaaagcagugcaugcuguc

SEQ ID NO: 3130111 - RNA, 22 nt, Human
uuccagugaggcucugcccuug

SEQ ID NO: 3130112 - RNA, 21 nt, Human
uuccagugaggcucugcccuu

SEQ ID NO: 3130113 - RNA, 20 nt, Human
uuccagugaggcucugcccu

SEQ ID NO: 3130114 - RNA, 19 nt, Human
uuccagugaggcucugccc

SEQ ID NO: 3130115 - RNA, 17 nt, Human
uuccagugaggcucugc

SEQ ID NO: 3130116 - RNA, 21 nt, Human
uuccaggggugggacacccug

SEQ ID NO: 3130117 - RNA, 18 nt, Human
uucccaagcucugcuccu

SEQ ID NO: 3130118 - RNA, 22 nt, Human
uucccaccucucucacuccuug

SEQ ID NO: 3130119 - RNA, 12 nt, Human
uucccaccucuc

SEQ ID NO: 3130120 - RNA, 13 nt, Human
uucccaagcucug

SEQ ID NO: 3130121 - RNA, 14 nt, Human
uucccaagcucugc

SEQ ID NO: 3130122 - RNA, 15 nt, Human
uucccaagcucugcu

SEQ ID NO: 3130123 - RNA, 16 nt, Human
uucccaagcucugcuc

SEQ ID NO: 3130124 - RNA, 17 nt, Human
uuccaggggugggacac

SEQ ID NO: 3130125 - RNA, 18 nt, Human
uuccaccaucaagccacc

SEQ ID NO: 3130126 - RNA, 22 nt, Human
uuccacaagagcccaggccucc

SEQ ID NO: 3130127 - RNA, 19 nt, Human
uuccaccaucaagccacca

SEQ ID NO: 3130128 - RNA, 16 nt, Human
auauguggaguucauc

SEQ ID NO: 3130129 - RNA, 15 nt, Human
auauguggaguucau

SEQ ID NO: 3130130 - RNA, 15 nt, Human
uuccaaggguacuaa

SEQ ID NO: 3130131 - RNA, 17 nt, Human
uuccaaggguacuaagg

SEQ ID NO: 3130132 - RNA, 13 nt, Human
uucagugccuuau

SEQ ID NO: 3130133 - RNA, 12 nt, Human
uucagugccuua

SEQ ID NO: 3130134 - RNA, 16 nt, Human
uucagugccaaaaaca

SEQ ID NO: 3130135 - RNA, 11 nt, Human
uucagaaaugu

SEQ ID NO: 3130136 - RNA, 13 nt, Human
uucagaaaugugu

SEQ ID NO: 3130137 - RNA, 17 nt, Human
uucaucccucuggggcu

SEQ ID NO: 3130138 - RNA, 21 nt, Human
uucaucccucuggggcuguuc

SEQ ID NO: 3130139 - RNA, 13 nt, Human
auaugcacacauu

SEQ ID NO: 3130140 - RNA, 16 nt, Human
auaugcacacauuuuu

SEQ ID NO: 3130141 - RNA, 14 nt, Human
auaugcacacauuu

SEQ ID NO: 3130142 - RNA, 15 nt, Human
auaugcacacauuuu

SEQ ID NO: 3130143 - RNA, 17 nt, Human
auauguaacaagccacc

SEQ ID NO: 3130144 - RNA, 16 nt, Human
auauguaacaagccac

SEQ ID NO: 3130145 - RNA, 16 nt, Human
auaucugaaaauguau

SEQ ID NO: 3130146 - RNA, 17 nt, Human
auaucugaaaauguaug

SEQ ID NO: 3130147 - RNA, 20 nt, Human
auaucugaaaauguaugugu

SEQ ID NO: 3130148 - RNA, 22 nt, Human
agcauauucaggaagcucaggg

SEQ ID NO: 3130149 - RNA, 20 nt, Human
ugaucacggcucacugcagc

SEQ ID NO: 3130150 - RNA, 21 nt, Human
ugaucacggcucacugcagcc

SEQ ID NO: 3130151 - RNA, 12 nt, Human
agcaucaggcca

SEQ ID NO: 3130152 - RNA, 13 nt, Human
agcaucaggccag

SEQ ID NO: 3130153 - RNA, 18 nt, Human
ugaucacggcucacugca

SEQ ID NO: 3130154 - RNA, 19 nt, Human
ugaucacggcucacugcag

SEQ ID NO: 3130155 - RNA, 18 nt, Human
agcaucaggccaggcccu

SEQ ID NO: 3130156 - RNA, 17 nt, Human
agcaucaggccaggccc

SEQ ID NO: 3130157 - RNA, 16 nt, Human
agcaucaggccaggcc

SEQ ID NO: 3130158 - RNA, 14 nt, Human
agcaucaggccagg

SEQ ID NO: 3130159 - RNA, 20 nt, Human
agcaucaggccaggcccucu

SEQ ID NO: 3130160 - RNA, 19 nt, Human
agcaucaggccaggcccuc

SEQ ID NO: 3130161 - RNA, 12 nt, Human
agcauggcugcc

SEQ ID NO: 3130162 - RNA, 14 nt, Human
ugaguacuacaguc

SEQ ID NO: 3130163 - RNA, 23 nt, Human
ugaguacuacaguccucccaucu

SEQ ID NO: 3130164 - RNA, 22 nt, Human
ugaguacuacaguccucccauc

SEQ ID NO: 3130165 - RNA, 21 nt, Human
ugaguacuacaguccucccau

SEQ ID NO: 3130166 - RNA, 17 nt, Human
ugaguacuacaguccuc

SEQ ID NO: 3130167 - RNA, 14 nt, Human
agcauauucaggaa

SEQ ID NO: 3130168 - RNA, 15 nt, Human
ugaguacuacagucc

SEQ ID NO: 3130169 - RNA, 20 nt, Human
agcauacguacacauuuuau

SEQ ID NO: 3130170 - RNA, 21 nt, Human
agcauacguacacauuuuauu

SEQ ID NO: 3130171 - RNA, 16 nt, Human
agcauacguacacauu

SEQ ID NO: 3130172 - RNA, 17 nt, Human
agcauacguacacauuu

SEQ ID NO: 3130173 - RNA, 18 nt, Human
agcauacguacacauuuu

SEQ ID NO: 3130174 - RNA, 19 nt, Human
agcauacguacacauuuua

SEQ ID NO: 3130175 - RNA, 12 nt, Human
ugagaauuaccc

SEQ ID NO: 3130176 - RNA, 15 nt, Human
agcauacguacacau

SEQ ID NO: 3130177 - RNA, 17 nt, Human
ugaguucauacccuguu

SEQ ID NO: 3130178 - RNA, 20 nt, Human
ugauaagaaccuuuugagug

SEQ ID NO: 3130179 - RNA, 18 nt, Human
ugauacaaugcugugccc

SEQ ID NO: 3130180 - RNA, 20 nt, Human
ugauacaaugcugugcccua

SEQ ID NO: 3130181 - RNA, 21 nt, Human
ugauacaaugcugugcccuaa

SEQ ID NO: 3130182 - RNA, 14 nt, Human
ugauacuacaguuu

SEQ ID NO: 3130183 - RNA, 17 nt, Human
ugauacuacaguuuguu

SEQ ID NO: 3130184 - RNA, 14 nt, Human
ugagucaccaagcc

SEQ ID NO: 3130185 - RNA, 16 nt, Human
ugagucaccaagccca

SEQ ID NO: 3130186 - RNA, 17 nt, Human
ugagucaccaagcccag

SEQ ID NO: 3130187 - RNA, 20 nt, Human
ugagugccuuacacaauggu

SEQ ID NO: 3130188 - RNA, 17 nt, Human
ugagugccuuacacaau

SEQ ID NO: 3130189 - RNA, 16 nt, Human
ugagugccuuacacaa

SEQ ID NO: 3130190 - RNA, 21 nt, Human
ugagugggugaauaauacagu

SEQ ID NO: 3130191 - RNA, 23 nt, Human
ugagugggggaucacagccucug

SEQ ID NO: 3130192 - RNA, 14 nt, Human
ugauucagcucugc

SEQ ID NO: 3130193 - RNA, 13 nt, Human
ugauucagcucug

SEQ ID NO: 3130194 - RNA, 18 nt, Human
agcccaggaaaggcucca

SEQ ID NO: 3130195 - RNA, 24 nt, Human
agcccaggaaaggcuccaggagca

SEQ ID NO: 3130196 - RNA, 23 nt, Human
agcccaggaaaggcuccaggagc

SEQ ID NO: 3130197 - RNA, 22 nt, Human
agcccaggaaaggcuccaggag

SEQ ID NO: 3130198 - RNA, 15 nt, Human
ugauucccaagcucu

SEQ ID NO: 3130199 - RNA, 16 nt, Human
ugauucccaagcucug

SEQ ID NO: 3130200 - RNA, 18 nt, Human
ugauucccaagcucugcu

SEQ ID NO: 3130201 - RNA, 19 nt, Human
ugauucccaagcucugcuc

SEQ ID NO: 3130202 - RNA, 21 nt, Human
ugauucccaagcucugcuccu

SEQ ID NO: 3130203 - RNA, 21 nt, Human
agcccaggaaaggcuccagga

SEQ ID NO: 3130204 - RNA, 20 nt, Human
agcccaggaaaggcuccagg

SEQ ID NO: 3130205 - RNA, 19 nt, Human
agcccaggaaaggcuccag

SEQ ID NO: 3130206 - RNA, 22 nt, Human
agcccacuucugccauauucug

SEQ ID NO: 3130207 - RNA, 14 nt, Human
agccaggccacaag

SEQ ID NO: 3130208 - RNA, 12 nt, Human
agccaggccaca

SEQ ID NO: 3130209 - RNA, 23 nt, Human
agccaguaaaugggggugcauuu

SEQ ID NO: 3130210 - RNA, 22 nt, Human
agccaguaaaugggggugcauu

SEQ ID NO: 3130211 - RNA, 12 nt, Human
agccagggucuc

SEQ ID NO: 3130212 - RNA, 22 nt, Human
agccaggccacaagacccuugu

SEQ ID NO: 3130213 - RNA, 21 nt, Human
agccaggccacaagacccuug

SEQ ID NO: 3130214 - RNA, 23 nt, Human
ugauguuuuccaugaguccccug

SEQ ID NO: 3130215 - RNA, 17 nt, Human
ugauguuuuaaggaugc

SEQ ID NO: 3130216 - RNA, 16 nt, Human
ugauggugcaaugacc

SEQ ID NO: 3130217 - RNA, 15 nt, Human
ugauggugcaaugac

SEQ ID NO: 3130218 - RNA, 23 nt, Human
ugauggugcaaugaccuuucaau

SEQ ID NO: 3130219 - RNA, 17 nt, Human
ugauggugcaaugaccu

SEQ ID NO: 3130220 - RNA, 20 nt, Human
ugaugauccuaggcauuugc

SEQ ID NO: 3130221 - RNA, 14 nt, Human
ugaugauccuaggc

SEQ ID NO: 3130222 - RNA, 20 nt, Human
agccacugcaccgggccaca

SEQ ID NO: 3130223 - RNA, 13 nt, Human
agccacugcaccg

SEQ ID NO: 3130224 - RNA, 21 nt, Human
agccacugcaccgggccacag

SEQ ID NO: 3130225 - RNA, 22 nt, Human
agccacugcaccgggccacaga

SEQ ID NO: 3130226 - RNA, 15 nt, Human
ugauuaauuaaaaca

SEQ ID NO: 3130227 - RNA, 14 nt, Human
agccacggccaggc

SEQ ID NO: 3130228 - RNA, 19 nt, Human
agccaccaacauacuccca

SEQ ID NO: 3130229 - RNA, 23 nt, Human
agccaccaacauacucccaucug

SEQ ID NO: 3130230 - RNA, 20 nt, Human
agccaccaacauacucccau

SEQ ID NO: 3130231 - RNA, 18 nt, Human
agccacauuccugaugcu

SEQ ID NO: 3130232 - RNA, 14 nt, Human
agccacauuccuga

SEQ ID NO: 3130233 - RNA, 15 nt, Human
agccacggccaggcc

SEQ ID NO: 3130234 - RNA, 17 nt, Human
agccucagcauccuggc

SEQ ID NO: 3130235 - RNA, 19 nt, Human
agccucagcauccuggcac

SEQ ID NO: 3130236 - RNA, 20 nt, Human
agccucagcauccuggcacc

SEQ ID NO: 3130237 - RNA, 21 nt, Human
agccucagcauccuggcaccc

SEQ ID NO: 3130238 - RNA, 16 nt, Human
agccucagcauccugg

SEQ ID NO: 3130239 - RNA, 16 nt, Human
agccucccaaagugcu

SEQ ID NO: 3130240 - RNA, 22 nt, Human
agccucagcauccuggcacccg

SEQ ID NO: 3130241 - RNA, 23 nt, Human
agccucagcauccuggcacccgg

SEQ ID NO: 3130242 - RNA, 22 nt, Human
ugcacuauagccuaggugacag

SEQ ID NO: 3130243 - RNA, 23 nt, Human
ugcacuauagccuaggugacaga

SEQ ID NO: 3130244 - RNA, 23 nt, Human
agcccuucuaccuuccugcaaca

SEQ ID NO: 3130245 - RNA, 23 nt, Human
ugcagccucaaccuccugggcua

SEQ ID NO: 3130246 - RNA, 15 nt, Human
ugcagccucacaguc

SEQ ID NO: 3130247 - RNA, 13 nt, Human
ugcagccucacag

SEQ ID NO: 3130248 - RNA, 16 nt, Human
ugcagccucacagucc

SEQ ID NO: 3130249 - RNA, 14 nt, Human
ugcauaaguuaacu

SEQ ID NO: 3130250 - RNA, 17 nt, Human
ugcauaaguuaacuucc

SEQ ID NO: 3130251 - RNA, 10 nt, Human
ugcacacauu

SEQ ID NO: 3130252 - RNA, 20 nt, Human
ugcacacauuuuuuaaaugc

SEQ ID NO: 3130253 - RNA, 17 nt, Human
ugcacccucaggcaggu

SEQ ID NO: 3130254 - RNA, 16 nt, Human
ugcacccucaggcagg

SEQ ID NO: 3130255 - RNA, 14 nt, Human
ugcacgugugugca

SEQ ID NO: 3130256 - RNA, 15 nt, Human
ugcacgugugugcac

SEQ ID NO: 3130257 - RNA, 22 nt, Human
agcccugguggcagugggagcu

SEQ ID NO: 3130258 - RNA, 23 nt, Human
agcccugguggcagugggagcug

SEQ ID NO: 3130259 - RNA, 15 nt, Human
ugcacaagcugcacc

SEQ ID NO: 3130260 - RNA, 14 nt, Human
ugcacaagcugcac

SEQ ID NO: 3130261 - RNA, 22 nt, Human
ugcacacaccagagcccaccuu

SEQ ID NO: 3130262 - RNA, 21 nt, Human
ugcacaagcugcacccucagg

SEQ ID NO: 3130263 - RNA, 18 nt, Human
ugcacaagcugcacccuc

SEQ ID NO: 3130264 - RNA, 24 nt, Human
agccccuucugacccaugcugccc

SEQ ID NO: 3130265 - RNA, 20 nt, Human
agccccuucugacccaugcu

SEQ ID NO: 3130266 - RNA, 21 nt, Human
agcccugguggcagugggagc

SEQ ID NO: 3130267 - RNA, 17 nt, Human
agccccgaggccuucuc

SEQ ID NO: 3130268 - RNA, 22 nt, Human
agccccgaggccuucucugaag

SEQ ID NO: 3130269 - RNA, 16 nt, Human
agccccgaggccuucu

SEQ ID NO: 3130270 - RNA, 23 nt, Human
agccccauucugccugcccaggc

SEQ ID NO: 3130271 - RNA, 18 nt, Human
agccccuggaugcagccu

SEQ ID NO: 3130272 - RNA, 17 nt, Human
agccccuggaugcagcc

SEQ ID NO: 3130273 - RNA, 19 nt, Human
agccccuggaugcagccuc

SEQ ID NO: 3130274 - RNA, 20 nt, Human
agccccaaaacucuccucug

SEQ ID NO: 3130275 - RNA, 22 nt, Human
agccccaaaacucuccucugcu

SEQ ID NO: 3130276 - RNA, 21 nt, Human
agccccaaaacucuccucugc

SEQ ID NO: 3130277 - RNA, 19 nt, Human
ugauucuccugccucagcc

SEQ ID NO: 3130278 - RNA, 15 nt, Human
ugauucuccugccuc

SEQ ID NO: 3130279 - RNA, 13 nt, Human
ugauucuccugcc

SEQ ID NO: 3130280 - RNA, 20 nt, Human
ugauucuccugccucagccu

SEQ ID NO: 3130281 - RNA, 20 nt, Human
agcucauucuccuuguguua

SEQ ID NO: 3130282 - RNA, 21 nt, Human
agcucauucuccuuguguuac

SEQ ID NO: 3130283 - RNA, 20 nt, Human
ugcccacaggaucagucuga

SEQ ID NO: 3130284 - RNA, 19 nt, Human
ugcccacaggaucagucug

SEQ ID NO: 3130285 - RNA, 16 nt, Human
ugcccacaggaucagu

SEQ ID NO: 3130286 - RNA, 20 nt, Human
ugcccagccccuucugaccc

SEQ ID NO: 3130287 - RNA, 21 nt, Human
ugcccagccccuucugaccca

SEQ ID NO: 3130288 - RNA, 22 nt, Human
agcucaggugucccugcacuug

SEQ ID NO: 3130289 - RNA, 20 nt, Human
agcucaggugucccugcacu

SEQ ID NO: 3130290 - RNA, 21 nt, Human
agcucaggugucccugcacuu

SEQ ID NO: 3130291 - RNA, 18 nt, Human
agcucaggugucccugca

SEQ ID NO: 3130292 - RNA, 17 nt, Human
agcucaggugucccugc

SEQ ID NO: 3130293 - RNA, 14 nt, Human
agcuaggccuggcc

SEQ ID NO: 3130294 - RNA, 15 nt, Human
agcuaggccuggcca

SEQ ID NO: 3130295 - RNA, 12 nt, Human
agcuaggccugg

SEQ ID NO: 3130296 - RNA, 18 nt, Human
agcuagacgagcaggcuu

SEQ ID NO: 3130297 - RNA, 19 nt, Human
agcgugagccacugcaccg

SEQ ID NO: 3130298 - RNA, 22 nt, Human
agcgugagccacugcaccgggc

SEQ ID NO: 3130299 - RNA, 15 nt, Human
agcgugcauaaguua

SEQ ID NO: 3130300 - RNA, 18 nt, Human
ugccaaugggagcucaug

SEQ ID NO: 3130301 - RNA, 18 nt, Human
ugcauuaucuagauacug

SEQ ID NO: 3130302 - RNA, 21 nt, Human
ugcauuaucuagauacuguau

SEQ ID NO: 3130303 - RNA, 22 nt, Human
ugcauuaucuagauacuguauc

SEQ ID NO: 3130304 - RNA, 20 nt, Human
ugcauuaucuagauacugua

SEQ ID NO: 3130305 - RNA, 18 nt, Human
agcggagacggaguccca

SEQ ID NO: 3130306 - RNA, 20 nt, Human
agcggagaaaggaagggcug

SEQ ID NO: 3130307 - RNA, 16 nt, Human
agcggagaaaggaagg

SEQ ID NO: 3130308 - RNA, 17 nt, Human
agccuuccagggguggg

SEQ ID NO: 3130309 - RNA, 16 nt, Human
agccuuccaggggugg

SEQ ID NO: 3130310 - RNA, 14 nt, Human
agccuuccaggggu

SEQ ID NO: 3130311 - RNA, 11 nt, Human
agccuuccagg

SEQ ID NO: 3130312 - RNA, 17 nt, Human
agccugcuccagcuguu

SEQ ID NO: 3130313 - RNA, 16 nt, Human
agccugcuccagcugu

SEQ ID NO: 3130314 - RNA, 15 nt, Human
agccugcuccagcug

SEQ ID NO: 3130315 - RNA, 14 nt, Human
agccugcuccagcu

SEQ ID NO: 3130316 - RNA, 12 nt, Human
ugcauaccacuu

SEQ ID NO: 3130317 - RNA, 22 nt, Human
agccugcuccagcuguucagcu

SEQ ID NO: 3130318 - RNA, 19 nt, Human
agccugcuccagcuguuca

SEQ ID NO: 3130319 - RNA, 22 nt, Human
agccugggugacagagcaagug

SEQ ID NO: 3130320 - RNA, 19 nt, Human
agccugugccucugggacu

SEQ ID NO: 3130321 - RNA, 21 nt, Human
agccugugccucugggacugg

SEQ ID NO: 3130322 - RNA, 22 nt, Human
agccuuagaagucacacaguau

SEQ ID NO: 3130323 - RNA, 23 nt, Human
uggccgggcgcgguggcucacgc

SEQ ID NO: 3130324 - RNA, 13 nt, Human
uggccucuucaga

SEQ ID NO: 3130325 - RNA, 20 nt, Human
aggccugggggcugggcaga

SEQ ID NO: 3130326 - RNA, 18 nt, Human
aggccugggggcugggca

SEQ ID NO: 3130327 - RNA, 12 nt, Human
aggccuggggac

SEQ ID NO: 3130328 - RNA, 12 nt, Human
uggccuggcccc

SEQ ID NO: 3130329 - RNA, 21 nt, Human
uggccuggccccucagggucc

SEQ ID NO: 3130330 - RNA, 18 nt, Human
uggccuggccccucaggg

SEQ ID NO: 3130331 - RNA, 21 nt, Human
uggccaaagccaaagcuaggc

SEQ ID NO: 3130332 - RNA, 23 nt, Human
uggccaaagccaaagcuaggccu

SEQ ID NO: 3130333 - RNA, 23 nt, Human
uggccagugugacaaggauugcu

SEQ ID NO: 3130334 - RNA, 17 nt, Human
aggccccgcccaggcuu

SEQ ID NO: 3130335 - RNA, 16 nt, Human
aggccccgcccaggcu

SEQ ID NO: 3130336 - RNA, 21 nt, Human
aggcccagagggccugcaagg

SEQ ID NO: 3130337 - RNA, 20 nt, Human
aggccagagggagugacaga

SEQ ID NO: 3130338 - RNA, 17 nt, Human
uggcagccuuggcaaac

SEQ ID NO: 3130339 - RNA, 15 nt, Human
uggcagcucaccucu

SEQ ID NO: 3130340 - RNA, 19 nt, Human
uggcagcucaccucucccu

SEQ ID NO: 3130341 - RNA, 16 nt, Human
aggccacaagacccuu

SEQ ID NO: 3130342 - RNA, 14 nt, Human
aggccagagggagu

SEQ ID NO: 3130343 - RNA, 19 nt, Human
aggccacaagacccuugug

SEQ ID NO: 3130344 - RNA, 18 nt, Human
aggccacaagacccuugu

SEQ ID NO: 3130345 - RNA, 17 nt, Human
aggccacaagacccuug

SEQ ID NO: 3130346 - RNA, 13 nt, Human
uggcagccuuggc

SEQ ID NO: 3130347 - RNA, 16 nt, Human
aggccaaggugggagg

SEQ ID NO: 3130348 - RNA, 18 nt, Human
aggcagccaggccacaag

SEQ ID NO: 3130349 - RNA, 16 nt, Human
aggcagccccauucug

SEQ ID NO: 3130350 - RNA, 17 nt, Human
aggcagccccauucugc

SEQ ID NO: 3130351 - RNA, 15 nt, Human
aggccaaaggaagca

SEQ ID NO: 3130352 - RNA, 19 nt, Human
aggccaaaggaagcacaug

SEQ ID NO: 3130353 - RNA, 18 nt, Human
aggccaaaggaagcacau

SEQ ID NO: 3130354 - RNA, 16 nt, Human
aggccaaaggaagcac

SEQ ID NO: 3130355 - RNA, 14 nt, Human
uggaguauauguca

SEQ ID NO: 3130356 - RNA, 13 nt, Human
uggauuguccccg

SEQ ID NO: 3130357 - RNA, 14 nt, Human
aggauccugagcca

SEQ ID NO: 3130358 - RNA, 13 nt, Human
aggauccugagcc

SEQ ID NO: 3130359 - RNA, 21 nt, Human
aggauacaaaagcaugugaga

SEQ ID NO: 3130360 - RNA, 17 nt, Human
uggaaaugggcagagca

SEQ ID NO: 3130361 - RNA, 22 nt, Human
ugcuuguacauaaugcgugcau

SEQ ID NO: 3130362 - RNA, 14 nt, Human
ugcuuguacauaau

SEQ ID NO: 3130363 - RNA, 16 nt, Human
ugcuuguacauaaugc

SEQ ID NO: 3130364 - RNA, 12 nt, Human
ugcuuugugauu

SEQ ID NO: 3130365 - RNA, 14 nt, Human
ugcuuugugauuuu

SEQ ID NO: 3130366 - RNA, 16 nt, Human
ugcuuugugauuuuug

SEQ ID NO: 3130367 - RNA, 14 nt, Human
ugcuuuuggucugu

SEQ ID NO: 3130368 - RNA, 17 nt, Human
ugcuuuuggucugugug

SEQ ID NO: 3130369 - RNA, 14 nt, Human
ugcuuggaggaagg

SEQ ID NO: 3130370 - RNA, 16 nt, Human
ugcuuggaggaaggaa

SEQ ID NO: 3130371 - RNA, 15 nt, Human
ugcuuggaggaagga

SEQ ID NO: 3130372 - RNA, 12 nt, Human
ugcuuguacaua

SEQ ID NO: 3130373 - RNA, 13 nt, Human
ugcuuguacauaa

SEQ ID NO: 3130374 - RNA, 21 nt, Human
ugcuugaggcaacucaucuua

SEQ ID NO: 3130375 - RNA, 23 nt, Human
uggacacagcucuucuccaggcu

SEQ ID NO: 3130376 - RNA, 18 nt, Human
uggacccugaggcccaga

SEQ ID NO: 3130377 - RNA, 16 nt, Human
uggacccugaggccca

SEQ ID NO: 3130378 - RNA, 20 nt, Human
uggacccugaggcccagagg

SEQ ID NO: 3130379 - RNA, 19 nt, Human
uggacccugaggcccagag

SEQ ID NO: 3130380 - RNA, 21 nt, Human
uggacccugaggcccagaggg

SEQ ID NO: 3130381 - RNA, 23 nt, Human
uggacccuguggaugauaaaaca

SEQ ID NO: 3130382 - RNA, 15 nt, Human
uggacccugaggccc

SEQ ID NO: 3130383 - RNA, 21 nt, Human
uggacacagcucuucuccagg

SEQ ID NO: 3130384 - RNA, 22 nt, Human
uggacacagcucuucuccaggc

SEQ ID NO: 3130385 - RNA, 13 nt, Human
uggacacagcucu

SEQ ID NO: 3130386 - RNA, 14 nt, Human
uggacacagcucuu

SEQ ID NO: 3130387 - RNA, 12 nt, Human
aggaucucuuga

SEQ ID NO: 3130388 - RNA, 19 nt, Human
aggaucucuugagccuggg

SEQ ID NO: 3130389 - RNA, 18 nt, Human
aggaucucuugagccugg

SEQ ID NO: 3130390 - RNA, 17 nt, Human
aggaucucuugagccug

SEQ ID NO: 3130391 - RNA, 15 nt, Human
aggcacccaccauca

SEQ ID NO: 3130392 - RNA, 14 nt, Human
aggcaaugcuggcu

SEQ ID NO: 3130393 - RNA, 20 nt, Human
aggcacccaccaucaugucu

SEQ ID NO: 3130394 - RNA, 21 nt, Human
aggcacccaccaucaugucug

SEQ ID NO: 3130395 - RNA, 22 nt, Human
aggcacccaccaucaugucugg

SEQ ID NO: 3130396 - RNA, 17 nt, Human
aggcaaggcugucaauu

SEQ ID NO: 3130397 - RNA, 22 nt, Human
uggagaagcggcuggcagccca

SEQ ID NO: 3130398 - RNA, 13 nt, Human
uggagaagcggcu

SEQ ID NO: 3130399 - RNA, 19 nt, Human
agcugugcucuggacaggc

SEQ ID NO: 3130400 - RNA, 20 nt, Human
agcugugcucuggacaggca

SEQ ID NO: 3130401 - RNA, 21 nt, Human
agcugugcucuggacaggcau

SEQ ID NO: 3130402 - RNA, 21 nt, Human
ugccuguucagcuccagcuca

SEQ ID NO: 3130403 - RNA, 19 nt, Human
ugccuguugggccaggagc

SEQ ID NO: 3130404 - RNA, 20 nt, Human
ugccuguugggccaggagcc

SEQ ID NO: 3130405 - RNA, 16 nt, Human
ugccuuauggaacacu

SEQ ID NO: 3130406 - RNA, 15 nt, Human
ugccuuauggaacac

SEQ ID NO: 3130407 - RNA, 17 nt, Human
ugccuguucagcuccag

SEQ ID NO: 3130408 - RNA, 13 nt, Human
agcuguucagcug

SEQ ID NO: 3130409 - RNA, 18 nt, Human
ugccuguucagcuccagc

SEQ ID NO: 3130410 - RNA, 20 nt, Human
ugccuguucagcuccagcuc

SEQ ID NO: 3130411 - RNA, 21 nt, Human
agcugcuuuugucuaugggac

SEQ ID NO: 3130412 - RNA, 19 nt, Human
agcugccuguucagcucca

SEQ ID NO: 3130413 - RNA, 21 nt, Human
agcugcuugggcuucauccuc

SEQ ID NO: 3130414 - RNA, 21 nt, Human
agcugccuguucagcuccagc

SEQ ID NO: 3130415 - RNA, 20 nt, Human
agcugcuugggcuucauccu

SEQ ID NO: 3130416 - RNA, 15 nt, Human
ugccuggauggggcu

SEQ ID NO: 3130417 - RNA, 14 nt, Human
ugccuggauggggc

SEQ ID NO: 3130418 - RNA, 20 nt, Human
agcugccuguucagcuccag

SEQ ID NO: 3130419 - RNA, 12 nt, Human
ugcccaggcagg

SEQ ID NO: 3130420 - RNA, 13 nt, Human
ugcccaggcaggu

SEQ ID NO: 3130421 - RNA, 14 nt, Human
ugcccaggcagguc

SEQ ID NO: 3130422 - RNA, 13 nt, Human
ugccucugccucu

SEQ ID NO: 3130423 - RNA, 14 nt, Human
ugccucugccucug

SEQ ID NO: 3130424 - RNA, 13 nt, Human
ugccugcccaggc

SEQ ID NO: 3130425 - RNA, 15 nt, Human
ugccucugccucuga

SEQ ID NO: 3130426 - RNA, 14 nt, Human
ugccugcccaggcc

SEQ ID NO: 3130427 - RNA, 15 nt, Human
ugccugcccaggccc

SEQ ID NO: 3130428 - RNA, 12 nt, Human
ugccucugccuc

SEQ ID NO: 3130429 - RNA, 24 nt, Human
ugccugcccaggccccugccaccc

SEQ ID NO: 3130430 - RNA, 16 nt, Human
ugccugcccaggcccc

SEQ ID NO: 3130431 - RNA, 23 nt, Human
ugcggacagccacggccaggcca

SEQ ID NO: 3130432 - RNA, 21 nt, Human
ugcggacagccacggccaggc

SEQ ID NO: 3130433 - RNA, 22 nt, Human
ugcggacagccacggccaggcc

SEQ ID NO: 3130434 - RNA, 18 nt, Human
ugcgguccacccaggagc

SEQ ID NO: 3130435 - RNA, 17 nt, Human
ugcggugcuaucucccc

SEQ ID NO: 3130436 - RNA, 17 nt, Human
ugcgguccacccaggag

SEQ ID NO: 3130437 - RNA, 19 nt, Human
ugcggccuuuggcuucacg

SEQ ID NO: 3130438 - RNA, 17 nt, Human
ugcggccuuuggcuuca

SEQ ID NO: 3130439 - RNA, 20 nt, Human
ugcgggcuuccuccuggugu

SEQ ID NO: 3130440 - RNA, 14 nt, Human
agcuguucagcugg

SEQ ID NO: 3130441 - RNA, 18 nt, Human
agcuugaggguugggcug

SEQ ID NO: 3130442 - RNA, 14 nt, Human
agcuugaggguugg

SEQ ID NO: 3130443 - RNA, 21 nt, Human
aggaagccagcaggcucucag

SEQ ID NO: 3130444 - RNA, 23 nt, Human
aggaagccagcaggcucucaggc

SEQ ID NO: 3130445 - RNA, 22 nt, Human
aggaagccagcaggcucucagg

SEQ ID NO: 3130446 - RNA, 20 nt, Human
aggaagccgcuggggccagu

SEQ ID NO: 3130447 - RNA, 19 nt, Human
aggaagccgcuggggccag

SEQ ID NO: 3130448 - RNA, 18 nt, Human
aggaagccgcuggggcca

SEQ ID NO: 3130449 - RNA, 18 nt, Human
aggaagccagcaggcucu

SEQ ID NO: 3130450 - RNA, 23 nt, Human
aggaaggaaacccagcucugguc

SEQ ID NO: 3130451 - RNA, 22 nt, Human
aggaaggaaacccagcucuggu

SEQ ID NO: 3130452 - RNA, 20 nt, Human
aggaaggaaacccagcucug

SEQ ID NO: 3130453 - RNA, 14 nt, Human
aggaaaggcuccag

SEQ ID NO: 3130454 - RNA, 13 nt, Human
aggaaaggcucca

SEQ ID NO: 3130455 - RNA, 15 nt, Human
aggaaaggcuccagg

SEQ ID NO: 3130456 - RNA, 11 nt, Human
aggaagcacau

SEQ ID NO: 3130457 - RNA, 17 nt, Human
aggaagcacaugccucu

SEQ ID NO: 3130458 - RNA, 16 nt, Human
aggaagcacaugccuc

SEQ ID NO: 3130459 - RNA, 19 nt, Human
aggaaaucaccgaaaacgu

SEQ ID NO: 3130460 - RNA, 15 nt, Human
aggaaaucaccgaaa

SEQ ID NO: 3130461 - RNA, 14 nt, Human
ugcucuggacaggc

SEQ ID NO: 3130462 - RNA, 15 nt, Human
ugcucuggacaggca

SEQ ID NO: 3130463 - RNA, 16 nt, Human
ugcucuggacaggcau

SEQ ID NO: 3130464 - RNA, 18 nt, Human
ugcuaucucccccagccc

SEQ ID NO: 3130465 - RNA, 20 nt, Human
ugcuaucucccccagcccca

SEQ ID NO: 3130466 - RNA, 19 nt, Human
ugcuaucucccccagcccc

SEQ ID NO: 3130467 - RNA, 17 nt, Human
ugcugucccuuacguga

SEQ ID NO: 3130468 - RNA, 15 nt, Human
ugcugucccuuuucc

SEQ ID NO: 3130469 - RNA, 19 nt, Human
ugcugucccuuacgugagu

SEQ ID NO: 3130470 - RNA, 17 nt, Human
ugcugucccuuuuccuu

SEQ ID NO: 3130471 - RNA, 18 nt, Human
aggacacuaaccacgcug

SEQ ID NO: 3130472 - RNA, 16 nt, Human
ugcuuccagugaggcu

SEQ ID NO: 3130473 - RNA, 23 nt, Human
ugcuucaaggauccugagccaga

SEQ ID NO: 3130474 - RNA, 21 nt, Human
ugcuucaaggauccugagcca

SEQ ID NO: 3130475 - RNA, 20 nt, Human
ugcuucaaggauccugagcc

SEQ ID NO: 3130476 - RNA, 18 nt, Human
ugcugcccugcccaccug

SEQ ID NO: 3130477 - RNA, 17 nt, Human
ugcugcccugcccaccu

SEQ ID NO: 3130478 - RNA, 16 nt, Human
ugcugcccugcccacc

SEQ ID NO: 3130479 - RNA, 13 nt, Human
ugcugcccugccc

SEQ ID NO: 3130480 - RNA, 21 nt, Human
ugcugcccugcccaccuggcc

SEQ ID NO: 3130481 - RNA, 19 nt, Human
ugcugcccugcccaccugg

SEQ ID NO: 3130482 - RNA, 12 nt, Human
ugcugcccugcc

SEQ ID NO: 3130483 - RNA, 11 nt, Human
ugcugcccugu

SEQ ID NO: 3130484 - RNA, 18 nt, Human
ugcuggcuguuggcuggg

SEQ ID NO: 3130485 - RNA, 19 nt, Human
ugcugggauuacaagcgug

SEQ ID NO: 3130486 - RNA, 19 nt, Human
ugcuggcuguuggcugggg

SEQ ID NO: 3130487 - RNA, 21 nt, Human
ugcuggcuguuggcugggggc

SEQ ID NO: 3130488 - RNA, 21 nt, Human
ugcugggauuacaagcgugag

SEQ ID NO: 3130489 - RNA, 17 nt, Human
ugcugggauuacaggug

SEQ ID NO: 3130490 - RNA, 24 nt, Human
agggguucccuuuuuuggcugcug

SEQ ID NO: 3130491 - RNA, 20 nt, Human
agggucucacuauguugccc

SEQ ID NO: 3130492 - RNA, 21 nt, Human
agggucucacuauguugccca

SEQ ID NO: 3130493 - RNA, 22 nt, Human
agggucucacuauguugcccag

SEQ ID NO: 3130494 - RNA, 23 nt, Human
agggucucacuauguugcccagg

SEQ ID NO: 3130495 - RNA, 15 nt, Human
aggggguggccuccc

SEQ ID NO: 3130496 - RNA, 18 nt, Human
aggggguggccucccaac

SEQ ID NO: 3130497 - RNA, 17 nt, Human
aggggguggccucccaa

SEQ ID NO: 3130498 - RNA, 22 nt, Human
aggggugggacacccugugaug

SEQ ID NO: 3130499 - RNA, 20 nt, Human
aggggugggacacccuguga

SEQ ID NO: 3130500 - RNA, 18 nt, Human
aggggugggacacccugu

SEQ ID NO: 3130501 - RNA, 19 nt, Human
uggggucacucuggcagcu

SEQ ID NO: 3130502 - RNA, 23 nt, Human
aggggagcaaaaucgaugcagug

SEQ ID NO: 3130503 - RNA, 16 nt, Human
ugguacuaacuuuccu

SEQ ID NO: 3130504 - RNA, 22 nt, Human
agggucucacucugucgcccag

SEQ ID NO: 3130505 - RNA, 21 nt, Human
agggucucacucugucgccca

SEQ ID NO: 3130506 - RNA, 22 nt, Human
uggguggcaccagcagccugga

SEQ ID NO: 3130507 - RNA, 22 nt, Human
ugggugcuuggaggaaggaaac

SEQ ID NO: 3130508 - RNA, 19 nt, Human
ugggugcuuggaggaagga

SEQ ID NO: 3130509 - RNA, 15 nt, Human
ugggugcuuggagga

SEQ ID NO: 3130510 - RNA, 16 nt, Human
uggucugacccacugc

SEQ ID NO: 3130511 - RNA, 17 nt, Human
uggucugacccacugcu

SEQ ID NO: 3130512 - RNA, 21 nt, Human
aggguggugaccucugccuga

SEQ ID NO: 3130513 - RNA, 22 nt, Human
aggguguccggucccuguccca

SEQ ID NO: 3130514 - RNA, 13 nt, Human
aggguuauaauaa

SEQ ID NO: 3130515 - RNA, 13 nt, Human
uggucccacccca

SEQ ID NO: 3130516 - RNA, 16 nt, Human
uggucucaaacucuug

SEQ ID NO: 3130517 - RNA, 19 nt, Human
uggucuacacugugcugag

SEQ ID NO: 3130518 - RNA, 16 nt, Human
uggucccaccccacac

SEQ ID NO: 3130519 - RNA, 17 nt, Human
uggucucaaacucuuga

SEQ ID NO: 3130520 - RNA, 23 nt, Human
uggucucaaacucuugaccucag

SEQ ID NO: 3130521 - RNA, 15 nt, Human
uggucccaccccaca

SEQ ID NO: 3130522 - RNA, 14 nt, Human
uggucccaccccac

SEQ ID NO: 3130523 - RNA, 18 nt, Human
uggucaccaaaucagcug

SEQ ID NO: 3130524 - RNA, 22 nt, Human
uggucagauuugaacucuucaa

SEQ ID NO: 3130525 - RNA, 17 nt, Human
aggucauuuuuuuuaag

SEQ ID NO: 3130526 - RNA, 12 nt, Human
aggucagagccu

SEQ ID NO: 3130527 - RNA, 18 nt, Human
aggguuggccccugcccg

SEQ ID NO: 3130528 - RNA, 23 nt, Human
aggguuggccccugcccggcugc

SEQ ID NO: 3130529 - RNA, 17 nt, Human
aggguuggccccugccc

SEQ ID NO: 3130530 - RNA, 17 nt, Human
agguagaaauaucugaa

SEQ ID NO: 3130531 - RNA, 19 nt, Human
agguagaaauaucugaaaa

SEQ ID NO: 3130532 - RNA, 23 nt, Human
agguagaaauaucugaaaaugua

SEQ ID NO: 3130533 - RNA, 21 nt, Human
agguaugcaaucaaaucugcu

SEQ ID NO: 3130534 - RNA, 17 nt, Human
agguaugcaaucaaauc

SEQ ID NO: 3130535 - RNA, 17 nt, Human
ugggcaacccccagccu

SEQ ID NO: 3130536 - RNA, 20 nt, Human
ugggcaacccccagccugcu

SEQ ID NO: 3130537 - RNA, 20 nt, Human
ugggcccaaugcacuuuguu

SEQ ID NO: 3130538 - RNA, 16 nt, Human
ugggccaggagccucc

SEQ ID NO: 3130539 - RNA, 14 nt, Human
ugggccaggagccu

SEQ ID NO: 3130540 - RNA, 13 nt, Human
ugggccaggagcc

SEQ ID NO: 3130541 - RNA, 17 nt, Human
ugggaggucaaggcugc

SEQ ID NO: 3130542 - RNA, 23 nt, Human
ugggaggucaaggcugcagugag

SEQ ID NO: 3130543 - RNA, 20 nt, Human
ugggaggucaaggcugcagu

SEQ ID NO: 3130544 - RNA, 19 nt, Human
ugggaggucaaggcugcag

SEQ ID NO: 3130545 - RNA, 18 nt, Human
ugggaggucaaggcugca

SEQ ID NO: 3130546 - RNA, 16 nt, Human
ugggcaacccccagcc

SEQ ID NO: 3130547 - RNA, 17 nt, Human
agggaggugaccccagg

SEQ ID NO: 3130548 - RNA, 17 nt, Human
agggagugacagaggca

SEQ ID NO: 3130549 - RNA, 18 nt, Human
agggagugacagaggcag

SEQ ID NO: 3130550 - RNA, 19 nt, Human
agggagugacagaggcagc

SEQ ID NO: 3130551 - RNA, 15 nt, Human
agggagggcuucugc

SEQ ID NO: 3130552 - RNA, 23 nt, Human
agggcccagagaggguggugacc

SEQ ID NO: 3130553 - RNA, 18 nt, Human
agggcccagagagggugg

SEQ ID NO: 3130554 - RNA, 16 nt, Human
uggggcccugccuccu

SEQ ID NO: 3130555 - RNA, 15 nt, Human
uggggcccugccucc

SEQ ID NO: 3130556 - RNA, 18 nt, Human
uggggcggugagagggga

SEQ ID NO: 3130557 - RNA, 23 nt, Human
uggggaccucaggccugggggcu

SEQ ID NO: 3130558 - RNA, 12 nt, Human
uggggagaaagu

SEQ ID NO: 3130559 - RNA, 14 nt, Human
uggggcccugccuc

SEQ ID NO: 3130560 - RNA, 15 nt, Human
ugggguacccacugc

SEQ ID NO: 3130561 - RNA, 16 nt, Human
ugggguacccacugcu

SEQ ID NO: 3130562 - RNA, 20 nt, Human
ugggguacccacugcucugg

SEQ ID NO: 3130563 - RNA, 18 nt, Human
uggggucacucuggcagc

SEQ ID NO: 3130564 - RNA, 17 nt, Human
uggggucacucuggcag

SEQ ID NO: 3130565 - RNA, 14 nt, Human
ugggguacccacug

SEQ ID NO: 3130566 - RNA, 20 nt, Human
uggggcugcaccggcuggcc

SEQ ID NO: 3130567 - RNA, 23 nt, Human
agggcuucugccauuucugagau

SEQ ID NO: 3130568 - RNA, 15 nt, Human
ugggcucccuuccca

SEQ ID NO: 3130569 - RNA, 19 nt, Human
ugggcucccuucccaccuc

SEQ ID NO: 3130570 - RNA, 18 nt, Human
ugggcucccuucccaccu

SEQ ID NO: 3130571 - RNA, 20 nt, Human
ugggcucccuucccaccucu

SEQ ID NO: 3130572 - RNA, 19 nt, Human
ugggcuggguucuacccag

SEQ ID NO: 3130573 - RNA, 18 nt, Human
ugggcuggguucuaccca

SEQ ID NO: 3130574 - RNA, 13 nt, Human
uggggaccucagg

SEQ ID NO: 3130575 - RNA, 18 nt, Human
uggggaccagagcugcca

SEQ ID NO: 3130576 - RNA, 17 nt, Human
uggggaccagagcugcc

SEQ ID NO: 3130577 - RNA, 15 nt, Human
uggggaccagagcug

SEQ ID NO: 3130578 - RNA, 14 nt, Human
uggggaccagagcu

SEQ ID NO: 3130579 - RNA, 22 nt, Human
agucagaaguuucugccgcagc

SEQ ID NO: 3130580 - RNA, 15 nt, Human
ugucgggcaugacac

SEQ ID NO: 3130581 - RNA, 14 nt, Human
ugucgggcaugaca

SEQ ID NO: 3130582 - RNA, 14 nt, Human
ugucgcccagucug

SEQ ID NO: 3130583 - RNA, 15 nt, Human
ugucgcccagucugg

SEQ ID NO: 3130584 - RNA, 12 nt, Human
ugucgggcauga

SEQ ID NO: 3130585 - RNA, 14 nt, Human
uguccgagcuuuga

SEQ ID NO: 3130586 - RNA, 13 nt, Human
uguccgagcuuug

SEQ ID NO: 3130587 - RNA, 17 nt, Human
ugucccuuuuccuuuuu

SEQ ID NO: 3130588 - RNA, 16 nt, Human
agucucacuguugccc

SEQ ID NO: 3130589 - RNA, 17 nt, Human
agucucacuguugccca

SEQ ID NO: 3130590 - RNA, 23 nt, Human
aguccgaaagggacuuggaagcu

SEQ ID NO: 3130591 - RNA, 12 nt, Human
agucccugccaa

SEQ ID NO: 3130592 - RNA, 16 nt, Human
aguaggaagacuuugg

SEQ ID NO: 3130593 - RNA, 22 nt, Human
aguaggaagacuuuggaaagac

SEQ ID NO: 3130594 - RNA, 19 nt, Human
aguaggaagacuuuggaaa

SEQ ID NO: 3130595 - RNA, 18 nt, Human
aguaggaagacuuuggaa

SEQ ID NO: 3130596 - RNA, 17 nt, Human
aguaggaagacuuugga

SEQ ID NO: 3130597 - RNA, 14 nt, Human
uguauuuuuuuacu

SEQ ID NO: 3130598 - RNA, 19 nt, Human
ugucaagagggucugagga

SEQ ID NO: 3130599 - RNA, 15 nt, Human
ugucaagccauaauu

SEQ ID NO: 3130600 - RNA, 13 nt, Human
agucaccaagccc

SEQ ID NO: 3130601 - RNA, 16 nt, Human
ugucagcugaaccugg

SEQ ID NO: 3130602 - RNA, 18 nt, Human
agucacugagacagcccg

SEQ ID NO: 3130603 - RNA, 19 nt, Human
agucacugagacagcccgg

SEQ ID NO: 3130604 - RNA, 19 nt, Human
ugucagcugaaccugggua

SEQ ID NO: 3130605 - RNA, 20 nt, Human
aggugggauccuccaggugc

SEQ ID NO: 3130606 - RNA, 18 nt, Human
aggugggauccuccaggu

SEQ ID NO: 3130607 - RNA, 21 nt, Human
aggugcacaagcuccaagcuc

SEQ ID NO: 3130608 - RNA, 15 nt, Human
aggugcacaagcucc

SEQ ID NO: 3130609 - RNA, 20 nt, Human
aggugcacaagcuccaagcu

SEQ ID NO: 3130610 - RNA, 18 nt, Human
aggugcacaagcuccaag

SEQ ID NO: 3130611 - RNA, 17 nt, Human
aggugcacaagcuccaa

SEQ ID NO: 3130612 - RNA, 16 nt, Human
aggugcacaagcucca

SEQ ID NO: 3130613 - RNA, 23 nt, Human
aggucuugaacuccuggccucaa

SEQ ID NO: 3130614 - RNA, 22 nt, Human
aggucuugaacuccuggccuca

SEQ ID NO: 3130615 - RNA, 14 nt, Human
agguuggugggggc

SEQ ID NO: 3130616 - RNA, 17 nt, Human
aggugguuauggagagg

SEQ ID NO: 3130617 - RNA, 23 nt, Human
uguaauuaaguacuauguaucaa

SEQ ID NO: 3130618 - RNA, 11 nt, Human
agguuuuccug

SEQ ID NO: 3130619 - RNA, 20 nt, Human
aguaagccgugauuuucauu

SEQ ID NO: 3130620 - RNA, 17 nt, Human
aguaauaugcacacauu

SEQ ID NO: 3130621 - RNA, 20 nt, Human
aguaauaugcacacauuuuu

SEQ ID NO: 3130622 - RNA, 18 nt, Human
aguaauaugcacacauuu

SEQ ID NO: 3130623 - RNA, 19 nt, Human
aguaauaugcacacauuuu

SEQ ID NO: 3130624 - RNA, 13 nt, Human
uguagagugggag

SEQ ID NO: 3130625 - RNA, 14 nt, Human
uguaauuugugaua

SEQ ID NO: 3130626 - RNA, 16 nt, Human
aguacacuguuucaaa

SEQ ID NO: 3130627 - RNA, 14 nt, Human
aguacacuguuuca

SEQ ID NO: 3130628 - RNA, 20 nt, Human
uguaggaagguuaauguuca

SEQ ID NO: 3130629 - RNA, 18 nt, Human
uguaggaagguuaauguu

SEQ ID NO: 3130630 - RNA, 12 nt, Human
aguagagacagg

SEQ ID NO: 3130631 - RNA, 16 nt, Human
agugagucgaggacag

SEQ ID NO: 3130632 - RNA, 22 nt, Human
agugauucuccugccucagccu

SEQ ID NO: 3130633 - RNA, 24 nt, Human
agugauucuccugccucagccucc

SEQ ID NO: 3130634 - RNA, 14 nt, Human
agugccaaaaacaa

SEQ ID NO: 3130635 - RNA, 16 nt, Human
agugccaaaaacaaca

SEQ ID NO: 3130636 - RNA, 14 nt, Human
agugcccacaggau

SEQ ID NO: 3130637 - RNA, 22 nt, Human
ugugcucugaucauccacugug

SEQ ID NO: 3130638 - RNA, 12 nt, Human
ugugcucugauc

SEQ ID NO: 3130639 - RNA, 23 nt, Human
ugugcucugaucauccacugugc

SEQ ID NO: 3130640 - RNA, 15 nt, Human
ugugcucuggacagg

SEQ ID NO: 3130641 - RNA, 20 nt, Human
agucucacuguugcccaggc

SEQ ID NO: 3130642 - RNA, 18 nt, Human
agucucacuguugcccag

SEQ ID NO: 3130643 - RNA, 19 nt, Human
agucucacuguugcccagg

SEQ ID NO: 3130644 - RNA, 20 nt, Human
ugugcccuaaaguguauuuu

SEQ ID NO: 3130645 - RNA, 21 nt, Human
ugugcccuaaaguguauuuuu

SEQ ID NO: 3130646 - RNA, 15 nt, Human
ugugcugcccugccc

SEQ ID NO: 3130647 - RNA, 21 nt, Human
uguggagaagcggcuggcagc

SEQ ID NO: 3130648 - RNA, 14 nt, Human
ugugcugcccugcc

SEQ ID NO: 3130649 - RNA, 13 nt, Human
ugugcugcccugc

SEQ ID NO: 3130650 - RNA, 12 nt, Human
ugugcugcccug

SEQ ID NO: 3130651 - RNA, 19 nt, Human
ugugcucuggacaggcaug

SEQ ID NO: 3130652 - RNA, 16 nt, Human
ugugcucuggacaggc

SEQ ID NO: 3130653 - RNA, 18 nt, Human
ugugcucuggacaggcau

SEQ ID NO: 3130654 - RNA, 13 nt, Human
ugugucucuuggu

SEQ ID NO: 3130655 - RNA, 17 nt, Human
ugugucagguggggcag

SEQ ID NO: 3130656 - RNA, 19 nt, Human
ugugucagguggggcagcu

SEQ ID NO: 3130657 - RNA, 14 nt, Human
uguguuaugaagca

SEQ ID NO: 3130658 - RNA, 23 nt, Human
uguguuaucacccagaagaaaau

SEQ ID NO: 3130659 - RNA, 19 nt, Human
uguuaaugauagcuacugu

SEQ ID NO: 3130660 - RNA, 11 nt, Human
aguggaaaaau

SEQ ID NO: 3130661 - RNA, 19 nt, Human
aguggaaaaauagccugcc

SEQ ID NO: 3130662 - RNA, 18 nt, Human
aguggaaaaauagccugc

SEQ ID NO: 3130663 - RNA, 21 nt, Human
uguuaacauggacaugaucuu

SEQ ID NO: 3130664 - RNA, 20 nt, Human
agugcugggauuacaagcgu

SEQ ID NO: 3130665 - RNA, 22 nt, Human
agugcugcauuuaaaagauaca

SEQ ID NO: 3130666 - RNA, 19 nt, Human
agugcugggauuacaggug

SEQ ID NO: 3130667 - RNA, 15 nt, Human
agugccuuacacaau

SEQ ID NO: 3130668 - RNA, 17 nt, Human
agugccuuacacaaugg

SEQ ID NO: 3130669 - RNA, 20 nt, Human
agugcugcauuuaaaagaua

SEQ ID NO: 3130670 - RNA, 16 nt, Human
uguggucccaccccac

SEQ ID NO: 3130671 - RNA, 16 nt, Human
agugcuuccaaggaug

SEQ ID NO: 3130672 - RNA, 12 nt, Human
ugugguuucauu

SEQ ID NO: 3130673 - RNA, 19 nt, Human
ugugucagcauagaaguaa

SEQ ID NO: 3130674 - RNA, 20 nt, Human
ugugguguuuccuggcacug

SEQ ID NO: 3130675 - RNA, 15 nt, Human
uguugcccaggcugg

SEQ ID NO: 3130676 - RNA, 13 nt, Human
uguugcccaggcu

SEQ ID NO: 3130677 - RNA, 19 nt, Human
uguucuugguuuguaaauu

SEQ ID NO: 3130678 - RNA, 20 nt, Human
uguucuugguuuguaaauua

SEQ ID NO: 3130679 - RNA, 22 nt, Human
uguucuugguuuguaaauuaac

SEQ ID NO: 3130680 - RNA, 18 nt, Human
uguucuuaguuugcaguu

SEQ ID NO: 3130681 - RNA, 18 nt, Human
uguucuagcauggcugcc

SEQ ID NO: 3130682 - RNA, 16 nt, Human
aguucaauucucauuu

SEQ ID NO: 3130683 - RNA, 23 nt, Human
aguuccucauuagcauuuugcua

SEQ ID NO: 3130684 - RNA, 14 nt, Human
uguuuauugucaaa

SEQ ID NO: 3130685 - RNA, 20 nt, Human
uguuuagauaauacaccacu

SEQ ID NO: 3130686 - RNA, 12 nt, Human
auaauacaccac

SEQ ID NO: 3130687 - RNA, 18 nt, Human
auaauacaccacuacauu

SEQ ID NO: 3130688 - RNA, 20 nt, Human
auaauacaccacuacauucu

SEQ ID NO: 3130689 - RNA, 15 nt, Human
auaaugcgugcauac

SEQ ID NO: 3130690 - RNA, 15 nt, Human
auaaugaaugaaaca

SEQ ID NO: 3130691 - RNA, 22 nt, Human
auaauugacaggauuauuggaa

SEQ ID NO: 3130692 - RNA, 15 nt, Human
uuaguuucuccaagc

SEQ ID NO: 3130693 - RNA, 22 nt, Human
uuaguuugcaguuacacuaaaa

SEQ ID NO: 3130694 - RNA, 18 nt, Human
uuagguuggcaaaaaggc

SEQ ID NO: 3130695 - RNA, 16 nt, Human
uuaggugaggaagcaa

SEQ ID NO: 3130696 - RNA, 16 nt, Human
uuaggugugacugaau

SEQ ID NO: 3130697 - RNA, 20 nt, Human
uuagggaaggauacaaaagc

SEQ ID NO: 3130698 - RNA, 15 nt, Human
uuaggugaggaagca

SEQ ID NO: 3130699 - RNA, 18 nt, Human
uuagcaaauucuguuuuu

SEQ ID NO: 3130700 - RNA, 18 nt, Human
uuagccaagugugguaga

SEQ ID NO: 3130701 - RNA, 13 nt, Human
uuagacagagucu

SEQ ID NO: 3130702 - RNA, 20 nt, Human
uuagacagagucucacuguu

SEQ ID NO: 3130703 - RNA, 13 nt, Human
uuagacagucccu

SEQ ID NO: 3130704 - RNA, 19 nt, Human
uuacccucauguucuuaau

SEQ ID NO: 3130705 - RNA, 20 nt, Human
auaaccaguguuguggauuu

SEQ ID NO: 3130706 - RNA, 11 nt, Human
auaaauuauuu

SEQ ID NO: 3130707 - RNA, 16 nt, Human
uuaaaaaucucaaauu

SEQ ID NO: 3130708 - RNA, 14 nt, Human
uuaaaaaucucaaa

SEQ ID NO: 3130709 - RNA, 15 nt, Human
uuaaaaaucucaaau

SEQ ID NO: 3130710 - RNA, 15 nt, Human
uuaaauaaugugaaa

SEQ ID NO: 3130711 - RNA, 13 nt, Human
uuaaauaauguga

SEQ ID NO: 3130712 - RNA, 16 nt, Human
uuaaauaaugugaaac

SEQ ID NO: 3130713 - RNA, 18 nt, Human
uuaaauaaugugaaacug

SEQ ID NO: 3130714 - RNA, 20 nt, Human
uuaacagaaauguacagcaa

SEQ ID NO: 3130715 - RNA, 19 nt, Human
uuaacagaaauguacagca

SEQ ID NO: 3130716 - RNA, 16 nt, Human
uuaacagaaauguaca

SEQ ID NO: 3130717 - RNA, 13 nt, Human
aguugggcuuccu

SEQ ID NO: 3130718 - RNA, 19 nt, Human
aguugggcuuccucauagu

SEQ ID NO: 3130719 - RNA, 23 nt, Human
aguugccagucaccccggccacc

SEQ ID NO: 3130720 - RNA, 13 nt, Human
uuaaaaaaaaucc

SEQ ID NO: 3130721 - RNA, 17 nt, Human
aguuggucccccuucca

SEQ ID NO: 3130722 - RNA, 13 nt, Human
aguuggucccccu

SEQ ID NO: 3130723 - RNA, 11 nt, Human
aguuggucccc

SEQ ID NO: 3130724 - RNA, 22 nt, Human
uuaaucauuaggugugacugaa

SEQ ID NO: 3130725 - RNA, 23 nt, Human
uuaaucauuaggugugacugaau

SEQ ID NO: 3130726 - RNA, 13 nt, Human
uuaaucauuaggu

SEQ ID NO: 3130727 - RNA, 19 nt, Human
uuaaugaaagacuguacaa

SEQ ID NO: 3130728 - RNA, 22 nt, Human
uuaaucugguuuauuuuuguuc

SEQ ID NO: 3130729 - RNA, 18 nt, Human
uuaaugaaagacuguaca

SEQ ID NO: 3130730 - RNA, 22 nt, Human
uuaagaaagacuaucuaaaugu

SEQ ID NO: 3130731 - RNA, 9 nt, Human
uuaaggugg

SEQ ID NO: 3130732 - RNA, 19 nt, Human
uuaagugcugcauuuaaaa

SEQ ID NO: 3130733 - RNA, 15 nt, Human
uuaagugcugcauuu

SEQ ID NO: 3130734 - RNA, 16 nt, Human
uuaagugcugcauuua

SEQ ID NO: 3130735 - RNA, 14 nt, Human
uuaagugcugcauu

SEQ ID NO: 3130736 - RNA, 23 nt, Human
aguuuuuauggcuuuugugcauu

SEQ ID NO: 3130737 - RNA, 21 nt, Human
uuaagaaaaaggaugcacaga

SEQ ID NO: 3130738 - RNA, 19 nt, Human
uuaagaaaaaggaugcaca

SEQ ID NO: 3130739 - RNA, 20 nt, Human
uuaagaaaaaggaugcacag

SEQ ID NO: 3130740 - RNA, 23 nt, Human
ucaaggauccugagccagauuuc

SEQ ID NO: 3130741 - RNA, 17 nt, Human
ucaagagggucugagga

SEQ ID NO: 3130742 - RNA, 16 nt, Human
ucaagugauucuccug

SEQ ID NO: 3130743 - RNA, 17 nt, Human
ucaagugauucuccugc

SEQ ID NO: 3130744 - RNA, 17 nt, Human
ucaauaggaaaaacuga

SEQ ID NO: 3130745 - RNA, 19 nt, Human
ucaauaggaaaaacugauu

SEQ ID NO: 3130746 - RNA, 18 nt, Human
ucaauaggaaaaacugau

SEQ ID NO: 3130747 - RNA, 22 nt, Human
ucaauaggaaaaacugauuuuu

SEQ ID NO: 3130748 - RNA, 21 nt, Human
acauuuuuuaaaugcaccugg

SEQ ID NO: 3130749 - RNA, 13 nt, Human
acauuuuucuuag

SEQ ID NO: 3130750 - RNA, 23 nt, Human
acauuuuucuuagggaaggauac

SEQ ID NO: 3130751 - RNA, 15 nt, Human
acauuuuuaagugcu

SEQ ID NO: 3130752 - RNA, 18 nt, Human
acauuuuuaagugcugca

SEQ ID NO: 3130753 - RNA, 21 nt, Human
acauugcggacagccacggcc

SEQ ID NO: 3130754 - RNA, 22 nt, Human
acauugcggacagccacggcca

SEQ ID NO: 3130755 - RNA, 15 nt, Human
ucacagaugggugcu

SEQ ID NO: 3130756 - RNA, 14 nt, Human
ucacagaugggugc

SEQ ID NO: 3130757 - RNA, 16 nt, Human
ucacauauugauuucc

SEQ ID NO: 3130758 - RNA, 18 nt, Human
ucacauauugauuuccgu

SEQ ID NO: 3130759 - RNA, 20 nt, Human
ucacauauugauuuccguua

SEQ ID NO: 3130760 - RNA, 17 nt, Human
ucaccagccccagugcc

SEQ ID NO: 3130761 - RNA, 16 nt, Human
ucaccagccccagugc

SEQ ID NO: 3130762 - RNA, 17 nt, Human
accacacagaggcugcc

SEQ ID NO: 3130763 - RNA, 15 nt, Human
accacacccagccca

SEQ ID NO: 3130764 - RNA, 16 nt, Human
accacacccagcccac

SEQ ID NO: 3130765 - RNA, 20 nt, Human
accacacccagcccacuucu

SEQ ID NO: 3130766 - RNA, 21 nt, Human
accacacccagcccacuucug

SEQ ID NO: 3130767 - RNA, 23 nt, Human
accacacccagcccacuucugcc

SEQ ID NO: 3130768 - RNA, 16 nt, Human
accaacauacucccau

SEQ ID NO: 3130769 - RNA, 20 nt, Human
accaaccacugcgaccacaa

SEQ ID NO: 3130770 - RNA, 16 nt, Human
accaaaucagcugcua

SEQ ID NO: 3130771 - RNA, 19 nt, Human
accaaaucagcugcuacua

SEQ ID NO: 3130772 - RNA, 15 nt, Human
acauggaguauaugu

SEQ ID NO: 3130773 - RNA, 19 nt, Human
acauggaguauaugucaag

SEQ ID NO: 3130774 - RNA, 23 nt, Human
acaugagcaucaggccaggcccu

SEQ ID NO: 3130775 - RNA, 20 nt, Human
acaugagcaucaggccaggc

SEQ ID NO: 3130776 - RNA, 20 nt, Human
acauggaauaacauguaauu

SEQ ID NO: 3130777 - RNA, 14 nt, Human
acauggaaguacua

SEQ ID NO: 3130778 - RNA, 18 nt, Human
acauggaauaacauguaa

SEQ ID NO: 3130779 - RNA, 21 nt, Human
acaugucuuuucuugcaugag

SEQ ID NO: 3130780 - RNA, 22 nt, Human
ucaaagauauuuugcuuuguga

SEQ ID NO: 3130781 - RNA, 13 nt, Human
ucaaagauauuuu

SEQ ID NO: 3130782 - RNA, 20 nt, Human
ucaaagauauuuugcuuugu

SEQ ID NO: 3130783 - RNA, 16 nt, Human
ucaaaagcugggcagg

SEQ ID NO: 3130784 - RNA, 13 nt, Human
acaugagcaucag

SEQ ID NO: 3130785 - RNA, 23 nt, Human
acaugaaaacacauuuuucuuag

SEQ ID NO: 3130786 - RNA, 22 nt, Human
acaugaaaacacauuuuucuua

SEQ ID NO: 3130787 - RNA, 15 nt, Human
acaugaaaacacauu

SEQ ID NO: 3130788 - RNA, 14 nt, Human
acaucuugcucugc

SEQ ID NO: 3130789 - RNA, 19 nt, Human
acaucuuggucagauuuga

SEQ ID NO: 3130790 - RNA, 22 nt, Human
acaucuugcucugcugacagac

SEQ ID NO: 3130791 - RNA, 17 nt, Human
acaucuugcucugcuga

SEQ ID NO: 3130792 - RNA, 15 nt, Human
acaucuugcucugcu

SEQ ID NO: 3130793 - RNA, 16 nt, Human
acaucuugcucugcug

SEQ ID NO: 3130794 - RNA, 17 nt, Human
uauuuuuguagagccag

SEQ ID NO: 3130795 - RNA, 20 nt, Human
uauuuugcuuugugauuuuu

SEQ ID NO: 3130796 - RNA, 13 nt, Human
uauuuugcuuugu

SEQ ID NO: 3130797 - RNA, 15 nt, Human
uauuuugcuuuguga

SEQ ID NO: 3130798 - RNA, 21 nt, Human
acccuccuuucaccacaugug

SEQ ID NO: 3130799 - RNA, 22 nt, Human
acccgggaagggggcugggaca

SEQ ID NO: 3130800 - RNA, 14 nt, Human
acccucauguucuu

SEQ ID NO: 3130801 - RNA, 15 nt, Human
acccucauguucuua

SEQ ID NO: 3130802 - RNA, 17 nt, Human
acccucauguucuuaau

SEQ ID NO: 3130803 - RNA, 20 nt, Human
acccgggaagggggcuggga

SEQ ID NO: 3130804 - RNA, 19 nt, Human
acccgggaagggggcuggg

SEQ ID NO: 3130805 - RNA, 21 nt, Human
acccugaggcccagagggccu

SEQ ID NO: 3130806 - RNA, 19 nt, Human
acccugaggcccagagggc

SEQ ID NO: 3130807 - RNA, 17 nt, Human
acccugaggcccagagg

SEQ ID NO: 3130808 - RNA, 11 nt, Human
acccugaggcc

SEQ ID NO: 3130809 - RNA, 23 nt, Human
acccugaggcccagagggccugc

SEQ ID NO: 3130810 - RNA, 17 nt, Human
ucaggcaggugggaugg

SEQ ID NO: 3130811 - RNA, 18 nt, Human
ucaggcaggugggaugga

SEQ ID NO: 3130812 - RNA, 13 nt, Human
acccccagccugc

SEQ ID NO: 3130813 - RNA, 12 nt, Human
acccccagccug

SEQ ID NO: 3130814 - RNA, 16 nt, Human
ucaggccaggcccucu

SEQ ID NO: 3130815 - RNA, 15 nt, Human
ucaggccaggcccuc

SEQ ID NO: 3130816 - RNA, 14 nt, Human
ucaggccaggcccu

SEQ ID NO: 3130817 - RNA, 13 nt, Human
ucaggccaggccc

SEQ ID NO: 3130818 - RNA, 12 nt, Human
ucaggccaggcc

SEQ ID NO: 3130819 - RNA, 13 nt, Human
ucaggccagcugc

SEQ ID NO: 3130820 - RNA, 19 nt, Human
acccgcuaagagggaggga

SEQ ID NO: 3130821 - RNA, 18 nt, Human
ucaggguuggccccugcc

SEQ ID NO: 3130822 - RNA, 19 nt, Human
ucaggguuggccccugccc

SEQ ID NO: 3130823 - RNA, 17 nt, Human
ucaggguuggccccugc

SEQ ID NO: 3130824 - RNA, 19 nt, Human
ucaggggugugcggccuuu

SEQ ID NO: 3130825 - RNA, 12 nt, Human
ucaggggugugc

SEQ ID NO: 3130826 - RNA, 18 nt, Human
ucaggccaggcccucugc

SEQ ID NO: 3130827 - RNA, 17 nt, Human
ucaggccaggcccucug

SEQ ID NO: 3130828 - RNA, 19 nt, Human
ucaggccaggcccucugcc

SEQ ID NO: 3130829 - RNA, 22 nt, Human
ucaggugucccugcacuugcag

SEQ ID NO: 3130830 - RNA, 13 nt, Human
ucaguaagccgug

SEQ ID NO: 3130831 - RNA, 13 nt, Human
ucaguaauaacuc

SEQ ID NO: 3130832 - RNA, 20 nt, Human
acccuugccgucuaccugag

SEQ ID NO: 3130833 - RNA, 20 nt, Human
accgaaaacguggcugcuuc

SEQ ID NO: 3130834 - RNA, 15 nt, Human
ucaggugucccugca

SEQ ID NO: 3130835 - RNA, 23 nt, Human
ucagguggggucacucuggcagc

SEQ ID NO: 3130836 - RNA, 17 nt, Human
ucaggugucccugcacu

SEQ ID NO: 3130837 - RNA, 18 nt, Human
ucaggugucccugcacuu

SEQ ID NO: 3130838 - RNA, 22 nt, Human
accgaaaacguggcugcuucaa

SEQ ID NO: 3130839 - RNA, 21 nt, Human
accgaaaacguggcugcuuca

SEQ ID NO: 3130840 - RNA, 22 nt, Human
ucagguggggucacucuggcag

SEQ ID NO: 3130841 - RNA, 21 nt, Human
ucagguggggucacucuggca

SEQ ID NO: 3130842 - RNA, 23 nt, Human
ucagugccuuauggaacacucug

SEQ ID NO: 3130843 - RNA, 22 nt, Human
ucagugccuuauggaacacucu

SEQ ID NO: 3130844 - RNA, 20 nt, Human
ucagugccuuauggaacacu

SEQ ID NO: 3130845 - RNA, 19 nt, Human
ucagugccuuauggaacac

SEQ ID NO: 3130846 - RNA, 14 nt, Human
ucaguggcagcugc

SEQ ID NO: 3130847 - RNA, 15 nt, Human
ucaguggcagcugcu

SEQ ID NO: 3130848 - RNA, 17 nt, Human
ucaguuguuaguguguc

SEQ ID NO: 3130849 - RNA, 16 nt, Human
ucaguggcagcugcuu

SEQ ID NO: 3130850 - RNA, 18 nt, Human
ucagugccuuauggaaca

SEQ ID NO: 3130851 - RNA, 13 nt, Human
ucaguggcagcug

SEQ ID NO: 3130852 - RNA, 19 nt, Human
ucaguuguuagugugucuu

SEQ ID NO: 3130853 - RNA, 21 nt, Human
accauuuugggguacccacug

SEQ ID NO: 3130854 - RNA, 23 nt, Human
accauuuugcugucccuuuuccu

SEQ ID NO: 3130855 - RNA, 22 nt, Human
accauuuugcugucccuuuucc

SEQ ID NO: 3130856 - RNA, 18 nt, Human
accauucuccaccugcca

SEQ ID NO: 3130857 - RNA, 19 nt, Human
accauucuccaccugccag

SEQ ID NO: 3130858 - RNA, 21 nt, Human
accauucuccaccugccaggg

SEQ ID NO: 3130859 - RNA, 20 nt, Human
accauucuccaccugccagg

SEQ ID NO: 3130860 - RNA, 20 nt, Human
acccacugcuuuuggucugu

SEQ ID NO: 3130861 - RNA, 15 nt, Human
ucacuguugcccagg

SEQ ID NO: 3130862 - RNA, 18 nt, Human
ucacugcaaccuccgccu

SEQ ID NO: 3130863 - RNA, 14 nt, Human
ucacuguugcccag

SEQ ID NO: 3130864 - RNA, 22 nt, Human
ucaccagccccagugcccacag

SEQ ID NO: 3130865 - RNA, 20 nt, Human
ucacuauguugcccaggcag

SEQ ID NO: 3130866 - RNA, 21 nt, Human
ucacuauguugcccaggcagg

SEQ ID NO: 3130867 - RNA, 23 nt, Human
ucacugagacagcccgggcucug

SEQ ID NO: 3130868 - RNA, 23 nt, Human
ucagagacuccugcaggcagcca

SEQ ID NO: 3130869 - RNA, 15 nt, Human
ucagaucucuaacuu

SEQ ID NO: 3130870 - RNA, 16 nt, Human
ucagaucucuaacuuc

SEQ ID NO: 3130871 - RNA, 22 nt, Human
ucagagacuccugcaggcagcc

SEQ ID NO: 3130872 - RNA, 20 nt, Human
ucagaauucucagaaucuca

SEQ ID NO: 3130873 - RNA, 10 nt, Human
ucagaauucu

SEQ ID NO: 3130874 - RNA, 12 nt, Human
ucagaauucuca

SEQ ID NO: 3130875 - RNA, 23 nt, Human
ucagaaguuucugccgcagcccu

SEQ ID NO: 3130876 - RNA, 13 nt, Human
acccagcgagccc

SEQ ID NO: 3130877 - RNA, 16 nt, Human
acccagcgagcccugg

SEQ ID NO: 3130878 - RNA, 17 nt, Human
acccagcgagcccuggu

SEQ ID NO: 3130879 - RNA, 13 nt, Human
acccaggagcccc

SEQ ID NO: 3130880 - RNA, 15 nt, Human
acccaggagccccga

SEQ ID NO: 3130881 - RNA, 13 nt, Human
accccagguuucu

SEQ ID NO: 3130882 - RNA, 23 nt, Human
acccaggugcuaggaacacuccu

SEQ ID NO: 3130883 - RNA, 11 nt, Human
acccaggugcu

SEQ ID NO: 3130884 - RNA, 14 nt, Human
ucccaccccacaca

SEQ ID NO: 3130885 - RNA, 11 nt, Human
ucccaccccac

SEQ ID NO: 3130886 - RNA, 14 nt, Human
ucccacaaaggaga

SEQ ID NO: 3130887 - RNA, 15 nt, Human
ucccaaagugcuggg

SEQ ID NO: 3130888 - RNA, 16 nt, Human
ucccaaagugcuggga

SEQ ID NO: 3130889 - RNA, 14 nt, Human
acggcucacugcag

SEQ ID NO: 3130890 - RNA, 17 nt, Human
uccagugaggcucugcc

SEQ ID NO: 3130891 - RNA, 19 nt, Human
uccagugaggcucugcccu

SEQ ID NO: 3130892 - RNA, 18 nt, Human
uccagugaggcucugccc

SEQ ID NO: 3130893 - RNA, 20 nt, Human
uccagugaggcucugcccuu

SEQ ID NO: 3130894 - RNA, 17 nt, Human
uccaugaguccccuguu

SEQ ID NO: 3130895 - RNA, 16 nt, Human
uccaugaguccccugu

SEQ ID NO: 3130896 - RNA, 15 nt, Human
uccaugaguccccug

SEQ ID NO: 3130897 - RNA, 20 nt, Human
acgcgugcacacaccagagc

SEQ ID NO: 3130898 - RNA, 23 nt, Human
acgcgugcacacaccagagccca

SEQ ID NO: 3130899 - RNA, 14 nt, Human
acgcccccacuggu

SEQ ID NO: 3130900 - RNA, 17 nt, Human
acgcuacccgggaaggg

SEQ ID NO: 3130901 - RNA, 13 nt, Human
acgcuacccggga

SEQ ID NO: 3130902 - RNA, 19 nt, Human
acggagucccaccuuggcu

SEQ ID NO: 3130903 - RNA, 13 nt, Human
acggccaggccag

SEQ ID NO: 3130904 - RNA, 16 nt, Human
acggccaggccagagg

SEQ ID NO: 3130905 - RNA, 18 nt, Human
acgccaucccagccccaa

SEQ ID NO: 3130906 - RNA, 17 nt, Human
acgccaucccagcccca

SEQ ID NO: 3130907 - RNA, 16 nt, Human
acgccaucccagcccc

SEQ ID NO: 3130908 - RNA, 15 nt, Human
acgccaucccagccc

SEQ ID NO: 3130909 - RNA, 14 nt, Human
acgccaucccagcc

SEQ ID NO: 3130910 - RNA, 11 nt, Human
acgccauccca

SEQ ID NO: 3130911 - RNA, 23 nt, Human
acgccaggggaaaaucagccugc

SEQ ID NO: 3130912 - RNA, 15 nt, Human
acgacugcccggcag

SEQ ID NO: 3130913 - RNA, 18 nt, Human
acgccaggggaaaaucag

SEQ ID NO: 3130914 - RNA, 22 nt, Human
uccaggcuccuuuagcgcccag

SEQ ID NO: 3130915 - RNA, 18 nt, Human
uccaggcugggagagccu

SEQ ID NO: 3130916 - RNA, 17 nt, Human
uccaggcugggagagcc

SEQ ID NO: 3130917 - RNA, 14 nt, Human
uccaggcugggaga

SEQ ID NO: 3130918 - RNA, 14 nt, Human
accuucuccuucac

SEQ ID NO: 3130919 - RNA, 22 nt, Human
accuucuccuucaccuuugucc

SEQ ID NO: 3130920 - RNA, 16 nt, Human
accuugacagggcaca

SEQ ID NO: 3130921 - RNA, 13 nt, Human
accuuugucccca

SEQ ID NO: 3130922 - RNA, 14 nt, Human
accuuuuuuauaca

SEQ ID NO: 3130923 - RNA, 16 nt, Human
accuuuguccccaccg

SEQ ID NO: 3130924 - RNA, 15 nt, Human
accuuuguccccacc

SEQ ID NO: 3130925 - RNA, 14 nt, Human
accuuuguccccac

SEQ ID NO: 3130926 - RNA, 16 nt, Human
accuuuuuuauacaua

SEQ ID NO: 3130927 - RNA, 17 nt, Human
accuuuuuuauacauaa

SEQ ID NO: 3130928 - RNA, 18 nt, Human
accuuuuuuauacauaaa

SEQ ID NO: 3130929 - RNA, 21 nt, Human
accuggguaacuagggaagau

SEQ ID NO: 3130930 - RNA, 20 nt, Human
uccacccaggagccccgagg

SEQ ID NO: 3130931 - RNA, 12 nt, Human
uccacccaccuc

SEQ ID NO: 3130932 - RNA, 18 nt, Human
uccaccaucaagccacca

SEQ ID NO: 3130933 - RNA, 13 nt, Human
uccacccaccuca

SEQ ID NO: 3130934 - RNA, 17 nt, Human
uccacccaggagccccg

SEQ ID NO: 3130935 - RNA, 13 nt, Human
accuggccucugc

SEQ ID NO: 3130936 - RNA, 12 nt, Human
accuggccucug

SEQ ID NO: 3130937 - RNA, 20 nt, Human
accuggaauauauaaccagu

SEQ ID NO: 3130938 - RNA, 17 nt, Human
accuggaauauauaacc

SEQ ID NO: 3130939 - RNA, 16 nt, Human
accugcggugcuaucu

SEQ ID NO: 3130940 - RNA, 21 nt, Human
accugcgucucauacucaccu

SEQ ID NO: 3130941 - RNA, 23 nt, Human
accugccuguugggccaggagcc

SEQ ID NO: 3130942 - RNA, 16 nt, Human
ucauuugucacacacu

SEQ ID NO: 3130943 - RNA, 14 nt, Human
ucauuugucacaca

SEQ ID NO: 3130944 - RNA, 19 nt, Human
ucauuuuuaguagagacag

SEQ ID NO: 3130945 - RNA, 18 nt, Human
ucauuuuuuuuaagaaaa

SEQ ID NO: 3130946 - RNA, 17 nt, Human
ucauuuuuuuuaagaaa

SEQ ID NO: 3130947 - RNA, 17 nt, Human
accugccaggaagccag

SEQ ID NO: 3130948 - RNA, 16 nt, Human
accugccaggaagcca

SEQ ID NO: 3130949 - RNA, 18 nt, Human
accugccaggaagccagc

SEQ ID NO: 3130950 - RNA, 15 nt, Human
accugccaggaagcc

SEQ ID NO: 3130951 - RNA, 14 nt, Human
accugaggggccuc

SEQ ID NO: 3130952 - RNA, 23 nt, Human
accugaggcccuucucuccagcc

SEQ ID NO: 3130953 - RNA, 18 nt, Human
accugaagacucauucuu

SEQ ID NO: 3130954 - RNA, 19 nt, Human
accugaauuuuggcugugu

SEQ ID NO: 3130955 - RNA, 12 nt, Human
ucauaaugacuu

SEQ ID NO: 3130956 - RNA, 16 nt, Human
acucgcgacaaugcaa

SEQ ID NO: 3130957 - RNA, 15 nt, Human
acucgcgacaaugca

SEQ ID NO: 3130958 - RNA, 17 nt, Human
acucuggcagcucagag

SEQ ID NO: 3130959 - RNA, 16 nt, Human
acucuggcagcucaga

SEQ ID NO: 3130960 - RNA, 21 nt, Human
acucuuauugcccacgcugga

SEQ ID NO: 3130961 - RNA, 20 nt, Human
acucuggcagcucagagagg

SEQ ID NO: 3130962 - RNA, 19 nt, Human
acucuggcagcucagagag

SEQ ID NO: 3130963 - RNA, 15 nt, Human
uccguuaaaauacca

SEQ ID NO: 3130964 - RNA, 13 nt, Human
uccguuaaaauac

SEQ ID NO: 3130965 - RNA, 16 nt, Human
acucgaguuacagaca

SEQ ID NO: 3130966 - RNA, 21 nt, Human
uccuagccugugccucuggga

SEQ ID NO: 3130967 - RNA, 20 nt, Human
uccuagcacuuugggaggcc

SEQ ID NO: 3130968 - RNA, 21 nt, Human
uccucccaccucagccucccg

SEQ ID NO: 3130969 - RNA, 15 nt, Human
uccucccaccucagc

SEQ ID NO: 3130970 - RNA, 16 nt, Human
uccucccaccucagcc

SEQ ID NO: 3130971 - RNA, 18 nt, Human
uccucccaccucagccuc

SEQ ID NO: 3130972 - RNA, 20 nt, Human
uccucccaccucagccuccc

SEQ ID NO: 3130973 - RNA, 13 nt, Human
uccucccaccuca

SEQ ID NO: 3130974 - RNA, 14 nt, Human
uccucccaccucag

SEQ ID NO: 3130975 - RNA, 23 nt, Human
uccucuuuggucuacacugugcu

SEQ ID NO: 3130976 - RNA, 15 nt, Human
uccugaagaauugaa

SEQ ID NO: 3130977 - RNA, 19 nt, Human
acucuuucuauuguuucuu

SEQ ID NO: 3130978 - RNA, 13 nt, Human
acguacacacaca

SEQ ID NO: 3130979 - RNA, 12 nt, Human
acguacacauuu

SEQ ID NO: 3130980 - RNA, 13 nt, Human
acguacacauuuu

SEQ ID NO: 3130981 - RNA, 18 nt, Human
acuacggaauaguuggcu

SEQ ID NO: 3130982 - RNA, 19 nt, Human
acucacauuuauucugcuc

SEQ ID NO: 3130983 - RNA, 20 nt, Human
acucacauuuauucugcuca

SEQ ID NO: 3130984 - RNA, 14 nt, Human
acucaaugcacuga

SEQ ID NO: 3130985 - RNA, 12 nt, Human
acuauguaucaa

SEQ ID NO: 3130986 - RNA, 12 nt, Human
acuauaauguaa

SEQ ID NO: 3130987 - RNA, 11 nt, Human
acuauaaugua

SEQ ID NO: 3130988 - RNA, 13 nt, Human
acuauaauguaag

SEQ ID NO: 3130989 - RNA, 14 nt, Human
acuauaauguaagc

SEQ ID NO: 3130990 - RNA, 23 nt, Human
ucccugaaggccccgcccaggcu

SEQ ID NO: 3130991 - RNA, 17 nt, Human
acucaccccagccccaa

SEQ ID NO: 3130992 - RNA, 17 nt, Human
ucccugaaggccccgcc

SEQ ID NO: 3130993 - RNA, 18 nt, Human
ucccugaaggccccgccc

SEQ ID NO: 3130994 - RNA, 22 nt, Human
ucccugaaggccccgcccaggc

SEQ ID NO: 3130995 - RNA, 21 nt, Human
ucccugaaggccccgcccagg

SEQ ID NO: 3130996 - RNA, 21 nt, Human
ucccucuuucccucccuuccu

SEQ ID NO: 3130997 - RNA, 18 nt, Human
ucccucagucuggcccuu

SEQ ID NO: 3130998 - RNA, 11 nt, Human
ucccucuuucc

SEQ ID NO: 3130999 - RNA, 13 nt, Human
ucccucuuucccu

SEQ ID NO: 3131000 - RNA, 18 nt, Human
acucauugaccugaggcc

SEQ ID NO: 3131001 - RNA, 17 nt, Human
acucauugaccugaggc

SEQ ID NO: 3131002 - RNA, 16 nt, Human
acucauugaccugagg

SEQ ID NO: 3131003 - RNA, 12 nt, Human
acucaucuuagg

SEQ ID NO: 3131004 - RNA, 21 nt, Human
acucaccugccccucaacucu

SEQ ID NO: 3131005 - RNA, 19 nt, Human
acucaccugccccucaacu

SEQ ID NO: 3131006 - RNA, 14 nt, Human
acucaccugccccu

SEQ ID NO: 3131007 - RNA, 14 nt, Human
acucagaagacacu

SEQ ID NO: 3131008 - RNA, 15 nt, Human
acucagaagacacug

SEQ ID NO: 3131009 - RNA, 16 nt, Human
acucagaagacacuga

SEQ ID NO: 3131010 - RNA, 17 nt, Human
acucagaagacacugau

SEQ ID NO: 3131011 - RNA, 18 nt, Human
acucagaagacacugaug

SEQ ID NO: 3131012 - RNA, 21 nt, Human
acucagaauucucuaguuuga

SEQ ID NO: 3131013 - RNA, 22 nt, Human
acucagaauucucuaguuugau

SEQ ID NO: 3131014 - RNA, 14 nt, Human
acucagaauucucu

SEQ ID NO: 3131015 - RNA, 22 nt, Human
ucuaguuugauuaaauucuugc

SEQ ID NO: 3131016 - RNA, 23 nt, Human
ucuaguuugauuaaauucuugca

SEQ ID NO: 3131017 - RNA, 24 nt, Human
ucuagauacuguaucaugacaaag

SEQ ID NO: 3131018 - RNA, 13 nt, Human
ucuagauacugua

SEQ ID NO: 3131019 - RNA, 13 nt, Human
ucuagccagagga

SEQ ID NO: 3131020 - RNA, 18 nt, Human
acuuccaauuuacauacu

SEQ ID NO: 3131021 - RNA, 17 nt, Human
acuuccacugccauccu

SEQ ID NO: 3131022 - RNA, 16 nt, Human
acuucaucccucuggg

SEQ ID NO: 3131023 - RNA, 13 nt, Human
acuuacuguacau

SEQ ID NO: 3131024 - RNA, 14 nt, Human
acuuacuguacaug

SEQ ID NO: 3131025 - RNA, 15 nt, Human
acuuacuguacauga

SEQ ID NO: 3131026 - RNA, 20 nt, Human
acuuagagguggggagcaga

SEQ ID NO: 3131027 - RNA, 19 nt, Human
ucuaccugaggggccucuu

SEQ ID NO: 3131028 - RNA, 12 nt, Human
ucuaccugaggg

SEQ ID NO: 3131029 - RNA, 14 nt, Human
acuuggaagcuccg

SEQ ID NO: 3131030 - RNA, 14 nt, Human
acuugucuuuggac

SEQ ID NO: 3131031 - RNA, 16 nt, Human
ucuauuguuucuuuca

SEQ ID NO: 3131032 - RNA, 16 nt, Human
ucucaaaaaaagaaaa

SEQ ID NO: 3131033 - RNA, 18 nt, Human
acuucuccacccugcucu

SEQ ID NO: 3131034 - RNA, 20 nt, Human
acuucgggaggucgaggcag

SEQ ID NO: 3131035 - RNA, 17 nt, Human
acuucgggaggucgagg

SEQ ID NO: 3131036 - RNA, 21 nt, Human
acuguuaauaguucagguaac

SEQ ID NO: 3131037 - RNA, 17 nt, Human
acuguuaauaguucagg

SEQ ID NO: 3131038 - RNA, 21 nt, Human
ucuacccucuuagaaaaacca

SEQ ID NO: 3131039 - RNA, 14 nt, Human
ucuacccaggugcu

SEQ ID NO: 3131040 - RNA, 17 nt, Human
ucuaaagcugccagccg

SEQ ID NO: 3131041 - RNA, 16 nt, Human
ucuaaagcugccagcc

SEQ ID NO: 3131042 - RNA, 13 nt, Human
ucuaaaggcuacc

SEQ ID NO: 3131043 - RNA, 16 nt, Human
ucuaaaggcuaccuuu

SEQ ID NO: 3131044 - RNA, 22 nt, Human
ucuaacuucaccauauuaccac

SEQ ID NO: 3131045 - RNA, 15 nt, Human
acuggguacuugugg

SEQ ID NO: 3131046 - RNA, 21 nt, Human
acugggcuuggggaccagagc

SEQ ID NO: 3131047 - RNA, 14 nt, Human
ucgcuccugugucu

SEQ ID NO: 3131048 - RNA, 23 nt, Human
acuguccuacccacccuccuuuc

SEQ ID NO: 3131049 - RNA, 16 nt, Human
acuguaucaugacaaa

SEQ ID NO: 3131050 - RNA, 20 nt, Human
acuguaucaugacaaagacu

SEQ ID NO: 3131051 - RNA, 20 nt, Human
acuguacaugaaaacacauu

SEQ ID NO: 3131052 - RNA, 21 nt, Human
acuguacaugaaaacacauuu

SEQ ID NO: 3131053 - RNA, 14 nt, Human
acuguaucaugaca

SEQ ID NO: 3131054 - RNA, 17 nt, Human
acuggguacuuguggac

SEQ ID NO: 3131055 - RNA, 16 nt, Human
acuguacaaaguagaa

SEQ ID NO: 3131056 - RNA, 22 nt, Human
acuguacaaaguagaagucuua

SEQ ID NO: 3131057 - RNA, 19 nt, Human
acuguacaugaaaacacau

SEQ ID NO: 3131058 - RNA, 16 nt, Human
acuguacaugaaaaca

SEQ ID NO: 3131059 - RNA, 22 nt, Human
ucugcuuugggguuuaucagaa

SEQ ID NO: 3131060 - RNA, 21 nt, Human
ucuggcagcucagagagggug

SEQ ID NO: 3131061 - RNA, 18 nt, Human
ucuggcagcucagagagg

SEQ ID NO: 3131062 - RNA, 23 nt, Human
ucuggcagaguugaagacagagc

SEQ ID NO: 3131063 - RNA, 20 nt, Human
ucuggcagaguugaagacag

SEQ ID NO: 3131064 - RNA, 17 nt, Human
ucuggcagcucagagag

SEQ ID NO: 3131065 - RNA, 16 nt, Human
ucuggcagcucagaga

SEQ ID NO: 3131066 - RNA, 22 nt, Human
agaaguuugagaucagccuggg

SEQ ID NO: 3131067 - RNA, 16 nt, Human
agaagcagaggaagga

SEQ ID NO: 3131068 - RNA, 23 nt, Human
agaagcccaggaaaggcuccagg

SEQ ID NO: 3131069 - RNA, 23 nt, Human
ucugcccacucccugcaaccuga

SEQ ID NO: 3131070 - RNA, 12 nt, Human
ucugcccuuggu

SEQ ID NO: 3131071 - RNA, 23 nt, Human
agaaccuuuugagugccuuacac

SEQ ID NO: 3131072 - RNA, 19 nt, Human
agaaccuuuugagugccuu

SEQ ID NO: 3131073 - RNA, 20 nt, Human
agaaagacuaucuaaauguu

SEQ ID NO: 3131074 - RNA, 22 nt, Human
agaaagacuaucuaaauguuga

SEQ ID NO: 3131075 - RNA, 22 nt, Human
ucugaaggacauugcggacagc

SEQ ID NO: 3131076 - RNA, 18 nt, Human
ucugaaggcuggguucug

SEQ ID NO: 3131077 - RNA, 15 nt, Human
agaaaugccuuaccc

SEQ ID NO: 3131078 - RNA, 18 nt, Human
ucucuugguccugcugca

SEQ ID NO: 3131079 - RNA, 17 nt, Human
ucucuugguccugcugc

SEQ ID NO: 3131080 - RNA, 16 nt, Human
ucucuugguccugcug

SEQ ID NO: 3131081 - RNA, 18 nt, Human
agaaaaaugagccuggca

SEQ ID NO: 3131082 - RNA, 17 nt, Human
agaaaaaugagccuggc

SEQ ID NO: 3131083 - RNA, 23 nt, Human
agaaaaaauauuuuccugccagg

SEQ ID NO: 3131084 - RNA, 17 nt, Human
agaaaaaauauuuuccu

SEQ ID NO: 3131085 - RNA, 19 nt, Human
agaaaaaauauuuucccua

SEQ ID NO: 3131086 - RNA, 12 nt, Human
ucucucaggcca

SEQ ID NO: 3131087 - RNA, 19 nt, Human
ucuccuguaccucuugagc

SEQ ID NO: 3131088 - RNA, 23 nt, Human
ucuccuuggugucgggcaugaca

SEQ ID NO: 3131089 - RNA, 21 nt, Human
ucuccuuggugucgggcauga

SEQ ID NO: 3131090 - RNA, 16 nt, Human
acuuuguguucaccuu

SEQ ID NO: 3131091 - RNA, 14 nt, Human
acuuguggacacag

SEQ ID NO: 3131092 - RNA, 16 nt, Human
acuuuaaaaggagcca

SEQ ID NO: 3131093 - RNA, 23 nt, Human
acuuuaccuuuuuuauacauaaa

SEQ ID NO: 3131094 - RNA, 23 nt, Human
acuuuggaaagacuuuuccaacc

SEQ ID NO: 3131095 - RNA, 14 nt, Human
acuuuggaaagagu

SEQ ID NO: 3131096 - RNA, 13 nt, Human
acuuuggaaagag

SEQ ID NO: 3131097 - RNA, 23 nt, Human
acuuuggaaagaguaggaagacu

SEQ ID NO: 3131098 - RNA, 19 nt, Human
ucuugcaauggcagccuug

SEQ ID NO: 3131099 - RNA, 18 nt, Human
ucuugcaauggcagccuu

SEQ ID NO: 3131100 - RNA, 22 nt, Human
ucuugcaauggcagccuuggca

SEQ ID NO: 3131101 - RNA, 14 nt, Human
ucuugguccugcug

SEQ ID NO: 3131102 - RNA, 17 nt, Human
ucuuggucagauuugaa

SEQ ID NO: 3131103 - RNA, 16 nt, Human
ucuuuccugaggcugg

SEQ ID NO: 3131104 - RNA, 17 nt, Human
ucuuuccugaggcuggg

SEQ ID NO: 3131105 - RNA, 19 nt, Human
ucuugguccugcugcaguu

SEQ ID NO: 3131106 - RNA, 17 nt, Human
ucuugguccugcugcag

SEQ ID NO: 3131107 - RNA, 15 nt, Human
ucuugguccugcugc

SEQ ID NO: 3131108 - RNA, 11 nt, Human
agaccuucucc

SEQ ID NO: 3131109 - RNA, 18 nt, Human
agaccuucuccuucaccu

SEQ ID NO: 3131110 - RNA, 15 nt, Human
agaccuucuccuuca

SEQ ID NO: 3131111 - RNA, 23 nt, Human
agaccuucuccuucaccuuuguc

SEQ ID NO: 3131112 - RNA, 21 nt, Human
agaccuucuccuucaccuuug

SEQ ID NO: 3131113 - RNA, 20 nt, Human
ucuugagccuugaacuuuga

SEQ ID NO: 3131114 - RNA, 16 nt, Human
ucuugagccugggagg

SEQ ID NO: 3131115 - RNA, 13 nt, Human
ucuugagccuggg

SEQ ID NO: 3131116 - RNA, 13 nt, Human
ucuugauucauaa

SEQ ID NO: 3131117 - RNA, 15 nt, Human
ucuuccucccucccu

SEQ ID NO: 3131118 - RNA, 14 nt, Human
ucuuccucccuccc

SEQ ID NO: 3131119 - RNA, 19 nt, Human
ucuucccuacaguugaaaa

SEQ ID NO: 3131120 - RNA, 20 nt, Human
ucuuccaggcugggagagcc

SEQ ID NO: 3131121 - RNA, 17 nt, Human
ucuuccaggcugggaga

SEQ ID NO: 3131122 - RNA, 15 nt, Human
ucuuccaggcuggga

SEQ ID NO: 3131123 - RNA, 20 nt, Human
ucuucagagacuccugcagg

SEQ ID NO: 3131124 - RNA, 12 nt, Human
ucuucagagacu

SEQ ID NO: 3131125 - RNA, 18 nt, Human
ucuucagagacuccugca

SEQ ID NO: 3131126 - RNA, 17 nt, Human
ucuucagagacuccugc

SEQ ID NO: 3131127 - RNA, 20 nt, Human
ucuucuguggguuucuaaag

SEQ ID NO: 3131128 - RNA, 15 nt, Human
ucuucuguacgucug

SEQ ID NO: 3131129 - RNA, 23 nt, Human
ucuucuguacgucugacaggcaa

SEQ ID NO: 3131130 - RNA, 12 nt, Human
ucuucugcuuca

SEQ ID NO: 3131131 - RNA, 21 nt, Human
ucuucugaacuuggcgcugcc

SEQ ID NO: 3131132 - RNA, 19 nt, Human
agacauacuaaccagcaga

SEQ ID NO: 3131133 - RNA, 23 nt, Human
agagcaccuuagacagucccugc

SEQ ID NO: 3131134 - RNA, 21 nt, Human
agagcaccuuagacagucccu

SEQ ID NO: 3131135 - RNA, 22 nt, Human
agagcaccuuagacagucccug

SEQ ID NO: 3131136 - RNA, 20 nt, Human
agagcuagcagcagggaggg

SEQ ID NO: 3131137 - RNA, 22 nt, Human
agagccuuccaggggugggaca

SEQ ID NO: 3131138 - RNA, 17 nt, Human
agagccuuccaggggug

SEQ ID NO: 3131139 - RNA, 15 nt, Human
agagccuuccagggg

SEQ ID NO: 3131140 - RNA, 13 nt, Human
agagccuuccagg

SEQ ID NO: 3131141 - RNA, 14 nt, Human
agagcugccaccug

SEQ ID NO: 3131142 - RNA, 15 nt, Human
agagacuccugcagg

SEQ ID NO: 3131143 - RNA, 18 nt, Human
agagacuccugcaggcag

SEQ ID NO: 3131144 - RNA, 17 nt, Human
agagacuccugcaggca

SEQ ID NO: 3131145 - RNA, 22 nt, Human
agagacuccugcaggcagccag

SEQ ID NO: 3131146 - RNA, 21 nt, Human
agagacuccugcaggcagcca

SEQ ID NO: 3131147 - RNA, 20 nt, Human
agagacuccugcaggcagcc

SEQ ID NO: 3131148 - RNA, 19 nt, Human
agagacuccugcaggcagc

SEQ ID NO: 3131149 - RNA, 13 nt, Human
ugaaagacuguac

SEQ ID NO: 3131150 - RNA, 15 nt, Human
ugaaagacuguacaa

SEQ ID NO: 3131151 - RNA, 22 nt, Human
agagaucaaccccuucgcuccu

SEQ ID NO: 3131152 - RNA, 23 nt, Human
agagacuccugcaggcagccagg

SEQ ID NO: 3131153 - RNA, 23 nt, Human
agagcaagacgcugugcugcccu

SEQ ID NO: 3131154 - RNA, 19 nt, Human
agagcaagacgcugugcug

SEQ ID NO: 3131155 - RNA, 22 nt, Human
ugaaaaaggaggaagagaaaaa

SEQ ID NO: 3131156 - RNA, 20 nt, Human
ugaaaaaggaggaagagaaa

SEQ ID NO: 3131157 - RNA, 16 nt, Human
ugaaaaucgugacaac

SEQ ID NO: 3131158 - RNA, 17 nt, Human
ugaaaauguauguguaa

SEQ ID NO: 3131159 - RNA, 19 nt, Human
ugaaaaucgugacaacacu

SEQ ID NO: 3131160 - RNA, 16 nt, Human
ugaaacgcaaccacca

SEQ ID NO: 3131161 - RNA, 14 nt, Human
ucuuuguggcuucc

SEQ ID NO: 3131162 - RNA, 22 nt, Human
ucuuuggucuacacugugcuga

SEQ ID NO: 3131163 - RNA, 20 nt, Human
ucuuucuggcuaugcauuug

SEQ ID NO: 3131164 - RNA, 19 nt, Human
ucuuucuggcuaugcauuu

SEQ ID NO: 3131165 - RNA, 21 nt, Human
ucuuucuggcuaugcauuuga

SEQ ID NO: 3131166 - RNA, 16 nt, Human
ugaaaaaggaggaaga

SEQ ID NO: 3131167 - RNA, 15 nt, Human
agagguuaagguggg

SEQ ID NO: 3131168 - RNA, 16 nt, Human
agagguggggagcaga

SEQ ID NO: 3131169 - RNA, 16 nt, Human
agagggagggagggcu

SEQ ID NO: 3131170 - RNA, 14 nt, Human
ugaagucacacagu

SEQ ID NO: 3131171 - RNA, 22 nt, Human
agauacaguuacucagaauucu

SEQ ID NO: 3131172 - RNA, 11 nt, Human
agauacuguau

SEQ ID NO: 3131173 - RNA, 20 nt, Human
agauacaggaaaagcugcug

SEQ ID NO: 3131174 - RNA, 13 nt, Human
agauacaguuacu

SEQ ID NO: 3131175 - RNA, 22 nt, Human
agauaauauuaaggaagacaau

SEQ ID NO: 3131176 - RNA, 18 nt, Human
agauaauauuaaggaaga

SEQ ID NO: 3131177 - RNA, 18 nt, Human
agaucaaaagguuaauaa

SEQ ID NO: 3131178 - RNA, 20 nt, Human
agauauuuugcuuugugauu

SEQ ID NO: 3131179 - RNA, 21 nt, Human
agauauuuugcuuugugauuu

SEQ ID NO: 3131180 - RNA, 15 nt, Human
agauacuguaucaug

SEQ ID NO: 3131181 - RNA, 16 nt, Human
agauacuguaucauga

SEQ ID NO: 3131182 - RNA, 18 nt, Human
agauaauacaccacuaca

SEQ ID NO: 3131183 - RNA, 19 nt, Human
agaguuguuacauuuuuaa

SEQ ID NO: 3131184 - RNA, 20 nt, Human
agaguuguuacauuuuuaag

SEQ ID NO: 3131185 - RNA, 16 nt, Human
agaguuguuacauuuu

SEQ ID NO: 3131186 - RNA, 17 nt, Human
agaguuguuacauuuuu

SEQ ID NO: 3131187 - RNA, 15 nt, Human
agagucacuggaaca

SEQ ID NO: 3131188 - RNA, 19 nt, Human
ugacacacagcucuguccu

SEQ ID NO: 3131189 - RNA, 19 nt, Human
ugacaaagacugaguacgu

SEQ ID NO: 3131190 - RNA, 16 nt, Human
ugacacacagcucugu

SEQ ID NO: 3131191 - RNA, 18 nt, Human
ugacacacagcucugucc

SEQ ID NO: 3131192 - RNA, 12 nt, Human
ugacacaugcaa

SEQ ID NO: 3131193 - RNA, 20 nt, Human
ugacacaugcaaggucauuu

SEQ ID NO: 3131194 - RNA, 23 nt, Human
ugaauuucuuuugccguuauuaa

SEQ ID NO: 3131195 - RNA, 16 nt, Human
agcaagacgcugugcu

SEQ ID NO: 3131196 - RNA, 13 nt, Human
agcaagacgcugu

SEQ ID NO: 3131197 - RNA, 23 nt, Human
agcaagacgcugugcugcccugc

SEQ ID NO: 3131198 - RNA, 22 nt, Human
agcaagacgcugugcugcccug

SEQ ID NO: 3131199 - RNA, 21 nt, Human
agcaagacgcugugcugcccu

SEQ ID NO: 3131200 - RNA, 20 nt, Human
agcaagacgcugugcugccc

SEQ ID NO: 3131201 - RNA, 17 nt, Human
agcaagacgcugugcug

SEQ ID NO: 3131202 - RNA, 21 nt, Human
agauuuugaaauuuuuauuaa

SEQ ID NO: 3131203 - RNA, 19 nt, Human
agauucauauuuacuucuu

SEQ ID NO: 3131204 - RNA, 22 nt, Human
agauucauauuuacuucuuaua

SEQ ID NO: 3131205 - RNA, 13 nt, Human
agauuggaaggaa

SEQ ID NO: 3131206 - RNA, 16 nt, Human
agaugccgcauuugga

SEQ ID NO: 3131207 - RNA, 21 nt, Human
ugacccaugcugcccugugag

SEQ ID NO: 3131208 - RNA, 16 nt, Human
ugacccaugcugcccu

SEQ ID NO: 3131209 - RNA, 12 nt, Human
ugacccaugcug

SEQ ID NO: 3131210 - RNA, 15 nt, Human
ugacccaugcugccc

SEQ ID NO: 3131211 - RNA, 14 nt, Human
ugacccaugcugcc

SEQ ID NO: 3131212 - RNA, 15 nt, Human
ugacuuacuguacau

SEQ ID NO: 3131213 - RNA, 16 nt, Human
ugacuuacuguacaug

SEQ ID NO: 3131214 - RNA, 13 nt, Human
ugacuuacuguac

SEQ ID NO: 3131215 - RNA, 17 nt, Human
ugaccugaggcccuucu

SEQ ID NO: 3131216 - RNA, 19 nt, Human
ugaccugaggcccuucucu

SEQ ID NO: 3131217 - RNA, 18 nt, Human
ugaccugaggcccuucuc

SEQ ID NO: 3131218 - RNA, 13 nt, Human
aacuuccaauuua

SEQ ID NO: 3131219 - RNA, 16 nt, Human
gugaugagaggaaauc

SEQ ID NO: 3131220 - RNA, 14 nt, Human
gugaugagaggaaa

SEQ ID NO: 3131221 - RNA, 22 nt, Human
gugaugcgcaugucacggaggg

SEQ ID NO: 3131222 - RNA, 18 nt, Human
gugauggggcccugccuc

SEQ ID NO: 3131223 - RNA, 17 nt, Human
gugauggggcccugccu

SEQ ID NO: 3131224 - RNA, 16 nt, Human
gugauggggcccugcc

SEQ ID NO: 3131225 - RNA, 14 nt, Human
gugauggggcccug

SEQ ID NO: 3131226 - RNA, 23 nt, Human
gugcauuaucuagauacuguauc

SEQ ID NO: 3131227 - RNA, 19 nt, Human
gugcauguguguucaugca

SEQ ID NO: 3131228 - RNA, 15 nt, Human
gugcauuaucuagau

SEQ ID NO: 3131229 - RNA, 19 nt, Human
gugcauuaucuagauacug

SEQ ID NO: 3131230 - RNA, 22 nt, Human
gugcaugcugucccuuacguga

SEQ ID NO: 3131231 - RNA, 21 nt, Human
gugcacacaccagagcccacc

SEQ ID NO: 3131232 - RNA, 19 nt, Human
gugauggggcccugccucc

SEQ ID NO: 3131233 - RNA, 22 nt, Human
gugcaaugaccuuucaauagga

SEQ ID NO: 3131234 - RNA, 21 nt, Human
aacucuucaaucucuugcacu

SEQ ID NO: 3131235 - RNA, 15 nt, Human
gugagucgaggacag

SEQ ID NO: 3131236 - RNA, 22 nt, Human
gugagucgaggacagggaggug

SEQ ID NO: 3131237 - RNA, 19 nt, Human
gugaacuugggccacugug

SEQ ID NO: 3131238 - RNA, 17 nt, Human
gugaacuugggccacug

SEQ ID NO: 3131239 - RNA, 13 nt, Human
gugaggccagaga

SEQ ID NO: 3131240 - RNA, 22 nt, Human
gugaggccagagacacaagccu

SEQ ID NO: 3131241 - RNA, 17 nt, Human
gugaggccagagacaca

SEQ ID NO: 3131242 - RNA, 16 nt, Human
aacuggguacuugugg

SEQ ID NO: 3131243 - RNA, 21 nt, Human
aacuggguacuuguggacaca

SEQ ID NO: 3131244 - RNA, 21 nt, Human
aacugggggagggugaaguga

SEQ ID NO: 3131245 - RNA, 22 nt, Human
aacugggggagggugaagugaa

SEQ ID NO: 3131246 - RNA, 16 nt, Human
aacuggauuaaacuua

SEQ ID NO: 3131247 - RNA, 11 nt, Human
aacuggcugca

SEQ ID NO: 3131248 - RNA, 15 nt, Human
aacuggauuaaacuu

SEQ ID NO: 3131249 - RNA, 23 nt, Human
aacugcugacuguuuucucuuga

SEQ ID NO: 3131250 - RNA, 21 nt, Human
aacugcugacuguuuucucuu

SEQ ID NO: 3131251 - RNA, 20 nt, Human
aacugcugacuguuuucucu

SEQ ID NO: 3131252 - RNA, 15 nt, Human
aacugcugacuguuu

SEQ ID NO: 3131253 - RNA, 14 nt, Human
gucuggcccuuccu

SEQ ID NO: 3131254 - RNA, 18 nt, Human
gucuuuggacccugaggc

SEQ ID NO: 3131255 - RNA, 22 nt, Human
gugaaccaccacacccagccca

SEQ ID NO: 3131256 - RNA, 23 nt, Human
gugaaccaccacacccagcccac

SEQ ID NO: 3131257 - RNA, 16 nt, Human
aacucuccucugcugc

SEQ ID NO: 3131258 - RNA, 18 nt, Human
aacucuccuccagaguca

SEQ ID NO: 3131259 - RNA, 15 nt, Human
aacucuccuccagag

SEQ ID NO: 3131260 - RNA, 12 nt, Human
aacuccuggccu

SEQ ID NO: 3131261 - RNA, 15 nt, Human
aaccaagucaaguga

SEQ ID NO: 3131262 - RNA, 19 nt, Human
aaccaccacacccagccca

SEQ ID NO: 3131263 - RNA, 18 nt, Human
aaccaucauugaaaucuu

SEQ ID NO: 3131264 - RNA, 17 nt, Human
aaccaucauugaaaucu

SEQ ID NO: 3131265 - RNA, 12 nt, Human
aaccaucauuga

SEQ ID NO: 3131266 - RNA, 21 nt, Human
aaccaccacacccagcccacu

SEQ ID NO: 3131267 - RNA, 10 nt, Human
aacccagcuc

SEQ ID NO: 3131268 - RNA, 22 nt, Human
gucacacaguauuacuucugcu

SEQ ID NO: 3131269 - RNA, 21 nt, Human
gucacacaguauuacuucugc

SEQ ID NO: 3131270 - RNA, 23 nt, Human
gucagaaguuucugccgcagccc

SEQ ID NO: 3131271 - RNA, 18 nt, Human
aaauuuguuauaaugaau

SEQ ID NO: 3131272 - RNA, 15 nt, Human
gucagugugacugau

SEQ ID NO: 3131273 - RNA, 18 nt, Human
aaauuuugauguuuuaag

SEQ ID NO: 3131274 - RNA, 23 nt, Human
aaauuuugauguuuuaaggaugc

SEQ ID NO: 3131275 - RNA, 20 nt, Human
aacaagaccacguuucuaaa

SEQ ID NO: 3131276 - RNA, 16 nt, Human
aacaaggcaaggcugu

SEQ ID NO: 3131277 - RNA, 15 nt, Human
aacaaggcaaggcug

SEQ ID NO: 3131278 - RNA, 21 nt, Human
aacaaggcaaggcugucaauu

SEQ ID NO: 3131279 - RNA, 18 nt, Human
aacaaggcaaggcuguca

SEQ ID NO: 3131280 - RNA, 14 nt, Human
guccauagagagca

SEQ ID NO: 3131281 - RNA, 13 nt, Human
guccauagagagc

SEQ ID NO: 3131282 - RNA, 21 nt, Human
gucccaccccacacacgccag

SEQ ID NO: 3131283 - RNA, 20 nt, Human
gucccaccccacacacgcca

SEQ ID NO: 3131284 - RNA, 14 nt, Human
gucccaccuuggcu

SEQ ID NO: 3131285 - RNA, 15 nt, Human
gucccaccuuggcug

SEQ ID NO: 3131286 - RNA, 16 nt, Human
gucccaccuuggcugc

SEQ ID NO: 3131287 - RNA, 19 nt, Human
gucauuuuuuuuaagaaaa

SEQ ID NO: 3131288 - RNA, 21 nt, Human
gucauuuuuuuuaagaaaaag

SEQ ID NO: 3131289 - RNA, 18 nt, Human
guccaagaagcccaggaa

SEQ ID NO: 3131290 - RNA, 17 nt, Human
guccaagaagcccagga

SEQ ID NO: 3131291 - RNA, 20 nt, Human
guccaagaagcccaggaaag

SEQ ID NO: 3131292 - RNA, 16 nt, Human
guccaagaagcccagg

SEQ ID NO: 3131293 - RNA, 15 nt, Human
guccaagaagcccag

SEQ ID NO: 3131294 - RNA, 13 nt, Human
guccaagaagccc

SEQ ID NO: 3131295 - RNA, 18 nt, Human
gucccccugacaacacuc

SEQ ID NO: 3131296 - RNA, 14 nt, Human
gucccccuuccaug

SEQ ID NO: 3131297 - RNA, 18 nt, Human
gucccccuuccauggacu

SEQ ID NO: 3131298 - RNA, 16 nt, Human
gucccccuuccaugga

SEQ ID NO: 3131299 - RNA, 16 nt, Human
guccuacccacccucc

SEQ ID NO: 3131300 - RNA, 15 nt, Human
guccuacccacccuc

SEQ ID NO: 3131301 - RNA, 12 nt, Human
guccuacucugu

SEQ ID NO: 3131302 - RNA, 14 nt, Human
aacagaaauguaca

SEQ ID NO: 3131303 - RNA, 12 nt, Human
aacagaaaugua

SEQ ID NO: 3131304 - RNA, 13 nt, Human
aacagaaauguac

SEQ ID NO: 3131305 - RNA, 11 nt, Human
aacagaaaugu

SEQ ID NO: 3131306 - RNA, 22 nt, Human
guauuuuguuuuugucuuaaaa

SEQ ID NO: 3131307 - RNA, 19 nt, Human
aaaugucuaguuguaacac

SEQ ID NO: 3131308 - RNA, 16 nt, Human
guaucaggugcugcca

SEQ ID NO: 3131309 - RNA, 18 nt, Human
guaucaggugcugccauc

SEQ ID NO: 3131310 - RNA, 19 nt, Human
guaucccaugagccucagc

SEQ ID NO: 3131311 - RNA, 22 nt, Human
guaucaggugcugccauccagg

SEQ ID NO: 3131312 - RNA, 15 nt, Human
guaugguggcugggu

SEQ ID NO: 3131313 - RNA, 16 nt, Human
guaugguggcuggguu

SEQ ID NO: 3131314 - RNA, 14 nt, Human
guaugguggcuggg

SEQ ID NO: 3131315 - RNA, 13 nt, Human
guaugguggcugg

SEQ ID NO: 3131316 - RNA, 20 nt, Human
guaacaggaaaauuuuaaaa

SEQ ID NO: 3131317 - RNA, 19 nt, Human
aaaugggggugcauuugag

SEQ ID NO: 3131318 - RNA, 12 nt, Human
guaacaggcaga

SEQ ID NO: 3131319 - RNA, 22 nt, Human
guaacaggaaaauuuuaaaaau

SEQ ID NO: 3131320 - RNA, 15 nt, Human
gugggagcugccugu

SEQ ID NO: 3131321 - RNA, 18 nt, Human
gugggagcugccuguuca

SEQ ID NO: 3131322 - RNA, 15 nt, Human
guggggucacucugg

SEQ ID NO: 3131323 - RNA, 14 nt, Human
gugggagcugccug

SEQ ID NO: 3131324 - RNA, 15 nt, Human
gugggacacccugug

SEQ ID NO: 3131325 - RNA, 13 nt, Human
gugggacacccug

SEQ ID NO: 3131326 - RNA, 15 nt, Human
guggccucccaacuc

SEQ ID NO: 3131327 - RNA, 22 nt, Human
guggccucccaacucaccccag

SEQ ID NO: 3131328 - RNA, 21 nt, Human
guggccucccaacucacccca

SEQ ID NO: 3131329 - RNA, 23 nt, Human
aagacugaguacguugugcauuu

SEQ ID NO: 3131330 - RNA, 22 nt, Human
aagacugaguacguugugcauu

SEQ ID NO: 3131331 - RNA, 19 nt, Human
aagaccuucuccuucaccu

SEQ ID NO: 3131332 - RNA, 18 nt, Human
aagaccuucuccuucacc

SEQ ID NO: 3131333 - RNA, 15 nt, Human
aagaccuucuccuuc

SEQ ID NO: 3131334 - RNA, 19 nt, Human
aagacgcugugcugcccug

SEQ ID NO: 3131335 - RNA, 18 nt, Human
aagacgcugugcugcccu

SEQ ID NO: 3131336 - RNA, 17 nt, Human
aagacgcugugcugccc

SEQ ID NO: 3131337 - RNA, 15 nt, Human
aagacgcugugcugc

SEQ ID NO: 3131338 - RNA, 13 nt, Human
aagacgcugugcu

SEQ ID NO: 3131339 - RNA, 12 nt, Human
aagaguaggaag

SEQ ID NO: 3131340 - RNA, 23 nt, Human
aagagggagggagggcuccagac

SEQ ID NO: 3131341 - RNA, 22 nt, Human
guggggucacucuggcagcuca

SEQ ID NO: 3131342 - RNA, 21 nt, Human
guggggucacucuggcagcuc

SEQ ID NO: 3131343 - RNA, 20 nt, Human
guggggucacucuggcagcu

SEQ ID NO: 3131344 - RNA, 17 nt, Human
guggggucacucuggca

SEQ ID NO: 3131345 - RNA, 16 nt, Human
aagaugcuucucacug

SEQ ID NO: 3131346 - RNA, 17 nt, Human
aagaugcuucucacugc

SEQ ID NO: 3131347 - RNA, 19 nt, Human
aagaugcuucucacugcca

SEQ ID NO: 3131348 - RNA, 13 nt, Human
aagaguaggaaga

SEQ ID NO: 3131349 - RNA, 16 nt, Human
gugucagcauagaagu

SEQ ID NO: 3131350 - RNA, 20 nt, Human
gugucaagagggucugagga

SEQ ID NO: 3131351 - RNA, 17 nt, Human
guguauuuuuuuacuaa

SEQ ID NO: 3131352 - RNA, 23 nt, Human
guguauuuuuuuacuaauagaca

SEQ ID NO: 3131353 - RNA, 20 nt, Human
gugucagguggggcagcuug

SEQ ID NO: 3131354 - RNA, 22 nt, Human
gugugacaaggauugcuacugu

SEQ ID NO: 3131355 - RNA, 16 nt, Human
gugugguagagugugc

SEQ ID NO: 3131356 - RNA, 16 nt, Human
aagcauuuacuuugug

SEQ ID NO: 3131357 - RNA, 12 nt, Human
aagcagugcaug

SEQ ID NO: 3131358 - RNA, 21 nt, Human
gugugugcgccuacaggagug

SEQ ID NO: 3131359 - RNA, 15 nt, Human
aagcagugcaugcug

SEQ ID NO: 3131360 - RNA, 14 nt, Human
aagcagugcaugcu

SEQ ID NO: 3131361 - RNA, 20 nt, Human
aagcagugcaugcugucccu

SEQ ID NO: 3131362 - RNA, 19 nt, Human
aagcccugagcuuucugcu

SEQ ID NO: 3131363 - RNA, 20 nt, Human
aagccgcuggggccaguugg

SEQ ID NO: 3131364 - RNA, 22 nt, Human
aagcccaggaaaggcuccagga

SEQ ID NO: 3131365 - RNA, 19 nt, Human
aagcccaggaaaggcucca

SEQ ID NO: 3131366 - RNA, 20 nt, Human
aagccaaagcuaggccuggc

SEQ ID NO: 3131367 - RNA, 22 nt, Human
aagccaaagcuaggccuggcca

SEQ ID NO: 3131368 - RNA, 17 nt, Human
aagcccaggaaaggcuc

SEQ ID NO: 3131369 - RNA, 14 nt, Human
aagcccaggaaagg

SEQ ID NO: 3131370 - RNA, 17 nt, Human
aagcucagggccuggcu

SEQ ID NO: 3131371 - RNA, 16 nt, Human
aagcucagggccuggc

SEQ ID NO: 3131372 - RNA, 13 nt, Human
aagcucagggccu

SEQ ID NO: 3131373 - RNA, 12 nt, Human
aagcucagggcc

SEQ ID NO: 3131374 - RNA, 20 nt, Human
aagcucagggccuggcucag

SEQ ID NO: 3131375 - RNA, 19 nt, Human
aagcucagggccuggcuca

SEQ ID NO: 3131376 - RNA, 18 nt, Human
aagcucagggccuggcuc

SEQ ID NO: 3131377 - RNA, 18 nt, Human
aagcuccaagcucccagg

SEQ ID NO: 3131378 - RNA, 17 nt, Human
aagcuccaagcucccag

SEQ ID NO: 3131379 - RNA, 13 nt, Human
guucagcuccagc

SEQ ID NO: 3131380 - RNA, 12 nt, Human
aagcuaggccug

SEQ ID NO: 3131381 - RNA, 22 nt, Human
aagcuagacgagcaggcuucuu

SEQ ID NO: 3131382 - RNA, 20 nt, Human
guuaggcauugugggaaggg

SEQ ID NO: 3131383 - RNA, 19 nt, Human
guuaggcauugugggaagg

SEQ ID NO: 3131384 - RNA, 12 nt, Human
guuaagagaaau

SEQ ID NO: 3131385 - RNA, 11 nt, Human
guuaagagaaa

SEQ ID NO: 3131386 - RNA, 18 nt, Human
guuaagagaaaugagcuu

SEQ ID NO: 3131387 - RNA, 18 nt, Human
guucaagcgauucuucug

SEQ ID NO: 3131388 - RNA, 20 nt, Human
guucaaagauauuuugcuuu

SEQ ID NO: 3131389 - RNA, 21 nt, Human
guucaaagauauuuugcuuug

SEQ ID NO: 3131390 - RNA, 22 nt, Human
guucaaagauauuuugcuuugu

SEQ ID NO: 3131391 - RNA, 23 nt, Human
guuauuuuuauuuauuuaaauuu

SEQ ID NO: 3131392 - RNA, 22 nt, Human
aaggggcccaaauucuuucagu

SEQ ID NO: 3131393 - RNA, 17 nt, Human
aaggggcaguggugguu

SEQ ID NO: 3131394 - RNA, 20 nt, Human
aagguagaaauaucugaaaa

SEQ ID NO: 3131395 - RNA, 19 nt, Human
guuucuauguguagggcgg

SEQ ID NO: 3131396 - RNA, 18 nt, Human
guuucugaaagggacgcu

SEQ ID NO: 3131397 - RNA, 12 nt, Human
aaggucauuuuu

SEQ ID NO: 3131398 - RNA, 22 nt, Human
guuucuaugacacaugcaaggu

SEQ ID NO: 3131399 - RNA, 22 nt, Human
aaggcucgagcaugccuggaug

SEQ ID NO: 3131400 - RNA, 20 nt, Human
aaggcucgagcaugccugga

SEQ ID NO: 3131401 - RNA, 19 nt, Human
aaggcucgagcaugccugg

SEQ ID NO: 3131402 - RNA, 18 nt, Human
aaggcucgagcaugccug

SEQ ID NO: 3131403 - RNA, 16 nt, Human
aaggcucgagcaugcc

SEQ ID NO: 3131404 - RNA, 22 nt, Human
aaggcuccaggagcagccacau

SEQ ID NO: 3131405 - RNA, 19 nt, Human
aaggcuccaggagcagcca

SEQ ID NO: 3131406 - RNA, 13 nt, Human
guuucaaacuuua

SEQ ID NO: 3131407 - RNA, 14 nt, Human
guuucaaacuuuac

SEQ ID NO: 3131408 - RNA, 16 nt, Human
guuucaaacuuuacua

SEQ ID NO: 3131409 - RNA, 18 nt, Human
aaggcuccaggagcagcc

SEQ ID NO: 3131410 - RNA, 16 nt, Human
aaggcuccaggagcag

SEQ ID NO: 3131411 - RNA, 15 nt, Human
aaggcuccaggagca

SEQ ID NO: 3131412 - RNA, 13 nt, Human
guugggcuggugu

SEQ ID NO: 3131413 - RNA, 17 nt, Human
guugggccaggagccuc

SEQ ID NO: 3131414 - RNA, 15 nt, Human
guugggccaggagcc

SEQ ID NO: 3131415 - RNA, 13 nt, Human
guuuauugucaaa

SEQ ID NO: 3131416 - RNA, 20 nt, Human
aaggaggggauagagagaga

SEQ ID NO: 3131417 - RNA, 18 nt, Human
aaggaggaagagaaaaaa

SEQ ID NO: 3131418 - RNA, 18 nt, Human
aaggaauaccuguccccc

SEQ ID NO: 3131419 - RNA, 11 nt, Human
aaggagagcua

SEQ ID NO: 3131420 - RNA, 14 nt, Human
aaggagauuuacaa

SEQ ID NO: 3131421 - RNA, 16 nt, Human
aaggaagcacaugccu

SEQ ID NO: 3131422 - RNA, 17 nt, Human
aaggaauaccugucccc

SEQ ID NO: 3131423 - RNA, 14 nt, Human
aaggaagacuucau

SEQ ID NO: 3131424 - RNA, 13 nt, Human
aaggaagcacaug

SEQ ID NO: 3131425 - RNA, 15 nt, Human
aaggaagacuucauc

SEQ ID NO: 3131426 - RNA, 15 nt, Human
aaggaaagagggagg

SEQ ID NO: 3131427 - RNA, 23 nt, Human
guugcccaggcaggucuugaacu

SEQ ID NO: 3131428 - RNA, 12 nt, Human
guugcccaggcu

SEQ ID NO: 3131429 - RNA, 13 nt, Human
guugcccaggcug

SEQ ID NO: 3131430 - RNA, 19 nt, Human
guugcccaggcaggucuug

SEQ ID NO: 3131431 - RNA, 13 nt, Human
aaggauacaaaag

SEQ ID NO: 3131432 - RNA, 21 nt, Human
aaggauacaaaagcaugugag

SEQ ID NO: 3131433 - RNA, 15 nt, Human
uaaaaaucucaaauu

SEQ ID NO: 3131434 - RNA, 16 nt, Human
uaaaaaucucaaauuu

SEQ ID NO: 3131435 - RNA, 17 nt, Human
uaaaaaucucaaauuuc

SEQ ID NO: 3131436 - RNA, 15 nt, Human
guuuuucuucucccu

SEQ ID NO: 3131437 - RNA, 15 nt, Human
uaaaaaguggaaaaa

SEQ ID NO: 3131438 - RNA, 19 nt, Human
uaaaaaucucaaauuucua

SEQ ID NO: 3131439 - RNA, 20 nt, Human
uaaaaaucucaaauuucuaa

SEQ ID NO: 3131440 - RNA, 21 nt, Human
uaaaaaucucaaauuucuaaa

SEQ ID NO: 3131441 - RNA, 20 nt, Human
uaaaacuugauguguuaucu

SEQ ID NO: 3131442 - RNA, 22 nt, Human
uaaaacuugauguguuaucucu

SEQ ID NO: 3131443 - RNA, 15 nt, Human
aagugagagcugggu

SEQ ID NO: 3131444 - RNA, 16 nt, Human
aagugaggaugaaaaa

SEQ ID NO: 3131445 - RNA, 19 nt, Human
aagugauucuccugccuca

SEQ ID NO: 3131446 - RNA, 15 nt, Human
aagugauucuccugc

SEQ ID NO: 3131447 - RNA, 16 nt, Human
aagugauucuccugcc

SEQ ID NO: 3131448 - RNA, 17 nt, Human
aagugauucuccugccu

SEQ ID NO: 3131449 - RNA, 18 nt, Human
aagugauucuccugccuc

SEQ ID NO: 3131450 - RNA, 21 nt, Human
uaaaauaccagccaguaaaug

SEQ ID NO: 3131451 - RNA, 22 nt, Human
uaaaauaccagccaguaaaugg

SEQ ID NO: 3131452 - RNA, 14 nt, Human
guuucugccgcagc

SEQ ID NO: 3131453 - RNA, 15 nt, Human
guuucugccgcagcc

SEQ ID NO: 3131454 - RNA, 16 nt, Human
guuuugccauguuggc

SEQ ID NO: 3131455 - RNA, 20 nt, Human
guuuugccauguuggccagg

SEQ ID NO: 3131456 - RNA, 21 nt, Human
guuuugccauguuggccaggc

SEQ ID NO: 3131457 - RNA, 22 nt, Human
guuuugccauguuggccaggcu

SEQ ID NO: 3131458 - RNA, 13 nt, Human
aaguacacuguuu

SEQ ID NO: 3131459 - RNA, 18 nt, Human
aaguacacuguuucaaac

SEQ ID NO: 3131460 - RNA, 23 nt, Human
aaguacacuguuucaaacuuuac

SEQ ID NO: 3131461 - RNA, 19 nt, Human
aaguacacuguuucaaacu

SEQ ID NO: 3131462 - RNA, 20 nt, Human
aaguacacuguuucaaacuu

SEQ ID NO: 3131463 - RNA, 21 nt, Human
aagugaaaaaggaggaagaga

SEQ ID NO: 3131464 - RNA, 17 nt, Human
aagugaagacaaugacu

SEQ ID NO: 3131465 - RNA, 19 nt, Human
aagugaagacaaugacuua

SEQ ID NO: 3131466 - RNA, 14 nt, Human
aagugagagcuggg

SEQ ID NO: 3131467 - RNA, 12 nt, Human
aagugagagagg

SEQ ID NO: 3131468 - RNA, 14 nt, Human
uaccagcagagcac

SEQ ID NO: 3131469 - RNA, 13 nt, Human
uaccagcagagca

SEQ ID NO: 3131470 - RNA, 22 nt, Human
uaccagcagagcaccuuagaca

SEQ ID NO: 3131471 - RNA, 18 nt, Human
uaccagccaguaaauggg

SEQ ID NO: 3131472 - RNA, 12 nt, Human
uaccagcagagc

SEQ ID NO: 3131473 - RNA, 11 nt, Human
aauuaacuuuu

SEQ ID NO: 3131474 - RNA, 12 nt, Human
aauuaacuuuua

SEQ ID NO: 3131475 - RNA, 13 nt, Human
aauuaacuuuuau

SEQ ID NO: 3131476 - RNA, 15 nt, Human
aauuaacuuuuauaa

SEQ ID NO: 3131477 - RNA, 13 nt, Human
aauuaaguacuau

SEQ ID NO: 3131478 - RNA, 16 nt, Human
aauuaaguacuaugua

SEQ ID NO: 3131479 - RNA, 17 nt, Human
aauuaaguacuauguau

SEQ ID NO: 3131480 - RNA, 21 nt, Human
aaugugcugaaugguuuucaa

SEQ ID NO: 3131481 - RNA, 16 nt, Human
uaccugccaggaagcc

SEQ ID NO: 3131482 - RNA, 16 nt, Human
uaccugaggggccucu

SEQ ID NO: 3131483 - RNA, 20 nt, Human
aauuacaggaaguacuggag

SEQ ID NO: 3131484 - RNA, 19 nt, Human
aauuacaggaaguacugga

SEQ ID NO: 3131485 - RNA, 17 nt, Human
aauuacaggaaguacug

SEQ ID NO: 3131486 - RNA, 23 nt, Human
uacccgggaagggggcugggaca

SEQ ID NO: 3131487 - RNA, 21 nt, Human
uaccucuugagccuugaacuu

SEQ ID NO: 3131488 - RNA, 22 nt, Human
uaccucuugagccuugaacuuu

SEQ ID NO: 3131489 - RNA, 23 nt, Human
uaccucuugagccuugaacuuug

SEQ ID NO: 3131490 - RNA, 16 nt, Human
uaccugaagucuuugu

SEQ ID NO: 3131491 - RNA, 15 nt, Human
uaccugaggggccuc

SEQ ID NO: 3131492 - RNA, 13 nt, Human
uaccugaggggcc

SEQ ID NO: 3131493 - RNA, 14 nt, Human
uaccugaagucuuu

SEQ ID NO: 3131494 - RNA, 13 nt, Human
uaccugaagucuu

SEQ ID NO: 3131495 - RNA, 21 nt, Human
aauuauuuauuaaaugcccag

SEQ ID NO: 3131496 - RNA, 22 nt, Human
aauuauuuauuaaaugcccagc

SEQ ID NO: 3131497 - RNA, 22 nt, Human
aauucaguuguuagugugucuu

SEQ ID NO: 3131498 - RNA, 17 nt, Human
aauucaguuguuagugu

SEQ ID NO: 3131499 - RNA, 11 nt, Human
aauucaguugu

SEQ ID NO: 3131500 - RNA, 13 nt, Human
aaugcaccuggaa

SEQ ID NO: 3131501 - RNA, 12 nt, Human
aaugcaaaccau

SEQ ID NO: 3131502 - RNA, 11 nt, Human
aaugcaaacca

SEQ ID NO: 3131503 - RNA, 13 nt, Human
aaugagccuggca

SEQ ID NO: 3131504 - RNA, 12 nt, Human
aaugagccuggc

SEQ ID NO: 3131505 - RNA, 16 nt, Human
aaugaggucagagccu

SEQ ID NO: 3131506 - RNA, 18 nt, Human
aaugaggucagagccugc

SEQ ID NO: 3131507 - RNA, 11 nt, Human
aaugagccugg

SEQ ID NO: 3131508 - RNA, 20 nt, Human
aaugaccuuucaauaggaaa

SEQ ID NO: 3131509 - RNA, 21 nt, Human
aaugaccuuucaauaggaaaa

SEQ ID NO: 3131510 - RNA, 13 nt, Human
aauggaagacagc

SEQ ID NO: 3131511 - RNA, 21 nt, Human
aaugcuggcuguuggcugggg

SEQ ID NO: 3131512 - RNA, 22 nt, Human
aaugcuggcuguuggcuggggg

SEQ ID NO: 3131513 - RNA, 13 nt, Human
uacaaugcugugc

SEQ ID NO: 3131514 - RNA, 14 nt, Human
uacaaugcugugcc

SEQ ID NO: 3131515 - RNA, 16 nt, Human
uacaaugcugugcccu

SEQ ID NO: 3131516 - RNA, 18 nt, Human
uaauuuuuuugagacaga

SEQ ID NO: 3131517 - RNA, 14 nt, Human
aaugguuuucaaaa

SEQ ID NO: 3131518 - RNA, 16 nt, Human
aauggaagacagcucu

SEQ ID NO: 3131519 - RNA, 16 nt, Human
aaugguuuucaaaaua

SEQ ID NO: 3131520 - RNA, 13 nt, Human
uacagacaaagcg

SEQ ID NO: 3131521 - RNA, 15 nt, Human
uacagacaaagcgug

SEQ ID NO: 3131522 - RNA, 14 nt, Human
uacagacaaagcgu

SEQ ID NO: 3131523 - RNA, 22 nt, Human
uacagagcccacgcccccacug

SEQ ID NO: 3131524 - RNA, 19 nt, Human
uacagagcccacgccccca

SEQ ID NO: 3131525 - RNA, 23 nt, Human
uacagagcagacaguuaagagaa

SEQ ID NO: 3131526 - RNA, 17 nt, Human
aauaccagccaguaaau

SEQ ID NO: 3131527 - RNA, 19 nt, Human
aauaccagccaguaaaugg

SEQ ID NO: 3131528 - RNA, 19 nt, Human
aauaccugucccccugaca

SEQ ID NO: 3131529 - RNA, 18 nt, Human
aauaccugucccccugac

SEQ ID NO: 3131530 - RNA, 15 nt, Human
aauaccugucccccu

SEQ ID NO: 3131531 - RNA, 20 nt, Human
aauagccugccucuucucua

SEQ ID NO: 3131532 - RNA, 18 nt, Human
uaaaugaaaaucgugaca

SEQ ID NO: 3131533 - RNA, 18 nt, Human
aaguguauuuuuuuacua

SEQ ID NO: 3131534 - RNA, 21 nt, Human
aaguguauuuuuuuacuaaua

SEQ ID NO: 3131535 - RNA, 18 nt, Human
uaaauuaacuuuuauaaa

SEQ ID NO: 3131536 - RNA, 19 nt, Human
uaaauuaacuuuuauaaac

SEQ ID NO: 3131537 - RNA, 20 nt, Human
uaaauuaacuuuuauaaacu

SEQ ID NO: 3131538 - RNA, 21 nt, Human
uaaauuaacuuuuauaaacuu

SEQ ID NO: 3131539 - RNA, 21 nt, Human
aauacaccacuacauucuguu

SEQ ID NO: 3131540 - RNA, 13 nt, Human
aauacagaggcaa

SEQ ID NO: 3131541 - RNA, 17 nt, Human
uaacauguaauuaagua

SEQ ID NO: 3131542 - RNA, 19 nt, Human
uaacauguaauuaaguacu

SEQ ID NO: 3131543 - RNA, 20 nt, Human
uaacuugucuuuggacccug

SEQ ID NO: 3131544 - RNA, 16 nt, Human
uaacuugucuuuggac

SEQ ID NO: 3131545 - RNA, 17 nt, Human
aaucccauuuaaaaaaa

SEQ ID NO: 3131546 - RNA, 21 nt, Human
uaaguauucuuauuuaaugaa

SEQ ID NO: 3131547 - RNA, 19 nt, Human
aaucagccugcuccagcug

SEQ ID NO: 3131548 - RNA, 18 nt, Human
aaucagccugcuccagcu

SEQ ID NO: 3131549 - RNA, 13 nt, Human
aaucagccugcuc

SEQ ID NO: 3131550 - RNA, 11 nt, Human
aaucagccugc

SEQ ID NO: 3131551 - RNA, 14 nt, Human
uaagauucauauuu

SEQ ID NO: 3131552 - RNA, 14 nt, Human
uaagcuauucagua

SEQ ID NO: 3131553 - RNA, 21 nt, Human
uaagcuauucaguaauaacuc

SEQ ID NO: 3131554 - RNA, 9 nt, Human
uaaggaaua

SEQ ID NO: 3131555 - RNA, 13 nt, Human
uaaggaagacaau

SEQ ID NO: 3131556 - RNA, 18 nt, Human
uaaggaauaccugucccc

SEQ ID NO: 3131557 - RNA, 17 nt, Human
uaaggaauaccuguccc

SEQ ID NO: 3131558 - RNA, 18 nt, Human
acaggcccggcuccaggc

SEQ ID NO: 3131559 - RNA, 20 nt, Human
acaggcccggcuccaggcuc

SEQ ID NO: 3131560 - RNA, 21 nt, Human
acaggcccggcuccaggcucc

SEQ ID NO: 3131561 - RNA, 22 nt, Human
acaggcccggcuccaggcuccu

SEQ ID NO: 3131562 - RNA, 20 nt, Human
acaggaaaauuuuaaaaaua

SEQ ID NO: 3131563 - RNA, 15 nt, Human
acaggcagauacagg

SEQ ID NO: 3131564 - RNA, 16 nt, Human
acaggcccggcuccag

SEQ ID NO: 3131565 - RNA, 17 nt, Human
acaggcccggcuccagg

SEQ ID NO: 3131566 - RNA, 23 nt, Human
acagcuugaccgugaggccagag

SEQ ID NO: 3131567 - RNA, 22 nt, Human
acagcuugaccgugaggccaga

SEQ ID NO: 3131568 - RNA, 18 nt, Human
acaggaaaagcugcugac

SEQ ID NO: 3131569 - RNA, 19 nt, Human
acaggaaaagcugcugaca

SEQ ID NO: 3131570 - RNA, 20 nt, Human
acaggaaaagcugcugacag

SEQ ID NO: 3131571 - RNA, 21 nt, Human
acaggaaaagcugcugacagu

SEQ ID NO: 3131572 - RNA, 17 nt, Human
acagcuugaccgugagg

SEQ ID NO: 3131573 - RNA, 21 nt, Human
acagcuugaccgugaggccag

SEQ ID NO: 3131574 - RNA, 20 nt, Human
acagcuugaccgugaggcca

SEQ ID NO: 3131575 - RNA, 17 nt, Human
acagcuucauuuccugu

SEQ ID NO: 3131576 - RNA, 19 nt, Human
acagcuucauuuccugugu

SEQ ID NO: 3131577 - RNA, 21 nt, Human
acagcuucauuuccugugucu

SEQ ID NO: 3131578 - RNA, 15 nt, Human
acagcuaaugggaca

SEQ ID NO: 3131579 - RNA, 16 nt, Human
acagcuaaugggacac

SEQ ID NO: 3131580 - RNA, 17 nt, Human
acagcuaaugggacacu

SEQ ID NO: 3131581 - RNA, 19 nt, Human
acagcuaaugggacacuaa

SEQ ID NO: 3131582 - RNA, 22 nt, Human
uaugcaugaaguaauaugcaca

SEQ ID NO: 3131583 - RNA, 18 nt, Human
uaugcaugaaguaauaug

SEQ ID NO: 3131584 - RNA, 20 nt, Human
uauggcccuggccuagcaua

SEQ ID NO: 3131585 - RNA, 23 nt, Human
uauggcuuuugugcauuaucuag

SEQ ID NO: 3131586 - RNA, 21 nt, Human
uauggcccuggccuagcauac

SEQ ID NO: 3131587 - RNA, 16 nt, Human
uaugggacucaaugca

SEQ ID NO: 3131588 - RNA, 23 nt, Human
uaugggacucaaugcacugacau

SEQ ID NO: 3131589 - RNA, 15 nt, Human
acagcccgggcucug

SEQ ID NO: 3131590 - RNA, 16 nt, Human
acagcccgggcucugc

SEQ ID NO: 3131591 - RNA, 21 nt, Human
uaugaggcauuuguuugaacu

SEQ ID NO: 3131592 - RNA, 14 nt, Human
uaugaggcauuugu

SEQ ID NO: 3131593 - RNA, 15 nt, Human
uaugaggcauuuguu

SEQ ID NO: 3131594 - RNA, 20 nt, Human
acacuguuucaaacuuuacu

SEQ ID NO: 3131595 - RNA, 16 nt, Human
acacuuacacuuuaug

SEQ ID NO: 3131596 - RNA, 17 nt, Human
acacucauugaccugag

SEQ ID NO: 3131597 - RNA, 16 nt, Human
acacuguuucaaacuu

SEQ ID NO: 3131598 - RNA, 17 nt, Human
acacuguuucaaacuuu

SEQ ID NO: 3131599 - RNA, 18 nt, Human
acacuguuucaaacuuua

SEQ ID NO: 3131600 - RNA, 18 nt, Human
acacuuacacuuuaugca

SEQ ID NO: 3131601 - RNA, 21 nt, Human
acacuuacacuuuaugcacaa

SEQ ID NO: 3131602 - RNA, 18 nt, Human
acagacauacuaaccagc

SEQ ID NO: 3131603 - RNA, 19 nt, Human
acagacauacuaaccagca

SEQ ID NO: 3131604 - RNA, 19 nt, Human
uaucacccagaagaaaaua

SEQ ID NO: 3131605 - RNA, 22 nt, Human
uaucacccagaagaaaauagug

SEQ ID NO: 3131606 - RNA, 19 nt, Human
uauccaacaucaacaucuu

SEQ ID NO: 3131607 - RNA, 10 nt, Human
uaucagaauu

SEQ ID NO: 3131608 - RNA, 17 nt, Human
uaucagaauucucagaa

SEQ ID NO: 3131609 - RNA, 20 nt, Human
uagucacugagacagcccgg

SEQ ID NO: 3131610 - RNA, 17 nt, Human
uagucacugagacagcc

SEQ ID NO: 3131611 - RNA, 21 nt, Human
acacucaaaagcugggcaggu

SEQ ID NO: 3131612 - RNA, 22 nt, Human
acacuaaugaggaaacugcacu

SEQ ID NO: 3131613 - RNA, 15 nt, Human
acacuaaugaggaaa

SEQ ID NO: 3131614 - RNA, 18 nt, Human
uauaauuuaccugaaguc

SEQ ID NO: 3131615 - RNA, 21 nt, Human
uauacacuuacacuuuaugca

SEQ ID NO: 3131616 - RNA, 22 nt, Human
uauacacuuacacuuuaugcac

SEQ ID NO: 3131617 - RNA, 23 nt, Human
uauaggaacuuaaauaaugugaa

SEQ ID NO: 3131618 - RNA, 16 nt, Human
acacucauugaccuga

SEQ ID NO: 3131619 - RNA, 13 nt, Human
uagggaagauaau

SEQ ID NO: 3131620 - RNA, 17 nt, Human
uaggaaaaacugauuuu

SEQ ID NO: 3131621 - RNA, 16 nt, Human
uaggaaaaacugauuu

SEQ ID NO: 3131622 - RNA, 20 nt, Human
uagccuuagaagucacacag

SEQ ID NO: 3131623 - RNA, 17 nt, Human
uagcgcccaguugggug

SEQ ID NO: 3131624 - RNA, 14 nt, Human
uagcgcccaguugg

SEQ ID NO: 3131625 - RNA, 20 nt, Human
uagccugugccucugggacu

SEQ ID NO: 3131626 - RNA, 21 nt, Human
uagccuuagaagucacacagu

SEQ ID NO: 3131627 - RNA, 14 nt, Human
uaggaaaaacugau

SEQ ID NO: 3131628 - RNA, 13 nt, Human
uaggaaaaacuga

SEQ ID NO: 3131629 - RNA, 19 nt, Human
acaaugacuuacuguacau

SEQ ID NO: 3131630 - RNA, 20 nt, Human
acaaugacuuacuguacaug

SEQ ID NO: 3131631 - RNA, 22 nt, Human
acaaugacuuacuguacaugaa

SEQ ID NO: 3131632 - RNA, 18 nt, Human
acaaugcaaaccaucauu

SEQ ID NO: 3131633 - RNA, 17 nt, Human
acaaugcaaaccaucau

SEQ ID NO: 3131634 - RNA, 16 nt, Human
acaaugcaaaccauca

SEQ ID NO: 3131635 - RNA, 11 nt, Human
acaaugcaaac

SEQ ID NO: 3131636 - RNA, 19 nt, Human
uaggguaagugagagaggg

SEQ ID NO: 3131637 - RNA, 17 nt, Human
uaggguuauaauaaugu

SEQ ID NO: 3131638 - RNA, 15 nt, Human
uaggguuauaauaau

SEQ ID NO: 3131639 - RNA, 23 nt, Human
acaaugcaaaccaucauugaaau

SEQ ID NO: 3131640 - RNA, 21 nt, Human
acaaugcaaaccaucauugaa

SEQ ID NO: 3131641 - RNA, 19 nt, Human
acaaugcaaaccaucauug

SEQ ID NO: 3131642 - RNA, 23 nt, Human
acacaggcccggcuccaggcucc

SEQ ID NO: 3131643 - RNA, 24 nt, Human
acacaggcccggcuccaggcuccu

SEQ ID NO: 3131644 - RNA, 19 nt, Human
acacaggcccggcuccagg

SEQ ID NO: 3131645 - RNA, 20 nt, Human
acacaggcccggcuccaggc

SEQ ID NO: 3131646 - RNA, 21 nt, Human
acacaggcccggcuccaggcu

SEQ ID NO: 3131647 - RNA, 22 nt, Human
acacaggcccggcuccaggcuc

SEQ ID NO: 3131648 - RNA, 17 nt, Human
acacaggcccggcucca

SEQ ID NO: 3131649 - RNA, 18 nt, Human
acacaggcccggcuccag

SEQ ID NO: 3131650 - RNA, 16 nt, Human
acacaggcccggcucc

SEQ ID NO: 3131651 - RNA, 22 nt, Human
acacacacgcgugcacacacca

SEQ ID NO: 3131652 - RNA, 15 nt, Human
uaguagagacagggu

SEQ ID NO: 3131653 - RNA, 22 nt, Human
uaguagagacaggguuuugcca

SEQ ID NO: 3131654 - RNA, 14 nt, Human
uagucacugagaca

SEQ ID NO: 3131655 - RNA, 14 nt, Human
uaguagagacaggg

SEQ ID NO: 3131656 - RNA, 10 nt, Human
uagacagagu

SEQ ID NO: 3131657 - RNA, 16 nt, Human
uagacagucccugcca

SEQ ID NO: 3131658 - RNA, 18 nt, Human
uagacaauuuauuauggc

SEQ ID NO: 3131659 - RNA, 21 nt, Human
uagacagucccugccaaugga

SEQ ID NO: 3131660 - RNA, 17 nt, Human
uagacagucccugccaa

SEQ ID NO: 3131661 - RNA, 17 nt, Human
aauuugugauacaaugc

SEQ ID NO: 3131662 - RNA, 18 nt, Human
aauuugugauacaaugcu

SEQ ID NO: 3131663 - RNA, 14 nt, Human
aauuugugauacaa

SEQ ID NO: 3131664 - RNA, 14 nt, Human
uagagccagggucu

SEQ ID NO: 3131665 - RNA, 22 nt, Human
uagagcggagaaaggaagggcu

SEQ ID NO: 3131666 - RNA, 16 nt, Human
acaaaaagcauaaaaa

SEQ ID NO: 3131667 - RNA, 13 nt, Human
uagccaaggccaa

SEQ ID NO: 3131668 - RNA, 12 nt, Human
uagccaaggcca

SEQ ID NO: 3131669 - RNA, 22 nt, Human
uagcacagacccugcccugugg

SEQ ID NO: 3131670 - RNA, 14 nt, Human
uagcacagacccug

SEQ ID NO: 3131671 - RNA, 21 nt, Human
uagcacagacccugcccugug

SEQ ID NO: 3131672 - RNA, 20 nt, Human
uagcacagacccugcccugu

SEQ ID NO: 3131673 - RNA, 15 nt, Human
uagcacagacccugc

SEQ ID NO: 3131674 - RNA, 23 nt, Human
cacagaugggugcuuggaggaag

SEQ ID NO: 3131675 - RNA, 21 nt, Human
cacagaguuguuacauuuuua

SEQ ID NO: 3131676 - RNA, 22 nt, Human
cacagaguuguuacauuuuuaa

SEQ ID NO: 3131677 - RNA, 13 nt, Human
cacagaggcugcc

SEQ ID NO: 3131678 - RNA, 19 nt, Human
cacagagaaaguacuucuc

SEQ ID NO: 3131679 - RNA, 20 nt, Human
cacagagaaaguacuucucc

SEQ ID NO: 3131680 - RNA, 12 nt, Human
cacagagaaagu

SEQ ID NO: 3131681 - RNA, 21 nt, Human
cacagcucuucuccaggcugu

SEQ ID NO: 3131682 - RNA, 13 nt, Human
cacaaacagaggc

SEQ ID NO: 3131683 - RNA, 14 nt, Human
cacaaacagaggcc

SEQ ID NO: 3131684 - RNA, 18 nt, Human
caauuacaggaaguacug

SEQ ID NO: 3131685 - RNA, 17 nt, Human
caauuacaggaaguacu

SEQ ID NO: 3131686 - RNA, 14 nt, Human
caauguucucucuu

SEQ ID NO: 3131687 - RNA, 19 nt, Human
caaugugaaaagaaaaaug

SEQ ID NO: 3131688 - RNA, 22 nt, Human
caaugugaaaagaaaaaugagc

SEQ ID NO: 3131689 - RNA, 17 nt, Human
cacacacgcgugcacac

SEQ ID NO: 3131690 - RNA, 13 nt, Human
cacaaaggagagc

SEQ ID NO: 3131691 - RNA, 16 nt, Human
caaggagauuuacaac

SEQ ID NO: 3131692 - RNA, 19 nt, Human
caaggauccugagccagau

SEQ ID NO: 3131693 - RNA, 18 nt, Human
caaggauccugagccaga

SEQ ID NO: 3131694 - RNA, 20 nt, Human
caaggauccugagccagauu

SEQ ID NO: 3131695 - RNA, 15 nt, Human
caaggcugcagugag

SEQ ID NO: 3131696 - RNA, 17 nt, Human
caaggauccugagccag

SEQ ID NO: 3131697 - RNA, 22 nt, Human
caaggcugcagugagccgagau

SEQ ID NO: 3131698 - RNA, 17 nt, Human
caaggcugcagugagcc

SEQ ID NO: 3131699 - RNA, 22 nt, Human
caagcuggucccacucagucca

SEQ ID NO: 3131700 - RNA, 23 nt, Human
caagcuggucccacucaguccau

SEQ ID NO: 3131701 - RNA, 18 nt, Human
caagcgauucuucugcuu

SEQ ID NO: 3131702 - RNA, 21 nt, Human
caagcugcacccucaggcagg

SEQ ID NO: 3131703 - RNA, 15 nt, Human
caagcgauucuucug

SEQ ID NO: 3131704 - RNA, 17 nt, Human
caagcgauucuucugcu

SEQ ID NO: 3131705 - RNA, 21 nt, Human
caagcuggucccacucagucc

SEQ ID NO: 3131706 - RNA, 22 nt, Human
caagcugcacccucaggcaggu

SEQ ID NO: 3131707 - RNA, 20 nt, Human
caagcugcacccucaggcag

SEQ ID NO: 3131708 - RNA, 14 nt, Human
caauaggaaaaacu

SEQ ID NO: 3131709 - RNA, 15 nt, Human
caauaggaaaaacug

SEQ ID NO: 3131710 - RNA, 17 nt, Human
caauaggaaaaacugau

SEQ ID NO: 3131711 - RNA, 16 nt, Human
caauaggaaaaacuga

SEQ ID NO: 3131712 - RNA, 13 nt, Human
caagacgcugugc

SEQ ID NO: 3131713 - RNA, 23 nt, Human
caagaccuucuccuucaccuuug

SEQ ID NO: 3131714 - RNA, 21 nt, Human
caagaccuucuccuucaccuu

SEQ ID NO: 3131715 - RNA, 13 nt, Human
caagaagcccagg

SEQ ID NO: 3131716 - RNA, 15 nt, Human
caaauuucuaaaucu

SEQ ID NO: 3131717 - RNA, 22 nt, Human
caaauuucuaaaucuccaaaau

SEQ ID NO: 3131718 - RNA, 20 nt, Human
caacauacucccaucuguga

SEQ ID NO: 3131719 - RNA, 12 nt, Human
caacaggcuggg

SEQ ID NO: 3131720 - RNA, 19 nt, Human
caacauacucccaucugug

SEQ ID NO: 3131721 - RNA, 17 nt, Human
caacauacucccaucug

SEQ ID NO: 3131722 - RNA, 19 nt, Human
caaaguggugagaggcauc

SEQ ID NO: 3131723 - RNA, 23 nt, Human
caaagugcugggauuacaagcgu

SEQ ID NO: 3131724 - RNA, 13 nt, Human
caaagugcuggga

SEQ ID NO: 3131725 - RNA, 19 nt, Human
caaagugcugggauuacaa

SEQ ID NO: 3131726 - RNA, 22 nt, Human
caaauggaaaugggcagagcag

SEQ ID NO: 3131727 - RNA, 23 nt, Human
caaauggaaaugggcagagcaga

SEQ ID NO: 3131728 - RNA, 22 nt, Human
caaaaugaaacgcaaccaccac

SEQ ID NO: 3131729 - RNA, 11 nt, Human
caaaaugaaac

SEQ ID NO: 3131730 - RNA, 13 nt, Human
caaacagaggccg

SEQ ID NO: 3131731 - RNA, 17 nt, Human
caaacucuugaccucag

SEQ ID NO: 3131732 - RNA, 19 nt, Human
caaacucuugaccucaggu

SEQ ID NO: 3131733 - RNA, 20 nt, Human
caaacucuugaccucaggug

SEQ ID NO: 3131734 - RNA, 21 nt, Human
caaacucuugaccucagguga

SEQ ID NO: 3131735 - RNA, 16 nt, Human
caaaacucuccucugc

SEQ ID NO: 3131736 - RNA, 15 nt, Human
caaaacucuccucug

SEQ ID NO: 3131737 - RNA, 18 nt, Human
auuuuauuuuauuaugca

SEQ ID NO: 3131738 - RNA, 21 nt, Human
caaaacgguuuuacugcagcu

SEQ ID NO: 3131739 - RNA, 15 nt, Human
caaaacgguuuuacu

SEQ ID NO: 3131740 - RNA, 14 nt, Human
caaaaguuucucuu

SEQ ID NO: 3131741 - RNA, 23 nt, Human
caaaacucuccucugcugcuggc

SEQ ID NO: 3131742 - RNA, 21 nt, Human
caaaaucgaugcagugcuucc

SEQ ID NO: 3131743 - RNA, 14 nt, Human
caaaauaaaacuuu

SEQ ID NO: 3131744 - RNA, 16 nt, Human
caaaauaaaacuuuuu

SEQ ID NO: 3131745 - RNA, 20 nt, Human
caaaauaaaacuuuuuaaaa

SEQ ID NO: 3131746 - RNA, 17 nt, Human
cacaguucaauucucau

SEQ ID NO: 3131747 - RNA, 21 nt, Human
ugacucuuucuauuguuucuu

SEQ ID NO: 3131748 - RNA, 16 nt, Human
ugacuuuccucuuugg

SEQ ID NO: 3131749 - RNA, 13 nt, Human
ugaccauucucca

SEQ ID NO: 3131750 - RNA, 14 nt, Human
ugagaccaaccugg

SEQ ID NO: 3131751 - RNA, 18 nt, Human
ugagaggggaacagacug

SEQ ID NO: 3131752 - RNA, 14 nt, Human
ugagaggggaacag

SEQ ID NO: 3131753 - RNA, 22 nt, Human
ugacuuuucuguccgagcuuug

SEQ ID NO: 3131754 - RNA, 15 nt, Human
ugagaaauaaaguuu

SEQ ID NO: 3131755 - RNA, 21 nt, Human
ugaggugggaggaucucuuga

SEQ ID NO: 3131756 - RNA, 21 nt, Human
ugaggcugggcucccuuccca

SEQ ID NO: 3131757 - RNA, 18 nt, Human
ugaggucagagccugcag

SEQ ID NO: 3131758 - RNA, 19 nt, Human
ugaggucagagccugcagu

SEQ ID NO: 3131759 - RNA, 15 nt, Human
ugaggcucugcccuu

SEQ ID NO: 3131760 - RNA, 16 nt, Human
ugaggcucugcccuug

SEQ ID NO: 3131761 - RNA, 18 nt, Human
ugaggcucugcccuuggu

SEQ ID NO: 3131762 - RNA, 16 nt, Human
ugaggcugggcucccu

SEQ ID NO: 3131763 - RNA, 15 nt, Human
ugaggcugggcuccc

SEQ ID NO: 3131764 - RNA, 19 nt, Human
ugagcucaggaguuugaga

SEQ ID NO: 3131765 - RNA, 11 nt, Human
ugagcucagga

SEQ ID NO: 3131766 - RNA, 23 nt, Human
ugagccgagaucacgccacugca

SEQ ID NO: 3131767 - RNA, 20 nt, Human
ugagcagggcucagcgggga

SEQ ID NO: 3131768 - RNA, 22 nt, Human
ugagcagggcucagcggggaca

SEQ ID NO: 3131769 - RNA, 23 nt, Human
ugagcagggcucagcggggacag

SEQ ID NO: 3131770 - RNA, 22 nt, Human
ugagccgagaucacgccacugc

SEQ ID NO: 3131771 - RNA, 22 nt, Human
ugaggaugaaaaaauaacacug

SEQ ID NO: 3131772 - RNA, 20 nt, Human
ugaccagcaccaucucuccu

SEQ ID NO: 3131773 - RNA, 23 nt, Human
ugacaucaacugcaucaagaugu

SEQ ID NO: 3131774 - RNA, 22 nt, Human
ugacagagcaagugagacccug

SEQ ID NO: 3131775 - RNA, 17 nt, Human
ugacagacacaggcccg

SEQ ID NO: 3131776 - RNA, 18 nt, Human
ugacagacacaggcccgg

SEQ ID NO: 3131777 - RNA, 23 nt, Human
ugacaaggauugcuacuguccua

SEQ ID NO: 3131778 - RNA, 14 nt, Human
ugacagacacaggc

SEQ ID NO: 3131779 - RNA, 16 nt, Human
ugacagacacaggccc

SEQ ID NO: 3131780 - RNA, 13 nt, Human
ugacagacacagg

SEQ ID NO: 3131781 - RNA, 14 nt, Human
ugacacacagcucu

SEQ ID NO: 3131782 - RNA, 15 nt, Human
ugacacacagcucug

SEQ ID NO: 3131783 - RNA, 21 nt, Human
ugaauuguaaggaaugauuaa

SEQ ID NO: 3131784 - RNA, 13 nt, Human
ugaauuguaagga

SEQ ID NO: 3131785 - RNA, 23 nt, Human
ugacaacacucauugaccugagg

SEQ ID NO: 3131786 - RNA, 13 nt, Human
ugacaacacucau

SEQ ID NO: 3131787 - RNA, 20 nt, Human
ugaaggccccgcccaggcuu

SEQ ID NO: 3131788 - RNA, 19 nt, Human
ugaaggccccgcccaggcu

SEQ ID NO: 3131789 - RNA, 16 nt, Human
ugaaggcuggguucug

SEQ ID NO: 3131790 - RNA, 18 nt, Human
ugaaggccccgcccaggc

SEQ ID NO: 3131791 - RNA, 19 nt, Human
ugaagacucauucuucugu

SEQ ID NO: 3131792 - RNA, 20 nt, Human
ugaagacucauucuucugua

SEQ ID NO: 3131793 - RNA, 23 nt, Human
ugaacuggguacuuguggacaca

SEQ ID NO: 3131794 - RNA, 21 nt, Human
ugaaggcuggguucugauccu

SEQ ID NO: 3131795 - RNA, 20 nt, Human
ugaaggcuggguucugaucc

SEQ ID NO: 3131796 - RNA, 23 nt, Human
ugaaugaugauccuaggcauuug

SEQ ID NO: 3131797 - RNA, 13 nt, Human
ucuuugcagacag

SEQ ID NO: 3131798 - RNA, 23 nt, Human
ucuuugagugaagcugggagaac

SEQ ID NO: 3131799 - RNA, 14 nt, Human
ucuuugcagacagg

SEQ ID NO: 3131800 - RNA, 17 nt, Human
ucuuugcagacaggcaa

SEQ ID NO: 3131801 - RNA, 13 nt, Human
ucuuuggacccug

SEQ ID NO: 3131802 - RNA, 15 nt, Human
ucuuuggacccugag

SEQ ID NO: 3131803 - RNA, 14 nt, Human
ucuuuggacccuga

SEQ ID NO: 3131804 - RNA, 13 nt, Human
ucuuguguguuua

SEQ ID NO: 3131805 - RNA, 23 nt, Human
ucuuuccaaaguacacuguuuca

SEQ ID NO: 3131806 - RNA, 13 nt, Human
ucuuucccucccu

SEQ ID NO: 3131807 - RNA, 23 nt, Human
ucuuucccucccuuccucuuucc

SEQ ID NO: 3131808 - RNA, 17 nt, Human
ucuuuccaaaguacacu

SEQ ID NO: 3131809 - RNA, 12 nt, Human
ucuuucccuccc

SEQ ID NO: 3131810 - RNA, 21 nt, Human
ugaaaacacauuuuucuuagg

SEQ ID NO: 3131811 - RNA, 21 nt, Human
ugaaaacacuguucucugccc

SEQ ID NO: 3131812 - RNA, 20 nt, Human
ugaaaacacuguucucugcc

SEQ ID NO: 3131813 - RNA, 17 nt, Human
ugaaaacacuguucucu

SEQ ID NO: 3131814 - RNA, 20 nt, Human
ugaaaacacauuuuucuuag

SEQ ID NO: 3131815 - RNA, 23 nt, Human
ugaaaacacuguucucugcccuc

SEQ ID NO: 3131816 - RNA, 22 nt, Human
ugaaaacacuguucucugcccu

SEQ ID NO: 3131817 - RNA, 22 nt, Human
ugaaaagaaaaaugagccuggc

SEQ ID NO: 3131818 - RNA, 20 nt, Human
ugaaaagaaaaaugagccug

SEQ ID NO: 3131819 - RNA, 15 nt, Human
ugaaaagaaaaauga

SEQ ID NO: 3131820 - RNA, 19 nt, Human
ugaaaagaaaaaugagccu

SEQ ID NO: 3131821 - RNA, 14 nt, Human
ugaaaauucagugg

SEQ ID NO: 3131822 - RNA, 14 nt, Human
ucuugcucugcuga

SEQ ID NO: 3131823 - RNA, 15 nt, Human
ucuugcucugcugac

SEQ ID NO: 3131824 - RNA, 23 nt, Human
ucuugcucugcugacagacacag

SEQ ID NO: 3131825 - RNA, 22 nt, Human
ucuugaagacuuuucuuucagc

SEQ ID NO: 3131826 - RNA, 13 nt, Human
ucuugaagacuuu

SEQ ID NO: 3131827 - RNA, 15 nt, Human
ucuugcaugaggcua

SEQ ID NO: 3131828 - RNA, 20 nt, Human
ucuugaaauauaggaacuua

SEQ ID NO: 3131829 - RNA, 21 nt, Human
ucuugaaauauaggaacuuaa

SEQ ID NO: 3131830 - RNA, 23 nt, Human
ucuuagguuggcaaaaaggcagg

SEQ ID NO: 3131831 - RNA, 20 nt, Human
ucuuagguuggcaaaaaggc

SEQ ID NO: 3131832 - RNA, 17 nt, Human
ucugugucagguggggc

SEQ ID NO: 3131833 - RNA, 20 nt, Human
ucugugucagguggggcagc

SEQ ID NO: 3131834 - RNA, 15 nt, Human
ucuuagauguauaua

SEQ ID NO: 3131835 - RNA, 14 nt, Human
ucuuagauguauau

SEQ ID NO: 3131836 - RNA, 14 nt, Human
ucuucagaucucua

SEQ ID NO: 3131837 - RNA, 21 nt, Human
ucuucagagacuccugcaggc

SEQ ID NO: 3131838 - RNA, 22 nt, Human
ucuuauccaacaucaacaucuu

SEQ ID NO: 3131839 - RNA, 15 nt, Human
ucugccucugacaca

SEQ ID NO: 3131840 - RNA, 18 nt, Human
ucugccucugacacacag

SEQ ID NO: 3131841 - RNA, 21 nt, Human
ucugccucccaucacccgcua

SEQ ID NO: 3131842 - RNA, 20 nt, Human
ucugccucccaucacccgcu

SEQ ID NO: 3131843 - RNA, 17 nt, Human
ucugccucccaucaccc

SEQ ID NO: 3131844 - RNA, 16 nt, Human
ucugccucccaucacc

SEQ ID NO: 3131845 - RNA, 23 nt, Human
ucugccucugacacacagcucug

SEQ ID NO: 3131846 - RNA, 21 nt, Human
ucugccucugacacacagcuc

SEQ ID NO: 3131847 - RNA, 22 nt, Human
ucugccucugacacacagcucu

SEQ ID NO: 3131848 - RNA, 19 nt, Human
ucugccugaagucacacag

SEQ ID NO: 3131849 - RNA, 20 nt, Human
ucugccugaagucacacagu

SEQ ID NO: 3131850 - RNA, 18 nt, Human
ucugccauauucuguugg

SEQ ID NO: 3131851 - RNA, 12 nt, Human
ucugcccacucc

SEQ ID NO: 3131852 - RNA, 22 nt, Human
ucugccauauucuguuggccag

SEQ ID NO: 3131853 - RNA, 23 nt, Human
ucugccauauucuguuggccagu

SEQ ID NO: 3131854 - RNA, 14 nt, Human
ucugcccacucccu

SEQ ID NO: 3131855 - RNA, 13 nt, Human
ucugcccacuccc

SEQ ID NO: 3131856 - RNA, 12 nt, Human
ucugccucccau

SEQ ID NO: 3131857 - RNA, 15 nt, Human
ucugccucccaucac

SEQ ID NO: 3131858 - RNA, 13 nt, Human
ucugccucccauc

SEQ ID NO: 3131859 - RNA, 22 nt, Human
ucugaggaauccagacccggcu

SEQ ID NO: 3131860 - RNA, 18 nt, Human
ucugaggaauccagaccc

SEQ ID NO: 3131861 - RNA, 21 nt, Human
ucugaggaauccagacccggc

SEQ ID NO: 3131862 - RNA, 21 nt, Human
ucugcaagaauugaagcagga

SEQ ID NO: 3131863 - RNA, 23 nt, Human
ucugacccaugcugcccugugag

SEQ ID NO: 3131864 - RNA, 22 nt, Human
ucugacccaugcugcccuguga

SEQ ID NO: 3131865 - RNA, 20 nt, Human
ucugacccaugcugcccugu

SEQ ID NO: 3131866 - RNA, 19 nt, Human
ucugacccaugcugcccug

SEQ ID NO: 3131867 - RNA, 18 nt, Human
ucugagaggacuuuucuu

SEQ ID NO: 3131868 - RNA, 20 nt, Human
ucuguccuacucugugucag

SEQ ID NO: 3131869 - RNA, 15 nt, Human
ucuguacagagccca

SEQ ID NO: 3131870 - RNA, 14 nt, Human
ucuguacagagccc

SEQ ID NO: 3131871 - RNA, 12 nt, Human
ucuguccuggga

SEQ ID NO: 3131872 - RNA, 17 nt, Human
ucugucgcccagucugg

SEQ ID NO: 3131873 - RNA, 16 nt, Human
ucugucgcccagucug

SEQ ID NO: 3131874 - RNA, 13 nt, Human
ucugucuaggaau

SEQ ID NO: 3131875 - RNA, 16 nt, Human
ucuggugacuuuccuc

SEQ ID NO: 3131876 - RNA, 13 nt, Human
ucugcugcuggcu

SEQ ID NO: 3131877 - RNA, 11 nt, Human
ucugcugcugg

SEQ ID NO: 3131878 - RNA, 21 nt, Human
ucugcuccucuccccagcaag

SEQ ID NO: 3131879 - RNA, 16 nt, Human
ucugccugcccaggcc

SEQ ID NO: 3131880 - RNA, 17 nt, Human
ucugccugcccaggccc

SEQ ID NO: 3131881 - RNA, 18 nt, Human
ucugccugcccaggcccc

SEQ ID NO: 3131882 - RNA, 20 nt, Human
ucugccugcccaggccccug

SEQ ID NO: 3131883 - RNA, 17 nt, Human
ucugcugcuggcugguu

SEQ ID NO: 3131884 - RNA, 15 nt, Human
ucugcugcuggcugg

SEQ ID NO: 3131885 - RNA, 14 nt, Human
ucugcugcuggcug

SEQ ID NO: 3131886 - RNA, 16 nt, Human
ucuggaaugcaguggu

SEQ ID NO: 3131887 - RNA, 15 nt, Human
ucagcuccagcucac

SEQ ID NO: 3131888 - RNA, 18 nt, Human
ucagcuccagcucaccag

SEQ ID NO: 3131889 - RNA, 21 nt, Human
ucagcuccagcucaccagccc

SEQ ID NO: 3131890 - RNA, 16 nt, Human
ucagccugcuccagcu

SEQ ID NO: 3131891 - RNA, 12 nt, Human
ucagccucccga

SEQ ID NO: 3131892 - RNA, 20 nt, Human
ucagccucccgaauagcugg

SEQ ID NO: 3131893 - RNA, 22 nt, Human
ucagccucccaaagugcuggga

SEQ ID NO: 3131894 - RNA, 15 nt, Human
ucagcugcuacuacu

SEQ ID NO: 3131895 - RNA, 15 nt, Human
ucagcauccuggcac

SEQ ID NO: 3131896 - RNA, 16 nt, Human
ucagcauccuggcacc

SEQ ID NO: 3131897 - RNA, 17 nt, Human
ucagcauccuggcaccc

SEQ ID NO: 3131898 - RNA, 18 nt, Human
ucagcauccuggcacccg

SEQ ID NO: 3131899 - RNA, 12 nt, Human
ucagccucccaa

SEQ ID NO: 3131900 - RNA, 15 nt, Human
ucagcacgauuucug

SEQ ID NO: 3131901 - RNA, 16 nt, Human
ucagcacgauuucugu

SEQ ID NO: 3131902 - RNA, 17 nt, Human
ucagcacgauuucuguu

SEQ ID NO: 3131903 - RNA, 15 nt, Human
ucauacucaccucac

SEQ ID NO: 3131904 - RNA, 14 nt, Human
ucagguggggcagc

SEQ ID NO: 3131905 - RNA, 18 nt, Human
ucaggugcugccauccag

SEQ ID NO: 3131906 - RNA, 20 nt, Human
ucaggugcugccauccaggu

SEQ ID NO: 3131907 - RNA, 15 nt, Human
ucagguggggcagcu

SEQ ID NO: 3131908 - RNA, 16 nt, Human
ucagguggggcagcuu

SEQ ID NO: 3131909 - RNA, 21 nt, Human
ucagguggggcagcuugaggg

SEQ ID NO: 3131910 - RNA, 15 nt, Human
ucaggugcugccauc

SEQ ID NO: 3131911 - RNA, 20 nt, Human
ucagguggggucacucuggc

SEQ ID NO: 3131912 - RNA, 17 nt, Human
ucagguggggucacucu

SEQ ID NO: 3131913 - RNA, 15 nt, Human
ucaguccauagcaga

SEQ ID NO: 3131914 - RNA, 17 nt, Human
ucagucugauucccaag

SEQ ID NO: 3131915 - RNA, 18 nt, Human
ucagugugacugaucucu

SEQ ID NO: 3131916 - RNA, 14 nt, Human
uccacuuucuagcc

SEQ ID NO: 3131917 - RNA, 21 nt, Human
uccacccugcucuccgaccag

SEQ ID NO: 3131918 - RNA, 13 nt, Human
uccacccugcucu

SEQ ID NO: 3131919 - RNA, 14 nt, Human
uccacccugcucuc

SEQ ID NO: 3131920 - RNA, 22 nt, Human
uccacugugccaugugccaggu

SEQ ID NO: 3131921 - RNA, 12 nt, Human
uccaagaagccc

SEQ ID NO: 3131922 - RNA, 14 nt, Human
uccaagaagcccag

SEQ ID NO: 3131923 - RNA, 16 nt, Human
uccaagaagcccagga

SEQ ID NO: 3131924 - RNA, 15 nt, Human
uccaagaagcccagg

SEQ ID NO: 3131925 - RNA, 14 nt, Human
uccaagcaggacau

SEQ ID NO: 3131926 - RNA, 20 nt, Human
uccaagaccuucuccuucac

SEQ ID NO: 3131927 - RNA, 19 nt, Human
uccaagaccuucuccuuca

SEQ ID NO: 3131928 - RNA, 21 nt, Human
uccacaagagcccaggccucc

SEQ ID NO: 3131929 - RNA, 19 nt, Human
uccacaagagcccaggccu

SEQ ID NO: 3131930 - RNA, 20 nt, Human
uccacaagagcccaggccuc

SEQ ID NO: 3131931 - RNA, 18 nt, Human
ucccaccucagccucccg

SEQ ID NO: 3131932 - RNA, 16 nt, Human
ucccaccucagccucc

SEQ ID NO: 3131933 - RNA, 14 nt, Human
ucccaccucucuca

SEQ ID NO: 3131934 - RNA, 18 nt, Human
ucccaccucucucacucc

SEQ ID NO: 3131935 - RNA, 17 nt, Human
ucccaccucucucacuc

SEQ ID NO: 3131936 - RNA, 19 nt, Human
ucccaccuuggcugcaggg

SEQ ID NO: 3131937 - RNA, 21 nt, Human
ucccaccuuggcugcagggag

SEQ ID NO: 3131938 - RNA, 18 nt, Human
ucccaccuuggcugcagg

SEQ ID NO: 3131939 - RNA, 20 nt, Human
ucccaccucucucacuccuu

SEQ ID NO: 3131940 - RNA, 14 nt, Human
ucccacucagucca

SEQ ID NO: 3131941 - RNA, 15 nt, Human
ucccaugagccucag

SEQ ID NO: 3131942 - RNA, 16 nt, Human
ucccaugagccucagc

SEQ ID NO: 3131943 - RNA, 18 nt, Human
ucccaggcauuccccagg

SEQ ID NO: 3131944 - RNA, 17 nt, Human
ucccaggcauuccccag

SEQ ID NO: 3131945 - RNA, 20 nt, Human
uccauagagagcaagacgcu

SEQ ID NO: 3131946 - RNA, 17 nt, Human
uccauagagagcaagac

SEQ ID NO: 3131947 - RNA, 15 nt, Human
uccauagagagcaag

SEQ ID NO: 3131948 - RNA, 21 nt, Human
ucccaacucaccccagcccca

SEQ ID NO: 3131949 - RNA, 19 nt, Human
ucccaacucaccccagccc

SEQ ID NO: 3131950 - RNA, 18 nt, Human
ucccaacucaccccagcc

SEQ ID NO: 3131951 - RNA, 17 nt, Human
ucccaacucaccccagc

SEQ ID NO: 3131952 - RNA, 12 nt, Human
uccuccucagau

SEQ ID NO: 3131953 - RNA, 13 nt, Human
uccuccaggugca

SEQ ID NO: 3131954 - RNA, 12 nt, Human
uccuccaggugc

SEQ ID NO: 3131955 - RNA, 22 nt, Human
uccuccaggugcacaagcucca

SEQ ID NO: 3131956 - RNA, 20 nt, Human
uccuccaggugcacaagcuc

SEQ ID NO: 3131957 - RNA, 18 nt, Human
uccuccaggugcacaagc

SEQ ID NO: 3131958 - RNA, 14 nt, Human
uccuccaggugcac

SEQ ID NO: 3131959 - RNA, 21 nt, Human
uccuaguuccaccaucaagcc

SEQ ID NO: 3131960 - RNA, 12 nt, Human
uccuaguuccac

SEQ ID NO: 3131961 - RNA, 17 nt, Human
uccuaguuccaccauca

SEQ ID NO: 3131962 - RNA, 14 nt, Human
uccuaguuccacca

SEQ ID NO: 3131963 - RNA, 16 nt, Human
uccuaagcuauucagu

SEQ ID NO: 3131964 - RNA, 19 nt, Human
uccucuguacagagcccac

SEQ ID NO: 3131965 - RNA, 23 nt, Human
uccucuguacagagcccacgccc

SEQ ID NO: 3131966 - RNA, 17 nt, Human
uccugagccagauuuca

SEQ ID NO: 3131967 - RNA, 14 nt, Human
uccugagccagauu

SEQ ID NO: 3131968 - RNA, 19 nt, Human
uccugagccagauuucacu

SEQ ID NO: 3131969 - RNA, 18 nt, Human
uccugagccagauuucac

SEQ ID NO: 3131970 - RNA, 12 nt, Human
uccugaggcugg

SEQ ID NO: 3131971 - RNA, 19 nt, Human
uccugaggcugggcucccu

SEQ ID NO: 3131972 - RNA, 17 nt, Human
uccugaggcugggcucc

SEQ ID NO: 3131973 - RNA, 16 nt, Human
uccugaggcugggcuc

SEQ ID NO: 3131974 - RNA, 15 nt, Human
uccugaggcugggcu

SEQ ID NO: 3131975 - RNA, 15 nt, Human
uccucuggccugugu

SEQ ID NO: 3131976 - RNA, 13 nt, Human
uccucuguacaga

SEQ ID NO: 3131977 - RNA, 17 nt, Human
uccucugcugcuggcug

SEQ ID NO: 3131978 - RNA, 21 nt, Human
uccuccuuuucacaguucucu

SEQ ID NO: 3131979 - RNA, 17 nt, Human
uccucuaggaggucucu

SEQ ID NO: 3131980 - RNA, 21 nt, Human
uccucuaggaggucucuaaga

SEQ ID NO: 3131981 - RNA, 16 nt, Human
ucccuucccaccucuc

SEQ ID NO: 3131982 - RNA, 14 nt, Human
ucccuucccaccuc

SEQ ID NO: 3131983 - RNA, 21 nt, Human
ucccuucccacuggaggcaug

SEQ ID NO: 3131984 - RNA, 17 nt, Human
ucccuucccaccucucu

SEQ ID NO: 3131985 - RNA, 21 nt, Human
uccgaaagggacuuggaagcu

SEQ ID NO: 3131986 - RNA, 17 nt, Human
uccgaccagacaccuug

SEQ ID NO: 3131987 - RNA, 22 nt, Human
uccgaaagggacuuggaagcuc

SEQ ID NO: 3131988 - RNA, 21 nt, Human
uccgcuuucuacccagcgagc

SEQ ID NO: 3131989 - RNA, 22 nt, Human
ucccaugagccucagcauccug

SEQ ID NO: 3131990 - RNA, 18 nt, Human
ucccucccuuccucuuuc

SEQ ID NO: 3131991 - RNA, 16 nt, Human
ucccugccaauggacu

SEQ ID NO: 3131992 - RNA, 14 nt, Human
ucccugccaaugga

SEQ ID NO: 3131993 - RNA, 20 nt, Human
ucccugcacuugcagacucu

SEQ ID NO: 3131994 - RNA, 17 nt, Human
ucccucuggggcuguuc

SEQ ID NO: 3131995 - RNA, 13 nt, Human
ucccucuggggcu

SEQ ID NO: 3131996 - RNA, 23 nt, Human
ucucacucugucgcccagucugg

SEQ ID NO: 3131997 - RNA, 21 nt, Human
ucucacacaugagcaucaggc

SEQ ID NO: 3131998 - RNA, 22 nt, Human
ucucacucugucgcccagucug

SEQ ID NO: 3131999 - RNA, 20 nt, Human
ucucacugccaugccagcuu

SEQ ID NO: 3132000 - RNA, 16 nt, Human
ucucacacaugagcau

SEQ ID NO: 3132001 - RNA, 18 nt, Human
ucucaaauuucuaaaucu

SEQ ID NO: 3132002 - RNA, 13 nt, Human
ucucaaauuucua

SEQ ID NO: 3132003 - RNA, 14 nt, Human
ucucaaauuucuaa

SEQ ID NO: 3132004 - RNA, 16 nt, Human
ucucaaauuucuaaau

SEQ ID NO: 3132005 - RNA, 14 nt, Human
ucucacuguugccc

SEQ ID NO: 3132006 - RNA, 15 nt, Human
ucucacuguugccca

SEQ ID NO: 3132007 - RNA, 14 nt, Human
ucuaauauguaaca

SEQ ID NO: 3132008 - RNA, 18 nt, Human
ucuaggaggucucuaaga

SEQ ID NO: 3132009 - RNA, 18 nt, Human
ucuacucuagggaaaaac

SEQ ID NO: 3132010 - RNA, 21 nt, Human
ucuacucgaguuacagacaaa

SEQ ID NO: 3132011 - RNA, 20 nt, Human
ucuacucgaguuacagacaa

SEQ ID NO: 3132012 - RNA, 12 nt, Human
ucuagggaaaaa

SEQ ID NO: 3132013 - RNA, 23 nt, Human
ucgucacugcuuaacuucacaua

SEQ ID NO: 3132014 - RNA, 14 nt, Human
ucgcccagucugga

SEQ ID NO: 3132015 - RNA, 19 nt, Human
ucgcccagucuggaaugca

SEQ ID NO: 3132016 - RNA, 23 nt, Human
ucgcccagucuggaaugcagugg

SEQ ID NO: 3132017 - RNA, 15 nt, Human
ucggaaaacaugcua

SEQ ID NO: 3132018 - RNA, 18 nt, Human
ucggaaaacaugcuacac

SEQ ID NO: 3132019 - RNA, 17 nt, Human
ucgcaggauucuuccuc

SEQ ID NO: 3132020 - RNA, 21 nt, Human
ucgcaggauucuuccucccuc

SEQ ID NO: 3132021 - RNA, 23 nt, Human
ucgcaggauucuuccucccuccc

SEQ ID NO: 3132022 - RNA, 22 nt, Human
uccuuuucgcaggauucuuccu

SEQ ID NO: 3132023 - RNA, 18 nt, Human
uccuuuucgcaggauucu

SEQ ID NO: 3132024 - RNA, 17 nt, Human
uccuuugugaggaagcc

SEQ ID NO: 3132025 - RNA, 22 nt, Human
uccuuugugaggaagccgcugg

SEQ ID NO: 3132026 - RNA, 18 nt, Human
uccuuugugaggaagccg

SEQ ID NO: 3132027 - RNA, 21 nt, Human
uccuuggugucgggcaugaca

SEQ ID NO: 3132028 - RNA, 18 nt, Human
uccuuggugucgggcaug

SEQ ID NO: 3132029 - RNA, 23 nt, Human
uccuugaaaacacuguucucugc

SEQ ID NO: 3132030 - RNA, 22 nt, Human
uccuugaaaacacuguucucug

SEQ ID NO: 3132031 - RNA, 21 nt, Human
uccuuaccagcagagcaccuu

SEQ ID NO: 3132032 - RNA, 20 nt, Human
uccuuaccagcagagcaccu

SEQ ID NO: 3132033 - RNA, 20 nt, Human
uggccagaugcaccagcccu

SEQ ID NO: 3132034 - RNA, 21 nt, Human
uggccagaugcaccagcccuu

SEQ ID NO: 3132035 - RNA, 21 nt, Human
uggcacccggccccugcuggu

SEQ ID NO: 3132036 - RNA, 13 nt, Human
uggcagcugcuuu

SEQ ID NO: 3132037 - RNA, 23 nt, Human
uggcagcugcgguccacccagga

SEQ ID NO: 3132038 - RNA, 17 nt, Human
uggauuuaacagaaaug

SEQ ID NO: 3132039 - RNA, 20 nt, Human
uggauuuaacagaaauguac

SEQ ID NO: 3132040 - RNA, 24 nt, Human
uggauuuaacagaaauguacagca

SEQ ID NO: 3132041 - RNA, 20 nt, Human
uggaggaaggaaacccagcu

SEQ ID NO: 3132042 - RNA, 18 nt, Human
uggaggaaggaaacccag

SEQ ID NO: 3132043 - RNA, 12 nt, Human
uggaggaaggaa

SEQ ID NO: 3132044 - RNA, 14 nt, Human
uggaauaacaugua

SEQ ID NO: 3132045 - RNA, 15 nt, Human
uggaauaacauguaa

SEQ ID NO: 3132046 - RNA, 19 nt, Human
uggaauaacauguaauuaa

SEQ ID NO: 3132047 - RNA, 15 nt, Human
uggaauauauaacca

SEQ ID NO: 3132048 - RNA, 16 nt, Human
uggaauauauaaccag

SEQ ID NO: 3132049 - RNA, 17 nt, Human
uggaauaaggagaauga

SEQ ID NO: 3132050 - RNA, 19 nt, Human
uggacaugcacagcuaaca

SEQ ID NO: 3132051 - RNA, 13 nt, Human
uggacaugcacag

SEQ ID NO: 3132052 - RNA, 20 nt, Human
uggaaaaauagccugccucu

SEQ ID NO: 3132053 - RNA, 17 nt, Human
uggaaaaauagccugcc

SEQ ID NO: 3132054 - RNA, 21 nt, Human
uggaaagacuuuuccaacccu

SEQ ID NO: 3132055 - RNA, 20 nt, Human
uggaaagaguaggaagacuu

SEQ ID NO: 3132056 - RNA, 21 nt, Human
uggcugcuucaaggauccuga

SEQ ID NO: 3132057 - RNA, 16 nt, Human
uggcugcuucaaggau

SEQ ID NO: 3132058 - RNA, 21 nt, Human
uggcugggggccucagugcca

SEQ ID NO: 3132059 - RNA, 22 nt, Human
uggcuuccuaaaauucagugga

SEQ ID NO: 3132060 - RNA, 14 nt, Human
uggcuuuugugcau

SEQ ID NO: 3132061 - RNA, 12 nt, Human
ugggacacccug

SEQ ID NO: 3132062 - RNA, 12 nt, Human
ugggagcugccu

SEQ ID NO: 3132063 - RNA, 13 nt, Human
ugggagcugccug

SEQ ID NO: 3132064 - RNA, 14 nt, Human
ugggagcugccugu

SEQ ID NO: 3132065 - RNA, 13 nt, Human
ugggagcaaaaga

SEQ ID NO: 3132066 - RNA, 15 nt, Human
ugggcagaggaaagc

SEQ ID NO: 3132067 - RNA, 16 nt, Human
ugggauuacaggugug

SEQ ID NO: 3132068 - RNA, 13 nt, Human
ugggauccuggag

SEQ ID NO: 3132069 - RNA, 18 nt, Human
ugggauccuccaggugca

SEQ ID NO: 3132070 - RNA, 17 nt, Human
ugggagcugccuguuca

SEQ ID NO: 3132071 - RNA, 21 nt, Human
ugggagcugccuguucagcuc

SEQ ID NO: 3132072 - RNA, 22 nt, Human
ugggagcugccuguucagcucc

SEQ ID NO: 3132073 - RNA, 15 nt, Human
ugggagugagcuggu

SEQ ID NO: 3132074 - RNA, 15 nt, Human
ugggauccuccaggu

SEQ ID NO: 3132075 - RNA, 14 nt, Human
ugggauccuccagg

SEQ ID NO: 3132076 - RNA, 16 nt, Human
ugggcuaguugggcuu

SEQ ID NO: 3132077 - RNA, 17 nt, Human
ugggcuggugucaccug

SEQ ID NO: 3132078 - RNA, 23 nt, Human
ugggcuggguucuacccaggugc

SEQ ID NO: 3132079 - RNA, 22 nt, Human
ugggcuaagugauccucccacc

SEQ ID NO: 3132080 - RNA, 16 nt, Human
ugggcagaggaaagca

SEQ ID NO: 3132081 - RNA, 17 nt, Human
ugggcuucaguggcagc

SEQ ID NO: 3132082 - RNA, 15 nt, Human
ugggcuucaguggca

SEQ ID NO: 3132083 - RNA, 20 nt, Human
ugggggaucacagccucuga

SEQ ID NO: 3132084 - RNA, 21 nt, Human
ugggggaucacagccucugaa

SEQ ID NO: 3132085 - RNA, 18 nt, Human
ugggggcugggcagagga

SEQ ID NO: 3132086 - RNA, 17 nt, Human
ugggggcugggcagagg

SEQ ID NO: 3132087 - RNA, 12 nt, Human
ugggggugcauu

SEQ ID NO: 3132088 - RNA, 15 nt, Human
ugggggugcauuuga

SEQ ID NO: 3132089 - RNA, 18 nt, Human
uggguuucuaaagcugcc

SEQ ID NO: 3132090 - RNA, 17 nt, Human
uggguuucuaaagcugc

SEQ ID NO: 3132091 - RNA, 21 nt, Human
uggguuucuaaagcugccagc

SEQ ID NO: 3132092 - RNA, 23 nt, Human
ugguauuggcuagagguucaaag

SEQ ID NO: 3132093 - RNA, 14 nt, Human
uggguguggcgcag

SEQ ID NO: 3132094 - RNA, 22 nt, Human
uggguucuacccaggugcuagg

SEQ ID NO: 3132095 - RNA, 16 nt, Human
uggguucuacccaggu

SEQ ID NO: 3132096 - RNA, 15 nt, Human
uggguucuacccagg

SEQ ID NO: 3132097 - RNA, 16 nt, Human
uggguaacuagggaag

SEQ ID NO: 3132098 - RNA, 19 nt, Human
ugggguuuaucagaauucu

SEQ ID NO: 3132099 - RNA, 14 nt, Human
ugcaguugccaguc

SEQ ID NO: 3132100 - RNA, 13 nt, Human
ugcaguugccagu

SEQ ID NO: 3132101 - RNA, 22 nt, Human
ugcagugguaugaucacggcuc

SEQ ID NO: 3132102 - RNA, 15 nt, Human
ugcaggcagccaggc

SEQ ID NO: 3132103 - RNA, 19 nt, Human
ugcaggcagccaggccaca

SEQ ID NO: 3132104 - RNA, 14 nt, Human
ugcaggcagccagg

SEQ ID NO: 3132105 - RNA, 13 nt, Human
ugcaggcagccag

SEQ ID NO: 3132106 - RNA, 16 nt, Human
ugcagugcuuccaagg

SEQ ID NO: 3132107 - RNA, 14 nt, Human
ugcaccgggccaca

SEQ ID NO: 3132108 - RNA, 15 nt, Human
ugcaccgggccacag

SEQ ID NO: 3132109 - RNA, 23 nt, Human
ugcaccggcuggccuggccccuc

SEQ ID NO: 3132110 - RNA, 19 nt, Human
ugaguccccuguuuguuuc

SEQ ID NO: 3132111 - RNA, 17 nt, Human
ugcaccgggccacagag

SEQ ID NO: 3132112 - RNA, 22 nt, Human
ugcaccgggccacagagaaagu

SEQ ID NO: 3132113 - RNA, 14 nt, Human
ugcacuuuguucug

SEQ ID NO: 3132114 - RNA, 12 nt, Human
ugcacuuuguuc

SEQ ID NO: 3132115 - RNA, 20 nt, Human
ugcagcaauaaagcagcguu

SEQ ID NO: 3132116 - RNA, 23 nt, Human
ugcagcaauaaagcagcguuucu

SEQ ID NO: 3132117 - RNA, 19 nt, Human
ugccccucaacucuccucc

SEQ ID NO: 3132118 - RNA, 17 nt, Human
ugccccuggcagccccu

SEQ ID NO: 3132119 - RNA, 23 nt, Human
ugccccucaacucuccuccagag

SEQ ID NO: 3132120 - RNA, 11 nt, Human
ugcccaggcug

SEQ ID NO: 3132121 - RNA, 16 nt, Human
ugcccacucccugcaa

SEQ ID NO: 3132122 - RNA, 15 nt, Human
ugcccacucccugca

SEQ ID NO: 3132123 - RNA, 14 nt, Human
ugcccacucccugc

SEQ ID NO: 3132124 - RNA, 13 nt, Human
ugcccaccuggcc

SEQ ID NO: 3132125 - RNA, 13 nt, Human
ugcccacucccug

SEQ ID NO: 3132126 - RNA, 21 nt, Human
ugccauccagguucagcuugu

SEQ ID NO: 3132127 - RNA, 20 nt, Human
ugccauccagguucagcuug

SEQ ID NO: 3132128 - RNA, 22 nt, Human
ugccacuacggaauaguuggcu

SEQ ID NO: 3132129 - RNA, 19 nt, Human
ugccacccuggggagaaag

SEQ ID NO: 3132130 - RNA, 18 nt, Human
ugccagguuuuuggucug

SEQ ID NO: 3132131 - RNA, 19 nt, Human
ugccagguuuuuggucuga

SEQ ID NO: 3132132 - RNA, 22 nt, Human
ugccagguuuuuggucugaccc

SEQ ID NO: 3132133 - RNA, 14 nt, Human
ugcaucaagaugug

SEQ ID NO: 3132134 - RNA, 15 nt, Human
ugcuaaaugugaaug

SEQ ID NO: 3132135 - RNA, 13 nt, Human
ugcgccuacagga

SEQ ID NO: 3132136 - RNA, 22 nt, Human
ugcgccuacaggagugagcacu

SEQ ID NO: 3132137 - RNA, 14 nt, Human
ugcgccuacaggag

SEQ ID NO: 3132138 - RNA, 16 nt, Human
ugcgccuacaggagug

SEQ ID NO: 3132139 - RNA, 14 nt, Human
ugcgaucuggguuc

SEQ ID NO: 3132140 - RNA, 15 nt, Human
ugcgaucuggguuca

SEQ ID NO: 3132141 - RNA, 19 nt, Human
ugcgaucuggguucacugc

SEQ ID NO: 3132142 - RNA, 20 nt, Human
ugcgaucuggguucacugca

SEQ ID NO: 3132143 - RNA, 21 nt, Human
ugcgaucuggguucacugcaa

SEQ ID NO: 3132144 - RNA, 14 nt, Human
ugccugguggcagc

SEQ ID NO: 3132145 - RNA, 15 nt, Human
ugccugguggcagcu

SEQ ID NO: 3132146 - RNA, 16 nt, Human
ugccugguggcagcug

SEQ ID NO: 3132147 - RNA, 18 nt, Human
ugccugggcagaaggaag

SEQ ID NO: 3132148 - RNA, 21 nt, Human
ugccugggaucccucauccuc

SEQ ID NO: 3132149 - RNA, 18 nt, Human
ugccccuggcagccccug

SEQ ID NO: 3132150 - RNA, 20 nt, Human
ugccucgaacuggcugcaaa

SEQ ID NO: 3132151 - RNA, 18 nt, Human
ugccucgaacuggcugca

SEQ ID NO: 3132152 - RNA, 19 nt, Human
ugccucgaacuggcugcaa

SEQ ID NO: 3132153 - RNA, 13 nt, Human
ugcugauggugca

SEQ ID NO: 3132154 - RNA, 17 nt, Human
ugcugauggugcaauga

SEQ ID NO: 3132155 - RNA, 15 nt, Human
ugcugauggugcaau

SEQ ID NO: 3132156 - RNA, 22 nt, Human
ugcugacagacacaggcccggc

SEQ ID NO: 3132157 - RNA, 23 nt, Human
ugcugacagacacaggcccggcu

SEQ ID NO: 3132158 - RNA, 19 nt, Human
ugcugacagacacaggccc

SEQ ID NO: 3132159 - RNA, 13 nt, Human
ugcugaaggcucg

SEQ ID NO: 3132160 - RNA, 12 nt, Human
ugcugaaggcuc

SEQ ID NO: 3132161 - RNA, 13 nt, Human
ugcugcuggcugg

SEQ ID NO: 3132162 - RNA, 23 nt, Human
ugcugcaguugccagucaccccg

SEQ ID NO: 3132163 - RNA, 18 nt, Human
ugcugcaguugccaguca

SEQ ID NO: 3132164 - RNA, 16 nt, Human
ugcugcaguugccagu

SEQ ID NO: 3132165 - RNA, 18 nt, Human
ugcuccuuucuuguuuua

SEQ ID NO: 3132166 - RNA, 17 nt, Human
ugcuccucuccccagca

SEQ ID NO: 3132167 - RNA, 14 nt, Human
ugcuccucucccca

SEQ ID NO: 3132168 - RNA, 15 nt, Human
ugcucacauaucugu

SEQ ID NO: 3132169 - RNA, 16 nt, Human
ugcucacauaucuguc

SEQ ID NO: 3132170 - RNA, 13 nt, Human
ugucaccugaaga

SEQ ID NO: 3132171 - RNA, 16 nt, Human
ugucauuugagcaggg

SEQ ID NO: 3132172 - RNA, 19 nt, Human
ugucauuugagcagggcuc

SEQ ID NO: 3132173 - RNA, 23 nt, Human
ugucccaaaaagaaaggagggga

SEQ ID NO: 3132174 - RNA, 13 nt, Human
uguccccaccgca

SEQ ID NO: 3132175 - RNA, 22 nt, Human
uguccccaccgcagacaggacc

SEQ ID NO: 3132176 - RNA, 19 nt, Human
uguccccaccgcagacagg

SEQ ID NO: 3132177 - RNA, 18 nt, Human
uguccccaccgcagacag

SEQ ID NO: 3132178 - RNA, 20 nt, Human
uguccuacccacccuccuuu

SEQ ID NO: 3132179 - RNA, 17 nt, Human
uguccccgacccuugcc

SEQ ID NO: 3132180 - RNA, 16 nt, Human
uguccccgacccuugc

SEQ ID NO: 3132181 - RNA, 12 nt, Human
uguccuacucug

SEQ ID NO: 3132182 - RNA, 17 nt, Human
uguccuacucuguguca

SEQ ID NO: 3132183 - RNA, 16 nt, Human
uguccuacccacccuc

SEQ ID NO: 3132184 - RNA, 19 nt, Human
uguauuuuacuaauaaaau

SEQ ID NO: 3132185 - RNA, 13 nt, Human
ugucacacacuuu

SEQ ID NO: 3132186 - RNA, 17 nt, Human
ugucacacacuuuggcu

SEQ ID NO: 3132187 - RNA, 12 nt, Human
ugucacaggcag

SEQ ID NO: 3132188 - RNA, 22 nt, Human
uguauucucuccuguaccucuu

SEQ ID NO: 3132189 - RNA, 20 nt, Human
uguauucucuccuguaccuc

SEQ ID NO: 3132190 - RNA, 13 nt, Human
uguacagagccca

SEQ ID NO: 3132191 - RNA, 17 nt, Human
uguacagagcccacgcc

SEQ ID NO: 3132192 - RNA, 16 nt, Human
uguacagagcccacgc

SEQ ID NO: 3132193 - RNA, 18 nt, Human
uguacagagcccacgccc

SEQ ID NO: 3132194 - RNA, 19 nt, Human
uguacugcauaugaaagga

SEQ ID NO: 3132195 - RNA, 15 nt, Human
uguacgucugacagg

SEQ ID NO: 3132196 - RNA, 14 nt, Human
ugugcacguacaca

SEQ ID NO: 3132197 - RNA, 16 nt, Human
ugugcauuaucuagau

SEQ ID NO: 3132198 - RNA, 19 nt, Human
ugugcauuaucuagauacu

SEQ ID NO: 3132199 - RNA, 14 nt, Human
ugugcauuaucuag

SEQ ID NO: 3132200 - RNA, 23 nt, Human
ugugcauuaucuagauacuguau

SEQ ID NO: 3132201 - RNA, 20 nt, Human
ugugcauuaucuagauacug

SEQ ID NO: 3132202 - RNA, 21 nt, Human
ugugcauuaucuagauacugu

SEQ ID NO: 3132203 - RNA, 19 nt, Human
ugugcgccuacaggaguga

SEQ ID NO: 3132204 - RNA, 14 nt, Human
ugugcgccuacagg

SEQ ID NO: 3132205 - RNA, 16 nt, Human
uguggacacagcucuu

SEQ ID NO: 3132206 - RNA, 19 nt, Human
uguggacacagcucuucuc

SEQ ID NO: 3132207 - RNA, 18 nt, Human
uguggacacagcucuucu

SEQ ID NO: 3132208 - RNA, 23 nt, Human
uguggcgcagcauauucaggaag

SEQ ID NO: 3132209 - RNA, 12 nt, Human
uguguagggcgg

SEQ ID NO: 3132210 - RNA, 21 nt, Human
ugugaaaagaaaaaugagccu

SEQ ID NO: 3132211 - RNA, 23 nt, Human
ugugaaaagaaaaaugagccugg

SEQ ID NO: 3132212 - RNA, 23 nt, Human
ugucuuuucuugcaugaggcuag

SEQ ID NO: 3132213 - RNA, 14 nt, Human
ugucuuuggacccu

SEQ ID NO: 3132214 - RNA, 21 nt, Human
ugucuuuucuugcaugaggcu

SEQ ID NO: 3132215 - RNA, 16 nt, Human
ugucuuuggacccuga

SEQ ID NO: 3132216 - RNA, 19 nt, Human
ugugagucaccaagcccag

SEQ ID NO: 3132217 - RNA, 21 nt, Human
ugugagucaccaagcccaguu

SEQ ID NO: 3132218 - RNA, 15 nt, Human
ugugagucaccaagc

SEQ ID NO: 3132219 - RNA, 17 nt, Human
ugugagucaccaagccc

SEQ ID NO: 3132220 - RNA, 12 nt, Human
ugugaggaagcc

SEQ ID NO: 3132221 - RNA, 20 nt, Human
ugugaggaagccgcuggggc

SEQ ID NO: 3132222 - RNA, 18 nt, Human
ugugaggaagccgcuggg

SEQ ID NO: 3132223 - RNA, 13 nt, Human
ugugaggaagccg

SEQ ID NO: 3132224 - RNA, 15 nt, Human
ugugacauguuuuau

SEQ ID NO: 3132225 - RNA, 14 nt, Human
uguuacuaaguuuu

SEQ ID NO: 3132226 - RNA, 19 nt, Human
uguuaguaugaggcauuug

SEQ ID NO: 3132227 - RNA, 20 nt, Human
uguuaguaugaggcauuugu

SEQ ID NO: 3132228 - RNA, 17 nt, Human
uguuaguaugaggcauu

SEQ ID NO: 3132229 - RNA, 20 nt, Human
uguucagcuccagcucacca

SEQ ID NO: 3132230 - RNA, 21 nt, Human
uguucagcuccagcucaccag

SEQ ID NO: 3132231 - RNA, 18 nt, Human
uguucagcuccagcucac

SEQ ID NO: 3132232 - RNA, 19 nt, Human
ugugugcacguacacacac

SEQ ID NO: 3132233 - RNA, 13 nt, Human
uguguuuauuguc

SEQ ID NO: 3132234 - RNA, 16 nt, Human
uguguuuauugucaaa

SEQ ID NO: 3132235 - RNA, 16 nt, Human
uguucucucuucucca

SEQ ID NO: 3132236 - RNA, 15 nt, Human
uguucucucuucucc

SEQ ID NO: 3132237 - RNA, 19 nt, Human
uguucaucauccuaagcua

SEQ ID NO: 3132238 - RNA, 12 nt, Human
uguucuggcucu

SEQ ID NO: 3132239 - RNA, 16 nt, Human
uguucuggcucuucca

SEQ ID NO: 3132240 - RNA, 13 nt, Human
uguucuggcucuu

SEQ ID NO: 3132241 - RNA, 16 nt, Human
uguucucugcccucca

SEQ ID NO: 3132242 - RNA, 15 nt, Human
uguucucugcccucc

SEQ ID NO: 3132243 - RNA, 14 nt, Human
uguucucugcccuc

SEQ ID NO: 3132244 - RNA, 13 nt, Human
uguucucugcccu

SEQ ID NO: 3132245 - RNA, 21 nt, Human
uguucuggcucuuccaggcug

SEQ ID NO: 3132246 - RNA, 20 nt, Human
uguucuggcucuuccaggcu

SEQ ID NO: 3132247 - RNA, 17 nt, Human
uguucuggcucuuccag

SEQ ID NO: 3132248 - RNA, 23 nt, Human
uguucuuucuggcuaugcauuug

SEQ ID NO: 3132249 - RNA, 15 nt, Human
uguuggccaggcugg

SEQ ID NO: 3132250 - RNA, 16 nt, Human
uguuggccaggcuggu

SEQ ID NO: 3132251 - RNA, 17 nt, Human
uguuggcugggggccuc

SEQ ID NO: 3132252 - RNA, 19 nt, Human
uguuggcugggggccucag

SEQ ID NO: 3132253 - RNA, 14 nt, Human
uuaaaugcccagcc

SEQ ID NO: 3132254 - RNA, 16 nt, Human
uuaaaugcccagcccc

SEQ ID NO: 3132255 - RNA, 15 nt, Human
uuaaaugcccagccc

SEQ ID NO: 3132256 - RNA, 22 nt, Human
uuaaacuuaaucuaaauggaac

SEQ ID NO: 3132257 - RNA, 14 nt, Human
uuaaaacccaagug

SEQ ID NO: 3132258 - RNA, 17 nt, Human
uguuuuaagaggcaggg

SEQ ID NO: 3132259 - RNA, 19 nt, Human
uguuuuaaggaugcuugua

SEQ ID NO: 3132260 - RNA, 22 nt, Human
uguuuuaaggaugcuuguacau

SEQ ID NO: 3132261 - RNA, 23 nt, Human
uguuuuaaggaugcuuguacaua

SEQ ID NO: 3132262 - RNA, 16 nt, Human
uguuuuaagaggcagg

SEQ ID NO: 3132263 - RNA, 12 nt, Human
uuaacuuuuaua

SEQ ID NO: 3132264 - RNA, 13 nt, Human
uuaacuuuuauaa

SEQ ID NO: 3132265 - RNA, 13 nt, Human
uuaaaugcccagc

SEQ ID NO: 3132266 - RNA, 13 nt, Human
uuacacuuuaugc

SEQ ID NO: 3132267 - RNA, 20 nt, Human
uuacacuuuaugcacaaaau

SEQ ID NO: 3132268 - RNA, 12 nt, Human
uuacauuuuuaa

SEQ ID NO: 3132269 - RNA, 17 nt, Human
uuacauuuuuaagugcu

SEQ ID NO: 3132270 - RNA, 22 nt, Human
uuaauuaaaacacaacaucuuu

SEQ ID NO: 3132271 - RNA, 12 nt, Human
uaagaggcaggg

SEQ ID NO: 3132272 - RNA, 15 nt, Human
uaagaggcagggucu

SEQ ID NO: 3132273 - RNA, 16 nt, Human
uaaggauguucuagca

SEQ ID NO: 3132274 - RNA, 20 nt, Human
uaagguggguacgggagggu

SEQ ID NO: 3132275 - RNA, 15 nt, Human
uaaggugugcucuga

SEQ ID NO: 3132276 - RNA, 17 nt, Human
uaaggguaucuggugac

SEQ ID NO: 3132277 - RNA, 14 nt, Human
uaagugcugcauuu

SEQ ID NO: 3132278 - RNA, 23 nt, Human
uaagugaggaugaaaaaauaaca

SEQ ID NO: 3132279 - RNA, 12 nt, Human
uaagugagagag

SEQ ID NO: 3132280 - RNA, 20 nt, Human
uaagugguacuaacuuuccu

SEQ ID NO: 3132281 - RNA, 15 nt, Human
uaagugcugcauuua

SEQ ID NO: 3132282 - RNA, 16 nt, Human
uaagugcugcauuuaa

SEQ ID NO: 3132283 - RNA, 18 nt, Human
uaagugcugcauuuaaaa

SEQ ID NO: 3132284 - RNA, 22 nt, Human
uaagugcugcauuuaaaagaua

SEQ ID NO: 3132285 - RNA, 15 nt, Human
uaauggggcggugag

SEQ ID NO: 3132286 - RNA, 23 nt, Human
uaaugcgugcauaccacuuuugu

SEQ ID NO: 3132287 - RNA, 19 nt, Human
uaaugcgugcauaccacuu

SEQ ID NO: 3132288 - RNA, 22 nt, Human
uaaugcgugcauaccacuuuug

SEQ ID NO: 3132289 - RNA, 15 nt, Human
uaaugcgugcauacc

SEQ ID NO: 3132290 - RNA, 14 nt, Human
uaauuaaguacuau

SEQ ID NO: 3132291 - RNA, 17 nt, Human
uaauuaaguacuaugua

SEQ ID NO: 3132292 - RNA, 20 nt, Human
uaauauuaaggaagacaaug

SEQ ID NO: 3132293 - RNA, 12 nt, Human
uaaucuaaaugg

SEQ ID NO: 3132294 - RNA, 13 nt, Human
uaaucuaaaugga

SEQ ID NO: 3132295 - RNA, 19 nt, Human
uaauaugcacacauuuuuu

SEQ ID NO: 3132296 - RNA, 15 nt, Human
uaauaugcacacauu

SEQ ID NO: 3132297 - RNA, 16 nt, Human
uaauaugcacacauuu

SEQ ID NO: 3132298 - RNA, 17 nt, Human
uaauaugcacacauuuu

SEQ ID NO: 3132299 - RNA, 18 nt, Human
uaauaugcacacauuuuu

SEQ ID NO: 3132300 - RNA, 22 nt, Human
uaaaugucucuuuaaugucaca

SEQ ID NO: 3132301 - RNA, 20 nt, Human
uaaaugucuaguuguaacac

SEQ ID NO: 3132302 - RNA, 18 nt, Human
uaaaugggggugcauuug

SEQ ID NO: 3132303 - RNA, 19 nt, Human
uaaaugggggugcauuuga

SEQ ID NO: 3132304 - RNA, 14 nt, Human
uaaaugggggugca

SEQ ID NO: 3132305 - RNA, 17 nt, Human
uaaaugggggugcauuu

SEQ ID NO: 3132306 - RNA, 16 nt, Human
uaaauggaaccacucu

SEQ ID NO: 3132307 - RNA, 17 nt, Human
uaaaugcccagccccuu

SEQ ID NO: 3132308 - RNA, 16 nt, Human
uaaaugcccagccccu

SEQ ID NO: 3132309 - RNA, 15 nt, Human
uaaaugcccagcccc

SEQ ID NO: 3132310 - RNA, 14 nt, Human
uaaaugcccagccc

SEQ ID NO: 3132311 - RNA, 13 nt, Human
uaaaugcccagcc

SEQ ID NO: 3132312 - RNA, 11 nt, Human
uaaauuauuuu

SEQ ID NO: 3132313 - RNA, 22 nt, Human
uaaauucuugcaaaguaucccu

SEQ ID NO: 3132314 - RNA, 17 nt, Human
uaaauucuugcaaagua

SEQ ID NO: 3132315 - RNA, 18 nt, Human
uaaauucuugcaaaguau

SEQ ID NO: 3132316 - RNA, 16 nt, Human
uaaauucuugcaaagu

SEQ ID NO: 3132317 - RNA, 18 nt, Human
uaacaccaugauuaacca

SEQ ID NO: 3132318 - RNA, 11 nt, Human
uaacagaaaug

SEQ ID NO: 3132319 - RNA, 23 nt, Human
uaaccaguguuguggauuuaaca

SEQ ID NO: 3132320 - RNA, 16 nt, Human
uaaccacuucagcuga

SEQ ID NO: 3132321 - RNA, 19 nt, Human
uaagaaccuuuugagugcc

SEQ ID NO: 3132322 - RNA, 16 nt, Human
uaagaaaaaggaugca

SEQ ID NO: 3132323 - RNA, 18 nt, Human
uaagaaaaaggaugcaca

SEQ ID NO: 3132324 - RNA, 19 nt, Human
uaagaaaaaggaugcacag

SEQ ID NO: 3132325 - RNA, 23 nt, Human
uaagaaaaaggaugcacagaguu

SEQ ID NO: 3132326 - RNA, 20 nt, Human
guuggccccugcccggcugc

SEQ ID NO: 3132327 - RNA, 13 nt, Human
guuggccccugcc

SEQ ID NO: 3132328 - RNA, 14 nt, Human
guuggccccugccc

SEQ ID NO: 3132329 - RNA, 12 nt, Human
guuggcuggggg

SEQ ID NO: 3132330 - RNA, 19 nt, Human
guuggcugggggccucagu

SEQ ID NO: 3132331 - RNA, 12 nt, Human
guugucagcuga

SEQ ID NO: 3132332 - RNA, 14 nt, Human
guugugguuaaucu

SEQ ID NO: 3132333 - RNA, 22 nt, Human
guuguggauuuaacagaaaugu

SEQ ID NO: 3132334 - RNA, 14 nt, Human
guuguuacauuuuu

SEQ ID NO: 3132335 - RNA, 15 nt, Human
guuguuacauuuuua

SEQ ID NO: 3132336 - RNA, 14 nt, Human
guuuagauaauaca

SEQ ID NO: 3132337 - RNA, 20 nt, Human
guuuuccaugaguccccugu

SEQ ID NO: 3132338 - RNA, 19 nt, Human
guuuuccaugaguccccug

SEQ ID NO: 3132339 - RNA, 20 nt, Human
guuuuccagguuuaagcugu

SEQ ID NO: 3132340 - RNA, 20 nt, Human
guuuguuucugaaagggacg

SEQ ID NO: 3132341 - RNA, 11 nt, Human
guuuucacucu

SEQ ID NO: 3132342 - RNA, 12 nt, Human
guuuucacucuu

SEQ ID NO: 3132343 - RNA, 17 nt, Human
guuuucaaaauaaaaau

SEQ ID NO: 3132344 - RNA, 20 nt, Human
guuuguaaauuaacuuuuau

SEQ ID NO: 3132345 - RNA, 18 nt, Human
guuuggggaugagaaagg

SEQ ID NO: 3132346 - RNA, 20 nt, Human
guuugauucagacagcugcc

SEQ ID NO: 3132347 - RNA, 16 nt, Human
guuugauucagacagc

SEQ ID NO: 3132348 - RNA, 18 nt, Human
guuuguuucugaaaggga

SEQ ID NO: 3132349 - RNA, 17 nt, Human
guuugagaucagccugg

SEQ ID NO: 3132350 - RNA, 23 nt, Human
guuugauuaaauucuugcaaagu

SEQ ID NO: 3132351 - RNA, 12 nt, Human
uaaagaaaacug

SEQ ID NO: 3132352 - RNA, 16 nt, Human
uaaagcagcguuucua

SEQ ID NO: 3132353 - RNA, 17 nt, Human
uaaagcagcguuucuau

SEQ ID NO: 3132354 - RNA, 19 nt, Human
uaaagcagcguuucuauga

SEQ ID NO: 3132355 - RNA, 15 nt, Human
uaaaggcuaccuuug

SEQ ID NO: 3132356 - RNA, 17 nt, Human
uaaaggcuaccuuugua

SEQ ID NO: 3132357 - RNA, 22 nt, Human
uaaacuugguuuuuaaaaaacu

SEQ ID NO: 3132358 - RNA, 21 nt, Human
uaaacaagaccacguuucuaa

SEQ ID NO: 3132359 - RNA, 22 nt, Human
uaaacaagaccacguuucuaaa

SEQ ID NO: 3132360 - RNA, 20 nt, Human
uaaacaagaccacguuucua

SEQ ID NO: 3132361 - RNA, 19 nt, Human
uaaacaagaccacguuucu

SEQ ID NO: 3132362 - RNA, 17 nt, Human
uaaaacacaacaucuuu

SEQ ID NO: 3132363 - RNA, 23 nt, Human
uaaaacacaacaucuuuuucuac

SEQ ID NO: 3132364 - RNA, 22 nt, Human
uaaaacacaacaucuuuuucua

SEQ ID NO: 3132365 - RNA, 15 nt, Human
uaaaacaacacucac

SEQ ID NO: 3132366 - RNA, 12 nt, Human
uaaaaggagcca

SEQ ID NO: 3132367 - RNA, 21 nt, Human
uaaaagguaugcaaucaaauc

SEQ ID NO: 3132368 - RNA, 12 nt, Human
uaaaaggugacc

SEQ ID NO: 3132369 - RNA, 21 nt, Human
uaaaagauacaguuacucaga

SEQ ID NO: 3132370 - RNA, 17 nt, Human
uaaaagauacaguuacu

SEQ ID NO: 3132371 - RNA, 20 nt, Human
uaaaagauacaguuacucag

SEQ ID NO: 3132372 - RNA, 14 nt, Human
uaaaagauacaguu

SEQ ID NO: 3132373 - RNA, 13 nt, Human
uacuaacuuuccu

SEQ ID NO: 3132374 - RNA, 14 nt, Human
uacuaaggaaucuu

SEQ ID NO: 3132375 - RNA, 20 nt, Human
uacuaauagacaauuuauua

SEQ ID NO: 3132376 - RNA, 21 nt, Human
uacuaauagacaauuuauuau

SEQ ID NO: 3132377 - RNA, 22 nt, Human
uaccuuuuuuauacauaaacaa

SEQ ID NO: 3132378 - RNA, 17 nt, Human
uaccuuuuuuauacaua

SEQ ID NO: 3132379 - RNA, 13 nt, Human
uaccuuuuuuaua

SEQ ID NO: 3132380 - RNA, 16 nt, Human
uaccuuuuuuauacau

SEQ ID NO: 3132381 - RNA, 21 nt, Human
uacgaaaagaggggaagagac

SEQ ID NO: 3132382 - RNA, 18 nt, Human
uacgaaaagaggggaaga

SEQ ID NO: 3132383 - RNA, 18 nt, Human
uaccucggugccuuccuc

SEQ ID NO: 3132384 - RNA, 13 nt, Human
uaccuuuuuuaga

SEQ ID NO: 3132385 - RNA, 19 nt, Human
uaccuuuuuuagaguugau

SEQ ID NO: 3132386 - RNA, 22 nt, Human
uaccuuuuuuagaguugauacu

SEQ ID NO: 3132387 - RNA, 15 nt, Human
uaccuacauacaauu

SEQ ID NO: 3132388 - RNA, 23 nt, Human
uacauuuuuaagugcugcauuua

SEQ ID NO: 3132389 - RNA, 15 nt, Human
uacccacugcucugg

SEQ ID NO: 3132390 - RNA, 21 nt, Human
uacugucuucaguaagccgug

SEQ ID NO: 3132391 - RNA, 16 nt, Human
uacuguccuacccacc

SEQ ID NO: 3132392 - RNA, 13 nt, Human
uacuuguggacac

SEQ ID NO: 3132393 - RNA, 17 nt, Human
uacugcauaugaaagga

SEQ ID NO: 3132394 - RNA, 13 nt, Human
uacuacaguuugu

SEQ ID NO: 3132395 - RNA, 14 nt, Human
uacuacaguuuguu

SEQ ID NO: 3132396 - RNA, 20 nt, Human
uacuacaguccucccaucuc

SEQ ID NO: 3132397 - RNA, 22 nt, Human
uacuacaguccucccaucucac

SEQ ID NO: 3132398 - RNA, 18 nt, Human
uacucgaguuacagacaa

SEQ ID NO: 3132399 - RNA, 22 nt, Human
uacucgaguuacagacaaagcg

SEQ ID NO: 3132400 - RNA, 14 nt, Human
uacaaaguagaagu

SEQ ID NO: 3132401 - RNA, 18 nt, Human
uacaaaguagaagucuua

SEQ ID NO: 3132402 - RNA, 11 nt, Human
uacacacacac

SEQ ID NO: 3132403 - RNA, 23 nt, Human
uacacaaugguuuucuugugugu

SEQ ID NO: 3132404 - RNA, 21 nt, Human
uacacugugcugagucugaag

SEQ ID NO: 3132405 - RNA, 15 nt, Human
uacacacugcauguu

SEQ ID NO: 3132406 - RNA, 14 nt, Human
uacauuuuuaagug

SEQ ID NO: 3132407 - RNA, 19 nt, Human
uacauuuuuaagugcugca

SEQ ID NO: 3132408 - RNA, 22 nt, Human
uacauuuuuaagugcugcauuu

SEQ ID NO: 3132409 - RNA, 14 nt, Human
uacauggaauaaca

SEQ ID NO: 3132410 - RNA, 18 nt, Human
uacauggaauaacaugua

SEQ ID NO: 3132411 - RNA, 19 nt, Human
uacauggaauaacauguaa

SEQ ID NO: 3132412 - RNA, 22 nt, Human
uacauggaauaacauguaauua

SEQ ID NO: 3132413 - RNA, 16 nt, Human
uacaugaaaacacauu

SEQ ID NO: 3132414 - RNA, 16 nt, Human
uacauaagauaaaugu

SEQ ID NO: 3132415 - RNA, 17 nt, Human
uacauaagauaaaugug

SEQ ID NO: 3132416 - RNA, 17 nt, Human
uacaugaaaacacauuu

SEQ ID NO: 3132417 - RNA, 18 nt, Human
uacaugaaaacacauuuu

SEQ ID NO: 3132418 - RNA, 19 nt, Human
uacaugaaaacacauuuuu

SEQ ID NO: 3132419 - RNA, 23 nt, Human
uacaugaaaacacauuuuucuua

SEQ ID NO: 3132420 - RNA, 16 nt, Human
uacauaaacaaguccu

SEQ ID NO: 3132421 - RNA, 19 nt, Human
uacaguuuguuaguaugag

SEQ ID NO: 3132422 - RNA, 21 nt, Human
uacaguuuguuaguaugaggc

SEQ ID NO: 3132423 - RNA, 20 nt, Human
uacacuguuucaaacuuuac

SEQ ID NO: 3132424 - RNA, 23 nt, Human
uacacugugcugagucugaaggc

SEQ ID NO: 3132425 - RNA, 22 nt, Human
uacacugugcugagucugaagg

SEQ ID NO: 3132426 - RNA, 22 nt, Human
uacacuguuucaaacuuuacua

SEQ ID NO: 3132427 - RNA, 16 nt, Human
uacacuuacacuuuau

SEQ ID NO: 3132428 - RNA, 19 nt, Human
uacacuguuucaaacuuua

SEQ ID NO: 3132429 - RNA, 20 nt, Human
uacagcuugaccgugaggcc

SEQ ID NO: 3132430 - RNA, 13 nt, Human
uacaggaaguacu

SEQ ID NO: 3132431 - RNA, 18 nt, Human
uacaggaagguagaaaua

SEQ ID NO: 3132432 - RNA, 18 nt, Human
uacaguuuguuaguauga

SEQ ID NO: 3132433 - RNA, 20 nt, Human
uacaguugaaaaacagcuga

SEQ ID NO: 3132434 - RNA, 19 nt, Human
uacaguugaaaaacagcug

SEQ ID NO: 3132435 - RNA, 17 nt, Human
uacaguugaaaaacagc

SEQ ID NO: 3132436 - RNA, 15 nt, Human
uacaggagugagcac

SEQ ID NO: 3132437 - RNA, 22 nt, Human
uacaggaaguacuggagaaaau

SEQ ID NO: 3132438 - RNA, 15 nt, Human
uacaggaaguacugg

SEQ ID NO: 3132439 - RNA, 14 nt, Human
uacaggaaguacug

SEQ ID NO: 3132440 - RNA, 17 nt, Human
uaucaugacaaagacug

SEQ ID NO: 3132441 - RNA, 17 nt, Human
uaucaggugcugccauc

SEQ ID NO: 3132442 - RNA, 20 nt, Human
uaucaggugcugccauccag

SEQ ID NO: 3132443 - RNA, 19 nt, Human
uaucaggugcugccaucca

SEQ ID NO: 3132444 - RNA, 22 nt, Human
uaguuguuugauucagacagcu

SEQ ID NO: 3132445 - RNA, 21 nt, Human
uaguuguuugauucagacagc

SEQ ID NO: 3132446 - RNA, 20 nt, Human
uaguuguuugauucagacag

SEQ ID NO: 3132447 - RNA, 20 nt, Human
uaguggcuuaaaacaacacu

SEQ ID NO: 3132448 - RNA, 16 nt, Human
uaguaugguggcuggg

SEQ ID NO: 3132449 - RNA, 15 nt, Human
uaguaugaggcauuu

SEQ ID NO: 3132450 - RNA, 17 nt, Human
uauaaacuuuaccuuuu

SEQ ID NO: 3132451 - RNA, 15 nt, Human
uauaaacuuuaccuu

SEQ ID NO: 3132452 - RNA, 16 nt, Human
uauaaacuuuaccuuu

SEQ ID NO: 3132453 - RNA, 11 nt, Human
uauaaacuuua

SEQ ID NO: 3132454 - RNA, 13 nt, Human
uauaaacuuuacc

SEQ ID NO: 3132455 - RNA, 14 nt, Human
uauaaacuuuaccu

SEQ ID NO: 3132456 - RNA, 15 nt, Human
uaguuugauuaaauu

SEQ ID NO: 3132457 - RNA, 16 nt, Human
uaguuugauuaaauuc

SEQ ID NO: 3132458 - RNA, 11 nt, Human
uaggugacaga

SEQ ID NO: 3132459 - RNA, 16 nt, Human
uaggugacagagugag

SEQ ID NO: 3132460 - RNA, 17 nt, Human
uaguaugaggcauuugu

SEQ ID NO: 3132461 - RNA, 18 nt, Human
uaguaugaggcauuuguu

SEQ ID NO: 3132462 - RNA, 19 nt, Human
uaggugugacugaauuucu

SEQ ID NO: 3132463 - RNA, 21 nt, Human
uaggugugacugaauuucuuu

SEQ ID NO: 3132464 - RNA, 23 nt, Human
uaggugugacugaauuucuuuug

SEQ ID NO: 3132465 - RNA, 17 nt, Human
uaggugugggggaagca

SEQ ID NO: 3132466 - RNA, 13 nt, Human
uagguguggggga

SEQ ID NO: 3132467 - RNA, 20 nt, Human
uagaagucuuagauguauau

SEQ ID NO: 3132468 - RNA, 14 nt, Human
uagagguucaaaga

SEQ ID NO: 3132469 - RNA, 15 nt, Human
uagagguucaaagau

SEQ ID NO: 3132470 - RNA, 12 nt, Human
uagagugggagc

SEQ ID NO: 3132471 - RNA, 14 nt, Human
uagaguugauacua

SEQ ID NO: 3132472 - RNA, 17 nt, Human
uagaguugauacuacag

SEQ ID NO: 3132473 - RNA, 11 nt, Human
uagcagggaaa

SEQ ID NO: 3132474 - RNA, 16 nt, Human
uagcauacguacacau

SEQ ID NO: 3132475 - RNA, 17 nt, Human
uagcauacguacacauu

SEQ ID NO: 3132476 - RNA, 18 nt, Human
uagcauacguacacauuu

SEQ ID NO: 3132477 - RNA, 19 nt, Human
uagcauacguacacauuuu

SEQ ID NO: 3132478 - RNA, 16 nt, Human
uagauacuguaucaug

SEQ ID NO: 3132479 - RNA, 12 nt, Human
uagcugggacua

SEQ ID NO: 3132480 - RNA, 15 nt, Human
uagcugggacuacag

SEQ ID NO: 3132481 - RNA, 17 nt, Human
uagcugggacuacaggc

SEQ ID NO: 3132482 - RNA, 18 nt, Human
uagccugugccucuggga

SEQ ID NO: 3132483 - RNA, 20 nt, Human
uagcucaggugucccugcac

SEQ ID NO: 3132484 - RNA, 21 nt, Human
uagcucaggugucccugcacu

SEQ ID NO: 3132485 - RNA, 12 nt, Human
uagcucauucuc

SEQ ID NO: 3132486 - RNA, 15 nt, Human
gugggcuaguugggc

SEQ ID NO: 3132487 - RNA, 17 nt, Human
gugggcccaaugcacuu

SEQ ID NO: 3132488 - RNA, 23 nt, Human
guggguuucuaaagcugccagcc

SEQ ID NO: 3132489 - RNA, 17 nt, Human
guggggcagcuugaggg

SEQ ID NO: 3132490 - RNA, 13 nt, Human
guggggcagcuug

SEQ ID NO: 3132491 - RNA, 18 nt, Human
guggggaccucaggccug

SEQ ID NO: 3132492 - RNA, 15 nt, Human
guggggaccucaggc

SEQ ID NO: 3132493 - RNA, 14 nt, Human
guggcugcuucaag

SEQ ID NO: 3132494 - RNA, 12 nt, Human
guggcugcuuca

SEQ ID NO: 3132495 - RNA, 14 nt, Human
guggcucacgccug

SEQ ID NO: 3132496 - RNA, 22 nt, Human
guggcuuaaaacaacacucaca

SEQ ID NO: 3132497 - RNA, 22 nt, Human
guggcugcuucaaggauccuga

SEQ ID NO: 3132498 - RNA, 19 nt, Human
guggcugcuucaaggaucc

SEQ ID NO: 3132499 - RNA, 16 nt, Human
guggcugcuucaagga

SEQ ID NO: 3132500 - RNA, 15 nt, Human
guggcugcuucaagg

SEQ ID NO: 3132501 - RNA, 19 nt, Human
guggcuggguuggagggug

SEQ ID NO: 3132502 - RNA, 23 nt, Human
guggcugcuucaaggauccugag

SEQ ID NO: 3132503 - RNA, 13 nt, Human
gugucccugcacu

SEQ ID NO: 3132504 - RNA, 16 nt, Human
gugucccugcacuugc

SEQ ID NO: 3132505 - RNA, 18 nt, Human
gugucccugcacuugcag

SEQ ID NO: 3132506 - RNA, 17 nt, Human
guguacauggaauaaca

SEQ ID NO: 3132507 - RNA, 22 nt, Human
guguacauggaauaacauguaa

SEQ ID NO: 3132508 - RNA, 21 nt, Human
guguaaguauucuuauuuaau

SEQ ID NO: 3132509 - RNA, 19 nt, Human
guggugcgaucuggguuca

SEQ ID NO: 3132510 - RNA, 14 nt, Human
guggugaccucugc

SEQ ID NO: 3132511 - RNA, 17 nt, Human
guggugaccucugccug

SEQ ID NO: 3132512 - RNA, 21 nt, Human
guggugagaggcauccaguau

SEQ ID NO: 3132513 - RNA, 17 nt, Human
gugguagagugugccug

SEQ ID NO: 3132514 - RNA, 19 nt, Human
gugguaugaucacggcuca

SEQ ID NO: 3132515 - RNA, 16 nt, Human
guggucccaccccaca

SEQ ID NO: 3132516 - RNA, 15 nt, Human
guggucccaccccac

SEQ ID NO: 3132517 - RNA, 14 nt, Human
guggucccacccca

SEQ ID NO: 3132518 - RNA, 18 nt, Human
gugguccuaaucuucuga

SEQ ID NO: 3132519 - RNA, 17 nt, Human
guggucccaccccacac

SEQ ID NO: 3132520 - RNA, 20 nt, Human
gugugagucaccaagcccag

SEQ ID NO: 3132521 - RNA, 21 nt, Human
gugucucuugguccugcugca

SEQ ID NO: 3132522 - RNA, 20 nt, Human
gugucucuugguccugcugc

SEQ ID NO: 3132523 - RNA, 19 nt, Human
gugucucuugguccugcug

SEQ ID NO: 3132524 - RNA, 18 nt, Human
gugucucuugguccugcu

SEQ ID NO: 3132525 - RNA, 22 nt, Human
gugucucuugguccugcugcag

SEQ ID NO: 3132526 - RNA, 17 nt, Human
gugucucccuucauccu

SEQ ID NO: 3132527 - RNA, 14 nt, Human
gugucucuuggucc

SEQ ID NO: 3132528 - RNA, 23 nt, Human
gugucccugcacuugcagacucu

SEQ ID NO: 3132529 - RNA, 14 nt, Human
guguccggucccug

SEQ ID NO: 3132530 - RNA, 15 nt, Human
gugucgggcaugaca

SEQ ID NO: 3132531 - RNA, 21 nt, Human
guguggagaagcggcuggcag

SEQ ID NO: 3132532 - RNA, 13 nt, Human
guguggagaagcg

SEQ ID NO: 3132533 - RNA, 15 nt, Human
gugugcucugaucau

SEQ ID NO: 3132534 - RNA, 22 nt, Human
gugugcucugaucauccacugu

SEQ ID NO: 3132535 - RNA, 12 nt, Human
gugugcucugau

SEQ ID NO: 3132536 - RNA, 15 nt, Human
guuacacuaaaaggu

SEQ ID NO: 3132537 - RNA, 16 nt, Human
guuacacuaaaaggug

SEQ ID NO: 3132538 - RNA, 13 nt, Human
guuacagacaaag

SEQ ID NO: 3132539 - RNA, 22 nt, Human
guuaaaauaccagccaguaaau

SEQ ID NO: 3132540 - RNA, 18 nt, Human
guguuaugacuccagaau

SEQ ID NO: 3132541 - RNA, 14 nt, Human
guguuacuaaguuu

SEQ ID NO: 3132542 - RNA, 12 nt, Human
guguuacuaagu

SEQ ID NO: 3132543 - RNA, 12 nt, Human
guucuggcucuu

SEQ ID NO: 3132544 - RNA, 20 nt, Human
guucuggcucuuccaggcug

SEQ ID NO: 3132545 - RNA, 16 nt, Human
guucuggcucuuccag

SEQ ID NO: 3132546 - RNA, 23 nt, Human
guucuggcagaguugaagacaga

SEQ ID NO: 3132547 - RNA, 11 nt, Human
guucugggaca

SEQ ID NO: 3132548 - RNA, 12 nt, Human
guucugggacac

SEQ ID NO: 3132549 - RNA, 14 nt, Human
guucugggacacag

SEQ ID NO: 3132550 - RNA, 15 nt, Human
guucugggacacagu

SEQ ID NO: 3132551 - RNA, 16 nt, Human
guucugggacacaguu

SEQ ID NO: 3132552 - RNA, 18 nt, Human
guucuuucacccuuuucu

SEQ ID NO: 3132553 - RNA, 13 nt, Human
guucuuuccaaag

SEQ ID NO: 3132554 - RNA, 14 nt, Human
guucuuuccaaagu

SEQ ID NO: 3132555 - RNA, 18 nt, Human
guucuuuccaaaguacac

SEQ ID NO: 3132556 - RNA, 20 nt, Human
guucuuuccaaaguacacug

SEQ ID NO: 3132557 - RNA, 17 nt, Human
guugaaaaacagcugag

SEQ ID NO: 3132558 - RNA, 19 nt, Human
guucugauccuaguuccac

SEQ ID NO: 3132559 - RNA, 14 nt, Human
guugccagucaccc

SEQ ID NO: 3132560 - RNA, 13 nt, Human
guugccagucacc

SEQ ID NO: 3132561 - RNA, 23 nt, Human
guugccagucaccccggccaccu

SEQ ID NO: 3132562 - RNA, 18 nt, Human
guugccagucaccccggc

SEQ ID NO: 3132563 - RNA, 17 nt, Human
guugccagucaccccgg

SEQ ID NO: 3132564 - RNA, 16 nt, Human
guugccagucaccccg

SEQ ID NO: 3132565 - RNA, 12 nt, Human
guugcccaggca

SEQ ID NO: 3132566 - RNA, 14 nt, Human
guugcccaggcagg

SEQ ID NO: 3132567 - RNA, 17 nt, Human
guuggccaggcuggucu

SEQ ID NO: 3132568 - RNA, 19 nt, Human
guuggccaggcuggucuca

SEQ ID NO: 3132569 - RNA, 14 nt, Human
guuggccaguguga

SEQ ID NO: 3132570 - RNA, 15 nt, Human
guuggccaggcuggu

SEQ ID NO: 3132571 - RNA, 14 nt, Human
guuggccaggcugg

SEQ ID NO: 3132572 - RNA, 13 nt, Human
guuggccaggcug

SEQ ID NO: 3132573 - RNA, 18 nt, Human
guuggcaaaaaggcagga

SEQ ID NO: 3132574 - RNA, 14 nt, Human
guuggcaaaaaggc

SEQ ID NO: 3132575 - RNA, 23 nt, Human
guuggccaaagccaaagcuaggc

SEQ ID NO: 3132576 - RNA, 16 nt, Human
guugaagacagagcua

SEQ ID NO: 3132577 - RNA, 15 nt, Human
guugcaggaccucag

SEQ ID NO: 3132578 - RNA, 18 nt, Human
guucaucuugaauuguaa

SEQ ID NO: 3132579 - RNA, 13 nt, Human
guucaucuugaau

SEQ ID NO: 3132580 - RNA, 12 nt, Human
guucaucuugaa

SEQ ID NO: 3132581 - RNA, 17 nt, Human
guucaucauccuaagcu

SEQ ID NO: 3132582 - RNA, 19 nt, Human
guucacugcaaccuccgcc

SEQ ID NO: 3132583 - RNA, 22 nt, Human
guuccucauuagcauuuugcua

SEQ ID NO: 3132584 - RNA, 14 nt, Human
guuccuaauccucu

SEQ ID NO: 3132585 - RNA, 20 nt, Human
guuccaccaucaagccacca

SEQ ID NO: 3132586 - RNA, 17 nt, Human
guuccaccaucaagcca

SEQ ID NO: 3132587 - RNA, 22 nt, Human
guuaguuucuccaagcaggaca

SEQ ID NO: 3132588 - RNA, 19 nt, Human
guuaguuucuccaagcagg

SEQ ID NO: 3132589 - RNA, 16 nt, Human
guuaguuucuccaagc

SEQ ID NO: 3132590 - RNA, 15 nt, Human
guuacucagaauucu

SEQ ID NO: 3132591 - RNA, 22 nt, Human
guuacuaaguuuuuauggcuuu

SEQ ID NO: 3132592 - RNA, 17 nt, Human
guuacagacaaagcgug

SEQ ID NO: 3132593 - RNA, 15 nt, Human
guuacagacaaagcg

SEQ ID NO: 3132594 - RNA, 18 nt, Human
guuacauaagauaaaugu

SEQ ID NO: 3132595 - RNA, 19 nt, Human
guuacauaagauaaaugug

SEQ ID NO: 3132596 - RNA, 21 nt, Human
guuacauuuuuaagugcugca

SEQ ID NO: 3132597 - RNA, 23 nt, Human
guuaccauuuugggguacccacu

SEQ ID NO: 3132598 - RNA, 21 nt, Human
guuaugacuccagaauuuccc

SEQ ID NO: 3132599 - RNA, 19 nt, Human
guucaagcgauucuucugc

SEQ ID NO: 3132600 - RNA, 19 nt, Human
guuauuaaaaaucucaaau

SEQ ID NO: 3132601 - RNA, 16 nt, Human
guucaauucucauuug

SEQ ID NO: 3132602 - RNA, 23 nt, Human
guucaauucucauuugucacaca

SEQ ID NO: 3132603 - RNA, 20 nt, Human
guucaagcgauucuucugcu

SEQ ID NO: 3132604 - RNA, 18 nt, Human
gucugugccauuuuguau

SEQ ID NO: 3132605 - RNA, 14 nt, Human
gucuguucuuucca

SEQ ID NO: 3132606 - RNA, 17 nt, Human
gucuguucuuuccaaag

SEQ ID NO: 3132607 - RNA, 21 nt, Human
gucuuaaaaaguggaaaaaua

SEQ ID NO: 3132608 - RNA, 16 nt, Human
gucuugaacuccuggc

SEQ ID NO: 3132609 - RNA, 17 nt, Human
gucuugaacuccuggcc

SEQ ID NO: 3132610 - RNA, 21 nt, Human
gucuugaacuccuggccucaa

SEQ ID NO: 3132611 - RNA, 18 nt, Human
gucuugaacuccuggccu

SEQ ID NO: 3132612 - RNA, 20 nt, Human
gucuugaacuccuggccuca

SEQ ID NO: 3132613 - RNA, 16 nt, Human
gucuugcaauggcagc

SEQ ID NO: 3132614 - RNA, 17 nt, Human
gucuugcaauggcagcc

SEQ ID NO: 3132615 - RNA, 18 nt, Human
gucuugcaauggcagccu

SEQ ID NO: 3132616 - RNA, 19 nt, Human
gucuugcaauggcagccuu

SEQ ID NO: 3132617 - RNA, 23 nt, Human
gucuugcaauggcagccuuggca

SEQ ID NO: 3132618 - RNA, 20 nt, Human
gucuugcaauggcagccuug

SEQ ID NO: 3132619 - RNA, 21 nt, Human
gucuugcaauggcagccuugg

SEQ ID NO: 3132620 - RNA, 16 nt, Human
gucuuuuuucacuaca

SEQ ID NO: 3132621 - RNA, 21 nt, Human
gucggaaaacaugcuacacac

SEQ ID NO: 3132622 - RNA, 16 nt, Human
gucgggcaugacacga

SEQ ID NO: 3132623 - RNA, 19 nt, Human
guccuuaccagcagagcac

SEQ ID NO: 3132624 - RNA, 18 nt, Human
guccuuaccagcagagca

SEQ ID NO: 3132625 - RNA, 21 nt, Human
guccuuaccagcagagcaccu

SEQ ID NO: 3132626 - RNA, 14 nt, Human
gucccugccaaugg

SEQ ID NO: 3132627 - RNA, 11 nt, Human
gucccugccaa

SEQ ID NO: 3132628 - RNA, 15 nt, Human
gucccugccaaugga

SEQ ID NO: 3132629 - RNA, 18 nt, Human
gucucacuauguugccca

SEQ ID NO: 3132630 - RNA, 11 nt, Human
gucucacucug

SEQ ID NO: 3132631 - RNA, 19 nt, Human
gucucacuauguugcccag

SEQ ID NO: 3132632 - RNA, 15 nt, Human
gucucacucugucgc

SEQ ID NO: 3132633 - RNA, 16 nt, Human
gucucacucugucgcc

SEQ ID NO: 3132634 - RNA, 18 nt, Human
gucucacucugucgccca

SEQ ID NO: 3132635 - RNA, 19 nt, Human
gucucacucugucgcccag

SEQ ID NO: 3132636 - RNA, 22 nt, Human
gucucacucugucgcccagucu

SEQ ID NO: 3132637 - RNA, 21 nt, Human
gugcauaccacuuuuguucuu

SEQ ID NO: 3132638 - RNA, 22 nt, Human
gugcauaccacuuuuguucuug

SEQ ID NO: 3132639 - RNA, 20 nt, Human
gugcaguggugcgaucuggg

SEQ ID NO: 3132640 - RNA, 23 nt, Human
gugcaguggugcgaucuggguuc

SEQ ID NO: 3132641 - RNA, 23 nt, Human
gugauccacccaccucagccucc

SEQ ID NO: 3132642 - RNA, 24 nt, Human
gugauccacccaccucagccuccc

SEQ ID NO: 3132643 - RNA, 13 nt, Human
gugauuuuuguaa

SEQ ID NO: 3132644 - RNA, 18 nt, Human
gugauuuuuguaauuuuu

SEQ ID NO: 3132645 - RNA, 14 nt, Human
gugcggccuuuggc

SEQ ID NO: 3132646 - RNA, 14 nt, Human
gugcgccuacagga

SEQ ID NO: 3132647 - RNA, 14 nt, Human
gugccaugugccag

SEQ ID NO: 3132648 - RNA, 16 nt, Human
gugccaugugccaggu

SEQ ID NO: 3132649 - RNA, 21 nt, Human
gugcgaucuggguucacugca

SEQ ID NO: 3132650 - RNA, 17 nt, Human
gugauacaaugcugugc

SEQ ID NO: 3132651 - RNA, 15 nt, Human
gugauacaaugcugu

SEQ ID NO: 3132652 - RNA, 17 nt, Human
gugaguugauagcacag

SEQ ID NO: 3132653 - RNA, 22 nt, Human
gugauccacccaccucagccuc

SEQ ID NO: 3132654 - RNA, 19 nt, Human
gugagccgagaucacgcca

SEQ ID NO: 3132655 - RNA, 17 nt, Human
gugaggaugaaaaaaua

SEQ ID NO: 3132656 - RNA, 14 nt, Human
gugagccacugcac

SEQ ID NO: 3132657 - RNA, 15 nt, Human
gugagccacugcacc

SEQ ID NO: 3132658 - RNA, 20 nt, Human
gugagccacugcaccgggcc

SEQ ID NO: 3132659 - RNA, 12 nt, Human
gugacagaggca

SEQ ID NO: 3132660 - RNA, 13 nt, Human
gugacagaggcag

SEQ ID NO: 3132661 - RNA, 14 nt, Human
gugacagaggcagc

SEQ ID NO: 3132662 - RNA, 12 nt, Human
gugaccucugcc

SEQ ID NO: 3132663 - RNA, 15 nt, Human
gugacagaggcagcc

SEQ ID NO: 3132664 - RNA, 13 nt, Human
gugaccucugccu

SEQ ID NO: 3132665 - RNA, 14 nt, Human
gugaccucugccug

SEQ ID NO: 3132666 - RNA, 20 nt, Human
gugacaaggauugcuacugu

SEQ ID NO: 3132667 - RNA, 21 nt, Human
gugaaugaugauccuaggcau

SEQ ID NO: 3132668 - RNA, 19 nt, Human
guauuuuguuuuugucuua

SEQ ID NO: 3132669 - RNA, 15 nt, Human
gucaagugaaaaagg

SEQ ID NO: 3132670 - RNA, 15 nt, Human
gucaccccggccacc

SEQ ID NO: 3132671 - RNA, 14 nt, Human
guauuuuacuaaua

SEQ ID NO: 3132672 - RNA, 22 nt, Human
gucaccccggccaccugcggug

SEQ ID NO: 3132673 - RNA, 18 nt, Human
gucaccccggccaccugc

SEQ ID NO: 3132674 - RNA, 17 nt, Human
gucaccccggccaccug

SEQ ID NO: 3132675 - RNA, 19 nt, Human
gucacucuggcagcucaga

SEQ ID NO: 3132676 - RNA, 17 nt, Human
gucacucuggcagcuca

SEQ ID NO: 3132677 - RNA, 16 nt, Human
gucacucuggcagcuc

SEQ ID NO: 3132678 - RNA, 14 nt, Human
gucacucuggcagc

SEQ ID NO: 3132679 - RNA, 13 nt, Human
gucacucuggcag

SEQ ID NO: 3132680 - RNA, 12 nt, Human
gucacucuggca

SEQ ID NO: 3132681 - RNA, 14 nt, Human
gucagagccugcag

SEQ ID NO: 3132682 - RNA, 15 nt, Human
gucagagccugcagu

SEQ ID NO: 3132683 - RNA, 16 nt, Human
gucagagccugcaguu

SEQ ID NO: 3132684 - RNA, 23 nt, Human
guccacccaggagccccgaggcc

SEQ ID NO: 3132685 - RNA, 12 nt, Human
guccacccagga

SEQ ID NO: 3132686 - RNA, 21 nt, Human
gucccaccuuggcugcaggga

SEQ ID NO: 3132687 - RNA, 19 nt, Human
gucccugcacuugcagacu

SEQ ID NO: 3132688 - RNA, 21 nt, Human
gucccugcacuugcagacucu

SEQ ID NO: 3132689 - RNA, 16 nt, Human
gucccugcacuugcag

SEQ ID NO: 3132690 - RNA, 20 nt, Human
gucccaccuuggcugcaggg

SEQ ID NO: 3132691 - RNA, 23 nt, Human
gucccaccuuggcugcagggagu

SEQ ID NO: 3132692 - RNA, 16 nt, Human
guaggguuauaauaau

SEQ ID NO: 3132693 - RNA, 14 nt, Human
guagucaggugccu

SEQ ID NO: 3132694 - RNA, 16 nt, Human
guagggcgggaggaug

SEQ ID NO: 3132695 - RNA, 23 nt, Human
guagggcgggaggauguucuggg

SEQ ID NO: 3132696 - RNA, 21 nt, Human
guagggcgggaggauguucug

SEQ ID NO: 3132697 - RNA, 22 nt, Human
guagggcgggaggauguucugg

SEQ ID NO: 3132698 - RNA, 15 nt, Human
guagagugugccuga

SEQ ID NO: 3132699 - RNA, 22 nt, Human
guauaugucaagccauaauugu

SEQ ID NO: 3132700 - RNA, 20 nt, Human
guaugaucacggcucacugc

SEQ ID NO: 3132701 - RNA, 17 nt, Human
guaugaggcauuuguuu

SEQ ID NO: 3132702 - RNA, 20 nt, Human
guaugaggcauuuguuugaa

SEQ ID NO: 3132703 - RNA, 21 nt, Human
guaugaucacggcucacugca

SEQ ID NO: 3132704 - RNA, 19 nt, Human
guaucuggugacuuuccuc

SEQ ID NO: 3132705 - RNA, 12 nt, Human
guaucuggugac

SEQ ID NO: 3132706 - RNA, 12 nt, Human
guaucugagcag

SEQ ID NO: 3132707 - RNA, 13 nt, Human
guaugaggcauuu

SEQ ID NO: 3132708 - RNA, 15 nt, Human
guaugaggcauuugu

SEQ ID NO: 3132709 - RNA, 19 nt, Human
uuuuuccuucagugccuua

SEQ ID NO: 3132710 - RNA, 23 nt, Human
uuuuuaagaaaaaggaugcacag

SEQ ID NO: 3132711 - RNA, 11 nt, Human
uuuuuccuuca

SEQ ID NO: 3132712 - RNA, 16 nt, Human
uuuugucauauaagau

SEQ ID NO: 3132713 - RNA, 19 nt, Human
uuuuguagagccagggucu

SEQ ID NO: 3132714 - RNA, 15 nt, Human
uuuuggucuguguga

SEQ ID NO: 3132715 - RNA, 14 nt, Human
uuuuggcugcugaa

SEQ ID NO: 3132716 - RNA, 20 nt, Human
uuuugacaaggggcaguggu

SEQ ID NO: 3132717 - RNA, 11 nt, Human
uuuuaaaugca

SEQ ID NO: 3132718 - RNA, 12 nt, Human
uuuuaaaugcac

SEQ ID NO: 3132719 - RNA, 21 nt, Human
uuuuaaaugcaccuggaauau

SEQ ID NO: 3132720 - RNA, 21 nt, Human
uuuguucuggcucuuccaggc

SEQ ID NO: 3132721 - RNA, 17 nt, Human
uuuuaaagaaugcucuu

SEQ ID NO: 3132722 - RNA, 21 nt, Human
uuuggaauuuugugcccccau

SEQ ID NO: 3132723 - RNA, 17 nt, Human
uuuggucuacacugugc

SEQ ID NO: 3132724 - RNA, 14 nt, Human
uuuggaauuuugug

SEQ ID NO: 3132725 - RNA, 15 nt, Human
uuugcuuugugauuu

SEQ ID NO: 3132726 - RNA, 16 nt, Human
uuugcuuugugauuuu

SEQ ID NO: 3132727 - RNA, 18 nt, Human
uuucuuagggaaggauac

SEQ ID NO: 3132728 - RNA, 23 nt, Human
uuucuuagggaaggauacaaaag

SEQ ID NO: 3132729 - RNA, 13 nt, Human
uuucuucucccuc

SEQ ID NO: 3132730 - RNA, 12 nt, Human
uuucuucucccu

SEQ ID NO: 3132731 - RNA, 17 nt, Human
uuugaacugauaaagau

SEQ ID NO: 3132732 - RNA, 19 nt, Human
uuugaacugauaaagauga

SEQ ID NO: 3132733 - RNA, 15 nt, Human
uuugaacugauaaag

SEQ ID NO: 3132734 - RNA, 14 nt, Human
uuugaacucuucaa

SEQ ID NO: 3132735 - RNA, 22 nt, Human
uuugaagaugccgcauuuggau

SEQ ID NO: 3132736 - RNA, 16 nt, Human
uuuccugaggcugggc

SEQ ID NO: 3132737 - RNA, 14 nt, Human
uuaccacagacaua

SEQ ID NO: 3132738 - RNA, 17 nt, Human
uuaccacagacauacua

SEQ ID NO: 3132739 - RNA, 23 nt, Human
uuacauuuuuaagugcugcauuu

SEQ ID NO: 3132740 - RNA, 20 nt, Human
uuucuguucuuucuggcuau

SEQ ID NO: 3132741 - RNA, 23 nt, Human
uuucuacucgaguuacagacaaa

SEQ ID NO: 3132742 - RNA, 20 nt, Human
uuucuaaaggcuaccuuugu

SEQ ID NO: 3132743 - RNA, 21 nt, Human
uuucuaaaggcuaccuuugua

SEQ ID NO: 3132744 - RNA, 18 nt, Human
uuucuaaaggcuaccuuu

SEQ ID NO: 3132745 - RNA, 16 nt, Human
cuaaccagcagaaaug

SEQ ID NO: 3132746 - RNA, 17 nt, Human
cuaaccacgcuggaccu

SEQ ID NO: 3132747 - RNA, 17 nt, Human
cuaaccagcagaaaugc

SEQ ID NO: 3132748 - RNA, 15 nt, Human
cuaaggugugcucug

SEQ ID NO: 3132749 - RNA, 19 nt, Human
cuaagcuauucaguaauaa

SEQ ID NO: 3132750 - RNA, 21 nt, Human
cuaagcuauucaguaauaacu

SEQ ID NO: 3132751 - RNA, 13 nt, Human
cuacacacugcau

SEQ ID NO: 3132752 - RNA, 15 nt, Human
cuacacacugcaugu

SEQ ID NO: 3132753 - RNA, 18 nt, Human
cuacacugugcugagucu

SEQ ID NO: 3132754 - RNA, 15 nt, Human
cuacagaggccaugg

SEQ ID NO: 3132755 - RNA, 17 nt, Human
cuacccacccuccuuuc

SEQ ID NO: 3132756 - RNA, 13 nt, Human
cuacccacccucc

SEQ ID NO: 3132757 - RNA, 22 nt, Human
cuacccacccuccuuucaccac

SEQ ID NO: 3132758 - RNA, 20 nt, Human
cuacccagcgagcccuggug

SEQ ID NO: 3132759 - RNA, 19 nt, Human
cuacccagcgagcccuggu

SEQ ID NO: 3132760 - RNA, 16 nt, Human
cuaauguacugcauau

SEQ ID NO: 3132761 - RNA, 14 nt, Human
cuaauguacugcau

SEQ ID NO: 3132762 - RNA, 20 nt, Human
cuaauaaaauuuaaaagucu

SEQ ID NO: 3132763 - RNA, 16 nt, Human
cuaaggugugcucuga

SEQ ID NO: 3132764 - RNA, 21 nt, Human
cuaauaaaauuuaaaagucuu

SEQ ID NO: 3132765 - RNA, 18 nt, Human
cuaauauguaacaagcca

SEQ ID NO: 3132766 - RNA, 21 nt, Human
cuagacgagcaggcuucuucc

SEQ ID NO: 3132767 - RNA, 20 nt, Human
cuagacgagcaggcuucuuc

SEQ ID NO: 3132768 - RNA, 21 nt, Human
cuagagugaacuugggccacu

SEQ ID NO: 3132769 - RNA, 17 nt, Human
cuagagugaacuugggc

SEQ ID NO: 3132770 - RNA, 17 nt, Human
cuagcacuuugggaggc

SEQ ID NO: 3132771 - RNA, 13 nt, Human
cuacucuguguca

SEQ ID NO: 3132772 - RNA, 16 nt, Human
cuacucugugucaggu

SEQ ID NO: 3132773 - RNA, 21 nt, Human
cuacucugugucagguggggc

SEQ ID NO: 3132774 - RNA, 21 nt, Human
cuacccgggaagggggcuggg

SEQ ID NO: 3132775 - RNA, 20 nt, Human
cuacccgggaagggggcugg

SEQ ID NO: 3132776 - RNA, 15 nt, Human
cuacccgggaagggg

SEQ ID NO: 3132777 - RNA, 14 nt, Human
cuacccgggaaggg

SEQ ID NO: 3132778 - RNA, 14 nt, Human
cuacugaggugcua

SEQ ID NO: 3132779 - RNA, 17 nt, Human
cuacuguaauuugugau

SEQ ID NO: 3132780 - RNA, 16 nt, Human
cuacuguaauuuguga

SEQ ID NO: 3132781 - RNA, 22 nt, Human
cuaggaccccuccaugugggcu

SEQ ID NO: 3132782 - RNA, 17 nt, Human
cuaggaggucucuaaga

SEQ ID NO: 3132783 - RNA, 15 nt, Human
cuaggaacacuccuu

SEQ ID NO: 3132784 - RNA, 13 nt, Human
cuaggaacacucc

SEQ ID NO: 3132785 - RNA, 21 nt, Human
cuaggaagacuuuggaaagag

SEQ ID NO: 3132786 - RNA, 19 nt, Human
cuagugugguguuuccugg

SEQ ID NO: 3132787 - RNA, 23 nt, Human
cuagugugguguuuccuggcacu

SEQ ID NO: 3132788 - RNA, 22 nt, Human
cuagugugguguuuccuggcac

SEQ ID NO: 3132789 - RNA, 21 nt, Human
cuagugugguguuuccuggca

SEQ ID NO: 3132790 - RNA, 21 nt, Human
cuaggcauuugcugaauacag

SEQ ID NO: 3132791 - RNA, 22 nt, Human
cuauauuguuuucaguguacau

SEQ ID NO: 3132792 - RNA, 23 nt, Human
cuauauuguuuucaguguacaug

SEQ ID NO: 3132793 - RNA, 14 nt, Human
cuaugacacaugca

SEQ ID NO: 3132794 - RNA, 20 nt, Human
cuaucaaguauuauaccuuu

SEQ ID NO: 3132795 - RNA, 11 nt, Human
cuaugcauuug

SEQ ID NO: 3132796 - RNA, 12 nt, Human
cuaugcauuuga

SEQ ID NO: 3132797 - RNA, 23 nt, Human
cucacaguccuuaccagcagagc

SEQ ID NO: 3132798 - RNA, 18 nt, Human
cucaagugauucuccugc

SEQ ID NO: 3132799 - RNA, 19 nt, Human
cucaagugauucuccugcc

SEQ ID NO: 3132800 - RNA, 20 nt, Human
cucaagugauucuccugccu

SEQ ID NO: 3132801 - RNA, 20 nt, Human
cucaccagccccagugccca

SEQ ID NO: 3132802 - RNA, 21 nt, Human
cucaccagccccagugcccac

SEQ ID NO: 3132803 - RNA, 19 nt, Human
cucaccagccccagugccc

SEQ ID NO: 3132804 - RNA, 13 nt, Human
cucaccccagccc

SEQ ID NO: 3132805 - RNA, 12 nt, Human
cucaccccagcc

SEQ ID NO: 3132806 - RNA, 16 nt, Human
cucacuauguugccca

SEQ ID NO: 3132807 - RNA, 17 nt, Human
cucacuauguugcccag

SEQ ID NO: 3132808 - RNA, 21 nt, Human
cucaacucuccuccagaguca

SEQ ID NO: 3132809 - RNA, 20 nt, Human
cucaacucuccuccagaguc

SEQ ID NO: 3132810 - RNA, 19 nt, Human
cucaacucuccuccagagu

SEQ ID NO: 3132811 - RNA, 14 nt, Human
cuaugcauuugaaa

SEQ ID NO: 3132812 - RNA, 15 nt, Human
cuaaauggaaccacu

SEQ ID NO: 3132813 - RNA, 16 nt, Human
cuaaauggaaccacuc

SEQ ID NO: 3132814 - RNA, 17 nt, Human
cuaaauggaaccacucu

SEQ ID NO: 3132815 - RNA, 18 nt, Human
cuaaauggaaccacucua

SEQ ID NO: 3132816 - RNA, 16 nt, Human
cuaaauguugaaagau

SEQ ID NO: 3132817 - RNA, 17 nt, Human
cuaacauggaaguacua

SEQ ID NO: 3132818 - RNA, 15 nt, Human
cuaacauggaaguac

SEQ ID NO: 3132819 - RNA, 14 nt, Human
cgugcacacaccag

SEQ ID NO: 3132820 - RNA, 18 nt, Human
cgugcacacaccagagcc

SEQ ID NO: 3132821 - RNA, 19 nt, Human
cgugcacacaccagagccc

SEQ ID NO: 3132822 - RNA, 21 nt, Human
cgugcaguggugcgaucuggg

SEQ ID NO: 3132823 - RNA, 23 nt, Human
cgugcauaccacuuuuguucuug

SEQ ID NO: 3132824 - RNA, 20 nt, Human
cgucugacaggcaaugcugg

SEQ ID NO: 3132825 - RNA, 21 nt, Human
cgucugacaggcaaugcuggc

SEQ ID NO: 3132826 - RNA, 22 nt, Human
cgucugacaggcaaugcuggcu

SEQ ID NO: 3132827 - RNA, 16 nt, Human
cgugcacacaccagag

SEQ ID NO: 3132828 - RNA, 16 nt, Human
cgucuaccugaggggc

SEQ ID NO: 3132829 - RNA, 16 nt, Human
cgucucauacucaccu

SEQ ID NO: 3132830 - RNA, 18 nt, Human
cggugcuaucucccccag

SEQ ID NO: 3132831 - RNA, 21 nt, Human
cggugcuaucucccccagccc

SEQ ID NO: 3132832 - RNA, 20 nt, Human
cggugcuaucucccccagcc

SEQ ID NO: 3132833 - RNA, 22 nt, Human
cggugcuaucucccccagcccc

SEQ ID NO: 3132834 - RNA, 17 nt, Human
cguggcugcuucaagga

SEQ ID NO: 3132835 - RNA, 23 nt, Human
cggggacagcuccuucuguccua

SEQ ID NO: 3132836 - RNA, 15 nt, Human
cgggggcagagaggg

SEQ ID NO: 3132837 - RNA, 20 nt, Human
cgggaggucgaggcaggagg

SEQ ID NO: 3132838 - RNA, 18 nt, Human
cgggaggucgaggcagga

SEQ ID NO: 3132839 - RNA, 22 nt, Human
cggggacagcuccuucuguccu

SEQ ID NO: 3132840 - RNA, 14 nt, Human
cgggcacucagaag

SEQ ID NO: 3132841 - RNA, 22 nt, Human
cgggcacucagaagacacugau

SEQ ID NO: 3132842 - RNA, 19 nt, Human
cggcuggccuggccccuca

SEQ ID NO: 3132843 - RNA, 22 nt, Human
cggcuggccuggccccucaggg

SEQ ID NO: 3132844 - RNA, 23 nt, Human
cggcuggccuggccccucagggu

SEQ ID NO: 3132845 - RNA, 14 nt, Human
cgguccacccagga

SEQ ID NO: 3132846 - RNA, 15 nt, Human
cgguccacccaggag

SEQ ID NO: 3132847 - RNA, 16 nt, Human
cgguccacccaggagc

SEQ ID NO: 3132848 - RNA, 20 nt, Human
cgguccacccaggagccccg

SEQ ID NO: 3132849 - RNA, 20 nt, Human
cggugagaggggaacagacu

SEQ ID NO: 3132850 - RNA, 21 nt, Human
cggugagaggggaacagacug

SEQ ID NO: 3132851 - RNA, 17 nt, Human
cggccaccugcggugcu

SEQ ID NO: 3132852 - RNA, 16 nt, Human
cggccaccugcggugc

SEQ ID NO: 3132853 - RNA, 15 nt, Human
cggccaccugcggug

SEQ ID NO: 3132854 - RNA, 11 nt, Human
cggccaccugc

SEQ ID NO: 3132855 - RNA, 13 nt, Human
cggaagagccuug

SEQ ID NO: 3132856 - RNA, 13 nt, Human
cggccccugcugg

SEQ ID NO: 3132857 - RNA, 18 nt, Human
cggccccugcugguucag

SEQ ID NO: 3132858 - RNA, 19 nt, Human
cggccccugcugguucagg

SEQ ID NO: 3132859 - RNA, 24 nt, Human
cggccaggccagagggagugacag

SEQ ID NO: 3132860 - RNA, 21 nt, Human
cgcuaagagggagggagggcu

SEQ ID NO: 3132861 - RNA, 22 nt, Human
cgcuaagagggagggagggcuc

SEQ ID NO: 3132862 - RNA, 16 nt, Human
cgcuacccgggaaggg

SEQ ID NO: 3132863 - RNA, 15 nt, Human
cggaaaacaugcuac

SEQ ID NO: 3132864 - RNA, 20 nt, Human
cggaaaacaugcuacacacu

SEQ ID NO: 3132865 - RNA, 15 nt, Human
cgcugugcugcccug

SEQ ID NO: 3132866 - RNA, 17 nt, Human
cgcugugcugcccugcc

SEQ ID NO: 3132867 - RNA, 16 nt, Human
cgcugugcugcccugc

SEQ ID NO: 3132868 - RNA, 22 nt, Human
cgcugucagccauuccuguucc

SEQ ID NO: 3132869 - RNA, 22 nt, Human
cgccagauucuuuccugaggcu

SEQ ID NO: 3132870 - RNA, 20 nt, Human
ccucugcccacucccugcaa

SEQ ID NO: 3132871 - RNA, 19 nt, Human
ccucugcccacucccugca

SEQ ID NO: 3132872 - RNA, 17 nt, Human
ccucugcccacucccug

SEQ ID NO: 3132873 - RNA, 16 nt, Human
cgccaucccagcccca

SEQ ID NO: 3132874 - RNA, 14 nt, Human
cgccaucccagccc

SEQ ID NO: 3132875 - RNA, 23 nt, Human
cgccaggggaaaaucagccugcu

SEQ ID NO: 3132876 - RNA, 22 nt, Human
cgcccaggcuuagucacugaga

SEQ ID NO: 3132877 - RNA, 23 nt, Human
cugaaagcccugagcuuucugcu

SEQ ID NO: 3132878 - RNA, 19 nt, Human
cugaaagcccugagcuuuc

SEQ ID NO: 3132879 - RNA, 18 nt, Human
cugaaagcccugagcuuu

SEQ ID NO: 3132880 - RNA, 17 nt, Human
cugaaagcccugagcuu

SEQ ID NO: 3132881 - RNA, 16 nt, Human
cugaaagcccugagcu

SEQ ID NO: 3132882 - RNA, 15 nt, Human
cugaaagcccugagc

SEQ ID NO: 3132883 - RNA, 19 nt, Human
cugaagaauugaaaaacca

SEQ ID NO: 3132884 - RNA, 18 nt, Human
cucuuuaaugucacaggc

SEQ ID NO: 3132885 - RNA, 16 nt, Human
cucuugguccugcugc

SEQ ID NO: 3132886 - RNA, 15 nt, Human
cucuugguccugcug

SEQ ID NO: 3132887 - RNA, 13 nt, Human
cucuugguccugc

SEQ ID NO: 3132888 - RNA, 20 nt, Human
cucuuuaaugucacaggcag

SEQ ID NO: 3132889 - RNA, 21 nt, Human
cucuuuaaugucacaggcagg

SEQ ID NO: 3132890 - RNA, 22 nt, Human
cucuuuaaugucacaggcaggu

SEQ ID NO: 3132891 - RNA, 23 nt, Human
cucuuuaaugucacaggcagguc

SEQ ID NO: 3132892 - RNA, 13 nt, Human
cucuuucccuccc

SEQ ID NO: 3132893 - RNA, 17 nt, Human
cucuuucccucccuucc

SEQ ID NO: 3132894 - RNA, 22 nt, Human
cucuugaaauauaggaacuuaa

SEQ ID NO: 3132895 - RNA, 21 nt, Human
cucuuggguucaagcgauucu

SEQ ID NO: 3132896 - RNA, 19 nt, Human
cucuuggguucaagcgauu

SEQ ID NO: 3132897 - RNA, 13 nt, Human
cucuuccaggcug

SEQ ID NO: 3132898 - RNA, 15 nt, Human
cucuuccaggcuggg

SEQ ID NO: 3132899 - RNA, 14 nt, Human
cucuuccaggcugg

SEQ ID NO: 3132900 - RNA, 15 nt, Human
cucuuagaaaaacca

SEQ ID NO: 3132901 - RNA, 13 nt, Human
cucuuagaaaaac

SEQ ID NO: 3132902 - RNA, 15 nt, Human
cucugugucaggugg

SEQ ID NO: 3132903 - RNA, 13 nt, Human
cucucuccucccu

SEQ ID NO: 3132904 - RNA, 22 nt, Human
cucugccugaagucacacagug

SEQ ID NO: 3132905 - RNA, 10 nt, Human
cucugccuga

SEQ ID NO: 3132906 - RNA, 21 nt, Human
cucugccugaagucacacagu

SEQ ID NO: 3132907 - RNA, 15 nt, Human
cucuggacaggcaug

SEQ ID NO: 3132908 - RNA, 15 nt, Human
cucuggcagcucaga

SEQ ID NO: 3132909 - RNA, 14 nt, Human
cucuggcagcucag

SEQ ID NO: 3132910 - RNA, 12 nt, Human
cucuggcagcuc

SEQ ID NO: 3132911 - RNA, 16 nt, Human
cucuggacaggcaugu

SEQ ID NO: 3132912 - RNA, 22 nt, Human
cucuggacaggcauguucucug

SEQ ID NO: 3132913 - RNA, 14 nt, Human
cucuggacaggcau

SEQ ID NO: 3132914 - RNA, 15 nt, Human
cugagccagauuuca

SEQ ID NO: 3132915 - RNA, 21 nt, Human
cugagccagauuucacucucc

SEQ ID NO: 3132916 - RNA, 20 nt, Human
cugagccagauuucacucuc

SEQ ID NO: 3132917 - RNA, 19 nt, Human
cugagccagauuucacucu

SEQ ID NO: 3132918 - RNA, 18 nt, Human
cugagccagauuucacuc

SEQ ID NO: 3132919 - RNA, 17 nt, Human
cugagccagauuucacu

SEQ ID NO: 3132920 - RNA, 18 nt, Human
cugagacagcccgggcuc

SEQ ID NO: 3132921 - RNA, 17 nt, Human
cugagacagcccgggcu

SEQ ID NO: 3132922 - RNA, 16 nt, Human
cugagacagcccgggc

SEQ ID NO: 3132923 - RNA, 20 nt, Human
cugaggcccuucucuccagc

SEQ ID NO: 3132924 - RNA, 19 nt, Human
cugaggcccuucucuccag

SEQ ID NO: 3132925 - RNA, 18 nt, Human
cugaggcccuucucucca

SEQ ID NO: 3132926 - RNA, 15 nt, Human
cugaggcccuucucu

SEQ ID NO: 3132927 - RNA, 14 nt, Human
cugaggcccuucuc

SEQ ID NO: 3132928 - RNA, 23 nt, Human
cugaggcccagagggccugcaag

SEQ ID NO: 3132929 - RNA, 21 nt, Human
cugaggcccagagggccugca

SEQ ID NO: 3132930 - RNA, 19 nt, Human
cugaggcccagagggccug

SEQ ID NO: 3132931 - RNA, 18 nt, Human
cugaggcccagagggccu

SEQ ID NO: 3132932 - RNA, 17 nt, Human
cugaggcccagagggcc

SEQ ID NO: 3132933 - RNA, 16 nt, Human
cugaggcccagagggc

SEQ ID NO: 3132934 - RNA, 15 nt, Human
cugaggcccagaggg

SEQ ID NO: 3132935 - RNA, 14 nt, Human
cugaggcccagagg

SEQ ID NO: 3132936 - RNA, 13 nt, Human
cugaggcccagag

SEQ ID NO: 3132937 - RNA, 12 nt, Human
cugaggcccaga

SEQ ID NO: 3132938 - RNA, 15 nt, Human
cugagacagcccggg

SEQ ID NO: 3132939 - RNA, 14 nt, Human
cugagacagcccgg

SEQ ID NO: 3132940 - RNA, 18 nt, Human
cugacuguuuucucuuga

SEQ ID NO: 3132941 - RNA, 16 nt, Human
cugacuguuuucucuu

SEQ ID NO: 3132942 - RNA, 22 nt, Human
cugacauuguuggccaaagcca

SEQ ID NO: 3132943 - RNA, 12 nt, Human
cugacccacugc

SEQ ID NO: 3132944 - RNA, 16 nt, Human
cugacccaugcugccc

SEQ ID NO: 3132945 - RNA, 15 nt, Human
cugacccaugcugcc

SEQ ID NO: 3132946 - RNA, 14 nt, Human
cugacccaugcugc

SEQ ID NO: 3132947 - RNA, 13 nt, Human
cugacccacugcu

SEQ ID NO: 3132948 - RNA, 14 nt, Human
cugacccacugcuu

SEQ ID NO: 3132949 - RNA, 13 nt, Human
cugacccaugcug

SEQ ID NO: 3132950 - RNA, 21 nt, Human
cugacauuguuggccaaagcc

SEQ ID NO: 3132951 - RNA, 21 nt, Human
cugacaggcaaugcuggcugu

SEQ ID NO: 3132952 - RNA, 15 nt, Human
cucuaguuugauuaa

SEQ ID NO: 3132953 - RNA, 19 nt, Human
cucuaguuugauuaaauuc

SEQ ID NO: 3132954 - RNA, 20 nt, Human
cucuaguuugauuaaauucu

SEQ ID NO: 3132955 - RNA, 21 nt, Human
cucuaguuugauuaaauucuu

SEQ ID NO: 3132956 - RNA, 12 nt, Human
cucucaggccaa

SEQ ID NO: 3132957 - RNA, 21 nt, Human
cucucaggccaaacucaccug

SEQ ID NO: 3132958 - RNA, 20 nt, Human
cucucaggccaaacucaccu

SEQ ID NO: 3132959 - RNA, 15 nt, Human
cucucaggccagcug

SEQ ID NO: 3132960 - RNA, 13 nt, Human
cucucaggccagc

SEQ ID NO: 3132961 - RNA, 23 nt, Human
cucucaggccaaacucaccugcc

SEQ ID NO: 3132962 - RNA, 22 nt, Human
cucucaggccaaacucaccugc

SEQ ID NO: 3132963 - RNA, 21 nt, Human
cucucaggccagcugcuuggg

SEQ ID NO: 3132964 - RNA, 19 nt, Human
cucucaggccagcugcuug

SEQ ID NO: 3132965 - RNA, 18 nt, Human
cucucaggccagcugcuu

SEQ ID NO: 3132966 - RNA, 17 nt, Human
cucucaggccagcugcu

SEQ ID NO: 3132967 - RNA, 18 nt, Human
cucuccagccccuggaug

SEQ ID NO: 3132968 - RNA, 17 nt, Human
cucuccagccccuggau

SEQ ID NO: 3132969 - RNA, 16 nt, Human
cucuccagccccugga

SEQ ID NO: 3132970 - RNA, 15 nt, Human
cucuccagccccugg

SEQ ID NO: 3132971 - RNA, 14 nt, Human
cucuccagccccug

SEQ ID NO: 3132972 - RNA, 13 nt, Human
cucucucaggcca

SEQ ID NO: 3132973 - RNA, 12 nt, Human
cucucucacucc

SEQ ID NO: 3132974 - RNA, 14 nt, Human
cucuccccagcaag

SEQ ID NO: 3132975 - RNA, 22 nt, Human
cucuccccagcaagugagagcu

SEQ ID NO: 3132976 - RNA, 12 nt, Human
cucuccucugcu

SEQ ID NO: 3132977 - RNA, 19 nt, Human
cucuccagccccuggaugc

SEQ ID NO: 3132978 - RNA, 13 nt, Human
cucuccccagcaa

SEQ ID NO: 3132979 - RNA, 18 nt, Human
cucuccucugcugcuggc

SEQ ID NO: 3132980 - RNA, 15 nt, Human
cucuccucugcugcu

SEQ ID NO: 3132981 - RNA, 14 nt, Human
cucuccucugcugc

SEQ ID NO: 3132982 - RNA, 13 nt, Human
cucuccucugcug

SEQ ID NO: 3132983 - RNA, 13 nt, Human
cucuacagaggcc

SEQ ID NO: 3132984 - RNA, 19 nt, Human
cucuacagaggccaugggc

SEQ ID NO: 3132985 - RNA, 14 nt, Human
cucuacagaggcca

SEQ ID NO: 3132986 - RNA, 16 nt, Human
cucuacagaggccaug

SEQ ID NO: 3132987 - RNA, 13 nt, Human
cucuacaaaaagc

SEQ ID NO: 3132988 - RNA, 19 nt, Human
cuccuucacagaugggugc

SEQ ID NO: 3132989 - RNA, 14 nt, Human
cuccugugugugcg

SEQ ID NO: 3132990 - RNA, 17 nt, Human
cuccuucacagaugggu

SEQ ID NO: 3132991 - RNA, 16 nt, Human
cuccuucacagauggg

SEQ ID NO: 3132992 - RNA, 23 nt, Human
cucuagggaaaaaccagcgugug

SEQ ID NO: 3132993 - RNA, 20 nt, Human
cucuaccauccccuguagag

SEQ ID NO: 3132994 - RNA, 13 nt, Human
cucuacccuggca

SEQ ID NO: 3132995 - RNA, 20 nt, Human
cuccugcaggcagccaggcc

SEQ ID NO: 3132996 - RNA, 18 nt, Human
cuccugcaggcagccagg

SEQ ID NO: 3132997 - RNA, 11 nt, Human
cuccugcccuu

SEQ ID NO: 3132998 - RNA, 13 nt, Human
cuccugccucagc

SEQ ID NO: 3132999 - RNA, 14 nt, Human
cuccugccucagcc

SEQ ID NO: 3133000 - RNA, 17 nt, Human
cuccugcaggcagccag

SEQ ID NO: 3133001 - RNA, 16 nt, Human
cuccugcaggcagcca

SEQ ID NO: 3133002 - RNA, 11 nt, Human
cuccugcaggc

SEQ ID NO: 3133003 - RNA, 16 nt, Human
cuccugugugugcgcc

SEQ ID NO: 3133004 - RNA, 19 nt, Human
cuccugugugugcgccuac

SEQ ID NO: 3133005 - RNA, 22 nt, Human
cuccugccucgaacuggcugca

SEQ ID NO: 3133006 - RNA, 15 nt, Human
cuccugccucagccu

SEQ ID NO: 3133007 - RNA, 18 nt, Human
cucccucagucuggcccu

SEQ ID NO: 3133008 - RNA, 17 nt, Human
cucccuuucuucccuac

SEQ ID NO: 3133009 - RNA, 22 nt, Human
cuccuccagccgccaugcuccu

SEQ ID NO: 3133010 - RNA, 22 nt, Human
cuccucuccccagcaagugaga

SEQ ID NO: 3133011 - RNA, 17 nt, Human
cucccgaauagcuggga

SEQ ID NO: 3133012 - RNA, 16 nt, Human
cucccgaauagcuggg

SEQ ID NO: 3133013 - RNA, 13 nt, Human
cuccccugcuggg

SEQ ID NO: 3133014 - RNA, 15 nt, Human
cucccgaguagcugg

SEQ ID NO: 3133015 - RNA, 18 nt, Human
cucccgaauagcugggac

SEQ ID NO: 3133016 - RNA, 16 nt, Human
cucccgaguagcuggg

SEQ ID NO: 3133017 - RNA, 17 nt, Human
cucccgaguagcuggga

SEQ ID NO: 3133018 - RNA, 12 nt, Human
cuccccagcaag

SEQ ID NO: 3133019 - RNA, 20 nt, Human
cuccccagcaagugagagcu

SEQ ID NO: 3133020 - RNA, 20 nt, Human
cuccccagccccaucccaaa

SEQ ID NO: 3133021 - RNA, 12 nt, Human
cuccccugcugg

SEQ ID NO: 3133022 - RNA, 22 nt, Human
cucccaacucaccccagcccca

SEQ ID NO: 3133023 - RNA, 18 nt, Human
cucccaaagugcugggau

SEQ ID NO: 3133024 - RNA, 17 nt, Human
cucccaacucaccccag

SEQ ID NO: 3133025 - RNA, 16 nt, Human
cucccaacucacccca

SEQ ID NO: 3133026 - RNA, 23 nt, Human
cucccaucugugaaaggaaagag

SEQ ID NO: 3133027 - RNA, 18 nt, Human
cucccaucugugaaagga

SEQ ID NO: 3133028 - RNA, 15 nt, Human
cucccaucugugaaa

SEQ ID NO: 3133029 - RNA, 14 nt, Human
cucccaucugugaa

SEQ ID NO: 3133030 - RNA, 11 nt, Human
cucccaucugu

SEQ ID NO: 3133031 - RNA, 21 nt, Human
cucccaucucacacaugagca

SEQ ID NO: 3133032 - RNA, 17 nt, Human
cucccaaagugcuggga

SEQ ID NO: 3133033 - RNA, 13 nt, Human
cuccaugugggcu

SEQ ID NO: 3133034 - RNA, 18 nt, Human
cucacuauguugcccagg

SEQ ID NO: 3133035 - RNA, 16 nt, Human
cugcccaggccccugc

SEQ ID NO: 3133036 - RNA, 18 nt, Human
cugcccaggccccugcca

SEQ ID NO: 3133037 - RNA, 19 nt, Human
cugcccaggccccugccac

SEQ ID NO: 3133038 - RNA, 20 nt, Human
cugcccaggccccugccacc

SEQ ID NO: 3133039 - RNA, 13 nt, Human
cugcccaggcccc

SEQ ID NO: 3133040 - RNA, 12 nt, Human
cugcccaccugg

SEQ ID NO: 3133041 - RNA, 14 nt, Human
cugcccaggccccu

SEQ ID NO: 3133042 - RNA, 15 nt, Human
cugcccaggccccug

SEQ ID NO: 3133043 - RNA, 15 nt, Human
cugccauuucugaga

SEQ ID NO: 3133044 - RNA, 19 nt, Human
cugccccuggcagccccug

SEQ ID NO: 3133045 - RNA, 17 nt, Human
cugccccuggcagcccc

SEQ ID NO: 3133046 - RNA, 18 nt, Human
cugccccuggcagccccu

SEQ ID NO: 3133047 - RNA, 13 nt, Human
cugcccggcaggg

SEQ ID NO: 3133048 - RNA, 21 nt, Human
cugccaggaagccagcaggcu

SEQ ID NO: 3133049 - RNA, 20 nt, Human
cugccaggaagccagcaggc

SEQ ID NO: 3133050 - RNA, 14 nt, Human
cugccaggaagcca

SEQ ID NO: 3133051 - RNA, 13 nt, Human
cugccaggaagcc

SEQ ID NO: 3133052 - RNA, 21 nt, Human
cugccauccagguucagcuug

SEQ ID NO: 3133053 - RNA, 15 nt, Human
cugccauccucccaa

SEQ ID NO: 3133054 - RNA, 22 nt, Human
cugccaggaagccagcaggcuc

SEQ ID NO: 3133055 - RNA, 15 nt, Human
cugcauaugaaagga

SEQ ID NO: 3133056 - RNA, 20 nt, Human
cugcaucaagaugugacaug

SEQ ID NO: 3133057 - RNA, 21 nt, Human
cugccacccuggggagaaagu

SEQ ID NO: 3133058 - RNA, 12 nt, Human
cugccacccugg

SEQ ID NO: 3133059 - RNA, 14 nt, Human
cugcaccgggccac

SEQ ID NO: 3133060 - RNA, 15 nt, Human
cugcaccgggccaca

SEQ ID NO: 3133061 - RNA, 15 nt, Human
cugcaccggcuggcc

SEQ ID NO: 3133062 - RNA, 14 nt, Human
cugcaccggcuggc

SEQ ID NO: 3133063 - RNA, 23 nt, Human
cugaggcccuucucuccagcccc

SEQ ID NO: 3133064 - RNA, 22 nt, Human
cugaggcccuucucuccagccc

SEQ ID NO: 3133065 - RNA, 18 nt, Human
cugcaccgggccacagag

SEQ ID NO: 3133066 - RNA, 19 nt, Human
cugcacuccagccugggug

SEQ ID NO: 3133067 - RNA, 20 nt, Human
cugcacuccagccuggguga

SEQ ID NO: 3133068 - RNA, 13 nt, Human
cugcacuccccug

SEQ ID NO: 3133069 - RNA, 20 nt, Human
cugcacuccccugcugggug

SEQ ID NO: 3133070 - RNA, 19 nt, Human
cugcacuccccugcugggu

SEQ ID NO: 3133071 - RNA, 18 nt, Human
cugcacuccccugcuggg

SEQ ID NO: 3133072 - RNA, 21 nt, Human
cugcacuccccugcugggugu

SEQ ID NO: 3133073 - RNA, 13 nt, Human
cugcagagggcac

SEQ ID NO: 3133074 - RNA, 15 nt, Human
cugcagcaauaaagc

SEQ ID NO: 3133075 - RNA, 16 nt, Human
cugcagcaauaaagca

SEQ ID NO: 3133076 - RNA, 10 nt, Human
cugcagaggg

SEQ ID NO: 3133077 - RNA, 17 nt, Human
cugcagcaauaaagcag

SEQ ID NO: 3133078 - RNA, 16 nt, Human
cugcaguugccaguca

SEQ ID NO: 3133079 - RNA, 13 nt, Human
cugcaguugccag

SEQ ID NO: 3133080 - RNA, 19 nt, Human
cugcuugugaaaggaaaga

SEQ ID NO: 3133081 - RNA, 19 nt, Human
cugcuugggcuucauccuc

SEQ ID NO: 3133082 - RNA, 18 nt, Human
cugcuugggcuucauccu

SEQ ID NO: 3133083 - RNA, 17 nt, Human
cugcuugggcuucaucc

SEQ ID NO: 3133084 - RNA, 15 nt, Human
cugcuugggcuucau

SEQ ID NO: 3133085 - RNA, 13 nt, Human
cugcuugggcuuc

SEQ ID NO: 3133086 - RNA, 22 nt, Human
cugcuugaggcaacucaucuua

SEQ ID NO: 3133087 - RNA, 20 nt, Human
cugcuugcuugcuuuuuaau

SEQ ID NO: 3133088 - RNA, 15 nt, Human
cugcuuuuggucugu

SEQ ID NO: 3133089 - RNA, 17 nt, Human
cugcuuuuggucugugu

SEQ ID NO: 3133090 - RNA, 13 nt, Human
cugcugcuggcug

SEQ ID NO: 3133091 - RNA, 12 nt, Human
cugcugcuggcu

SEQ ID NO: 3133092 - RNA, 15 nt, Human
cugcuggguguggcg

SEQ ID NO: 3133093 - RNA, 14 nt, Human
cugcuggguguggc

SEQ ID NO: 3133094 - RNA, 17 nt, Human
cugcuggguguggcgca

SEQ ID NO: 3133095 - RNA, 21 nt, Human
cugcuugaggcaacucaucuu

SEQ ID NO: 3133096 - RNA, 20 nt, Human
cugcuugaggcaacucaucu

SEQ ID NO: 3133097 - RNA, 13 nt, Human
cugcuugaggcaa

SEQ ID NO: 3133098 - RNA, 19 nt, Human
cugccugaagucacacagu

SEQ ID NO: 3133099 - RNA, 18 nt, Human
cugccugaagucacacag

SEQ ID NO: 3133100 - RNA, 16 nt, Human
cugccugaagucacac

SEQ ID NO: 3133101 - RNA, 21 nt, Human
cugcccugcccaccuggccuc

SEQ ID NO: 3133102 - RNA, 17 nt, Human
cugcccugcccaccugg

SEQ ID NO: 3133103 - RNA, 20 nt, Human
cugcccugcccaccuggccu

SEQ ID NO: 3133104 - RNA, 23 nt, Human
cugcgguccacccaggagccccg

SEQ ID NO: 3133105 - RNA, 19 nt, Human
cugcggugcuaucuccccc

SEQ ID NO: 3133106 - RNA, 18 nt, Human
cugcggugcuaucucccc

SEQ ID NO: 3133107 - RNA, 23 nt, Human
cugcggugcuaucucccccagcc

SEQ ID NO: 3133108 - RNA, 22 nt, Human
cugcggugcuaucucccccagc

SEQ ID NO: 3133109 - RNA, 21 nt, Human
cugcggugcuaucucccccag

SEQ ID NO: 3133110 - RNA, 20 nt, Human
cugcggugcuaucuccccca

SEQ ID NO: 3133111 - RNA, 23 nt, Human
cugcuccucuccccagcaaguga

SEQ ID NO: 3133112 - RNA, 19 nt, Human
cugcuccucuccccagcaa

SEQ ID NO: 3133113 - RNA, 20 nt, Human
cugcuccucuccccagcaag

SEQ ID NO: 3133114 - RNA, 15 nt, Human
cugcucuccgaccag

SEQ ID NO: 3133115 - RNA, 13 nt, Human
cugcugcaguugc

SEQ ID NO: 3133116 - RNA, 10 nt, Human
cugcugcagu

SEQ ID NO: 3133117 - RNA, 14 nt, Human
cugcugcaguugcc

SEQ ID NO: 3133118 - RNA, 12 nt, Human
cugcucugguua

SEQ ID NO: 3133119 - RNA, 18 nt, Human
cugggagagccuuccagg

SEQ ID NO: 3133120 - RNA, 17 nt, Human
cugggagagccuuccag

SEQ ID NO: 3133121 - RNA, 21 nt, Human
cugggagagccuuccaggggu

SEQ ID NO: 3133122 - RNA, 20 nt, Human
cugggagagccuuccagggg

SEQ ID NO: 3133123 - RNA, 19 nt, Human
cugggagagccuuccaggg

SEQ ID NO: 3133124 - RNA, 20 nt, Human
cuggcugguuagagguuccc

SEQ ID NO: 3133125 - RNA, 22 nt, Human
cuggcuggguggcaccagcagc

SEQ ID NO: 3133126 - RNA, 16 nt, Human
cuggcuguuggcuggg

SEQ ID NO: 3133127 - RNA, 17 nt, Human
cuggcuguuggcugggg

SEQ ID NO: 3133128 - RNA, 17 nt, Human
cugggauuacaggugug

SEQ ID NO: 3133129 - RNA, 20 nt, Human
cugggauuacaggugugaac

SEQ ID NO: 3133130 - RNA, 18 nt, Human
cugggaugauuggagggg

SEQ ID NO: 3133131 - RNA, 20 nt, Human
cugggaucccucauccucau

SEQ ID NO: 3133132 - RNA, 21 nt, Human
cugggaggucaaggcugcagu

SEQ ID NO: 3133133 - RNA, 19 nt, Human
cugggaggucaaggcugca

SEQ ID NO: 3133134 - RNA, 23 nt, Human
cuggccucaagugauucuccugc

SEQ ID NO: 3133135 - RNA, 12 nt, Human
cuggccucugca

SEQ ID NO: 3133136 - RNA, 22 nt, Human
cuggccucaagugauucuccug

SEQ ID NO: 3133137 - RNA, 16 nt, Human
cuggccugagcuggga

SEQ ID NO: 3133138 - RNA, 14 nt, Human
cuggccucugcacu

SEQ ID NO: 3133139 - RNA, 13 nt, Human
cuggccucugcac

SEQ ID NO: 3133140 - RNA, 13 nt, Human
cuggccuggcccc

SEQ ID NO: 3133141 - RNA, 14 nt, Human
cuggccuggccccu

SEQ ID NO: 3133142 - RNA, 18 nt, Human
cuggccugagcugggaug

SEQ ID NO: 3133143 - RNA, 15 nt, Human
cuggccugagcuggg

SEQ ID NO: 3133144 - RNA, 14 nt, Human
cuggccugugucua

SEQ ID NO: 3133145 - RNA, 17 nt, Human
cuggccuggccccucag

SEQ ID NO: 3133146 - RNA, 16 nt, Human
cuggccuggccccuca

SEQ ID NO: 3133147 - RNA, 15 nt, Human
cuggcacuauaaugu

SEQ ID NO: 3133148 - RNA, 16 nt, Human
cuggcacuauaaugua

SEQ ID NO: 3133149 - RNA, 22 nt, Human
cuggcaugggaaugaaugucag

SEQ ID NO: 3133150 - RNA, 19 nt, Human
cuggcaugggaaugaaugu

SEQ ID NO: 3133151 - RNA, 18 nt, Human
cuggcaugggaaugaaug

SEQ ID NO: 3133152 - RNA, 16 nt, Human
cuggcaugggaaugaa

SEQ ID NO: 3133153 - RNA, 24 nt, Human
cuggcaugggaaugaaugucagug

SEQ ID NO: 3133154 - RNA, 22 nt, Human
cuggccagaugcaccagcccuu

SEQ ID NO: 3133155 - RNA, 16 nt, Human
cuggcacccggccccu

SEQ ID NO: 3133156 - RNA, 17 nt, Human
cuggcacccggccccug

SEQ ID NO: 3133157 - RNA, 18 nt, Human
cuggcacccggccccugc

SEQ ID NO: 3133158 - RNA, 22 nt, Human
cuggcacccggccccugcuggu

SEQ ID NO: 3133159 - RNA, 14 nt, Human
cuggcaagaaugug

SEQ ID NO: 3133160 - RNA, 18 nt, Human
cuggaauauauaaccagu

SEQ ID NO: 3133161 - RNA, 13 nt, Human
cuggucccacuca

SEQ ID NO: 3133162 - RNA, 23 nt, Human
cuggucucaaacucuugaccuca

SEQ ID NO: 3133163 - RNA, 21 nt, Human
cugguccauagagagcaagac

SEQ ID NO: 3133164 - RNA, 22 nt, Human
cugggcucccuucccaccucuc

SEQ ID NO: 3133165 - RNA, 21 nt, Human
cugggcucccuucccaccucu

SEQ ID NO: 3133166 - RNA, 20 nt, Human
cugggcucccuucccaccuc

SEQ ID NO: 3133167 - RNA, 19 nt, Human
cugggcucccuucccaccu

SEQ ID NO: 3133168 - RNA, 16 nt, Human
cuggguacuuguggac

SEQ ID NO: 3133169 - RNA, 14 nt, Human
cuggguacuugugg

SEQ ID NO: 3133170 - RNA, 18 nt, Human
cuggguacuuguggacac

SEQ ID NO: 3133171 - RNA, 15 nt, Human
cuggguuggagggug

SEQ ID NO: 3133172 - RNA, 18 nt, Human
cuguaauuugugauacaa

SEQ ID NO: 3133173 - RNA, 17 nt, Human
cuguaauuugugauaca

SEQ ID NO: 3133174 - RNA, 23 nt, Human
cuguacagagcccacgcccccac

SEQ ID NO: 3133175 - RNA, 21 nt, Human
cuguaauuugugauacaaugc

SEQ ID NO: 3133176 - RNA, 21 nt, Human
cuguaccucuugagccuugaa

SEQ ID NO: 3133177 - RNA, 22 nt, Human
cuguacaugaaaacacauuuuu

SEQ ID NO: 3133178 - RNA, 23 nt, Human
cuguacaugaaaacacauuuuuc

SEQ ID NO: 3133179 - RNA, 12 nt, Human
cugguggcagcu

SEQ ID NO: 3133180 - RNA, 14 nt, Human
cugguggcagcuca

SEQ ID NO: 3133181 - RNA, 13 nt, Human
cugguggcagcuc

SEQ ID NO: 3133182 - RNA, 20 nt, Human
cugguucaggguuggccccu

SEQ ID NO: 3133183 - RNA, 22 nt, Human
cugucucaaaaaaagaaaaaga

SEQ ID NO: 3133184 - RNA, 21 nt, Human
cuguccuacucugugucaggu

SEQ ID NO: 3133185 - RNA, 22 nt, Human
cugucccuuacgugaguccugg

SEQ ID NO: 3133186 - RNA, 16 nt, Human
cuguccuacucugugu

SEQ ID NO: 3133187 - RNA, 17 nt, Human
cuguccuacucuguguc

SEQ ID NO: 3133188 - RNA, 18 nt, Human
cuguccuacucuguguca

SEQ ID NO: 3133189 - RNA, 20 nt, Human
cuguccuacucugugucagg

SEQ ID NO: 3133190 - RNA, 14 nt, Human
cugucccccugaca

SEQ ID NO: 3133191 - RNA, 13 nt, Human
cugucccccugac

SEQ ID NO: 3133192 - RNA, 23 nt, Human
cugucauuugagcagggcucagc

SEQ ID NO: 3133193 - RNA, 22 nt, Human
cugucccagugccgagaaggaa

SEQ ID NO: 3133194 - RNA, 18 nt, Human
cuguaucccaugagccuc

SEQ ID NO: 3133195 - RNA, 14 nt, Human
cuguaucccaugag

SEQ ID NO: 3133196 - RNA, 15 nt, Human
cuguaucccaugagc

SEQ ID NO: 3133197 - RNA, 22 nt, Human
cuguaccucuugagccuugaac

SEQ ID NO: 3133198 - RNA, 13 nt, Human
gaagggggcuggg

SEQ ID NO: 3133199 - RNA, 18 nt, Human
gaagucuuagauguauau

SEQ ID NO: 3133200 - RNA, 13 nt, Human
gaagucacacagu

SEQ ID NO: 3133201 - RNA, 19 nt, Human
gaaguaauaugcacacauu

SEQ ID NO: 3133202 - RNA, 20 nt, Human
gaaguaauaugcacacauuu

SEQ ID NO: 3133203 - RNA, 20 nt, Human
gaaggaaacccagcucuggu

SEQ ID NO: 3133204 - RNA, 19 nt, Human
gaaggaaacccagcucugg

SEQ ID NO: 3133205 - RNA, 14 nt, Human
gaagccgcuggggc

SEQ ID NO: 3133206 - RNA, 20 nt, Human
gaagccgcuggggccaguug

SEQ ID NO: 3133207 - RNA, 18 nt, Human
gaagccgcuggggccagu

SEQ ID NO: 3133208 - RNA, 19 nt, Human
gaaggacauugcggacagc

SEQ ID NO: 3133209 - RNA, 20 nt, Human
gaaggacauugcggacagcc

SEQ ID NO: 3133210 - RNA, 21 nt, Human
gaaggacauugcggacagcca

SEQ ID NO: 3133211 - RNA, 22 nt, Human
gaaggaaacccagcucuggucc

SEQ ID NO: 3133212 - RNA, 21 nt, Human
gaaggaaacccagcucugguc

SEQ ID NO: 3133213 - RNA, 15 nt, Human
gaaggaacguccccu

SEQ ID NO: 3133214 - RNA, 19 nt, Human
gaaggaagacuucaucccu

SEQ ID NO: 3133215 - RNA, 17 nt, Human
gaacuuaaauaauguga

SEQ ID NO: 3133216 - RNA, 14 nt, Human
gaacuuaaauaaug

SEQ ID NO: 3133217 - RNA, 17 nt, Human
gaacuuggcgcugcccc

SEQ ID NO: 3133218 - RNA, 18 nt, Human
gaaccacaucuugcucug

SEQ ID NO: 3133219 - RNA, 14 nt, Human
gaagaagcucucuc

SEQ ID NO: 3133220 - RNA, 16 nt, Human
gaacuuugaccucugc

SEQ ID NO: 3133221 - RNA, 22 nt, Human
gaacuuugaccucugcagcaau

SEQ ID NO: 3133222 - RNA, 17 nt, Human
gaacuuuccaggaaggc

SEQ ID NO: 3133223 - RNA, 18 nt, Human
gaacuuggcgcugccccu

SEQ ID NO: 3133224 - RNA, 17 nt, Human
gaacuugggccacugug

SEQ ID NO: 3133225 - RNA, 17 nt, Human
gaagacuucaucccucu

SEQ ID NO: 3133226 - RNA, 12 nt, Human
gaagagccuugc

SEQ ID NO: 3133227 - RNA, 16 nt, Human
gaagacuucaucccuc

SEQ ID NO: 3133228 - RNA, 15 nt, Human
gaagacuucaucccu

SEQ ID NO: 3133229 - RNA, 18 nt, Human
gaagcauuuacuuugugu

SEQ ID NO: 3133230 - RNA, 16 nt, Human
gaaagaguaggaagac

SEQ ID NO: 3133231 - RNA, 16 nt, Human
gaaagaucaaaagguu

SEQ ID NO: 3133232 - RNA, 16 nt, Human
gaaaaaugagccuggc

SEQ ID NO: 3133233 - RNA, 22 nt, Human
gaaaguacuucuccacccugcu

SEQ ID NO: 3133234 - RNA, 16 nt, Human
gaaaggaaagaggcuc

SEQ ID NO: 3133235 - RNA, 11 nt, Human
gaaaggaaaga

SEQ ID NO: 3133236 - RNA, 18 nt, Human
gaaauaucugaaaaugua

SEQ ID NO: 3133237 - RNA, 19 nt, Human
gaaauaucugaaaauguau

SEQ ID NO: 3133238 - RNA, 17 nt, Human
gaaauauaggaacuuaa

SEQ ID NO: 3133239 - RNA, 18 nt, Human
gaaaugaggucagagccu

SEQ ID NO: 3133240 - RNA, 11 nt, Human
gaaaugagcug

SEQ ID NO: 3133241 - RNA, 15 nt, Human
gaaaugggcagagca

SEQ ID NO: 3133242 - RNA, 16 nt, Human
gaaaugggcagagcag

SEQ ID NO: 3133243 - RNA, 17 nt, Human
gaaauguacagcaagga

SEQ ID NO: 3133244 - RNA, 19 nt, Human
gaaaugggcagagcagaga

SEQ ID NO: 3133245 - RNA, 17 nt, Human
gaaaugggcagagcaga

SEQ ID NO: 3133246 - RNA, 22 nt, Human
gaacagacuggaagcacagcuu

SEQ ID NO: 3133247 - RNA, 17 nt, Human
gaacacuccuucacaga

SEQ ID NO: 3133248 - RNA, 20 nt, Human
gaacagacuggaagcacagc

SEQ ID NO: 3133249 - RNA, 19 nt, Human
gaacagacuggaagcacag

SEQ ID NO: 3133250 - RNA, 16 nt, Human
gaacacuccuucacag

SEQ ID NO: 3133251 - RNA, 15 nt, Human
gaacacuccuucaca

SEQ ID NO: 3133252 - RNA, 16 nt, Human
cuuguggacacagcuc

SEQ ID NO: 3133253 - RNA, 17 nt, Human
cuuguggacacagcucu

SEQ ID NO: 3133254 - RNA, 18 nt, Human
cuuguggacacagcucuu

SEQ ID NO: 3133255 - RNA, 16 nt, Human
cuuggggaccagagcu

SEQ ID NO: 3133256 - RNA, 17 nt, Human
cuuggggaccagagcug

SEQ ID NO: 3133257 - RNA, 19 nt, Human
cuuggggaccagagcugcc

SEQ ID NO: 3133258 - RNA, 18 nt, Human
cuuggggaccagagcugc

SEQ ID NO: 3133259 - RNA, 21 nt, Human
cuuguaaauagcucagguguc

SEQ ID NO: 3133260 - RNA, 20 nt, Human
cuugguuuguaaauuaacuu

SEQ ID NO: 3133261 - RNA, 12 nt, Human
cuuggcugcagg

SEQ ID NO: 3133262 - RNA, 13 nt, Human
cuuggcugcaggg

SEQ ID NO: 3133263 - RNA, 23 nt, Human
cuuggcucaaguccucuuuucug

SEQ ID NO: 3133264 - RNA, 13 nt, Human
cuuggauuguccc

SEQ ID NO: 3133265 - RNA, 13 nt, Human
cuugcuugcuuuu

SEQ ID NO: 3133266 - RNA, 22 nt, Human
cuugcaaaguaucccuacugua

SEQ ID NO: 3133267 - RNA, 14 nt, Human
cuugcaauggcagc

SEQ ID NO: 3133268 - RNA, 18 nt, Human
cuugcagacucuacagag

SEQ ID NO: 3133269 - RNA, 17 nt, Human
cuugcaugaggcuagug

SEQ ID NO: 3133270 - RNA, 21 nt, Human
cuugcaugaggcuaguguggu

SEQ ID NO: 3133271 - RNA, 19 nt, Human
cuugagccuugaacuuuga

SEQ ID NO: 3133272 - RNA, 20 nt, Human
cuugaccauucuccaccugc

SEQ ID NO: 3133273 - RNA, 17 nt, Human
cuugaccauucuccacc

SEQ ID NO: 3133274 - RNA, 21 nt, Human
cuugaccauucuccaccugcc

SEQ ID NO: 3133275 - RNA, 14 nt, Human
cuugagagggugga

SEQ ID NO: 3133276 - RNA, 20 nt, Human
cuugagccuugaacuuugac

SEQ ID NO: 3133277 - RNA, 22 nt, Human
cuugagccuugaacuuugaccu

SEQ ID NO: 3133278 - RNA, 19 nt, Human
cuugaaauauaggaacuua

SEQ ID NO: 3133279 - RNA, 22 nt, Human
cuucuuuauaauucuacuuuga

SEQ ID NO: 3133280 - RNA, 14 nt, Human
cuugaacuccuggc

SEQ ID NO: 3133281 - RNA, 15 nt, Human
cuugaacuccuggcc

SEQ ID NO: 3133282 - RNA, 17 nt, Human
cuugaacuccuggccuc

SEQ ID NO: 3133283 - RNA, 18 nt, Human
cuugaacuccuggccuca

SEQ ID NO: 3133284 - RNA, 15 nt, Human
cuugaacuuugaccu

SEQ ID NO: 3133285 - RNA, 18 nt, Human
cuugaacuggguacuugu

SEQ ID NO: 3133286 - RNA, 20 nt, Human
cuugaacuggguacuugugg

SEQ ID NO: 3133287 - RNA, 19 nt, Human
cuugaacuccuggccucaa

SEQ ID NO: 3133288 - RNA, 16 nt, Human
cuugaacuggguacuu

SEQ ID NO: 3133289 - RNA, 22 nt, Human
cuuuucauuuaggugaggaagc

SEQ ID NO: 3133290 - RNA, 23 nt, Human
cuuuuccaacccucaucaccaac

SEQ ID NO: 3133291 - RNA, 13 nt, Human
cuuuuccaacccu

SEQ ID NO: 3133292 - RNA, 20 nt, Human
cuuuucgcaggauucuuccu

SEQ ID NO: 3133293 - RNA, 21 nt, Human
cuuuucgcaggauucuuccuc

SEQ ID NO: 3133294 - RNA, 22 nt, Human
cuuuuuaauauugauaugcuua

SEQ ID NO: 3133295 - RNA, 13 nt, Human
cuuuucuuuucuu

SEQ ID NO: 3133296 - RNA, 16 nt, Human
cuuuucuuucagccaa

SEQ ID NO: 3133297 - RNA, 17 nt, Human
cuuuucuuucagccaag

SEQ ID NO: 3133298 - RNA, 15 nt, Human
cuuuuuuauacauaa

SEQ ID NO: 3133299 - RNA, 16 nt, Human
cuuuuuuauacauaaa

SEQ ID NO: 3133300 - RNA, 17 nt, Human
cuuuuuuauacauaaac

SEQ ID NO: 3133301 - RNA, 16 nt, Human
gaaaaagaaaaaauau

SEQ ID NO: 3133302 - RNA, 11 nt, Human
gaaaaagaaaa

SEQ ID NO: 3133303 - RNA, 18 nt, Human
cuuuuuuauacauaaaca

SEQ ID NO: 3133304 - RNA, 14 nt, Human
cuuugcagacaggc

SEQ ID NO: 3133305 - RNA, 15 nt, Human
cuuugcagacaggca

SEQ ID NO: 3133306 - RNA, 23 nt, Human
cuuuggaaagaguaggaagacuu

SEQ ID NO: 3133307 - RNA, 19 nt, Human
cuuuggaaagaguaggaag

SEQ ID NO: 3133308 - RNA, 21 nt, Human
cuuuccugaggcugggcuccc

SEQ ID NO: 3133309 - RNA, 20 nt, Human
cuuuccugaggcugggcucc

SEQ ID NO: 3133310 - RNA, 16 nt, Human
cuuuccugaggcuggg

SEQ ID NO: 3133311 - RNA, 17 nt, Human
cuuuccugaggcugggc

SEQ ID NO: 3133312 - RNA, 21 nt, Human
cuuguggacacagcucuucuc

SEQ ID NO: 3133313 - RNA, 22 nt, Human
cuuuccaaaguacacuguuuca

SEQ ID NO: 3133314 - RNA, 16 nt, Human
cuuuccaaaguacacu

SEQ ID NO: 3133315 - RNA, 14 nt, Human
cuuuccaggaaggc

SEQ ID NO: 3133316 - RNA, 21 nt, Human
gagauagccaaggccaaagga

SEQ ID NO: 3133317 - RNA, 20 nt, Human
gagauagccaaggccaaagg

SEQ ID NO: 3133318 - RNA, 19 nt, Human
gagauagccaaggccaaag

SEQ ID NO: 3133319 - RNA, 16 nt, Human
gagcagagaccauccc

SEQ ID NO: 3133320 - RNA, 18 nt, Human
gagcagagaccaucccug

SEQ ID NO: 3133321 - RNA, 17 nt, Human
gagcagagaccaucccu

SEQ ID NO: 3133322 - RNA, 23 nt, Human
gagcagagaccaucccugaaggc

SEQ ID NO: 3133323 - RNA, 21 nt, Human
gagcagagaccaucccugaag

SEQ ID NO: 3133324 - RNA, 19 nt, Human
gagcagagaccaucccuga

SEQ ID NO: 3133325 - RNA, 21 nt, Human
gagcagccacauuccugaugc

SEQ ID NO: 3133326 - RNA, 22 nt, Human
gagcagccacauuccugaugcu

SEQ ID NO: 3133327 - RNA, 13 nt, Human
gagccagauuuca

SEQ ID NO: 3133328 - RNA, 13 nt, Human
gagcccaccuugg

SEQ ID NO: 3133329 - RNA, 15 nt, Human
gagcccaccuuggcu

SEQ ID NO: 3133330 - RNA, 17 nt, Human
gagcccaccuuggcuca

SEQ ID NO: 3133331 - RNA, 18 nt, Human
gagccacugcaccgggcc

SEQ ID NO: 3133332 - RNA, 19 nt, Human
gagccacugcaccgggcca

SEQ ID NO: 3133333 - RNA, 13 nt, Human
gagccacugcacc

SEQ ID NO: 3133334 - RNA, 15 nt, Human
gagccagauuucacu

SEQ ID NO: 3133335 - RNA, 19 nt, Human
gagccagauuucacucucc

SEQ ID NO: 3133336 - RNA, 18 nt, Human
gagccagauuucacucuc

SEQ ID NO: 3133337 - RNA, 13 nt, Human
gagccuccugccc

SEQ ID NO: 3133338 - RNA, 12 nt, Human
gagccugcaguu

SEQ ID NO: 3133339 - RNA, 17 nt, Human
gagccucagcauccugg

SEQ ID NO: 3133340 - RNA, 14 nt, Human
gagccucagcaucc

SEQ ID NO: 3133341 - RNA, 15 nt, Human
gagccucagcauccu

SEQ ID NO: 3133342 - RNA, 13 nt, Human
gagccucagcauc

SEQ ID NO: 3133343 - RNA, 21 nt, Human
gagccgagaucacgccacugc

SEQ ID NO: 3133344 - RNA, 22 nt, Human
gagccgagaucacgccacugca

SEQ ID NO: 3133345 - RNA, 19 nt, Human
gagccgagaucacgccacu

SEQ ID NO: 3133346 - RNA, 20 nt, Human
gagccgagaucacgccacug

SEQ ID NO: 3133347 - RNA, 18 nt, Human
gagcccacgcccccacug

SEQ ID NO: 3133348 - RNA, 15 nt, Human
gagccugcaguuauu

SEQ ID NO: 3133349 - RNA, 17 nt, Human
gagcuagcagcagggag

SEQ ID NO: 3133350 - RNA, 15 nt, Human
gagcuagcagcaggg

SEQ ID NO: 3133351 - RNA, 15 nt, Human
gagcugaguggggga

SEQ ID NO: 3133352 - RNA, 14 nt, Human
gaggaacaaggcaa

SEQ ID NO: 3133353 - RNA, 16 nt, Human
gaggaacaaggcaagg

SEQ ID NO: 3133354 - RNA, 17 nt, Human
gaggaagagaaaaaaua

SEQ ID NO: 3133355 - RNA, 13 nt, Human
gaggaagccgcug

SEQ ID NO: 3133356 - RNA, 18 nt, Human
gaggaagccgcuggggcc

SEQ ID NO: 3133357 - RNA, 17 nt, Human
gaggaagccgcuggggc

SEQ ID NO: 3133358 - RNA, 14 nt, Human
gaggaagccgcugg

SEQ ID NO: 3133359 - RNA, 17 nt, Human
gaggaaagcaaaggaga

SEQ ID NO: 3133360 - RNA, 16 nt, Human
gaggaaagcaaaggag

SEQ ID NO: 3133361 - RNA, 22 nt, Human
gagcuuucugcuaucaaagagg

SEQ ID NO: 3133362 - RNA, 20 nt, Human
gagcuuugaaaauucagugg

SEQ ID NO: 3133363 - RNA, 14 nt, Human
gacuuggaagcucc

SEQ ID NO: 3133364 - RNA, 15 nt, Human
gacuuggaagcuccg

SEQ ID NO: 3133365 - RNA, 16 nt, Human
gacuuggaagcuccgc

SEQ ID NO: 3133366 - RNA, 19 nt, Human
gacucgcgacaaugcaaac

SEQ ID NO: 3133367 - RNA, 18 nt, Human
gacucgcgacaaugcaaa

SEQ ID NO: 3133368 - RNA, 17 nt, Human
gacuccugcaggcagcc

SEQ ID NO: 3133369 - RNA, 21 nt, Human
gagaaaauggacguguuauga

SEQ ID NO: 3133370 - RNA, 13 nt, Human
gacuuggaagcuc

SEQ ID NO: 3133371 - RNA, 23 nt, Human
gagaaaguacuucuccacccugc

SEQ ID NO: 3133372 - RNA, 22 nt, Human
gagaaaguacuucuccacccug

SEQ ID NO: 3133373 - RNA, 17 nt, Human
gagacacaagccuucgg

SEQ ID NO: 3133374 - RNA, 15 nt, Human
gagacacaagccuuc

SEQ ID NO: 3133375 - RNA, 19 nt, Human
gagacagaguuuucacucu

SEQ ID NO: 3133376 - RNA, 12 nt, Human
gagacagcccgg

SEQ ID NO: 3133377 - RNA, 21 nt, Human
gagaaugcacaaacagaggcc

SEQ ID NO: 3133378 - RNA, 20 nt, Human
gagaaugcacaaacagaggc

SEQ ID NO: 3133379 - RNA, 14 nt, Human
gagacucugucuca

SEQ ID NO: 3133380 - RNA, 13 nt, Human
gagacucugucuc

SEQ ID NO: 3133381 - RNA, 16 nt, Human
gagacucgcgacaaug

SEQ ID NO: 3133382 - RNA, 22 nt, Human
gagacuccugcaggcagccagg

SEQ ID NO: 3133383 - RNA, 24 nt, Human
gagacagcccgggcucugccuccc

SEQ ID NO: 3133384 - RNA, 23 nt, Human
gagacagcccgggcucugccucc

SEQ ID NO: 3133385 - RNA, 22 nt, Human
gagacagcccgggcucugccuc

SEQ ID NO: 3133386 - RNA, 21 nt, Human
gagacagcccgggcucugccu

SEQ ID NO: 3133387 - RNA, 20 nt, Human
gagacagcccgggcucugcc

SEQ ID NO: 3133388 - RNA, 19 nt, Human
gagacagcccgggcucugc

SEQ ID NO: 3133389 - RNA, 18 nt, Human
gagacagcccgggcucug

SEQ ID NO: 3133390 - RNA, 17 nt, Human
gagacagcccgggcucu

SEQ ID NO: 3133391 - RNA, 14 nt, Human
gagacagcccgggc

SEQ ID NO: 3133392 - RNA, 17 nt, Human
gagagaagagaaugcac

SEQ ID NO: 3133393 - RNA, 13 nt, Human
gagagccuuccag

SEQ ID NO: 3133394 - RNA, 13 nt, Human
gagaggggaacag

SEQ ID NO: 3133395 - RNA, 21 nt, Human
gagagggugggagugggccca

SEQ ID NO: 3133396 - RNA, 20 nt, Human
gagagggugggagugggccc

SEQ ID NO: 3133397 - RNA, 14 nt, Human
gaagucuuuguaca

SEQ ID NO: 3133398 - RNA, 16 nt, Human
gaagucuuuguacaga

SEQ ID NO: 3133399 - RNA, 21 nt, Human
gacaaggauugcuacuguccu

SEQ ID NO: 3133400 - RNA, 22 nt, Human
gacaaggauugcuacuguccua

SEQ ID NO: 3133401 - RNA, 16 nt, Human
gacaaugacccagugg

SEQ ID NO: 3133402 - RNA, 12 nt, Human
gacacaggcccg

SEQ ID NO: 3133403 - RNA, 15 nt, Human
gacacaggcccggcu

SEQ ID NO: 3133404 - RNA, 17 nt, Human
gacacaggcccggcucc

SEQ ID NO: 3133405 - RNA, 22 nt, Human
gacacaagccuucggcgccuua

SEQ ID NO: 3133406 - RNA, 13 nt, Human
gacaauuuauuau

SEQ ID NO: 3133407 - RNA, 19 nt, Human
gacaauuuauuauggcaca

SEQ ID NO: 3133408 - RNA, 12 nt, Human
gacaauuuauua

SEQ ID NO: 3133409 - RNA, 18 nt, Human
gacaaugcaaaccaucau

SEQ ID NO: 3133410 - RNA, 16 nt, Human
gacaaugcaaaccauc

SEQ ID NO: 3133411 - RNA, 17 nt, Human
gacaaugacuuacugua

SEQ ID NO: 3133412 - RNA, 20 nt, Human
gacaaugacuuacuguacau

SEQ ID NO: 3133413 - RNA, 12 nt, Human
gacaaugcaaac

SEQ ID NO: 3133414 - RNA, 21 nt, Human
gacaaugacuuacuguacaug

SEQ ID NO: 3133415 - RNA, 15 nt, Human
gacacgaauauugcu

SEQ ID NO: 3133416 - RNA, 18 nt, Human
gacaccuugacagggcac

SEQ ID NO: 3133417 - RNA, 20 nt, Human
gacaccuugacagggcacac

SEQ ID NO: 3133418 - RNA, 15 nt, Human
gacaccuugacaggg

SEQ ID NO: 3133419 - RNA, 17 nt, Human
gacaccuugacagggca

SEQ ID NO: 3133420 - RNA, 19 nt, Human
gacacgaauauugcugaug

SEQ ID NO: 3133421 - RNA, 18 nt, Human
gacacgaauauugcugau

SEQ ID NO: 3133422 - RNA, 17 nt, Human
gacacgaauauugcuga

SEQ ID NO: 3133423 - RNA, 15 nt, Human
gacacuaaccacgcu

SEQ ID NO: 3133424 - RNA, 16 nt, Human
gacacuaaccacgcug

SEQ ID NO: 3133425 - RNA, 17 nt, Human
gacacuaaccacgcugg

SEQ ID NO: 3133426 - RNA, 18 nt, Human
gacacuaaccacgcugga

SEQ ID NO: 3133427 - RNA, 13 nt, Human
gacacccugugau

SEQ ID NO: 3133428 - RNA, 12 nt, Human
gacacccuguga

SEQ ID NO: 3133429 - RNA, 18 nt, Human
gacacaggcccggcucca

SEQ ID NO: 3133430 - RNA, 23 nt, Human
gacacccugugauggggcccugc

SEQ ID NO: 3133431 - RNA, 22 nt, Human
gacacccugugauggggcccug

SEQ ID NO: 3133432 - RNA, 15 nt, Human
gacauacuaaccagc

SEQ ID NO: 3133433 - RNA, 16 nt, Human
gacauacuaaccagca

SEQ ID NO: 3133434 - RNA, 23 nt, Human
gacauacuaaccagcagaaaugc

SEQ ID NO: 3133435 - RNA, 21 nt, Human
gacaugucuuuucuugcauga

SEQ ID NO: 3133436 - RNA, 17 nt, Human
gacaugucuuuucuugc

SEQ ID NO: 3133437 - RNA, 21 nt, Human
gacaggcaagcaccuccugcc

SEQ ID NO: 3133438 - RNA, 14 nt, Human
gacaggcaaugcug

SEQ ID NO: 3133439 - RNA, 16 nt, Human
gacaggcaaugcuggc

SEQ ID NO: 3133440 - RNA, 24 nt, Human
gacaggcaaugcuggcuguuggcu

SEQ ID NO: 3133441 - RNA, 17 nt, Human
gacaggcaaugcuggcu

SEQ ID NO: 3133442 - RNA, 18 nt, Human
gacaggcauguucucuga

SEQ ID NO: 3133443 - RNA, 19 nt, Human
gacaggcauguucucugag

SEQ ID NO: 3133444 - RNA, 15 nt, Human
gacagcugccuggga

SEQ ID NO: 3133445 - RNA, 14 nt, Human
gacagcugccuggg

SEQ ID NO: 3133446 - RNA, 21 nt, Human
gacagcugccugggaucccuc

SEQ ID NO: 3133447 - RNA, 12 nt, Human
gacagacacagg

SEQ ID NO: 3133448 - RNA, 14 nt, Human
gacagacacaggcc

SEQ ID NO: 3133449 - RNA, 20 nt, Human
gacacuaaccacgcuggacc

SEQ ID NO: 3133450 - RNA, 15 nt, Human
gacagacacaggccc

SEQ ID NO: 3133451 - RNA, 16 nt, Human
gacagacacaggcccg

SEQ ID NO: 3133452 - RNA, 13 nt, Human
gacagcugccugg

SEQ ID NO: 3133453 - RNA, 12 nt, Human
gacagcugccug

SEQ ID NO: 3133454 - RNA, 22 nt, Human
gacguguuaugacuccagaauu

SEQ ID NO: 3133455 - RNA, 12 nt, Human
gacuacaggcac

SEQ ID NO: 3133456 - RNA, 17 nt, Human
gacuacucccccaggug

SEQ ID NO: 3133457 - RNA, 14 nt, Human
gacuccugcaggca

SEQ ID NO: 3133458 - RNA, 16 nt, Human
gacuccugcaggcagc

SEQ ID NO: 3133459 - RNA, 15 nt, Human
gacuccugcaggcag

SEQ ID NO: 3133460 - RNA, 14 nt, Human
gacggagucccacc

SEQ ID NO: 3133461 - RNA, 18 nt, Human
gacggagucccaccuugg

SEQ ID NO: 3133462 - RNA, 21 nt, Human
gacggagucccaccuuggcug

SEQ ID NO: 3133463 - RNA, 20 nt, Human
gacguguuaugacuccagaa

SEQ ID NO: 3133464 - RNA, 17 nt, Human
gacguguuaugacucca

SEQ ID NO: 3133465 - RNA, 15 nt, Human
gacguguuaugacuc

SEQ ID NO: 3133466 - RNA, 23 nt, Human
gaccuugaacuggguacuugugg

SEQ ID NO: 3133467 - RNA, 21 nt, Human
gaccuuucaauaggaaaaacu

SEQ ID NO: 3133468 - RNA, 13 nt, Human
gaccccuccaugu

SEQ ID NO: 3133469 - RNA, 18 nt, Human
gacccugaggcccagagg

SEQ ID NO: 3133470 - RNA, 21 nt, Human
gacccugaggcccagagggcc

SEQ ID NO: 3133471 - RNA, 12 nt, Human
gacccugcccug

SEQ ID NO: 3133472 - RNA, 20 nt, Human
gacccugaggcccagagggc

SEQ ID NO: 3133473 - RNA, 19 nt, Human
gacccugaggcccagaggg

SEQ ID NO: 3133474 - RNA, 15 nt, Human
gacccugcccugugg

SEQ ID NO: 3133475 - RNA, 13 nt, Human
gacccugcccugu

SEQ ID NO: 3133476 - RNA, 16 nt, Human
gacccugcccuguggg

SEQ ID NO: 3133477 - RNA, 23 nt, Human
gacccugucucaaaaaaagaaaa

SEQ ID NO: 3133478 - RNA, 13 nt, Human
gacccaugcugcc

SEQ ID NO: 3133479 - RNA, 15 nt, Human
gacccaugcugcccu

SEQ ID NO: 3133480 - RNA, 14 nt, Human
gacccaugcugccc

SEQ ID NO: 3133481 - RNA, 16 nt, Human
gacccaugcugcccug

SEQ ID NO: 3133482 - RNA, 11 nt, Human
gacccacugcu

SEQ ID NO: 3133483 - RNA, 19 nt, Human
gaccgugaggccagagaca

SEQ ID NO: 3133484 - RNA, 14 nt, Human
gaccgugaggccag

SEQ ID NO: 3133485 - RNA, 21 nt, Human
gaccugaggcccuucucucca

SEQ ID NO: 3133486 - RNA, 18 nt, Human
gaccugaggcccuucucu

SEQ ID NO: 3133487 - RNA, 15 nt, Human
gaccugaggcccuuc

SEQ ID NO: 3133488 - RNA, 14 nt, Human
gaccugaggcccuu

SEQ ID NO: 3133489 - RNA, 12 nt, Human
gaccucaggccu

SEQ ID NO: 3133490 - RNA, 11 nt, Human
gaccucaggcc

SEQ ID NO: 3133491 - RNA, 17 nt, Human
gaucauccacugugcca

SEQ ID NO: 3133492 - RNA, 19 nt, Human
gaucauccacugugccaug

SEQ ID NO: 3133493 - RNA, 16 nt, Human
gaucauccacugugcc

SEQ ID NO: 3133494 - RNA, 21 nt, Human
gaucauccacugugccaugug

SEQ ID NO: 3133495 - RNA, 22 nt, Human
gaucagucugauucccaagcuc

SEQ ID NO: 3133496 - RNA, 15 nt, Human
gaucagccugggcaa

SEQ ID NO: 3133497 - RNA, 12 nt, Human
gaucagccuggg

SEQ ID NO: 3133498 - RNA, 12 nt, Human
gaucacggcuca

SEQ ID NO: 3133499 - RNA, 16 nt, Human
gaucacgccacugcac

SEQ ID NO: 3133500 - RNA, 18 nt, Human
gaucacgccacugcacua

SEQ ID NO: 3133501 - RNA, 21 nt, Human
gaggaaggaaacccagcucug

SEQ ID NO: 3133502 - RNA, 20 nt, Human
gaggaaggaaacccagcucu

SEQ ID NO: 3133503 - RNA, 19 nt, Human
gaggaaggaaacccagcuc

SEQ ID NO: 3133504 - RNA, 13 nt, Human
gaggaaggaaacc

SEQ ID NO: 3133505 - RNA, 22 nt, Human
gauagcacagacccugcccugu

SEQ ID NO: 3133506 - RNA, 21 nt, Human
gauagcacagacccugcccug

SEQ ID NO: 3133507 - RNA, 20 nt, Human
gauagcacagacccugcccu

SEQ ID NO: 3133508 - RNA, 18 nt, Human
gauacaggaaaagcugcu

SEQ ID NO: 3133509 - RNA, 14 nt, Human
gauaauacaccacu

SEQ ID NO: 3133510 - RNA, 18 nt, Human
gauaauacaccacuacau

SEQ ID NO: 3133511 - RNA, 21 nt, Human
gauaauacaccacuacauucu

SEQ ID NO: 3133512 - RNA, 22 nt, Human
gauaauacaccacuacauucug

SEQ ID NO: 3133513 - RNA, 16 nt, Human
gaucccucauccucau

SEQ ID NO: 3133514 - RNA, 15 nt, Human
gaucccucauccuca

SEQ ID NO: 3133515 - RNA, 22 nt, Human
gauccugagccagauuucacuc

SEQ ID NO: 3133516 - RNA, 21 nt, Human
gauccugagccagauuucacu

SEQ ID NO: 3133517 - RNA, 18 nt, Human
gaucuuugcagacaggca

SEQ ID NO: 3133518 - RNA, 17 nt, Human
gaucuuugcagacaggc

SEQ ID NO: 3133519 - RNA, 13 nt, Human
gauggggcccugc

SEQ ID NO: 3133520 - RNA, 22 nt, Human
gauggggcccugccuccuuugu

SEQ ID NO: 3133521 - RNA, 14 nt, Human
gauggggcccugcc

SEQ ID NO: 3133522 - RNA, 20 nt, Human
gaugccugguggcagcugcg

SEQ ID NO: 3133523 - RNA, 18 nt, Human
gaugccugguggcagcug

SEQ ID NO: 3133524 - RNA, 19 nt, Human
gaugccugguggcagcugc

SEQ ID NO: 3133525 - RNA, 22 nt, Human
gauggauuuccagccaaagccu

SEQ ID NO: 3133526 - RNA, 17 nt, Human
gaugccugguggcagcu

SEQ ID NO: 3133527 - RNA, 12 nt, Human
gaugcagccuca

SEQ ID NO: 3133528 - RNA, 14 nt, Human
gaugcagccucaca

SEQ ID NO: 3133529 - RNA, 13 nt, Human
gaugcaccagccc

SEQ ID NO: 3133530 - RNA, 21 nt, Human
gaugcacagaguuguuacauu

SEQ ID NO: 3133531 - RNA, 22 nt, Human
gaugcacagaguuguuacauuu

SEQ ID NO: 3133532 - RNA, 23 nt, Human
gcaaugaccuuucaauaggaaaa

SEQ ID NO: 3133533 - RNA, 13 nt, Human
gcaaugcuggcug

SEQ ID NO: 3133534 - RNA, 14 nt, Human
gcaaugcuggcugu

SEQ ID NO: 3133535 - RNA, 22 nt, Human
gcaaugcuggcuguuggcuggg

SEQ ID NO: 3133536 - RNA, 23 nt, Human
gcaaugcuggcuguuggcugggg

SEQ ID NO: 3133537 - RNA, 17 nt, Human
gcaaucaaaucugcuuu

SEQ ID NO: 3133538 - RNA, 15 nt, Human
gcaaucaaaucugcu

SEQ ID NO: 3133539 - RNA, 22 nt, Human
gcaaugaccuuucaauaggaaa

SEQ ID NO: 3133540 - RNA, 20 nt, Human
gcaaugaccuuucaauagga

SEQ ID NO: 3133541 - RNA, 17 nt, Human
gcaaugaccuuucaaua

SEQ ID NO: 3133542 - RNA, 15 nt, Human
gcaaugaccuuucaa

SEQ ID NO: 3133543 - RNA, 18 nt, Human
gcaaggagauuuacaacu

SEQ ID NO: 3133544 - RNA, 11 nt, Human
gcaaggcuguc

SEQ ID NO: 3133545 - RNA, 16 nt, Human
gcaaaguaucccuacu

SEQ ID NO: 3133546 - RNA, 23 nt, Human
gcaagacgcugugcugcccugcc

SEQ ID NO: 3133547 - RNA, 22 nt, Human
gcaagacgcugugcugcccugc

SEQ ID NO: 3133548 - RNA, 21 nt, Human
gcaagacgcugugcugcccug

SEQ ID NO: 3133549 - RNA, 20 nt, Human
gcaagacgcugugcugcccu

SEQ ID NO: 3133550 - RNA, 14 nt, Human
gcaagacgcugugc

SEQ ID NO: 3133551 - RNA, 17 nt, Human
gcaagaauugaagcagg

SEQ ID NO: 3133552 - RNA, 15 nt, Human
gauuuccguuaaaau

SEQ ID NO: 3133553 - RNA, 11 nt, Human
gauuucuguuu

SEQ ID NO: 3133554 - RNA, 19 nt, Human
gauuucuguuuagauaaua

SEQ ID NO: 3133555 - RNA, 21 nt, Human
gauugcaacaggcugggcuuc

SEQ ID NO: 3133556 - RNA, 23 nt, Human
gauugcaccacugcacuccagcc

SEQ ID NO: 3133557 - RNA, 16 nt, Human
gauugcaccacugcac

SEQ ID NO: 3133558 - RNA, 20 nt, Human
gauugcaacaggcugggcuu

SEQ ID NO: 3133559 - RNA, 18 nt, Human
gauucuuuccugaggcug

SEQ ID NO: 3133560 - RNA, 17 nt, Human
gauucuuuccugaggcu

SEQ ID NO: 3133561 - RNA, 16 nt, Human
gauucuuuccugaggc

SEQ ID NO: 3133562 - RNA, 12 nt, Human
gauucuuuccug

SEQ ID NO: 3133563 - RNA, 19 nt, Human
gauucccaagcucugcucc

SEQ ID NO: 3133564 - RNA, 20 nt, Human
gauucccaagcucugcuccu

SEQ ID NO: 3133565 - RNA, 19 nt, Human
gauucagacagcugccugg

SEQ ID NO: 3133566 - RNA, 15 nt, Human
gauucagcucugcaa

SEQ ID NO: 3133567 - RNA, 13 nt, Human
gauucagcucugc

SEQ ID NO: 3133568 - RNA, 19 nt, Human
gauggggcugcaccggcug

SEQ ID NO: 3133569 - RNA, 23 nt, Human
gauggggcugcaccggcuggccu

SEQ ID NO: 3133570 - RNA, 17 nt, Human
gauucauauuuacuucu

SEQ ID NO: 3133571 - RNA, 18 nt, Human
gauucauauuuacuucuu

SEQ ID NO: 3133572 - RNA, 19 nt, Human
gauucauauuuacuucuua

SEQ ID NO: 3133573 - RNA, 18 nt, Human
gauucccaagcucugcuc

SEQ ID NO: 3133574 - RNA, 13 nt, Human
gcagcccugcaga

SEQ ID NO: 3133575 - RNA, 21 nt, Human
gcagccccuguucuggcagag

SEQ ID NO: 3133576 - RNA, 20 nt, Human
gcagccccuguucuggcaga

SEQ ID NO: 3133577 - RNA, 17 nt, Human
gcagccccauucugccu

SEQ ID NO: 3133578 - RNA, 16 nt, Human
gcagcaauaaagcagc

SEQ ID NO: 3133579 - RNA, 23 nt, Human
gcagcaauaaagcagcguuucua

SEQ ID NO: 3133580 - RNA, 18 nt, Human
gcagccccauucugccug

SEQ ID NO: 3133581 - RNA, 19 nt, Human
gcagccccauucugccugc

SEQ ID NO: 3133582 - RNA, 21 nt, Human
gcagccccauucugccugccc

SEQ ID NO: 3133583 - RNA, 24 nt, Human
gcagccccauucugccugcccagg

SEQ ID NO: 3133584 - RNA, 22 nt, Human
gcagauacaggaaaagcugcug

SEQ ID NO: 3133585 - RNA, 12 nt, Human
gcagcaauaaag

SEQ ID NO: 3133586 - RNA, 17 nt, Human
gcagacaguuaagagaa

SEQ ID NO: 3133587 - RNA, 21 nt, Human
gcagaguugaagacagagcua

SEQ ID NO: 3133588 - RNA, 20 nt, Human
gcagaguugaagacagagcu

SEQ ID NO: 3133589 - RNA, 12 nt, Human
gcaggcagccag

SEQ ID NO: 3133590 - RNA, 14 nt, Human
gcaggcagccaggc

SEQ ID NO: 3133591 - RNA, 13 nt, Human
gcaggcagccagg

SEQ ID NO: 3133592 - RNA, 20 nt, Human
gcaggaggaucacuugaguc

SEQ ID NO: 3133593 - RNA, 23 nt, Human
gcaggaggaucacuugaguccag

SEQ ID NO: 3133594 - RNA, 14 nt, Human
gcagcucaccucuc

SEQ ID NO: 3133595 - RNA, 15 nt, Human
gcagccuuggcaaac

SEQ ID NO: 3133596 - RNA, 15 nt, Human
gcagcucaccucucc

SEQ ID NO: 3133597 - RNA, 17 nt, Human
gcagcccugcagagggc

SEQ ID NO: 3133598 - RNA, 16 nt, Human
gcagcccugcagaggg

SEQ ID NO: 3133599 - RNA, 15 nt, Human
gcagcccugcagagg

SEQ ID NO: 3133600 - RNA, 14 nt, Human
gcagcccugcagag

SEQ ID NO: 3133601 - RNA, 14 nt, Human
gcaauggcagccuu

SEQ ID NO: 3133602 - RNA, 20 nt, Human
gcaccacugcacuccagccu

SEQ ID NO: 3133603 - RNA, 12 nt, Human
gcaauggcagcc

SEQ ID NO: 3133604 - RNA, 13 nt, Human
gcaauggcagccu

SEQ ID NO: 3133605 - RNA, 14 nt, Human
gcaccagcagccug

SEQ ID NO: 3133606 - RNA, 15 nt, Human
gcaccagcagccugg

SEQ ID NO: 3133607 - RNA, 22 nt, Human
gcaccacugcacuccagccugg

SEQ ID NO: 3133608 - RNA, 21 nt, Human
gcaccacugcacuccagccug

SEQ ID NO: 3133609 - RNA, 16 nt, Human
gcaccagcagccugga

SEQ ID NO: 3133610 - RNA, 22 nt, Human
gcacccaccaucaugucuggcu

SEQ ID NO: 3133611 - RNA, 18 nt, Human
gcacccggccccugcugg

SEQ ID NO: 3133612 - RNA, 19 nt, Human
gcacccggccccugcuggu

SEQ ID NO: 3133613 - RNA, 22 nt, Human
gcaccuggaauauauaaccagu

SEQ ID NO: 3133614 - RNA, 17 nt, Human
gcaccuuagacaguccc

SEQ ID NO: 3133615 - RNA, 14 nt, Human
gcaccuuagacagu

SEQ ID NO: 3133616 - RNA, 15 nt, Human
gcacccucaggcagg

SEQ ID NO: 3133617 - RNA, 18 nt, Human
gcaccuggaauauauaac

SEQ ID NO: 3133618 - RNA, 21 nt, Human
gcaccuggaauauauaaccag

SEQ ID NO: 3133619 - RNA, 18 nt, Human
gcaccuuagacagucccu

SEQ ID NO: 3133620 - RNA, 12 nt, Human
gcacgauuucug

SEQ ID NO: 3133621 - RNA, 23 nt, Human
gcagacaggcaagcaccuccugc

SEQ ID NO: 3133622 - RNA, 19 nt, Human
gcagacaggcaagcaccuc

SEQ ID NO: 3133623 - RNA, 14 nt, Human
gcagacaggcaagc

SEQ ID NO: 3133624 - RNA, 15 nt, Human
gcagacaggaccagg

SEQ ID NO: 3133625 - RNA, 13 nt, Human
gcagacaggacca

SEQ ID NO: 3133626 - RNA, 12 nt, Human
gcagacaggacc

SEQ ID NO: 3133627 - RNA, 20 nt, Human
gcacugcuuccagugaggcu

SEQ ID NO: 3133628 - RNA, 18 nt, Human
gcacugcuuccagugagg

SEQ ID NO: 3133629 - RNA, 16 nt, Human
gcacugcuuccaguga

SEQ ID NO: 3133630 - RNA, 19 nt, Human
gcagggcucagcggggaca

SEQ ID NO: 3133631 - RNA, 21 nt, Human
gcagggcucagcggggacagc

SEQ ID NO: 3133632 - RNA, 16 nt, Human
gcaggcagccaggcca

SEQ ID NO: 3133633 - RNA, 15 nt, Human
gcaggcagccaggcc

SEQ ID NO: 3133634 - RNA, 17 nt, Human
gcagggucucacucugu

SEQ ID NO: 3133635 - RNA, 18 nt, Human
gcagggucucacucuguc

SEQ ID NO: 3133636 - RNA, 22 nt, Human
gcaggggaggguagagcggaga

SEQ ID NO: 3133637 - RNA, 14 nt, Human
gcagggcucagcgg

SEQ ID NO: 3133638 - RNA, 16 nt, Human
gcagugcaugcugucc

SEQ ID NO: 3133639 - RNA, 15 nt, Human
gcagugcaugcuguc

SEQ ID NO: 3133640 - RNA, 22 nt, Human
gcagguccaggguuugaguuca

SEQ ID NO: 3133641 - RNA, 19 nt, Human
gcaggucuugaacuccugg

SEQ ID NO: 3133642 - RNA, 20 nt, Human
gcaggucuugaacuccuggc

SEQ ID NO: 3133643 - RNA, 22 nt, Human
gcaguggugguuuucuguucuu

SEQ ID NO: 3133644 - RNA, 23 nt, Human
gcaguggugguuuucuguucuuu

SEQ ID NO: 3133645 - RNA, 13 nt, Human
gcagugggagcug

SEQ ID NO: 3133646 - RNA, 12 nt, Human
gcagugggagcu

SEQ ID NO: 3133647 - RNA, 14 nt, Human
gcagugggagcugc

SEQ ID NO: 3133648 - RNA, 15 nt, Human
gcagugggagcugcc

SEQ ID NO: 3133649 - RNA, 17 nt, Human
gcaguuauuaacacuaa

SEQ ID NO: 3133650 - RNA, 13 nt, Human
gccaaagccaaag

SEQ ID NO: 3133651 - RNA, 20 nt, Human
gccaaagccaaagcuaggcc

SEQ ID NO: 3133652 - RNA, 19 nt, Human
gccaaagccuccuccagcc

SEQ ID NO: 3133653 - RNA, 16 nt, Human
gccaaagccuccucca

SEQ ID NO: 3133654 - RNA, 16 nt, Human
gccaaagcuaggccug

SEQ ID NO: 3133655 - RNA, 22 nt, Human
gccaaagcuaggccuggccaga

SEQ ID NO: 3133656 - RNA, 18 nt, Human
gcauuuguuugaacugau

SEQ ID NO: 3133657 - RNA, 16 nt, Human
gccaaacucaccugcc

SEQ ID NO: 3133658 - RNA, 14 nt, Human
gccaaacucaccug

SEQ ID NO: 3133659 - RNA, 21 nt, Human
gcauuugaggucuguucuuuc

SEQ ID NO: 3133660 - RNA, 13 nt, Human
gcauuugcugaau

SEQ ID NO: 3133661 - RNA, 14 nt, Human
gcauuugcugaaua

SEQ ID NO: 3133662 - RNA, 16 nt, Human
gcauuuguuugaacug

SEQ ID NO: 3133663 - RNA, 17 nt, Human
gcauuaucuagauacug

SEQ ID NO: 3133664 - RNA, 14 nt, Human
gcauguucucugag

SEQ ID NO: 3133665 - RNA, 15 nt, Human
gcauguucucugagg

SEQ ID NO: 3133666 - RNA, 21 nt, Human
gcauguucucugaggacacua

SEQ ID NO: 3133667 - RNA, 22 nt, Human
gcauguucucugaggacacuaa

SEQ ID NO: 3133668 - RNA, 18 nt, Human
gcaugcgggcuuccuccu

SEQ ID NO: 3133669 - RNA, 22 nt, Human
gcccaguuggguggaugccugg

SEQ ID NO: 3133670 - RNA, 15 nt, Human
gcccagagagggugg

SEQ ID NO: 3133671 - RNA, 21 nt, Human
gcccagagaggguggugaccu

SEQ ID NO: 3133672 - RNA, 23 nt, Human
gcccaggccccugccacccuggg

SEQ ID NO: 3133673 - RNA, 13 nt, Human
gcccaggccuccu

SEQ ID NO: 3133674 - RNA, 22 nt, Human
gcccaggccccugccacccugg

SEQ ID NO: 3133675 - RNA, 12 nt, Human
gcccaggcuggc

SEQ ID NO: 3133676 - RNA, 14 nt, Human
gccccauucugccu

SEQ ID NO: 3133677 - RNA, 22 nt, Human
gccccauccucuguacagagcc

SEQ ID NO: 3133678 - RNA, 14 nt, Human
gccccauccucugu

SEQ ID NO: 3133679 - RNA, 13 nt, Human
gccccauccucug

SEQ ID NO: 3133680 - RNA, 21 nt, Human
gccccagugcccacaggauca

SEQ ID NO: 3133681 - RNA, 13 nt, Human
gccccagugccca

SEQ ID NO: 3133682 - RNA, 14 nt, Human
gccccagugcccac

SEQ ID NO: 3133683 - RNA, 18 nt, Human
gccccaucccaaacccuu

SEQ ID NO: 3133684 - RNA, 12 nt, Human
gccccagugccc

SEQ ID NO: 3133685 - RNA, 18 nt, Human
gcccucugcccacucccu

SEQ ID NO: 3133686 - RNA, 16 nt, Human
gcccucugcccacucc

SEQ ID NO: 3133687 - RNA, 13 nt, Human
gcccucugcccac

SEQ ID NO: 3133688 - RNA, 13 nt, Human
gcccugcagaggg

SEQ ID NO: 3133689 - RNA, 14 nt, Human
gcccugcagagggc

SEQ ID NO: 3133690 - RNA, 15 nt, Human
gcccugcagagggca

SEQ ID NO: 3133691 - RNA, 23 nt, Human
gcccuccaagaccuucuccuuca

SEQ ID NO: 3133692 - RNA, 22 nt, Human
gcccuccaagaccuucuccuuc

SEQ ID NO: 3133693 - RNA, 21 nt, Human
gcccuccaagaccuucuccuu

SEQ ID NO: 3133694 - RNA, 19 nt, Human
gcccuccaagaccuucucc

SEQ ID NO: 3133695 - RNA, 15 nt, Human
gccccgaggccuucu

SEQ ID NO: 3133696 - RNA, 23 nt, Human
gccccucaacucuccuccagagu

SEQ ID NO: 3133697 - RNA, 18 nt, Human
gccccgaggccuucucug

SEQ ID NO: 3133698 - RNA, 14 nt, Human
gccccucagggucc

SEQ ID NO: 3133699 - RNA, 16 nt, Human
gccccucagggucccu

SEQ ID NO: 3133700 - RNA, 20 nt, Human
gccccuucugacccaugcug

SEQ ID NO: 3133701 - RNA, 11 nt, Human
gccaggaagcc

SEQ ID NO: 3133702 - RNA, 20 nt, Human
gccaggaagccagcaggcuc

SEQ ID NO: 3133703 - RNA, 16 nt, Human
gccaggagccuccugc

SEQ ID NO: 3133704 - RNA, 14 nt, Human
gccaggagccuccu

SEQ ID NO: 3133705 - RNA, 20 nt, Human
gccaggagccuccugcccuu

SEQ ID NO: 3133706 - RNA, 19 nt, Human
gccaggagccuccugcccu

SEQ ID NO: 3133707 - RNA, 16 nt, Human
gccagcugcuugggcu

SEQ ID NO: 3133708 - RNA, 18 nt, Human
gccagcugcuugggcuuc

SEQ ID NO: 3133709 - RNA, 17 nt, Human
gccagcugcuugggcuu

SEQ ID NO: 3133710 - RNA, 14 nt, Human
gccaggaagccagc

SEQ ID NO: 3133711 - RNA, 13 nt, Human
gccaggaagccag

SEQ ID NO: 3133712 - RNA, 12 nt, Human
gccaggaagcca

SEQ ID NO: 3133713 - RNA, 20 nt, Human
gccagcugcuugggcuucau

SEQ ID NO: 3133714 - RNA, 19 nt, Human
gccagauucuuuccugagg

SEQ ID NO: 3133715 - RNA, 21 nt, Human
gccagccgagauagccaaggc

SEQ ID NO: 3133716 - RNA, 22 nt, Human
gccagccgagauagccaaggcc

SEQ ID NO: 3133717 - RNA, 20 nt, Human
gccagauucuuuccugaggc

SEQ ID NO: 3133718 - RNA, 13 nt, Human
gccagauuucacu

SEQ ID NO: 3133719 - RNA, 24 nt, Human
gccagauucuuuccugaggcuggg

SEQ ID NO: 3133720 - RNA, 14 nt, Human
gccagaugcaccag

SEQ ID NO: 3133721 - RNA, 20 nt, Human
gccacugcaccgggccacag

SEQ ID NO: 3133722 - RNA, 21 nt, Human
gccacugcaccgggccacaga

SEQ ID NO: 3133723 - RNA, 19 nt, Human
gccacugcaccgggccaca

SEQ ID NO: 3133724 - RNA, 22 nt, Human
gccagagacacaagccuucggc

SEQ ID NO: 3133725 - RNA, 21 nt, Human
gccagagacacaagccuucgg

SEQ ID NO: 3133726 - RNA, 20 nt, Human
gccaaggccaaaggaagcac

SEQ ID NO: 3133727 - RNA, 19 nt, Human
gccaaggccaaaggaagca

SEQ ID NO: 3133728 - RNA, 24 nt, Human
gccaaggccaaaggaagcacaugc

SEQ ID NO: 3133729 - RNA, 15 nt, Human
gccaugggccuccug

SEQ ID NO: 3133730 - RNA, 16 nt, Human
gccaugggccuccugu

SEQ ID NO: 3133731 - RNA, 16 nt, Human
gcccaccuggccucug

SEQ ID NO: 3133732 - RNA, 15 nt, Human
gcccaccuggccucu

SEQ ID NO: 3133733 - RNA, 24 nt, Human
gcccaccuggccucugcacucccc

SEQ ID NO: 3133734 - RNA, 21 nt, Human
gcccaccuggccucugcacuc

SEQ ID NO: 3133735 - RNA, 20 nt, Human
gcccaccuggccucugcacu

SEQ ID NO: 3133736 - RNA, 17 nt, Human
gcccaccuggccucugc

SEQ ID NO: 3133737 - RNA, 13 nt, Human
gcccaccuuggcu

SEQ ID NO: 3133738 - RNA, 15 nt, Human
gcccaccuuggcuca

SEQ ID NO: 3133739 - RNA, 16 nt, Human
gcccaccuuggcucaa

SEQ ID NO: 3133740 - RNA, 14 nt, Human
gcccacuucugcca

SEQ ID NO: 3133741 - RNA, 21 nt, Human
gccagucaccccggccaccug

SEQ ID NO: 3133742 - RNA, 23 nt, Human
gccaguaaaugggggugcauuug

SEQ ID NO: 3133743 - RNA, 12 nt, Human
gccaguaaaugg

SEQ ID NO: 3133744 - RNA, 13 nt, Human
gccaggcuggucu

SEQ ID NO: 3133745 - RNA, 20 nt, Human
gccaugaggaacaaggcaag

SEQ ID NO: 3133746 - RNA, 14 nt, Human
gccaugcuccuggc

SEQ ID NO: 3133747 - RNA, 17 nt, Human
gcccuucucuccagccc

SEQ ID NO: 3133748 - RNA, 16 nt, Human
gcccuucucuccagcc

SEQ ID NO: 3133749 - RNA, 14 nt, Human
gcccuucucuccag

SEQ ID NO: 3133750 - RNA, 20 nt, Human
gccgagaucacgccacugca

SEQ ID NO: 3133751 - RNA, 21 nt, Human
gccgagaucacgccacugcac

SEQ ID NO: 3133752 - RNA, 22 nt, Human
gccgagaucacgccacugcacu

SEQ ID NO: 3133753 - RNA, 19 nt, Human
gccgagaucacgccacugc

SEQ ID NO: 3133754 - RNA, 12 nt, Human
gccgcagcccug

SEQ ID NO: 3133755 - RNA, 11 nt, Human
gccgcagcccu

SEQ ID NO: 3133756 - RNA, 21 nt, Human
gccgggcgcgguggcucacgc

SEQ ID NO: 3133757 - RNA, 20 nt, Human
gccguguaaccauggaccca

SEQ ID NO: 3133758 - RNA, 17 nt, Human
gccgucuaccugagggg

SEQ ID NO: 3133759 - RNA, 16 nt, Human
gccgucuaccugaggg

SEQ ID NO: 3133760 - RNA, 15 nt, Human
gccgucuaccugagg

SEQ ID NO: 3133761 - RNA, 18 nt, Human
gccucaaccuccugggcu

SEQ ID NO: 3133762 - RNA, 19 nt, Human
gccucaaccuccugggcua

SEQ ID NO: 3133763 - RNA, 17 nt, Human
gccucaaccuccugggc

SEQ ID NO: 3133764 - RNA, 17 nt, Human
gccucacaguccuuacc

SEQ ID NO: 3133765 - RNA, 13 nt, Human
gccucacaguccu

SEQ ID NO: 3133766 - RNA, 15 nt, Human
gccugcaagggagug

SEQ ID NO: 3133767 - RNA, 13 nt, Human
gccugcaagggag

SEQ ID NO: 3133768 - RNA, 12 nt, Human
gccucugccucu

SEQ ID NO: 3133769 - RNA, 13 nt, Human
gccucugccucug

SEQ ID NO: 3133770 - RNA, 19 nt, Human
gccucugacacacagcucu

SEQ ID NO: 3133771 - RNA, 20 nt, Human
gccucugacacacagcucug

SEQ ID NO: 3133772 - RNA, 21 nt, Human
gccucugacacacagcucugu

SEQ ID NO: 3133773 - RNA, 14 nt, Human
gccucugcacuccc

SEQ ID NO: 3133774 - RNA, 17 nt, Human
gccucugacacacagcu

SEQ ID NO: 3133775 - RNA, 18 nt, Human
gccucugacacacagcuc

SEQ ID NO: 3133776 - RNA, 16 nt, Human
gccucugacacacagc

SEQ ID NO: 3133777 - RNA, 16 nt, Human
gccucucucaggccaa

SEQ ID NO: 3133778 - RNA, 14 nt, Human
gccucucucaggcc

SEQ ID NO: 3133779 - RNA, 13 nt, Human
gccucucucaggc

SEQ ID NO: 3133780 - RNA, 18 nt, Human
gccucacaguccuuacca

SEQ ID NO: 3133781 - RNA, 15 nt, Human
gccucagcauccugg

SEQ ID NO: 3133782 - RNA, 16 nt, Human
gccucagcauccuggc

SEQ ID NO: 3133783 - RNA, 18 nt, Human
gccucccaaagugcuggg

SEQ ID NO: 3133784 - RNA, 19 nt, Human
gccucccaaagugcuggga

SEQ ID NO: 3133785 - RNA, 13 nt, Human
gccucccaacuca

SEQ ID NO: 3133786 - RNA, 16 nt, Human
gccucccaucacccgc

SEQ ID NO: 3133787 - RNA, 14 nt, Human
gccucccaucaccc

SEQ ID NO: 3133788 - RNA, 19 nt, Human
gccucccaacucaccccag

SEQ ID NO: 3133789 - RNA, 18 nt, Human
gccucccaacucacccca

SEQ ID NO: 3133790 - RNA, 17 nt, Human
gccucccaacucacccc

SEQ ID NO: 3133791 - RNA, 16 nt, Human
gccucccaacucaccc

SEQ ID NO: 3133792 - RNA, 18 nt, Human
gccucccgaguagcuggg

SEQ ID NO: 3133793 - RNA, 19 nt, Human
gccucccgaguagcuggga

SEQ ID NO: 3133794 - RNA, 17 nt, Human
gccucccgaguagcugg

SEQ ID NO: 3133795 - RNA, 15 nt, Human
gcggacagccacggc

SEQ ID NO: 3133796 - RNA, 19 nt, Human
gcgucucauacucaccuca

SEQ ID NO: 3133797 - RNA, 15 nt, Human
gcgccuacaggagug

SEQ ID NO: 3133798 - RNA, 11 nt, Human
gcggacagcca

SEQ ID NO: 3133799 - RNA, 13 nt, Human
gcggacagccacg

SEQ ID NO: 3133800 - RNA, 16 nt, Human
gcuaccuuuguauucu

SEQ ID NO: 3133801 - RNA, 15 nt, Human
gcuaggaacacuccu

SEQ ID NO: 3133802 - RNA, 20 nt, Human
gcuaagagggagggagggcu

SEQ ID NO: 3133803 - RNA, 13 nt, Human
gcuacacacugca

SEQ ID NO: 3133804 - RNA, 20 nt, Human
gcuacacacugcauguuugu

SEQ ID NO: 3133805 - RNA, 14 nt, Human
gcuacacaggggaa

SEQ ID NO: 3133806 - RNA, 13 nt, Human
gcuaagagggagg

SEQ ID NO: 3133807 - RNA, 16 nt, Human
gccuuccagggguggg

SEQ ID NO: 3133808 - RNA, 15 nt, Human
gccuuccaggggugg

SEQ ID NO: 3133809 - RNA, 12 nt, Human
gccuuccagggg

SEQ ID NO: 3133810 - RNA, 20 nt, Human
gccuuauggaacacucugag

SEQ ID NO: 3133811 - RNA, 19 nt, Human
gccuuauggaacacucuga

SEQ ID NO: 3133812 - RNA, 18 nt, Human
gccuuauggaacacucug

SEQ ID NO: 3133813 - RNA, 16 nt, Human
gccuuauggaacacuc

SEQ ID NO: 3133814 - RNA, 23 nt, Human
gcgacaaugcaaaccaucauuga

SEQ ID NO: 3133815 - RNA, 13 nt, Human
gccuuuggcuuca

SEQ ID NO: 3133816 - RNA, 14 nt, Human
gccuuauggaacac

SEQ ID NO: 3133817 - RNA, 10 nt, Human
gccuuaugga

SEQ ID NO: 3133818 - RNA, 19 nt, Human
gccuuagaagucacacagu

SEQ ID NO: 3133819 - RNA, 17 nt, Human
gccuuagaagucacaca

SEQ ID NO: 3133820 - RNA, 18 nt, Human
gccuuagaagucacacag

SEQ ID NO: 3133821 - RNA, 21 nt, Human
gccuuacacaaugguuuucuu

SEQ ID NO: 3133822 - RNA, 18 nt, Human
gccuuacccucauguucu

SEQ ID NO: 3133823 - RNA, 20 nt, Human
gccuuacacaaugguuuucu

SEQ ID NO: 3133824 - RNA, 16 nt, Human
gccuuacacaaugguu

SEQ ID NO: 3133825 - RNA, 21 nt, Human
gccuguugggccaggagccuc

SEQ ID NO: 3133826 - RNA, 22 nt, Human
gccugggggcugggcagaggaa

SEQ ID NO: 3133827 - RNA, 21 nt, Human
gccugggggcugggcagagga

SEQ ID NO: 3133828 - RNA, 18 nt, Human
gccugguggcagcugcgg

SEQ ID NO: 3133829 - RNA, 19 nt, Human
gccugguggcagcugcggu

SEQ ID NO: 3133830 - RNA, 21 nt, Human
gccugguggcagcugcggucc

SEQ ID NO: 3133831 - RNA, 13 nt, Human
gccugguggcagc

SEQ ID NO: 3133832 - RNA, 17 nt, Human
cccuuggauuguccccg

SEQ ID NO: 3133833 - RNA, 20 nt, Human
cccuuguggucccaccccac

SEQ ID NO: 3133834 - RNA, 22 nt, Human
cccuuguggucccaccccacac

SEQ ID NO: 3133835 - RNA, 23 nt, Human
cccuugguuaggcauugugggaa

SEQ ID NO: 3133836 - RNA, 22 nt, Human
cccuugguuaggcauuguggga

SEQ ID NO: 3133837 - RNA, 12 nt, Human
cccuucccaccu

SEQ ID NO: 3133838 - RNA, 13 nt, Human
cccuucccaccuc

SEQ ID NO: 3133839 - RNA, 17 nt, Human
ccgggaagggggcuggg

SEQ ID NO: 3133840 - RNA, 12 nt, Human
ccguuauuaaaa

SEQ ID NO: 3133841 - RNA, 16 nt, Human
ccuaaaauucagugga

SEQ ID NO: 3133842 - RNA, 15 nt, Human
ccuaaaauucagugg

SEQ ID NO: 3133843 - RNA, 22 nt, Human
ccuacaguugaaaaacagcuga

SEQ ID NO: 3133844 - RNA, 19 nt, Human
ccuacagcuugaccgugag

SEQ ID NO: 3133845 - RNA, 21 nt, Human
ccuacaguugaaaaacagcug

SEQ ID NO: 3133846 - RNA, 13 nt, Human
ccuacccacccuc

SEQ ID NO: 3133847 - RNA, 18 nt, Human
ccuacccacccuccuuuc

SEQ ID NO: 3133848 - RNA, 19 nt, Human
ccuacuguaauuugugaua

SEQ ID NO: 3133849 - RNA, 21 nt, Human
ccuagaaauuccccacccuga

SEQ ID NO: 3133850 - RNA, 13 nt, Human
ccuaggugacaga

SEQ ID NO: 3133851 - RNA, 23 nt, Human
ccucaggccugggggcugggcag

SEQ ID NO: 3133852 - RNA, 20 nt, Human
ccucagggucccugguggca

SEQ ID NO: 3133853 - RNA, 17 nt, Human
ccucagggucccuggug

SEQ ID NO: 3133854 - RNA, 16 nt, Human
ccucagggucccuggu

SEQ ID NO: 3133855 - RNA, 16 nt, Human
ccucagaucuucugug

SEQ ID NO: 3133856 - RNA, 15 nt, Human
ccuaggugacagagu

SEQ ID NO: 3133857 - RNA, 17 nt, Human
ccuauuagagaagagau

SEQ ID NO: 3133858 - RNA, 16 nt, Human
ccuauuagagaagaga

SEQ ID NO: 3133859 - RNA, 23 nt, Human
ccucacaguccuuaccagcagag

SEQ ID NO: 3133860 - RNA, 24 nt, Human
ccucacaguccuuaccagcagagc

SEQ ID NO: 3133861 - RNA, 15 nt, Human
ccucccaacucaccc

SEQ ID NO: 3133862 - RNA, 18 nt, Human
ccucccgaauagcuggga

SEQ ID NO: 3133863 - RNA, 13 nt, Human
ccucccucuuucc

SEQ ID NO: 3133864 - RNA, 11 nt, Human
ccuccucagau

SEQ ID NO: 3133865 - RNA, 12 nt, Human
ccuccuccagcc

SEQ ID NO: 3133866 - RNA, 17 nt, Human
ccucccgaguagcuggg

SEQ ID NO: 3133867 - RNA, 18 nt, Human
ccucccgaguagcuggga

SEQ ID NO: 3133868 - RNA, 21 nt, Human
ccucccgaauagcugggacua

SEQ ID NO: 3133869 - RNA, 19 nt, Human
ccucccgaauagcugggac

SEQ ID NO: 3133870 - RNA, 20 nt, Human
ccucccgaauagcugggacu

SEQ ID NO: 3133871 - RNA, 12 nt, Human
ccuccauguggg

SEQ ID NO: 3133872 - RNA, 15 nt, Human
ccuccaugugggcua

SEQ ID NO: 3133873 - RNA, 17 nt, Human
ccucccaaagugcuggg

SEQ ID NO: 3133874 - RNA, 14 nt, Human
ccucccaacucacc

SEQ ID NO: 3133875 - RNA, 12 nt, Human
ccuccaggugca

SEQ ID NO: 3133876 - RNA, 11 nt, Human
ccuccaggugc

SEQ ID NO: 3133877 - RNA, 17 nt, Human
ccuccaggugcacaagc

SEQ ID NO: 3133878 - RNA, 20 nt, Human
ccucaggugagaagcagagg

SEQ ID NO: 3133879 - RNA, 18 nt, Human
ccucaggugagaagcaga

SEQ ID NO: 3133880 - RNA, 17 nt, Human
ccucaggugagaagcag

SEQ ID NO: 3133881 - RNA, 13 nt, Human
ccucugacacaca

SEQ ID NO: 3133882 - RNA, 14 nt, Human
ccucugacacacag

SEQ ID NO: 3133883 - RNA, 19 nt, Human
ccucugacacacagcucug

SEQ ID NO: 3133884 - RNA, 20 nt, Human
ccucugacacacagcucugu

SEQ ID NO: 3133885 - RNA, 21 nt, Human
ccucugacacacagcucuguc

SEQ ID NO: 3133886 - RNA, 15 nt, Human
ccucugcacuccccu

SEQ ID NO: 3133887 - RNA, 17 nt, Human
ccucugcacuccccugc

SEQ ID NO: 3133888 - RNA, 16 nt, Human
ccucugcacuccccug

SEQ ID NO: 3133889 - RNA, 18 nt, Human
ccucugcacuccccugcu

SEQ ID NO: 3133890 - RNA, 23 nt, Human
ccucugcacuccccugcugggug

SEQ ID NO: 3133891 - RNA, 14 nt, Human
ccucugcagcaaua

SEQ ID NO: 3133892 - RNA, 18 nt, Human
ccucugcagcaauaaagc

SEQ ID NO: 3133893 - RNA, 16 nt, Human
ccucugcccacucccu

SEQ ID NO: 3133894 - RNA, 13 nt, Human
ccucugcccacuc

SEQ ID NO: 3133895 - RNA, 18 nt, Human
ccucgguguggagaagcg

SEQ ID NO: 3133896 - RNA, 21 nt, Human
ccuccuccagccgccaugcuc

SEQ ID NO: 3133897 - RNA, 22 nt, Human
ccucucccuuggauuguccccg

SEQ ID NO: 3133898 - RNA, 13 nt, Human
ccucucccuugga

SEQ ID NO: 3133899 - RNA, 20 nt, Human
ccucuccccagcaagugaga

SEQ ID NO: 3133900 - RNA, 15 nt, Human
ccucuccccagcaag

SEQ ID NO: 3133901 - RNA, 14 nt, Human
cccugguggcagcu

SEQ ID NO: 3133902 - RNA, 13 nt, Human
cccugcugguuca

SEQ ID NO: 3133903 - RNA, 22 nt, Human
cccugcuggguguggcgcagca

SEQ ID NO: 3133904 - RNA, 19 nt, Human
cccugcugguucaggguug

SEQ ID NO: 3133905 - RNA, 20 nt, Human
cccugcugguucaggguugg

SEQ ID NO: 3133906 - RNA, 22 nt, Human
cccugguggcagugggagcugc

SEQ ID NO: 3133907 - RNA, 21 nt, Human
cccugguggcagugggagcug

SEQ ID NO: 3133908 - RNA, 22 nt, Human
cccugcacuugcagacucuaca

SEQ ID NO: 3133909 - RNA, 12 nt, Human
cccugcagaggg

SEQ ID NO: 3133910 - RNA, 18 nt, Human
cccugcagagggcacaga

SEQ ID NO: 3133911 - RNA, 16 nt, Human
cccugcaaccugauug

SEQ ID NO: 3133912 - RNA, 22 nt, Human
cccugcaaccugauugugucuc

SEQ ID NO: 3133913 - RNA, 12 nt, Human
cccugccacccu

SEQ ID NO: 3133914 - RNA, 14 nt, Human
cccugccacccugg

SEQ ID NO: 3133915 - RNA, 15 nt, Human
cccugccacccuggg

SEQ ID NO: 3133916 - RNA, 17 nt, Human
cccugccacccugggga

SEQ ID NO: 3133917 - RNA, 18 nt, Human
cccugccacccuggggag

SEQ ID NO: 3133918 - RNA, 14 nt, Human
cccugccuccuuug

SEQ ID NO: 3133919 - RNA, 23 nt, Human
cccugccuccuuugugaggaagc

SEQ ID NO: 3133920 - RNA, 16 nt, Human
cccugccuccuuugug

SEQ ID NO: 3133921 - RNA, 21 nt, Human
cccucagggucccugguggca

SEQ ID NO: 3133922 - RNA, 20 nt, Human
cccucagucuggcccuuccu

SEQ ID NO: 3133923 - RNA, 22 nt, Human
cccucaucaccaacgucugugc

SEQ ID NO: 3133924 - RNA, 20 nt, Human
cccucauccucauacccacc

SEQ ID NO: 3133925 - RNA, 17 nt, Human
cccucauccucauaccc

SEQ ID NO: 3133926 - RNA, 22 nt, Human
cccucauccucauacccacccc

SEQ ID NO: 3133927 - RNA, 21 nt, Human
cccuccaagaccuucuccuuc

SEQ ID NO: 3133928 - RNA, 17 nt, Human
cccuccaugugggcuag

SEQ ID NO: 3133929 - RNA, 13 nt, Human
cccucccucuuuc

SEQ ID NO: 3133930 - RNA, 22 nt, Human
cccuaaaguguauuuuuuuacu

SEQ ID NO: 3133931 - RNA, 17 nt, Human
cccuaaaguguauuuuu

SEQ ID NO: 3133932 - RNA, 16 nt, Human
cccggcaggguccuag

SEQ ID NO: 3133933 - RNA, 15 nt, Human
cccucagggucccug

SEQ ID NO: 3133934 - RNA, 19 nt, Human
cccucagggucccuggugg

SEQ ID NO: 3133935 - RNA, 18 nt, Human
cccucagggucccuggug

SEQ ID NO: 3133936 - RNA, 17 nt, Human
cccucagggucccuggu

SEQ ID NO: 3133937 - RNA, 16 nt, Human
cccucagggucccugg

SEQ ID NO: 3133938 - RNA, 20 nt, Human
cccgaggccuucucugaagg

SEQ ID NO: 3133939 - RNA, 15 nt, Human
cccgaggccuucucu

SEQ ID NO: 3133940 - RNA, 20 nt, Human
ccccuguucuggcagaguug

SEQ ID NO: 3133941 - RNA, 22 nt, Human
ccccuguccccgcacugggcuu

SEQ ID NO: 3133942 - RNA, 12 nt, Human
ccccaggaggcc

SEQ ID NO: 3133943 - RNA, 15 nt, Human
ccccuggcagccccu

SEQ ID NO: 3133944 - RNA, 14 nt, Human
ccccuggcagcccc

SEQ ID NO: 3133945 - RNA, 12 nt, Human
ccccuggcagcc

SEQ ID NO: 3133946 - RNA, 15 nt, Human
ccccagccccauccu

SEQ ID NO: 3133947 - RNA, 16 nt, Human
ccccagccccauccca

SEQ ID NO: 3133948 - RNA, 13 nt, Human
ccccagccugcua

SEQ ID NO: 3133949 - RNA, 14 nt, Human
cccaguuagcucuc

SEQ ID NO: 3133950 - RNA, 20 nt, Human
cccagugguuccuaauccuc

SEQ ID NO: 3133951 - RNA, 15 nt, Human
cccagugccgagaag

SEQ ID NO: 3133952 - RNA, 21 nt, Human
cccagugcccacaggaucagu

SEQ ID NO: 3133953 - RNA, 10 nt, Human
cccagucugg

SEQ ID NO: 3133954 - RNA, 18 nt, Human
cccagucuggaaugcagu

SEQ ID NO: 3133955 - RNA, 19 nt, Human
cccagucuggaaugcagug

SEQ ID NO: 3133956 - RNA, 17 nt, Human
cccaggcauuccccagg

SEQ ID NO: 3133957 - RNA, 23 nt, Human
cccaggcaggucuugaacuccug

SEQ ID NO: 3133958 - RNA, 15 nt, Human
cccaggcauucccca

SEQ ID NO: 3133959 - RNA, 16 nt, Human
cccaggaggccagccu

SEQ ID NO: 3133960 - RNA, 15 nt, Human
cccaggaggccagcc

SEQ ID NO: 3133961 - RNA, 13 nt, Human
cccagguuucuau

SEQ ID NO: 3133962 - RNA, 21 nt, Human
ccccaaauggaaaugggcaga

SEQ ID NO: 3133963 - RNA, 20 nt, Human
cccaucugugaaaggaaaga

SEQ ID NO: 3133964 - RNA, 13 nt, Human
cccaucucacaca

SEQ ID NO: 3133965 - RNA, 18 nt, Human
cccaucucacacaugagc

SEQ ID NO: 3133966 - RNA, 12 nt, Human
cccaucugugaa

SEQ ID NO: 3133967 - RNA, 14 nt, Human
cccaugcugcccug

SEQ ID NO: 3133968 - RNA, 13 nt, Human
cccaugcugcccu

SEQ ID NO: 3133969 - RNA, 12 nt, Human
cccaugcugccc

SEQ ID NO: 3133970 - RNA, 20 nt, Human
cccaugagccucagcauccu

SEQ ID NO: 3133971 - RNA, 15 nt, Human
cccaugagccucagc

SEQ ID NO: 3133972 - RNA, 16 nt, Human
cccaugagccucagca

SEQ ID NO: 3133973 - RNA, 15 nt, Human
ccaugcugcccugug

SEQ ID NO: 3133974 - RNA, 18 nt, Human
ccaugcuccuggcccacu

SEQ ID NO: 3133975 - RNA, 15 nt, Human
ccaugcuccuggccc

SEQ ID NO: 3133976 - RNA, 17 nt, Human
ccaugcugcccugugag

SEQ ID NO: 3133977 - RNA, 16 nt, Human
ccaugcugcccuguga

SEQ ID NO: 3133978 - RNA, 13 nt, Human
ccaugcuccuggc

SEQ ID NO: 3133979 - RNA, 13 nt, Human
ccauguuggccag

SEQ ID NO: 3133980 - RNA, 14 nt, Human
ccauguuggccagg

SEQ ID NO: 3133981 - RNA, 13 nt, Human
ccaugugccaggu

SEQ ID NO: 3133982 - RNA, 19 nt, Human
ccauguuggccaggcuggu

SEQ ID NO: 3133983 - RNA, 21 nt, Human
ccauguuggccaggcuggucu

SEQ ID NO: 3133984 - RNA, 18 nt, Human
ccauguuggccaggcugg

SEQ ID NO: 3133985 - RNA, 15 nt, Human
ccauguuggccaggc

SEQ ID NO: 3133986 - RNA, 15 nt, Human
cccaccuggccucug

SEQ ID NO: 3133987 - RNA, 12 nt, Human
cccaccuggccu

SEQ ID NO: 3133988 - RNA, 16 nt, Human
cccaccuuggcugcag

SEQ ID NO: 3133989 - RNA, 17 nt, Human
cccaccuuggcugcagg

SEQ ID NO: 3133990 - RNA, 19 nt, Human
cccaccuuggcugcaggga

SEQ ID NO: 3133991 - RNA, 14 nt, Human
cccacgcccccacu

SEQ ID NO: 3133992 - RNA, 13 nt, Human
cccacgcccccac

SEQ ID NO: 3133993 - RNA, 15 nt, Human
cccagccccauccuc

SEQ ID NO: 3133994 - RNA, 14 nt, Human
cccagccccauccu

SEQ ID NO: 3133995 - RNA, 14 nt, Human
cccagccccauccc

SEQ ID NO: 3133996 - RNA, 13 nt, Human
cccagccccaucc

SEQ ID NO: 3133997 - RNA, 18 nt, Human
cccagccccuucugaccc

SEQ ID NO: 3133998 - RNA, 19 nt, Human
cccagccccauccucugua

SEQ ID NO: 3133999 - RNA, 18 nt, Human
cccagccccauccucugu

SEQ ID NO: 3134000 - RNA, 13 nt, Human
cccagccccaaug

SEQ ID NO: 3134001 - RNA, 12 nt, Human
cccagccccauc

SEQ ID NO: 3134002 - RNA, 11 nt, Human
cccagccccau

SEQ ID NO: 3134003 - RNA, 17 nt, Human
cccagccccaaugaaca

SEQ ID NO: 3134004 - RNA, 23 nt, Human
cccagauugcaacaggcugggcu

SEQ ID NO: 3134005 - RNA, 18 nt, Human
cccagcucugguccauag

SEQ ID NO: 3134006 - RNA, 16 nt, Human
cccagcucugguccau

SEQ ID NO: 3134007 - RNA, 15 nt, Human
cccagcucuggucca

SEQ ID NO: 3134008 - RNA, 12 nt, Human
cccagcucuggu

SEQ ID NO: 3134009 - RNA, 14 nt, Human
cccagcucuggucc

SEQ ID NO: 3134010 - RNA, 13 nt, Human
cccagcucugguc

SEQ ID NO: 3134011 - RNA, 14 nt, Human
cccagcgagcccug

SEQ ID NO: 3134012 - RNA, 13 nt, Human
cccaggagccccg

SEQ ID NO: 3134013 - RNA, 14 nt, Human
cccaggagccccga

SEQ ID NO: 3134014 - RNA, 14 nt, Human
cccaggaggccagc

SEQ ID NO: 3134015 - RNA, 19 nt, Human
ccaggccccugccacccug

SEQ ID NO: 3134016 - RNA, 21 nt, Human
ccaggccccugccacccuggg

SEQ ID NO: 3134017 - RNA, 23 nt, Human
ccaggccccugccacccugggga

SEQ ID NO: 3134018 - RNA, 14 nt, Human
ccaggccagaggga

SEQ ID NO: 3134019 - RNA, 21 nt, Human
ccaggccagagggagugacag

SEQ ID NO: 3134020 - RNA, 14 nt, Human
ccaggagcagccac

SEQ ID NO: 3134021 - RNA, 12 nt, Human
ccaggccagagg

SEQ ID NO: 3134022 - RNA, 19 nt, Human
ccaggccuccuacagcuug

SEQ ID NO: 3134023 - RNA, 18 nt, Human
ccaggccuccuacagcuu

SEQ ID NO: 3134024 - RNA, 13 nt, Human
ccaggccuccuac

SEQ ID NO: 3134025 - RNA, 19 nt, Human
ccaggcccucugcccacuc

SEQ ID NO: 3134026 - RNA, 18 nt, Human
ccaggcccucugcccacu

SEQ ID NO: 3134027 - RNA, 17 nt, Human
ccaggcccucugcccac

SEQ ID NO: 3134028 - RNA, 16 nt, Human
ccaggcccucugccca

SEQ ID NO: 3134029 - RNA, 22 nt, Human
ccagcugugcucuggacaggca

SEQ ID NO: 3134030 - RNA, 23 nt, Human
ccagcugugcucuggacaggcau

SEQ ID NO: 3134031 - RNA, 19 nt, Human
ccaggaagccagcaggcuc

SEQ ID NO: 3134032 - RNA, 17 nt, Human
ccaggaagccagcaggc

SEQ ID NO: 3134033 - RNA, 15 nt, Human
ccaggaagccagcag

SEQ ID NO: 3134034 - RNA, 14 nt, Human
ccaggaagccagca

SEQ ID NO: 3134035 - RNA, 13 nt, Human
ccaggagcagcca

SEQ ID NO: 3134036 - RNA, 12 nt, Human
ccaggagcagcc

SEQ ID NO: 3134037 - RNA, 18 nt, Human
ccagcugugcucuggaca

SEQ ID NO: 3134038 - RNA, 20 nt, Human
ccagcugugcucuggacagg

SEQ ID NO: 3134039 - RNA, 21 nt, Human
ccagcugugcucuggacaggc

SEQ ID NO: 3134040 - RNA, 15 nt, Human
ccagcugcuugggcu

SEQ ID NO: 3134041 - RNA, 13 nt, Human
ccagcugcuuggg

SEQ ID NO: 3134042 - RNA, 18 nt, Human
ccagcugcuugggcuuca

SEQ ID NO: 3134043 - RNA, 16 nt, Human
ccagcugcuugggcuu

SEQ ID NO: 3134044 - RNA, 23 nt, Human
ccagggacagaggggguggccuc

SEQ ID NO: 3134045 - RNA, 23 nt, Human
ccauagagagcaagacgcugugc

SEQ ID NO: 3134046 - RNA, 19 nt, Human
ccauauuaccacagacaua

SEQ ID NO: 3134047 - RNA, 15 nt, Human
ccauauucuguuggc

SEQ ID NO: 3134048 - RNA, 18 nt, Human
ccauauucuguuggccag

SEQ ID NO: 3134049 - RNA, 12 nt, Human
ccaucacccgcu

SEQ ID NO: 3134050 - RNA, 13 nt, Human
ccaucaccagaca

SEQ ID NO: 3134051 - RNA, 21 nt, Human
ccauccucuguacagagccca

SEQ ID NO: 3134052 - RNA, 14 nt, Human
ccaucaugucuggc

SEQ ID NO: 3134053 - RNA, 16 nt, Human
ccaucaugucuggcua

SEQ ID NO: 3134054 - RNA, 15 nt, Human
caucaccaacgucug

SEQ ID NO: 3134055 - RNA, 13 nt, Human
caucauugaaauc

SEQ ID NO: 3134056 - RNA, 21 nt, Human
caucauugaaaucuuuuugcu

SEQ ID NO: 3134057 - RNA, 20 nt, Human
caucauugaaaucuuuuugc

SEQ ID NO: 3134058 - RNA, 15 nt, Human
caucauugaaaucuu

SEQ ID NO: 3134059 - RNA, 14 nt, Human
caucauugaaaucu

SEQ ID NO: 3134060 - RNA, 15 nt, Human
cauccagguucagcu

SEQ ID NO: 3134061 - RNA, 19 nt, Human
caucccucuggggcuguuc

SEQ ID NO: 3134062 - RNA, 13 nt, Human
caucccugaaggc

SEQ ID NO: 3134063 - RNA, 11 nt, Human
caucccugaag

SEQ ID NO: 3134064 - RNA, 21 nt, Human
caucccugaaggccccgccca

SEQ ID NO: 3134065 - RNA, 19 nt, Human
caucccugaaggccccgcc

SEQ ID NO: 3134066 - RNA, 18 nt, Human
caucccugaaggccccgc

SEQ ID NO: 3134067 - RNA, 17 nt, Human
caucccugaaggccccg

SEQ ID NO: 3134068 - RNA, 20 nt, Human
caucuugcucugcugacaga

SEQ ID NO: 3134069 - RNA, 19 nt, Human
caucuugcucugcugacag

SEQ ID NO: 3134070 - RNA, 14 nt, Human
caucuugcucugcu

SEQ ID NO: 3134071 - RNA, 13 nt, Human
caucuugcucugc

SEQ ID NO: 3134072 - RNA, 22 nt, Human
caucuuccaaggguacuaagga

SEQ ID NO: 3134073 - RNA, 12 nt, Human
cauccuccucag

SEQ ID NO: 3134074 - RNA, 11 nt, Human
cauccuccuca

SEQ ID NO: 3134075 - RNA, 19 nt, Human
cauccuccucagaucuucu

SEQ ID NO: 3134076 - RNA, 18 nt, Human
cauccuccucagaucuuc

SEQ ID NO: 3134077 - RNA, 16 nt, Human
cauccuccucagaucu

SEQ ID NO: 3134078 - RNA, 15 nt, Human
cauccuccucagauc

SEQ ID NO: 3134079 - RNA, 13 nt, Human
cauccucccaagg

SEQ ID NO: 3134080 - RNA, 22 nt, Human
cauccucauacccacccccacc

SEQ ID NO: 3134081 - RNA, 21 nt, Human
cauccucauacccacccccac

SEQ ID NO: 3134082 - RNA, 18 nt, Human
cauccucauacccacccc

SEQ ID NO: 3134083 - RNA, 17 nt, Human
cauccucauacccaccc

SEQ ID NO: 3134084 - RNA, 16 nt, Human
cauccucauacccacc

SEQ ID NO: 3134085 - RNA, 15 nt, Human
cauccucauacccac

SEQ ID NO: 3134086 - RNA, 20 nt, Human
caucucacacaugagcauca

SEQ ID NO: 3134087 - RNA, 17 nt, Human
caucucacacaugagca

SEQ ID NO: 3134088 - RNA, 16 nt, Human
caucucacacaugagc

SEQ ID NO: 3134089 - RNA, 19 nt, Human
cauccucuguacagagccc

SEQ ID NO: 3134090 - RNA, 18 nt, Human
cauccucuguacagagcc

SEQ ID NO: 3134091 - RNA, 15 nt, Human
cauccucuguacaga

SEQ ID NO: 3134092 - RNA, 15 nt, Human
caucuacccuccgau

SEQ ID NO: 3134093 - RNA, 14 nt, Human
caucaagaugugac

SEQ ID NO: 3134094 - RNA, 14 nt, Human
cauauuuacuucuu

SEQ ID NO: 3134095 - RNA, 16 nt, Human
cauauuuacuucuuau

SEQ ID NO: 3134096 - RNA, 17 nt, Human
cauauuuacuucuuaua

SEQ ID NO: 3134097 - RNA, 20 nt, Human
cauauuuacuucuuauacau

SEQ ID NO: 3134098 - RNA, 17 nt, Human
cauaguaugguggcugg

SEQ ID NO: 3134099 - RNA, 20 nt, Human
cauaguaugguggcuggguu

SEQ ID NO: 3134100 - RNA, 18 nt, Human
cauaguaugguggcuggg

SEQ ID NO: 3134101 - RNA, 19 nt, Human
cauaguaugguggcugggu

SEQ ID NO: 3134102 - RNA, 22 nt, Human
cauaguggcuuaaaacaacacu

SEQ ID NO: 3134103 - RNA, 22 nt, Human
cauauauauguuuuaagaggca

SEQ ID NO: 3134104 - RNA, 11 nt, Human
cauacucugcu

SEQ ID NO: 3134105 - RNA, 20 nt, Human
cauacucccaucugugaaag

SEQ ID NO: 3134106 - RNA, 18 nt, Human
cauacucccaucugugaa

SEQ ID NO: 3134107 - RNA, 15 nt, Human
cauacucccaucugu

SEQ ID NO: 3134108 - RNA, 16 nt, Human
cauacucccaucugug

SEQ ID NO: 3134109 - RNA, 21 nt, Human
cauagagagcaagacgcugug

SEQ ID NO: 3134110 - RNA, 19 nt, Human
cauagagagcaagacgcug

SEQ ID NO: 3134111 - RNA, 23 nt, Human
cauagagagcaagacgcugugcu

SEQ ID NO: 3134112 - RNA, 16 nt, Human
caguguacauggaaua

SEQ ID NO: 3134113 - RNA, 20 nt, Human
caguguacauggaauaacau

SEQ ID NO: 3134114 - RNA, 23 nt, Human
caguguacauggaauaacaugua

SEQ ID NO: 3134115 - RNA, 14 nt, Human
cagugugacaagga

SEQ ID NO: 3134116 - RNA, 12 nt, Human
cagugugacuga

SEQ ID NO: 3134117 - RNA, 12 nt, Human
caguggcagcug

SEQ ID NO: 3134118 - RNA, 13 nt, Human
caguggcagcugc

SEQ ID NO: 3134119 - RNA, 14 nt, Human
caguggcagcugcu

SEQ ID NO: 3134120 - RNA, 15 nt, Human
caguggcagcugcuu

SEQ ID NO: 3134121 - RNA, 16 nt, Human
caguggcagcugcuuu

SEQ ID NO: 3134122 - RNA, 22 nt, Human
cagugguuccuaauccucuagg

SEQ ID NO: 3134123 - RNA, 19 nt, Human
caguugaaaaacagcugag

SEQ ID NO: 3134124 - RNA, 18 nt, Human
caguugaaaaacagcuga

SEQ ID NO: 3134125 - RNA, 12 nt, Human
caguugaaaaac

SEQ ID NO: 3134126 - RNA, 22 nt, Human
caguucucuccuucuucccccc

SEQ ID NO: 3134127 - RNA, 13 nt, Human
caguucucuccuu

SEQ ID NO: 3134128 - RNA, 15 nt, Human
caguucucuccuucu

SEQ ID NO: 3134129 - RNA, 14 nt, Human
caguucucuccuuc

SEQ ID NO: 3134130 - RNA, 14 nt, Human
caguuaagagaaau

SEQ ID NO: 3134131 - RNA, 13 nt, Human
caguuaagagaaa

SEQ ID NO: 3134132 - RNA, 19 nt, Human
caguguuguggauuuaaca

SEQ ID NO: 3134133 - RNA, 20 nt, Human
caguguuguggauuuaacag

SEQ ID NO: 3134134 - RNA, 22 nt, Human
caguguuguggauuuaacagaa

SEQ ID NO: 3134135 - RNA, 16 nt, Human
cauaaccuagccuuag

SEQ ID NO: 3134136 - RNA, 22 nt, Human
cauaaacaagaccacguuucua

SEQ ID NO: 3134137 - RNA, 20 nt, Human
cauaaacaagaccacguuuc

SEQ ID NO: 3134138 - RNA, 21 nt, Human
cauaaacaagaccacguuucu

SEQ ID NO: 3134139 - RNA, 21 nt, Human
cauaaaaauuagccaagugug

SEQ ID NO: 3134140 - RNA, 19 nt, Human
cauaccacuuuuguucuug

SEQ ID NO: 3134141 - RNA, 12 nt, Human
cauacccacccc

SEQ ID NO: 3134142 - RNA, 11 nt, Human
cauacccaccc

SEQ ID NO: 3134143 - RNA, 13 nt, Human
cauaccacuuuug

SEQ ID NO: 3134144 - RNA, 14 nt, Human
cauaccacuuuugu

SEQ ID NO: 3134145 - RNA, 15 nt, Human
cauaccacuuuuguu

SEQ ID NO: 3134146 - RNA, 18 nt, Human
cauaccacuuuuguucuu

SEQ ID NO: 3134147 - RNA, 14 nt, Human
cauaagauaaaugu

SEQ ID NO: 3134148 - RNA, 18 nt, Human
caguuggucccccuucca

SEQ ID NO: 3134149 - RNA, 18 nt, Human
caguuggguggaugccug

SEQ ID NO: 3134150 - RNA, 19 nt, Human
caguuggguggaugccugg

SEQ ID NO: 3134151 - RNA, 22 nt, Human
caguuggucccccuuccaugga

SEQ ID NO: 3134152 - RNA, 21 nt, Human
caguuggucccccuuccaugg

SEQ ID NO: 3134153 - RNA, 20 nt, Human
caguuggucccccuuccaug

SEQ ID NO: 3134154 - RNA, 19 nt, Human
caguuggucccccuuccau

SEQ ID NO: 3134155 - RNA, 16 nt, Human
caguuggguggaugcc

SEQ ID NO: 3134156 - RNA, 23 nt, Human
caguugccagucaccccggccac

SEQ ID NO: 3134157 - RNA, 17 nt, Human
caguuguuagugugucu

SEQ ID NO: 3134158 - RNA, 13 nt, Human
cauacguacacau

SEQ ID NO: 3134159 - RNA, 15 nt, Human
cauacguacacauuu

SEQ ID NO: 3134160 - RNA, 16 nt, Human
cauacguacacauuuu

SEQ ID NO: 3134161 - RNA, 17 nt, Human
cauacguacacauuuua

SEQ ID NO: 3134162 - RNA, 18 nt, Human
cauacguacacauuuuau

SEQ ID NO: 3134163 - RNA, 14 nt, Human
cauacuaaccagca

SEQ ID NO: 3134164 - RNA, 21 nt, Human
cauacuaaccagcagaaaugc

SEQ ID NO: 3134165 - RNA, 21 nt, Human
cauacccacccccacccaagg

SEQ ID NO: 3134166 - RNA, 18 nt, Human
cauacccacccccaccca

SEQ ID NO: 3134167 - RNA, 17 nt, Human
cauacccacccccaccc

SEQ ID NO: 3134168 - RNA, 14 nt, Human
cauacccaccccca

SEQ ID NO: 3134169 - RNA, 22 nt, Human
cauugaccugaggcccuucucu

SEQ ID NO: 3134170 - RNA, 13 nt, Human
cauugaccugagg

SEQ ID NO: 3134171 - RNA, 19 nt, Human
cauugaaaucuuuuugcuu

SEQ ID NO: 3134172 - RNA, 21 nt, Human
cauuucuuccacaagagccca

SEQ ID NO: 3134173 - RNA, 21 nt, Human
cauuuaaaagauacaguuacu

SEQ ID NO: 3134174 - RNA, 17 nt, Human
cauuuacuuuguguuca

SEQ ID NO: 3134175 - RNA, 21 nt, Human
cauuuacuuuguguucaccuu

SEQ ID NO: 3134176 - RNA, 17 nt, Human
cauuugaggucuguucu

SEQ ID NO: 3134177 - RNA, 18 nt, Human
cauuugaggucuguucuu

SEQ ID NO: 3134178 - RNA, 19 nt, Human
cauuugaggucuguucuuu

SEQ ID NO: 3134179 - RNA, 14 nt, Human
cauuugagcagggc

SEQ ID NO: 3134180 - RNA, 23 nt, Human
cauuucuuccacaagagcccagg

SEQ ID NO: 3134181 - RNA, 20 nt, Human
cauuuugggguacccacugc

SEQ ID NO: 3134182 - RNA, 21 nt, Human
cauuuugggguacccacugcu

SEQ ID NO: 3134183 - RNA, 22 nt, Human
cauuuugggguacccacugcuc

SEQ ID NO: 3134184 - RNA, 24 nt, Human
cauuuugcuaaaugugaaugauga

SEQ ID NO: 3134185 - RNA, 21 nt, Human
cauuuugcuaaaugugaauga

SEQ ID NO: 3134186 - RNA, 18 nt, Human
cauuuugcuaaaugugaa

SEQ ID NO: 3134187 - RNA, 23 nt, Human
cauuuugggguacccacugcucu

SEQ ID NO: 3134188 - RNA, 19 nt, Human
cauuuuuaguagagacagg

SEQ ID NO: 3134189 - RNA, 18 nt, Human
cauuuuuaguagagacag

SEQ ID NO: 3134190 - RNA, 15 nt, Human
cauuuuuaagugcug

SEQ ID NO: 3134191 - RNA, 20 nt, Human
cauuuuuaagugcugcauuu

SEQ ID NO: 3134192 - RNA, 19 nt, Human
cauuuuauuuuauuaugca

SEQ ID NO: 3134193 - RNA, 21 nt, Human
cauuuuauuuuauuaugcaug

SEQ ID NO: 3134194 - RNA, 20 nt, Human
cauuuuuaguagagacaggg

SEQ ID NO: 3134195 - RNA, 18 nt, Human
ccaaaauaaaacuuuuua

SEQ ID NO: 3134196 - RNA, 21 nt, Human
ccaaaauaaaacuuuuuaaaa

SEQ ID NO: 3134197 - RNA, 16 nt, Human
ccaaacccuucagugc

SEQ ID NO: 3134198 - RNA, 21 nt, Human
ccacaagagcccaggccuccu

SEQ ID NO: 3134199 - RNA, 20 nt, Human
ccacaagagcccaggccucc

SEQ ID NO: 3134200 - RNA, 19 nt, Human
ccacaagagcccaggccuc

SEQ ID NO: 3134201 - RNA, 18 nt, Human
ccacaagagcccaggccu

SEQ ID NO: 3134202 - RNA, 17 nt, Human
ccacaagagcccaggcc

SEQ ID NO: 3134203 - RNA, 16 nt, Human
ccacaagagcccaggc

SEQ ID NO: 3134204 - RNA, 15 nt, Human
ccacaaguuaaauaa

SEQ ID NO: 3134205 - RNA, 20 nt, Human
ccacaaguuaaauaaaucau

SEQ ID NO: 3134206 - RNA, 18 nt, Human
ccacaaaggagagcuagc

SEQ ID NO: 3134207 - RNA, 13 nt, Human
ccacaagagccca

SEQ ID NO: 3134208 - RNA, 16 nt, Human
ccacaagacccuugug

SEQ ID NO: 3134209 - RNA, 18 nt, Human
ccaaggugggaggauugc

SEQ ID NO: 3134210 - RNA, 14 nt, Human
ccaaggcuggggga

SEQ ID NO: 3134211 - RNA, 13 nt, Human
ccaagcucccagg

SEQ ID NO: 3134212 - RNA, 12 nt, Human
ccaagcucccag

SEQ ID NO: 3134213 - RNA, 14 nt, Human
ccaagcaggacaug

SEQ ID NO: 3134214 - RNA, 23 nt, Human
ccaagcagagguugggaggccau

SEQ ID NO: 3134215 - RNA, 13 nt, Human
ccaaagaugcagc

SEQ ID NO: 3134216 - RNA, 14 nt, Human
ccaaagaugcagcc

SEQ ID NO: 3134217 - RNA, 13 nt, Human
ccaacaucaacau

SEQ ID NO: 3134218 - RNA, 14 nt, Human
ccaacauacuccca

SEQ ID NO: 3134219 - RNA, 16 nt, Human
ccaacaucaacaucuu

SEQ ID NO: 3134220 - RNA, 15 nt, Human
ccaaauucuuucagu

SEQ ID NO: 3134221 - RNA, 22 nt, Human
ccaaauucuuucaguggcuacc

SEQ ID NO: 3134222 - RNA, 15 nt, Human
ccaagaccuucuccu

SEQ ID NO: 3134223 - RNA, 15 nt, Human
ccaacccucaucacc

SEQ ID NO: 3134224 - RNA, 13 nt, Human
ccaacccucauca

SEQ ID NO: 3134225 - RNA, 21 nt, Human
caugugccagguuuuuggucu

SEQ ID NO: 3134226 - RNA, 15 nt, Human
caugugcacaugcac

SEQ ID NO: 3134227 - RNA, 15 nt, Human
cauguuugugauuga

SEQ ID NO: 3134228 - RNA, 18 nt, Human
cauguaauuaaguacuau

SEQ ID NO: 3134229 - RNA, 21 nt, Human
cauguaauuaaguacuaugua

SEQ ID NO: 3134230 - RNA, 23 nt, Human
caugucuuuucuugcaugaggcu

SEQ ID NO: 3134231 - RNA, 21 nt, Human
caugucuuuucuugcaugagg

SEQ ID NO: 3134232 - RNA, 19 nt, Human
caugucuuuucuugcauga

SEQ ID NO: 3134233 - RNA, 14 nt, Human
caugucuuuucuug

SEQ ID NO: 3134234 - RNA, 16 nt, Human
cauggucggaaaacau

SEQ ID NO: 3134235 - RNA, 15 nt, Human
cauguuuuguuuacg

SEQ ID NO: 3134236 - RNA, 20 nt, Human
caugccagcuuaucucaggg

SEQ ID NO: 3134237 - RNA, 19 nt, Human
caugccagcuuaucucagg

SEQ ID NO: 3134238 - RNA, 13 nt, Human
caugccccugaac

SEQ ID NO: 3134239 - RNA, 15 nt, Human
caugccucucucagg

SEQ ID NO: 3134240 - RNA, 14 nt, Human
caugccucucucag

SEQ ID NO: 3134241 - RNA, 13 nt, Human
caugccuggaugg

SEQ ID NO: 3134242 - RNA, 19 nt, Human
caugccucucucaggccaa

SEQ ID NO: 3134243 - RNA, 18 nt, Human
caugccucucucaggcca

SEQ ID NO: 3134244 - RNA, 17 nt, Human
caugccucucucaggcc

SEQ ID NO: 3134245 - RNA, 16 nt, Human
caugccucucucaggc

SEQ ID NO: 3134246 - RNA, 15 nt, Human
caugggccuccugug

SEQ ID NO: 3134247 - RNA, 22 nt, Human
caugggaaugaaugucagugug

SEQ ID NO: 3134248 - RNA, 16 nt, Human
caugggccuccugugu

SEQ ID NO: 3134249 - RNA, 17 nt, Human
caugggccuccugugug

SEQ ID NO: 3134250 - RNA, 18 nt, Human
caugggaaugaaugucag

SEQ ID NO: 3134251 - RNA, 16 nt, Human
cauggaguauauguca

SEQ ID NO: 3134252 - RNA, 13 nt, Human
cauggacuuuguu

SEQ ID NO: 3134253 - RNA, 11 nt, Human
cauggacuuug

SEQ ID NO: 3134254 - RNA, 17 nt, Human
cauggagguuugaagau

SEQ ID NO: 3134255 - RNA, 23 nt, Human
caugccuggauggggcugcaccg

SEQ ID NO: 3134256 - RNA, 21 nt, Human
caugccuggauggggcugcac

SEQ ID NO: 3134257 - RNA, 18 nt, Human
caugccuggauggggcug

SEQ ID NO: 3134258 - RNA, 17 nt, Human
caugcgggcuuccuccu

SEQ ID NO: 3134259 - RNA, 22 nt, Human
caugcugucccuuacgugaguc

SEQ ID NO: 3134260 - RNA, 17 nt, Human
caugcugucccuuacgu

SEQ ID NO: 3134261 - RNA, 22 nt, Human
cauggaaguacuauaauuuacc

SEQ ID NO: 3134262 - RNA, 20 nt, Human
cauggaaguacuauaauuua

SEQ ID NO: 3134263 - RNA, 16 nt, Human
cauggaauaacaugua

SEQ ID NO: 3134264 - RNA, 18 nt, Human
cauggacaugaucuucuu

SEQ ID NO: 3134265 - RNA, 17 nt, Human
guuaagagaaaugagcu

SEQ ID NO: 3134266 - RNA, 17 nt, Human
cccgggcucugccuccc

SEQ ID NO: 3134267 - RNA, 17 nt, Human
gaacaaggcaaggcugu

SEQ ID NO: 3134268 - RNA, 12 nt, Human
gagaaaugagcu

SEQ ID NO: 3134269 - RNA, 14 nt, Human
ggcccccaaaugga

SEQ ID NO: 3134270 - RNA, 22 nt, Human
ggaagagcuccuugauauccuc

SEQ ID NO: 3134271 - RNA, 16 nt, Human
agucccugccaaugga

SEQ ID NO: 3134272 - RNA, 15 nt, Human
cugcuucagccuccc

SEQ ID NO: 3134273 - RNA, 12 nt, Human
ccucagccuccc

SEQ ID NO: 3134274 - RNA, 19 nt, Human
ccaaagcagugcaugcugu

SEQ ID NO: 3134275 - RNA, 20 nt, Human
ccaggcugggagagccuucc

SEQ ID NO: 3134276 - RNA, 21 nt, Human
auuguuucuuucaauaucccc

SEQ ID NO: 3134277 - RNA, 15 nt, Human
ccaccucagccuccc

SEQ ID NO: 3134278 - RNA, 24 nt, Human
cccugugaguacuacaguccuccc

SEQ ID NO: 3134279 - RNA, 21 nt, Murray Valley encephalitis virus
aggccagccgguuaggcugcc

SEQ ID NO: 3134280 - RNA, 16 nt, Murray Valley encephalitis virus
ugaguggcccaagcuc

SEQ ID NO: 3134281 - RNA, 16 nt, Murray Valley encephalitis virus
cgccgaggagugcaau

SEQ ID NO: 3134282 - RNA, 14 nt, Murray Valley encephalitis virus
gaggccccaggagg

SEQ ID NO: 3134283 - RNA, 11 nt, Murray Valley encephalitis virus
aaccccaggag

SEQ ID NO: 3134284 - RNA, 13 nt, Murray Valley encephalitis virus
uagagguuagagg

SEQ ID NO: 3134285 - RNA, 18 nt, Murray Valley encephalitis virus
cgaggagugcaaucugug

SEQ ID NO: 3134286 - RNA, 23 nt, Murray Valley encephalitis virus
ccgcagcccgggccgggaggagg

SEQ ID NO: 3134287 - RNA, 18 nt, Murray Valley encephalitis virus
ucugugaggccccaggag

SEQ ID NO: 3134288 - RNA, 22 nt, Murray Valley encephalitis virus
acgguuggaaagccucccagaa

SEQ ID NO: 3134289 - RNA, 16 nt, Murray Valley encephalitis virus
uagagguuagaggaga

SEQ ID NO: 3134290 - RNA, 18 nt, Murray Valley encephalitis virus
cuagagguuagaggagac

SEQ ID NO: 3134291 - RNA, 15 nt, Murray Valley encephalitis virus
ugaggccccaggagg

SEQ ID NO: 3134292 - RNA, 12 nt, Murray Valley encephalitis virus
gucucggaagag

SEQ ID NO: 3134293 - RNA, 15 nt, Murray Valley encephalitis virus
ccacuucgccgagga

SEQ ID NO: 3134294 - RNA, 16 nt, Murray Valley encephalitis virus
gaccaaccccaggagg

SEQ ID NO: 3134295 - RNA, 22 nt, Murray Valley encephalitis virus
aggccagccgguuaggcugcca

SEQ ID NO: 3134296 - RNA, 14 nt, Murray Valley encephalitis virus
guuaggcugccacc

SEQ ID NO: 3134297 - RNA, 17 nt, Murray Valley encephalitis virus
ggaagaggagucccugc

SEQ ID NO: 3134298 - RNA, 21 nt, Murray Valley encephalitis virus
gccgaacacugugacugaugg

SEQ ID NO: 3134299 - RNA, 20 nt, Murray Valley encephalitis virus
gccugcgaccaaccccagga

SEQ ID NO: 3134300 - RNA, 21 nt, Murray Valley encephalitis virus
ugcaaucugugaggccccagg

SEQ ID NO: 3134301 - RNA, 21 nt, Murray Valley encephalitis virus
ugcgaccaaccccaggaggac

SEQ ID NO: 3134302 - RNA, 16 nt, Murray Valley encephalitis virus
gugaggccccaggagg

SEQ ID NO: 3134303 - RNA, 21 nt, Murray Valley encephalitis virus
cccccgcagcccgggccggga

SEQ ID NO: 3134304 - RNA, 13 nt, Murray Valley encephalitis virus
gaucuucugcucu

SEQ ID NO: 3134305 - RNA, 14 nt, Murray Valley encephalitis virus
caggaggacugggu

SEQ ID NO: 3134306 - RNA, 17 nt, Murray Valley encephalitis virus
gaccaaccccaggagga

SEQ ID NO: 3134307 - RNA, 15 nt, Murray Valley encephalitis virus
ugcucuauuccaaca

SEQ ID NO: 3134308 - RNA, 15 nt, Murray Valley encephalitis virus
acggacuagagguua

SEQ ID NO: 3134309 - RNA, 15 nt, Murray Valley encephalitis virus
gugcugccugcgacc

SEQ ID NO: 3134310 - RNA, 23 nt, Murray Valley encephalitis virus
uguaauauaguauagguaaaauu

SEQ ID NO: 3134311 - RNA, 11 nt, Murray Valley encephalitis virus
aggaggacugg

SEQ ID NO: 3134312 - RNA, 15 nt, Murray Valley encephalitis virus
ggagaagaccacagg

SEQ ID NO: 3134313 - RNA, 13 nt, Murray Valley encephalitis virus
gaggccccaggag

SEQ ID NO: 3134314 - RNA, 15 nt, Murray Valley encephalitis virus
gaaaagacuaggaga

SEQ ID NO: 3134315 - RNA, 15 nt, Murray Valley encephalitis virus
uggagaugaagcccg

SEQ ID NO: 3134316 - RNA, 20 nt, Murray Valley encephalitis virus
agucacaaggcaccgagcgc

SEQ ID NO: 3134317 - RNA, 22 nt, Murray Valley encephalitis virus
cgucucggaagaggagucccug

SEQ ID NO: 3134318 - RNA, 16 nt, Murray Valley encephalitis virus
ugugaggccccaggag

SEQ ID NO: 3134319 - RNA, 22 nt, Murray Valley encephalitis virus
cugcgaccaaccccaggaggac

SEQ ID NO: 3134320 - RNA, 15 nt, Murray Valley encephalitis virus
caggccagccgguua

SEQ ID NO: 3134321 - RNA, 23 nt, Murray Valley encephalitis virus
acugaugggggagaagaccacag

SEQ ID NO: 3134322 - RNA, 15 nt, Murray Valley encephalitis virus
accaaccccaggagg

SEQ ID NO: 3134323 - RNA, 21 nt, Murray Valley encephalitis virus
cccaggaggacuggguaaaca

SEQ ID NO: 3134324 - RNA, 17 nt, Murray Valley encephalitis virus
agcccgggccgggagga

SEQ ID NO: 3134325 - RNA, 21 nt, Murray Valley encephalitis virus
aucugugaggccccaggagga

SEQ ID NO: 3134326 - RNA, 20 nt, Murray Valley encephalitis virus
gacugaugggggagaagacc

SEQ ID NO: 3134327 - RNA, 20 nt, Murray Valley encephalitis virus
aaccgucucggaagaggagu

SEQ ID NO: 3134328 - RNA, 19 nt, Murray Valley encephalitis virus
ggagugcaaucugugaggc

SEQ ID NO: 3134329 - RNA, 20 nt, Murray Valley encephalitis virus
caccugggaaaagacuagga

SEQ ID NO: 3134330 - RNA, 14 nt, Murray Valley encephalitis virus
agacggugcugccu

SEQ ID NO: 3134331 - RNA, 18 nt, Murray Valley encephalitis virus
gguuggaaagccucccag

SEQ ID NO: 3134332 - RNA, 19 nt, Murray Valley encephalitis virus
aucugugaggccccaggag

SEQ ID NO: 3134333 - RNA, 20 nt, Murray Valley encephalitis virus
ggacuagagguuagaggaga

SEQ ID NO: 3134334 - RNA, 15 nt, Murray Valley encephalitis virus
aggcccccgcagccc

SEQ ID NO: 3134335 - RNA, 13 nt, Murray Valley encephalitis virus
ccugggaaaagac

SEQ ID NO: 3134336 - RNA, 18 nt, Murray Valley encephalitis virus
gcgaccaaccccaggagg

SEQ ID NO: 3134337 - RNA, 22 nt, Murray Valley encephalitis virus
aagcgccacuucgccgaggagu

SEQ ID NO: 3134338 - RNA, 13 nt, Murray Valley encephalitis virus
agagguuagagga

SEQ ID NO: 3134339 - RNA, 23 nt, Murray Valley encephalitis virus
acaccugggaaaagacuaggaga

SEQ ID NO: 3134340 - RNA, 21 nt, Murray Valley encephalitis virus
cuagagguuagaggagacccu

SEQ ID NO: 3134341 - RNA, 12 nt, Murray Valley encephalitis virus
aaccccaggagg

SEQ ID NO: 3134342 - RNA, 13 nt, Murray Valley encephalitis virus
ugaggccccagga

SEQ ID NO: 3134343 - RNA, 18 nt, Murray Valley encephalitis virus
acuagagguuagaggaga

SEQ ID NO: 3134344 - RNA, 14 nt, Murray Valley encephalitis virus
agaggagaccccac

SEQ ID NO: 3134345 - RNA, 16 nt, Murray Valley encephalitis virus
gccccaggaggacugg

SEQ ID NO: 3134346 - RNA, 15 nt, Murray Valley encephalitis virus
gggccgggaggaggu

SEQ ID NO: 3134347 - RNA, 19 nt, Murray Valley encephalitis virus
ugcgaccaaccccaggagg

SEQ ID NO: 3134348 - RNA, 22 nt, Murray Valley encephalitis virus
agaaccgucucggaagaggagu

SEQ ID NO: 3134349 - RNA, 15 nt, Murray Valley encephalitis virus
gaggccccaggagga

SEQ ID NO: 3134350 - RNA, 22 nt, Murray Valley encephalitis virus
aucuucugcucuauuccaacau

SEQ ID NO: 3134351 - RNA, 22 nt, Murray Valley encephalitis virus
gcccaagcucgccgaagcugua

SEQ ID NO: 3134352 - RNA, 15 nt, Murray Valley encephalitis virus
agugcaaucugugag

SEQ ID NO: 3134353 - RNA, 18 nt, Murray Valley encephalitis virus
uaguauagguaaaauuuu

SEQ ID NO: 3134354 - RNA, 21 nt, Murray Valley encephalitis virus
ccagccgguuaggcugccacc

SEQ ID NO: 3134355 - RNA, 19 nt, Murray Valley encephalitis virus
guggacggacuagagguua

SEQ ID NO: 3134356 - RNA, 14 nt, Murray Valley encephalitis virus
ggaggaggugaugc

SEQ ID NO: 3134357 - RNA, 18 nt, Murray Valley encephalitis virus
aggagaucuucugcucua

SEQ ID NO: 3134358 - RNA, 12 nt, Murray Valley encephalitis virus
acuggguaaaca

SEQ ID NO: 3134359 - RNA, 20 nt, Murray Valley encephalitis virus
cugugaggccccaggaggac

SEQ ID NO: 3134360 - RNA, 13 nt, Murray Valley encephalitis virus
gugaggccccagg

SEQ ID NO: 3134361 - RNA, 15 nt, Murray Valley encephalitis virus
gcgaccaaccccagg

SEQ ID NO: 3134362 - RNA, 16 nt, Murray Valley encephalitis virus
ugcgaccaaccccagg

SEQ ID NO: 3134363 - RNA, 24 nt, Murray Valley encephalitis virus
gacuagagguuagaggagacccug

SEQ ID NO: 3134364 - RNA, 20 nt, Murray Valley encephalitis virus
guuggaaagccucccagaac

SEQ ID NO: 3134365 - RNA, 19 nt, Murray Valley encephalitis virus
agguuagaggagacccugc

SEQ ID NO: 3134366 - RNA, 22 nt, Murray Valley encephalitis virus
ugccugcgaccaaccccaggag

SEQ ID NO: 3134367 - RNA, 15 nt, Murray Valley encephalitis virus
caggaggacuggguu

SEQ ID NO: 3134368 - RNA, 19 nt, Murray Valley encephalitis virus
gccugcgaccaaccccagg

SEQ ID NO: 3134369 - RNA, 18 nt, Murray Valley encephalitis virus
aggccccaggaggacugg

SEQ ID NO: 3134370 - RNA, 14 nt, Murray Valley encephalitis virus
ccaggaggacuggg

SEQ ID NO: 3134371 - RNA, 13 nt, Murray Valley encephalitis virus
ccguaaggccccc

SEQ ID NO: 3134372 - RNA, 18 nt, Murray Valley encephalitis virus
guuaccaaagcugauucu

SEQ ID NO: 3134373 - RNA, 17 nt, Murray Valley encephalitis virus
ccugcggaagaaaugag

SEQ ID NO: 3134374 - RNA, 14 nt, Murray Valley encephalitis virus
ccaaccccaggagg

SEQ ID NO: 3134375 - RNA, 13 nt, Murray Valley encephalitis virus
aaccccaggagga

SEQ ID NO: 3134376 - RNA, 15 nt, Murray Valley encephalitis virus
gguagacggugcugc

SEQ ID NO: 3134377 - RNA, 22 nt, Murray Valley encephalitis virus
cugccugcgaccaaccccagga

SEQ ID NO: 3134378 - RNA, 16 nt, Murray Valley encephalitis virus
gacugaugggggagaa

SEQ ID NO: 3134379 - RNA, 19 nt, Murray Valley encephalitis virus
caagcucgccgaagcugua

SEQ ID NO: 3134380 - RNA, 19 nt, Murray Valley encephalitis virus
cggguggacggacuagagg

SEQ ID NO: 3134381 - RNA, 20 nt, Murray Valley encephalitis virus
caaucugugaggccccagga

SEQ ID NO: 3134382 - RNA, 13 nt, Murray Valley encephalitis virus
aagcuguaaggcg

SEQ ID NO: 3134383 - RNA, 14 nt, Murray Valley encephalitis virus
agccguaaggcccc

SEQ ID NO: 3134384 - RNA, 23 nt, Murray Valley encephalitis virus
ccccaggaggacuggguaaacaa

SEQ ID NO: 3134385 - RNA, 13 nt, Murray Valley encephalitis virus
aagccguaaggcc

SEQ ID NO: 3134386 - RNA, 13 nt, Murray Valley encephalitis virus
cgccgaagcugua

SEQ ID NO: 3134387 - RNA, 13 nt, Murray Valley encephalitis virus
aggaggacugggu

SEQ ID NO: 3134388 - RNA, 13 nt, Murray Valley encephalitis virus
aggccccaggagg

SEQ ID NO: 3134389 - RNA, 19 nt, Murray Valley encephalitis virus
ugguagacggugcugccug

SEQ ID NO: 3134390 - RNA, 17 nt, Murray Valley encephalitis virus
acuggguuaccaaagcu

SEQ ID NO: 3134391 - RNA, 17 nt, Murray Valley encephalitis virus
ugaaauuaaguaaaauu

SEQ ID NO: 3134392 - RNA, 11 nt, Murray Valley encephalitis virus
agccucccaga

SEQ ID NO: 3134393 - RNA, 22 nt, Murray Valley encephalitis virus
aggacuagagguuagaggagac

SEQ ID NO: 3134394 - RNA, 23 nt, Murray Valley encephalitis virus
ccccaggaggacuggguuaccaa

SEQ ID NO: 3134395 - RNA, 15 nt, Murray Valley encephalitis virus
ccccaggaggacugg

SEQ ID NO: 3134396 - RNA, 15 nt, Murray Valley encephalitis virus
uugauagaaaauuuu

SEQ ID NO: 3134397 - RNA, 14 nt, Murray Valley encephalitis virus
accaaccccaggag

SEQ ID NO: 3134398 - RNA, 23 nt, Murray Valley encephalitis virus
auguaauauaguauagguaaaau

SEQ ID NO: 3134399 - RNA, 18 nt, Murray Valley encephalitis virus
gacuggguuaccaaagcu

SEQ ID NO: 3134400 - RNA, 22 nt, Murray Valley encephalitis virus
gagugcaaucugugaggcccca

SEQ ID NO: 3134401 - RNA, 22 nt, Murray Valley encephalitis virus
caacaucagucacaaggcaccg

SEQ ID NO: 3134402 - RNA, 17 nt, Murray Valley encephalitis virus
gacugaugggggagaag

SEQ ID NO: 3134403 - RNA, 17 nt, Murray Valley encephalitis virus
aaccccaggaggacugg

SEQ ID NO: 3134404 - RNA, 23 nt, Murray Valley encephalitis virus
acggacuagagguuagaggagac

SEQ ID NO: 3134405 - RNA, 18 nt, Murray Valley encephalitis virus
aaccccggcgaaggacua

SEQ ID NO: 3134406 - RNA, 21 nt, Murray Valley encephalitis virus
aaucugugaggccccaggagg

SEQ ID NO: 3134407 - RNA, 20 nt, Murray Valley encephalitis virus
cagaucgcgaaagcgccacu

SEQ ID NO: 3134408 - RNA, 16 nt, Murray Valley encephalitis virus
ugaggccccaggagga

SEQ ID NO: 3134409 - RNA, 17 nt, Murray Valley encephalitis virus
gguggacggacuagagg

SEQ ID NO: 3134410 - RNA, 22 nt, Murray Valley encephalitis virus
ugacugaugggggagaagacca

SEQ ID NO: 3134411 - RNA, 15 nt, Murray Valley encephalitis virus
guaaacaaagccgua

SEQ ID NO: 3134412 - RNA, 21 nt, Murray Valley encephalitis virus
cccagaaccgucucggaagag

SEQ ID NO: 3134413 - RNA, 12 nt, Murray Valley encephalitis virus
aggccccaggag

SEQ ID NO: 3134414 - RNA, 17 nt, Murray Valley encephalitis virus
accugggaaaagacuag

SEQ ID NO: 3134415 - RNA, 15 nt, Murray Valley encephalitis virus
cgaccaaccccagga

SEQ ID NO: 3134416 - RNA, 18 nt, Murray Valley encephalitis virus
accccaggaggacugggu

SEQ ID NO: 3134417 - RNA, 22 nt, Murray Valley encephalitis virus
caccgagcgccgaacacuguga

SEQ ID NO: 3134418 - RNA, 19 nt, Murray Valley encephalitis virus
gcgaccaaccccaggagga

SEQ ID NO: 3134419 - RNA, 20 nt, Murray Valley encephalitis virus
agaaaugaguggcccaagcu

SEQ ID NO: 3134420 - RNA, 15 nt, Murray Valley encephalitis virus
agaagaccacaggau

SEQ ID NO: 3134421 - RNA, 22 nt, Murray Valley encephalitis virus
caaucugugaggccccaggagg

SEQ ID NO: 3134422 - RNA, 18 nt, Murray Valley encephalitis virus
ugcgaccaaccccaggag

SEQ ID NO: 3134423 - RNA, 15 nt, Murray Valley encephalitis virus
gagucccugccaaca

SEQ ID NO: 3134424 - RNA, 20 nt, Murray Valley encephalitis virus
ugcgaccaaccccaggagga

SEQ ID NO: 3134425 - RNA, 21 nt, Murray Valley encephalitis virus
cuagagguuagaggagacccc

SEQ ID NO: 3134426 - RNA, 18 nt, Murray Valley encephalitis virus
ggaaaagacuaggagauc

SEQ ID NO: 3134427 - RNA, 15 nt, Murray Valley encephalitis virus
gaagaggagucccug

SEQ ID NO: 3134428 - RNA, 22 nt, Murray Valley encephalitis virus
acagcauauugacaccugggaa

SEQ ID NO: 3134429 - RNA, 21 nt, Murray Valley encephalitis virus
cccaggaggacuggguuacca

SEQ ID NO: 3134430 - RNA, 22 nt, Murray Valley encephalitis virus
auuuaauguaauauaguauagg

SEQ ID NO: 3134431 - RNA, 21 nt, Murray Valley encephalitis virus
ucugugaggccccaggaggac

SEQ ID NO: 3134432 - RNA, 21 nt, Murray Valley encephalitis virus
caaucugugaggccccaggag

SEQ ID NO: 3134433 - RNA, 19 nt, Murray Valley encephalitis virus
ugcugccugcgaccaaccc

SEQ ID NO: 3134434 - RNA, 22 nt, Murray Valley encephalitis virus
aggagugcaaucugugaggccc

SEQ ID NO: 3134435 - RNA, 16 nt, Murray Valley encephalitis virus
cugggaaaagacuagg

SEQ ID NO: 3134436 - RNA, 17 nt, Murray Valley encephalitis virus
cugcgaccaaccccagg

SEQ ID NO: 3134437 - RNA, 15 nt, Murray Valley encephalitis virus
caggaggacugggua

SEQ ID NO: 3134438 - RNA, 22 nt, Murray Valley encephalitis virus
gguugguagacggugcugccug

SEQ ID NO: 3134439 - RNA, 21 nt, Murray Valley encephalitis virus
ggacuagagguuagaggagac

SEQ ID NO: 3134440 - RNA, 13 nt, Murray Valley encephalitis virus
ggccccaggagga

SEQ ID NO: 3134441 - RNA, 13 nt, Murray Valley encephalitis virus
ccaggaggacugg

SEQ ID NO: 3134442 - RNA, 18 nt, Murray Valley encephalitis virus
aagaggagucccugccaa

SEQ ID NO: 3134443 - RNA, 19 nt, Murray Valley encephalitis virus
ccugcgaccaaccccagga

SEQ ID NO: 3134444 - RNA, 18 nt, Murray Valley encephalitis virus
aaggcaccgagcgccgaa

SEQ ID NO: 3134445 - RNA, 17 nt, Murray Valley encephalitis virus
cuagagguuagaggaga

SEQ ID NO: 3134446 - RNA, 16 nt, Murray Valley encephalitis virus
agagguuagaggagac

SEQ ID NO: 3134447 - RNA, 22 nt, Murray Valley encephalitis virus
gaccaaccccaggaggacuggg

SEQ ID NO: 3134448 - RNA, 16 nt, Murray Valley encephalitis virus
cugugaggccccagga

SEQ ID NO: 3134449 - RNA, 14 nt, Murray Valley encephalitis virus
acuugauagucagg

SEQ ID NO: 3134450 - RNA, 21 nt, Murray Valley encephalitis virus
cuucugcucuauuccaacauc

SEQ ID NO: 3134451 - RNA, 14 nt, Murray Valley encephalitis virus
aggccccaggagga

SEQ ID NO: 3134452 - RNA, 17 nt, Murray Valley encephalitis virus
auuaaguagcaagacuu

SEQ ID NO: 3134453 - RNA, 16 nt, Murray Valley encephalitis virus
cuucgccgaggagugc

SEQ ID NO: 3134454 - RNA, 14 nt, Murray Valley encephalitis virus
gccgaacacuguga

SEQ ID NO: 3134455 - RNA, 15 nt, Murray Valley encephalitis virus
aaggacuagagguua

SEQ ID NO: 3134456 - RNA, 17 nt, Murray Valley encephalitis virus
gcagcccgggccgggag

SEQ ID NO: 3134457 - RNA, 13 nt, Murray Valley encephalitis virus
caaccccaggagg

SEQ ID NO: 3134458 - RNA, 16 nt, Murray Valley encephalitis virus
ggcgaaggacuagagg

SEQ ID NO: 3134459 - RNA, 17 nt, Murray Valley encephalitis virus
cugccugcgaccaaccc

SEQ ID NO: 3134460 - RNA, 12 nt, Murray Valley encephalitis virus
gaacacugugac

SEQ ID NO: 3134461 - RNA, 19 nt, Murray Valley encephalitis virus
ucucaaaagcaucaaacaa

SEQ ID NO: 3134462 - RNA, 19 nt, Murray Valley encephalitis virus
ccacgguuggaaagccucc

SEQ ID NO: 3134463 - RNA, 20 nt, Murray Valley encephalitis virus
gagucccugccaacaaugga

SEQ ID NO: 3134464 - RNA, 12 nt, Human
aaaaacaacuuu

SEQ ID NO: 3134465 - RNA, 12 nt, Human
aaaacaacuuua

SEQ ID NO: 3134466 - RNA, 14 nt, Human
aauuaaauuuugag

SEQ ID NO: 3134467 - RNA, 18 nt, Human
aaucucauaauuuauaca

SEQ ID NO: 3134468 - RNA, 21 nt, Human
aaugauaaguaaaugcuaggu

SEQ ID NO: 3134469 - RNA, 18 nt, Human
aaugauaaguaaaugcua

SEQ ID NO: 3134470 - RNA, 14 nt, Human
aauauuauguguuu

SEQ ID NO: 3134471 - RNA, 21 nt, Human
aaauugauguguuuauuuaua

SEQ ID NO: 3134472 - RNA, 16 nt, Human
aacuuuggaacaagau

SEQ ID NO: 3134473 - RNA, 14 nt, Human
aaauaguauuugag

SEQ ID NO: 3134474 - RNA, 21 nt, Human
aaaauuauuuuguucauacau

SEQ ID NO: 3134475 - RNA, 12 nt, Human
acuguuuugaau

SEQ ID NO: 3134476 - RNA, 19 nt, Human
acuuuauacccagaaaguu

SEQ ID NO: 3134477 - RNA, 23 nt, Human
agaaaauauuauguguuuccaua

SEQ ID NO: 3134478 - RNA, 21 nt, Human
acagaauauguuucaaacuuu

SEQ ID NO: 3134479 - RNA, 19 nt, Human
acagaauauguuucaaacu

SEQ ID NO: 3134480 - RNA, 17 nt, Human
acagaauauguuucaaa

SEQ ID NO: 3134481 - RNA, 16 nt, Human
acagaauauguuucaa

SEQ ID NO: 3134482 - RNA, 19 nt, Human
acaggucauauuaauauau

SEQ ID NO: 3134483 - RNA, 20 nt, Human
aauuuugaguucuacauaag

SEQ ID NO: 3134484 - RNA, 15 nt, Human
aauuuuauaucuugu

SEQ ID NO: 3134485 - RNA, 14 nt, Human
acaacuuuauaccc

SEQ ID NO: 3134486 - RNA, 13 nt, Human
acaacuuuauacc

SEQ ID NO: 3134487 - RNA, 18 nt, Human
acaacuucccagugaauu

SEQ ID NO: 3134488 - RNA, 17 nt, Human
acaacuucaauauccaa

SEQ ID NO: 3134489 - RNA, 16 nt, Human
acaacuauuuuuccaa

SEQ ID NO: 3134490 - RNA, 14 nt, Human
agacacaacuauuu

SEQ ID NO: 3134491 - RNA, 19 nt, Human
agcuuccuucugugaaagu

SEQ ID NO: 3134492 - RNA, 15 nt, Human
agguuaauuccaauu

SEQ ID NO: 3134493 - RNA, 22 nt, Human
agguuaauuccaauuauaugag

SEQ ID NO: 3134494 - RNA, 22 nt, Human
auauaaguauucuaaauuuuau

SEQ ID NO: 3134495 - RNA, 15 nt, Human
auauccuuucuaaca

SEQ ID NO: 3134496 - RNA, 16 nt, Human
auauccuuucuaacaa

SEQ ID NO: 3134497 - RNA, 17 nt, Human
auguaauaacugugaag

SEQ ID NO: 3134498 - RNA, 13 nt, Human
auccuuucuaaca

SEQ ID NO: 3134499 - RNA, 14 nt, Human
augacucagaauau

SEQ ID NO: 3134500 - RNA, 20 nt, Human
augaaacacucaguuguuca

SEQ ID NO: 3134501 - RNA, 18 nt, Human
cugugaaguuuacauugu

SEQ ID NO: 3134502 - RNA, 23 nt, Human
cugugaaguuuacauuguaaaua

SEQ ID NO: 3134503 - RNA, 16 nt, Human
gaacaagaugguucua

SEQ ID NO: 3134504 - RNA, 19 nt, Human
gaaaucaaagagagaaaau

SEQ ID NO: 3134505 - RNA, 23 nt, Human
ggaucuucaucugacuaugacau

SEQ ID NO: 3134506 - RNA, 20 nt, Human
aaaaagccugcaauuucaua

SEQ ID NO: 3134507 - RNA, 23 nt, Human
aaaaagauuuucagaaaauauua

SEQ ID NO: 3134508 - RNA, 15 nt, Human
aaaauauauuuaaug

SEQ ID NO: 3134509 - RNA, 16 nt, Human
aaaauauauuuaauga

SEQ ID NO: 3134510 - RNA, 21 nt, Human
aaacuucccuuucugcuugug

SEQ ID NO: 3134511 - RNA, 15 nt, Human
aaauauauuuaauga

SEQ ID NO: 3134512 - RNA, 14 nt, Human
aaauauauuuaaug

SEQ ID NO: 3134513 - RNA, 20 nt, Human
aaauauuguguugugaaugu

SEQ ID NO: 3134514 - RNA, 15 nt, Human
guaauagagcaaaau

SEQ ID NO: 3134515 - RNA, 20 nt, Human
gguucuagcauggcauauuu

SEQ ID NO: 3134516 - RNA, 23 nt, Human
cauaugcuguauauccuuucuaa

SEQ ID NO: 3134517 - RNA, 15 nt, Human
cauauuaauauauuu

SEQ ID NO: 3134518 - RNA, 14 nt, Human
cauauuaauauauu

SEQ ID NO: 3134519 - RNA, 19 nt, Human
cauauuaauauauuuccau

SEQ ID NO: 3134520 - RNA, 12 nt, Human
cagaauauguuu

SEQ ID NO: 3134521 - RNA, 13 nt, Human
cagaauauugcuu

SEQ ID NO: 3134522 - RNA, 20 nt, Human
cagaauauguuucaaacuuu

SEQ ID NO: 3134523 - RNA, 18 nt, Human
cagaauauguuucaaacu

SEQ ID NO: 3134524 - RNA, 17 nt, Human
cagaauauguuucaaac

SEQ ID NO: 3134525 - RNA, 15 nt, Human
cagaauauguuucaa

SEQ ID NO: 3134526 - RNA, 14 nt, Human
cagaauauguuuca

SEQ ID NO: 3134527 - RNA, 13 nt, Human
cagaauauguuuc

SEQ ID NO: 3134528 - RNA, 18 nt, Human
caaaaaaauauauuuaau

SEQ ID NO: 3134529 - RNA, 20 nt, Human
caacuauuuuuccaaaauaa

SEQ ID NO: 3134530 - RNA, 18 nt, Human
auuaaauuuugaguucua

SEQ ID NO: 3134531 - RNA, 22 nt, Human
auucaagaaaacaacuucaaua

SEQ ID NO: 3134532 - RNA, 22 nt, Human
auuuaaugauaaguaaaugcua

SEQ ID NO: 3134533 - RNA, 19 nt, Human
auuuauacaggucauauua

SEQ ID NO: 3134534 - RNA, 23 nt, Human
cgccacuguuuugaaucucauaa

SEQ ID NO: 3134535 - RNA, 13 nt, Human
cugaaacuucccu

SEQ ID NO: 3134536 - RNA, 19 nt, Human
guauucuagcuaauguaau

SEQ ID NO: 3134537 - RNA, 24 nt, Human
guauucuaaauuuuauaucuugua

SEQ ID NO: 3134538 - RNA, 21 nt, Human
guauucuaaauuuuauaucuu

SEQ ID NO: 3134539 - RNA, 23 nt, Human
aacuauucaggagaguagaacag

SEQ ID NO: 3134540 - RNA, 14 nt, Human
gugaaguuuacauu

SEQ ID NO: 3134541 - RNA, 17 nt, Human
aacugugaaguuuacau

SEQ ID NO: 3134542 - RNA, 19 nt, Human
aacugugaaguuuacauug

SEQ ID NO: 3134543 - RNA, 14 nt, Human
aagaaaacaacuuc

SEQ ID NO: 3134544 - RNA, 12 nt, Human
aaguaaaugcua

SEQ ID NO: 3134545 - RNA, 19 nt, Human
aaguauguguaaaauguga

SEQ ID NO: 3134546 - RNA, 18 nt, Human
aaguauguguaaaaugug

SEQ ID NO: 3134547 - RNA, 11 nt, Human
uaaaaugugaa

SEQ ID NO: 3134548 - RNA, 13 nt, Human
uaaaaugugaagu

SEQ ID NO: 3134549 - RNA, 21 nt, Human
uaaaaauauuguguugugaau

SEQ ID NO: 3134550 - RNA, 22 nt, Human
uaaaaauauuguguugugaaug

SEQ ID NO: 3134551 - RNA, 14 nt, Human
uaaaaauauugugu

SEQ ID NO: 3134552 - RNA, 19 nt, Human
uaaaaagccugcaauuuca

SEQ ID NO: 3134553 - RNA, 22 nt, Human
uaaaaagccugcaauuucauau

SEQ ID NO: 3134554 - RNA, 15 nt, Human
guguaaaaugugaag

SEQ ID NO: 3134555 - RNA, 18 nt, Human
guuauugauaaguucaua

SEQ ID NO: 3134556 - RNA, 21 nt, Human
guuauugauaaguucauacau

SEQ ID NO: 3134557 - RNA, 22 nt, Human
guuauugauaaguucauacauu

SEQ ID NO: 3134558 - RNA, 19 nt, Human
guuaauuccaauuauauga

SEQ ID NO: 3134559 - RNA, 22 nt, Human
guucuagcauggcauauuuuuc

SEQ ID NO: 3134560 - RNA, 19 nt, Human
guucuagcauggcauauuu

SEQ ID NO: 3134561 - RNA, 20 nt, Human
acagauuuccauccuaguca

SEQ ID NO: 3134562 - RNA, 19 nt, Human
uaugaaauuauauaaguau

SEQ ID NO: 3134563 - RNA, 19 nt, Human
uauccaaaccaaauaaaaa

SEQ ID NO: 3134564 - RNA, 17 nt, Human
uauguguaaaaugugaa

SEQ ID NO: 3134565 - RNA, 18 nt, Human
uaggcaaccuuuauuuuu

SEQ ID NO: 3134566 - RNA, 12 nt, Human
uagcuaauguaa

SEQ ID NO: 3134567 - RNA, 19 nt, Human
uagcuaauguaauaacugu

SEQ ID NO: 3134568 - RNA, 22 nt, Human
uagcauggcauauuuuucacau

SEQ ID NO: 3134569 - RNA, 21 nt, Human
uagcauggcauauuuuucaca

SEQ ID NO: 3134570 - RNA, 22 nt, Human
uagagcaaaauugauguguuua

SEQ ID NO: 3134571 - RNA, 14 nt, Human
uagagcaaaauuga

SEQ ID NO: 3134572 - RNA, 21 nt, Human
uagagcaaaauugauguguuu

SEQ ID NO: 3134573 - RNA, 20 nt, Human
aauuauuuuguucauacaua

SEQ ID NO: 3134574 - RNA, 19 nt, Human
aauuauuuuguucauacau

SEQ ID NO: 3134575 - RNA, 18 nt, Human
aauuauuuuguucauaca

SEQ ID NO: 3134576 - RNA, 16 nt, Human
aauuauuuuguucaua

SEQ ID NO: 3134577 - RNA, 22 nt, Human
aauuauuuuguucauacauauu

SEQ ID NO: 3134578 - RNA, 21 nt, Human
aauuauuuuguucauacauau

SEQ ID NO: 3134579 - RNA, 19 nt, Human
uacauuguacgaagaguau

SEQ ID NO: 3134580 - RNA, 13 nt, Human
aauugauguguuu

SEQ ID NO: 3134581 - RNA, 14 nt, Human
aauugauguguuua

SEQ ID NO: 3134582 - RNA, 12 nt, Human
aaugcuguguua

SEQ ID NO: 3134583 - RNA, 13 nt, Human
aaugcuguguuaa

SEQ ID NO: 3134584 - RNA, 23 nt, Human
uacaggucauauuaauauauuuc

SEQ ID NO: 3134585 - RNA, 13 nt, Human
aauguuaagcaga

SEQ ID NO: 3134586 - RNA, 17 nt, Human
uacauuguaaauaguau

SEQ ID NO: 3134587 - RNA, 12 nt, Human
uaauagagcaaa

SEQ ID NO: 3134588 - RNA, 21 nt, Human
uaauagagcaaaauugaugug

SEQ ID NO: 3134589 - RNA, 18 nt, Human
uaauguaauaacugugaa

SEQ ID NO: 3134590 - RNA, 19 nt, Human
aaugaaacacucaguuguu

SEQ ID NO: 3134591 - RNA, 16 nt, Human
uaaguauucuaaauuu

SEQ ID NO: 3134592 - RNA, 14 nt, Human
uaaguucauacauu

SEQ ID NO: 3134593 - RNA, 13 nt, Human
uaaguaaaugcua

SEQ ID NO: 3134594 - RNA, 23 nt, Human
aauaguauuugagaguucuaaau

SEQ ID NO: 3134595 - RNA, 20 nt, Human
aauaguauuugagaguucua

SEQ ID NO: 3134596 - RNA, 22 nt, Human
aauaguauuugagaguucuaaa

SEQ ID NO: 3134597 - RNA, 17 nt, Human
aauauuguguugugaau

SEQ ID NO: 3134598 - RNA, 18 nt, Human
accuuuggagcaaagcug

SEQ ID NO: 3134599 - RNA, 17 nt, Human
ucaagaaaacaacuuca

SEQ ID NO: 3134600 - RNA, 18 nt, Human
ucaauauccaaaccaaau

SEQ ID NO: 3134601 - RNA, 19 nt, Human
acauucuuccaaaaagauu

SEQ ID NO: 3134602 - RNA, 19 nt, Human
acauuguacgaagaguauu

SEQ ID NO: 3134603 - RNA, 14 nt, Human
ucacauaucuagua

SEQ ID NO: 3134604 - RNA, 22 nt, Human
ucauaaaaagccugcaauuuca

SEQ ID NO: 3134605 - RNA, 14 nt, Human
accccugcuucuga

SEQ ID NO: 3134606 - RNA, 15 nt, Human
acuuuggaacaagau

SEQ ID NO: 3134607 - RNA, 23 nt, Human
acuuaacuauucaggagaguaga

SEQ ID NO: 3134608 - RNA, 23 nt, Human
ucuagcauggcauauuuuucaca

SEQ ID NO: 3134609 - RNA, 22 nt, Human
ucuagcauggcauauuuuucac

SEQ ID NO: 3134610 - RNA, 21 nt, Human
ucuagcauggcauauuuuuca

SEQ ID NO: 3134611 - RNA, 16 nt, Human
ucugugaaaguacauu

SEQ ID NO: 3134612 - RNA, 14 nt, Human
ucugcuuguguuaa

SEQ ID NO: 3134613 - RNA, 21 nt, Human
agaauauguuucaaacuuugg

SEQ ID NO: 3134614 - RNA, 19 nt, Human
agaauauguuucaaacuuu

SEQ ID NO: 3134615 - RNA, 18 nt, Human
agaauauguuucaaacuu

SEQ ID NO: 3134616 - RNA, 17 nt, Human
agaauauguuucaaacu

SEQ ID NO: 3134617 - RNA, 13 nt, Human
agaauauguuuca

SEQ ID NO: 3134618 - RNA, 14 nt, Human
ugacuaugacauaa

SEQ ID NO: 3134619 - RNA, 15 nt, Human
uuuuccaaaauaauu

SEQ ID NO: 3134620 - RNA, 13 nt, Human
auguuaagcagau

SEQ ID NO: 3134621 - RNA, 17 nt, Human
auuauauaaguauucua

SEQ ID NO: 3134622 - RNA, 14 nt, Human
auuauauaaguauu

SEQ ID NO: 3134623 - RNA, 20 nt, Human
auuauauaaguauucuaaau

SEQ ID NO: 3134624 - RNA, 14 nt, Human
uuuugaguucuaca

SEQ ID NO: 3134625 - RNA, 14 nt, Human
uuuuguucauacau

SEQ ID NO: 3134626 - RNA, 17 nt, Human
uuuuguucauacauauu

SEQ ID NO: 3134627 - RNA, 14 nt, Human
auuuucagaaaaua

SEQ ID NO: 3134628 - RNA, 17 nt, Human
auuuucagaaaauauua

SEQ ID NO: 3134629 - RNA, 22 nt, Human
auaugagcuuccuucugugaaa

SEQ ID NO: 3134630 - RNA, 21 nt, Human
auaugagcuuccuucugugaa

SEQ ID NO: 3134631 - RNA, 16 nt, Human
auauauuuaaugauaa

SEQ ID NO: 3134632 - RNA, 15 nt, Human
auauauuuaaugaua

SEQ ID NO: 3134633 - RNA, 12 nt, Human
auauuuaaugau

SEQ ID NO: 3134634 - RNA, 13 nt, Human
auauuuaaugaua

SEQ ID NO: 3134635 - RNA, 23 nt, Human
auauuuaaugauaaguaaaugcu

SEQ ID NO: 3134636 - RNA, 17 nt, Human
uucccagugaauucuug

SEQ ID NO: 3134637 - RNA, 16 nt, Human
auauguuucaaacuuu

SEQ ID NO: 3134638 - RNA, 14 nt, Human
auauguuucaaacu

SEQ ID NO: 3134639 - RNA, 13 nt, Human
auauguuucaaac

SEQ ID NO: 3134640 - RNA, 23 nt, Human
auauuuuuguagcacugacagau

SEQ ID NO: 3134641 - RNA, 16 nt, Human
auauuuuuguagcacu

SEQ ID NO: 3134642 - RNA, 15 nt, Human
auauuuuuguagcac

SEQ ID NO: 3134643 - RNA, 18 nt, Human
auauuuuucacauaucua

SEQ ID NO: 3134644 - RNA, 23 nt, Human
aucagugugucuaaauuugaaug

SEQ ID NO: 3134645 - RNA, 17 nt, Human
uugaaggaaaaugauac

SEQ ID NO: 3134646 - RNA, 14 nt, Human
uugagaguucuaaa

SEQ ID NO: 3134647 - RNA, 16 nt, Human
uugauaaguucauaca

SEQ ID NO: 3134648 - RNA, 17 nt, Human
uugauaaguucauacau

SEQ ID NO: 3134649 - RNA, 19 nt, Human
augcuguauauccuuucua

SEQ ID NO: 3134650 - RNA, 22 nt, Human
uuucagaaaauauuauguguuu

SEQ ID NO: 3134651 - RNA, 19 nt, Human
augacauaaaaacaacuuu

SEQ ID NO: 3134652 - RNA, 23 nt, Human
aguuauugauaaguucauacauu

SEQ ID NO: 3134653 - RNA, 22 nt, Human
aguuauugauaaguucauacau

SEQ ID NO: 3134654 - RNA, 21 nt, Human
aguuauugauaaguucauaca

SEQ ID NO: 3134655 - RNA, 19 nt, Human
aguuauugauaaguucaua

SEQ ID NO: 3134656 - RNA, 17 nt, Human
aguuauugauaaguuca

SEQ ID NO: 3134657 - RNA, 15 nt, Human
aguucuaaauuuugu

SEQ ID NO: 3134658 - RNA, 22 nt, Human
uuaucaaagggugaaaauuauu

SEQ ID NO: 3134659 - RNA, 21 nt, Human
auacaggucauauuaauauau

SEQ ID NO: 3134660 - RNA, 15 nt, Human
auacaggucauauua

SEQ ID NO: 3134661 - RNA, 22 nt, Human
auacauuguacgaagaguauuu

SEQ ID NO: 3134662 - RNA, 21 nt, Human
auacauuguacgaagaguauu

SEQ ID NO: 3134663 - RNA, 14 nt, Human
auacauuguacgaa

SEQ ID NO: 3134664 - RNA, 19 nt, Human
auacauauuuuuguagcac

SEQ ID NO: 3134665 - RNA, 14 nt, Human
auaauuuuaagaaa

SEQ ID NO: 3134666 - RNA, 15 nt, Human
auaauuuuaagaaau

SEQ ID NO: 3134667 - RNA, 21 nt, Human
auaauuuuaagaaaucaaaga

SEQ ID NO: 3134668 - RNA, 13 nt, Human
uuauauaaguauu

SEQ ID NO: 3134669 - RNA, 16 nt, Human
uuauauaaguauucua

SEQ ID NO: 3134670 - RNA, 14 nt, Human
uuauauaaguauuc

SEQ ID NO: 3134671 - RNA, 23 nt, Human
uuauacccagaaaguuauugaua

SEQ ID NO: 3134672 - RNA, 19 nt, Human
uuauacccagaaaguuauu

SEQ ID NO: 3134673 - RNA, 18 nt, Human
uuauacccagaaaguuau

SEQ ID NO: 3134674 - RNA, 23 nt, Human
uuauagaguguacuuaacuauuc

SEQ ID NO: 3134675 - RNA, 20 nt, Human
auaaucagugugucuaaauu

SEQ ID NO: 3134676 - RNA, 21 nt, Human
auaaguucauacauuguacga

SEQ ID NO: 3134677 - RNA, 15 nt, Human
auaaguucauacauu

SEQ ID NO: 3134678 - RNA, 14 nt, Human
auaaguucauacau

SEQ ID NO: 3134679 - RNA, 13 nt, Human
auaaguucauaca

SEQ ID NO: 3134680 - RNA, 11 nt, Human
auaaguucaua

SEQ ID NO: 3134681 - RNA, 16 nt, Human
auaaaccucaaaaugu

SEQ ID NO: 3134682 - RNA, 12 nt, Human
auaacugugaag

SEQ ID NO: 3134683 - RNA, 15 nt, Human
uguacuuaacuauuc

SEQ ID NO: 3134684 - RNA, 15 nt, Human
agggugaaaauuauu

SEQ ID NO: 3134685 - RNA, 14 nt, Human
aguauguguaaaau

SEQ ID NO: 3134686 - RNA, 18 nt, Human
ugucuaaauuugaauguu

SEQ ID NO: 3134687 - RNA, 15 nt, Human
ugucuaagauaguaa

SEQ ID NO: 3134688 - RNA, 14 nt, Human
ugucuaagauagua

SEQ ID NO: 3134689 - RNA, 16 nt, Human
ugugauguauucuagc

SEQ ID NO: 3134690 - RNA, 19 nt, Human
caaagcugaugacaacuuc

SEQ ID NO: 3134691 - RNA, 22 nt, Human
caaaauugauguguuuauuuau

SEQ ID NO: 3134692 - RNA, 15 nt, Human
caaaauugauguguu

SEQ ID NO: 3134693 - RNA, 16 nt, Human
caaaauugauguguuu

SEQ ID NO: 3134694 - RNA, 15 nt, Human
caagaaaacaacuuc

SEQ ID NO: 3134695 - RNA, 20 nt, Human
caggucauauuaauauauuu

SEQ ID NO: 3134696 - RNA, 21 nt, Human
caggucauauuaauauauuuc

SEQ ID NO: 3134697 - RNA, 12 nt, Human
cagugaauucuu

SEQ ID NO: 3134698 - RNA, 12 nt, Human
caggagaguaga

SEQ ID NO: 3134699 - RNA, 16 nt, Human
cagauggaaugcugug

SEQ ID NO: 3134700 - RNA, 17 nt, Human
cagauggaaugcugugu

SEQ ID NO: 3134701 - RNA, 19 nt, Human
cagauggaaugcuguguua

SEQ ID NO: 3134702 - RNA, 21 nt, Human
cagauggaaugcuguguuaaa

SEQ ID NO: 3134703 - RNA, 14 nt, Human
cagauaaucagugu

SEQ ID NO: 3134704 - RNA, 17 nt, Human
cagaaggaucuucaucu

SEQ ID NO: 3134705 - RNA, 19 nt, Human
cagaaaauauuauguguuu

SEQ ID NO: 3134706 - RNA, 22 nt, Human
cacugacagauuuccauccuag

SEQ ID NO: 3134707 - RNA, 17 nt, Human
cacugacagauuuccau

SEQ ID NO: 3134708 - RNA, 13 nt, Human
cacugacagauuu

SEQ ID NO: 3134709 - RNA, 12 nt, Human
gcuuguguuaag

SEQ ID NO: 3134710 - RNA, 18 nt, Human
gcuguguuaaauaaaccu

SEQ ID NO: 3134711 - RNA, 22 nt, Human
gcagauggaaugcuguguuaaa

SEQ ID NO: 3134712 - RNA, 13 nt, Human
gagcaaagcugau

SEQ ID NO: 3134713 - RNA, 16 nt, Human
gaucuucaucugacua

SEQ ID NO: 3134714 - RNA, 23 nt, Human
gaucuucaucugacuaugacaua

SEQ ID NO: 3134715 - RNA, 21 nt, Human
gauaaucagugugucuaaauu

SEQ ID NO: 3134716 - RNA, 18 nt, Human
gaguauuuuugacagaau

SEQ ID NO: 3134717 - RNA, 17 nt, Human
gaguauuuuugacagaa

SEQ ID NO: 3134718 - RNA, 16 nt, Human
gaguauuuuugacaga

SEQ ID NO: 3134719 - RNA, 14 nt, Human
gaguauuuuugaca

SEQ ID NO: 3134720 - RNA, 12 nt, Human
cucaaauuugga

SEQ ID NO: 3134721 - RNA, 17 nt, Human
gaaaauauuauguguuu

SEQ ID NO: 3134722 - RNA, 19 nt, Human
cuuguguuaaguaugugua

SEQ ID NO: 3134723 - RNA, 16 nt, Human
gaaguuuacauuguaa

SEQ ID NO: 3134724 - RNA, 17 nt, Human
gaaguuuacauuguaaa

SEQ ID NO: 3134725 - RNA, 14 nt, Human
gaaggaaaaugaua

SEQ ID NO: 3134726 - RNA, 18 nt, Human
cugugaaaguacauuugg

SEQ ID NO: 3134727 - RNA, 15 nt, Human
ccuucugugaaagua

SEQ ID NO: 3134728 - RNA, 21 nt, Human
cgaagaguauuuuugacagaa

SEQ ID NO: 3134729 - RNA, 19 nt, Human
ccugcaauuucauaugcug

SEQ ID NO: 3134730 - RNA, 17 nt, Human
caucugacuaugacaua

SEQ ID NO: 3134731 - RNA, 21 nt, Human
cauaucuaguaugaaauuaua

SEQ ID NO: 3134732 - RNA, 15 nt, Human
cauaucuaguaugaa

SEQ ID NO: 3134733 - RNA, 18 nt, Human
cauaucuaguaugaaauu

SEQ ID NO: 3134734 - RNA, 17 nt, Human
cauaucuaguaugaaau

SEQ ID NO: 3134735 - RNA, 13 nt, Human
cauggcauauuuu

SEQ ID NO: 3134736 - RNA, 19 nt, Human
cauggcauauuuuucacau

SEQ ID NO: 3134737 - RNA, 15 nt, Human
cauggcauauuuuuc

SEQ ID NO: 3134738 - RNA, 23 nt, Human
cauggcauauuuuucacauaucu

SEQ ID NO: 3134739 - RNA, 21 nt, Human
cauuaaaaaaucaguuguaca

SEQ ID NO: 3134740 - RNA, 19 nt, Human
cauuguacgaagaguauuu

SEQ ID NO: 3134741 - RNA, 11 nt, Human
uuuugacagaa

SEQ ID NO: 3134742 - RNA, 22 nt, Human
uuuugacagaauauguuucaaa

SEQ ID NO: 3134743 - RNA, 23 nt, Human
uuuugacagaauauguuucaaac

SEQ ID NO: 3134744 - RNA, 12 nt, Human
uuugaguucuac

SEQ ID NO: 3134745 - RNA, 23 nt, Human
uuuucagaaaauauuauguguuu

SEQ ID NO: 3134746 - RNA, 16 nt, Human
uuuucacauaucuagu

SEQ ID NO: 3134747 - RNA, 22 nt, Human
uuuucagaaaauauuauguguu

SEQ ID NO: 3134748 - RNA, 22 nt, Human
uuauacaggucauauuaauaua

SEQ ID NO: 3134749 - RNA, 14 nt, Human
uuauacaggucaua

SEQ ID NO: 3134750 - RNA, 15 nt, Human
uuauaucuuguagcu

SEQ ID NO: 3134751 - RNA, 22 nt, Human
uuauaucuuguagcuuuaucaa

SEQ ID NO: 3134752 - RNA, 16 nt, Human
uucaauaauaaauauu

SEQ ID NO: 3134753 - RNA, 16 nt, Human
uuauuuuguucauaca

SEQ ID NO: 3134754 - RNA, 14 nt, Human
uuauuuuguucaua

SEQ ID NO: 3134755 - RNA, 20 nt, Human
uucaucugacuaugacauaa

SEQ ID NO: 3134756 - RNA, 21 nt, Human
uuccaaaaagauuuucagaaa

SEQ ID NO: 3134757 - RNA, 22 nt, Human
uucuacauaaguaauucaagaa

SEQ ID NO: 3134758 - RNA, 17 nt, Human
uucuuccaaaaagauuu

SEQ ID NO: 3134759 - RNA, 18 nt, Human
uucugcuuguguuaagua

SEQ ID NO: 3134760 - RNA, 21 nt, Human
uuguacgaagaguauuuuuga

SEQ ID NO: 3134761 - RNA, 23 nt, Human
uuguacgaagaguauuuuugaca

SEQ ID NO: 3134762 - RNA, 17 nt, Human
uuguaaauaguauuuga

SEQ ID NO: 3134763 - RNA, 13 nt, Human
uuguguugugaau

SEQ ID NO: 3134764 - RNA, 20 nt, Human
uuuacauuguaaauaguauu

SEQ ID NO: 3134765 - RNA, 17 nt, Human
uggagacacaacuauuu

SEQ ID NO: 3134766 - RNA, 12 nt, Human
ugcuuguguuaa

SEQ ID NO: 3134767 - RNA, 15 nt, Human
ugcuuguguuaagua

SEQ ID NO: 3134768 - RNA, 14 nt, Human
uguaauaacuguga

SEQ ID NO: 3134769 - RNA, 22 nt, Human
uguaauaacugugaaguuuaca

SEQ ID NO: 3134770 - RNA, 15 nt, Human
uguagcuuuaucaaa

SEQ ID NO: 3134771 - RNA, 14 nt, Human
uguagcuuuaucaa

SEQ ID NO: 3134772 - RNA, 13 nt, Human
ugauguauucuag

SEQ ID NO: 3134773 - RNA, 21 nt, Human
ugauguauucuagcuaaugua

SEQ ID NO: 3134774 - RNA, 14 nt, Human
ugauguauucuagc

SEQ ID NO: 3134775 - RNA, 20 nt, Human
ugauguauucuagcuaaugu

SEQ ID NO: 3134776 - RNA, 19 nt, Human
ucuugaaggaaaaugauac

SEQ ID NO: 3134777 - RNA, 14 nt, Human
ugcaauuucauaug

SEQ ID NO: 3134778 - RNA, 20 nt, Human
ugcaauuucauaugcuguau

SEQ ID NO: 3134779 - RNA, 19 nt, Human
ucuucaucugacuaugaca

SEQ ID NO: 3134780 - RNA, 18 nt, Human
ucaucugacuaugacaua

SEQ ID NO: 3134781 - RNA, 17 nt, Human
ucaucugacuaugacau

SEQ ID NO: 3134782 - RNA, 15 nt, Human
uccaaaauaauuuua

SEQ ID NO: 3134783 - RNA, 19 nt, Human
uccaaaauaauuuuaagaa

SEQ ID NO: 3134784 - RNA, 12 nt, Human
uauuaauauauu

SEQ ID NO: 3134785 - RNA, 16 nt, Human
uauguuucaaacuuug

SEQ ID NO: 3134786 - RNA, 15 nt, Human
uauguuucaaacuuu

SEQ ID NO: 3134787 - RNA, 13 nt, Human
uauguuucaaacu

SEQ ID NO: 3134788 - RNA, 14 nt, Human
uauuguguugugaa

SEQ ID NO: 3134789 - RNA, 19 nt, Human
uauucuagcuaauguaaua

SEQ ID NO: 3134790 - RNA, 20 nt, Human
uauucuaaauuuuauaucuu

SEQ ID NO: 3134791 - RNA, 19 nt, Human
uauucuaaauuuuauaucu

SEQ ID NO: 3134792 - RNA, 15 nt, Human
uauucuaaauuuuau

SEQ ID NO: 3134793 - RNA, 14 nt, Human
uauucuaaauuuua

SEQ ID NO: 3134794 - RNA, 16 nt, Human
aguaugaaauuauaua

SEQ ID NO: 3134795 - RNA, 14 nt, Human
aguaugaaauuaua

SEQ ID NO: 3134796 - RNA, 11 nt, Human
aguucauacau

SEQ ID NO: 3134797 - RNA, 10 nt, Human
aguucauaca

SEQ ID NO: 3134798 - RNA, 15 nt, Human
aguucauacauugua

SEQ ID NO: 3134799 - RNA, 20 nt, Human
auaguauuugagaguucuaa

SEQ ID NO: 3134800 - RNA, 21 nt, Human
auaguauuugagaguucuaaa

SEQ ID NO: 3134801 - RNA, 23 nt, Human
auaguauuugagaguucuaaauu

SEQ ID NO: 3134802 - RNA, 20 nt, Human
auaauuaaauuuugaguucu

SEQ ID NO: 3134803 - RNA, 14 nt, Human
auaaaaauauugug

SEQ ID NO: 3134804 - RNA, 13 nt, Human
auguuucaaacuu

SEQ ID NO: 3134805 - RNA, 12 nt, Human
auguuucaaacu

SEQ ID NO: 3134806 - RNA, 17 nt, Human
auguuucaaacuuugga

SEQ ID NO: 3134807 - RNA, 14 nt, Human
auguuucaaacuuu

SEQ ID NO: 3134808 - RNA, 19 nt, Human
auguauucuagcuaaugua

SEQ ID NO: 3134809 - RNA, 20 nt, Human
auguauucuagcuaauguaa

SEQ ID NO: 3134810 - RNA, 17 nt, Human
augcauagguuuagcag

SEQ ID NO: 3134811 - RNA, 21 nt, Human
augcauagguuuagcaguaua

SEQ ID NO: 3134812 - RNA, 14 nt, Human
agcacugacagauu

SEQ ID NO: 3134813 - RNA, 13 nt, Human
agcacugacagau

SEQ ID NO: 3134814 - RNA, 18 nt, Human
agcacugacagauuucca

SEQ ID NO: 3134815 - RNA, 23 nt, Human
agaaaguuauugauaaguucaua

SEQ ID NO: 3134816 - RNA, 11 nt, Human
agaaaguuauu

SEQ ID NO: 3134817 - RNA, 22 nt, Human
acuuuauacccagaaaguuauu

SEQ ID NO: 3134818 - RNA, 20 nt, Human
acuuuauacccagaaaguua

SEQ ID NO: 3134819 - RNA, 22 nt, Human
acugugaaguuuacauuguaaa

SEQ ID NO: 3134820 - RNA, 21 nt, Human
acucauaaaaagccugcaauu

SEQ ID NO: 3134821 - RNA, 22 nt, Human
acuauucaggagaguagaacag

SEQ ID NO: 3134822 - RNA, 17 nt, Human
aagcagauggaaugcug

SEQ ID NO: 3134823 - RNA, 19 nt, Human
aagcagauggaaugcugug

SEQ ID NO: 3134824 - RNA, 20 nt, Human
aagcagauggaaugcugugu

SEQ ID NO: 3134825 - RNA, 21 nt, Human
aaugcuagguuaauuccaauu

SEQ ID NO: 3134826 - RNA, 18 nt, Human
aaugcuagguuaauucca

SEQ ID NO: 3134827 - RNA, 19 nt, Human
aaugcuagguuaauuccaa

SEQ ID NO: 3134828 - RNA, 15 nt, Human
aaucaccaaaggcuc

SEQ ID NO: 3134829 - RNA, 17 nt, Human
aauauguuucaaacuuu

SEQ ID NO: 3134830 - RNA, 16 nt, Human
aauauguuucaaacuu

SEQ ID NO: 3134831 - RNA, 15 nt, Human
aauauguuucaaacu

SEQ ID NO: 3134832 - RNA, 13 nt, Human
aauauguuucaaa

SEQ ID NO: 3134833 - RNA, 23 nt, Human
aacuuuauacccagaaaguuauu

SEQ ID NO: 3134834 - RNA, 22 nt, Human
aacuuuauacccagaaaguuau

SEQ ID NO: 3134835 - RNA, 24 nt, Human
aaacacucaguuguucaauaauaa

SEQ ID NO: 3134836 - RNA, 21 nt, Human
aaaauugauguguuuauuuau

SEQ ID NO: 3134837 - RNA, 12 nt, Human
aaaauugaugug

SEQ ID NO: 3134838 - RNA, 14 nt, Human
aaaauugauguguu

SEQ ID NO: 3134839 - RNA, 17 nt, Human
aaaaucaguuguacagu

SEQ ID NO: 3134840 - RNA, 21 nt, Human
aaaagauuuucagaaaauauu

SEQ ID NO: 3134841 - RNA, 14 nt, Human
guacuuaacuauuc

SEQ ID NO: 3134842 - RNA, 15 nt, Human
guacauuuggagaca

SEQ ID NO: 3134843 - RNA, 14 nt, Human
aaauauuauguguu

SEQ ID NO: 3134844 - RNA, 15 nt, Human
aaauauuauguguuu

SEQ ID NO: 3134845 - RNA, 19 nt, Human
guaauagagcaaaauugau

SEQ ID NO: 3134846 - RNA, 15 nt, Human
guaauaacugugaag

SEQ ID NO: 3134847 - RNA, 16 nt, Human
guaauaacugugaagu

SEQ ID NO: 3134848 - RNA, 22 nt, Human
guaauaacugugaaguuuacau

SEQ ID NO: 3134849 - RNA, 20 nt, Human
aaaguuauugauaaguucau

SEQ ID NO: 3134850 - RNA, 14 nt, Human
aaauaaaaauauug

SEQ ID NO: 3134851 - RNA, 22 nt, Human
aaagaccuuuggagcaaagcug

SEQ ID NO: 3134852 - RNA, 17 nt, Human
aaagggugaaaauuauu

SEQ ID NO: 3134853 - RNA, 22 nt, Human
ggugaaaauuauuuuguucaua

SEQ ID NO: 3134854 - RNA, 14 nt, Human
ggugaaaauuauuu

SEQ ID NO: 3134855 - RNA, 13 nt, Human
ggugaaaauuauu

SEQ ID NO: 3134856 - RNA, 18 nt, Human
gcauggcauauuuuucac

SEQ ID NO: 3134857 - RNA, 22 nt, Human
gaaaauuauuuuguucauacau

SEQ ID NO: 3134858 - RNA, 21 nt, Human
gaaaauuauuuuguucauaca

SEQ ID NO: 3134859 - RNA, 20 nt, Human
gaaaauuauuuuguucauac

SEQ ID NO: 3134860 - RNA, 23 nt, Human
gaaaauuauuuuguucauacaua

SEQ ID NO: 3134861 - RNA, 12 nt, Human
cucagaauauug

SEQ ID NO: 3134862 - RNA, 21 nt, Human
cauuuggagacacaacuauuu

SEQ ID NO: 3134863 - RNA, 19 nt, Human
cauuguaaauaguauuuga

SEQ ID NO: 3134864 - RNA, 20 nt, Human
cauaauuuauacaggucaua

SEQ ID NO: 3134865 - RNA, 13 nt, Human
cauaauuuauaca

SEQ ID NO: 3134866 - RNA, 11 nt, Human
cagaaaguuau

SEQ ID NO: 3134867 - RNA, 16 nt, Human
cagaaaguuauugaua

SEQ ID NO: 3134868 - RNA, 22 nt, Human
cacuguuuugaaucucauaauu

SEQ ID NO: 3134869 - RNA, 16 nt, Human
auuuuauaucuuguag

SEQ ID NO: 3134870 - RNA, 14 nt, Human
auuuuauaucuugu

SEQ ID NO: 3134871 - RNA, 12 nt, Human
auuuuauaucuu

SEQ ID NO: 3134872 - RNA, 15 nt, Human
caaaccaaauaaaaa

SEQ ID NO: 3134873 - RNA, 14 nt, Human
caaaccaaauaaaa

SEQ ID NO: 3134874 - RNA, 18 nt, Human
caaagggugaaaauuauu

SEQ ID NO: 3134875 - RNA, 16 nt, Human
caagaugguucuagca

SEQ ID NO: 3134876 - RNA, 13 nt, Human
caagaugguucua

SEQ ID NO: 3134877 - RNA, 16 nt, Human
auuucauaugcuguau

SEQ ID NO: 3134878 - RNA, 17 nt, Human
auuguguugugaauguu

SEQ ID NO: 3134879 - RNA, 14 nt, Human
auuguguugugaau

SEQ ID NO: 3134880 - RNA, 15 nt, Human
uacauaaguaauuca

SEQ ID NO: 3134881 - RNA, 16 nt, Human
uacauaaguaauucaa

SEQ ID NO: 3134882 - RNA, 17 nt, Human
uacauaaguaauucaag

SEQ ID NO: 3134883 - RNA, 19 nt, Human
uacauaaguaauucaagaa

SEQ ID NO: 3134884 - RNA, 22 nt, Human
aauuaaauuuugaguucuacau

SEQ ID NO: 3134885 - RNA, 23 nt, Human
uacauuguacgaagaguauuuuu

SEQ ID NO: 3134886 - RNA, 22 nt, Human
uacauuguacgaagaguauuuu

SEQ ID NO: 3134887 - RNA, 20 nt, Human
uacauuguacgaagaguauu

SEQ ID NO: 3134888 - RNA, 17 nt, Human
uaauguaauaacuguga

SEQ ID NO: 3134889 - RNA, 17 nt, Human
uaaucagugugucuaaa

SEQ ID NO: 3134890 - RNA, 18 nt, Human
uaaucagugugucuaaau

SEQ ID NO: 3134891 - RNA, 13 nt, Human
acaaaaaaauaua

SEQ ID NO: 3134892 - RNA, 17 nt, Human
acaaaaaaauauauuua

SEQ ID NO: 3134893 - RNA, 20 nt, Human
acaaaaaaauauauuuaaug

SEQ ID NO: 3134894 - RNA, 15 nt, Human
aauucuugaaggaaa

SEQ ID NO: 3134895 - RNA, 16 nt, Human
aauucuugaaggaaaa

SEQ ID NO: 3134896 - RNA, 21 nt, Human
aauucuugaaggaaaaugaua

SEQ ID NO: 3134897 - RNA, 19 nt, Human
uauuuaaugauaaguaaau

SEQ ID NO: 3134898 - RNA, 16 nt, Human
uauucaggagaguaga

SEQ ID NO: 3134899 - RNA, 17 nt, Human
uaucuaguaugaaauua

SEQ ID NO: 3134900 - RNA, 16 nt, Human
uaucuaguaugaaauu

SEQ ID NO: 3134901 - RNA, 14 nt, Human
uaucuaguaugaaa

SEQ ID NO: 3134902 - RNA, 21 nt, Human
uaugagcuuccuucugugaaa

SEQ ID NO: 3134903 - RNA, 18 nt, Human
uaugagcuuccuucugug

SEQ ID NO: 3134904 - RNA, 16 nt, Human
uauauccuuucuaaca

SEQ ID NO: 3134905 - RNA, 16 nt, Human
gugaagugaaugaaac

SEQ ID NO: 3134906 - RNA, 12 nt, Human
aacauaauuaaa

SEQ ID NO: 3134907 - RNA, 15 nt, Human
aaguauucuaaauuu

SEQ ID NO: 3134908 - RNA, 13 nt, Human
aaguauucuaaau

SEQ ID NO: 3134909 - RNA, 14 nt, Human
aaggaaaaugauac

SEQ ID NO: 3134910 - RNA, 12 nt, Human
aaggaaaaugau

SEQ ID NO: 3134911 - RNA, 14 nt, Human
aaggaucuucaucu

SEQ ID NO: 3134912 - RNA, 13 nt, Human
guguuuauuuaua

SEQ ID NO: 3134913 - RNA, 14 nt, Human
uaaauuuuauaucu

SEQ ID NO: 3134914 - RNA, 16 nt, Human
uaaauuuugaguucua

SEQ ID NO: 3134915 - RNA, 20 nt, Human
uaacaaaaaaauauauuuaa

SEQ ID NO: 3134916 - RNA, 23 nt, Human
uaacaaaaaaauauauuuaauga

SEQ ID NO: 3134917 - RNA, 18 nt, Human
uaaauaguauuugagagu

SEQ ID NO: 3134918 - RNA, 22 nt, Human
aauaaaaauauuguguugugaa

SEQ ID NO: 3134919 - RNA, 20 nt, Human
aaguuauugauaaguucaua

SEQ ID NO: 3134920 - RNA, 19 nt, Human
aaguuauugauaaguucau

SEQ ID NO: 3134921 - RNA, 15 nt, Human
aaguucauacauugu

SEQ ID NO: 3134922 - RNA, 13 nt, Human
aaguucauacauu

SEQ ID NO: 3134923 - RNA, 12 nt, Human
aaguucauacau

SEQ ID NO: 3134924 - RNA, 23 nt, Human
aaguuauugauaaguucauacau

SEQ ID NO: 3134925 - RNA, 22 nt, Human
aaguuauugauaaguucauaca

SEQ ID NO: 3134926 - RNA, 18 nt, Human
aaguuuacauuguaaaua

SEQ ID NO: 3134927 - RNA, 19 nt, Human
aaguuuacauuguaaauag

SEQ ID NO: 3134928 - RNA, 18 nt, Human
uaaaccucaaaaugucua

SEQ ID NO: 3134929 - RNA, 19 nt, Human
uaaaccucaaaaugucuaa

SEQ ID NO: 3134930 - RNA, 15 nt, Human
ucccagugaauucuu

SEQ ID NO: 3134931 - RNA, 19 nt, Human
ucauauuaauauauuucca

SEQ ID NO: 3134932 - RNA, 21 nt, Human
agcagauggaaugcuguguua

SEQ ID NO: 3134933 - RNA, 12 nt, Human
agauuuucagaa

SEQ ID NO: 3134934 - RNA, 17 nt, Human
agauuuucagaaaauau

SEQ ID NO: 3134935 - RNA, 19 nt, Human
agauaaucagugugucuaa

SEQ ID NO: 3134936 - RNA, 17 nt, Human
auaauucagaaggaucu

SEQ ID NO: 3134937 - RNA, 21 nt, Human
auaauuuauacaggucauauu

SEQ ID NO: 3134938 - RNA, 19 nt, Human
auaauuuauacaggucaua

SEQ ID NO: 3134939 - RNA, 15 nt, Human
uuaaauuuugaguuc

SEQ ID NO: 3134940 - RNA, 20 nt, Human
uuaaauuuugaguucuacau

SEQ ID NO: 3134941 - RNA, 15 nt, Human
aguuuacauuguaaa

SEQ ID NO: 3134942 - RNA, 17 nt, Human
aguuuacauuguaaaua

SEQ ID NO: 3134943 - RNA, 13 nt, Human
aguuuacauugua

SEQ ID NO: 3134944 - RNA, 23 nt, Human
auacgcaacauaauuaaauuuug

SEQ ID NO: 3134945 - RNA, 15 nt, Human
auagagcaaaauuga

SEQ ID NO: 3134946 - RNA, 17 nt, Human
auagagcaaaauugaug

SEQ ID NO: 3134947 - RNA, 21 nt, Human
auagagcaaaauugauguguu

SEQ ID NO: 3134948 - RNA, 22 nt, Human
auagagcaaaauugauguguuu

SEQ ID NO: 3134949 - RNA, 21 nt, Human
auagaguguacuuaacuauuc

SEQ ID NO: 3134950 - RNA, 14 nt, Human
auagaguguacuua

SEQ ID NO: 3134951 - RNA, 19 nt, Human
auagaguguacuuaacuau

SEQ ID NO: 3134952 - RNA, 13 nt, Human
aguaauagagcaa

SEQ ID NO: 3134953 - RNA, 19 nt, Human
aguacauuuggagacacaa

SEQ ID NO: 3134954 - RNA, 19 nt, Human
aguaauucaagaaaacaac

SEQ ID NO: 3134955 - RNA, 18 nt, Human
uguauauccuuucuaaca

SEQ ID NO: 3134956 - RNA, 14 nt, Human
uguguaaaauguga

SEQ ID NO: 3134957 - RNA, 19 nt, Human
ugugucuaaauuugaaugu

SEQ ID NO: 3134958 - RNA, 22 nt, Human
ugugucuaaauuugaauguuaa

SEQ ID NO: 3134959 - RNA, 22 nt, Human
uguguuaaguauguguaaaaug

SEQ ID NO: 3134960 - RNA, 23 nt, Human
uguuaagcagauggaaugcugug

SEQ ID NO: 3134961 - RNA, 21 nt, Human
uggaacaagaugguucuagca

SEQ ID NO: 3134962 - RNA, 19 nt, Human
agccugcaauuucauaugc

SEQ ID NO: 3134963 - RNA, 21 nt, Human
agccugcaauuucauaugcug

SEQ ID NO: 3134964 - RNA, 19 nt, Human
auuauuuuguucauacaua

SEQ ID NO: 3134965 - RNA, 18 nt, Human
auuauuuuguucauacau

SEQ ID NO: 3134966 - RNA, 17 nt, Human
auuauuuuguucauaca

SEQ ID NO: 3134967 - RNA, 16 nt, Human
auuauuuuguucauac

SEQ ID NO: 3134968 - RNA, 15 nt, Human
auuauuuuguucaua

SEQ ID NO: 3134969 - RNA, 24 nt, Human
auucagaaggaucuucaucugacu

SEQ ID NO: 3134970 - RNA, 18 nt, Human
auucagaaggaucuucau

SEQ ID NO: 3134971 - RNA, 14 nt, Human
auucuaaauuuuau

SEQ ID NO: 3134972 - RNA, 15 nt, Human
auucuagcuaaugua

SEQ ID NO: 3134973 - RNA, 18 nt, Human
auucuagcuaauguaaua

SEQ ID NO: 3134974 - RNA, 15 nt, Human
auuuuugacagaaua

SEQ ID NO: 3134975 - RNA, 14 nt, Human
auuuuugacagaau

SEQ ID NO: 3134976 - RNA, 13 nt, Human
auuuuugacagaa

SEQ ID NO: 3134977 - RNA, 12 nt, Human
auuuuugacaga

SEQ ID NO: 3134978 - RNA, 22 nt, Human
auuuuugacagaauauguuuca

SEQ ID NO: 3134979 - RNA, 15 nt, Human
auuuuuccaaaauaa

SEQ ID NO: 3134980 - RNA, 15 nt, Human
auuuuucacauaucu

SEQ ID NO: 3134981 - RNA, 21 nt, Human
auuuuucacauaucuaguaug

SEQ ID NO: 3134982 - RNA, 18 nt, Human
auuuuucacauaucuagu

SEQ ID NO: 3134983 - RNA, 21 nt, Human
auuuuuguagcacugacagau

SEQ ID NO: 3134984 - RNA, 20 nt, Human
auuuuuguagcacugacaga

SEQ ID NO: 3134985 - RNA, 18 nt, Human
auuuuguucauacauauu

SEQ ID NO: 3134986 - RNA, 16 nt, Human
auuuuguucauacaua

SEQ ID NO: 3134987 - RNA, 15 nt, Human
auuuuguucauacau

SEQ ID NO: 3134988 - RNA, 14 nt, Human
auuuuguucauaca

SEQ ID NO: 3134989 - RNA, 12 nt, Human
auuuuguucaua

SEQ ID NO: 3134990 - RNA, 14 nt, Human
auugcuuuggucau

SEQ ID NO: 3134991 - RNA, 18 nt, Human
auugcuuuggucauauga

SEQ ID NO: 3134992 - RNA, 16 nt, Human
auuguacgaagaguau

SEQ ID NO: 3134993 - RNA, 17 nt, Human
uugacagaauauguuuc

SEQ ID NO: 3134994 - RNA, 20 nt, Human
uugacagaauauguuucaaa

SEQ ID NO: 3134995 - RNA, 18 nt, Human
aucuuguagcuuuaucaa

SEQ ID NO: 3134996 - RNA, 20 nt, Human
aucuuguagcuuuaucaaag

SEQ ID NO: 3134997 - RNA, 19 nt, Human
aucuuguagcuuuaucaaa

SEQ ID NO: 3134998 - RNA, 20 nt, Human
uuggagacacaacuauuuuu

SEQ ID NO: 3134999 - RNA, 19 nt, Human
augaaauuauauaaguauu

SEQ ID NO: 3135000 - RNA, 21 nt, Human
augaaauuauauaaguauucu

SEQ ID NO: 3135001 - RNA, 22 nt, Human
uucuagcauggcauauuuuuca

SEQ ID NO: 3135002 - RNA, 17 nt, Human
uucuagcuaauguaaua

SEQ ID NO: 3135003 - RNA, 14 nt, Human
uucuagcauggcau

SEQ ID NO: 3135004 - RNA, 21 nt, Human
uucuagcauggcauauuuuuc

SEQ ID NO: 3135005 - RNA, 20 nt, Human
uucuagcauggcauauuuuu

SEQ ID NO: 3135006 - RNA, 18 nt, Human
uucuagcauggcauauuu

SEQ ID NO: 3135007 - RNA, 15 nt, Human
uucuagcauggcaua

SEQ ID NO: 3135008 - RNA, 14 nt, Human
uucuaaauuuuaua

SEQ ID NO: 3135009 - RNA, 17 nt, Human
auauuuuucacauaucu

SEQ ID NO: 3135010 - RNA, 15 nt, Human
auauuuuucacauau

SEQ ID NO: 3135011 - RNA, 14 nt, Human
auauuuuucacaua

SEQ ID NO: 3135012 - RNA, 13 nt, Human
auauuuuucacau

SEQ ID NO: 3135013 - RNA, 12 nt, Human
auauuuuucaca

SEQ ID NO: 3135014 - RNA, 14 nt, Human
uuucaaacuuugga

SEQ ID NO: 3135015 - RNA, 18 nt, Human
auggcauauuuuucacau

SEQ ID NO: 3135016 - RNA, 23 nt, Human
auggcauauuuuucacauaucua

SEQ ID NO: 3135017 - RNA, 22 nt, Human
auggcauauuuuucacauaucu

SEQ ID NO: 3135018 - RNA, 21 nt, Human
auggcauauuuuucacauauc

SEQ ID NO: 3135019 - RNA, 20 nt, Human
auggcauauuuuucacauau

SEQ ID NO: 3135020 - RNA, 18 nt, Human
augcuagguuaauuccaa

SEQ ID NO: 3135021 - RNA, 21 nt, Human
uuuaucaaagggugaaaauua

SEQ ID NO: 3135022 - RNA, 20 nt, Human
uuguguuaaguauguguaaa

SEQ ID NO: 3135023 - RNA, 17 nt, Human
augauaaguaaaugcua

SEQ ID NO: 3135024 - RNA, 22 nt, Human
uuugacagaauauguuucaaac

SEQ ID NO: 3135025 - RNA, 18 nt, Human
caagaaaacaacuucaau

SEQ ID NO: 3135026 - RNA, 12 nt, Human
caacuuuauacc

SEQ ID NO: 3135027 - RNA, 23 nt, Human
caaaaaaauauauuuaaugauaa

SEQ ID NO: 3135028 - RNA, 23 nt, Human
cacauaucuaguaugaaauuaua

SEQ ID NO: 3135029 - RNA, 14 nt, Human
cacaacuauuuuuc

SEQ ID NO: 3135030 - RNA, 19 nt, Human
cacaacuauuuuuccaaaa

SEQ ID NO: 3135031 - RNA, 20 nt, Human
cuaaauuuuauaucuuguag

SEQ ID NO: 3135032 - RNA, 13 nt, Human
cuaaauuuuauau

SEQ ID NO: 3135033 - RNA, 16 nt, Human
cuaaauuuuauaucuu

SEQ ID NO: 3135034 - RNA, 15 nt, Human
cuaaauuuuauaucu

SEQ ID NO: 3135035 - RNA, 16 nt, Human
cuaagauaguaacaau

SEQ ID NO: 3135036 - RNA, 21 nt, Human
cuauucaggagaguagaacag

SEQ ID NO: 3135037 - RNA, 22 nt, Human
cuagcuaauguaauaacuguga

SEQ ID NO: 3135038 - RNA, 21 nt, Human
cucauaaaaagccugcaauuu

SEQ ID NO: 3135039 - RNA, 23 nt, Human
cgaagaguauuuuugacagaaua

SEQ ID NO: 3135040 - RNA, 23 nt, Human
ccagugaauucuugaaggaaaau

SEQ ID NO: 3135041 - RNA, 13 nt, Human
cuucccuuucugc

SEQ ID NO: 3135042 - RNA, 14 nt, Human
cuucugugaaagua

SEQ ID NO: 3135043 - RNA, 20 nt, Human
gaaaaugauacgcaacauaa

SEQ ID NO: 3135044 - RNA, 21 nt, Human
gaaaauauuauguguuuccau

SEQ ID NO: 3135045 - RNA, 22 nt, Human
cuuuaucaaagggugaaaauua

SEQ ID NO: 3135046 - RNA, 21 nt, Human
cuuuaucaaagggugaaaauu

SEQ ID NO: 3135047 - RNA, 16 nt, Human
cuuucugcuuguguua

SEQ ID NO: 3135048 - RNA, 21 nt, Human
gcaaagcugaugacaacuucc

SEQ ID NO: 3135049 - RNA, 14 nt, Human
gcaauuucauaugc

SEQ ID NO: 3135050 - RNA, 18 nt, Human
gaguguacuuaacuauuc

SEQ ID NO: 3135051 - RNA, 18 nt, Human
gaauucuugaaggaaaau

SEQ ID NO: 3135052 - RNA, 15 nt, Human
gaauguuaagcagau

SEQ ID NO: 3135053 - RNA, 14 nt, Human
gaauguuaagcaga

SEQ ID NO: 3135054 - RNA, 18 nt, Human
gaaucucauaauuuauac

SEQ ID NO: 3135055 - RNA, 19 nt, Human
gaaucucauaauuuauaca

SEQ ID NO: 3135056 - RNA, 13 nt, Human
gaaugcuguguua

SEQ ID NO: 3135057 - RNA, 14 nt, Human
gaaugcuguguuaa

SEQ ID NO: 3135058 - RNA, 13 nt, Human
gacacaacuauuu

SEQ ID NO: 3135059 - RNA, 15 nt, Human
gagaguagaacagau

SEQ ID NO: 3135060 - RNA, 14 nt, Human
ggaaugcuguguua

SEQ ID NO: 3135061 - RNA, 13 nt, Human
guaauucaagaaa

SEQ ID NO: 3135062 - RNA, 14 nt, Human
guaauucaagaaaa

SEQ ID NO: 3135063 - RNA, 15 nt, Human
guacgaagaguauuu

SEQ ID NO: 3135064 - RNA, 16 nt, Human
guaaauaguauuugag

SEQ ID NO: 3135065 - RNA, 17 nt, Human
guaaauaguauuugaga

SEQ ID NO: 3135066 - RNA, 15 nt, Human
guaaauaguauuuga

SEQ ID NO: 3135067 - RNA, 23 nt, Human
gucuaagauaguaacaaugaaga

SEQ ID NO: 3135068 - RNA, 19 nt, Human
guauuugagaguucuaaau

SEQ ID NO: 3135069 - RNA, 21 nt, Human
guauuugagaguucuaaauuu

SEQ ID NO: 3135070 - RNA, 17 nt, Human
gugaaaguacauuugga

SEQ ID NO: 3135071 - RNA, 15 nt, Human
gugaaaauuauuuug

SEQ ID NO: 3135072 - RNA, 12 nt, Human
gugaaaauuauu

SEQ ID NO: 3135073 - RNA, 16 nt, Human
ugcauagguuuagcag

SEQ ID NO: 3135074 - RNA, 11 nt, Human
ugcuguguuaa

SEQ ID NO: 3135075 - RNA, 18 nt, Human
ugcuguguuaaauaaacc

SEQ ID NO: 3135076 - RNA, 16 nt, Human
ugacagaauauguuuc

SEQ ID NO: 3135077 - RNA, 14 nt, Human
ugauguguuuauuu

SEQ ID NO: 3135078 - RNA, 18 nt, Human
ugauguguuuauuuauag

SEQ ID NO: 3135079 - RNA, 22 nt, Human
ugaguucuacauaaguaauuca

SEQ ID NO: 3135080 - RNA, 23 nt, Human
ugagacguuuuuggaagaguagu

SEQ ID NO: 3135081 - RNA, 16 nt, Human
uccaaaccaaauaaaa

SEQ ID NO: 3135082 - RNA, 22 nt, Human
uccaaaaagauuuucagaaaau

SEQ ID NO: 3135083 - RNA, 23 nt, Human
ucucauaauuuauacaggucaua

SEQ ID NO: 3135084 - RNA, 23 nt, Human
uaguaugaaauuauauaaguauu

SEQ ID NO: 3135085 - RNA, 15 nt, Human
uaguaugaaauuaua

SEQ ID NO: 3135086 - RNA, 13 nt, Human
uaguaugaaauua

SEQ ID NO: 3135087 - RNA, 17 nt, Human
uauccuuucuaacaaaa

SEQ ID NO: 3135088 - RNA, 23 nt, Human
uaugacauaaaaacaacuuuaua

SEQ ID NO: 3135089 - RNA, 22 nt, Human
uaugacauaaaaacaacuuuau

SEQ ID NO: 3135090 - RNA, 19 nt, Human
uaugacauaaaaacaacuu

SEQ ID NO: 3135091 - RNA, 20 nt, Human
ucaaagagagaaaauaaaga

SEQ ID NO: 3135092 - RNA, 15 nt, Human
ucaaagagagaaaau

SEQ ID NO: 3135093 - RNA, 23 nt, Human
uauugauaaguucauacauugua

SEQ ID NO: 3135094 - RNA, 16 nt, Human
uauugauaaguucaua

SEQ ID NO: 3135095 - RNA, 14 nt, Human
uauugauaaguuca

SEQ ID NO: 3135096 - RNA, 12 nt, Human
uauuauguguuu

SEQ ID NO: 3135097 - RNA, 21 nt, Human
uuaagcagauggaaugcugug

SEQ ID NO: 3135098 - RNA, 17 nt, Human
uuaaugauaaguaaaug

SEQ ID NO: 3135099 - RNA, 21 nt, Human
uuaaugauaaguaaaugcuag

SEQ ID NO: 3135100 - RNA, 14 nt, Human
uuaauauauuucca

SEQ ID NO: 3135101 - RNA, 13 nt, Human
uuaauauauuucc

SEQ ID NO: 3135102 - RNA, 20 nt, Human
uuccuucugugaaaguacau

SEQ ID NO: 3135103 - RNA, 13 nt, Human
uuccaaaauaauu

SEQ ID NO: 3135104 - RNA, 21 nt, Human
uuccaaaauaauuuuaagaaa

SEQ ID NO: 3135105 - RNA, 12 nt, Human
uuccaaaauaau

SEQ ID NO: 3135106 - RNA, 19 nt, Human
uucaugcauagguuuagca

SEQ ID NO: 3135107 - RNA, 20 nt, Human
uuauugauaaguucauacau

SEQ ID NO: 3135108 - RNA, 19 nt, Human
uuauugauaaguucauaca

SEQ ID NO: 3135109 - RNA, 15 nt, Human
uuauugauaaguuca

SEQ ID NO: 3135110 - RNA, 19 nt, Human
uuguucaauaauaaauauu

SEQ ID NO: 3135111 - RNA, 15 nt, Human
uuuauacaggucaua

SEQ ID NO: 3135112 - RNA, 14 nt, Human
uuugagaguucuaa

SEQ ID NO: 3135113 - RNA, 16 nt, Human
uuugagaguucuaaau

SEQ ID NO: 3135114 - RNA, 13 nt, Human
uuugaguucuaca

SEQ ID NO: 3135115 - RNA, 21 nt, Human
uuucuaacaaaaaaauauauu

SEQ ID NO: 3135116 - RNA, 21 nt, Human
uuucacauaucuaguaugaaa

SEQ ID NO: 3135117 - RNA, 15 nt, Human
uuucacauaucuagu

SEQ ID NO: 3135118 - RNA, 22 nt, Human
uuguagcacugacagauuucca

SEQ ID NO: 3135119 - RNA, 18 nt, Human
uuguagcacugacagauu

SEQ ID NO: 3135120 - RNA, 17 nt, Human
uuguagcacugacagau

SEQ ID NO: 3135121 - RNA, 16 nt, Human
uuguagcacugacaga

SEQ ID NO: 3135122 - RNA, 14 nt, Human
uuguagcacugaca

SEQ ID NO: 3135123 - RNA, 19 nt, Human
uuguacgaagaguauuuuu

SEQ ID NO: 3135124 - RNA, 16 nt, Human
uuguacgaagaguauu

SEQ ID NO: 3135125 - RNA, 14 nt, Human
uugaauguuaagca

SEQ ID NO: 3135126 - RNA, 17 nt, Human
uugaauguuaagcagau

SEQ ID NO: 3135127 - RNA, 23 nt, Human
cuacauaaguaauucaagaaaac

SEQ ID NO: 3135128 - RNA, 22 nt, Human
cuacauaaguaauucaagaaaa

SEQ ID NO: 3135129 - RNA, 19 nt, Human
ccaaaaagauuuucagaaa

SEQ ID NO: 3135130 - RNA, 11 nt, Human
cacugacagau

SEQ ID NO: 3135131 - RNA, 14 nt, Human
auuguaaauaguau

SEQ ID NO: 3135132 - RNA, 21 nt, Human
auugauaaguucauacauugu

SEQ ID NO: 3135133 - RNA, 22 nt, Human
auugauaaguucauacauugua

SEQ ID NO: 3135134 - RNA, 15 nt, Human
auucuugaaggaaaa

SEQ ID NO: 3135135 - RNA, 18 nt, Human
auucuugaaggaaaauga

SEQ ID NO: 3135136 - RNA, 22 nt, Human
ggaucuucaucugacuaugaca

SEQ ID NO: 3135137 - RNA, 17 nt, Human
ggcauauuuuucacaua

SEQ ID NO: 3135138 - RNA, 15 nt, Human
ggcauauuuuucaca

SEQ ID NO: 3135139 - RNA, 17 nt, Human
guaacaaugaagauaaa

SEQ ID NO: 3135140 - RNA, 12 nt, Human
guaaaaugugaa

SEQ ID NO: 3135141 - RNA, 19 nt, Human
guaaaaugugaagugaaug

SEQ ID NO: 3135142 - RNA, 20 nt, Human
guaaaaugugaagugaauga

SEQ ID NO: 3135143 - RNA, 22 nt, Human
guaaaaugugaagugaaugaaa

SEQ ID NO: 3135144 - RNA, 23 nt, Human
aaaguuauugauaaguucauaca

SEQ ID NO: 3135145 - RNA, 13 nt, Human
aaagauuuucaga

SEQ ID NO: 3135146 - RNA, 12 nt, Human
aaaaugugaagu

SEQ ID NO: 3135147 - RNA, 19 nt, Human
aaaaauauauuuaaugaua

SEQ ID NO: 3135148 - RNA, 13 nt, Human
aaaaauauauuua

SEQ ID NO: 3135149 - RNA, 15 nt, Human
aaaaauauauuuaau

SEQ ID NO: 3135150 - RNA, 13 nt, Human
gacuaugacauaa

SEQ ID NO: 3135151 - RNA, 22 nt, Human
gagacguuuuuggaagaguagu

SEQ ID NO: 3135152 - RNA, 16 nt, Human
gacagaauauguuuca

SEQ ID NO: 3135153 - RNA, 12 nt, Human
gcacugacagau

SEQ ID NO: 3135154 - RNA, 17 nt, Human
gcacugacagauuucca

SEQ ID NO: 3135155 - RNA, 20 nt, Human
cuucaugcauagguuuagca

SEQ ID NO: 3135156 - RNA, 19 nt, Human
cuucaucugacuaugacau

SEQ ID NO: 3135157 - RNA, 21 nt, Human
cuucaucugacuaugacauaa

SEQ ID NO: 3135158 - RNA, 19 nt, Human
uagcacugacagauuucca

SEQ ID NO: 3135159 - RNA, 14 nt, Human
uagcacugacagau

SEQ ID NO: 3135160 - RNA, 16 nt, Human
aauuuggauugcuaau

SEQ ID NO: 3135161 - RNA, 17 nt, Human
aauuccaauuauaugag

SEQ ID NO: 3135162 - RNA, 16 nt, Human
acacucaguuguucaa

SEQ ID NO: 3135163 - RNA, 17 nt, Human
uauauccuuucuaacaa

SEQ ID NO: 3135164 - RNA, 20 nt, Human
uauauccuuucuaacaaaaa

SEQ ID NO: 3135165 - RNA, 21 nt, Human
uauacaggucauauuaauaua

SEQ ID NO: 3135166 - RNA, 16 nt, Human
uauacaggucauauua

SEQ ID NO: 3135167 - RNA, 15 nt, Human
uauacaggucauauu

SEQ ID NO: 3135168 - RNA, 19 nt, Human
uaucaaagggugaaaauua

SEQ ID NO: 3135169 - RNA, 18 nt, Human
uaucaaagggugaaaauu

SEQ ID NO: 3135170 - RNA, 22 nt, Human
uaucaaagggugaaaauuauuu

SEQ ID NO: 3135171 - RNA, 22 nt, Human
uaagcagauggaaugcuguguu

SEQ ID NO: 3135172 - RNA, 16 nt, Human
uaaguaauucaagaaa

SEQ ID NO: 3135173 - RNA, 14 nt, Human
aaucagugugucua

SEQ ID NO: 3135174 - RNA, 17 nt, Human
aaucagugugucuaaau

SEQ ID NO: 3135175 - RNA, 18 nt, Human
aaucagugugucuaaauu

SEQ ID NO: 3135176 - RNA, 22 nt, Human
aaucagugugucuaaauuugaa

SEQ ID NO: 3135177 - RNA, 14 nt, Human
aauauauuuaauga

SEQ ID NO: 3135178 - RNA, 17 nt, Human
uaacaaugaagauaaaa

SEQ ID NO: 3135179 - RNA, 20 nt, Human
aauagagcaaaauugaugug

SEQ ID NO: 3135180 - RNA, 22 nt, Human
aauagagcaaaauugauguguu

SEQ ID NO: 3135181 - RNA, 20 nt, Human
aaugacucagaauauugcuu

SEQ ID NO: 3135182 - RNA, 16 nt, Human
uaauuuauacagguca

SEQ ID NO: 3135183 - RNA, 15 nt, Human
aauucagaaggaucu

SEQ ID NO: 3135184 - RNA, 21 nt, Human
aauucagaaggaucuucaucu

SEQ ID NO: 3135185 - RNA, 12 nt, Human
aauucaagaaaa

SEQ ID NO: 3135186 - RNA, 20 nt, Human
aauucaagaaaacaacuuca

SEQ ID NO: 3135187 - RNA, 12 nt, Human
guuucaaacuuu

SEQ ID NO: 3135188 - RNA, 16 nt, Human
aagggugaaaauuauu

SEQ ID NO: 3135189 - RNA, 15 nt, Human
aagggugaaaauuau

SEQ ID NO: 3135190 - RNA, 17 nt, Human
aagccugcaauuucaua

SEQ ID NO: 3135191 - RNA, 22 nt, Human
aagccugcaauuucauaugcug

SEQ ID NO: 3135192 - RNA, 21 nt, Human
aagaccuuuggagcaaagcug

SEQ ID NO: 3135193 - RNA, 23 nt, Human
aagaccuugcuuaugauugcaga

SEQ ID NO: 3135194 - RNA, 15 nt, Human
guauuuuugacagaa

SEQ ID NO: 3135195 - RNA, 12 nt, Human
guauuuuugaca

SEQ ID NO: 3135196 - RNA, 13 nt, Human
aacagauaaucag

SEQ ID NO: 3135197 - RNA, 19 nt, Human
aacaagaugguucuagcau

SEQ ID NO: 3135198 - RNA, 18 nt, Human
aacuucccagugaauucu

SEQ ID NO: 3135199 - RNA, 18 nt, Human
agauggaaugcuguguua

SEQ ID NO: 3135200 - RNA, 13 nt, Human
agauggaaugcug

SEQ ID NO: 3135201 - RNA, 15 nt, Human
agauggaaugcugug

SEQ ID NO: 3135202 - RNA, 20 nt, Human
agaguauuuuugacagaaua

SEQ ID NO: 3135203 - RNA, 18 nt, Human
agaguauuuuugacagaa

SEQ ID NO: 3135204 - RNA, 17 nt, Human
agaguauuuuugacaga

SEQ ID NO: 3135205 - RNA, 23 nt, Human
ugaaaguacauuuggagacacaa

SEQ ID NO: 3135206 - RNA, 14 nt, Human
ugaaaguacauuug

SEQ ID NO: 3135207 - RNA, 15 nt, Human
agaguauuuuugaca

SEQ ID NO: 3135208 - RNA, 14 nt, Human
agaguauuuuugac

SEQ ID NO: 3135209 - RNA, 22 nt, Human
ugaaaaagaccuuuggagcaaa

SEQ ID NO: 3135210 - RNA, 20 nt, Human
agagcaaaauugauguguuu

SEQ ID NO: 3135211 - RNA, 14 nt, Human
agagagaaaauaaa

SEQ ID NO: 3135212 - RNA, 19 nt, Human
agacauucuuccaaaaaga

SEQ ID NO: 3135213 - RNA, 15 nt, Human
ucuuuaacucauaaa

SEQ ID NO: 3135214 - RNA, 16 nt, Human
agaaggaucuucaucu

SEQ ID NO: 3135215 - RNA, 21 nt, Human
ucuaagauaguaacaaugaag

SEQ ID NO: 3135216 - RNA, 22 nt, Human
acuucccuuucugcuuguguua

SEQ ID NO: 3135217 - RNA, 14 nt, Human
acuucccuuucugc

SEQ ID NO: 3135218 - RNA, 18 nt, Human
ucuagcauggcauauuuu

SEQ ID NO: 3135219 - RNA, 17 nt, Human
ucuagcauggcauauuu

SEQ ID NO: 3135220 - RNA, 17 nt, Human
acuucccagugaauucu

SEQ ID NO: 3135221 - RNA, 14 nt, Human
acucagaauauugc

SEQ ID NO: 3135222 - RNA, 22 nt, Human
acuaugacauaaaaacaacuuu

SEQ ID NO: 3135223 - RNA, 13 nt, Human
acugaaacuuccc

SEQ ID NO: 3135224 - RNA, 19 nt, Human
uccaaaaagauuuucagaa

SEQ ID NO: 3135225 - RNA, 20 nt, Human
uccaaaaagauuuucagaaa

SEQ ID NO: 3135226 - RNA, 20 nt, Human
acgaagaguauuuuugacag

SEQ ID NO: 3135227 - RNA, 22 nt, Human
acgaagaguauuuuugacagaa

SEQ ID NO: 3135228 - RNA, 13 nt, Human
uauuuuuguagca

SEQ ID NO: 3135229 - RNA, 13 nt, Human
uauuuuucacaua

SEQ ID NO: 3135230 - RNA, 12 nt, Human
uauuuuucacau

SEQ ID NO: 3135231 - RNA, 16 nt, Human
uauuuuguucauacau

SEQ ID NO: 3135232 - RNA, 15 nt, Human
uauuuuguucauaca

SEQ ID NO: 3135233 - RNA, 14 nt, Human
uauguguaaaaugu

SEQ ID NO: 3135234 - RNA, 19 nt, Human
uauuuuuguagcacugaca

SEQ ID NO: 3135235 - RNA, 15 nt, Human
uauuuuuguagcacu

SEQ ID NO: 3135236 - RNA, 16 nt, Human
accaaauaaaaauauu

SEQ ID NO: 3135237 - RNA, 18 nt, Human
accaaauaaaaauauugu

SEQ ID NO: 3135238 - RNA, 17 nt, Human
acauuguaaauaguauu

SEQ ID NO: 3135239 - RNA, 19 nt, Human
acauuguaaauaguauuug

SEQ ID NO: 3135240 - RNA, 21 nt, Human
acauuguaaauaguauuugag

SEQ ID NO: 3135241 - RNA, 14 nt, Human
uuaaguauguguaa

SEQ ID NO: 3135242 - RNA, 13 nt, Human
auaacugugaagu

SEQ ID NO: 3135243 - RNA, 18 nt, Human
auaaauauuuuugccaua

SEQ ID NO: 3135244 - RNA, 12 nt, Human
uguugugaaugu

SEQ ID NO: 3135245 - RNA, 13 nt, Human
uguugugaauguu

SEQ ID NO: 3135246 - RNA, 14 nt, Human
uguugugauguauu

SEQ ID NO: 3135247 - RNA, 20 nt, Human
uguugugauguauucuagcu

SEQ ID NO: 3135248 - RNA, 15 nt, Human
aguucuacauaagua

SEQ ID NO: 3135249 - RNA, 13 nt, Human
uguguugugaaug

SEQ ID NO: 3135250 - RNA, 13 nt, Human
aguagaacagaua

SEQ ID NO: 3135251 - RNA, 19 nt, Human
aguagaacagauaaucagu

SEQ ID NO: 3135252 - RNA, 16 nt, Human
aguauuugagaguucu

SEQ ID NO: 3135253 - RNA, 16 nt, Human
aggucauauuaauaua

SEQ ID NO: 3135254 - RNA, 19 nt, Human
aggucauauuaauauauuu

SEQ ID NO: 3135255 - RNA, 18 nt, Human
aggucauauuaauauauu

SEQ ID NO: 3135256 - RNA, 23 nt, Human
agcuuuaucaaagggugaaaauu

SEQ ID NO: 3135257 - RNA, 17 nt, Human
uggcauauuuuucacau

SEQ ID NO: 3135258 - RNA, 16 nt, Human
uggcauauuuuucaca

SEQ ID NO: 3135259 - RNA, 19 nt, Human
ugauacgcaacauaauuaa

SEQ ID NO: 3135260 - RNA, 12 nt, Human
ugauaaguaaau

SEQ ID NO: 3135261 - RNA, 22 nt, Human
agcauggcauauuuuucacaua

SEQ ID NO: 3135262 - RNA, 21 nt, Human
agcauggcauauuuuucacau

SEQ ID NO: 3135263 - RNA, 19 nt, Human
agcauggcauauuuuucac

SEQ ID NO: 3135264 - RNA, 18 nt, Human
agcauggcauauuuuuca

SEQ ID NO: 3135265 - RNA, 13 nt, Human
auaucuuguagcu

SEQ ID NO: 3135266 - RNA, 17 nt, Human
auaucuaguaugaaauu

SEQ ID NO: 3135267 - RNA, 15 nt, Human
auaucuaguaugaaa

SEQ ID NO: 3135268 - RNA, 14 nt, Human
auaucuaguaugaa

SEQ ID NO: 3135269 - RNA, 13 nt, Human
auauauuuaauga

SEQ ID NO: 3135270 - RNA, 23 nt, Human
uucauacauauuuuuguagcacu

SEQ ID NO: 3135271 - RNA, 12 nt, Human
uucauacauauu

SEQ ID NO: 3135272 - RNA, 13 nt, Human
uucauaugcugua

SEQ ID NO: 3135273 - RNA, 19 nt, Human
uucauacauuguacgaaga

SEQ ID NO: 3135274 - RNA, 13 nt, Human
uucauacauugua

SEQ ID NO: 3135275 - RNA, 21 nt, Human
uuauuuuguucauacauauuu

SEQ ID NO: 3135276 - RNA, 17 nt, Human
uuauuuuguucauacau

SEQ ID NO: 3135277 - RNA, 13 nt, Human
auagucuuucagu

SEQ ID NO: 3135278 - RNA, 20 nt, Human
auccuagucacuaccuucau

SEQ ID NO: 3135279 - RNA, 19 nt, Human
uucuaacaaaaaaauauau

SEQ ID NO: 3135280 - RNA, 20 nt, Human
uucuaacaaaaaaauauauu

SEQ ID NO: 3135281 - RNA, 16 nt, Human
auggaaugcuguguua

SEQ ID NO: 3135282 - RNA, 15 nt, Human
uuucauaugcuguau

SEQ ID NO: 3135283 - RNA, 18 nt, Human
aucucauaauuuauacag

SEQ ID NO: 3135284 - RNA, 17 nt, Human
aucucauaauuuauaca

SEQ ID NO: 3135285 - RNA, 11 nt, Human
uugauguguuu

SEQ ID NO: 3135286 - RNA, 11 nt, Human
uuuuaagaaau

SEQ ID NO: 3135287 - RNA, 17 nt, Human
uuuguagcacugacaga

SEQ ID NO: 3135288 - RNA, 19 nt, Human
uuuguagcacugacagauu

SEQ ID NO: 3135289 - RNA, 15 nt, Human
auguugugauguauu

SEQ ID NO: 3135290 - RNA, 20 nt, Human
auuaaaaaaucaguuguaca

SEQ ID NO: 3135291 - RNA, 15 nt, Human
auuaauauauuucca

SEQ ID NO: 3135292 - RNA, 20 nt, Human
auuuggagacacaacuauuu

SEQ ID NO: 3135293 - RNA, 21 nt, Human
auugcuaaucaccaaaggcuc

SEQ ID NO: 3135294 - RNA, 15 nt, Human
auguguaaaauguga

SEQ ID NO: 3135295 - RNA, 14 nt, Human
aucuaguaugaaau

SEQ ID NO: 3135296 - RNA, 19 nt, Human
aucuaguaugaaauuauau

SEQ ID NO: 3135297 - RNA, 18 nt, Human
aucuaguaugaaauuaua

SEQ ID NO: 3135298 - RNA, 17 nt, Human
aucuaguaugaaauuau

SEQ ID NO: 3135299 - RNA, 16 nt, Human
aucuaguaugaaauua

SEQ ID NO: 3135300 - RNA, 15 nt, Human
aucuaguaugaaauu

SEQ ID NO: 3135301 - RNA, 13 nt, Human
auauuauguguuu

SEQ ID NO: 3135302 - RNA, 17 nt, Human
auauuauguguuuccau

SEQ ID NO: 3135303 - RNA, 20 nt, Human
auaaaaagccugcaauuuca

SEQ ID NO: 3135304 - RNA, 22 nt, Human
auaaaaagccugcaauuucaua

SEQ ID NO: 3135305 - RNA, 17 nt, Human
auacccagaaaguuauu

SEQ ID NO: 3135306 - RNA, 19 nt, Human
aguaacaaugaagauaaaa

SEQ ID NO: 3135307 - RNA, 23 nt, Human
aguaaaugcuagguuaauuccaa

SEQ ID NO: 3135308 - RNA, 11 nt, Human
aguaaaugcua

SEQ ID NO: 3135309 - RNA, 22 nt, Human
aguaaaugcuagguuaauucca

SEQ ID NO: 3135310 - RNA, 13 nt, Human
aguauuuuugaca

SEQ ID NO: 3135311 - RNA, 18 nt, Human
aguauuuuugacagaaua

SEQ ID NO: 3135312 - RNA, 17 nt, Human
aguauuuuugacagaau

SEQ ID NO: 3135313 - RNA, 16 nt, Human
aguauuuuugacagaa

SEQ ID NO: 3135314 - RNA, 20 nt, Human
agugaauucuugaaggaaaa

SEQ ID NO: 3135315 - RNA, 23 nt, Human
agcuaauguaauaacugugaagu

SEQ ID NO: 3135316 - RNA, 14 nt, Human
agaugguucuagca

SEQ ID NO: 3135317 - RNA, 21 nt, Human
agcaaagcugaugacaacuuc

SEQ ID NO: 3135318 - RNA, 23 nt, Human
agcaaagcugaugacaacuuccc

SEQ ID NO: 3135319 - RNA, 14 nt, Human
aaauugauguguuu

SEQ ID NO: 3135320 - RNA, 20 nt, Human
aaaugcuagguuaauuccaa

SEQ ID NO: 3135321 - RNA, 20 nt, Human
aaaauuauuuuguucauaca

SEQ ID NO: 3135322 - RNA, 18 nt, Human
aaaauuauuuuguucaua

SEQ ID NO: 3135323 - RNA, 16 nt, Human
aaaauuauuuuguuca

SEQ ID NO: 3135324 - RNA, 19 nt, Human
aaauaaaccucaaaauguc

SEQ ID NO: 3135325 - RNA, 20 nt, Human
aaauaaaaauauuguguugu

SEQ ID NO: 3135326 - RNA, 17 nt, Human
aaaccucaaaaugucua

SEQ ID NO: 3135327 - RNA, 22 nt, Human
aaaccucaaaaugucuaagaua

SEQ ID NO: 3135328 - RNA, 13 nt, Human
aagauuuucagaa

SEQ ID NO: 3135329 - RNA, 21 nt, Human
aagacauucuuccaaaaagau

SEQ ID NO: 3135330 - RNA, 17 nt, Human
aauaaaccucaaaaugu

SEQ ID NO: 3135331 - RNA, 20 nt, Human
aauaaaccucaaaaugucua

SEQ ID NO: 3135332 - RNA, 14 nt, Human
aauaauaaauauuu

SEQ ID NO: 3135333 - RNA, 15 nt, Human
acauaaguaauucaa

SEQ ID NO: 3135334 - RNA, 19 nt, Human
acauaauuaaauuuugagu

SEQ ID NO: 3135335 - RNA, 18 nt, Human
caaaauaauuuuaagaaa

SEQ ID NO: 3135336 - RNA, 22 nt, Human
caaaauaauuuuaagaaaucaa

SEQ ID NO: 3135337 - RNA, 19 nt, Human
caaagagagaaaauaaaga

SEQ ID NO: 3135338 - RNA, 16 nt, Human
caaagagagaaaauaa

SEQ ID NO: 3135339 - RNA, 15 nt, Human
caaauaaaaauauug

SEQ ID NO: 3135340 - RNA, 16 nt, Human
caaauaaaaauauugu

SEQ ID NO: 3135341 - RNA, 18 nt, Human
caaauaaaaauauugugu

SEQ ID NO: 3135342 - RNA, 19 nt, Human
caauaauaaauauuuuugc

SEQ ID NO: 3135343 - RNA, 15 nt, Human
cauaaaaacaacuuu

SEQ ID NO: 3135344 - RNA, 18 nt, Human
cauaaguaauucaagaaa

SEQ ID NO: 3135345 - RNA, 22 nt, Human
cauaaguaauucaagaaaacaa

SEQ ID NO: 3135346 - RNA, 16 nt, Human
cauaaguaauucaaga

SEQ ID NO: 3135347 - RNA, 17 nt, Human
cauaaguaauucaagaa

SEQ ID NO: 3135348 - RNA, 15 nt, Human
cauacauuguacgaa

SEQ ID NO: 3135349 - RNA, 19 nt, Human
cauacauauuuuuguagca

SEQ ID NO: 3135350 - RNA, 12 nt, Human
cauacauauuuu

SEQ ID NO: 3135351 - RNA, 11 nt, Human
cauacauauuu

SEQ ID NO: 3135352 - RNA, 23 nt, Human
cauaaaaagccugcaauuucaua

SEQ ID NO: 3135353 - RNA, 23 nt, Human
cauaaaaacaacuuuauacccag

SEQ ID NO: 3135354 - RNA, 21 nt, Human
cauaaaaacaacuuuauaccc

SEQ ID NO: 3135355 - RNA, 20 nt, Human
cauaaaaacaacuuuauacc

SEQ ID NO: 3135356 - RNA, 17 nt, Human
cauaaaaacaacuuuau

SEQ ID NO: 3135357 - RNA, 23 nt, Human
cagugugucuaaauuugaauguu

SEQ ID NO: 3135358 - RNA, 14 nt, Human
cagugugucuaaau

SEQ ID NO: 3135359 - RNA, 18 nt, Human
cauauuuuucacauaucu

SEQ ID NO: 3135360 - RNA, 14 nt, Human
cauauuuuucacau

SEQ ID NO: 3135361 - RNA, 21 nt, Human
cauauuuuucacauaucuagu

SEQ ID NO: 3135362 - RNA, 15 nt, Human
gccugcaauuucaua

SEQ ID NO: 3135363 - RNA, 20 nt, Human
gcauauuuuucacauaucua

SEQ ID NO: 3135364 - RNA, 19 nt, Human
gcauauuuuucacauaucu

SEQ ID NO: 3135365 - RNA, 16 nt, Human
gcauauuuuucacaua

SEQ ID NO: 3135366 - RNA, 15 nt, Human
gcauauuuuucacau

SEQ ID NO: 3135367 - RNA, 14 nt, Human
gcauauuuuucaca

SEQ ID NO: 3135368 - RNA, 17 nt, Human
gcaaaauugauguguuu

SEQ ID NO: 3135369 - RNA, 17 nt, Human
gaugacaacuucccagu

SEQ ID NO: 3135370 - RNA, 12 nt, Human
gauaaguucaua

SEQ ID NO: 3135371 - RNA, 16 nt, Human
gauaaguucauacauu

SEQ ID NO: 3135372 - RNA, 14 nt, Human
gauaaguucauaca

SEQ ID NO: 3135373 - RNA, 22 nt, Human
gauagucuuucaguuaaggaga

SEQ ID NO: 3135374 - RNA, 15 nt, Human
gauaguaacaaugaa

SEQ ID NO: 3135375 - RNA, 14 nt, Human
gauagucuuucagu

SEQ ID NO: 3135376 - RNA, 16 nt, Human
cuuuggaacaagaugg

SEQ ID NO: 3135377 - RNA, 23 nt, Human
gaaauuauauaaguauucuaaau

SEQ ID NO: 3135378 - RNA, 17 nt, Human
gaaauuauauaaguauu

SEQ ID NO: 3135379 - RNA, 18 nt, Human
gaacagauaaucagugug

SEQ ID NO: 3135380 - RNA, 23 nt, Human
gaaaguuauugauaaguucauac

SEQ ID NO: 3135381 - RNA, 20 nt, Human
gaagaguauuuuugacagaa

SEQ ID NO: 3135382 - RNA, 21 nt, Human
cucuccugauagucuuucagu

SEQ ID NO: 3135383 - RNA, 15 nt, Human
cugacagauuuccau

SEQ ID NO: 3135384 - RNA, 11 nt, Human
cugacagauuu

SEQ ID NO: 3135385 - RNA, 15 nt, Human
cugacuaugacauaa

SEQ ID NO: 3135386 - RNA, 23 nt, Human
cuaaauuugaauguuaagcagau

SEQ ID NO: 3135387 - RNA, 21 nt, Human
cuaugacauaaaaacaacuuu

SEQ ID NO: 3135388 - RNA, 18 nt, Human
cuaugacauaaaaacaac

SEQ ID NO: 3135389 - RNA, 16 nt, Human
cuaguaugaaauuaua

SEQ ID NO: 3135390 - RNA, 19 nt, Human
cuaauguaauaacugugaa

SEQ ID NO: 3135391 - RNA, 22 nt, Human
uuugaaucucauaauuuauaca

SEQ ID NO: 3135392 - RNA, 21 nt, Human
uuugaaucucauaauuuauac

SEQ ID NO: 3135393 - RNA, 20 nt, Human
uuugaaucucauaauuuaua

SEQ ID NO: 3135394 - RNA, 19 nt, Human
uuugaaucucauaauuuau

SEQ ID NO: 3135395 - RNA, 16 nt, Human
uuugaaucucauaauu

SEQ ID NO: 3135396 - RNA, 20 nt, Human
uuuugaaucucauaauuuau

SEQ ID NO: 3135397 - RNA, 19 nt, Human
uuuuguagcacugacagau

SEQ ID NO: 3135398 - RNA, 18 nt, Human
uuuuguagcacugacaga

SEQ ID NO: 3135399 - RNA, 23 nt, Human
guaugaaauuauauaaguauucu

SEQ ID NO: 3135400 - RNA, 13 nt, Human
guaugaaauuaua

SEQ ID NO: 3135401 - RNA, 15 nt, Human
guagcacugacagau

SEQ ID NO: 3135402 - RNA, 14 nt, Human
guagcacugacaga

SEQ ID NO: 3135403 - RNA, 18 nt, Human
gugaauucuugaaggaaa

SEQ ID NO: 3135404 - RNA, 22 nt, Human
gugaauucuugaaggaaaauga

SEQ ID NO: 3135405 - RNA, 13 nt, Human
gucuaaauuugaa

SEQ ID NO: 3135406 - RNA, 21 nt, Human
gucuaagauaguaacaaugaa

SEQ ID NO: 3135407 - RNA, 18 nt, Human
guucaauaauaaauauuu

SEQ ID NO: 3135408 - RNA, 15 nt, Human
guguacuuaacuauu

SEQ ID NO: 3135409 - RNA, 15 nt, Human
uagcauggcauauuu

SEQ ID NO: 3135410 - RNA, 18 nt, Human
uagcauggcauauuuuuc

SEQ ID NO: 3135411 - RNA, 17 nt, Human
uagcauggcauauuuuu

SEQ ID NO: 3135412 - RNA, 22 nt, Human
uagguuaauuccaauuauauga

SEQ ID NO: 3135413 - RNA, 14 nt, Human
uauaucuuguagcu

SEQ ID NO: 3135414 - RNA, 13 nt, Human
uacuuaacuauuc

SEQ ID NO: 3135415 - RNA, 14 nt, Human
uacccagaaaguua

SEQ ID NO: 3135416 - RNA, 13 nt, Human
uaaaaacaacuuu

SEQ ID NO: 3135417 - RNA, 19 nt, Human
uaaaaacaacuuuauaccc

SEQ ID NO: 3135418 - RNA, 18 nt, Human
uaaaaacaacuuuauacc

SEQ ID NO: 3135419 - RNA, 21 nt, Human
uaaaaagacauucuuccaaaa

SEQ ID NO: 3135420 - RNA, 14 nt, Human
guugugaauguugu

SEQ ID NO: 3135421 - RNA, 13 nt, Human
uaacugugaaguu

SEQ ID NO: 3135422 - RNA, 17 nt, Human
uaacugugaaguuuaca

SEQ ID NO: 3135423 - RNA, 18 nt, Human
uaacugugaaguuuacau

SEQ ID NO: 3135424 - RNA, 19 nt, Human
uaagaaaucaaagagagaa

SEQ ID NO: 3135425 - RNA, 14 nt, Human
uaaauuugaauguu

SEQ ID NO: 3135426 - RNA, 22 nt, Human
uaaauuugaauguuaagcagau

SEQ ID NO: 3135427 - RNA, 21 nt, Human
uaauaacugugaaguuuacau

SEQ ID NO: 3135428 - RNA, 16 nt, Human
uuaaugauaaguaaau

SEQ ID NO: 3135429 - RNA, 12 nt, Human
uuacauuguaaa

SEQ ID NO: 3135430 - RNA, 13 nt, Human
uuacauuguaaau

SEQ ID NO: 3135431 - RNA, 19 nt, Human
uguuuccauauuuuauagg

SEQ ID NO: 3135432 - RNA, 12 nt, Human
uguucauacaua

SEQ ID NO: 3135433 - RNA, 23 nt, Human
uguucauacauauuuuuguagca

SEQ ID NO: 3135434 - RNA, 14 nt, Human
uguucauacauauu

SEQ ID NO: 3135435 - RNA, 18 nt, Human
ugugaagugaaugaaaca

SEQ ID NO: 3135436 - RNA, 21 nt, Human
ugugaauguugugauguauuc

SEQ ID NO: 3135437 - RNA, 22 nt, Human
uguacgaagaguauuuuugaca

SEQ ID NO: 3135438 - RNA, 14 nt, Human
uguacgaagaguau

SEQ ID NO: 3135439 - RNA, 16 nt, Human
uggaaugcuguguuaa

SEQ ID NO: 3135440 - RNA, 22 nt, Human
ucucauaauuuauacaggucau

SEQ ID NO: 3135441 - RNA, 16 nt, Human
ucucauaauuuauaca

SEQ ID NO: 3135442 - RNA, 19 nt, Human
ucagugugucuaaauuuga

SEQ ID NO: 3135443 - RNA, 22 nt, Human
ucaggagaguagaacagauaau

SEQ ID NO: 3135444 - RNA, 18 nt, Human
ucuuguagcuuuaucaaa

SEQ ID NO: 3135445 - RNA, 23 nt, Human
ugaaaauuauuuuguucauacau

SEQ ID NO: 3135446 - RNA, 22 nt, Human
ugaaaauuauuuuguucauaca

SEQ ID NO: 3135447 - RNA, 23 nt, Human
ugaaacacucaguuguucaauaa

SEQ ID NO: 3135448 - RNA, 19 nt, Human
ugaaaauuauuuuguucau

SEQ ID NO: 3135449 - RNA, 20 nt, Human
ugaaucucauaauuuauaca

SEQ ID NO: 3135450 - RNA, 13 nt, Human
ugaaucucauaau

SEQ ID NO: 3135451 - RNA, 14 nt, Human
ugaaguuuacauug

SEQ ID NO: 3135452 - RNA, 16 nt, Human
ugaaguuuacauugua

SEQ ID NO: 3135453 - RNA, 20 nt, Human
ugaaguuuacauuguaaaua

SEQ ID NO: 3135454 - RNA, 15 nt, Human
ugaaggaaaaugaua

SEQ ID NO: 3135455 - RNA, 18 nt, Human
ugacagaauauguuucaa

SEQ ID NO: 3135456 - RNA, 22 nt, Human
ugacagaauauguuucaaacuu

SEQ ID NO: 3135457 - RNA, 21 nt, Human
ugacagaauauguuucaaacu

SEQ ID NO: 3135458 - RNA, 22 nt, Human
ugacaacuucccagugaauucu

SEQ ID NO: 3135459 - RNA, 23 nt, Human
ugacagaauauguuucaaacuuu

SEQ ID NO: 3135460 - RNA, 13 nt, Human
agugaaugaaaca

SEQ ID NO: 3135461 - RNA, 17 nt, Human
auaaguaauucaagaaa

SEQ ID NO: 3135462 - RNA, 15 nt, Human
auaaguaaaugcuag

SEQ ID NO: 3135463 - RNA, 20 nt, Human
aguuguucaauaauaaauau

SEQ ID NO: 3135464 - RNA, 22 nt, Human
auaaaaauauuguguugugaau

SEQ ID NO: 3135465 - RNA, 23 nt, Human
auaaaaauauuguguugugaaug

SEQ ID NO: 3135466 - RNA, 20 nt, Human
auaaaaagacauucuuccaa

SEQ ID NO: 3135467 - RNA, 14 nt, Human
auaaaaacaacuuu

SEQ ID NO: 3135468 - RNA, 18 nt, Human
aucaaagagagaaaauaa

SEQ ID NO: 3135469 - RNA, 20 nt, Human
aucaaagggugaaaauuauu

SEQ ID NO: 3135470 - RNA, 23 nt, Human
agcaaaauugauguguuuauuua

SEQ ID NO: 3135471 - RNA, 13 nt, Human
agcaaaauugaug

SEQ ID NO: 3135472 - RNA, 19 nt, Human
agcaaaauugauguguuua

SEQ ID NO: 3135473 - RNA, 19 nt, Human
agaacagauaaucagugug

SEQ ID NO: 3135474 - RNA, 17 nt, Human
aauuauauaaguauucu

SEQ ID NO: 3135475 - RNA, 16 nt, Human
aauuauauaaguauuc

SEQ ID NO: 3135476 - RNA, 15 nt, Human
aauuauauaaguauu

SEQ ID NO: 3135477 - RNA, 16 nt, Human
aauuucauaugcugua

SEQ ID NO: 3135478 - RNA, 18 nt, Human
aauuucauaugcuguaua

SEQ ID NO: 3135479 - RNA, 20 nt, Human
acauaaguaauucaagaaaa

SEQ ID NO: 3135480 - RNA, 21 nt, Human
acauaaguaauucaagaaaac

SEQ ID NO: 3135481 - RNA, 16 nt, Human
acugacagauuuccau

SEQ ID NO: 3135482 - RNA, 16 nt, Human
aaucucauaauuuaua

SEQ ID NO: 3135483 - RNA, 16 nt, Human
aagaguaguaauagag

SEQ ID NO: 3135484 - RNA, 19 nt, Human
aagaguauuuuugacagaa

SEQ ID NO: 3135485 - RNA, 14 nt, Human
aagagagaaaauaa

SEQ ID NO: 3135486 - RNA, 23 nt, Human
aaaucucaaauuuggauugcuaa

SEQ ID NO: 3135487 - RNA, 13 nt, Human
aaagccugcaauu

SEQ ID NO: 3135488 - RNA, 18 nt, Human
aaagccugcaauuucaua

SEQ ID NO: 3135489 - RNA, 22 nt, Human
gcuuccuucugugaaaguacau

SEQ ID NO: 3135490 - RNA, 21 nt, Human
gccacuguuuugaaucucaua

SEQ ID NO: 3135491 - RNA, 21 nt, Human
aaagauuuucagaaaauauua

SEQ ID NO: 3135492 - RNA, 18 nt, Human
ggucauauuaauauauuu

SEQ ID NO: 3135493 - RNA, 21 nt, Human
ggucauauuaauauauuucca

SEQ ID NO: 3135494 - RNA, 14 nt, Human
aaagauuuucagaa

SEQ ID NO: 3135495 - RNA, 15 nt, Human
aaagauuuucagaaa

SEQ ID NO: 3135496 - RNA, 21 nt, Human
aaaauauuauguguuuccaua

SEQ ID NO: 3135497 - RNA, 14 nt, Human
aaaauauuaugugu

SEQ ID NO: 3135498 - RNA, 15 nt, Human
aaaauauuauguguu

SEQ ID NO: 3135499 - RNA, 19 nt, Human
aaacaacuucaauauccaa

SEQ ID NO: 3135500 - RNA, 19 nt, Human
aaaagccugcaauuucaua

SEQ ID NO: 3135501 - RNA, 14 nt, Human
aaaauauauuuaau

SEQ ID NO: 3135502 - RNA, 14 nt, Human
gaugguucuagcau

SEQ ID NO: 3135503 - RNA, 20 nt, Human
gaauauguuucaaacuuugg

SEQ ID NO: 3135504 - RNA, 15 nt, Human
gaauauguuucaaac

SEQ ID NO: 3135505 - RNA, 14 nt, Human
gaauauguuucaaa

SEQ ID NO: 3135506 - RNA, 22 nt, Human
gaauauugcuuuggucauauga

SEQ ID NO: 3135507 - RNA, 12 nt, Human
cuucaucugacu

SEQ ID NO: 3135508 - RNA, 18 nt, Human
cuucaucugacuaugaca

SEQ ID NO: 3135509 - RNA, 23 nt, Human
caguuguucaauaauaaauauuu

SEQ ID NO: 3135510 - RNA, 22 nt, Human
ccaauuauaugagacguuuuug

SEQ ID NO: 3135511 - RNA, 19 nt, Human
ccaauucgaacuuuuucca

SEQ ID NO: 3135512 - RNA, 15 nt, Human
caacuauuuuuccaa

SEQ ID NO: 3135513 - RNA, 20 nt, Human
auuaaauuuugaguucuaca

SEQ ID NO: 3135514 - RNA, 15 nt, Human
auugauaaguucaua

SEQ ID NO: 3135515 - RNA, 12 nt, Human
auugauaaguuc

SEQ ID NO: 3135516 - RNA, 19 nt, Human
auugauaaguucauacauu

SEQ ID NO: 3135517 - RNA, 18 nt, Human
auugauaaguucauacau

SEQ ID NO: 3135518 - RNA, 17 nt, Human
auugauaaguucauaca

SEQ ID NO: 3135519 - RNA, 16 nt, Human
auugauaaguucauac

SEQ ID NO: 3135520 - RNA, 13 nt, Human
uaauucaagaaaa

SEQ ID NO: 3135521 - RNA, 17 nt, Human
uaauuuauacaggucau

SEQ ID NO: 3135522 - RNA, 18 nt, Human
uacauauuuuuguagcac

SEQ ID NO: 3135523 - RNA, 17 nt, Human
uacauauuuuuguagca

SEQ ID NO: 3135524 - RNA, 14 nt, Human
uaaugguguuuuaa

SEQ ID NO: 3135525 - RNA, 23 nt, Human
uaaucagugugucuaaauuugaa

SEQ ID NO: 3135526 - RNA, 20 nt, Human
uaaguauguguaaaauguga

SEQ ID NO: 3135527 - RNA, 13 nt, Human
uaaguucauacau

SEQ ID NO: 3135528 - RNA, 12 nt, Human
uaaguucauaca

SEQ ID NO: 3135529 - RNA, 15 nt, Human
aauaguauuugagag

SEQ ID NO: 3135530 - RNA, 20 nt, Human
uaaauuuugucuuuaacuca

SEQ ID NO: 3135531 - RNA, 18 nt, Human
uaaauuuugaguucuaca

SEQ ID NO: 3135532 - RNA, 19 nt, Human
uaaauuuugaguucuacau

SEQ ID NO: 3135533 - RNA, 20 nt, Human
aauauugcuuuggucauaug

SEQ ID NO: 3135534 - RNA, 18 nt, Human
aauauuguguugugaaug

SEQ ID NO: 3135535 - RNA, 17 nt, Human
uaaauuuugaguucuac

SEQ ID NO: 3135536 - RNA, 21 nt, Human
aauaauuuuaagaaaucaaag

SEQ ID NO: 3135537 - RNA, 20 nt, Human
aauaacugugaaguuuacau

SEQ ID NO: 3135538 - RNA, 14 nt, Human
aauaacugugaagu

SEQ ID NO: 3135539 - RNA, 16 nt, Human
aauaacugugaaguuu

SEQ ID NO: 3135540 - RNA, 13 nt, Human
aauaacugugaag

SEQ ID NO: 3135541 - RNA, 17 nt, Human
aauuuauacaggucaua

SEQ ID NO: 3135542 - RNA, 16 nt, Human
aauuuauacaggucau

SEQ ID NO: 3135543 - RNA, 18 nt, Human
acaaugaagauaaaaaga

SEQ ID NO: 3135544 - RNA, 17 nt, Human
acaagaugguucuagca

SEQ ID NO: 3135545 - RNA, 16 nt, Human
uauaaguauucuaaau

SEQ ID NO: 3135546 - RNA, 15 nt, Human
uauauuuaaugauaa

SEQ ID NO: 3135547 - RNA, 16 nt, Human
uaucuuguagcuuuau

SEQ ID NO: 3135548 - RNA, 14 nt, Human
acagauaaucagug

SEQ ID NO: 3135549 - RNA, 20 nt, Human
uaguaauagagcaaaauuga

SEQ ID NO: 3135550 - RNA, 14 nt, Human
uaguaauagagcaa

SEQ ID NO: 3135551 - RNA, 18 nt, Human
acacaacuauuuuuccaa

SEQ ID NO: 3135552 - RNA, 18 nt, Human
guucuagcauggcauauu

SEQ ID NO: 3135553 - RNA, 9 nt, Human
guucauaca

SEQ ID NO: 3135554 - RNA, 23 nt, Human
guucauacauauuuuuguagcac

SEQ ID NO: 3135555 - RNA, 14 nt, Human
guucauacauauuu

SEQ ID NO: 3135556 - RNA, 13 nt, Human
guucauacauauu

SEQ ID NO: 3135557 - RNA, 10 nt, Human
guucauacau

SEQ ID NO: 3135558 - RNA, 14 nt, Human
guucauacauugua

SEQ ID NO: 3135559 - RNA, 11 nt, Human
guucauacauu

SEQ ID NO: 3135560 - RNA, 14 nt, Human
guuaaguaugugua

SEQ ID NO: 3135561 - RNA, 18 nt, Human
guguuuccauauuuuaua

SEQ ID NO: 3135562 - RNA, 16 nt, Human
guauuuuugacagaau

SEQ ID NO: 3135563 - RNA, 20 nt, Human
guauuuuugacagaauaugu

SEQ ID NO: 3135564 - RNA, 22 nt, Human
aaauuauuuuguucauacauau

SEQ ID NO: 3135565 - RNA, 21 nt, Human
aaauuauuuuguucauacaua

SEQ ID NO: 3135566 - RNA, 20 nt, Human
aaauuauuuuguucauacau

SEQ ID NO: 3135567 - RNA, 18 nt, Human
aaauuauauaaguauucu

SEQ ID NO: 3135568 - RNA, 16 nt, Human
aaauuauauaaguauu

SEQ ID NO: 3135569 - RNA, 22 nt, Human
aaauuauauaaguauucuaaau

SEQ ID NO: 3135570 - RNA, 19 nt, Human
aaauuauuuuguucauaca

SEQ ID NO: 3135571 - RNA, 17 nt, Human
aaauuauuuuguucaua

SEQ ID NO: 3135572 - RNA, 17 nt, Human
aaccucaaaaugucuaa

SEQ ID NO: 3135573 - RNA, 18 nt, Human
aacaaugaagauaaaaag

SEQ ID NO: 3135574 - RNA, 14 nt, Human
aacaaugaagauaa

SEQ ID NO: 3135575 - RNA, 19 nt, Human
agacacaacuauuuuucca

SEQ ID NO: 3135576 - RNA, 20 nt, Human
agacacaacuauuuuuccaa

SEQ ID NO: 3135577 - RNA, 17 nt, Human
ugacauaaaaacaacuu

SEQ ID NO: 3135578 - RNA, 20 nt, Human
ugacauaaaaacaacuuuau

SEQ ID NO: 3135579 - RNA, 18 nt, Human
ugacauaaaaacaacuuu

SEQ ID NO: 3135580 - RNA, 14 nt, Human
agagcaaaauugau

SEQ ID NO: 3135581 - RNA, 22 nt, Human
ucuacauaaguaauucaagaaa

SEQ ID NO: 3135582 - RNA, 17 nt, Human
ucuacauaaguaauuca

SEQ ID NO: 3135583 - RNA, 20 nt, Human
ucuacauaaguaauucaaga

SEQ ID NO: 3135584 - RNA, 22 nt, Human
uccuuucuaacaaaaaaauaua

SEQ ID NO: 3135585 - RNA, 17 nt, Human
agaaaucaaagagagaa

SEQ ID NO: 3135586 - RNA, 16 nt, Human
ucugacuaugacauaa

SEQ ID NO: 3135587 - RNA, 14 nt, Human
ucugacuaugacau

SEQ ID NO: 3135588 - RNA, 19 nt, Human
ucccuuucugcuuguguua

SEQ ID NO: 3135589 - RNA, 16 nt, Human
accucaaaaugucuaa

SEQ ID NO: 3135590 - RNA, 19 nt, Human
accucaaaaugucuaagau

SEQ ID NO: 3135591 - RNA, 17 nt, Human
acauaucuaguaugaaa

SEQ ID NO: 3135592 - RNA, 23 nt, Human
acauaucuaguaugaaauuauau

SEQ ID NO: 3135593 - RNA, 22 nt, Human
acauaucuaguaugaaauuaua

SEQ ID NO: 3135594 - RNA, 20 nt, Human
acauaucuaguaugaaauua

SEQ ID NO: 3135595 - RNA, 21 nt, Human
uauuuccauuaaaaaaucagu

SEQ ID NO: 3135596 - RNA, 21 nt, Human
acauaaaaacaacuuuauacc

SEQ ID NO: 3135597 - RNA, 19 nt, Human
acauaaaaacaacuuuaua

SEQ ID NO: 3135598 - RNA, 16 nt, Human
acauaaaaacaacuuu

SEQ ID NO: 3135599 - RNA, 17 nt, Human
ucaaagggugaaaauua

SEQ ID NO: 3135600 - RNA, 23 nt, Human
uauuuuugacagaauauguuuca

SEQ ID NO: 3135601 - RNA, 19 nt, Human
uauuuuugacagaauaugu

SEQ ID NO: 3135602 - RNA, 13 nt, Human
uauuuuugacaga

SEQ ID NO: 3135603 - RNA, 15 nt, Human
uauuuuugacagaau

SEQ ID NO: 3135604 - RNA, 14 nt, Human
uauuuuugacagaa

SEQ ID NO: 3135605 - RNA, 14 nt, Human
ucaaaaugucuaag

SEQ ID NO: 3135606 - RNA, 22 nt, Human
ucacauaucuaguaugaaauua

SEQ ID NO: 3135607 - RNA, 21 nt, Human
ucacauaucuaguaugaaauu

SEQ ID NO: 3135608 - RNA, 17 nt, Human
ucacauaucuaguauga

SEQ ID NO: 3135609 - RNA, 17 nt, Human
ucacuaccuucaugcau

SEQ ID NO: 3135610 - RNA, 14 nt, Human
agugugucuaaauu

SEQ ID NO: 3135611 - RNA, 17 nt, Human
aguguacuuaacuauuc

SEQ ID NO: 3135612 - RNA, 19 nt, Human
uguguuaaguauguguaaa

SEQ ID NO: 3135613 - RNA, 15 nt, Human
uguuaaguaugugua

SEQ ID NO: 3135614 - RNA, 16 nt, Human
uguuaaguauguguaa

SEQ ID NO: 3135615 - RNA, 14 nt, Human
ugugauguauucua

SEQ ID NO: 3135616 - RNA, 18 nt, Human
agucacuaccuucaugca

SEQ ID NO: 3135617 - RNA, 17 nt, Human
uuaauuccaauuauaug

SEQ ID NO: 3135618 - RNA, 14 nt, Human
uguuuauuuauaga

SEQ ID NO: 3135619 - RNA, 24 nt, Human
uguuuauuuauagaguguacuuaa

SEQ ID NO: 3135620 - RNA, 19 nt, Human
uguuuugaaucucauaauu

SEQ ID NO: 3135621 - RNA, 16 nt, Human
uguaaauaguauuuga

SEQ ID NO: 3135622 - RNA, 22 nt, Human
uguauucuagcuaauguaauaa

SEQ ID NO: 3135623 - RNA, 20 nt, Human
uguauucuagcuaauguaau

SEQ ID NO: 3135624 - RNA, 16 nt, Human
aguaguaauagagcaa

SEQ ID NO: 3135625 - RNA, 16 nt, Human
aguacauuuggagaca

SEQ ID NO: 3135626 - RNA, 15 nt, Human
aguaauucaagaaaa

SEQ ID NO: 3135627 - RNA, 14 nt, Human
aguaauagagcaaa

SEQ ID NO: 3135628 - RNA, 17 nt, Human
aggagaguagaacagau

SEQ ID NO: 3135629 - RNA, 15 nt, Human
uggagcaaagcugau

SEQ ID NO: 3135630 - RNA, 15 nt, Human
ugaguucuacauaag

SEQ ID NO: 3135631 - RNA, 20 nt, Human
ugaguucuacauaaguaauu

SEQ ID NO: 3135632 - RNA, 16 nt, Human
ugauaaguaaaugcua

SEQ ID NO: 3135633 - RNA, 19 nt, Human
ugauaaguucauacauugu

SEQ ID NO: 3135634 - RNA, 17 nt, Human
ugauaaguucauacauu

SEQ ID NO: 3135635 - RNA, 15 nt, Human
ugauaaguucauaca

SEQ ID NO: 3135636 - RNA, 13 nt, Human
ugauaaguucaua

SEQ ID NO: 3135637 - RNA, 19 nt, Human
auuugaauguuaagcagau

SEQ ID NO: 3135638 - RNA, 13 nt, Human
auuugaauguuaa

SEQ ID NO: 3135639 - RNA, 18 nt, Human
auuugaauguuaagcaga

SEQ ID NO: 3135640 - RNA, 21 nt, Human
auuuggagacacaacuauuuu

SEQ ID NO: 3135641 - RNA, 19 nt, Human
auugauguguuuauuuaua

SEQ ID NO: 3135642 - RNA, 12 nt, Human
auugauguguuu

SEQ ID NO: 3135643 - RNA, 17 nt, Human
auuguacgaagaguauu

SEQ ID NO: 3135644 - RNA, 21 nt, Human
auucaggagaguagaacagau

SEQ ID NO: 3135645 - RNA, 22 nt, Human
auucaggagaguagaacagaua

SEQ ID NO: 3135646 - RNA, 21 nt, Human
auuauuuuguucauacauauu

SEQ ID NO: 3135647 - RNA, 19 nt, Human
uuuuuguagcacugacaga

SEQ ID NO: 3135648 - RNA, 17 nt, Human
uuuuuguagcacugaca

SEQ ID NO: 3135649 - RNA, 21 nt, Human
uuuuuguagcacugacagauu

SEQ ID NO: 3135650 - RNA, 20 nt, Human
uuuuuguagcacugacagau

SEQ ID NO: 3135651 - RNA, 13 nt, Human
uuuuugacagaau

SEQ ID NO: 3135652 - RNA, 12 nt, Human
uuuuugacagaa

SEQ ID NO: 3135653 - RNA, 12 nt, Human
auguuaagcaga

SEQ ID NO: 3135654 - RNA, 12 nt, Human
auguguuuccau

SEQ ID NO: 3135655 - RNA, 13 nt, Human
uuugagaguucua

SEQ ID NO: 3135656 - RNA, 21 nt, Human
uuugacagaauauguuucaaa

SEQ ID NO: 3135657 - RNA, 20 nt, Human
uuugacagaauauguuucaa

SEQ ID NO: 3135658 - RNA, 19 nt, Human
uuugacagaauauguuuca

SEQ ID NO: 3135659 - RNA, 18 nt, Human
uuugacagaauauguuuc

SEQ ID NO: 3135660 - RNA, 16 nt, Human
uucaaacuuuggaaca

SEQ ID NO: 3135661 - RNA, 22 nt, Human
uucaagaaaacaacuucaauau

SEQ ID NO: 3135662 - RNA, 21 nt, Human
uucacauaucuaguaugaaau

SEQ ID NO: 3135663 - RNA, 20 nt, Human
uucacauaucuaguaugaaa

SEQ ID NO: 3135664 - RNA, 13 nt, Human
uucagaaaauauu

SEQ ID NO: 3135665 - RNA, 14 nt, Human
uucagaaaauauua

SEQ ID NO: 3135666 - RNA, 20 nt, Human
uucagaaaauauuauguguu

SEQ ID NO: 3135667 - RNA, 21 nt, Human
uucagaaaauauuauguguuu

SEQ ID NO: 3135668 - RNA, 17 nt, Human
auauaaguauucuaaau

SEQ ID NO: 3135669 - RNA, 19 nt, Human
auauaaguauucuaaauuu

SEQ ID NO: 3135670 - RNA, 17 nt, Human
auauuguguugugaaug

SEQ ID NO: 3135671 - RNA, 18 nt, Human
auauuguguugugaaugu

SEQ ID NO: 3135672 - RNA, 17 nt, Human
auauguuucaaacuuug

SEQ ID NO: 3135673 - RNA, 20 nt, Human
aucagugugucuaaauuuga

SEQ ID NO: 3135674 - RNA, 19 nt, Human
aucagugugucuaaauuug

SEQ ID NO: 3135675 - RNA, 20 nt, Human
uugauguguuuauuuauaga

SEQ ID NO: 3135676 - RNA, 17 nt, Human
aucugacuaugacauaa

SEQ ID NO: 3135677 - RNA, 14 nt, Human
aucugacuaugaca

SEQ ID NO: 3135678 - RNA, 18 nt, Human
uuggagacacaacuauuu

SEQ ID NO: 3135679 - RNA, 18 nt, Human
uuguucauacauauuuuu

SEQ ID NO: 3135680 - RNA, 16 nt, Human
uuguucauacauauuu

SEQ ID NO: 3135681 - RNA, 20 nt, Human
uuguucaauaauaaauauuu

SEQ ID NO: 3135682 - RNA, 22 nt, Human
uuguucaauaauaaauauuuuu

SEQ ID NO: 3135683 - RNA, 13 nt, Human
uuguucauacaua

SEQ ID NO: 3135684 - RNA, 17 nt, Human
uuguagcuuuaucaaag

SEQ ID NO: 3135685 - RNA, 16 nt, Human
uuguagcuuuaucaaa

SEQ ID NO: 3135686 - RNA, 22 nt, Human
uuucacauaucuaguaugaaau

SEQ ID NO: 3135687 - RNA, 21 nt, Human
auggaaugcuguguuaaauaa

SEQ ID NO: 3135688 - RNA, 17 nt, Human
auggaaugcuguguuaa

SEQ ID NO: 3135689 - RNA, 17 nt, Human
gguguuuuaaaaaaucu

SEQ ID NO: 3135690 - RNA, 14 nt, Human
gcuuuaucaaaggg

SEQ ID NO: 3135691 - RNA, 18 nt, Human
gcagauggaaugcugugu

SEQ ID NO: 3135692 - RNA, 11 nt, Human
gaguucuacau

SEQ ID NO: 3135693 - RNA, 17 nt, Human
gacauaaaaacaacuuu

SEQ ID NO: 3135694 - RNA, 23 nt, Human
gaauucuugaaggaaaaugauac

SEQ ID NO: 3135695 - RNA, 11 nt, Human
cuuaacuauuc

SEQ ID NO: 3135696 - RNA, 18 nt, Human
cuguuuugaaucucauaa

SEQ ID NO: 3135697 - RNA, 15 nt, Human
cuuaugauugcagau

SEQ ID NO: 3135698 - RNA, 15 nt, Human
cucauaauuuauaca

SEQ ID NO: 3135699 - RNA, 13 nt, Human
cucauaauuuaua

SEQ ID NO: 3135700 - RNA, 22 nt, Human
cucauaauuuauacaggucaua

SEQ ID NO: 3135701 - RNA, 20 nt, Human
cugcaauuucauaugcugua

SEQ ID NO: 3135702 - RNA, 18 nt, Human
cugcaauuucauaugcug

SEQ ID NO: 3135703 - RNA, 20 nt, Human
cauuguacgaagaguauuuu

SEQ ID NO: 3135704 - RNA, 16 nt, Human
ccaaaggcucucuccu

SEQ ID NO: 3135705 - RNA, 16 nt, Human
ccagugaauucuugaa

SEQ ID NO: 3135706 - RNA, 20 nt, Human
ccagugaauucuugaaggaa

SEQ ID NO: 3135707 - RNA, 23 nt, Human
uuuggaacaagaugguucuagca

SEQ ID NO: 3135708 - RNA, 13 nt, Human
uuuguucauacau

SEQ ID NO: 3135709 - RNA, 16 nt, Human
uuuguucauacauauu

SEQ ID NO: 3135710 - RNA, 15 nt, Human
uuuucagaaaauauu

SEQ ID NO: 3135711 - RNA, 13 nt, Human
uuuucacauaucu

SEQ ID NO: 3135712 - RNA, 16 nt, Human
uuuucagaaaauauua

SEQ ID NO: 3135713 - RNA, 14 nt, Human
uuuccaaaauaauu

SEQ ID NO: 3135714 - RNA, 15 nt, Human
uuuacauuguaaaua

SEQ ID NO: 3135715 - RNA, 13 nt, Human
uuuacauuguaaa

SEQ ID NO: 3135716 - RNA, 17 nt, Human
uuccuucugugaaagua

SEQ ID NO: 3135717 - RNA, 17 nt, Human
uucaucugacuaugaca

SEQ ID NO: 3135718 - RNA, 21 nt, Human
uuccauccuagucacuaccuu

SEQ ID NO: 3135719 - RNA, 15 nt, Human
uugaaucucauaauu

SEQ ID NO: 3135720 - RNA, 21 nt, Human
uugaaucucauaauuuauaca

SEQ ID NO: 3135721 - RNA, 12 nt, Human
uguuuuaaaaaa

SEQ ID NO: 3135722 - RNA, 20 nt, Human
ugugaaguuuacauuguaaa

SEQ ID NO: 3135723 - RNA, 14 nt, Human
ugugaaguuuacau

SEQ ID NO: 3135724 - RNA, 20 nt, Human
uguaaaaugugaagugaaug

SEQ ID NO: 3135725 - RNA, 22 nt, Human
uguagcacugacagauuuccau

SEQ ID NO: 3135726 - RNA, 17 nt, Human
uguagcacugacagauu

SEQ ID NO: 3135727 - RNA, 16 nt, Human
uguagcacugacagau

SEQ ID NO: 3135728 - RNA, 16 nt, Human
ugcuagguuaauucca

SEQ ID NO: 3135729 - RNA, 23 nt, Human
ugcuagguuaauuccaauuauau

SEQ ID NO: 3135730 - RNA, 22 nt, Human
uaaauaaaccucaaaaugucua

SEQ ID NO: 3135731 - RNA, 13 nt, Human
guuuagcaguaua

SEQ ID NO: 3135732 - RNA, 13 nt, Human
uaauuuuaagaaa

SEQ ID NO: 3135733 - RNA, 23 nt, Human
uaauuaaauuuugaguucuacau

SEQ ID NO: 3135734 - RNA, 19 nt, Human
uaaugauaaguaaaugcua

SEQ ID NO: 3135735 - RNA, 14 nt, Human
uaauauauuuccau

SEQ ID NO: 3135736 - RNA, 19 nt, Human
uaauaaauauuuuugccau

SEQ ID NO: 3135737 - RNA, 15 nt, Human
uaauaacugugaagu

SEQ ID NO: 3135738 - RNA, 18 nt, Human
uauauaaguauucuaaau

SEQ ID NO: 3135739 - RNA, 21 nt, Human
uauaauucagaaggaucuuca

SEQ ID NO: 3135740 - RNA, 16 nt, Human
uauacccagaaaguua

SEQ ID NO: 3135741 - RNA, 23 nt, Human
uacauuuggagacacaacuauuu

SEQ ID NO: 3135742 - RNA, 22 nt, Human
uacgaagaguauuuuugacaga

SEQ ID NO: 3135743 - RNA, 20 nt, Human
uacgaagaguauuuuugaca

SEQ ID NO: 3135744 - RNA, 23 nt, Human
uacgaagaguauuuuugacagaa

SEQ ID NO: 3135745 - RNA, 17 nt, Human
uagaacagauaaucagu

SEQ ID NO: 3135746 - RNA, 21 nt, Human
ucucaaauuuggauugcuaau

SEQ ID NO: 3135747 - RNA, 17 nt, Human
ucuaguaugaaauuaua

SEQ ID NO: 3135748 - RNA, 15 nt, Human
ucuaguaugaaauua

SEQ ID NO: 3135749 - RNA, 13 nt, Human
ucuaaauuugaau

SEQ ID NO: 3135750 - RNA, 17 nt, Human
ucuaaauuugaauguua

SEQ ID NO: 3135751 - RNA, 19 nt, Human
ucuaacaaaaaaauauauu

SEQ ID NO: 3135752 - RNA, 22 nt, Human
ucuaaauuugaauguuaagcag

SEQ ID NO: 3135753 - RNA, 23 nt, Human
ucuaaauuugaauguuaagcaga

SEQ ID NO: 3135754 - RNA, 23 nt, Human
ucuaaauuuuauaucuuguagcu

SEQ ID NO: 3135755 - RNA, 18 nt, Human
ucuaaauuuuauaucuug

SEQ ID NO: 3135756 - RNA, 20 nt, Human
uccuucugugaaaguacauu

SEQ ID NO: 3135757 - RNA, 18 nt, Human
uauuugagaguucuaaau

SEQ ID NO: 3135758 - RNA, 19 nt, Human
uauuugagaguucuaaauu

SEQ ID NO: 3135759 - RNA, 15 nt, Human
uauuugagaguucua

SEQ ID NO: 3135760 - RNA, 16 nt, Human
uauuugagaguucuaa

SEQ ID NO: 3135761 - RNA, 19 nt, Human
ucagaaaauauuauguguu

SEQ ID NO: 3135762 - RNA, 20 nt, Human
ucagaaaauauuauguguuu

SEQ ID NO: 3135763 - RNA, 17 nt, Human
ucagaaaauauuaugug

SEQ ID NO: 3135764 - RNA, 13 nt, Human
ucaguuguacagu

SEQ ID NO: 3135765 - RNA, 16 nt, Human
ucauacauuguacgaa

SEQ ID NO: 3135766 - RNA, 15 nt, Human
ucauacauuguacga

SEQ ID NO: 3135767 - RNA, 13 nt, Human
ucauacauuguac

SEQ ID NO: 3135768 - RNA, 15 nt, Human
ucauaauuuauacag

SEQ ID NO: 3135769 - RNA, 13 nt, Norwalk virus
ggcaucauauuca

SEQ ID NO: 3135770 - RNA, 15 nt, Norwalk virus
accccauugaggugc

SEQ ID NO: 3135771 - RNA, 20 nt, Norwalk virus
gacagcagucgcgacugcug

SEQ ID NO: 3135772 - RNA, 21 nt, Norwalk virus
uuaccacaagaguacauuuca

SEQ ID NO: 3135773 - RNA, 17 nt, Norwalk virus
ucucccaaucaguagua

SEQ ID NO: 3135774 - RNA, 16 nt, Norwalk virus
aggcugcccugcucca

SEQ ID NO: 3135775 - RNA, 18 nt, Norwalk virus
gugagagugucugcuccc

SEQ ID NO: 3135776 - RNA, 16 nt, Norwalk virus
gguggcuucaugucag

SEQ ID NO: 3135777 - RNA, 18 nt, Norwalk virus
guaucggcauuuccccag

SEQ ID NO: 3135778 - RNA, 22 nt, Norwalk virus
auuugaguuuggguccccaucu

SEQ ID NO: 3135779 - RNA, 15 nt, Norwalk virus
gcaagaaaauucuuu

SEQ ID NO: 3135780 - RNA, 15 nt, Norwalk virus
gagguuaaugcuucu

SEQ ID NO: 3135781 - RNA, 17 nt, Norwalk virus
auggcgcuaguggcgcu

SEQ ID NO: 3135782 - RNA, 12 nt, Norwalk virus
aaugauagaaau

SEQ ID NO: 3135783 - RNA, 18 nt, Norwalk virus
ugcuagcugguaaugccu

SEQ ID NO: 3135784 - RNA, 17 nt, Norwalk virus
ucaauacagacagguug

SEQ ID NO: 3135785 - RNA, 14 nt, Norwalk virus
caacucucuuucca

SEQ ID NO: 3135786 - RNA, 22 nt, Norwalk virus
agcgggcauacagguugguggc

SEQ ID NO: 3135787 - RNA, 21 nt, Norwalk virus
auuucccccccaucacacccg

SEQ ID NO: 3135788 - RNA, 15 nt, Norwalk virus
ucccaaucaguagua

SEQ ID NO: 3135789 - RNA, 14 nt, Norwalk virus
ugcucccgaguccu

SEQ ID NO: 3135790 - RNA, 14 nt, Norwalk virus
auccgguggcuuca

SEQ ID NO: 3135791 - RNA, 19 nt, Norwalk virus
ccaaaucugccauugaguu

SEQ ID NO: 3135792 - RNA, 19 nt, Norwalk virus
gagauuuggaaaucuuucu

SEQ ID NO: 3135793 - RNA, 21 nt, Norwalk virus
guaccggagguuaaugcuucu

SEQ ID NO: 3135794 - RNA, 15 nt, Norwalk virus
cccugucuauuacca

SEQ ID NO: 3135795 - RNA, 14 nt, Norwalk virus
cgcuggucaguugg

SEQ ID NO: 3135796 - RNA, 15 nt, Norwalk virus
acaaaauuugcaacu

SEQ ID NO: 3135797 - RNA, 20 nt, Norwalk virus
cgagucacaaaacucaucga

SEQ ID NO: 3135798 - RNA, 18 nt, Norwalk virus
acacucccaaaucugcca

SEQ ID NO: 3135799 - RNA, 20 nt, Norwalk virus
cuacacugucuucugugcca

SEQ ID NO: 3135800 - RNA, 23 nt, Norwalk virus
gcacugguggugguacuggugau

SEQ ID NO: 3135801 - RNA, 14 nt, Norwalk virus
ugaccuuuggaaga

SEQ ID NO: 3135802 - RNA, 16 nt, Norwalk virus
acugucuucugugcca

SEQ ID NO: 3135803 - RNA, 20 nt, Norwalk virus
aacucacgugccccucuccc

SEQ ID NO: 3135804 - RNA, 12 nt, Norwalk virus
cacuuuuguccc

SEQ ID NO: 3135805 - RNA, 17 nt, Norwalk virus
uaccacgcggaggcucu

SEQ ID NO: 3135806 - RNA, 22 nt, Norwalk virus
ugaugcagcaagaucuguggca

SEQ ID NO: 3135807 - RNA, 17 nt, Norwalk virus
aggcugcccugcuccac

SEQ ID NO: 3135808 - RNA, 12 nt, Norwalk virus
gaacaagccccu

SEQ ID NO: 3135809 - RNA, 20 nt, Norwalk virus
cauugaggugccuuuggaag

SEQ ID NO: 3135810 - RNA, 17 nt, Norwalk virus
ccaggcccuucacacuc

SEQ ID NO: 3135811 - RNA, 15 nt, Norwalk virus
uauaauuugcccugu

SEQ ID NO: 3135812 - RNA, 13 nt, Norwalk virus
ugaacaagccccu

SEQ ID NO: 3135813 - RNA, 16 nt, Norwalk virus
caugcuguacaccccc

SEQ ID NO: 3135814 - RNA, 18 nt, Norwalk virus
ccaauggggcuagcucgg

SEQ ID NO: 3135815 - RNA, 16 nt, Norwalk virus
uuuccugcauaccccc

SEQ ID NO: 3135816 - RNA, 18 nt, Norwalk virus
aguuaugacuugccccag

SEQ ID NO: 3135817 - RNA, 19 nt, Norwalk virus
gagcuccagucacccgcau

SEQ ID NO: 3135818 - RNA, 13 nt, Norwalk virus
cucuuuccacaug

SEQ ID NO: 3135819 - RNA, 13 nt, Norwalk virus
acugccagcucgg

SEQ ID NO: 3135820 - RNA, 12 nt, Norwalk virus
ucaaucaucugg

SEQ ID NO: 3135821 - RNA, 19 nt, Norwalk virus
aagcaacucucuuuccaca

SEQ ID NO: 3135822 - RNA, 13 nt, Norwalk virus
ugacuccacccgg

SEQ ID NO: 3135823 - RNA, 16 nt, Norwalk virus
ugagagugucugcucc

SEQ ID NO: 3135824 - RNA, 13 nt, Norwalk virus
ucuuuguuucaug

SEQ ID NO: 3135825 - RNA, 23 nt, Norwalk virus
uugaagcuucaaaucaauuauug

SEQ ID NO: 3135826 - RNA, 15 nt, Norwalk virus
caagagguaggcuug

SEQ ID NO: 3135827 - RNA, 19 nt, Norwalk virus
uggaagauccccaauuaug

SEQ ID NO: 3135828 - RNA, 19 nt, Norwalk virus
aguaauccaaauuauuccc

SEQ ID NO: 3135829 - RNA, 19 nt, Norwalk virus
aacacaucuagccccuucu

SEQ ID NO: 3135830 - RNA, 16 nt, Norwalk virus
gaauuuacuauuuccc

SEQ ID NO: 3135831 - RNA, 23 nt, Norwalk virus
gaaaugugggcaucauauucauu

SEQ ID NO: 3135832 - RNA, 20 nt, Norwalk virus
auuucaauacagacagguug

SEQ ID NO: 3135833 - RNA, 21 nt, Norwalk virus
ucuuaauccuuucuugcucca

SEQ ID NO: 3135834 - RNA, 19 nt, Norwalk virus
ggagcgggcauacagguug

SEQ ID NO: 3135835 - RNA, 24 nt, Norwalk virus
caucaagcguggauggcgcuagug

SEQ ID NO: 3135836 - RNA, 16 nt, Norwalk virus
aaccaggcccuucaca

SEQ ID NO: 3135837 - RNA, 23 nt, Norwalk virus
uacuguaggugaggcugcccugc

SEQ ID NO: 3135838 - RNA, 17 nt, Norwalk virus
guccucugcuaccacau

SEQ ID NO: 3135839 - RNA, 16 nt, Norwalk virus
agcagguucuucgaca

SEQ ID NO: 3135840 - RNA, 12 nt, Norwalk virus
cuugcuagugaa

SEQ ID NO: 3135841 - RNA, 18 nt, Norwalk virus
agucgcgacugcuggaca

SEQ ID NO: 3135842 - RNA, 13 nt, Norwalk virus
gugccuuuggaag

SEQ ID NO: 3135843 - RNA, 15 nt, Norwalk virus
agacagguugccauu

SEQ ID NO: 3135844 - RNA, 13 nt, Norwalk virus
auaugaaaugugg

SEQ ID NO: 3135845 - RNA, 14 nt, Norwalk virus
auccauuucucgaa

SEQ ID NO: 3135846 - RNA, 20 nt, Norwalk virus
cauuuccccagacaaugucc

SEQ ID NO: 3135847 - RNA, 23 nt, Norwalk virus
cauaauuggugcaauugcugcuu

SEQ ID NO: 3135848 - RNA, 23 nt, Norwalk virus
uggcccaagccauaauuggugca

SEQ ID NO: 3135849 - RNA, 14 nt, Norwalk virus
uuuacuauuucccc

SEQ ID NO: 3135850 - RNA, 18 nt, Norwalk virus
ggccgccugguuggcacc

SEQ ID NO: 3135851 - RNA, 16 nt, Norwalk virus
guuggcaccaccccag

SEQ ID NO: 3135852 - RNA, 21 nt, Norwalk virus
agguuuaauuagguuuaauuu

SEQ ID NO: 3135853 - RNA, 19 nt, Norwalk virus
uucuuagcuggauuucccc

SEQ ID NO: 3135854 - RNA, 22 nt, Norwalk virus
uuguaauaugaaaugugggcau

SEQ ID NO: 3135855 - RNA, 23 nt, Norwalk virus
uguuguaauaugaaaugugggca

SEQ ID NO: 3135856 - RNA, 23 nt, Norwalk virus
ucugggagcgggcauacagguug

SEQ ID NO: 3135857 - RNA, 15 nt, Norwalk virus
guggcuucaugucag

SEQ ID NO: 3135858 - RNA, 14 nt, Norwalk virus
cuucacacucccaa

SEQ ID NO: 3135859 - RNA, 18 nt, Norwalk virus
ccaucuaucacaaaugua

SEQ ID NO: 3135860 - RNA, 22 nt, Norwalk virus
cuuuggaagauccccaauuaug

SEQ ID NO: 3135861 - RNA, 20 nt, Norwalk virus
cauuucacaucuugcuagug

SEQ ID NO: 3135862 - RNA, 11 nt, Norwalk virus
ccaguuucauu

SEQ ID NO: 3135863 - RNA, 14 nt, Norwalk virus
uguuaggacucuag

SEQ ID NO: 3135864 - RNA, 19 nt, Norwalk virus
uaguaucggcauuucccca

SEQ ID NO: 3135865 - RNA, 17 nt, Norwalk virus
gcuucaugucaguuccc

SEQ ID NO: 3135866 - RNA, 12 nt, Norwalk virus
acacaucuagcc

SEQ ID NO: 3135867 - RNA, 13 nt, Norwalk virus
ugccuuuggaaga

SEQ ID NO: 3135868 - RNA, 19 nt, Norwalk virus
auaugacacaguuuggcca

SEQ ID NO: 3135869 - RNA, 14 nt, Norwalk virus
caucauauucauuu

SEQ ID NO: 3135870 - RNA, 14 nt, Norwalk virus
cauguugccaagau

SEQ ID NO: 3135871 - RNA, 16 nt, Norwalk virus
ggcaagagguaggcuu

SEQ ID NO: 3135872 - RNA, 20 nt, Norwalk virus
ucuacacugucuucugugcc

SEQ ID NO: 3135873 - RNA, 20 nt, Norwalk virus
gaagauguuaggaauguucu

SEQ ID NO: 3135874 - RNA, 20 nt, Norwalk virus
augcuguacaccccccuccg

SEQ ID NO: 3135875 - RNA, 18 nt, Norwalk virus
caugcgccuugugugcau

SEQ ID NO: 3135876 - RNA, 17 nt, Norwalk virus
acuguaggugaggcugc

SEQ ID NO: 3135877 - RNA, 21 nt, Norwalk virus
cacugguggugguacugguga

SEQ ID NO: 3135878 - RNA, 15 nt, Norwalk virus
cucaauacagugugg

SEQ ID NO: 3135879 - RNA, 19 nt, Norwalk virus
cagucgcgacugcuggaca

SEQ ID NO: 3135880 - RNA, 16 nt, Norwalk virus
gguccacaacagcugc

SEQ ID NO: 3135881 - RNA, 17 nt, Norwalk virus
ucuaucacaaauguaua

SEQ ID NO: 3135882 - RNA, 19 nt, Norwalk virus
caaagcauacccugauggu

SEQ ID NO: 3135883 - RNA, 21 nt, Norwalk virus
uccgcacugguggugguacug

SEQ ID NO: 3135884 - RNA, 20 nt, Norwalk virus
cucugucuaacucacgugcc

SEQ ID NO: 3135885 - RNA, 12 nt, Norwalk virus
cgucuggcuccc

SEQ ID NO: 3135886 - RNA, 14 nt, Norwalk virus
cagguccuggugcu

SEQ ID NO: 3135887 - RNA, 23 nt, Norwalk virus
accucggugguugugauuggcau

SEQ ID NO: 3135888 - RNA, 13 nt, Norwalk virus
auauucauuuaau

SEQ ID NO: 3135889 - RNA, 13 nt, Norwalk virus
uaauccaaauuau

SEQ ID NO: 3135890 - RNA, 11 nt, Norwalk virus
cagacagguug

SEQ ID NO: 3135891 - RNA, 16 nt, Norwalk virus
aacagccucuucuaca

SEQ ID NO: 3135892 - RNA, 19 nt, Norwalk virus
cugccauugaguucucugu

SEQ ID NO: 3135893 - RNA, 21 nt, Norwalk virus
agagugugcaguuccaaaaug

SEQ ID NO: 3135894 - RNA, 13 nt, Norwalk virus
cugucuauuacca

SEQ ID NO: 3135895 - RNA, 20 nt, Norwalk virus
ccaggcccuucacacuccca

SEQ ID NO: 3135896 - RNA, 22 nt, Norwalk virus
ugaagcuucaaaucaauuauug

SEQ ID NO: 3135897 - RNA, 15 nt, Norwalk virus
gacuugccccagucc

SEQ ID NO: 3135898 - RNA, 13 nt, Norwalk virus
uacuauuucccca

SEQ ID NO: 3135899 - RNA, 21 nt, Norwalk virus
ccuggauaauuaauaauuuug

SEQ ID NO: 3135900 - RNA, 14 nt, Norwalk virus
gggcauacagguug

SEQ ID NO: 3135901 - RNA, 19 nt, Norwalk virus
cgcuaguggcgcuggucag

SEQ ID NO: 3135902 - RNA, 17 nt, Norwalk virus
aggaauguucucuuuca

SEQ ID NO: 3135903 - RNA, 14 nt, Norwalk virus
guuugaccagugcu

SEQ ID NO: 3135904 - RNA, 17 nt, Norwalk virus
agggcccugcccccauu

SEQ ID NO: 3135905 - RNA, 17 nt, Norwalk virus
ccauucuagccagaccc

SEQ ID NO: 3135906 - RNA, 17 nt, Norwalk virus
cucccgaguccucugcu

SEQ ID NO: 3135907 - RNA, 18 nt, Norwalk virus
uucccauaccauuugccu

SEQ ID NO: 3135908 - RNA, 21 nt, Norwalk virus
caaagguaucaacaaaauuug

SEQ ID NO: 3135909 - RNA, 15 nt, Norwalk virus
ucccccaucuugguu

SEQ ID NO: 3135910 - RNA, 17 nt, Norwalk virus
aacucacgugccccucu

SEQ ID NO: 3135911 - RNA, 13 nt, Norwalk virus
gguccuggugcuu

SEQ ID NO: 3135912 - RNA, 16 nt, Norwalk virus
aaucaucugguauuag

SEQ ID NO: 3135913 - RNA, 13 nt, Norwalk virus
uacauuucacauc

SEQ ID NO: 3135914 - RNA, 17 nt, Norwalk virus
uaguuuccugcauaccc

SEQ ID NO: 3135915 - RNA, 22 nt, Norwalk virus
acacaguuuggccauucuagcc

SEQ ID NO: 3135916 - RNA, 16 nt, Norwalk virus
uucuucgacagcaguc

SEQ ID NO: 3135917 - RNA, 14 nt, Norwalk virus
acucuggauggccg

SEQ ID NO: 3135918 - RNA, 20 nt, Norwalk virus
auguccagagugugcaguuc

SEQ ID NO: 3135919 - RNA, 20 nt, Norwalk virus
auccuauugaucccuggaua

SEQ ID NO: 3135920 - RNA, 22 nt, Norwalk virus
uaaugcuucugacccucuugca

SEQ ID NO: 3135921 - RNA, 21 nt, Norwalk virus
uuaauuagguuuaauuagguu

SEQ ID NO: 3135922 - RNA, 17 nt, Norwalk virus
agcgggcauacagguug

SEQ ID NO: 3135923 - RNA, 12 nt, Norwalk virus
cagguucaauca

SEQ ID NO: 3135924 - RNA, 17 nt, Norwalk virus
ggguccacaacagcugc

SEQ ID NO: 3135925 - RNA, 14 nt, Norwalk virus
gguucaacagccuc

SEQ ID NO: 3135926 - RNA, 20 nt, Norwalk virus
ugcaugcuguacaccccccu

SEQ ID NO: 3135927 - RNA, 23 nt, Norwalk virus
cacaagaguacauuucacaucuu

SEQ ID NO: 3135928 - RNA, 11 nt, Norwalk virus
auauucauuua

SEQ ID NO: 3135929 - RNA, 15 nt, Norwalk virus
gcccccauuggguuu

SEQ ID NO: 3135930 - RNA, 18 nt, Norwalk virus
auucuagccagacccagu

SEQ ID NO: 3135931 - RNA, 12 nt, Norwalk virus
cuagccccuucu

SEQ ID NO: 3135932 - RNA, 22 nt, Norwalk virus
uccaaauuauuccccuucaucc

SEQ ID NO: 3135933 - RNA, 17 nt, Norwalk virus
caucaagcguggauggc

SEQ ID NO: 3135934 - RNA, 16 nt, Norwalk virus
uggccauucuagccag

SEQ ID NO: 3135935 - RNA, 16 nt, Norwalk virus
gauccgguggcuucau

SEQ ID NO: 3135936 - RNA, 15 nt, Norwalk virus
aggcaaauggcauug

SEQ ID NO: 3135937 - RNA, 21 nt, Norwalk virus
gcugccgaucaauggggucuu

SEQ ID NO: 3135938 - RNA, 19 nt, Norwalk virus
uggauaauuaauaauuuug

SEQ ID NO: 3135939 - RNA, 15 nt, Norwalk virus
ucacgugccccucuc

SEQ ID NO: 3135940 - RNA, 12 nt, Norwalk virus
ucucaauacagu

SEQ ID NO: 3135941 - RNA, 18 nt, Norwalk virus
ucaggauuaugcuagcug

SEQ ID NO: 3135942 - RNA, 19 nt, Norwalk virus
uguaaucaaccuuacugaa

SEQ ID NO: 3135943 - RNA, 14 nt, Norwalk virus
gugaggcugcccug

SEQ ID NO: 3135944 - RNA, 19 nt, Norwalk virus
ccugguuggcaccacccca

SEQ ID NO: 3135945 - RNA, 20 nt, Norwalk virus
auggcgugagagugucugcu

SEQ ID NO: 3135946 - RNA, 19 nt, Norwalk virus
agcuccagucacccgcauu

SEQ ID NO: 3135947 - RNA, 16 nt, Norwalk virus
uaauaauuuugugcaa

SEQ ID NO: 3135948 - RNA, 15 nt, Norwalk virus
gaguuugggucccca

SEQ ID NO: 3135949 - RNA, 18 nt, Norwalk virus
acucaucgagauuuggaa

SEQ ID NO: 3135950 - RNA, 15 nt, Norwalk virus
cugugggaacugcca

SEQ ID NO: 3135951 - RNA, 22 nt, Norwalk virus
auaccacgcggaggcucucaau

SEQ ID NO: 3135952 - RNA, 14 nt, Norwalk virus
gucuauuaccacaa

SEQ ID NO: 3135953 - RNA, 15 nt, Norwalk virus
caaagcauacccuga

SEQ ID NO: 3135954 - RNA, 16 nt, Norwalk virus
uuagcuggauuucccc

SEQ ID NO: 3135955 - RNA, 15 nt, Norwalk virus
acgugccccucuccc

SEQ ID NO: 3135956 - RNA, 13 nt, Norwalk virus
ucaaagcauaccc

SEQ ID NO: 3135957 - RNA, 22 nt, Norwalk virus
accccauugaggugccuuugga

SEQ ID NO: 3135958 - RNA, 16 nt, Norwalk virus
agcaacucucuuucca

SEQ ID NO: 3135959 - RNA, 12 nt, Norwalk virus
ugcuggacaagu

SEQ ID NO: 3135960 - RNA, 23 nt, Norwalk virus
acaaauguauaaugguuggguug

SEQ ID NO: 3135961 - RNA, 15 nt, Norwalk virus
agacccaguaugaug

SEQ ID NO: 3135962 - RNA, 15 nt, Norwalk virus
ggugccuuuggaaga

SEQ ID NO: 3135963 - RNA, 14 nt, Norwalk virus
ugugguugacucca

SEQ ID NO: 3135964 - RNA, 14 nt, Norwalk virus
cacaucuagccccu

SEQ ID NO: 3135965 - RNA, 19 nt, Norwalk virus
caaaucugccauugaguuc

SEQ ID NO: 3135966 - RNA, 13 nt, Norwalk virus
ggcaccaccccag

SEQ ID NO: 3135967 - RNA, 23 nt, Norwalk virus
gccaagauaagagggaccuccaa

SEQ ID NO: 3135968 - RNA, 15 nt, Norwalk virus
ugugcaugcuguaca

SEQ ID NO: 3135969 - RNA, 18 nt, Norwalk virus
aacaaaauuugcaacugc

SEQ ID NO: 3135970 - RNA, 14 nt, Norwalk virus
ccauugaguucucu

SEQ ID NO: 3135971 - RNA, 16 nt, Norwalk virus
aucauauucauuuaau

SEQ ID NO: 3135972 - RNA, 20 nt, Norwalk virus
gugccuuuggaagauguuag

SEQ ID NO: 3135973 - RNA, 22 nt, Norwalk virus
uccacccgguucaacagccucu

SEQ ID NO: 3135974 - RNA, 17 nt, Norwalk virus
ugaggcugcccugcucc

SEQ ID NO: 3135975 - RNA, 18 nt, Norwalk virus
ugcugaugcagcaagauc

SEQ ID NO: 3135976 - RNA, 15 nt, Norwalk virus
ccgucuggcucccaa

SEQ ID NO: 3135977 - RNA, 15 nt, Norwalk virus
gaaaugugggcauca

SEQ ID NO: 3135978 - RNA, 15 nt, Norwalk virus
uccagaccucggugg

SEQ ID NO: 3135979 - RNA, 15 nt, Norwalk virus
uguauaccccccugg

SEQ ID NO: 3135980 - RNA, 18 nt, Norwalk virus
cucaucgagauuuggaaa

SEQ ID NO: 3135981 - RNA, 14 nt, Norwalk virus
gauaauaguuuccu

SEQ ID NO: 3135982 - RNA, 20 nt, Norwalk virus
ugcgccuugugugcaugcug

SEQ ID NO: 3135983 - RNA, 19 nt, Norwalk virus
ucuaagcaaaaacagguuc

SEQ ID NO: 3135984 - RNA, 13 nt, Norwalk virus
ucccccccaucac

SEQ ID NO: 3135985 - RNA, 19 nt, Norwalk virus
uggagcagaaaaccaggcc

SEQ ID NO: 3135986 - RNA, 15 nt, Norwalk virus
acaugugauugcuga

SEQ ID NO: 3135987 - RNA, 15 nt, Norwalk virus
cugucuucugugcca

SEQ ID NO: 3135988 - RNA, 13 nt, Norwalk virus
agucaggauuaug

SEQ ID NO: 3135989 - RNA, 13 nt, Norwalk virus
caugcgccuugug

SEQ ID NO: 3135990 - RNA, 18 nt, Norwalk virus
cccaaguugaccuuugga

SEQ ID NO: 3135991 - RNA, 13 nt, Norwalk virus
gcaguuccaaaau

SEQ ID NO: 3135992 - RNA, 20 nt, Norwalk virus
uccagaccucggugguugug

SEQ ID NO: 3135993 - RNA, 11 nt, Norwalk virus
aucaauuauug

SEQ ID NO: 3135994 - RNA, 13 nt, Norwalk virus
caucuuaauccuu

SEQ ID NO: 3135995 - RNA, 14 nt, Norwalk virus
agggcccugccccc

SEQ ID NO: 3135996 - RNA, 18 nt, Norwalk virus
caggcccuucacacuccc

SEQ ID NO: 3135997 - RNA, 18 nt, Norwalk virus
accccaguuucauuguca

SEQ ID NO: 3135998 - RNA, 15 nt, Norwalk virus
ucuaagcaaaaacag

SEQ ID NO: 3135999 - RNA, 13 nt, Norwalk virus
uaaugcuucugac

SEQ ID NO: 3136000 - RNA, 15 nt, Norwalk virus
uggcaggagcuccag

SEQ ID NO: 3136001 - RNA, 15 nt, Norwalk virus
ugccgaucaaugggg

SEQ ID NO: 3136002 - RNA, 21 nt, Norwalk virus
ucacacccgucuggcucccaa

SEQ ID NO: 3136003 - RNA, 18 nt, Norwalk virus
gggaacugccagcucggc

SEQ ID NO: 3136004 - RNA, 15 nt, Norwalk virus
uucauaauaaugaua

SEQ ID NO: 3136005 - RNA, 14 nt, Norwalk virus
gcugcccugcucca

SEQ ID NO: 3136006 - RNA, 22 nt, Norwalk virus
uacaccccccuccgcacuggug

SEQ ID NO: 3136007 - RNA, 21 nt, Norwalk virus
cucaucgagauuuggaaaucu

SEQ ID NO: 3136008 - RNA, 19 nt, Norwalk virus
gaauuuacuauuuccccaa

SEQ ID NO: 3136009 - RNA, 15 nt, Norwalk virus
aggugaggcugcccu

SEQ ID NO: 3136010 - RNA, 15 nt, Norwalk virus
cuucuguauaccccc

SEQ ID NO: 3136011 - RNA, 13 nt, Norwalk virus
uuacuauuucccc

SEQ ID NO: 3136012 - RNA, 20 nt, Norwalk virus
ggcgcuaguggcgcugguca

SEQ ID NO: 3136013 - RNA, 22 nt, Norwalk virus
gucgcgacugcuggacaaguua

SEQ ID NO: 3136014 - RNA, 19 nt, Norwalk virus
uacagugugguugacucca

SEQ ID NO: 3136015 - RNA, 23 nt, Norwalk virus
gugcuggggguuugaccagugcu

SEQ ID NO: 3136016 - RNA, 13 nt, Norwalk virus
uccgcacuggugg

SEQ ID NO: 3136017 - RNA, 14 nt, Norwalk virus
ggcaggagcuccag

SEQ ID NO: 3136018 - RNA, 15 nt, Norwalk virus
ccagagugugcaguu

SEQ ID NO: 3136019 - RNA, 23 nt, Norwalk virus
agcaacucucuuuccacauguga

SEQ ID NO: 3136020 - RNA, 17 nt, Norwalk virus
cagcagguagugcucug

SEQ ID NO: 3136021 - RNA, 12 nt, Norwalk virus
auggcacacccu

SEQ ID NO: 3136022 - RNA, 20 nt, Norwalk virus
caggcccuucacacucccaa

SEQ ID NO: 3136023 - RNA, 18 nt, Norwalk virus
uuguaauaugaaaugugg

SEQ ID NO: 3136024 - RNA, 15 nt, Norwalk virus
uaucggcauuucccc

SEQ ID NO: 3136025 - RNA, 14 nt, Norwalk virus
cugaauuggauggc

SEQ ID NO: 3136026 - RNA, 22 nt, Norwalk virus
cugacacuuuugucccccaucu

SEQ ID NO: 3136027 - RNA, 20 nt, Norwalk virus
uaugacuugccccaguccug

SEQ ID NO: 3136028 - RNA, 16 nt, Norwalk virus
cugguuggcaccaccc

SEQ ID NO: 3136029 - RNA, 13 nt, Norwalk virus
uaucaauaugaca

SEQ ID NO: 3136030 - RNA, 20 nt, Norwalk virus
aaaugugggcaucauauuca

SEQ ID NO: 3136031 - RNA, 23 nt, Norwalk virus
gcccccauuggguuuccagaccu

SEQ ID NO: 3136032 - RNA, 19 nt, Norwalk virus
uucacauaaucuuacuaua

SEQ ID NO: 3136033 - RNA, 18 nt, Norwalk virus
uaguaucggcauuucccc

SEQ ID NO: 3136034 - RNA, 16 nt, Norwalk virus
cauuguagauuggaau

SEQ ID NO: 3136035 - RNA, 20 nt, Norwalk virus
aagccugugggaacugccag

SEQ ID NO: 3136036 - RNA, 14 nt, Norwalk virus
aagcuucaaaucaa

SEQ ID NO: 3136037 - RNA, 18 nt, Norwalk virus
caguuucauugucacaug

SEQ ID NO: 3136038 - RNA, 20 nt, Norwalk virus
gucugcucccgaguccucug

SEQ ID NO: 3136039 - RNA, 14 nt, Norwalk virus
gucgcgacugcugg

SEQ ID NO: 3136040 - RNA, 15 nt, Norwalk virus
cgugccccucuccca

SEQ ID NO: 3136041 - RNA, 17 nt, Norwalk virus
uguggcaggagcuccag

SEQ ID NO: 3136042 - RNA, 17 nt, Norwalk virus
ggcccuucacacuccca

SEQ ID NO: 3136043 - RNA, 14 nt, Norwalk virus
cuuucuugcuccau

SEQ ID NO: 3136044 - RNA, 13 nt, Norwalk virus
ggguaucagguug

SEQ ID NO: 3136045 - RNA, 13 nt, Norwalk virus
ggaaaucuuucuc

SEQ ID NO: 3136046 - RNA, 13 nt, Norwalk virus
ccgcacugguggu

SEQ ID NO: 3136047 - RNA, 18 nt, Norwalk virus
uaguaauccaaauuauuc

SEQ ID NO: 3136048 - RNA, 19 nt, Norwalk virus
cuuggggaauucaaagcau

SEQ ID NO: 3136049 - RNA, 17 nt, Norwalk virus
gacacuuuuguccccca

SEQ ID NO: 3136050 - RNA, 13 nt, Norwalk virus
uccacaacagcug

SEQ ID NO: 3136051 - RNA, 21 nt, Norwalk virus
cucggguccacaacagcugcc

SEQ ID NO: 3136052 - RNA, 13 nt, Norwalk virus
gaaaugugggcau

SEQ ID NO: 3136053 - RNA, 22 nt, Norwalk virus
aaucuuggggaauucaaagcau

SEQ ID NO: 3136054 - RNA, 20 nt, Norwalk virus
ugccacgugguuauuucaau

SEQ ID NO: 3136055 - RNA, 16 nt, Norwalk virus
agugugguugacucca

SEQ ID NO: 3136056 - RNA, 17 nt, Norwalk virus
acugucuucugugccac

SEQ ID NO: 3136057 - RNA, 23 nt, Norwalk virus
acaagcaacucucuuuccacaug

SEQ ID NO: 3136058 - RNA, 14 nt, Norwalk virus
ggugcaauugcugc

SEQ ID NO: 3136059 - RNA, 14 nt, Norwalk virus
guuuuuagucccuc

SEQ ID NO: 3136060 - RNA, 16 nt, Norwalk virus
aguccucugcuaccac

SEQ ID NO: 3136061 - RNA, 13 nt, Norwalk virus
agggaaaugauug

SEQ ID NO: 3136062 - RNA, 22 nt, Norwalk virus
uguacucuggauggccgccugg

SEQ ID NO: 3136063 - RNA, 15 nt, Norwalk virus
caucugguauuagua

SEQ ID NO: 3136064 - RNA, 15 nt, Norwalk virus
ccagauuuuaucaau

SEQ ID NO: 3136065 - RNA, 12 nt, Norwalk virus
caucuaucacaa

SEQ ID NO: 3136066 - RNA, 12 nt, Norwalk virus
auuggauggcac

SEQ ID NO: 3136067 - RNA, 15 nt, Norwalk virus
guugaccuuuggaag

SEQ ID NO: 3136068 - RNA, 23 nt, Norwalk virus
gguauuggucuuuuucaugucaa

SEQ ID NO: 3136069 - RNA, 11 nt, Norwalk virus
acucuggaugg

SEQ ID NO: 3136070 - RNA, 19 nt, Norwalk virus
agccucuucuacacugucu

SEQ ID NO: 3136071 - RNA, 19 nt, Norwalk virus
ugcauacccccugguuuug

SEQ ID NO: 3136072 - RNA, 15 nt, Norwalk virus
acgcggaggcucuca

SEQ ID NO: 3136073 - RNA, 13 nt, Norwalk virus
ccuucacacuccc

SEQ ID NO: 3136074 - RNA, 14 nt, Norwalk virus
cugcccugcuccac

SEQ ID NO: 3136075 - RNA, 20 nt, Norwalk virus
uuggguccccaucuuaaucc

SEQ ID NO: 3136076 - RNA, 20 nt, Norwalk virus
cccaguuucauugucacaug

SEQ ID NO: 3136077 - RNA, 19 nt, Norwalk virus
uuuaauuagguuuaauuug

SEQ ID NO: 3136078 - RNA, 19 nt, Norwalk virus
ucacacccgucuggcuccc

SEQ ID NO: 3136079 - RNA, 20 nt, Norwalk virus
uuuccccaaauaauaccccc

SEQ ID NO: 3136080 - RNA, 19 nt, Norwalk virus
acaugugauugcugauguu

SEQ ID NO: 3136081 - RNA, 22 nt, Norwalk virus
cacugguggugguacuggugau

SEQ ID NO: 3136082 - RNA, 20 nt, Norwalk virus
gacaaguuaauccuauugau

SEQ ID NO: 3136083 - RNA, 18 nt, Norwalk virus
gcaacacaucuagccccu

SEQ ID NO: 3136084 - RNA, 19 nt, Norwalk virus
cacagcagguagugcucug

SEQ ID NO: 3136085 - RNA, 16 nt, Norwalk virus
gcggcccuccaaagcc

SEQ ID NO: 3136086 - RNA, 18 nt, Norwalk virus
cgguguacucuggauggc

SEQ ID NO: 3136087 - RNA, 20 nt, Norwalk virus
cucacgugccccucucccaa

SEQ ID NO: 3136088 - RNA, 16 nt, Norwalk virus
cagcaagaucuguggc

SEQ ID NO: 3136089 - RNA, 17 nt, Norwalk virus
auuuaauuagguuuaau

SEQ ID NO: 3136090 - RNA, 14 nt, Norwalk virus
accacauugagauc

SEQ ID NO: 3136091 - RNA, 17 nt, Norwalk virus
gcuuauaauuugcccug

SEQ ID NO: 3136092 - RNA, 12 nt, Norwalk virus
ccaauggcacug

SEQ ID NO: 3136093 - RNA, 15 nt, Norwalk virus
ugugguugacuccac

SEQ ID NO: 3136094 - RNA, 21 nt, Norwalk virus
caguucccauaccauuugccu

SEQ ID NO: 3136095 - RNA, 17 nt, Norwalk virus
cagucgcgacugcugga

SEQ ID NO: 3136096 - RNA, 18 nt, Norwalk virus
gcaauugcugcuuccaca

SEQ ID NO: 3136097 - RNA, 17 nt, Norwalk virus
uaagcaaaaacagguuc

SEQ ID NO: 3136098 - RNA, 20 nt, Norwalk virus
ucaaucaucugguauuagua

SEQ ID NO: 3136099 - RNA, 17 nt, Norwalk virus
aagguaucaacaaaauu

SEQ ID NO: 3136100 - RNA, 18 nt, Norwalk virus
cugguuuugguucacaua

SEQ ID NO: 3136101 - RNA, 12 nt, Norwalk virus
ugccccaguccu

SEQ ID NO: 3136102 - RNA, 21 nt, Norwalk virus
agcuggauuucccccccauca

SEQ ID NO: 3136103 - RNA, 22 nt, Norwalk virus
uuucacaucuugcuagugaaca

SEQ ID NO: 3136104 - RNA, 20 nt, Norwalk virus
ucugcgccgauaauggccca

SEQ ID NO: 3136105 - RNA, 17 nt, Norwalk virus
aggacucuagaccccau

SEQ ID NO: 3136106 - RNA, 12 nt, Norwalk virus
ugcaagcccccc

SEQ ID NO: 3136107 - RNA, 22 nt, Norwalk virus
ccauuggguuuccagaccucgg

SEQ ID NO: 3136108 - RNA, 13 nt, Norwalk virus
ugggucaaguauu

SEQ ID NO: 3136109 - RNA, 18 nt, Norwalk virus
ggcaggagcuccagucac

SEQ ID NO: 3136110 - RNA, 13 nt, Norwalk virus
aauuggauggcac

SEQ ID NO: 3136111 - RNA, 20 nt, Norwalk virus
caacagccucuucuacacug

SEQ ID NO: 3136112 - RNA, 14 nt, Norwalk virus
cuccgcacuggugg

SEQ ID NO: 3136113 - RNA, 15 nt, Norwalk virus
guaucagguugaagc

SEQ ID NO: 3136114 - RNA, 15 nt, Norwalk virus
accagugcugaugca

SEQ ID NO: 3136115 - RNA, 18 nt, Norwalk virus
cagguagugcucugggag

SEQ ID NO: 3136116 - RNA, 16 nt, Norwalk virus
ugugauuggcauauca

SEQ ID NO: 3136117 - RNA, 17 nt, Norwalk virus
ugaauuuacuauuuccc

SEQ ID NO: 3136118 - RNA, 18 nt, Norwalk virus
caaguugaccuuuggaag

SEQ ID NO: 3136119 - RNA, 14 nt, Norwalk virus
caaguuaauccuau

SEQ ID NO: 3136120 - RNA, 18 nt, Norwalk virus
aauuggugcaauugcugc

SEQ ID NO: 3136121 - RNA, 13 nt, Norwalk virus
caucuagccccuu

SEQ ID NO: 3136122 - RNA, 14 nt, Norwalk virus
ucgagauuuggaaa

SEQ ID NO: 3136123 - RNA, 22 nt, Norwalk virus
aguaguaucggcauuuccccag

SEQ ID NO: 3136124 - RNA, 14 nt, Norwalk virus
aagauguuaggaau

SEQ ID NO: 3136125 - RNA, 14 nt, Norwalk virus
ccaccccaguuuca

SEQ ID NO: 3136126 - RNA, 23 nt, Norwalk virus
ccuacgguggagcagaaaaccag

SEQ ID NO: 3136127 - RNA, 18 nt, Norwalk virus
ugccagguccuggugcuu

SEQ ID NO: 3136128 - RNA, 15 nt, Norwalk virus
uaauuugcccugucu

SEQ ID NO: 3136129 - RNA, 19 nt, Norwalk virus
uucuuguuuuuagucccuc

SEQ ID NO: 3136130 - RNA, 23 nt, Norwalk virus
uaaacaugacagggaaaugauug

SEQ ID NO: 3136131 - RNA, 15 nt, Norwalk virus
cacgugccccucucc

SEQ ID NO: 3136132 - RNA, 14 nt, Norwalk virus
caauuaaagccugu

SEQ ID NO: 3136133 - RNA, 18 nt, Norwalk virus
accuccaauggcacugua

SEQ ID NO: 3136134 - RNA, 20 nt, Norwalk virus
agguuaaugcuucugacccu

SEQ ID NO: 3136135 - RNA, 16 nt, Norwalk virus
cgugccccucucccaa

SEQ ID NO: 3136136 - RNA, 19 nt, Norwalk virus
agggaccuccaauggcacu

SEQ ID NO: 3136137 - RNA, 19 nt, Norwalk virus
auuuggaaaucuuucucca

SEQ ID NO: 3136138 - RNA, 16 nt, Norwalk virus
accacuaguugggucg

SEQ ID NO: 3136139 - RNA, 15 nt, Norwalk virus
auuuaauuagguuua

SEQ ID NO: 3136140 - RNA, 20 nt, Norwalk virus
ugaguuuggguccccaucuu

SEQ ID NO: 3136141 - RNA, 18 nt, Norwalk virus
ugguuauuucaauacaga

SEQ ID NO: 3136142 - RNA, 17 nt, Norwalk virus
cuaaaaauuuggcaacu

SEQ ID NO: 3136143 - RNA, 20 nt, Norwalk virus
uaugacacaguuuggccauu

SEQ ID NO: 3136144 - RNA, 13 nt, Norwalk virus
cugguuggcacca

SEQ ID NO: 3136145 - RNA, 23 nt, Norwalk virus
cugaugcagcaagaucuguggca

SEQ ID NO: 3136146 - RNA, 16 nt, Norwalk virus
ugggaacugccagcuc

SEQ ID NO: 3136147 - RNA, 19 nt, Norwalk virus
cacaucuagccccuucugu

SEQ ID NO: 3136148 - RNA, 20 nt, Norwalk virus
ggauccuguagcagguucuu

SEQ ID NO: 3136149 - RNA, 19 nt, Norwalk virus
cagguugccauuauucgca

SEQ ID NO: 3136150 - RNA, 22 nt, Norwalk virus
gguuuccucacuugugucccca

SEQ ID NO: 3136151 - RNA, 17 nt, Norwalk virus
cggaggcaacacaucua

SEQ ID NO: 3136152 - RNA, 16 nt, Norwalk virus
acccgucuggcuccca

SEQ ID NO: 3136153 - RNA, 17 nt, Norwalk virus
ugcuuccacagcaggua

SEQ ID NO: 3136154 - RNA, 21 nt, Norwalk virus
cuccacccgguucaacagccu

SEQ ID NO: 3136155 - RNA, 19 nt, Norwalk virus
uaauccuuucuugcuccau

SEQ ID NO: 3136156 - RNA, 14 nt, Norwalk virus
ucuugguucaauuc

SEQ ID NO: 3136157 - RNA, 19 nt, Norwalk virus
uccacagcagguagugcuc

SEQ ID NO: 3136158 - RNA, 17 nt, Norwalk virus
auguuguaauaugaaau

SEQ ID NO: 3136159 - RNA, 15 nt, Norwalk virus
gguccacaacagcug

SEQ ID NO: 3136160 - RNA, 12 nt, Norwalk virus
cuccauaccacg

SEQ ID NO: 3136161 - RNA, 14 nt, Norwalk virus
ggauggcacacccu

SEQ ID NO: 3136162 - RNA, 14 nt, Norwalk virus
ccuucacacuccca

SEQ ID NO: 3136163 - RNA, 17 nt, Norwalk virus
cacccuuuugagggccc

SEQ ID NO: 3136164 - RNA, 21 nt, Norwalk virus
cugugggaacugccagcucgg

SEQ ID NO: 3136165 - RNA, 14 nt, Norwalk virus
ccccaucacacccg

SEQ ID NO: 3136166 - RNA, 16 nt, Norwalk virus
auuuaauuagguuuaa

SEQ ID NO: 3136167 - RNA, 16 nt, Norwalk virus
ggacucuagaccccau

SEQ ID NO: 3136168 - RNA, 21 nt, Norwalk virus
cgaucaauggggucuuugucu

SEQ ID NO: 3136169 - RNA, 15 nt, Norwalk virus
cggcccuccaaagcc

SEQ ID NO: 3136170 - RNA, 18 nt, Norwalk virus
aauucaggcaaauggcau

SEQ ID NO: 3136171 - RNA, 19 nt, Norwalk virus
ugcuggggguuugaccagu

SEQ ID NO: 3136172 - RNA, 23 nt, Norwalk virus
ucuugcuagugaacaagccccua

SEQ ID NO: 3136173 - RNA, 13 nt, Norwalk virus
agacaccaccccu

SEQ ID NO: 3136174 - RNA, 19 nt, Norwalk virus
caguaguaucggcauuucc

SEQ ID NO: 3136175 - RNA, 15 nt, Norwalk virus
cacgcggaggcucuc

SEQ ID NO: 3136176 - RNA, 19 nt, Norwalk virus
uugagauccgguggcuuca

SEQ ID NO: 3136177 - RNA, 21 nt, Norwalk virus
ccucuaagcaaaaacagguuc

SEQ ID NO: 3136178 - RNA, 22 nt, Norwalk virus
agccccuucuguauaccccccu

SEQ ID NO: 3136179 - RNA, 15 nt, Norwalk virus
ccccaguuucauugu

SEQ ID NO: 3136180 - RNA, 15 nt, Norwalk virus
uaauccaaauuauuc

SEQ ID NO: 3136181 - RNA, 14 nt, Norwalk virus
uugaggugccuuug

SEQ ID NO: 3136182 - RNA, 20 nt, Norwalk virus
uaauccuauugaucccugga

SEQ ID NO: 3136183 - RNA, 20 nt, Norwalk virus
auaauuuugugcaagccccc

SEQ ID NO: 3136184 - RNA, 20 nt, Norwalk virus
cgggcauacagguugguggc

SEQ ID NO: 3136185 - RNA, 21 nt, Norwalk virus
ucuggauggccgccugguugg

SEQ ID NO: 3136186 - RNA, 15 nt, Norwalk virus
cgcggaggcucucaa

SEQ ID NO: 3136187 - RNA, 19 nt, Norwalk virus
auuggcagugguaauuaug

SEQ ID NO: 3136188 - RNA, 18 nt, Norwalk virus
uaauuagguuuaauuuga

SEQ ID NO: 3136189 - RNA, 17 nt, Norwalk virus
gugauugcugauguuag

SEQ ID NO: 3136190 - RNA, 21 nt, Norwalk virus
cacccuuuugagggcccugcc

SEQ ID NO: 3136191 - RNA, 20 nt, Norwalk virus
uguaggugaggcugcccugc

SEQ ID NO: 3136192 - RNA, 17 nt, Norwalk virus
caagauaagagggaccu

SEQ ID NO: 3136193 - RNA, 11 nt, Norwalk virus
cgucuggcucc

SEQ ID NO: 3136194 - RNA, 18 nt, Norwalk virus
ggcuucaugucaguuccc

SEQ ID NO: 3136195 - RNA, 19 nt, Norwalk virus
ugucuucugugccacgugg

SEQ ID NO: 3136196 - RNA, 22 nt, Norwalk virus
ugcgccgauaauggcccaagcc

SEQ ID NO: 3136197 - RNA, 16 nt, Norwalk virus
ccugauuuuaauuucu

SEQ ID NO: 3136198 - RNA, 19 nt, Norwalk virus
ccauuggguuuccagaccu

SEQ ID NO: 3136199 - RNA, 17 nt, Norwalk virus
uggcagugguaauuaug

SEQ ID NO: 3136200 - RNA, 16 nt, Norwalk virus
uguguccccaaugggg

SEQ ID NO: 3136201 - RNA, 13 nt, Norwalk virus
cgaguuaugacuu

SEQ ID NO: 3136202 - RNA, 17 nt, Norwalk virus
ugcuuauaauuugcccu

SEQ ID NO: 3136203 - RNA, 22 nt, Norwalk virus
aacagccucuucuacacugucu

SEQ ID NO: 3136204 - RNA, 21 nt, Norwalk virus
augaaaugugggcaucauauu

SEQ ID NO: 3136205 - RNA, 21 nt, Norwalk virus
agccagacccaguaugaugua

SEQ ID NO: 3136206 - RNA, 15 nt, Norwalk virus
uacacugucuucugu

SEQ ID NO: 3136207 - RNA, 12 nt, Norwalk virus
cagagugugcag

SEQ ID NO: 3136208 - RNA, 20 nt, Norwalk virus
cacaagaguacauuucacau

SEQ ID NO: 3136209 - RNA, 18 nt, Norwalk virus
ccccaaggugaauuuacu

SEQ ID NO: 3136210 - RNA, 18 nt, Norwalk virus
acugccagcucggcaaga

SEQ ID NO: 3136211 - RNA, 23 nt, Norwalk virus
ucauauucauuuaauuagguuua

SEQ ID NO: 3136212 - RNA, 19 nt, Norwalk virus
ccccaguccugauuuuaau

SEQ ID NO: 3136213 - RNA, 21 nt, Norwalk virus
cuccauaccacgcggaggcuc

SEQ ID NO: 3136214 - RNA, 17 nt, Norwalk virus
uccgguggcuucauguc

SEQ ID NO: 3136215 - RNA, 20 nt, Norwalk virus
ccaugcgccuugugugcaug

SEQ ID NO: 3136216 - RNA, 17 nt, Norwalk virus
uuuaauuagguuuaauu

SEQ ID NO: 3136217 - RNA, 17 nt, Norwalk virus
acacugucuucugugcc

SEQ ID NO: 3136218 - RNA, 15 nt, Norwalk virus
gggcccugcccccau

SEQ ID NO: 3136219 - RNA, 16 nt, Norwalk virus
cuucugugccacgugg

SEQ ID NO: 3136220 - RNA, 23 nt, Norwalk virus
cuccaaagccaaagguaucaaca

SEQ ID NO: 3136221 - RNA, 13 nt, Norwalk virus
acaccccccuccg

SEQ ID NO: 3136222 - RNA, 19 nt, Norwalk virus
cuuuugucccccaucuugg

SEQ ID NO: 3136223 - RNA, 19 nt, Norwalk virus
cacuuuugucccccaucuu

SEQ ID NO: 3136224 - RNA, 19 nt, Norwalk virus
gaaaucuuucuccauacca

SEQ ID NO: 3136225 - RNA, 22 nt, Norwalk virus
caggcaaauggcauuggcagug

SEQ ID NO: 3136226 - RNA, 12 nt, Norwalk virus
uuucaauacaga

SEQ ID NO: 3136227 - RNA, 16 nt, Norwalk virus
uccuccgugcuggggg

SEQ ID NO: 3136228 - RNA, 19 nt, Norwalk virus
uggcacacccuuucacccu

SEQ ID NO: 3136229 - RNA, 16 nt, Norwalk virus
guugaccuuuggaaga

SEQ ID NO: 3136230 - RNA, 15 nt, Norwalk virus
uuucacaucuugcua

SEQ ID NO: 3136231 - RNA, 15 nt, Norwalk virus
cuauagcacaagcaa

SEQ ID NO: 3136232 - RNA, 14 nt, Norwalk virus
uugugcaagccccc

SEQ ID NO: 3136233 - RNA, 20 nt, Norwalk virus
auuaguaauccaaauuauuc

SEQ ID NO: 3136234 - RNA, 19 nt, Norwalk virus
uacacugucuucugugcca

SEQ ID NO: 3136235 - RNA, 21 nt, Norwalk virus
uucaauacagacagguugcca

SEQ ID NO: 3136236 - RNA, 20 nt, Norwalk virus
uucauugucacauguugcca

SEQ ID NO: 3136237 - RNA, 20 nt, Norwalk virus
gcacuguaaucaaccuuacu

SEQ ID NO: 3136238 - RNA, 13 nt, Human
cucucacucccca

SEQ ID NO: 3136239 - RNA, 21 nt, Human
cucucacuccccagccugggc

SEQ ID NO: 3136240 - RNA, 22 nt, Human
cucucacuccccagccugggcc

SEQ ID NO: 3136241 - RNA, 23 nt, Human
cucucacuccccagccugggccc

SEQ ID NO: 3136242 - RNA, 12 nt, Human
cuccguggagga

SEQ ID NO: 3136243 - RNA, 13 nt, Human
cuccguggaggag

SEQ ID NO: 3136244 - RNA, 17 nt, Human
cuccguggaggagguug

SEQ ID NO: 3136245 - RNA, 18 nt, Human
cuccguggaggagguugg

SEQ ID NO: 3136246 - RNA, 22 nt, Human
cuccguggaggagguugggagg

SEQ ID NO: 3136247 - RNA, 13 nt, Human
cuaaacuuuucug

SEQ ID NO: 3136248 - RNA, 14 nt, Human
cgccgugcugggca

SEQ ID NO: 3136249 - RNA, 15 nt, Human
cgccgugcugggcag

SEQ ID NO: 3136250 - RNA, 16 nt, Human
cgccgugcugggcagc

SEQ ID NO: 3136251 - RNA, 17 nt, Human
cgccgugcugggcagcc

SEQ ID NO: 3136252 - RNA, 19 nt, Human
cgccgugcugggcagcccg

SEQ ID NO: 3136253 - RNA, 20 nt, Human
cgaguggugacaggacgcug

SEQ ID NO: 3136254 - RNA, 13 nt, Human
cgacauugucucc

SEQ ID NO: 3136255 - RNA, 14 nt, Human
cgacauugucuccc

SEQ ID NO: 3136256 - RNA, 15 nt, Human
ccuuuuucauuauuu

SEQ ID NO: 3136257 - RNA, 17 nt, Human
ccuuuuucauuauuuua

SEQ ID NO: 3136258 - RNA, 12 nt, Human
ccuuucccgggc

SEQ ID NO: 3136259 - RNA, 13 nt, Human
ccuuucccgggcu

SEQ ID NO: 3136260 - RNA, 14 nt, Human
ccuuucccgggcug

SEQ ID NO: 3136261 - RNA, 18 nt, Human
ccuuucccgggcugucca

SEQ ID NO: 3136262 - RNA, 22 nt, Human
ccuuucccgggcuguccacuag

SEQ ID NO: 3136263 - RNA, 13 nt, Human
ccccgcuggagga

SEQ ID NO: 3136264 - RNA, 22 nt, Human
ccccgcuggaggaugugggcag

SEQ ID NO: 3136265 - RNA, 23 nt, Human
ccccgcuggaggaugugggcagc

SEQ ID NO: 3136266 - RNA, 13 nt, Human
ccccuuucccggg

SEQ ID NO: 3136267 - RNA, 14 nt, Human
ccccuuucccgggc

SEQ ID NO: 3136268 - RNA, 18 nt, Human
ccccuuucccgggcuguc

SEQ ID NO: 3136269 - RNA, 16 nt, Human
ccagcagauuauucac

SEQ ID NO: 3136270 - RNA, 21 nt, Human
ccagcagauuauucacugauu

SEQ ID NO: 3136271 - RNA, 22 nt, Human
ccagcagauuauucacugauuu

SEQ ID NO: 3136272 - RNA, 15 nt, Human
ccaugucacugcaga

SEQ ID NO: 3136273 - RNA, 13 nt, Human
ccagggcuggaga

SEQ ID NO: 3136274 - RNA, 12 nt, Human
ccucuugucucc

SEQ ID NO: 3136275 - RNA, 13 nt, Human
ccucuugucuccc

SEQ ID NO: 3136276 - RNA, 14 nt, Human
ccucuugucucccc

SEQ ID NO: 3136277 - RNA, 17 nt, Human
ccuggaggcggugcggc

SEQ ID NO: 3136278 - RNA, 20 nt, Human
ccuggaggcggugcggcagg

SEQ ID NO: 3136279 - RNA, 21 nt, Human
ccuggaggcggugcggcaggg

SEQ ID NO: 3136280 - RNA, 18 nt, Human
ccuggaucuaccuggagg

SEQ ID NO: 3136281 - RNA, 19 nt, Human
ccuggaucuaccuggaggg

SEQ ID NO: 3136282 - RNA, 14 nt, Human
ccuggagggaagag

SEQ ID NO: 3136283 - RNA, 21 nt, Human
ccuggagggaagaguggaggu

SEQ ID NO: 3136284 - RNA, 22 nt, Human
ccuggagggaagaguggaggug

SEQ ID NO: 3136285 - RNA, 21 nt, Human
ccuaggauaaaaagccagggc

SEQ ID NO: 3136286 - RNA, 22 nt, Human
cccuggcggccccaacucgggc

SEQ ID NO: 3136287 - RNA, 15 nt, Human
cccuucuugcugccc

SEQ ID NO: 3136288 - RNA, 16 nt, Human
cccuucuugcugcccu

SEQ ID NO: 3136289 - RNA, 20 nt, Human
cccuucuugcugcccugccc

SEQ ID NO: 3136290 - RNA, 22 nt, Human
cccuucuugcugcccugcccca

SEQ ID NO: 3136291 - RNA, 19 nt, Human
ccgccccccacacuucccu

SEQ ID NO: 3136292 - RNA, 20 nt, Human
ccgccccccacacuucccug

SEQ ID NO: 3136293 - RNA, 21 nt, Human
ccgccccccacacuucccugg

SEQ ID NO: 3136294 - RNA, 23 nt, Human
ccgccccccacacuucccuggcg

SEQ ID NO: 3136295 - RNA, 13 nt, Human
auuguaauuauau

SEQ ID NO: 3136296 - RNA, 14 nt, Human
auuguaauuauauc

SEQ ID NO: 3136297 - RNA, 14 nt, Human
auuaugaaacuugu

SEQ ID NO: 3136298 - RNA, 15 nt, Human
auuaugaaacuugug

SEQ ID NO: 3136299 - RNA, 21 nt, Human
auuaugaaacuuguguaaaua

SEQ ID NO: 3136300 - RNA, 18 nt, Human
auuaugaaacuuguguaa

SEQ ID NO: 3136301 - RNA, 20 nt, Human
auuaugaaacuuguguaaau

SEQ ID NO: 3136302 - RNA, 17 nt, Human
auucaaaguugccuaaa

SEQ ID NO: 3136303 - RNA, 18 nt, Human
auucaaaguugccuaaau

SEQ ID NO: 3136304 - RNA, 20 nt, Human
auucaaaguugccuaaaucc

SEQ ID NO: 3136305 - RNA, 21 nt, Human
auucaaaguugccuaaaucca

SEQ ID NO: 3136306 - RNA, 22 nt, Human
auucaaaguugccuaaauccau

SEQ ID NO: 3136307 - RNA, 12 nt, Human
auuacaguauaa

SEQ ID NO: 3136308 - RNA, 14 nt, Human
auuacaguauaauu

SEQ ID NO: 3136309 - RNA, 15 nt, Human
auuacaguauaauua

SEQ ID NO: 3136310 - RNA, 16 nt, Human
auuacaguauaauuaa

SEQ ID NO: 3136311 - RNA, 14 nt, Human
auuuuaugauccag

SEQ ID NO: 3136312 - RNA, 15 nt, Human
auuuuaugauccagc

SEQ ID NO: 3136313 - RNA, 16 nt, Human
auuuuaugauccagca

SEQ ID NO: 3136314 - RNA, 13 nt, Human
auuuggaaaucuu

SEQ ID NO: 3136315 - RNA, 11 nt, Human
auuuggaaauc

SEQ ID NO: 3136316 - RNA, 12 nt, Human
auuuggaaaucu

SEQ ID NO: 3136317 - RNA, 14 nt, Human
caaacccaaaagaa

SEQ ID NO: 3136318 - RNA, 20 nt, Human
ccaaaaaccaguauuguaca

SEQ ID NO: 3136319 - RNA, 16 nt, Human
ccaaaaaccaguauug

SEQ ID NO: 3136320 - RNA, 19 nt, Human
ccaaaaaccaguauuguac

SEQ ID NO: 3136321 - RNA, 14 nt, Human
cauuuuucuuguuu

SEQ ID NO: 3136322 - RNA, 21 nt, Human
cauucuccuaucaccugucuu

SEQ ID NO: 3136323 - RNA, 11 nt, Human
ccacacuuccc

SEQ ID NO: 3136324 - RNA, 13 nt, Human
ccacacuucccug

SEQ ID NO: 3136325 - RNA, 14 nt, Human
ccacacuucccugg

SEQ ID NO: 3136326 - RNA, 15 nt, Human
ccacacuucccuggc

SEQ ID NO: 3136327 - RNA, 16 nt, Human
ccacacuucccuggcg

SEQ ID NO: 3136328 - RNA, 15 nt, Human
ccaaaugcaauguga

SEQ ID NO: 3136329 - RNA, 22 nt, Human
cauggccuuugcuugaaagaaa

SEQ ID NO: 3136330 - RNA, 19 nt, Human
cauggccuuugcuugaaag

SEQ ID NO: 3136331 - RNA, 22 nt, Human
caguauuguacaaaguauuaag

SEQ ID NO: 3136332 - RNA, 16 nt, Human
cagguugaagccaugu

SEQ ID NO: 3136333 - RNA, 18 nt, Human
cagguugaagccaugucu

SEQ ID NO: 3136334 - RNA, 12 nt, Human
cagggcuggaga

SEQ ID NO: 3136335 - RNA, 13 nt, Human
cagggcuggagaa

SEQ ID NO: 3136336 - RNA, 14 nt, Human
cagcuuagggcccu

SEQ ID NO: 3136337 - RNA, 15 nt, Human
cagcuuagggcccug

SEQ ID NO: 3136338 - RNA, 16 nt, Human
cagcuuagggcccugg

SEQ ID NO: 3136339 - RNA, 17 nt, Human
cagcuuagggcccugga

SEQ ID NO: 3136340 - RNA, 18 nt, Human
cagcuuagggcccuggag

SEQ ID NO: 3136341 - RNA, 19 nt, Human
cagcuuagggcccuggagg

SEQ ID NO: 3136342 - RNA, 20 nt, Human
cagcuuagggcccuggaggc

SEQ ID NO: 3136343 - RNA, 18 nt, Human
gcguugaaauuguaauua

SEQ ID NO: 3136344 - RNA, 20 nt, Human
gcggccccaacucgggcucc

SEQ ID NO: 3136345 - RNA, 23 nt, Human
gcguugaaauuguaauuauaucu

SEQ ID NO: 3136346 - RNA, 24 nt, Human
gcguugaaauuguaauuauaucug

SEQ ID NO: 3136347 - RNA, 21 nt, Human
gcccuaggauaaaaagccagg

SEQ ID NO: 3136348 - RNA, 13 nt, Human
gccccaaguuggg

SEQ ID NO: 3136349 - RNA, 16 nt, Human
gccccacaccuccucu

SEQ ID NO: 3136350 - RNA, 16 nt, Human
gccccaacucgggcuc

SEQ ID NO: 3136351 - RNA, 20 nt, Human
gccccaacucgggcucccgg

SEQ ID NO: 3136352 - RNA, 21 nt, Human
gccccaacucgggcucccggg

SEQ ID NO: 3136353 - RNA, 17 nt, Human
gcugguuuuggcaucuc

SEQ ID NO: 3136354 - RNA, 21 nt, Human
gcugguuuuggcaucucuguc

SEQ ID NO: 3136355 - RNA, 16 nt, Human
gcuuuucugauccagu

SEQ ID NO: 3136356 - RNA, 12 nt, Human
gcuuuucugauc

SEQ ID NO: 3136357 - RNA, 15 nt, Human
gcuuuucugauccag

SEQ ID NO: 3136358 - RNA, 11 nt, Human
gcuuuucugau

SEQ ID NO: 3136359 - RNA, 13 nt, Human
ggaacaccuccuc

SEQ ID NO: 3136360 - RNA, 13 nt, Human
ggaaaucuuuaaa

SEQ ID NO: 3136361 - RNA, 20 nt, Human
ggagguggauuccgaguggu

SEQ ID NO: 3136362 - RNA, 18 nt, Human
ggaggggguugggguggu

SEQ ID NO: 3136363 - RNA, 20 nt, Human
ggaggccagcacggugguga

SEQ ID NO: 3136364 - RNA, 17 nt, Human
ggagcuuaagccacugc

SEQ ID NO: 3136365 - RNA, 18 nt, Human
ggagcuuaagccacugcc

SEQ ID NO: 3136366 - RNA, 17 nt, Human
ggcacacaaggggcccu

SEQ ID NO: 3136367 - RNA, 20 nt, Human
ggcacacaaggggcccuugg

SEQ ID NO: 3136368 - RNA, 21 nt, Human
ggcacacaaggggcccuugga

SEQ ID NO: 3136369 - RNA, 15 nt, Human
ggaucugguggucag

SEQ ID NO: 3136370 - RNA, 17 nt, Human
ggauaaaaagccagggc

SEQ ID NO: 3136371 - RNA, 18 nt, Human
ggauaaaaagccagggcu

SEQ ID NO: 3136372 - RNA, 19 nt, Human
ggauaaaaagccagggcug

SEQ ID NO: 3136373 - RNA, 20 nt, Human
ggauaaaaagccagggcugg

SEQ ID NO: 3136374 - RNA, 21 nt, Human
ggauaaaaagccagggcugga

SEQ ID NO: 3136375 - RNA, 12 nt, Human
ggauaaaugcca

SEQ ID NO: 3136376 - RNA, 22 nt, Human
ggauaauaaggaaaaguuuaau

SEQ ID NO: 3136377 - RNA, 19 nt, Human
ggccgacauugucucccgc

SEQ ID NO: 3136378 - RNA, 14 nt, Human
ggcaucucuguccc

SEQ ID NO: 3136379 - RNA, 15 nt, Human
ggcaucucuguccca

SEQ ID NO: 3136380 - RNA, 21 nt, Human
ggcaucucugucccauucccu

SEQ ID NO: 3136381 - RNA, 22 nt, Human
ggcaucucugucccauucccug

SEQ ID NO: 3136382 - RNA, 23 nt, Human
ggcaucucugucccauucccugg

SEQ ID NO: 3136383 - RNA, 14 nt, Human
aaaaauauuuuaug

SEQ ID NO: 3136384 - RNA, 17 nt, Human
gggaagaguggaggugg

SEQ ID NO: 3136385 - RNA, 18 nt, Human
gggaagaguggaggugga

SEQ ID NO: 3136386 - RNA, 16 nt, Human
gggcaaaugccagggc

SEQ ID NO: 3136387 - RNA, 17 nt, Human
gggcaaaugccagggcc

SEQ ID NO: 3136388 - RNA, 18 nt, Human
gggcccuucuugcugccc

SEQ ID NO: 3136389 - RNA, 19 nt, Human
gggcccuucuugcugcccu

SEQ ID NO: 3136390 - RNA, 22 nt, Human
gggcccuucuugcugcccugcc

SEQ ID NO: 3136391 - RNA, 17 nt, Human
gggcccuuggagcgugg

SEQ ID NO: 3136392 - RNA, 20 nt, Human
gggccgacauugucucccgc

SEQ ID NO: 3136393 - RNA, 19 nt, Human
gguggauuccgagugguga

SEQ ID NO: 3136394 - RNA, 16 nt, Human
aaaguugaauuuauug

SEQ ID NO: 3136395 - RNA, 22 nt, Human
aaaguugaauuuauuggcuuuu

SEQ ID NO: 3136396 - RNA, 12 nt, Human
aaaguugaauuu

SEQ ID NO: 3136397 - RNA, 13 nt, Human
aaaguugaauuua

SEQ ID NO: 3136398 - RNA, 14 nt, Human
aaaguuuaauauua

SEQ ID NO: 3136399 - RNA, 16 nt, Human
aaaguuuaauauuaaa

SEQ ID NO: 3136400 - RNA, 19 nt, Human
aaaguuuaauauuaaagcc

SEQ ID NO: 3136401 - RNA, 22 nt, Human
aaaguuuaauauuaaagccaug

SEQ ID NO: 3136402 - RNA, 20 nt, Human
aaaguuuaauauuaaagcca

SEQ ID NO: 3136403 - RNA, 21 nt, Human
aaaguuuaauauuaaagccau

SEQ ID NO: 3136404 - RNA, 15 nt, Human
gacuggugacugauu

SEQ ID NO: 3136405 - RNA, 18 nt, Human
gacuggugacugauucuu

SEQ ID NO: 3136406 - RNA, 12 nt, Human
gacuggugacug

SEQ ID NO: 3136407 - RNA, 13 nt, Human
gaauuuuguguua

SEQ ID NO: 3136408 - RNA, 16 nt, Human
gaauuuuguguuagag

SEQ ID NO: 3136409 - RNA, 22 nt, Human
gaauuuuguguuagagauuuuu

SEQ ID NO: 3136410 - RNA, 12 nt, Human
gaaguggaaugg

SEQ ID NO: 3136411 - RNA, 14 nt, Human
gauuagaauucugu

SEQ ID NO: 3136412 - RNA, 15 nt, Human
gauuagaauucugua

SEQ ID NO: 3136413 - RNA, 23 nt, Human
gauuagaauucuguauagauuag

SEQ ID NO: 3136414 - RNA, 13 nt, Human
gauuauucacuga

SEQ ID NO: 3136415 - RNA, 15 nt, Human
gauuauucacugauu

SEQ ID NO: 3136416 - RNA, 16 nt, Human
gauuauucacugauuu

SEQ ID NO: 3136417 - RNA, 14 nt, Human
gauuagagaguguu

SEQ ID NO: 3136418 - RNA, 18 nt, Human
gauuagagaguguugaaa

SEQ ID NO: 3136419 - RNA, 22 nt, Human
gauccaguuuuguuuggaccaa

SEQ ID NO: 3136420 - RNA, 11 nt, Human
gauccaguuuu

SEQ ID NO: 3136421 - RNA, 17 nt, Human
gauccaguuuuguuugg

SEQ ID NO: 3136422 - RNA, 21 nt, Human
gcauaacauaaaucugugaac

SEQ ID NO: 3136423 - RNA, 23 nt, Human
gcauaacauaaaucugugaacuu

SEQ ID NO: 3136424 - RNA, 15 nt, Human
gcauaacauaaaucu

SEQ ID NO: 3136425 - RNA, 14 nt, Human
gcagguugaagcca

SEQ ID NO: 3136426 - RNA, 16 nt, Human
gcagguugaagccaug

SEQ ID NO: 3136427 - RNA, 17 nt, Human
gcagguugaagccaugu

SEQ ID NO: 3136428 - RNA, 13 nt, Human
gcaccgaccacgg

SEQ ID NO: 3136429 - RNA, 21 nt, Human
gcaccgaccacggggccgaca

SEQ ID NO: 3136430 - RNA, 20 nt, Human
gcacacaaggggcccuugga

SEQ ID NO: 3136431 - RNA, 21 nt, Human
gcacacaaggggcccuuggag

SEQ ID NO: 3136432 - RNA, 14 nt, Human
cuguacuuuuuggc

SEQ ID NO: 3136433 - RNA, 18 nt, Human
cugugaacuugaaauuug

SEQ ID NO: 3136434 - RNA, 18 nt, Human
cuggugacugauucuuca

SEQ ID NO: 3136435 - RNA, 16 nt, Human
cuggggccgaaagaac

SEQ ID NO: 3136436 - RNA, 12 nt, Human
gaaaauuugaau

SEQ ID NO: 3136437 - RNA, 11 nt, Human
cuuuguauaga

SEQ ID NO: 3136438 - RNA, 20 nt, Human
cuuuguauagaaccucuuug

SEQ ID NO: 3136439 - RNA, 23 nt, Human
cuugccuuuuucauuauuuuauu

SEQ ID NO: 3136440 - RNA, 20 nt, Human
cuugccuuuuucauuauuuu

SEQ ID NO: 3136441 - RNA, 22 nt, Human
cuugccuuuuucauuauuuuau

SEQ ID NO: 3136442 - RNA, 14 nt, Human
cuugccuuuuucau

SEQ ID NO: 3136443 - RNA, 15 nt, Human
cuugccuuuuucauu

SEQ ID NO: 3136444 - RNA, 23 nt, Human
auugugcgcuaaacuuuucugau

SEQ ID NO: 3136445 - RNA, 17 nt, Human
auuuggaaaucuuuaaa

SEQ ID NO: 3136446 - RNA, 20 nt, Human
auuuggaaaucuuuaaaaaa

SEQ ID NO: 3136447 - RNA, 18 nt, Human
auuuuauuaugaaacuug

SEQ ID NO: 3136448 - RNA, 21 nt, Human
auuuuauuaugaaacuugugu

SEQ ID NO: 3136449 - RNA, 13 nt, Human
auuuuauuaugaa

SEQ ID NO: 3136450 - RNA, 14 nt, Human
auuuuauuaugaaa

SEQ ID NO: 3136451 - RNA, 11 nt, Human
auuuuauuaug

SEQ ID NO: 3136452 - RNA, 12 nt, Human
auuuuauuauga

SEQ ID NO: 3136453 - RNA, 13 nt, Human
auuuuauuaugua

SEQ ID NO: 3136454 - RNA, 14 nt, Human
auuuuauuauguaa

SEQ ID NO: 3136455 - RNA, 15 nt, Human
auuauuuuauuauga

SEQ ID NO: 3136456 - RNA, 15 nt, Human
auuagagaguguuga

SEQ ID NO: 3136457 - RNA, 16 nt, Human
auuagagaguguugaa

SEQ ID NO: 3136458 - RNA, 17 nt, Human
auuagagaguguugaaa

SEQ ID NO: 3136459 - RNA, 18 nt, Human
auuagagaguguugaaac

SEQ ID NO: 3136460 - RNA, 19 nt, Human
auuagagaguguugaaacg

SEQ ID NO: 3136461 - RNA, 21 nt, Human
auuauuuuauuaugaaacuug

SEQ ID NO: 3136462 - RNA, 22 nt, Human
auuauuuuauuaugaaacuugu

SEQ ID NO: 3136463 - RNA, 14 nt, Human
auucccugggaucu

SEQ ID NO: 3136464 - RNA, 16 nt, Human
auucccugggaucugg

SEQ ID NO: 3136465 - RNA, 19 nt, Human
auuaacauguuaaaccaug

SEQ ID NO: 3136466 - RNA, 13 nt, Human
auuaacauguuaa

SEQ ID NO: 3136467 - RNA, 14 nt, Human
auuaacauguuaaa

SEQ ID NO: 3136468 - RNA, 15 nt, Human
auuaacauguuaaac

SEQ ID NO: 3136469 - RNA, 17 nt, Human
auuaacauguuaaacca

SEQ ID NO: 3136470 - RNA, 11 nt, Human
auuaaagccau

SEQ ID NO: 3136471 - RNA, 12 nt, Human
auuaaagccaug

SEQ ID NO: 3136472 - RNA, 16 nt, Human
auuaaagccauguuua

SEQ ID NO: 3136473 - RNA, 17 nt, Human
auuaaagccauguuuau

SEQ ID NO: 3136474 - RNA, 21 nt, Human
auuaaagccauguuuauuaca

SEQ ID NO: 3136475 - RNA, 21 nt, Human
uuuucauuauuuuauuaugaa

SEQ ID NO: 3136476 - RNA, 15 nt, Human
uuuucauuauuuuau

SEQ ID NO: 3136477 - RNA, 13 nt, Human
uuuuauuauguaa

SEQ ID NO: 3136478 - RNA, 14 nt, Human
uuuuauuauguaaa

SEQ ID NO: 3136479 - RNA, 12 nt, Human
uuuuauuaugua

SEQ ID NO: 3136480 - RNA, 15 nt, Human
uuugucuacaccauu

SEQ ID NO: 3136481 - RNA, 18 nt, Human
uuuguuucuguacuuuuu

SEQ ID NO: 3136482 - RNA, 12 nt, Human
uuuguuucugua

SEQ ID NO: 3136483 - RNA, 13 nt, Human
uuuguuucuguac

SEQ ID NO: 3136484 - RNA, 22 nt, Human
uugccuaaauccauuuggaaau

SEQ ID NO: 3136485 - RNA, 13 nt, Human
uugccuaaaucca

SEQ ID NO: 3136486 - RNA, 14 nt, Human
uugccuaaauccau

SEQ ID NO: 3136487 - RNA, 15 nt, Human
uugccuaaauccauu

SEQ ID NO: 3136488 - RNA, 15 nt, Human
aucugaggaauucug

SEQ ID NO: 3136489 - RNA, 21 nt, Human
aucugaggaauucuguauaga

SEQ ID NO: 3136490 - RNA, 16 nt, Human
aucugaggaauucugu

SEQ ID NO: 3136491 - RNA, 17 nt, Human
aucugaggaauucugua

SEQ ID NO: 3136492 - RNA, 18 nt, Human
aucugaggaauucuguau

SEQ ID NO: 3136493 - RNA, 20 nt, Human
aucugaggaauucuguauag

SEQ ID NO: 3136494 - RNA, 13 nt, Human
aucugugaacuug

SEQ ID NO: 3136495 - RNA, 17 nt, Human
aucugugaacuugaaau

SEQ ID NO: 3136496 - RNA, 18 nt, Human
aucugugaacuugaaauu

SEQ ID NO: 3136497 - RNA, 19 nt, Human
aucugugaacuugaaauuu

SEQ ID NO: 3136498 - RNA, 18 nt, Human
aucugccuaaggacuucu

SEQ ID NO: 3136499 - RNA, 19 nt, Human
aucugccuaaggacuucuu

SEQ ID NO: 3136500 - RNA, 13 nt, Human
aucugccuaagga

SEQ ID NO: 3136501 - RNA, 14 nt, Human
aucugccuaaggac

SEQ ID NO: 3136502 - RNA, 15 nt, Human
aucugccuaaggacu

SEQ ID NO: 3136503 - RNA, 16 nt, Human
aucugccuaaggacuu

SEQ ID NO: 3136504 - RNA, 17 nt, Human
aucugccuaaggacuuc

SEQ ID NO: 3136505 - RNA, 19 nt, Human
uuggauaauaaggaaaagu

SEQ ID NO: 3136506 - RNA, 21 nt, Human
uuggauaauaaggaaaaguuu

SEQ ID NO: 3136507 - RNA, 15 nt, Human
uuggauaauaaggaa

SEQ ID NO: 3136508 - RNA, 13 nt, Human
uuggggauucuua

SEQ ID NO: 3136509 - RNA, 16 nt, Human
uugggggucagugcug

SEQ ID NO: 3136510 - RNA, 19 nt, Human
uugggggucagugcugccu

SEQ ID NO: 3136511 - RNA, 20 nt, Human
uugggggucagugcugccug

SEQ ID NO: 3136512 - RNA, 15 nt, Human
uuggggauucuuaaa

SEQ ID NO: 3136513 - RNA, 15 nt, Human
uuguacaaaguauua

SEQ ID NO: 3136514 - RNA, 17 nt, Human
uuguacaaaguauuaag

SEQ ID NO: 3136515 - RNA, 20 nt, Human
uuguacaaaguauuaagcau

SEQ ID NO: 3136516 - RNA, 21 nt, Human
uuguacaaaguauuaagcaua

SEQ ID NO: 3136517 - RNA, 13 nt, Human
uuguacaaaguau

SEQ ID NO: 3136518 - RNA, 14 nt, Human
uuguacaaaguauu

SEQ ID NO: 3136519 - RNA, 20 nt, Human
auggccuuugcuugaaagaa

SEQ ID NO: 3136520 - RNA, 23 nt, Human
auggaacgcguugaaauuguaau

SEQ ID NO: 3136521 - RNA, 23 nt, Human
uuuauuacaguauaauuaacaug

SEQ ID NO: 3136522 - RNA, 22 nt, Human
augcuguaacuuucugaaauaa

SEQ ID NO: 3136523 - RNA, 21 nt, Human
augcuggcauagagcagcacu

SEQ ID NO: 3136524 - RNA, 14 nt, Human
uuuagucuugucuc

SEQ ID NO: 3136525 - RNA, 22 nt, Human
uuuauuacaguauaauuaacau

SEQ ID NO: 3136526 - RNA, 14 nt, Human
uuuaauuuuggaau

SEQ ID NO: 3136527 - RNA, 15 nt, Human
uuuaauuuuggaauu

SEQ ID NO: 3136528 - RNA, 17 nt, Human
uuuaauuuuggaauuuu

SEQ ID NO: 3136529 - RNA, 10 nt, Human
augcaggugg

SEQ ID NO: 3136530 - RNA, 16 nt, Human
augauuucuaugcuga

SEQ ID NO: 3136531 - RNA, 12 nt, Human
augauuucuaug

SEQ ID NO: 3136532 - RNA, 13 nt, Human
augauuucuaugc

SEQ ID NO: 3136533 - RNA, 19 nt, Human
uuguguaaauacaauuuug

SEQ ID NO: 3136534 - RNA, 17 nt, Human
uucuaaccaagaggcug

SEQ ID NO: 3136535 - RNA, 18 nt, Human
uucuaaccaagaggcugg

SEQ ID NO: 3136536 - RNA, 19 nt, Human
uucuaaccaagaggcuggu

SEQ ID NO: 3136537 - RNA, 18 nt, Human
aucaauaaaaaauuauga

SEQ ID NO: 3136538 - RNA, 15 nt, Human
aucaauaaaaaauua

SEQ ID NO: 3136539 - RNA, 17 nt, Human
aucaauaaaaaauuaug

SEQ ID NO: 3136540 - RNA, 13 nt, Human
aucagacagaucu

SEQ ID NO: 3136541 - RNA, 16 nt, Human
uuccccucuugucucc

SEQ ID NO: 3136542 - RNA, 17 nt, Human
uuccccucuugucuccc

SEQ ID NO: 3136543 - RNA, 18 nt, Human
uuccccucuugucucccc

SEQ ID NO: 3136544 - RNA, 19 nt, Human
uuccccucuugucuccccu

SEQ ID NO: 3136545 - RNA, 12 nt, Human
uuccccucuccc

SEQ ID NO: 3136546 - RNA, 13 nt, Human
uuccccucucccu

SEQ ID NO: 3136547 - RNA, 21 nt, Human
uuccccucucccuucccuccu

SEQ ID NO: 3136548 - RNA, 16 nt, Human
auauuuuuauauuuac

SEQ ID NO: 3136549 - RNA, 17 nt, Human
auauuuucauucuccua

SEQ ID NO: 3136550 - RNA, 13 nt, Human
auauuuucauucu

SEQ ID NO: 3136551 - RNA, 20 nt, Human
auccaguuuuguuuggacca

SEQ ID NO: 3136552 - RNA, 21 nt, Human
auccaguuuuguuuggaccaa

SEQ ID NO: 3136553 - RNA, 18 nt, Human
auccaguuuuguuuggac

SEQ ID NO: 3136554 - RNA, 17 nt, Human
auccaguuuuguuugga

SEQ ID NO: 3136555 - RNA, 13 nt, Human
auccauuuggaaa

SEQ ID NO: 3136556 - RNA, 17 nt, Human
auccauuuggaaaucuu

SEQ ID NO: 3136557 - RNA, 19 nt, Human
auccauuuggaaaucuuua

SEQ ID NO: 3136558 - RNA, 13 nt, Human
uucuguacuuuuu

SEQ ID NO: 3136559 - RNA, 18 nt, Human
uucuguacuuuuuggcau

SEQ ID NO: 3136560 - RNA, 19 nt, Human
uucuguacuuuuuggcaua

SEQ ID NO: 3136561 - RNA, 13 nt, Human
auagucuggcugu

SEQ ID NO: 3136562 - RNA, 14 nt, Human
auaguucugcaggu

SEQ ID NO: 3136563 - RNA, 21 nt, Human
ugauccagcagauuauucacu

SEQ ID NO: 3136564 - RNA, 20 nt, Human
ugauccagcagauuauucac

SEQ ID NO: 3136565 - RNA, 22 nt, Human
ugauccagcagauuauucacug

SEQ ID NO: 3136566 - RNA, 22 nt, Human
ugauccaguuuuguuuggacca

SEQ ID NO: 3136567 - RNA, 14 nt, Human
agccacugccucuc

SEQ ID NO: 3136568 - RNA, 15 nt, Human
agccacugccucucc

SEQ ID NO: 3136569 - RNA, 16 nt, Human
agccacugccucuccc

SEQ ID NO: 3136570 - RNA, 17 nt, Human
agccacugccucucccu

SEQ ID NO: 3136571 - RNA, 18 nt, Human
agccacugccucucccuc

SEQ ID NO: 3136572 - RNA, 20 nt, Human
agccacugccucucccucug

SEQ ID NO: 3136573 - RNA, 21 nt, Human
agccacugccucucccucugg

SEQ ID NO: 3136574 - RNA, 12 nt, Human
agccagggcugg

SEQ ID NO: 3136575 - RNA, 13 nt, Human
agccagggcugga

SEQ ID NO: 3136576 - RNA, 14 nt, Human
agccagggcuggag

SEQ ID NO: 3136577 - RNA, 15 nt, Human
agccagggcuggaga

SEQ ID NO: 3136578 - RNA, 16 nt, Human
agccagggcuggagaa

SEQ ID NO: 3136579 - RNA, 16 nt, Human
agccauguuuauuaca

SEQ ID NO: 3136580 - RNA, 13 nt, Human
agccauguuuauu

SEQ ID NO: 3136581 - RNA, 14 nt, Human
agccauguuuauua

SEQ ID NO: 3136582 - RNA, 13 nt, Human
agcuagacuggug

SEQ ID NO: 3136583 - RNA, 14 nt, Human
agcuagacugguga

SEQ ID NO: 3136584 - RNA, 16 nt, Human
agcuagacuggugacu

SEQ ID NO: 3136585 - RNA, 17 nt, Human
agcuagacuggugacug

SEQ ID NO: 3136586 - RNA, 21 nt, Human
agcuagacuggugacugauuc

SEQ ID NO: 3136587 - RNA, 17 nt, Human
uggcauaacauaaaucu

SEQ ID NO: 3136588 - RNA, 21 nt, Human
uggcauagagcagcacuaaau

SEQ ID NO: 3136589 - RNA, 15 nt, Human
uggcauagagcagca

SEQ ID NO: 3136590 - RNA, 12 nt, Human
uggcaucucugu

SEQ ID NO: 3136591 - RNA, 15 nt, Human
uggcaucucuguccc

SEQ ID NO: 3136592 - RNA, 21 nt, Human
uggcauaacauaaaucuguga

SEQ ID NO: 3136593 - RNA, 22 nt, Human
uggcauaacauaaaucugugaa

SEQ ID NO: 3136594 - RNA, 15 nt, Human
uggagcguggacugg

SEQ ID NO: 3136595 - RNA, 16 nt, Human
uggagcguggacuggu

SEQ ID NO: 3136596 - RNA, 15 nt, Human
uggacuguggugacu

SEQ ID NO: 3136597 - RNA, 16 nt, Human
uggacuguggugacuu

SEQ ID NO: 3136598 - RNA, 17 nt, Human
uggacuguggugacuuu

SEQ ID NO: 3136599 - RNA, 19 nt, Human
uggacuguggugacuuugg

SEQ ID NO: 3136600 - RNA, 21 nt, Human
uggacuguggugacuuuggau

SEQ ID NO: 3136601 - RNA, 22 nt, Human
uggacuguggugacuuuggaua

SEQ ID NO: 3136602 - RNA, 17 nt, Human
ugcuuuucuuuucuaac

SEQ ID NO: 3136603 - RNA, 14 nt, Human
uggaaaucuuuaaa

SEQ ID NO: 3136604 - RNA, 15 nt, Human
uggaaaucuuuaaaa

SEQ ID NO: 3136605 - RNA, 13 nt, Human
ugcuccguggagg

SEQ ID NO: 3136606 - RNA, 17 nt, Human
ugcuccguggaggaggu

SEQ ID NO: 3136607 - RNA, 21 nt, Human
aggaagccugauuaaagaaug

SEQ ID NO: 3136608 - RNA, 17 nt, Human
aggaagccugauuaaag

SEQ ID NO: 3136609 - RNA, 18 nt, Human
aggaagccugauuaaaga

SEQ ID NO: 3136610 - RNA, 14 nt, Human
ugcugcccugcccc

SEQ ID NO: 3136611 - RNA, 15 nt, Human
ugcugcccugcccca

SEQ ID NO: 3136612 - RNA, 23 nt, Human
aggaauggagccugcacggugaa

SEQ ID NO: 3136613 - RNA, 13 nt, Human
ugcuaaggacuug

SEQ ID NO: 3136614 - RNA, 18 nt, Human
ugcuaaggacuuguuaga

SEQ ID NO: 3136615 - RNA, 22 nt, Human
ugcuaaggacuuguuagaucua

SEQ ID NO: 3136616 - RNA, 12 nt, Human
ugcuaaggacuu

SEQ ID NO: 3136617 - RNA, 14 nt, Human
ugcggcagggaaga

SEQ ID NO: 3136618 - RNA, 15 nt, Human
ugcggcagggaagag

SEQ ID NO: 3136619 - RNA, 20 nt, Human
uggucagcccuaggauaaaa

SEQ ID NO: 3136620 - RNA, 15 nt, Human
agggccaggagaugg

SEQ ID NO: 3136621 - RNA, 16 nt, Human
agggccaggagaugga

SEQ ID NO: 3136622 - RNA, 13 nt, Human
ugggcccaucucc

SEQ ID NO: 3136623 - RNA, 16 nt, Human
ugggcccaucucccug

SEQ ID NO: 3136624 - RNA, 17 nt, Human
ugggcccaucucccugc

SEQ ID NO: 3136625 - RNA, 18 nt, Human
ugggcccaucucccugcu

SEQ ID NO: 3136626 - RNA, 19 nt, Human
ugggcccaucucccugcuu

SEQ ID NO: 3136627 - RNA, 12 nt, Human
ugucgggcccuu

SEQ ID NO: 3136628 - RNA, 21 nt, Human
ugucgggcccuucuugcugcc

SEQ ID NO: 3136629 - RNA, 22 nt, Human
ugucgggcccuucuugcugccc

SEQ ID NO: 3136630 - RNA, 17 nt, Human
uguacuuuuuggcauaa

SEQ ID NO: 3136631 - RNA, 12 nt, Human
uguacuuuuugg

SEQ ID NO: 3136632 - RNA, 15 nt, Human
uguacuuuuuggcau

SEQ ID NO: 3136633 - RNA, 16 nt, Human
uguacuuuuuggcaua

SEQ ID NO: 3136634 - RNA, 13 nt, Human
uguaauuauaucu

SEQ ID NO: 3136635 - RNA, 14 nt, Human
uguaauuauaucug

SEQ ID NO: 3136636 - RNA, 15 nt, Human
uguaauuauaucuga

SEQ ID NO: 3136637 - RNA, 17 nt, Human
uguaacuuucugaaaua

SEQ ID NO: 3136638 - RNA, 16 nt, Human
uguaaaucccauuauu

SEQ ID NO: 3136639 - RNA, 18 nt, Human
uguaaaucccauuauuca

SEQ ID NO: 3136640 - RNA, 13 nt, Human
uguaaaucccauu

SEQ ID NO: 3136641 - RNA, 22 nt, Human
uguaaaucccauuauucaaagu

SEQ ID NO: 3136642 - RNA, 19 nt, Human
uguaaaucccauuauucaa

SEQ ID NO: 3136643 - RNA, 20 nt, Human
uguaaaucccauuauucaaa

SEQ ID NO: 3136644 - RNA, 18 nt, Human
agguggugucgggcccuu

SEQ ID NO: 3136645 - RNA, 16 nt, Human
uguggugacuuuggau

SEQ ID NO: 3136646 - RNA, 17 nt, Human
uguggugacuuuggaua

SEQ ID NO: 3136647 - RNA, 16 nt, Human
agugcugccugucccc

SEQ ID NO: 3136648 - RNA, 17 nt, Human
agugcugccugucccca

SEQ ID NO: 3136649 - RNA, 21 nt, Human
agugcugccuguccccaugcu

SEQ ID NO: 3136650 - RNA, 23 nt, Human
uguggcaaaauguuacagaaucu

SEQ ID NO: 3136651 - RNA, 22 nt, Human
aguucacucuccauuuaauaau

SEQ ID NO: 3136652 - RNA, 24 nt, Human
aguucacucuccauuuaauaauua

SEQ ID NO: 3136653 - RNA, 18 nt, Human
uguuuauuacaguauaau

SEQ ID NO: 3136654 - RNA, 13 nt, Human
uguuuagucuugu

SEQ ID NO: 3136655 - RNA, 17 nt, Human
uguuuagucuugucuca

SEQ ID NO: 3136656 - RNA, 18 nt, Human
uguuuagucuugucucag

SEQ ID NO: 3136657 - RNA, 19 nt, Human
uguuuagucuugucucaga

SEQ ID NO: 3136658 - RNA, 13 nt, Human
uguuccccucucc

SEQ ID NO: 3136659 - RNA, 14 nt, Human
uguuccccucuccc

SEQ ID NO: 3136660 - RNA, 15 nt, Human
uguuccccucucccu

SEQ ID NO: 3136661 - RNA, 16 nt, Human
uguuccccucucccuu

SEQ ID NO: 3136662 - RNA, 17 nt, Human
uguuccccucucccuuc

SEQ ID NO: 3136663 - RNA, 21 nt, Human
uguuccccucucccuucccuc

SEQ ID NO: 3136664 - RNA, 23 nt, Human
uguuccccucucccuucccuccu

SEQ ID NO: 3136665 - RNA, 12 nt, Human
uguuccccucuu

SEQ ID NO: 3136666 - RNA, 15 nt, Human
uguuccccucuuguc

SEQ ID NO: 3136667 - RNA, 18 nt, Human
uguuccccucuugucucc

SEQ ID NO: 3136668 - RNA, 19 nt, Human
uguuccccucuugucuccc

SEQ ID NO: 3136669 - RNA, 20 nt, Human
uguuccccucuugucucccc

SEQ ID NO: 3136670 - RNA, 21 nt, Human
uguuccccucuugucuccccu

SEQ ID NO: 3136671 - RNA, 22 nt, Human
uguuccccucuugucuccccug

SEQ ID NO: 3136672 - RNA, 23 nt, Human
uguuccccucuugucuccccugu

SEQ ID NO: 3136673 - RNA, 12 nt, Human
aguggaggugga

SEQ ID NO: 3136674 - RNA, 21 nt, Human
aguguugaaacggaugauuuc

SEQ ID NO: 3136675 - RNA, 21 nt, Human
auaaauagcuagacuggugac

SEQ ID NO: 3136676 - RNA, 22 nt, Human
auaaauagcuagacuggugacu

SEQ ID NO: 3136677 - RNA, 11 nt, Human
aguugccuaaa

SEQ ID NO: 3136678 - RNA, 15 nt, Human
aguugccuaaaucca

SEQ ID NO: 3136679 - RNA, 16 nt, Human
aguugccuaaauccau

SEQ ID NO: 3136680 - RNA, 17 nt, Human
aguugccuaaauccauu

SEQ ID NO: 3136681 - RNA, 18 nt, Human
aguugggggucagugcug

SEQ ID NO: 3136682 - RNA, 21 nt, Human
aguugggggucagugcugccu

SEQ ID NO: 3136683 - RNA, 14 nt, Human
acauugguguugua

SEQ ID NO: 3136684 - RNA, 16 nt, Human
acauugguguuguacu

SEQ ID NO: 3136685 - RNA, 22 nt, Human
acauugguguuguacucaauuu

SEQ ID NO: 3136686 - RNA, 23 nt, Human
acauugguguuguacucaauuuu

SEQ ID NO: 3136687 - RNA, 12 nt, Human
accaaaaaccag

SEQ ID NO: 3136688 - RNA, 13 nt, Human
accaaaaaccagu

SEQ ID NO: 3136689 - RNA, 15 nt, Human
ucaaaguugccuaaa

SEQ ID NO: 3136690 - RNA, 14 nt, Human
acauggccuuugcu

SEQ ID NO: 3136691 - RNA, 13 nt, Human
ucagaucugccua

SEQ ID NO: 3136692 - RNA, 20 nt, Human
ucagaucugccuaaggacuu

SEQ ID NO: 3136693 - RNA, 15 nt, Human
ucagaucugccuaag

SEQ ID NO: 3136694 - RNA, 18 nt, Human
ucagaucugccuaaggac

SEQ ID NO: 3136695 - RNA, 17 nt, Human
accaugggauaaaugcc

SEQ ID NO: 3136696 - RNA, 12 nt, Human
ucagugcugccu

SEQ ID NO: 3136697 - RNA, 13 nt, Human
ucagugcugccug

SEQ ID NO: 3136698 - RNA, 14 nt, Human
ucagugcugccugu

SEQ ID NO: 3136699 - RNA, 19 nt, Human
ucagugcugccugucccca

SEQ ID NO: 3136700 - RNA, 15 nt, Human
acccgccuagcugcu

SEQ ID NO: 3136701 - RNA, 18 nt, Human
acccgccuagcugcuguc

SEQ ID NO: 3136702 - RNA, 15 nt, Human
acggaugauuucuau

SEQ ID NO: 3136703 - RNA, 14 nt, Human
acggaugauuucua

SEQ ID NO: 3136704 - RNA, 15 nt, Human
acgcugaccguggag

SEQ ID NO: 3136705 - RNA, 13 nt, Human
acgcguugaaauu

SEQ ID NO: 3136706 - RNA, 14 nt, Human
acgcguugaaauug

SEQ ID NO: 3136707 - RNA, 18 nt, Human
acgcguugaaauuguaau

SEQ ID NO: 3136708 - RNA, 20 nt, Human
acgcguugaaauuguaauua

SEQ ID NO: 3136709 - RNA, 12 nt, Human
uccauuuaauaa

SEQ ID NO: 3136710 - RNA, 19 nt, Human
uccauuuggaaaucuuuaa

SEQ ID NO: 3136711 - RNA, 20 nt, Human
uccauuuggaaaucuuuaaa

SEQ ID NO: 3136712 - RNA, 12 nt, Human
uccauuuggaaa

SEQ ID NO: 3136713 - RNA, 20 nt, Human
acggggccgacauugucucc

SEQ ID NO: 3136714 - RNA, 21 nt, Human
acggggccgacauugucuccc

SEQ ID NO: 3136715 - RNA, 20 nt, Human
acucuucuugauuaaaaguu

SEQ ID NO: 3136716 - RNA, 19 nt, Human
acucuucuugauuaaaagu

SEQ ID NO: 3136717 - RNA, 12 nt, Human
uccguggaggag

SEQ ID NO: 3136718 - RNA, 22 nt, Human
uccguggaggagguugggaggg

SEQ ID NO: 3136719 - RNA, 23 nt, Human
uccgugcuaaggacuuguuagau

SEQ ID NO: 3136720 - RNA, 17 nt, Human
uccgugcuaaggacuug

SEQ ID NO: 3136721 - RNA, 18 nt, Human
uccgugcuaaggacuugu

SEQ ID NO: 3136722 - RNA, 16 nt, Human
uccgugcuaaggacuu

SEQ ID NO: 3136723 - RNA, 19 nt, Human
uccccucuugucuccccug

SEQ ID NO: 3136724 - RNA, 16 nt, Human
ucuaguucacucucca

SEQ ID NO: 3136725 - RNA, 19 nt, Human
ucuaguucacucuccauuu

SEQ ID NO: 3136726 - RNA, 12 nt, Human
ucuaguucacuc

SEQ ID NO: 3136727 - RNA, 12 nt, Human
ucuaccuggagg

SEQ ID NO: 3136728 - RNA, 13 nt, Human
ucuaccuggaggg

SEQ ID NO: 3136729 - RNA, 18 nt, Human
ucuaccuggagggaagag

SEQ ID NO: 3136730 - RNA, 18 nt, Human
ucucacuccccagccugg

SEQ ID NO: 3136731 - RNA, 21 nt, Human
ucucacuccccagccugggcc

SEQ ID NO: 3136732 - RNA, 22 nt, Human
ucucacuccccagccugggccc

SEQ ID NO: 3136733 - RNA, 22 nt, Human
agaaccucuuugucuacaccau

SEQ ID NO: 3136734 - RNA, 18 nt, Human
ucugcagguugaagccau

SEQ ID NO: 3136735 - RNA, 22 nt, Human
ucugcagguugaagccaugucu

SEQ ID NO: 3136736 - RNA, 21 nt, Human
agaagccccacccugccucac

SEQ ID NO: 3136737 - RNA, 22 nt, Human
acuuugugcugggguuaucuga

SEQ ID NO: 3136738 - RNA, 15 nt, Human
ucuugauuaaaaguu

SEQ ID NO: 3136739 - RNA, 15 nt, Human
ugaaacggaugauuu

SEQ ID NO: 3136740 - RNA, 17 nt, Human
ugaaacuuguguaaaua

SEQ ID NO: 3136741 - RNA, 23 nt, Human
ugaaacuuguguaaauacaauuu

SEQ ID NO: 3136742 - RNA, 17 nt, Human
ugaaacggaugauuucu

SEQ ID NO: 3136743 - RNA, 18 nt, Human
ugaaacggaugauuucua

SEQ ID NO: 3136744 - RNA, 19 nt, Human
ugaaacggaugauuucuau

SEQ ID NO: 3136745 - RNA, 20 nt, Human
ugaaacggaugauuucuaug

SEQ ID NO: 3136746 - RNA, 16 nt, Human
agaggcuguggcuggu

SEQ ID NO: 3136747 - RNA, 14 nt, Human
agaggcugguuuug

SEQ ID NO: 3136748 - RNA, 18 nt, Human
agaggcugguuuuggcau

SEQ ID NO: 3136749 - RNA, 10 nt, Human
agaggcuggu

SEQ ID NO: 3136750 - RNA, 17 nt, Human
ugaauggcuuuguauag

SEQ ID NO: 3136751 - RNA, 18 nt, Human
ugaauggcuuuguauaga

SEQ ID NO: 3136752 - RNA, 19 nt, Human
ugaauggcuuuguauagaa

SEQ ID NO: 3136753 - RNA, 22 nt, Human
ugaauggcuuuguauagaaccu

SEQ ID NO: 3136754 - RNA, 12 nt, Human
ugaauggcuuug

SEQ ID NO: 3136755 - RNA, 15 nt, Human
ugaauggcuuuguau

SEQ ID NO: 3136756 - RNA, 11 nt, Human
ugaauggcuuu

SEQ ID NO: 3136757 - RNA, 17 nt, Human
agauacuggauuguacu

SEQ ID NO: 3136758 - RNA, 14 nt, Human
agauacuggauugu

SEQ ID NO: 3136759 - RNA, 17 nt, Human
ugaauuuuguguuagag

SEQ ID NO: 3136760 - RNA, 21 nt, Human
ugaauuuuguguuagagauuu

SEQ ID NO: 3136761 - RNA, 12 nt, Human
agauuuugaaug

SEQ ID NO: 3136762 - RNA, 19 nt, Human
agauuuuauuauguaaauc

SEQ ID NO: 3136763 - RNA, 14 nt, Human
agauuuuauuaugu

SEQ ID NO: 3136764 - RNA, 15 nt, Human
agauuuuauuaugua

SEQ ID NO: 3136765 - RNA, 16 nt, Human
agauuuuauuauguaa

SEQ ID NO: 3136766 - RNA, 17 nt, Human
agauuuuauuauguaaa

SEQ ID NO: 3136767 - RNA, 18 nt, Human
agauuuuauuauguaaau

SEQ ID NO: 3136768 - RNA, 16 nt, Human
ugagaaggguguugua

SEQ ID NO: 3136769 - RNA, 23 nt, Human
agauuuuuuuguuguuuguuuag

SEQ ID NO: 3136770 - RNA, 18 nt, Human
agauuuuuuuguuguuug

SEQ ID NO: 3136771 - RNA, 19 nt, Human
agauuuuuuuguuguuugu

SEQ ID NO: 3136772 - RNA, 15 nt, Human
agauuuuuuuguugu

SEQ ID NO: 3136773 - RNA, 16 nt, Human
agauuuuuuuguuguu

SEQ ID NO: 3136774 - RNA, 22 nt, Human
aacugguggacauggcuguuca

SEQ ID NO: 3136775 - RNA, 14 nt, Human
gugaacuugaaauu

SEQ ID NO: 3136776 - RNA, 15 nt, Human
gugaacuugaaauuu

SEQ ID NO: 3136777 - RNA, 16 nt, Human
aaccucuuugucuaca

SEQ ID NO: 3136778 - RNA, 17 nt, Human
aacucgggcucccgggu

SEQ ID NO: 3136779 - RNA, 14 nt, Human
aaauuguaauuaua

SEQ ID NO: 3136780 - RNA, 15 nt, Human
aaauuguaauuauau

SEQ ID NO: 3136781 - RNA, 13 nt, Human
aaauguaugugag

SEQ ID NO: 3136782 - RNA, 12 nt, Human
guaugcugcuuu

SEQ ID NO: 3136783 - RNA, 13 nt, Human
guaugcugcuuuu

SEQ ID NO: 3136784 - RNA, 19 nt, Human
aagaggggugcagaggcug

SEQ ID NO: 3136785 - RNA, 21 nt, Human
aagaggggugcagaggcugug

SEQ ID NO: 3136786 - RNA, 22 nt, Human
aagaggggugcagaggcugugg

SEQ ID NO: 3136787 - RNA, 20 nt, Human
aagccugaguuugcuuucaa

SEQ ID NO: 3136788 - RNA, 14 nt, Human
aagcauuuaggaau

SEQ ID NO: 3136789 - RNA, 14 nt, Human
aaggggcccuugga

SEQ ID NO: 3136790 - RNA, 15 nt, Human
aaggggcccuuggag

SEQ ID NO: 3136791 - RNA, 16 nt, Human
aaggggcccuuggagc

SEQ ID NO: 3136792 - RNA, 20 nt, Human
aaggggcccuuggagcgugg

SEQ ID NO: 3136793 - RNA, 21 nt, Human
aaggggcccuuggagcgugga

SEQ ID NO: 3136794 - RNA, 19 nt, Human
guuuaauauuaaagccaug

SEQ ID NO: 3136795 - RNA, 20 nt, Human
guuuaauauuaaagccaugu

SEQ ID NO: 3136796 - RNA, 17 nt, Human
guugccuaaauccauuu

SEQ ID NO: 3136797 - RNA, 22 nt, Human
guugccuaaauccauuuggaaa

SEQ ID NO: 3136798 - RNA, 18 nt, Human
guugggaucuaggagagg

SEQ ID NO: 3136799 - RNA, 14 nt, Human
aaguauuaagcaua

SEQ ID NO: 3136800 - RNA, 15 nt, Human
aaguauuaagcauau

SEQ ID NO: 3136801 - RNA, 16 nt, Human
aaguauuaagcauaua

SEQ ID NO: 3136802 - RNA, 17 nt, Human
aaguauuaagcauauau

SEQ ID NO: 3136803 - RNA, 18 nt, Human
aaguauuaagcauauauu

SEQ ID NO: 3136804 - RNA, 22 nt, Human
uaaaagacugucuuaauuugca

SEQ ID NO: 3136805 - RNA, 12 nt, Human
aauuauugguaa

SEQ ID NO: 3136806 - RNA, 15 nt, Human
aauguuacagaaucu

SEQ ID NO: 3136807 - RNA, 19 nt, Human
uaauuauaucugaggaauu

SEQ ID NO: 3136808 - RNA, 21 nt, Human
uaauuauaucugaggaauucu

SEQ ID NO: 3136809 - RNA, 22 nt, Human
uaauuauaucugaggaauucug

SEQ ID NO: 3136810 - RNA, 23 nt, Human
uaauuauaucugaggaauucugu

SEQ ID NO: 3136811 - RNA, 19 nt, Human
uaauuauaugcuauuucua

SEQ ID NO: 3136812 - RNA, 14 nt, Human
uaauuauaugcuau

SEQ ID NO: 3136813 - RNA, 18 nt, Human
uaauuauaugcuauuucu

SEQ ID NO: 3136814 - RNA, 14 nt, Human
uacaccauuaugug

SEQ ID NO: 3136815 - RNA, 12 nt, Human
aauaccaaggaa

SEQ ID NO: 3136816 - RNA, 21 nt, Human
aauagcuagacuggugacuga

SEQ ID NO: 3136817 - RNA, 14 nt, Human
aauagcuagacugg

SEQ ID NO: 3136818 - RNA, 20 nt, Human
aauagcuagacuggugacug

SEQ ID NO: 3136819 - RNA, 12 nt, Human
uaacauguuaaa

SEQ ID NO: 3136820 - RNA, 15 nt, Human
uaacauguuaaacca

SEQ ID NO: 3136821 - RNA, 14 nt, Human
aaucccauuauuca

SEQ ID NO: 3136822 - RNA, 16 nt, Human
aaucccauuauucaaa

SEQ ID NO: 3136823 - RNA, 21 nt, Human
aaucccauuauucaaaguugc

SEQ ID NO: 3136824 - RNA, 13 nt, Human
uaaggacuuguua

SEQ ID NO: 3136825 - RNA, 15 nt, Human
uaaggacuuguuaga

SEQ ID NO: 3136826 - RNA, 16 nt, Human
uaaggacuuguuagau

SEQ ID NO: 3136827 - RNA, 19 nt, Human
uaaggacuuguuagaucua

SEQ ID NO: 3136828 - RNA, 13 nt, Human
uaagcauauauuu

SEQ ID NO: 3136829 - RNA, 14 nt, Human
uaaggacuucuuua

SEQ ID NO: 3136830 - RNA, 15 nt, Human
uaaggacuucuuuaa

SEQ ID NO: 3136831 - RNA, 16 nt, Human
uaaggacuucuuuaau

SEQ ID NO: 3136832 - RNA, 22 nt, Human
uaaggacuucuuuaauuuugga

SEQ ID NO: 3136833 - RNA, 16 nt, Human
uaaggaaaaguuuaau

SEQ ID NO: 3136834 - RNA, 21 nt, Human
uaaggaaaaguuuaauauuaa

SEQ ID NO: 3136835 - RNA, 17 nt, Human
uaaggaaaaguuuaaua

SEQ ID NO: 3136836 - RNA, 19 nt, Human
uaaggaaaaguuuaauauu

SEQ ID NO: 3136837 - RNA, 11 nt, Human
acacuucccug

SEQ ID NO: 3136838 - RNA, 12 nt, Human
acacuucccugg

SEQ ID NO: 3136839 - RNA, 13 nt, Human
acacuucccuggc

SEQ ID NO: 3136840 - RNA, 14 nt, Human
acacuucccuggcg

SEQ ID NO: 3136841 - RNA, 18 nt, Human
uauagauuagaauucugu

SEQ ID NO: 3136842 - RNA, 21 nt, Human
uaugaaacuuguguaaauaca

SEQ ID NO: 3136843 - RNA, 14 nt, Human
uaugaaacuugugu

SEQ ID NO: 3136844 - RNA, 19 nt, Human
uaugaaacuuguguaaaua

SEQ ID NO: 3136845 - RNA, 19 nt, Human
uaugccacccccgcuggag

SEQ ID NO: 3136846 - RNA, 14 nt, Human
uaugcuauuucuau

SEQ ID NO: 3136847 - RNA, 15 nt, Human
uaugcuauuucuaua

SEQ ID NO: 3136848 - RNA, 16 nt, Human
uaugcuauuucuauau

SEQ ID NO: 3136849 - RNA, 18 nt, Human
uaugcuauuucuauauuu

SEQ ID NO: 3136850 - RNA, 22 nt, Human
uaugcuauuucuauauuuucau

SEQ ID NO: 3136851 - RNA, 23 nt, Human
uaugcuauuucuauauuuucauu

SEQ ID NO: 3136852 - RNA, 17 nt, Human
uagagggaacagggcgg

SEQ ID NO: 3136853 - RNA, 13 nt, Human
acaaaguauuaag

SEQ ID NO: 3136854 - RNA, 15 nt, Human
acaaaguauuaagca

SEQ ID NO: 3136855 - RNA, 16 nt, Human
acaaaguauuaagcau

SEQ ID NO: 3136856 - RNA, 18 nt, Human
acaaaguauuaagcauau

SEQ ID NO: 3136857 - RNA, 14 nt, Human
acacaaggggcccu

SEQ ID NO: 3136858 - RNA, 20 nt, Human
acacaaggggcccuuggagc

SEQ ID NO: 3136859 - RNA, 16 nt, Human
uaggauaaaaagccag

SEQ ID NO: 3136860 - RNA, 20 nt, Human
uaggauaaaaagccagggcu

SEQ ID NO: 3136861 - RNA, 21 nt, Human
uaggauaaaaagccagggcug

SEQ ID NO: 3136862 - RNA, 22 nt, Human
uaggauaaaaagccagggcugg

SEQ ID NO: 3136863 - RNA, 23 nt, Human
uaggauaaaaagccagggcugga

SEQ ID NO: 3136864 - RNA, 14 nt, Human
uagggcccuggagg

SEQ ID NO: 3136865 - RNA, 16 nt, Human
uagggcccuggaggcg

SEQ ID NO: 3136866 - RNA, 13 nt, Human
acaugcccucccu

SEQ ID NO: 3136867 - RNA, 14 nt, Human
acaugcccucccuu

SEQ ID NO: 3136868 - RNA, 19 nt, Human
acaugcccucccuucuccc

SEQ ID NO: 3136869 - RNA, 21 nt, Human
acaugcccucccuucucccug

SEQ ID NO: 3136870 - RNA, 22 nt, Human
acaugcccucccuucucccugg

SEQ ID NO: 3136871 - RNA, 23 nt, Human
acaugcccucccuucucccugga

SEQ ID NO: 3136872 - RNA, 12 nt, Human
accaagaggcug

SEQ ID NO: 3136873 - RNA, 13 nt, Human
accaagaggcugg

SEQ ID NO: 3136874 - RNA, 14 nt, Human
accaagaggcuggu

SEQ ID NO: 3136875 - RNA, 15 nt, Human
accaagaggcugguu

SEQ ID NO: 3136876 - RNA, 16 nt, Human
accaagaggcugguuu

SEQ ID NO: 3136877 - RNA, 18 nt, Human
acaauuuuguuucuguac

SEQ ID NO: 3136878 - RNA, 20 nt, Human
acaauuuuguuucuguacuu

SEQ ID NO: 3136879 - RNA, 12 nt, Human
aauuuuggaauu

SEQ ID NO: 3136880 - RNA, 11 nt, Human
aauuuuggaau

SEQ ID NO: 3136881 - RNA, 23 nt, Human
aauuuauuggcuuuucugaucca

SEQ ID NO: 3136882 - RNA, 17 nt, Human
aauuuauuggcuuuucu

SEQ ID NO: 3136883 - RNA, 19 nt, Human
aauuuauuggcuuuucuga

SEQ ID NO: 3136884 - RNA, 20 nt, Human
aauuuauuggcuuuucugau

SEQ ID NO: 3136885 - RNA, 21 nt, Human
aauuuauuggcuuuucugauc

SEQ ID NO: 3136886 - RNA, 16 nt, Human
aauuggggauucuuaa

SEQ ID NO: 3136887 - RNA, 15 nt, Human
aauuggggauucuua

SEQ ID NO: 3136888 - RNA, 21 nt, Human
aaugguccgugcuaaggacuu

SEQ ID NO: 3136889 - RNA, 17 nt, Human
aauuggggauucuuaaa

SEQ ID NO: 3136890 - RNA, 20 nt, Human
aauuggggauucuuaaaguu

SEQ ID NO: 3136891 - RNA, 15 nt, Human
acugauucuucagca

SEQ ID NO: 3136892 - RNA, 22 nt, Human
acugauucuucagcaaaaauau

SEQ ID NO: 3136893 - RNA, 12 nt, Human
acugauucuuca

SEQ ID NO: 3136894 - RNA, 13 nt, Human
acugauucuucag

SEQ ID NO: 3136895 - RNA, 22 nt, Human
accugucuugccuuuuucauua

SEQ ID NO: 3136896 - RNA, 19 nt, Human
accugucuugccuuuuuca

SEQ ID NO: 3136897 - RNA, 21 nt, Human
accugucuugccuuuuucauu

SEQ ID NO: 3136898 - RNA, 12 nt, Human
aauauuaaagcc

SEQ ID NO: 3136899 - RNA, 13 nt, Human
aauauuaaagcca

SEQ ID NO: 3136900 - RNA, 14 nt, Human
aauauuaaagccau

SEQ ID NO: 3136901 - RNA, 15 nt, Human
aauauuaaagccaug

SEQ ID NO: 3136902 - RNA, 16 nt, Human
aauauuaaagccaugu

SEQ ID NO: 3136903 - RNA, 18 nt, Human
aauauuaaagccauguuu

SEQ ID NO: 3136904 - RNA, 19 nt, Human
aauauuaaagccauguuua

SEQ ID NO: 3136905 - RNA, 20 nt, Human
aauauuaaagccauguuuau

SEQ ID NO: 3136906 - RNA, 20 nt, Human
aaugguccgugcuaaggacu

SEQ ID NO: 3136907 - RNA, 17 nt, Human
aagccacugccucuccc

SEQ ID NO: 3136908 - RNA, 18 nt, Human
aagccacugccucucccu

SEQ ID NO: 3136909 - RNA, 19 nt, Human
aagccacugccucucccuc

SEQ ID NO: 3136910 - RNA, 15 nt, Human
aaagaaacugacaug

SEQ ID NO: 3136911 - RNA, 22 nt, Human
aaagaaacugacaugcccuccc

SEQ ID NO: 3136912 - RNA, 23 nt, Human
aaaaguuuaauauuaaagccaug

SEQ ID NO: 3136913 - RNA, 21 nt, Human
aaaaguuuaauauuaaagcca

SEQ ID NO: 3136914 - RNA, 22 nt, Human
aaaaguuuaauauuaaagccau

SEQ ID NO: 3136915 - RNA, 20 nt, Human
aaaaguuuaauauuaaagcc

SEQ ID NO: 3136916 - RNA, 21 nt, Human
aaaucugugaacuugaaauuu

SEQ ID NO: 3136917 - RNA, 20 nt, Human
aaaucugugaacuugaaauu

SEQ ID NO: 3136918 - RNA, 19 nt, Human
aaaucugugaacuugaaau

SEQ ID NO: 3136919 - RNA, 17 nt, Human
aaauuggggauucuuaa

SEQ ID NO: 3136920 - RNA, 18 nt, Human
aaauuggggauucuuaaa

SEQ ID NO: 3136921 - RNA, 19 nt, Human
aaauuggggauucuuaaag

SEQ ID NO: 3136922 - RNA, 20 nt, Human
aaauuggggauucuuaaagu

SEQ ID NO: 3136923 - RNA, 22 nt, Human
aaauuggggauucuuaaaguug

SEQ ID NO: 3136924 - RNA, 23 nt, Human
aaauuggggauucuuaaaguuga

SEQ ID NO: 3136925 - RNA, 15 nt, Human
aacgcguugaaauug

SEQ ID NO: 3136926 - RNA, 17 nt, Human
aacgcguugaaauugua

SEQ ID NO: 3136927 - RNA, 13 nt, Human
aacgcguugaaau

SEQ ID NO: 3136928 - RNA, 14 nt, Human
aacgcguugaaauu

SEQ ID NO: 3136929 - RNA, 14 nt, Human
aaccaguauuguac

SEQ ID NO: 3136930 - RNA, 11 nt, Human
aaccaguauug

SEQ ID NO: 3136931 - RNA, 13 nt, Human
aaccaguauugua

SEQ ID NO: 3136932 - RNA, 19 nt, Human
agaucugccuaaggacuuc

SEQ ID NO: 3136933 - RNA, 16 nt, Human
agaucuggaaugugaa

SEQ ID NO: 3136934 - RNA, 13 nt, Human
agaguggaggugg

SEQ ID NO: 3136935 - RNA, 14 nt, Human
agcagcccugcccc

SEQ ID NO: 3136936 - RNA, 17 nt, Human
agcagcccugccccaca

SEQ ID NO: 3136937 - RNA, 20 nt, Human
agacagaucuggaaugugaa

SEQ ID NO: 3136938 - RNA, 22 nt, Human
agacagauacuccuccaagguu

SEQ ID NO: 3136939 - RNA, 17 nt, Human
agccugggcccaucucc

SEQ ID NO: 3136940 - RNA, 18 nt, Human
agccugggcccaucuccc

SEQ ID NO: 3136941 - RNA, 19 nt, Human
agccugggcccaucucccu

SEQ ID NO: 3136942 - RNA, 20 nt, Human
agccugggcccaucucccug

SEQ ID NO: 3136943 - RNA, 21 nt, Human
agccugggcccaucucccugc

SEQ ID NO: 3136944 - RNA, 22 nt, Human
agccugggcccaucucccugcu

SEQ ID NO: 3136945 - RNA, 23 nt, Human
agccugggcccaucucccugcuu

SEQ ID NO: 3136946 - RNA, 13 nt, Human
aggaaguggaaug

SEQ ID NO: 3136947 - RNA, 13 nt, Human
aggcuaaguuggg

SEQ ID NO: 3136948 - RNA, 17 nt, Human
aggcuaaguugggaucu

SEQ ID NO: 3136949 - RNA, 24 nt, Human
aggcuaaguugggaucuaggagag

SEQ ID NO: 3136950 - RNA, 17 nt, Human
aggcugacguuccgggc

SEQ ID NO: 3136951 - RNA, 22 nt, Human
aggcggugcggcagggaagagg

SEQ ID NO: 3136952 - RNA, 18 nt, Human
auaaaaagccagggcugg

SEQ ID NO: 3136953 - RNA, 20 nt, Human
auauauuuuuauauuuacua

SEQ ID NO: 3136954 - RNA, 18 nt, Human
auauauuuuuauauuuac

SEQ ID NO: 3136955 - RNA, 19 nt, Human
auauauuuuuauauuuacu

SEQ ID NO: 3136956 - RNA, 20 nt, Human
aucccauuauucaaaguugc

SEQ ID NO: 3136957 - RNA, 14 nt, Human
aucccauuauucaa

SEQ ID NO: 3136958 - RNA, 15 nt, Human
aucccauuauucaaa

SEQ ID NO: 3136959 - RNA, 16 nt, Human
auccuuaugccacccc

SEQ ID NO: 3136960 - RNA, 15 nt, Human
augguccgugcuaag

SEQ ID NO: 3136961 - RNA, 18 nt, Human
augguccgugcuaaggac

SEQ ID NO: 3136962 - RNA, 18 nt, Human
auggcuuuguauagaacc

SEQ ID NO: 3136963 - RNA, 19 nt, Human
auggcuuuguauagaaccu

SEQ ID NO: 3136964 - RNA, 20 nt, Human
augcugaguuugugcuggug

SEQ ID NO: 3136965 - RNA, 21 nt, Human
caaaugggcgccccccccucc

SEQ ID NO: 3136966 - RNA, 23 nt, Human
caacagcuggugcccugcuuuca

SEQ ID NO: 3136967 - RNA, 16 nt, Human
ugacaugcccucccuu

SEQ ID NO: 3136968 - RNA, 21 nt, Human
ugacaugcccucccuucuccc

SEQ ID NO: 3136969 - RNA, 22 nt, Human
ugacaugcccucccuucucccu

SEQ ID NO: 3136970 - RNA, 23 nt, Human
ugacaugcccucccuucucccug

SEQ ID NO: 3136971 - RNA, 18 nt, Human
ugaacuugaaauuugaau

SEQ ID NO: 3136972 - RNA, 13 nt, Human
ugaacuugaaauu

SEQ ID NO: 3136973 - RNA, 14 nt, Human
ugaacuugaaauuu

SEQ ID NO: 3136974 - RNA, 20 nt, Human
ugaggcguauguggcaaaau

SEQ ID NO: 3136975 - RNA, 14 nt, Human
ugacguuccgggca

SEQ ID NO: 3136976 - RNA, 12 nt, Human
ugacuuuggaua

SEQ ID NO: 3136977 - RNA, 13 nt, Human
ugacuuuggauaa

SEQ ID NO: 3136978 - RNA, 14 nt, Human
ugacuuuggauaau

SEQ ID NO: 3136979 - RNA, 15 nt, Human
ugacuuuggauaaua

SEQ ID NO: 3136980 - RNA, 16 nt, Human
ugacuuuggauaauaa

SEQ ID NO: 3136981 - RNA, 20 nt, Human
ugacuuuggauaauaaggaa

SEQ ID NO: 3136982 - RNA, 22 nt, Human
ugacuuuggauaauaaggaaaa

SEQ ID NO: 3136983 - RNA, 14 nt, Human
ucuugucucagauu

SEQ ID NO: 3136984 - RNA, 15 nt, Human
ucuugucucagauuu

SEQ ID NO: 3136985 - RNA, 12 nt, Human
ucuugucucaga

SEQ ID NO: 3136986 - RNA, 14 nt, Human
ucuugccccaucac

SEQ ID NO: 3136987 - RNA, 21 nt, Human
ucuugccccaucacugcgcca

SEQ ID NO: 3136988 - RNA, 14 nt, Human
ucuggaaugugaag

SEQ ID NO: 3136989 - RNA, 23 nt, Human
ucugccuaaggacuucuuuaauu

SEQ ID NO: 3136990 - RNA, 16 nt, Human
ucugccuaaggacuuc

SEQ ID NO: 3136991 - RNA, 20 nt, Human
ucugccuaaggacuucuuua

SEQ ID NO: 3136992 - RNA, 21 nt, Human
ucugccuaaggacuucuuuaa

SEQ ID NO: 3136993 - RNA, 16 nt, Human
ucagauacuggauugu

SEQ ID NO: 3136994 - RNA, 19 nt, Human
ucagauacuggauuguacu

SEQ ID NO: 3136995 - RNA, 20 nt, Human
ucagauacuggauuguacuu

SEQ ID NO: 3136996 - RNA, 14 nt, Human
ucagauacuggauu

SEQ ID NO: 3136997 - RNA, 15 nt, Human
ucagauacuggauug

SEQ ID NO: 3136998 - RNA, 16 nt, Human
ucucagauuuuauuau

SEQ ID NO: 3136999 - RNA, 17 nt, Human
ucucagauuuuauuaug

SEQ ID NO: 3137000 - RNA, 18 nt, Human
ucucagauuuuauuaugu

SEQ ID NO: 3137001 - RNA, 14 nt, Human
ucucagauuuuauu

SEQ ID NO: 3137002 - RNA, 15 nt, Human
ucucagauuuuauua

SEQ ID NO: 3137003 - RNA, 13 nt, Human
ucucagauuuuau

SEQ ID NO: 3137004 - RNA, 18 nt, Human
ucuauauguuuaaaagua

SEQ ID NO: 3137005 - RNA, 15 nt, Human
ucuauauuuucauuc

SEQ ID NO: 3137006 - RNA, 16 nt, Human
ucuauauuuucauucu

SEQ ID NO: 3137007 - RNA, 13 nt, Human
ucuauauuuucau

SEQ ID NO: 3137008 - RNA, 14 nt, Human
ucuauauuuucauu

SEQ ID NO: 3137009 - RNA, 15 nt, Human
ucgucuuccgucucc

SEQ ID NO: 3137010 - RNA, 17 nt, Human
ucgucuuccgucucccc

SEQ ID NO: 3137011 - RNA, 19 nt, Human
ucgucuuccgucucccccg

SEQ ID NO: 3137012 - RNA, 22 nt, Human
ucgucuuccgucucccccgugu

SEQ ID NO: 3137013 - RNA, 23 nt, Human
uccuuaugccacccccgcuggag

SEQ ID NO: 3137014 - RNA, 14 nt, Human
ucccucugguccca

SEQ ID NO: 3137015 - RNA, 16 nt, Human
ucccucuggucccaca

SEQ ID NO: 3137016 - RNA, 15 nt, Human
ucccuggcggcccca

SEQ ID NO: 3137017 - RNA, 19 nt, Human
ucccuggcggccccaacuc

SEQ ID NO: 3137018 - RNA, 15 nt, Human
ucccugggaucuggu

SEQ ID NO: 3137019 - RNA, 17 nt, Human
ucccugggaucuggugg

SEQ ID NO: 3137020 - RNA, 13 nt, Human
uccucucacuccc

SEQ ID NO: 3137021 - RNA, 15 nt, Human
uccucucacucccca

SEQ ID NO: 3137022 - RNA, 22 nt, Human
uccucucacuccccagccuggg

SEQ ID NO: 3137023 - RNA, 19 nt, Human
uggaacgcguugaaauugu

SEQ ID NO: 3137024 - RNA, 18 nt, Human
uggaacgcguugaaauug

SEQ ID NO: 3137025 - RNA, 17 nt, Human
uggaacgcguugaaauu

SEQ ID NO: 3137026 - RNA, 15 nt, Human
uggaucuaccuggag

SEQ ID NO: 3137027 - RNA, 16 nt, Human
uggaucuaccuggagg

SEQ ID NO: 3137028 - RNA, 17 nt, Human
uggaucuaccuggaggg

SEQ ID NO: 3137029 - RNA, 18 nt, Human
uggggauucuuaaaguug

SEQ ID NO: 3137030 - RNA, 20 nt, Human
uggggauucuuaaaguugaa

SEQ ID NO: 3137031 - RNA, 13 nt, Human
uggggauucuuaa

SEQ ID NO: 3137032 - RNA, 16 nt, Human
uggggauucuuaaagu

SEQ ID NO: 3137033 - RNA, 12 nt, Human
uggggauucuua

SEQ ID NO: 3137034 - RNA, 14 nt, Human
ugggaucuaggaga

SEQ ID NO: 3137035 - RNA, 15 nt, Human
ugggaucuaggagag

SEQ ID NO: 3137036 - RNA, 16 nt, Human
ugggaucuaggagagg

SEQ ID NO: 3137037 - RNA, 18 nt, Human
uggcuuuucugauccagu

SEQ ID NO: 3137038 - RNA, 19 nt, Human
uggcuuuucugauccaguu

SEQ ID NO: 3137039 - RNA, 14 nt, Human
uggcuuuucugauc

SEQ ID NO: 3137040 - RNA, 17 nt, Human
uggcuuuucugauccag

SEQ ID NO: 3137041 - RNA, 13 nt, Human
uggcuuuucugau

SEQ ID NO: 3137042 - RNA, 16 nt, Human
uggcuggugagccggu

SEQ ID NO: 3137043 - RNA, 20 nt, Human
uggcuggugagccggucagg

SEQ ID NO: 3137044 - RNA, 12 nt, Human
ugccucucccuc

SEQ ID NO: 3137045 - RNA, 13 nt, Human
ugccucucccucu

SEQ ID NO: 3137046 - RNA, 14 nt, Human
ugccucucccucug

SEQ ID NO: 3137047 - RNA, 15 nt, Human
ugccucucccucugg

SEQ ID NO: 3137048 - RNA, 18 nt, Human
ugccccaucacugcgcca

SEQ ID NO: 3137049 - RNA, 11 nt, Human
ugcagaggcug

SEQ ID NO: 3137050 - RNA, 12 nt, Human
ugcagaggcugu

SEQ ID NO: 3137051 - RNA, 13 nt, Human
ugcagaggcugug

SEQ ID NO: 3137052 - RNA, 14 nt, Human
ugcagaggcugugg

SEQ ID NO: 3137053 - RNA, 15 nt, Human
ugcagaggcuguggc

SEQ ID NO: 3137054 - RNA, 22 nt, Human
ugcagaggcuguggcuggugag

SEQ ID NO: 3137055 - RNA, 14 nt, Human
ugcacggugaaugg

SEQ ID NO: 3137056 - RNA, 18 nt, Human
ugcacggugaauggcuuu

SEQ ID NO: 3137057 - RNA, 21 nt, Human
uguauugugcgcuaaacuuuu

SEQ ID NO: 3137058 - RNA, 23 nt, Human
ugucacauuuuucuuguuuuguc

SEQ ID NO: 3137059 - RNA, 21 nt, Human
ugugggcagcuuagggcccug

SEQ ID NO: 3137060 - RNA, 13 nt, Human
uguguaugcugcu

SEQ ID NO: 3137061 - RNA, 15 nt, Human
uguguaugcugcuuu

SEQ ID NO: 3137062 - RNA, 11 nt, Human
uguuucuguac

SEQ ID NO: 3137063 - RNA, 22 nt, Human
uguuucuguacuuuuuggcaua

SEQ ID NO: 3137064 - RNA, 23 nt, Human
uguuucuguacuuuuuggcauaa

SEQ ID NO: 3137065 - RNA, 15 nt, Human
uuaaaaaaaaaauug

SEQ ID NO: 3137066 - RNA, 18 nt, Human
uuaaagccauguuuauua

SEQ ID NO: 3137067 - RNA, 20 nt, Human
uuaaagccauguuuauuaca

SEQ ID NO: 3137068 - RNA, 12 nt, Human
uuaaagccaugu

SEQ ID NO: 3137069 - RNA, 14 nt, Human
uuaaagccauguuu

SEQ ID NO: 3137070 - RNA, 19 nt, Human
uuacagaaucuaacuggug

SEQ ID NO: 3137071 - RNA, 12 nt, Human
uuacagaagccc

SEQ ID NO: 3137072 - RNA, 18 nt, Human
uuaauauuaaagccaugu

SEQ ID NO: 3137073 - RNA, 19 nt, Human
uuaauauuaaagccauguu

SEQ ID NO: 3137074 - RNA, 13 nt, Human
uuaagccacugcc

SEQ ID NO: 3137075 - RNA, 15 nt, Human
uuaagccacugccuc

SEQ ID NO: 3137076 - RNA, 16 nt, Human
uuaagccacugccucu

SEQ ID NO: 3137077 - RNA, 19 nt, Human
uuaagccacugccucuccc

SEQ ID NO: 3137078 - RNA, 20 nt, Human
uuaagccacugccucucccu

SEQ ID NO: 3137079 - RNA, 23 nt, Human
uuaagcauauauuuuuauauuua

SEQ ID NO: 3137080 - RNA, 11 nt, Human
uuaauauuaaa

SEQ ID NO: 3137081 - RNA, 13 nt, Human
uuaauauuaaagc

SEQ ID NO: 3137082 - RNA, 14 nt, Human
uuaauauuaaagcc

SEQ ID NO: 3137083 - RNA, 16 nt, Human
uuaauauuaaagccau

SEQ ID NO: 3137084 - RNA, 17 nt, Human
uuaauauuaaagccaug

SEQ ID NO: 3137085 - RNA, 16 nt, Human
uaauaaggaaaaguuu

SEQ ID NO: 3137086 - RNA, 15 nt, Human
uaauauuaaagccau

SEQ ID NO: 3137087 - RNA, 16 nt, Human
uaauauuaaagccaug

SEQ ID NO: 3137088 - RNA, 21 nt, Human
uaauauuaaagccauguuuau

SEQ ID NO: 3137089 - RNA, 17 nt, Human
uaauauuaaagccaugu

SEQ ID NO: 3137090 - RNA, 20 nt, Human
uaauauuaaagccauguuua

SEQ ID NO: 3137091 - RNA, 21 nt, Human
uaauuaacauguuaaaccaug

SEQ ID NO: 3137092 - RNA, 20 nt, Human
uaauuaacauguuaaaccau

SEQ ID NO: 3137093 - RNA, 16 nt, Human
uaaaugccaucaauaa

SEQ ID NO: 3137094 - RNA, 23 nt, Human
uaaaugccaucaauaaaaaauua

SEQ ID NO: 3137095 - RNA, 18 nt, Human
guuuagucuugucucaga

SEQ ID NO: 3137096 - RNA, 17 nt, Human
uaaaaagccagggcugg

SEQ ID NO: 3137097 - RNA, 20 nt, Human
uaaaaagccagggcuggaga

SEQ ID NO: 3137098 - RNA, 20 nt, Human
uaaagccugaguuugcuuuc

SEQ ID NO: 3137099 - RNA, 15 nt, Human
uaaagccauguuuau

SEQ ID NO: 3137100 - RNA, 20 nt, Human
uaaagccauguuuauuacag

SEQ ID NO: 3137101 - RNA, 11 nt, Human
uaaagccaugu

SEQ ID NO: 3137102 - RNA, 13 nt, Human
uaaagccauguuu

SEQ ID NO: 3137103 - RNA, 17 nt, Human
uacuaaaauggacugug

SEQ ID NO: 3137104 - RNA, 15 nt, Human
uacuaaaauggacug

SEQ ID NO: 3137105 - RNA, 23 nt, Human
uacuaaaauggacuguggugacu

SEQ ID NO: 3137106 - RNA, 17 nt, Human
uacaauuuuguuucugu

SEQ ID NO: 3137107 - RNA, 15 nt, Human
uacaauuuuguuucu

SEQ ID NO: 3137108 - RNA, 16 nt, Human
uacaauuuuguuucug

SEQ ID NO: 3137109 - RNA, 12 nt, Human
uacaauuuuguu

SEQ ID NO: 3137110 - RNA, 13 nt, Human
uacaaaguauuaa

SEQ ID NO: 3137111 - RNA, 14 nt, Human
uacaaaguauuaag

SEQ ID NO: 3137112 - RNA, 12 nt, Human
uacaaaguauua

SEQ ID NO: 3137113 - RNA, 15 nt, Human
uacaaaguauuaagc

SEQ ID NO: 3137114 - RNA, 16 nt, Human
uacaaaguauuaagca

SEQ ID NO: 3137115 - RNA, 18 nt, Human
uacaaaguauuaagcaua

SEQ ID NO: 3137116 - RNA, 19 nt, Human
uacaaaguauuaagcauau

SEQ ID NO: 3137117 - RNA, 23 nt, Human
uauaucugaggaauucuguauag

SEQ ID NO: 3137118 - RNA, 20 nt, Human
uauagaaccucuuugucuac

SEQ ID NO: 3137119 - RNA, 21 nt, Human
uauagaaccucuuugucuaca

SEQ ID NO: 3137120 - RNA, 16 nt, Human
uauauuuucauucucc

SEQ ID NO: 3137121 - RNA, 22 nt, Human
uagcuggucuuauuuguaaagc

SEQ ID NO: 3137122 - RNA, 14 nt, Human
uagauuagaauucu

SEQ ID NO: 3137123 - RNA, 15 nt, Human
uagauuagaauucug

SEQ ID NO: 3137124 - RNA, 16 nt, Human
uagauuagaauucugu

SEQ ID NO: 3137125 - RNA, 17 nt, Human
uagauuagaauucugua

SEQ ID NO: 3137126 - RNA, 19 nt, Human
uagauuagaauucuguaua

SEQ ID NO: 3137127 - RNA, 20 nt, Human
uagauuagaauucuguauag

SEQ ID NO: 3137128 - RNA, 20 nt, Human
uagauuagagaguguugaaa

SEQ ID NO: 3137129 - RNA, 13 nt, Human
uagagugucuuaa

SEQ ID NO: 3137130 - RNA, 11 nt, Human
uagaauucugu

SEQ ID NO: 3137131 - RNA, 13 nt, Human
uagaauucuguau

SEQ ID NO: 3137132 - RNA, 14 nt, Human
uagaauucuguaua

SEQ ID NO: 3137133 - RNA, 15 nt, Human
uagaauucuguauag

SEQ ID NO: 3137134 - RNA, 16 nt, Human
uagaauucuguauaga

SEQ ID NO: 3137135 - RNA, 21 nt, Human
uagaauucuguauagauuaga

SEQ ID NO: 3137136 - RNA, 18 nt, Human
uagacuggugacugauuc

SEQ ID NO: 3137137 - RNA, 21 nt, Human
uagacuggugacugauucuuc

SEQ ID NO: 3137138 - RNA, 23 nt, Human
uagacuggugacugauucuucag

SEQ ID NO: 3137139 - RNA, 20 nt, Human
uagacuggugacugauucuu

SEQ ID NO: 3137140 - RNA, 23 nt, Human
uagaauuaguggcacuugcuuuu

SEQ ID NO: 3137141 - RNA, 14 nt, Human
guguaugcugcuuu

SEQ ID NO: 3137142 - RNA, 13 nt, Human
guggugacuuugg

SEQ ID NO: 3137143 - RNA, 15 nt, Human
guggugacuuuggau

SEQ ID NO: 3137144 - RNA, 17 nt, Human
guggugacaggacgcug

SEQ ID NO: 3137145 - RNA, 16 nt, Human
guggugacuuuggaua

SEQ ID NO: 3137146 - RNA, 16 nt, Human
guggcuggugagccgg

SEQ ID NO: 3137147 - RNA, 23 nt, Human
gugggcagcuuagggcccuggag

SEQ ID NO: 3137148 - RNA, 18 nt, Human
guguuccccucuugucuc

SEQ ID NO: 3137149 - RNA, 19 nt, Human
guguuccccucuugucucc

SEQ ID NO: 3137150 - RNA, 20 nt, Human
guguuccccucuugucuccc

SEQ ID NO: 3137151 - RNA, 22 nt, Human
guguuccccucuugucuccccu

SEQ ID NO: 3137152 - RNA, 18 nt, Human
guuaaaccaugggauaaa

SEQ ID NO: 3137153 - RNA, 21 nt, Human
guuaaaccaugggauaaaugc

SEQ ID NO: 3137154 - RNA, 13 nt, Human
guuacagaagccc

SEQ ID NO: 3137155 - RNA, 13 nt, Human
gugucgggcccuu

SEQ ID NO: 3137156 - RNA, 19 nt, Human
guuauguaauaaccaaaug

SEQ ID NO: 3137157 - RNA, 19 nt, Human
guuaucugaagucagaucu

SEQ ID NO: 3137158 - RNA, 18 nt, Human
guuccgggcaaaugccag

SEQ ID NO: 3137159 - RNA, 22 nt, Human
guuccgggcaaaugccagggcc

SEQ ID NO: 3137160 - RNA, 19 nt, Human
guucacucuccauuuaaua

SEQ ID NO: 3137161 - RNA, 22 nt, Human
guucauggaacgcguugaaauu

SEQ ID NO: 3137162 - RNA, 23 nt, Human
guucauggaacgcguugaaauug

SEQ ID NO: 3137163 - RNA, 21 nt, Human
guugaaacggaugauuucuau

SEQ ID NO: 3137164 - RNA, 22 nt, Human
guugaaacggaugauuucuaug

SEQ ID NO: 3137165 - RNA, 16 nt, Human
guugaaauuguaauua

SEQ ID NO: 3137166 - RNA, 20 nt, Human
guugaaauuguaauuauauc

SEQ ID NO: 3137167 - RNA, 15 nt, Human
guugaaauuguaauu

SEQ ID NO: 3137168 - RNA, 21 nt, Human
guugaauuuauuggcuuuucu

SEQ ID NO: 3137169 - RNA, 15 nt, Human
guugaagccaugucu

SEQ ID NO: 3137170 - RNA, 14 nt, Human
guugaauuuauugg

SEQ ID NO: 3137171 - RNA, 15 nt, Human
guucugcagguugaa

SEQ ID NO: 3137172 - RNA, 23 nt, Human
guucugcagguugaagccauguc

SEQ ID NO: 3137173 - RNA, 21 nt, Human
gucgggcccuucuugcugccc

SEQ ID NO: 3137174 - RNA, 22 nt, Human
gucgggcccuucuugcugcccu

SEQ ID NO: 3137175 - RNA, 23 nt, Human
gucgggcccuucuugcugcccug

SEQ ID NO: 3137176 - RNA, 14 nt, Human
gucucagauuuuau

SEQ ID NO: 3137177 - RNA, 15 nt, Human
gucucagauuuuauu

SEQ ID NO: 3137178 - RNA, 16 nt, Human
gucucagauuuuauua

SEQ ID NO: 3137179 - RNA, 17 nt, Human
gucucagauuuuauuau

SEQ ID NO: 3137180 - RNA, 21 nt, Human
gucucagauuuuauuauguaa

SEQ ID NO: 3137181 - RNA, 20 nt, Human
gucuugucucagauuuuauu

SEQ ID NO: 3137182 - RNA, 15 nt, Human
gucuugucucagauu

SEQ ID NO: 3137183 - RNA, 13 nt, Human
gucuugccccauc

SEQ ID NO: 3137184 - RNA, 16 nt, Human
gucuugccccaucacu

SEQ ID NO: 3137185 - RNA, 22 nt, Human
gucuugccccaucacugcgcca

SEQ ID NO: 3137186 - RNA, 20 nt, Human
gucuugccuuuuucauuauu

SEQ ID NO: 3137187 - RNA, 15 nt, Human
gucuugccuuuuuca

SEQ ID NO: 3137188 - RNA, 16 nt, Human
gucuugccuuuuucau

SEQ ID NO: 3137189 - RNA, 17 nt, Human
gucuugccuuuuucauu

SEQ ID NO: 3137190 - RNA, 18 nt, Human
gucuugccuuuuucauua

SEQ ID NO: 3137191 - RNA, 14 nt, Human
gugagcgcuugggc

SEQ ID NO: 3137192 - RNA, 15 nt, Human
gugcccggggcagca

SEQ ID NO: 3137193 - RNA, 21 nt, Human
gugcccggggcagcagcagcc

SEQ ID NO: 3137194 - RNA, 23 nt, Human
gugcccggggcagcagcagcccu

SEQ ID NO: 3137195 - RNA, 21 nt, Human
gugcgcuaaacuuuucugaua

SEQ ID NO: 3137196 - RNA, 17 nt, Human
gugcgcuaaacuuuucu

SEQ ID NO: 3137197 - RNA, 16 nt, Human
gugcggcagggaagag

SEQ ID NO: 3137198 - RNA, 20 nt, Human
gugcuaaggacuuguuagau

SEQ ID NO: 3137199 - RNA, 13 nt, Human
gugcuaaggacuu

SEQ ID NO: 3137200 - RNA, 14 nt, Human
gugcuaaggacuug

SEQ ID NO: 3137201 - RNA, 12 nt, Human
gugcuaaggacu

SEQ ID NO: 3137202 - RNA, 12 nt, Human
gugcagaggcug

SEQ ID NO: 3137203 - RNA, 13 nt, Human
gugcagaggcugu

SEQ ID NO: 3137204 - RNA, 14 nt, Human
gugcagaggcugug

SEQ ID NO: 3137205 - RNA, 17 nt, Human
gugcagaggcuguggcu

SEQ ID NO: 3137206 - RNA, 22 nt, Human
gugcagaggcuguggcugguga

SEQ ID NO: 3137207 - RNA, 10 nt, Human
guauaauuaa

SEQ ID NO: 3137208 - RNA, 13 nt, Human
guauaauuaacau

SEQ ID NO: 3137209 - RNA, 14 nt, Human
guauaauuaacaug

SEQ ID NO: 3137210 - RNA, 23 nt, Human
guauaauuaacauguuaaaccau

SEQ ID NO: 3137211 - RNA, 15 nt, Human
guauaauuaacaugu

SEQ ID NO: 3137212 - RNA, 17 nt, Human
guauaauuaacauguua

SEQ ID NO: 3137213 - RNA, 19 nt, Human
guauaauuaacauguuaaa

SEQ ID NO: 3137214 - RNA, 22 nt, Human
guauaauuaacauguuaaacca

SEQ ID NO: 3137215 - RNA, 21 nt, Human
guaugugugaagugagugagu

SEQ ID NO: 3137216 - RNA, 14 nt, Human
guauagauuagaau

SEQ ID NO: 3137217 - RNA, 19 nt, Human
guauagaaccucuuugucu

SEQ ID NO: 3137218 - RNA, 14 nt, Human
gucccauucccugg

SEQ ID NO: 3137219 - RNA, 15 nt, Human
gucccauucccuggg

SEQ ID NO: 3137220 - RNA, 16 nt, Human
gucccauucccuggga

SEQ ID NO: 3137221 - RNA, 17 nt, Human
gucccauucccugggau

SEQ ID NO: 3137222 - RNA, 16 nt, Human
gucagaucugccuaag

SEQ ID NO: 3137223 - RNA, 18 nt, Human
gucagaucugccuaagga

SEQ ID NO: 3137224 - RNA, 21 nt, Human
gucagaucugccuaaggacuu

SEQ ID NO: 3137225 - RNA, 19 nt, Human
gucagaucugccuaaggac

SEQ ID NO: 3137226 - RNA, 20 nt, Human
gucagaucugccuaaggacu

SEQ ID NO: 3137227 - RNA, 18 nt, Human
guauuaagcauauauuuu

SEQ ID NO: 3137228 - RNA, 21 nt, Human
guauuaagcauauauuuuuau

SEQ ID NO: 3137229 - RNA, 16 nt, Human
guauuaagcauauauu

SEQ ID NO: 3137230 - RNA, 17 nt, Human
guauuaagcauauauuu

SEQ ID NO: 3137231 - RNA, 15 nt, Human
guauuaagcauauau

SEQ ID NO: 3137232 - RNA, 21 nt, Human
uuuuggcauaacauaaaucug

SEQ ID NO: 3137233 - RNA, 19 nt, Human
uuuuggcaucucuguccca

SEQ ID NO: 3137234 - RNA, 22 nt, Human
uuuggaauuuuccuccuuucuc

SEQ ID NO: 3137235 - RNA, 16 nt, Human
uuuggauaauaaggaa

SEQ ID NO: 3137236 - RNA, 11 nt, Human
cuaaggacuug

SEQ ID NO: 3137237 - RNA, 16 nt, Human
cuaaggacuuguuaga

SEQ ID NO: 3137238 - RNA, 17 nt, Human
cuaaggacuuguuagau

SEQ ID NO: 3137239 - RNA, 22 nt, Human
cuaaggacuucuuuaauuuugg

SEQ ID NO: 3137240 - RNA, 19 nt, Human
cuaggauaaaaagccaggg

SEQ ID NO: 3137241 - RNA, 21 nt, Human
cuaggauaaaaagccagggcu

SEQ ID NO: 3137242 - RNA, 22 nt, Human
cuaggauaaaaagccagggcug

SEQ ID NO: 3137243 - RNA, 19 nt, Human
cuaggagaggagaaccaga

SEQ ID NO: 3137244 - RNA, 19 nt, Human
cuauauuuucauucuccua

SEQ ID NO: 3137245 - RNA, 12 nt, Human
cuaguucacucu

SEQ ID NO: 3137246 - RNA, 16 nt, Human
cuaaauccauuuggaa

SEQ ID NO: 3137247 - RNA, 17 nt, Human
cuaaauccauuuggaaa

SEQ ID NO: 3137248 - RNA, 19 nt, Human
cuaaauccauuuggaaauc

SEQ ID NO: 3137249 - RNA, 20 nt, Human
cuaaauccauuuggaaaucu

SEQ ID NO: 3137250 - RNA, 18 nt, Human
cguugaaauuguaauuau

SEQ ID NO: 3137251 - RNA, 23 nt, Human
cguugaaauuguaauuauaucug

SEQ ID NO: 3137252 - RNA, 20 nt, Human
cguggagcuuaagccacugc

SEQ ID NO: 3137253 - RNA, 19 nt, Human
cguggaggagguugggagg

SEQ ID NO: 3137254 - RNA, 12 nt, Human
cgugcuaaggac

SEQ ID NO: 3137255 - RNA, 13 nt, Human
cgugcuaaggacu

SEQ ID NO: 3137256 - RNA, 14 nt, Human
cgugcuaaggacuu

SEQ ID NO: 3137257 - RNA, 15 nt, Human
cgugcuaaggacuug

SEQ ID NO: 3137258 - RNA, 16 nt, Human
cgugcuaaggacuugu

SEQ ID NO: 3137259 - RNA, 12 nt, Human
cgugcugggcag

SEQ ID NO: 3137260 - RNA, 13 nt, Human
cgugcugggcagc

SEQ ID NO: 3137261 - RNA, 15 nt, Human
cgugcugggcagccc

SEQ ID NO: 3137262 - RNA, 16 nt, Human
cgugcugggcagcccg

SEQ ID NO: 3137263 - RNA, 17 nt, Human
cggugcggcagggaaga

SEQ ID NO: 3137264 - RNA, 16 nt, Human
cgucuuccgucucccc

SEQ ID NO: 3137265 - RNA, 17 nt, Human
cgucuuccgucuccccc

SEQ ID NO: 3137266 - RNA, 22 nt, Human
cgcuugggcgccgugcugggca

SEQ ID NO: 3137267 - RNA, 22 nt, Human
cggugaauggcuuuguauagaa

SEQ ID NO: 3137268 - RNA, 18 nt, Human
cggugaauggcuuuguau

SEQ ID NO: 3137269 - RNA, 20 nt, Human
cggugaauggcuuuguauag

SEQ ID NO: 3137270 - RNA, 13 nt, Human
cggugaauggcuu

SEQ ID NO: 3137271 - RNA, 14 nt, Human
cggugaauggcuuu

SEQ ID NO: 3137272 - RNA, 15 nt, Human
cggugaauggcuuug

SEQ ID NO: 3137273 - RNA, 16 nt, Human
cggugaauggcuuugu

SEQ ID NO: 3137274 - RNA, 17 nt, Human
cgggcaaaugccagggc

SEQ ID NO: 3137275 - RNA, 18 nt, Human
cgggcaaaugccagggcc

SEQ ID NO: 3137276 - RNA, 20 nt, Human
cgggcaaaugccagggcccg

SEQ ID NO: 3137277 - RNA, 22 nt, Human
cgggcaaaugccagggcccgca

SEQ ID NO: 3137278 - RNA, 15 nt, Human
cugacaugcccuccc

SEQ ID NO: 3137279 - RNA, 17 nt, Human
cugacaugcccucccuu

SEQ ID NO: 3137280 - RNA, 19 nt, Human
cugacaugcccucccuucu

SEQ ID NO: 3137281 - RNA, 20 nt, Human
cugacaugcccucccuucuc

SEQ ID NO: 3137282 - RNA, 13 nt, Human
cuccccagccugg

SEQ ID NO: 3137283 - RNA, 14 nt, Human
cuccccagccuggg

SEQ ID NO: 3137284 - RNA, 16 nt, Human
cuccccagccugggcc

SEQ ID NO: 3137285 - RNA, 14 nt, Human
cuccucccauguca

SEQ ID NO: 3137286 - RNA, 19 nt, Human
cuccucccaugucacugca

SEQ ID NO: 3137287 - RNA, 20 nt, Human
cuccucccaugucacugcag

SEQ ID NO: 3137288 - RNA, 16 nt, Human
cuguauagauuagaga

SEQ ID NO: 3137289 - RNA, 15 nt, Human
cuguauagauuagag

SEQ ID NO: 3137290 - RNA, 20 nt, Human
cuguauagauuagaauucug

SEQ ID NO: 3137291 - RNA, 13 nt, Human
cugucccauuccc

SEQ ID NO: 3137292 - RNA, 14 nt, Human
cugucccauucccu

SEQ ID NO: 3137293 - RNA, 15 nt, Human
cugucccauucccug

SEQ ID NO: 3137294 - RNA, 16 nt, Human
cugucccauucccugg

SEQ ID NO: 3137295 - RNA, 17 nt, Human
cugucccauucccuggg

SEQ ID NO: 3137296 - RNA, 18 nt, Human
cugucccauucccuggga

SEQ ID NO: 3137297 - RNA, 23 nt, Human
cugucccauucccugggaucugg

SEQ ID NO: 3137298 - RNA, 15 nt, Human
cugggaucugguggu

SEQ ID NO: 3137299 - RNA, 16 nt, Human
cugggaucuggugguc

SEQ ID NO: 3137300 - RNA, 14 nt, Human
cugggcccaucucc

SEQ ID NO: 3137301 - RNA, 17 nt, Human
cugggcccaucucccug

SEQ ID NO: 3137302 - RNA, 18 nt, Human
cugggcccaucucccugc

SEQ ID NO: 3137303 - RNA, 19 nt, Human
cugggcccaucucccugcu

SEQ ID NO: 3137304 - RNA, 21 nt, Human
cugggcccaucucccugcuuu

SEQ ID NO: 3137305 - RNA, 13 nt, Human
cugcgccacugcu

SEQ ID NO: 3137306 - RNA, 20 nt, Human
cugcgccacugcuccgugga

SEQ ID NO: 3137307 - RNA, 17 nt, Human
cugcccugccccaaguu

SEQ ID NO: 3137308 - RNA, 18 nt, Human
cugcuuuucuuuucuaac

SEQ ID NO: 3137309 - RNA, 18 nt, Human
cugcuuugcgugcccggg

SEQ ID NO: 3137310 - RNA, 20 nt, Human
cugcuuugcgugcccggggc

SEQ ID NO: 3137311 - RNA, 21 nt, Human
cugcuuugcgugcccggggca

SEQ ID NO: 3137312 - RNA, 23 nt, Human
cugcuuugcgugcccggggcagc

SEQ ID NO: 3137313 - RNA, 12 nt, Human
cugcuuucagau

SEQ ID NO: 3137314 - RNA, 15 nt, Human
cugcuuucagauacu

SEQ ID NO: 3137315 - RNA, 17 nt, Human
cugcagguugaagccau

SEQ ID NO: 3137316 - RNA, 19 nt, Human
cugcagguugaagccaugu

SEQ ID NO: 3137317 - RNA, 21 nt, Human
cugcagguugaagccaugucu

SEQ ID NO: 3137318 - RNA, 13 nt, Human
cugccccaaguug

SEQ ID NO: 3137319 - RNA, 16 nt, Human
cugccccacaccuccu

SEQ ID NO: 3137320 - RNA, 18 nt, Human
cugccccacaccuccucu

SEQ ID NO: 3137321 - RNA, 20 nt, Human
cugccccacaccuccucuca

SEQ ID NO: 3137322 - RNA, 22 nt, Human
cugccccacaccuccucucacu

SEQ ID NO: 3137323 - RNA, 16 nt, Human
gaagaguggaggugga

SEQ ID NO: 3137324 - RNA, 12 nt, Human
gaacuugaaauu

SEQ ID NO: 3137325 - RNA, 13 nt, Human
gaacuugaaauuu

SEQ ID NO: 3137326 - RNA, 15 nt, Human
gaacuugaaauuuga

SEQ ID NO: 3137327 - RNA, 22 nt, Human
gaacuugaaauuugaauuuugu

SEQ ID NO: 3137328 - RNA, 22 nt, Human
gaagucagaucugccuaaggac

SEQ ID NO: 3137329 - RNA, 23 nt, Human
gaagucagaucugccuaaggacu

SEQ ID NO: 3137330 - RNA, 14 nt, Human
gaagucagaucugc

SEQ ID NO: 3137331 - RNA, 19 nt, Human
gaaacugacaugcccuccc

SEQ ID NO: 3137332 - RNA, 16 nt, Human
gaaacggaugauuucu

SEQ ID NO: 3137333 - RNA, 13 nt, Human
gaaauuugaauuu

SEQ ID NO: 3137334 - RNA, 16 nt, Human
gaaauuugaauuuugu

SEQ ID NO: 3137335 - RNA, 24 nt, Human
gaaauuugaauuuuguguuagaga

SEQ ID NO: 3137336 - RNA, 21 nt, Human
cuuuuucauuauuuuauuaug

SEQ ID NO: 3137337 - RNA, 20 nt, Human
cuuuucuaaccaagaggcug

SEQ ID NO: 3137338 - RNA, 21 nt, Human
cuuuucuaaccaagaggcugg

SEQ ID NO: 3137339 - RNA, 22 nt, Human
cuuuucuaaccaagaggcuggu

SEQ ID NO: 3137340 - RNA, 15 nt, Human
cuuuucuuuucuaac

SEQ ID NO: 3137341 - RNA, 19 nt, Human
cuugaaauuugaauuuugu

SEQ ID NO: 3137342 - RNA, 20 nt, Human
cuugaaauuugaauuuugug

SEQ ID NO: 3137343 - RNA, 17 nt, Human
cuuggagcguggacugg

SEQ ID NO: 3137344 - RNA, 18 nt, Human
cuuggagcguggacuggu

SEQ ID NO: 3137345 - RNA, 13 nt, Human
gaccuacaggcug

SEQ ID NO: 3137346 - RNA, 13 nt, Human
gacaggacgcuga

SEQ ID NO: 3137347 - RNA, 21 nt, Human
gacaggacgcugaccguggag

SEQ ID NO: 3137348 - RNA, 22 nt, Human
gacaggacgcugaccguggagc

SEQ ID NO: 3137349 - RNA, 13 nt, Human
gaccaaaaaccag

SEQ ID NO: 3137350 - RNA, 19 nt, Human
gaccaaaaaccaguauugu

SEQ ID NO: 3137351 - RNA, 20 nt, Human
gaccaaaaaccaguauugua

SEQ ID NO: 3137352 - RNA, 14 nt, Human
gacauggcuguuca

SEQ ID NO: 3137353 - RNA, 16 nt, Human
gacauagucuggcugu

SEQ ID NO: 3137354 - RNA, 19 nt, Human
gagaacaagaaagggccag

SEQ ID NO: 3137355 - RNA, 12 nt, Human
gacuuguuagau

SEQ ID NO: 3137356 - RNA, 18 nt, Human
gaggaagccugauuaaag

SEQ ID NO: 3137357 - RNA, 19 nt, Human
gaggaagccugauuaaaga

SEQ ID NO: 3137358 - RNA, 23 nt, Human
gaugacauucuggucucgucuuc

SEQ ID NO: 3137359 - RNA, 20 nt, Human
gauuuuauuauguaaauccc

SEQ ID NO: 3137360 - RNA, 23 nt, Human
gauuuuauuauguaaaucccauu

SEQ ID NO: 3137361 - RNA, 13 nt, Human
gauuuuauuaugu

SEQ ID NO: 3137362 - RNA, 15 nt, Human
gauuuuauuauguaa

SEQ ID NO: 3137363 - RNA, 18 nt, Human
gauuuuauuauguaaauc

SEQ ID NO: 3137364 - RNA, 19 nt, Human
gauuuuauuauguaaaucc

SEQ ID NO: 3137365 - RNA, 20 nt, Human
gcauauauuuuuauauuuac

SEQ ID NO: 3137366 - RNA, 18 nt, Human
gcacgguggugaggcagu

SEQ ID NO: 3137367 - RNA, 18 nt, Human
gcacggugaauggcuuug

SEQ ID NO: 3137368 - RNA, 16 nt, Human
gcagcccugccccaca

SEQ ID NO: 3137369 - RNA, 19 nt, Human
gcagcccugccccacaccu

SEQ ID NO: 3137370 - RNA, 22 nt, Human
gcagcccugccccacaccuccu

SEQ ID NO: 3137371 - RNA, 18 nt, Human
gcagauuauucacugauu

SEQ ID NO: 3137372 - RNA, 17 nt, Human
gcagauugagaccuaca

SEQ ID NO: 3137373 - RNA, 19 nt, Human
gcagauugagaccuacagg

SEQ ID NO: 3137374 - RNA, 23 nt, Human
gcagauugagaccuacaggcuga

SEQ ID NO: 3137375 - RNA, 16 nt, Human
gcagauuauucacuga

SEQ ID NO: 3137376 - RNA, 18 nt, Human
gcagcccgcuaggcucgc

SEQ ID NO: 3137377 - RNA, 23 nt, Human
gccuuuuucauuauuuuauuaug

SEQ ID NO: 3137378 - RNA, 13 nt, Human
gcuaaacuuuucu

SEQ ID NO: 3137379 - RNA, 15 nt, Human
gcuaaacuuuucuga

SEQ ID NO: 3137380 - RNA, 17 nt, Human
gcuaaacuuuucugaua

SEQ ID NO: 3137381 - RNA, 14 nt, Human
gcgccgugcugggc

SEQ ID NO: 3137382 - RNA, 15 nt, Human
gcgccgugcugggca

SEQ ID NO: 3137383 - RNA, 16 nt, Human
gcgccgugcugggcag

SEQ ID NO: 3137384 - RNA, 17 nt, Human
gcgccgugcugggcagc

SEQ ID NO: 3137385 - RNA, 18 nt, Human
gcgccgugcugggcagcc

SEQ ID NO: 3137386 - RNA, 20 nt, Human
gcgccgugcugggcagcccg

SEQ ID NO: 3137387 - RNA, 12 nt, Human
gccuaaauccau

SEQ ID NO: 3137388 - RNA, 13 nt, Human
gccuaaauccauu

SEQ ID NO: 3137389 - RNA, 19 nt, Human
gccuaaauccauuuggaaa

SEQ ID NO: 3137390 - RNA, 21 nt, Human
gccuaaauccauuuggaaauc

SEQ ID NO: 3137391 - RNA, 11 nt, Human
gccuaaaucca

SEQ ID NO: 3137392 - RNA, 22 nt, Human
gccuaaauccauuuggaaaucu

SEQ ID NO: 3137393 - RNA, 23 nt, Human
gccuaaauccauuuggaaaucuu

SEQ ID NO: 3137394 - RNA, 15 nt, Human
gccgugcugggcagc

SEQ ID NO: 3137395 - RNA, 16 nt, Human
gccgugcugggcagcc

SEQ ID NO: 3137396 - RNA, 17 nt, Human
gccgugcugggcagccc

SEQ ID NO: 3137397 - RNA, 18 nt, Human
gccgugcugggcagcccg

SEQ ID NO: 3137398 - RNA, 16 nt, Human
gccggucaggcacaca

SEQ ID NO: 3137399 - RNA, 14 nt, Human
gcccugcuuucaga

SEQ ID NO: 3137400 - RNA, 16 nt, Human
gcccugcuuucagaua

SEQ ID NO: 3137401 - RNA, 12 nt, Human
gcccuuggagcg

SEQ ID NO: 3137402 - RNA, 15 nt, Human
gcccuuggagcgugg

SEQ ID NO: 3137403 - RNA, 21 nt, Human
gcccuuggagcguggacuggu

SEQ ID NO: 3137404 - RNA, 15 nt, Human
gccgacauugucucc

SEQ ID NO: 3137405 - RNA, 16 nt, Human
gccgacauugucuccc

SEQ ID NO: 3137406 - RNA, 17 nt, Human
gccgacauugucucccg

SEQ ID NO: 3137407 - RNA, 24 nt, Human
gccaucaauaaaaaauuaugacau

SEQ ID NO: 3137408 - RNA, 9 nt, Human
gccaggaga

SEQ ID NO: 3137409 - RNA, 15 nt, Human
gcccccuuucccggg

SEQ ID NO: 3137410 - RNA, 16 nt, Human
gcccccuuucccgggc

SEQ ID NO: 3137411 - RNA, 17 nt, Human
gcccccuuucccgggcu

SEQ ID NO: 3137412 - RNA, 18 nt, Human
gcccccuuucccgggcug

SEQ ID NO: 3137413 - RNA, 20 nt, Human
gcccccuuucccgggcuguc

SEQ ID NO: 3137414 - RNA, 23 nt, Human
gcccccuuucccgggcuguccac

SEQ ID NO: 3137415 - RNA, 17 nt, Human
gcccucccuucucccug

SEQ ID NO: 3137416 - RNA, 18 nt, Human
gcccucccuucucccugg

SEQ ID NO: 3137417 - RNA, 19 nt, Human
gcccucccuucucccugga

SEQ ID NO: 3137418 - RNA, 20 nt, Human
gcccucccuucucccuggau

SEQ ID NO: 3137419 - RNA, 13 nt, Human
gccccaucacugc

SEQ ID NO: 3137420 - RNA, 22 nt, Human
gccccaucacugcgccacugcu

SEQ ID NO: 3137421 - RNA, 22 nt, Human
cauauauuuuuauauuuacuaa

SEQ ID NO: 3137422 - RNA, 14 nt, Human
cauagagcagcacu

SEQ ID NO: 3137423 - RNA, 13 nt, Human
caucucuguccca

SEQ ID NO: 3137424 - RNA, 19 nt, Human
caucucugucccauucccu

SEQ ID NO: 3137425 - RNA, 20 nt, Human
caucucugucccauucccug

SEQ ID NO: 3137426 - RNA, 21 nt, Human
caucucugucccauucccugg

SEQ ID NO: 3137427 - RNA, 22 nt, Human
caucucugucccauucccuggg

SEQ ID NO: 3137428 - RNA, 23 nt, Human
caucucugucccauucccuggga

SEQ ID NO: 3137429 - RNA, 21 nt, Human
cauaacauaaaucugugaacu

SEQ ID NO: 3137430 - RNA, 12 nt, Human
cauaacauaaau

SEQ ID NO: 3137431 - RNA, 19 nt, Human
cauaacauaaaucugugaa

SEQ ID NO: 3137432 - RNA, 14 nt, Human
cauaaaucugugaa

SEQ ID NO: 3137433 - RNA, 16 nt, Human
cauaaaucugugaacu

SEQ ID NO: 3137434 - RNA, 18 nt, Human
cauaaaucugugaacuug

SEQ ID NO: 3137435 - RNA, 22 nt, Human
cauaaaucugugaacuugaaau

SEQ ID NO: 3137436 - RNA, 23 nt, Human
cauaaaucugugaacuugaaauu

SEQ ID NO: 3137437 - RNA, 21 nt, Human
caguuuuguuuggaccaaaaa

SEQ ID NO: 3137438 - RNA, 20 nt, Human
caguugagaaaauuugaaug

SEQ ID NO: 3137439 - RNA, 19 nt, Human
cauacccgccuagcugcug

SEQ ID NO: 3137440 - RNA, 20 nt, Human
cauacccgccuagcugcugu

SEQ ID NO: 3137441 - RNA, 22 nt, Human
cauacccgccuagcugcuguca

SEQ ID NO: 3137442 - RNA, 19 nt, Human
cauggaacgcguugaaauu

SEQ ID NO: 3137443 - RNA, 20 nt, Human
cauggaacgcguugaaauug

SEQ ID NO: 3137444 - RNA, 23 nt, Human
cauggaacgcguugaaauuguaa

SEQ ID NO: 3137445 - RNA, 18 nt, Human
cauggaacgcguugaaau

SEQ ID NO: 3137446 - RNA, 13 nt, Human
caugcccucccuu

SEQ ID NO: 3137447 - RNA, 14 nt, Human
caugcccucccuuc

SEQ ID NO: 3137448 - RNA, 15 nt, Human
caugcccucccuucu

SEQ ID NO: 3137449 - RNA, 20 nt, Human
caugcccucccuucucccug

SEQ ID NO: 3137450 - RNA, 21 nt, Human
caugcccucccuucucccugg

SEQ ID NO: 3137451 - RNA, 22 nt, Human
caugcccucccuucucccugga

SEQ ID NO: 3137452 - RNA, 23 nt, Human
caugcccucccuucucccuggau

SEQ ID NO: 3137453 - RNA, 22 nt, Human
caugcagguggugucgggcccu

SEQ ID NO: 3137454 - RNA, 21 nt, Human
cauuaaagccugaguuugcuu

SEQ ID NO: 3137455 - RNA, 11 nt, Human
cauuauuuuau

SEQ ID NO: 3137456 - RNA, 13 nt, Human
cauguuuauuaca

SEQ ID NO: 3137457 - RNA, 18 nt, Human
cauguuuauuacaguaua

SEQ ID NO: 3137458 - RNA, 19 nt, Human
cauguuuauuacaguauaa

SEQ ID NO: 3137459 - RNA, 20 nt, Human
cauguuuauuacaguauaau

SEQ ID NO: 3137460 - RNA, 12 nt, Human
cauguuuauuac

SEQ ID NO: 3137461 - RNA, 10 nt, Human
ccaagaggcu

SEQ ID NO: 3137462 - RNA, 11 nt, Human
ccaagaggcug

SEQ ID NO: 3137463 - RNA, 23 nt, Human
ccacaaaugggcgccccccccuc

SEQ ID NO: 3137464 - RNA, 23 nt, Human
cauuuuguuguguguaugcugcu

SEQ ID NO: 3137465 - RNA, 12 nt, Human
cauuauuuuauu

SEQ ID NO: 3137466 - RNA, 14 nt, Human
cauuauuuuauuau

SEQ ID NO: 3137467 - RNA, 16 nt, Human
cauuauuuuauuauga

SEQ ID NO: 3137468 - RNA, 14 nt, Human
ccaucacugcgcca

SEQ ID NO: 3137469 - RNA, 18 nt, Human
ccaucacugcgccacugc

SEQ ID NO: 3137470 - RNA, 19 nt, Human
ccaucacugcgccacugcu

SEQ ID NO: 3137471 - RNA, 21 nt, Human
ccaucacugcgccacugcucc

SEQ ID NO: 3137472 - RNA, 13 nt, Human
cccagccugggcc

SEQ ID NO: 3137473 - RNA, 15 nt, Human
cccagccugggccca

SEQ ID NO: 3137474 - RNA, 21 nt, Human
cccagccugggcccaucuccc

SEQ ID NO: 3137475 - RNA, 23 nt, Human
cccagccugggcccaucucccug

SEQ ID NO: 3137476 - RNA, 12 nt, Human
cccagccugggc

SEQ ID NO: 3137477 - RNA, 12 nt, Human
ccauucccuggg

SEQ ID NO: 3137478 - RNA, 19 nt, Human
ccauucccugggaucuggu

SEQ ID NO: 3137479 - RNA, 14 nt, Human
ccccacacuucccu

SEQ ID NO: 3137480 - RNA, 16 nt, Human
ccccacacuucccugg

SEQ ID NO: 3137481 - RNA, 17 nt, Human
ccccacacuucccuggc

SEQ ID NO: 3137482 - RNA, 18 nt, Human
ccccacacuucccuggcg

SEQ ID NO: 3137483 - RNA, 13 nt, Human
ccccagccugggc

SEQ ID NO: 3137484 - RNA, 15 nt, Human
ccccagccugggccc

SEQ ID NO: 3137485 - RNA, 21 nt, Human
ccccagccugggcccaucucc

SEQ ID NO: 3137486 - RNA, 16 nt, Human
cccucccuucucccug

SEQ ID NO: 3137487 - RNA, 17 nt, Human
cccucccuucucccugg

SEQ ID NO: 3137488 - RNA, 18 nt, Human
cccugggaucuggugguc

SEQ ID NO: 3137489 - RNA, 20 nt, Human
cccugggaucugguggucag

SEQ ID NO: 3137490 - RNA, 12 nt, Human
cccuggaggcgg

SEQ ID NO: 3137491 - RNA, 23 nt, Human
cccuggaggcggugcggcaggga

SEQ ID NO: 3137492 - RNA, 18 nt, Human
ccucucccucugguccca

SEQ ID NO: 3137493 - RNA, 13 nt, Human
ccuccucucacuc

SEQ ID NO: 3137494 - RNA, 14 nt, Human
ccuccucucacucc

SEQ ID NO: 3137495 - RNA, 21 nt, Human
ccuccucucacuccccagccu

SEQ ID NO: 3137496 - RNA, 14 nt, Human
ccucucccuucccu

SEQ ID NO: 3137497 - RNA, 15 nt, Human
ccucucccuucccuc

SEQ ID NO: 3137498 - RNA, 16 nt, Human
ccucucccuucccucc

SEQ ID NO: 3137499 - RNA, 17 nt, Human
ccucucccuucccuccu

SEQ ID NO: 3137500 - RNA, 10 nt, Human
ccucucccuu

SEQ ID NO: 3137501 - RNA, 20 nt, Human
ccuaaauccauuuggaaauc

SEQ ID NO: 3137502 - RNA, 21 nt, Human
ccuaaauccauuuggaaaucu

SEQ ID NO: 3137503 - RNA, 18 nt, Human
ccuaaauccauuuggaaa

SEQ ID NO: 3137504 - RNA, 19 nt, Human
ccuaaauccauuuggaaau

SEQ ID NO: 3137505 - RNA, 14 nt, Human
ccguguuccccucu

SEQ ID NO: 3137506 - RNA, 12 nt, Human
cccuuucccggg

SEQ ID NO: 3137507 - RNA, 14 nt, Human
cccuuucccgggcu

SEQ ID NO: 3137508 - RNA, 17 nt, Human
ccggggcagcagcagcc

SEQ ID NO: 3137509 - RNA, 18 nt, Human
ccggggcagcagcagccc

SEQ ID NO: 3137510 - RNA, 19 nt, Human
ccggggcagcagcagcccu

SEQ ID NO: 3137511 - RNA, 23 nt, Human
ccggggcagcagcagcccugccc

SEQ ID NO: 3137512 - RNA, 20 nt, Human
ccguggaggagguugggagg

SEQ ID NO: 3137513 - RNA, 19 nt, Human
cccuuggagcguggacugg

SEQ ID NO: 3137514 - RNA, 23 nt, Human
aaagccauguuuauuacaguaua

SEQ ID NO: 3137515 - RNA, 17 nt, Human
aaagccauguuuauuac

SEQ ID NO: 3137516 - RNA, 18 nt, Human
aaagccauguuuauuaca

SEQ ID NO: 3137517 - RNA, 14 nt, Human
aaagccauguuuau

SEQ ID NO: 3137518 - RNA, 16 nt, Human
aaagccauguuuauua

SEQ ID NO: 3137519 - RNA, 22 nt, Human
aaaccaguauuguacaaaguau

SEQ ID NO: 3137520 - RNA, 14 nt, Human
aaaccaguauugua

SEQ ID NO: 3137521 - RNA, 16 nt, Human
aaaccaguauuguaca

SEQ ID NO: 3137522 - RNA, 17 nt, Human
aaaccaguauuguacaa

SEQ ID NO: 3137523 - RNA, 18 nt, Human
aaaccaguauuguacaaa

SEQ ID NO: 3137524 - RNA, 18 nt, Human
aaaaguuuaauauuaaag

SEQ ID NO: 3137525 - RNA, 14 nt, Human
aaaaguuuaauauu

SEQ ID NO: 3137526 - RNA, 16 nt, Human
aaaaguuuaauauuaa

SEQ ID NO: 3137527 - RNA, 14 nt, Human
aaaagacugucuua

SEQ ID NO: 3137528 - RNA, 19 nt, Human
aaaugcuguaacuuucuga

SEQ ID NO: 3137529 - RNA, 23 nt, Human
aaauggacuguggugacuuugga

SEQ ID NO: 3137530 - RNA, 21 nt, Human
aaauggacuguggugacuuug

SEQ ID NO: 3137531 - RNA, 20 nt, Human
aaauggacuguggugacuuu

SEQ ID NO: 3137532 - RNA, 23 nt, Human
aacauggccuuugcuugaaagaa

SEQ ID NO: 3137533 - RNA, 22 nt, Human
aacauggccuuugcuugaaaga

SEQ ID NO: 3137534 - RNA, 23 nt, Human
aagacagauacuccuccaagguu

SEQ ID NO: 3137535 - RNA, 14 nt, Human
aagccagggcugga

SEQ ID NO: 3137536 - RNA, 16 nt, Human
aagccagggcuggaga

SEQ ID NO: 3137537 - RNA, 17 nt, Human
aagccagggcuggagaa

SEQ ID NO: 3137538 - RNA, 15 nt, Human
aaggacuuguuagau

SEQ ID NO: 3137539 - RNA, 21 nt, Human
aaggacuuguuagaucuaguu

SEQ ID NO: 3137540 - RNA, 23 nt, Human
aaggacuucuuuaauuuuggaau

SEQ ID NO: 3137541 - RNA, 23 nt, Human
aaggacuuguuagaucuaguuca

SEQ ID NO: 3137542 - RNA, 22 nt, Human
aauauuaaagccauguuuauua

SEQ ID NO: 3137543 - RNA, 14 nt, Human
aaguugaauuuauu

SEQ ID NO: 3137544 - RNA, 15 nt, Human
aaguugaauuuauug

SEQ ID NO: 3137545 - RNA, 17 nt, Human
aaguugaauuuauuggc

SEQ ID NO: 3137546 - RNA, 15 nt, Human
aaguuuaauauuaaa

SEQ ID NO: 3137547 - RNA, 17 nt, Human
aaguuuaauauuaaagc

SEQ ID NO: 3137548 - RNA, 19 nt, Human
aaguugggaucuaggagag

SEQ ID NO: 3137549 - RNA, 23 nt, Human
aaguugaauuuauuggcuuuucu

SEQ ID NO: 3137550 - RNA, 24 nt, Human
aaguugaauuuauuggcuuuucug

SEQ ID NO: 3137551 - RNA, 16 nt, Human
acugacaugcccuccc

SEQ ID NO: 3137552 - RNA, 17 nt, Human
acugacaugcccucccu

SEQ ID NO: 3137553 - RNA, 21 nt, Human
acugacaugcccucccuucuc

SEQ ID NO: 3137554 - RNA, 22 nt, Human
acugauuugacauagucuggcu

SEQ ID NO: 3137555 - RNA, 18 nt, Human
acuucuuuaauuuuggaa

SEQ ID NO: 3137556 - RNA, 19 nt, Human
acuucuuuaauuuuggaau

SEQ ID NO: 3137557 - RNA, 20 nt, Human
acuggugacugauucuucag

SEQ ID NO: 3137558 - RNA, 16 nt, Human
acuggugacugauucu

SEQ ID NO: 3137559 - RNA, 18 nt, Human
acuggugacugauucuuc

SEQ ID NO: 3137560 - RNA, 19 nt, Human
acuggugacugauucuuca

SEQ ID NO: 3137561 - RNA, 23 nt, Human
acauguuaaaccaugggauaaau

SEQ ID NO: 3137562 - RNA, 16 nt, Human
acauguuaaaccaugg

SEQ ID NO: 3137563 - RNA, 21 nt, Human
acauguuaaaccaugggauaa

SEQ ID NO: 3137564 - RNA, 14 nt, Human
acauguuaaaccau

SEQ ID NO: 3137565 - RNA, 17 nt, Human
aauuguaauuauaucug

SEQ ID NO: 3137566 - RNA, 15 nt, Human
aauuguaauuauauc

SEQ ID NO: 3137567 - RNA, 16 nt, Human
aauuguaauuauaucu

SEQ ID NO: 3137568 - RNA, 14 nt, Human
aauuguaauuauau

SEQ ID NO: 3137569 - RNA, 20 nt, Human
aauuauaugcuauuucuaua

SEQ ID NO: 3137570 - RNA, 21 nt, Human
aauuauaugcuauuucuauau

SEQ ID NO: 3137571 - RNA, 20 nt, Human
aauuauaucugaggaauucu

SEQ ID NO: 3137572 - RNA, 22 nt, Human
aauuauaucugaggaauucugu

SEQ ID NO: 3137573 - RNA, 23 nt, Human
aauuauaucugaggaauucugua

SEQ ID NO: 3137574 - RNA, 19 nt, Human
aauuauaugcuauuucuau

SEQ ID NO: 3137575 - RNA, 13 nt, Human
aauucuguauaga

SEQ ID NO: 3137576 - RNA, 14 nt, Human
aauucuguauagau

SEQ ID NO: 3137577 - RNA, 20 nt, Human
aauucuguauagauuagaga

SEQ ID NO: 3137578 - RNA, 12 nt, Human
aauucuguauag

SEQ ID NO: 3137579 - RNA, 13 nt, Human
acaaggggcccuu

SEQ ID NO: 3137580 - RNA, 22 nt, Human
acaaggggcccuuggagcgugg

SEQ ID NO: 3137581 - RNA, 22 nt, Human
agaacaagaaagggccaggaga

SEQ ID NO: 3137582 - RNA, 21 nt, Human
agaaucuaacugguggacaug

SEQ ID NO: 3137583 - RNA, 22 nt, Human
agaaucuaacugguggacaugg

SEQ ID NO: 3137584 - RNA, 24 nt, Human
agaaccagauucuauccucaucuu

SEQ ID NO: 3137585 - RNA, 20 nt, Human
agauugagaccuacaggcug

SEQ ID NO: 3137586 - RNA, 13 nt, Human
agaucugccuaag

SEQ ID NO: 3137587 - RNA, 18 nt, Human
agaucugccuaaggacuu

SEQ ID NO: 3137588 - RNA, 17 nt, Human
agauucuauccucaucu

SEQ ID NO: 3137589 - RNA, 13 nt, Human
agaggggugcaga

SEQ ID NO: 3137590 - RNA, 18 nt, Human
agaggggugcagaggcug

SEQ ID NO: 3137591 - RNA, 19 nt, Human
agaggggugcagaggcugu

SEQ ID NO: 3137592 - RNA, 23 nt, Human
agaggggugcagaggcuguggcu

SEQ ID NO: 3137593 - RNA, 14 nt, Human
agcuggugcccugc

SEQ ID NO: 3137594 - RNA, 14 nt, Human
aggagguugggagg

SEQ ID NO: 3137595 - RNA, 22 nt, Human
aggagguugggaggggguuggg

SEQ ID NO: 3137596 - RNA, 14 nt, Human
aggaugugggcagc

SEQ ID NO: 3137597 - RNA, 15 nt, Human
aggaugugggcagcu

SEQ ID NO: 3137598 - RNA, 18 nt, Human
auccagcagauuauucac

SEQ ID NO: 3137599 - RNA, 15 nt, Human
augagcugugagaag

SEQ ID NO: 3137600 - RNA, 18 nt, Human
augaaacuuguguaaaua

SEQ ID NO: 3137601 - RNA, 14 nt, Human
aucuaggagaggag

SEQ ID NO: 3137602 - RNA, 16 nt, Human
aucuaggagaggagaa

SEQ ID NO: 3137603 - RNA, 15 nt, Human
auggcuuuguauaga

SEQ ID NO: 3137604 - RNA, 16 nt, Human
auggcuuuguauagaa

SEQ ID NO: 3137605 - RNA, 16 nt, Human
auaaaaaauuaugaca

SEQ ID NO: 3137606 - RNA, 14 nt, Human
auacaauuuuguuu

SEQ ID NO: 3137607 - RNA, 16 nt, Human
auacaauuuuguuucu

SEQ ID NO: 3137608 - RNA, 17 nt, Human
auacaauuuuguuucug

SEQ ID NO: 3137609 - RNA, 19 nt, Human
agucuggcuguacccagga

SEQ ID NO: 3137610 - RNA, 21 nt, Human
agucuggcuguacccaggaau

SEQ ID NO: 3137611 - RNA, 21 nt, Human
gcucgccuucccuccugcuuu

SEQ ID NO: 3137612 - RNA, 22 nt, Human
gcucgccuucccuccugcuuug

SEQ ID NO: 3137613 - RNA, 12 nt, Human
gcugggcagccc

SEQ ID NO: 3137614 - RNA, 13 nt, Human
gcugggcagcccg

SEQ ID NO: 3137615 - RNA, 14 nt, Human
gcugggcagcccgc

SEQ ID NO: 3137616 - RNA, 17 nt, Human
gcuggaggaugugggca

SEQ ID NO: 3137617 - RNA, 19 nt, Human
gcuggaggaugugggcagc

SEQ ID NO: 3137618 - RNA, 20 nt, Human
gcuggaggaugugggcagcu

SEQ ID NO: 3137619 - RNA, 16 nt, Human
gcuugggcgccgugcu

SEQ ID NO: 3137620 - RNA, 23 nt, Human
gcuugggcgccgugcugggcagc

SEQ ID NO: 3137621 - RNA, 12 nt, Human
gccacugccucu

SEQ ID NO: 3137622 - RNA, 15 nt, Human
gccacugcuccgugg

SEQ ID NO: 3137623 - RNA, 16 nt, Human
gccacugcuccgugga

SEQ ID NO: 3137624 - RNA, 19 nt, Human
gccacugcuccguggagga

SEQ ID NO: 3137625 - RNA, 13 nt, Human
gccacugccucuc

SEQ ID NO: 3137626 - RNA, 15 nt, Human
gccacugccucuccc

SEQ ID NO: 3137627 - RNA, 16 nt, Human
gccacugccucucccu

SEQ ID NO: 3137628 - RNA, 18 nt, Human
gccacccccgcuggagga

SEQ ID NO: 3137629 - RNA, 19 nt, Human
gccacccccgcuggaggau

SEQ ID NO: 3137630 - RNA, 12 nt, Human
gccaugucuaca

SEQ ID NO: 3137631 - RNA, 13 nt, Human
ggcccaucucccu

SEQ ID NO: 3137632 - RNA, 14 nt, Human
ggcccaucucccug

SEQ ID NO: 3137633 - RNA, 15 nt, Human
ggcccaucucccugc

SEQ ID NO: 3137634 - RNA, 16 nt, Human
ggcccaucucccugcu

SEQ ID NO: 3137635 - RNA, 18 nt, Human
ggcccaucucccugcuuu

SEQ ID NO: 3137636 - RNA, 19 nt, Human
ggcccaucucccugcuuug

SEQ ID NO: 3137637 - RNA, 18 nt, Human
ggccccaacucgggcucc

SEQ ID NO: 3137638 - RNA, 19 nt, Human
ggccccaacucgggcuccc

SEQ ID NO: 3137639 - RNA, 15 nt, Human
ggcaaaugccagggc

SEQ ID NO: 3137640 - RNA, 17 nt, Human
ggcaaaugccagggccc

SEQ ID NO: 3137641 - RNA, 18 nt, Human
ggcaaaugccagggcccg

SEQ ID NO: 3137642 - RNA, 13 nt, Human
ggaugugggcagc

SEQ ID NO: 3137643 - RNA, 14 nt, Human
ggaugugggcagcu

SEQ ID NO: 3137644 - RNA, 20 nt, Human
ggagaacaagaaagggccag

SEQ ID NO: 3137645 - RNA, 14 nt, Human
aaaauaccaaggaa

SEQ ID NO: 3137646 - RNA, 20 nt, Human
gggauucuuaaaguugaauu

SEQ ID NO: 3137647 - RNA, 15 nt, Human
gggauucuuaaaguu

SEQ ID NO: 3137648 - RNA, 19 nt, Human
gggcagcuuagggcccugg

SEQ ID NO: 3137649 - RNA, 20 nt, Human
gggcagcuuagggcccugga

SEQ ID NO: 3137650 - RNA, 16 nt, Human
gggcagcagcagcccu

SEQ ID NO: 3137651 - RNA, 17 nt, Human
gggcagcagcagcccug

SEQ ID NO: 3137652 - RNA, 19 nt, Human
gggcagcagcagcccugcc

SEQ ID NO: 3137653 - RNA, 11 nt, Human
gggcuggagaa

SEQ ID NO: 3137654 - RNA, 22 nt, Human
aaaauggacuguggugacuuug

SEQ ID NO: 3137655 - RNA, 21 nt, Human
aaaauuggggauucuuaaagu

SEQ ID NO: 3137656 - RNA, 23 nt, Human
aaaauuggggauucuuaaaguug

SEQ ID NO: 3137657 - RNA, 16 nt, Human
aaacggaugauuucua

SEQ ID NO: 3137658 - RNA, 18 nt, Human
aaacggaugauuucuaug

SEQ ID NO: 3137659 - RNA, 13 nt, Human
aaacuuuucugau

SEQ ID NO: 3137660 - RNA, 14 nt, Human
aaacuuuucugaua

SEQ ID NO: 3137661 - RNA, 12 nt, Human
aaacuuuucuga

SEQ ID NO: 3137662 - RNA, 16 nt, Human
aaacuuuucugauaga

SEQ ID NO: 3137663 - RNA, 17 nt, Human
aaacuuuucugauagag

SEQ ID NO: 3137664 - RNA, 19 nt, Human
ggucccacaaaugggcgcc

SEQ ID NO: 3137665 - RNA, 15 nt, Human
aaacuuguguaaaua

SEQ ID NO: 3137666 - RNA, 17 nt, Human
aaacuuguguaaauaca

SEQ ID NO: 3137667 - RNA, 14 nt, Human
ggucuugccccauc

SEQ ID NO: 3137668 - RNA, 19 nt, Human
ggucuugccccaucacugc

SEQ ID NO: 3137669 - RNA, 21 nt, Human
gagugaguuggguguauugug

SEQ ID NO: 3137670 - RNA, 21 nt, Human
gauuuuuuuguuguuuguuua

SEQ ID NO: 3137671 - RNA, 18 nt, Human
gauuuuuuuguuguuugu

SEQ ID NO: 3137672 - RNA, 23 nt, Human
gauucuucagcaaaaauauuuua

SEQ ID NO: 3137673 - RNA, 22 nt, Human
gauuauucacugauuugacaua

SEQ ID NO: 3137674 - RNA, 21 nt, Human
gauuauucacugauuugacau

SEQ ID NO: 3137675 - RNA, 17 nt, Human
gaucugccuaaggacuu

SEQ ID NO: 3137676 - RNA, 18 nt, Human
gaucugccuaaggacuuc

SEQ ID NO: 3137677 - RNA, 20 nt, Human
gaucugccuaaggacuucuu

SEQ ID NO: 3137678 - RNA, 21 nt, Human
gaucugccuaaggacuucuuu

SEQ ID NO: 3137679 - RNA, 23 nt, Human
gaucugccuaaggacuucuuuaa

SEQ ID NO: 3137680 - RNA, 12 nt, Human
gacauugucucc

SEQ ID NO: 3137681 - RNA, 13 nt, Human
gacauugucuccc

SEQ ID NO: 3137682 - RNA, 20 nt, Human
gacauugucucccgcccccc

SEQ ID NO: 3137683 - RNA, 13 nt, Human
gacuguggugacu

SEQ ID NO: 3137684 - RNA, 14 nt, Human
gacuguggugacuu

SEQ ID NO: 3137685 - RNA, 12 nt, Human
cugggcagcccg

SEQ ID NO: 3137686 - RNA, 13 nt, Human
cugggcagcccgc

SEQ ID NO: 3137687 - RNA, 20 nt, Human
cugggcagcccgcuaggcuc

SEQ ID NO: 3137688 - RNA, 22 nt, Human
cugggcagcccgcuaggcucgc

SEQ ID NO: 3137689 - RNA, 14 nt, Human
cugcacggugaaug

SEQ ID NO: 3137690 - RNA, 15 nt, Human
cugcacggugaaugg

SEQ ID NO: 3137691 - RNA, 17 nt, Human
cugcacggugaauggcu

SEQ ID NO: 3137692 - RNA, 20 nt, Human
cugcacggugaauggcuuug

SEQ ID NO: 3137693 - RNA, 16 nt, Human
cuuuaauuuuggaauu

SEQ ID NO: 3137694 - RNA, 14 nt, Human
cuuuaauuuuggaa

SEQ ID NO: 3137695 - RNA, 15 nt, Human
cuuuaauuuuggaau

SEQ ID NO: 3137696 - RNA, 13 nt, Human
cuuuaauuuugga

SEQ ID NO: 3137697 - RNA, 15 nt, Human
cuuuggucuugcccc

SEQ ID NO: 3137698 - RNA, 18 nt, Human
cuuuuauuuuuuucuaau

SEQ ID NO: 3137699 - RNA, 11 nt, Human
cuuaaaguuga

SEQ ID NO: 3137700 - RNA, 13 nt, Human
cuuaaaguugaau

SEQ ID NO: 3137701 - RNA, 15 nt, Human
auuuaauaauuauau

SEQ ID NO: 3137702 - RNA, 18 nt, Human
auuuaauaauuauaugcu

SEQ ID NO: 3137703 - RNA, 13 nt, Human
auuuaauaauuau

SEQ ID NO: 3137704 - RNA, 13 nt, Human
auuuuuuucuaau

SEQ ID NO: 3137705 - RNA, 18 nt, Human
auuuuuuuguuguuuguu

SEQ ID NO: 3137706 - RNA, 15 nt, Human
auuauguaaauccca

SEQ ID NO: 3137707 - RNA, 17 nt, Human
auuauguaaaucccauu

SEQ ID NO: 3137708 - RNA, 22 nt, Human
auuauguaaaucccauuauuca

SEQ ID NO: 3137709 - RNA, 23 nt, Human
auuauguaaaucccauuauucaa

SEQ ID NO: 3137710 - RNA, 13 nt, Human
auuauguaaaucc

SEQ ID NO: 3137711 - RNA, 14 nt, Human
auuauguaaauccc

SEQ ID NO: 3137712 - RNA, 12 nt, Human
auuauguaaauc

SEQ ID NO: 3137713 - RNA, 17 nt, Human
cauugguguuguacuca

SEQ ID NO: 3137714 - RNA, 15 nt, Human
cauuauucaaaguug

SEQ ID NO: 3137715 - RNA, 14 nt, Human
cauuauucaaaguu

SEQ ID NO: 3137716 - RNA, 16 nt, Human
cauacaguuugcacuu

SEQ ID NO: 3137717 - RNA, 13 nt, Human
cagauacuggauu

SEQ ID NO: 3137718 - RNA, 14 nt, Human
cagauacuggauug

SEQ ID NO: 3137719 - RNA, 18 nt, Human
cagauacuggauuguacu

SEQ ID NO: 3137720 - RNA, 17 nt, Human
cagacagaucuggaaug

SEQ ID NO: 3137721 - RNA, 14 nt, Human
ccaguauuguacaa

SEQ ID NO: 3137722 - RNA, 17 nt, Human
ccaugggauaaaugcca

SEQ ID NO: 3137723 - RNA, 19 nt, Human
ccaugggauaaaugccauc

SEQ ID NO: 3137724 - RNA, 15 nt, Human
cccugccccacaccu

SEQ ID NO: 3137725 - RNA, 18 nt, Human
cccugccccacaccuccu

SEQ ID NO: 3137726 - RNA, 19 nt, Human
cccugccccacaccuccuc

SEQ ID NO: 3137727 - RNA, 19 nt, Human
cccuggaucuaccuggagg

SEQ ID NO: 3137728 - RNA, 20 nt, Human
cccuggaucuaccuggaggg

SEQ ID NO: 3137729 - RNA, 21 nt, Human
cccuggaucuaccuggaggga

SEQ ID NO: 3137730 - RNA, 11 nt, Human
ccuaaggacuu

SEQ ID NO: 3137731 - RNA, 12 nt, Human
ccuaaggacuuc

SEQ ID NO: 3137732 - RNA, 16 nt, Human
ccuaaggacuucuuua

SEQ ID NO: 3137733 - RNA, 17 nt, Human
ccuaaggacuucuuuaa

SEQ ID NO: 3137734 - RNA, 18 nt, Human
ccuaaggacuucuuuaau

SEQ ID NO: 3137735 - RNA, 23 nt, Human
ccuaaggacuucuuuaauuuugg

SEQ ID NO: 3137736 - RNA, 15 nt, Human
ccuagcugcugucac

SEQ ID NO: 3137737 - RNA, 11 nt, Human
ccuucccuccu

SEQ ID NO: 3137738 - RNA, 12 nt, Human
ccuucccuccuc

SEQ ID NO: 3137739 - RNA, 13 nt, Human
ccuucccuccucc

SEQ ID NO: 3137740 - RNA, 12 nt, Human
ccuucccuccug

SEQ ID NO: 3137741 - RNA, 14 nt, Human
ccuucccuccugcu

SEQ ID NO: 3137742 - RNA, 15 nt, Human
ccuucccuccugcuu

SEQ ID NO: 3137743 - RNA, 13 nt, Human
ccuguuccccucu

SEQ ID NO: 3137744 - RNA, 14 nt, Human
ccuguuccccucuc

SEQ ID NO: 3137745 - RNA, 15 nt, Human
ccuguuccccucucc

SEQ ID NO: 3137746 - RNA, 16 nt, Human
ccuguuccccucuccc

SEQ ID NO: 3137747 - RNA, 17 nt, Human
ccuguuccccucucccu

SEQ ID NO: 3137748 - RNA, 18 nt, Human
ccuguuccccucucccuu

SEQ ID NO: 3137749 - RNA, 19 nt, Human
ccuguuccccucucccuuc

SEQ ID NO: 3137750 - RNA, 12 nt, Human
ccuguuccccuc

SEQ ID NO: 3137751 - RNA, 19 nt, Human
cgggcccuucuugcugccc

SEQ ID NO: 3137752 - RNA, 20 nt, Human
cgggcccuucuugcugcccu

SEQ ID NO: 3137753 - RNA, 21 nt, Human
cgggcccuucuugcugcccug

SEQ ID NO: 3137754 - RNA, 23 nt, Human
cgggcccuucuugcugcccugcc

SEQ ID NO: 3137755 - RNA, 16 nt, Human
cuaaguugggaucuag

SEQ ID NO: 3137756 - RNA, 24 nt, Human
cuaaguugggaucuaggagaggag

SEQ ID NO: 3137757 - RNA, 13 nt, Human
cguguuccccucu

SEQ ID NO: 3137758 - RNA, 15 nt, Human
cguguuccccucuug

SEQ ID NO: 3137759 - RNA, 18 nt, Human
cguguuccccucuugucu

SEQ ID NO: 3137760 - RNA, 19 nt, Human
cguguuccccucuugucuc

SEQ ID NO: 3137761 - RNA, 20 nt, Human
cguguuccccucuugucucc

SEQ ID NO: 3137762 - RNA, 11 nt, Human
cuauccucauc

SEQ ID NO: 3137763 - RNA, 15 nt, Human
cucgucuuccgucuc

SEQ ID NO: 3137764 - RNA, 18 nt, Human
cucgucuuccgucucccc

SEQ ID NO: 3137765 - RNA, 19 nt, Human
cucgucuuccgucuccccc

SEQ ID NO: 3137766 - RNA, 15 nt, Human
cucucccucuggucc

SEQ ID NO: 3137767 - RNA, 17 nt, Human
cucugucccauucccug

SEQ ID NO: 3137768 - RNA, 18 nt, Human
cucugucccauucccugg

SEQ ID NO: 3137769 - RNA, 19 nt, Human
cucugucccauucccuggg

SEQ ID NO: 3137770 - RNA, 20 nt, Human
cucugucccauucccuggga

SEQ ID NO: 3137771 - RNA, 21 nt, Human
cucugucccauucccugggau

SEQ ID NO: 3137772 - RNA, 21 nt, Human
cucccccguguuccccucuug

SEQ ID NO: 3137773 - RNA, 20 nt, Human
augcuuaacauacccgccua

SEQ ID NO: 3137774 - RNA, 13 nt, Human
augcccucccuuc

SEQ ID NO: 3137775 - RNA, 16 nt, Human
augcccucccuucucc

SEQ ID NO: 3137776 - RNA, 17 nt, Human
augcccucccuucuccc

SEQ ID NO: 3137777 - RNA, 19 nt, Human
augcccucccuucucccug

SEQ ID NO: 3137778 - RNA, 20 nt, Human
augcccucccuucucccugg

SEQ ID NO: 3137779 - RNA, 21 nt, Human
augcccucccuucucccugga

SEQ ID NO: 3137780 - RNA, 22 nt, Human
augcccucccuucucccuggau

SEQ ID NO: 3137781 - RNA, 14 nt, Human
augccaucaauaaa

SEQ ID NO: 3137782 - RNA, 15 nt, Human
uuuagucuugucuca

SEQ ID NO: 3137783 - RNA, 17 nt, Human
uuuagucuugucucaga

SEQ ID NO: 3137784 - RNA, 23 nt, Human
uuuagucuugucucagauuuuau

SEQ ID NO: 3137785 - RNA, 16 nt, Human
uuggagcguggacugg

SEQ ID NO: 3137786 - RNA, 18 nt, Human
uuggggugguugaggcua

SEQ ID NO: 3137787 - RNA, 14 nt, Human
uugguuuugccauu

SEQ ID NO: 3137788 - RNA, 18 nt, Human
aucugaagucagaucugc

SEQ ID NO: 3137789 - RNA, 23 nt, Human
aucugaagucagaucugccuaag

SEQ ID NO: 3137790 - RNA, 16 nt, Human
aucugaagucagaucu

SEQ ID NO: 3137791 - RNA, 17 nt, Human
aucugaagucagaucug

SEQ ID NO: 3137792 - RNA, 14 nt, Human
uugccccaucacug

SEQ ID NO: 3137793 - RNA, 13 nt, Human
aucuaccuggagg

SEQ ID NO: 3137794 - RNA, 18 nt, Human
aucuaccuggagggaaga

SEQ ID NO: 3137795 - RNA, 19 nt, Human
aucuaccuggagggaagag

SEQ ID NO: 3137796 - RNA, 22 nt, Human
aucauuaaagccugaguuugcu

SEQ ID NO: 3137797 - RNA, 13 nt, Human
uucuggucucguc

SEQ ID NO: 3137798 - RNA, 19 nt, Human
uucuggucucgucuuccgu

SEQ ID NO: 3137799 - RNA, 22 nt, Human
uucuggucucgucuuccgucuc

SEQ ID NO: 3137800 - RNA, 14 nt, Human
auauuaaagccaug

SEQ ID NO: 3137801 - RNA, 15 nt, Human
auauuaaagccaugu

SEQ ID NO: 3137802 - RNA, 18 nt, Human
auauuaaagccauguuua

SEQ ID NO: 3137803 - RNA, 23 nt, Human
auauuaaagccauguuuauuaca

SEQ ID NO: 3137804 - RNA, 17 nt, Human
auauuuuaugauccagc

SEQ ID NO: 3137805 - RNA, 22 nt, Human
auauuuuaugauccagcagauu

SEQ ID NO: 3137806 - RNA, 12 nt, Human
auauuuuaugau

SEQ ID NO: 3137807 - RNA, 13 nt, Human
auauuuuaugauc

SEQ ID NO: 3137808 - RNA, 19 nt, Human
uucagcaaaaauauuuuau

SEQ ID NO: 3137809 - RNA, 21 nt, Human
uucagcaaaaauauuuuauga

SEQ ID NO: 3137810 - RNA, 15 nt, Human
auaucugaggaauuc

SEQ ID NO: 3137811 - RNA, 16 nt, Human
auaucugaggaauucu

SEQ ID NO: 3137812 - RNA, 17 nt, Human
auaucugaggaauucug

SEQ ID NO: 3137813 - RNA, 18 nt, Human
auaucugaggaauucugu

SEQ ID NO: 3137814 - RNA, 23 nt, Human
auaucugaggaauucuguauaga

SEQ ID NO: 3137815 - RNA, 19 nt, Human
auaucugaggaauucugua

SEQ ID NO: 3137816 - RNA, 20 nt, Human
auaucugaggaauucuguau

SEQ ID NO: 3137817 - RNA, 21 nt, Human
auaucugaggaauucuguaua

SEQ ID NO: 3137818 - RNA, 22 nt, Human
auaucugaggaauucuguauag

SEQ ID NO: 3137819 - RNA, 23 nt, Human
auagcuagacuggugacugauuc

SEQ ID NO: 3137820 - RNA, 18 nt, Human
auagcuagacuggugacu

SEQ ID NO: 3137821 - RNA, 19 nt, Human
auagcuagacuggugacug

SEQ ID NO: 3137822 - RNA, 14 nt, Human
auagcuagacuggu

SEQ ID NO: 3137823 - RNA, 15 nt, Human
auagcuagacuggug

SEQ ID NO: 3137824 - RNA, 16 nt, Human
auagcuagacugguga

SEQ ID NO: 3137825 - RNA, 22 nt, Human
auagcuggucuuauuuguaaag

SEQ ID NO: 3137826 - RNA, 23 nt, Human
auagcuggucuuauuuguaaagc

SEQ ID NO: 3137827 - RNA, 12 nt, Human
uuugaauuuugu

SEQ ID NO: 3137828 - RNA, 14 nt, Human
uuugaauuuugugu

SEQ ID NO: 3137829 - RNA, 22 nt, Human
uuugcuggggccgaaagaacag

SEQ ID NO: 3137830 - RNA, 19 nt, Human
uuugcuggggccgaaagaa

SEQ ID NO: 3137831 - RNA, 17 nt, Human
uuugcgugcccggggca

SEQ ID NO: 3137832 - RNA, 20 nt, Human
auguuacagaaucuaacugg

SEQ ID NO: 3137833 - RNA, 22 nt, Human
auguuuauuacaguauaauuaa

SEQ ID NO: 3137834 - RNA, 23 nt, Human
auguuuauuacaguauaauuaac

SEQ ID NO: 3137835 - RNA, 15 nt, Human
auguuuauuacagua

SEQ ID NO: 3137836 - RNA, 16 nt, Human
auguuuauuacaguau

SEQ ID NO: 3137837 - RNA, 18 nt, Human
auguuuauuacaguauaa

SEQ ID NO: 3137838 - RNA, 19 nt, Human
auguuuauuacaguauaau

SEQ ID NO: 3137839 - RNA, 19 nt, Human
uuuucugauccaguuuugu

SEQ ID NO: 3137840 - RNA, 12 nt, Human
auguuuauuaca

SEQ ID NO: 3137841 - RNA, 23 nt, Human
uuuuuggcauaacauaaaucugu

SEQ ID NO: 3137842 - RNA, 24 nt, Human
uuuuuggcauaacauaaaucugug

SEQ ID NO: 3137843 - RNA, 20 nt, Human
uuuuuauauuuacuaaaaug

SEQ ID NO: 3137844 - RNA, 15 nt, Human
uuuuggaauuuuccu

SEQ ID NO: 3137845 - RNA, 21 nt, Human
auuagaauucuguauagauua

SEQ ID NO: 3137846 - RNA, 19 nt, Human
auuauaugcuauuucuaua

SEQ ID NO: 3137847 - RNA, 18 nt, Human
auuauaugcuauuucuau

SEQ ID NO: 3137848 - RNA, 17 nt, Human
auuauaugcuauuucua

SEQ ID NO: 3137849 - RNA, 17 nt, Human
auuauucaaaguugccu

SEQ ID NO: 3137850 - RNA, 18 nt, Human
auuauucaaaguugccua

SEQ ID NO: 3137851 - RNA, 19 nt, Human
auuauucaaaguugccuaa

SEQ ID NO: 3137852 - RNA, 22 nt, Human
auuauucaaaguugccuaaauc

SEQ ID NO: 3137853 - RNA, 24 nt, Human
auuauucaaaguugccuaaaucca

SEQ ID NO: 3137854 - RNA, 19 nt, Human
auuauucacugauuugaca

SEQ ID NO: 3137855 - RNA, 18 nt, Human
auuauaucugaggaauuc

SEQ ID NO: 3137856 - RNA, 19 nt, Human
auuauaucugaggaauucu

SEQ ID NO: 3137857 - RNA, 20 nt, Human
auuauaucugaggaauucug

SEQ ID NO: 3137858 - RNA, 21 nt, Human
auuauaucugaggaauucugu

SEQ ID NO: 3137859 - RNA, 22 nt, Human
auuauaucugaggaauucugua

SEQ ID NO: 3137860 - RNA, 16 nt, Human
auuauaugcuauuucu

SEQ ID NO: 3137861 - RNA, 12 nt, Human
auucacugauuu

SEQ ID NO: 3137862 - RNA, 17 nt, Human
auucacugauuugacau

SEQ ID NO: 3137863 - RNA, 22 nt, Human
auuggggauucuuaaaguugaa

SEQ ID NO: 3137864 - RNA, 15 nt, Human
auuggggauucuuaa

SEQ ID NO: 3137865 - RNA, 16 nt, Human
auuggggauucuuaaa

SEQ ID NO: 3137866 - RNA, 20 nt, Human
auuggggauucuuaaaguug

SEQ ID NO: 3137867 - RNA, 21 nt, Human
auuggggauucuuaaaguuga

SEQ ID NO: 3137868 - RNA, 14 nt, Human
auuggggauucuua

SEQ ID NO: 3137869 - RNA, 13 nt, Human
auuugaauuuugu

SEQ ID NO: 3137870 - RNA, 20 nt, Human
auuuacuaaaauggacugug

SEQ ID NO: 3137871 - RNA, 16 nt, Human
auuuacuaaaauggac

SEQ ID NO: 3137872 - RNA, 19 nt, Human
auuuacuaaaauggacugu

SEQ ID NO: 3137873 - RNA, 15 nt, Human
auuuacuaaaaugga

SEQ ID NO: 3137874 - RNA, 15 nt, Human
auuguacuuugugcu

SEQ ID NO: 3137875 - RNA, 20 nt, Human
auuuauuggcuuuucugauc

SEQ ID NO: 3137876 - RNA, 23 nt, Human
auuuauuggcuuuucugauccag

SEQ ID NO: 3137877 - RNA, 14 nt, Human
auuuauuggcuuuu

SEQ ID NO: 3137878 - RNA, 18 nt, Human
auuuauuggcuuuucuga

SEQ ID NO: 3137879 - RNA, 15 nt, Human
agcauauauuuuuau

SEQ ID NO: 3137880 - RNA, 22 nt, Human
agcauauauuuuuauauuuacu

SEQ ID NO: 3137881 - RNA, 18 nt, Human
agcauauauuuuuauauu

SEQ ID NO: 3137882 - RNA, 20 nt, Human
agcauauauuuuuauauuua

SEQ ID NO: 3137883 - RNA, 12 nt, Human
agcagcagcccu

SEQ ID NO: 3137884 - RNA, 13 nt, Human
agcagcagcccug

SEQ ID NO: 3137885 - RNA, 19 nt, Human
ugauccagcagauuauuca

SEQ ID NO: 3137886 - RNA, 17 nt, Human
ugcagguugaagccaug

SEQ ID NO: 3137887 - RNA, 19 nt, Human
ugcagguggugucgggccc

SEQ ID NO: 3137888 - RNA, 20 nt, Human
ugcagguggugucgggcccu

SEQ ID NO: 3137889 - RNA, 21 nt, Human
ugcagguggugucgggcccuu

SEQ ID NO: 3137890 - RNA, 12 nt, Human
agcccugcccca

SEQ ID NO: 3137891 - RNA, 15 nt, Human
agcccugccccacac

SEQ ID NO: 3137892 - RNA, 20 nt, Human
agcccugccccacaccuccu

SEQ ID NO: 3137893 - RNA, 22 nt, Human
agcccugccccacaccuccucu

SEQ ID NO: 3137894 - RNA, 23 nt, Human
ugauuugacauagucuggcugua

SEQ ID NO: 3137895 - RNA, 17 nt, Human
aggcacacaaggggccc

SEQ ID NO: 3137896 - RNA, 18 nt, Human
aggcacacaaggggcccu

SEQ ID NO: 3137897 - RNA, 19 nt, Human
aggcacacaaggggcccuu

SEQ ID NO: 3137898 - RNA, 22 nt, Human
aggcacacaaggggcccuugga

SEQ ID NO: 3137899 - RNA, 18 nt, Human
uggauuccgaguggugac

SEQ ID NO: 3137900 - RNA, 16 nt, Human
aggacuucuuuaauuu

SEQ ID NO: 3137901 - RNA, 21 nt, Human
aggacuucuuuaauuuuggaa

SEQ ID NO: 3137902 - RNA, 22 nt, Human
aggacuucuuuaauuuuggaau

SEQ ID NO: 3137903 - RNA, 23 nt, Human
aggacuucuuuaauuuuggaauu

SEQ ID NO: 3137904 - RNA, 14 nt, Human
aggacuucuuuaau

SEQ ID NO: 3137905 - RNA, 13 nt, Human
aggaauucuguau

SEQ ID NO: 3137906 - RNA, 14 nt, Human
aggaauucuguaua

SEQ ID NO: 3137907 - RNA, 19 nt, Human
aggacgcugaccguggagc

SEQ ID NO: 3137908 - RNA, 14 nt, Human
ugccaucaauaaaa

SEQ ID NO: 3137909 - RNA, 22 nt, Human
ugccaucaauaaaaaauuauga

SEQ ID NO: 3137910 - RNA, 21 nt, Human
ugcuauuucuauauuuucauu

SEQ ID NO: 3137911 - RNA, 22 nt, Human
ugcuauuucuauauuuucauuc

SEQ ID NO: 3137912 - RNA, 16 nt, Human
agcuuaagccacugcc

SEQ ID NO: 3137913 - RNA, 20 nt, Human
agcuuaagccacugccucuc

SEQ ID NO: 3137914 - RNA, 21 nt, Human
agcuuaagccacugccucucc

SEQ ID NO: 3137915 - RNA, 23 nt, Human
agcuuaagccacugccucucccu

SEQ ID NO: 3137916 - RNA, 13 nt, Human
uguaugugugaag

SEQ ID NO: 3137917 - RNA, 15 nt, Human
uguaaauacaauuuu

SEQ ID NO: 3137918 - RNA, 15 nt, Human
uggugucgggcccuu

SEQ ID NO: 3137919 - RNA, 14 nt, Human
uggugcccugcuuu

SEQ ID NO: 3137920 - RNA, 20 nt, Human
uggugcccugcuuucagaua

SEQ ID NO: 3137921 - RNA, 16 nt, Human
uggugcccugcuuuca

SEQ ID NO: 3137922 - RNA, 19 nt, Human
uggugcccugcuuucagau

SEQ ID NO: 3137923 - RNA, 16 nt, Human
aggggugcagaggcug

SEQ ID NO: 3137924 - RNA, 17 nt, Human
aggggugcagaggcugu

SEQ ID NO: 3137925 - RNA, 12 nt, Human
agggcccuggag

SEQ ID NO: 3137926 - RNA, 13 nt, Human
agggcccuggagg

SEQ ID NO: 3137927 - RNA, 14 nt, Human
agggcccuggaggc

SEQ ID NO: 3137928 - RNA, 15 nt, Human
agggcccuggaggcg

SEQ ID NO: 3137929 - RNA, 17 nt, Human
agggcccgcaccgacca

SEQ ID NO: 3137930 - RNA, 13 nt, Human
agggaagagugga

SEQ ID NO: 3137931 - RNA, 19 nt, Human
agggaagaguggaggugga

SEQ ID NO: 3137932 - RNA, 14 nt, Human
agggaacagggcgg

SEQ ID NO: 3137933 - RNA, 15 nt, Human
agggaacagggcgga

SEQ ID NO: 3137934 - RNA, 19 nt, Human
uguuuggaccaaaaaccag

SEQ ID NO: 3137935 - RNA, 12 nt, Human
aguucugcaggu

SEQ ID NO: 3137936 - RNA, 18 nt, Human
aguucugcagguugaagc

SEQ ID NO: 3137937 - RNA, 23 nt, Human
uguuuagucuugucucagauuuu

SEQ ID NO: 3137938 - RNA, 22 nt, Human
uguuuagucuugucucagauuu

SEQ ID NO: 3137939 - RNA, 20 nt, Human
uguuuagucuugucucagau

SEQ ID NO: 3137940 - RNA, 14 nt, Human
uguuuauuacagua

SEQ ID NO: 3137941 - RNA, 14 nt, Human
uuaacaacagcugg

SEQ ID NO: 3137942 - RNA, 21 nt, Human
aguuuauaaaagacugucuua

SEQ ID NO: 3137943 - RNA, 13 nt, Human
aguuuauaaaaga

SEQ ID NO: 3137944 - RNA, 17 nt, Human
aguuggguguauugugc

SEQ ID NO: 3137945 - RNA, 20 nt, Human
aguuggguguauugugcgcu

SEQ ID NO: 3137946 - RNA, 20 nt, Human
aguuuaauauuaaagccaug

SEQ ID NO: 3137947 - RNA, 15 nt, Human
aguuuaauauuaaag

SEQ ID NO: 3137948 - RNA, 16 nt, Human
aguuuaauauuaaagc

SEQ ID NO: 3137949 - RNA, 18 nt, Human
aguuuaauauuaaagcca

SEQ ID NO: 3137950 - RNA, 19 nt, Human
aguuuaauauuaaagccau

SEQ ID NO: 3137951 - RNA, 16 nt, Human
aguuggguguauugug

SEQ ID NO: 3137952 - RNA, 22 nt, Human
aguugccuaaauccauuuggaa

SEQ ID NO: 3137953 - RNA, 23 nt, Human
aguugccuaaauccauuuggaaa

SEQ ID NO: 3137954 - RNA, 19 nt, Human
aguugccuaaauccauuug

SEQ ID NO: 3137955 - RNA, 17 nt, Human
uuagaauucuguauaga

SEQ ID NO: 3137956 - RNA, 13 nt, Human
uuacaguauaauu

SEQ ID NO: 3137957 - RNA, 16 nt, Human
uuacaguauaauuaac

SEQ ID NO: 3137958 - RNA, 17 nt, Human
uuacaguauaauuaaca

SEQ ID NO: 3137959 - RNA, 18 nt, Human
uuacaguauaauuaacau

SEQ ID NO: 3137960 - RNA, 19 nt, Human
uuacaguauaauuaacaug

SEQ ID NO: 3137961 - RNA, 20 nt, Human
uuacaguauaauuaacaugu

SEQ ID NO: 3137962 - RNA, 20 nt, Human
auaaaucugugaacuugaaa

SEQ ID NO: 3137963 - RNA, 21 nt, Human
auaaaucugugaacuugaaau

SEQ ID NO: 3137964 - RNA, 22 nt, Human
auaaaucugugaacuugaaauu

SEQ ID NO: 3137965 - RNA, 16 nt, Human
auaaauagcuagacug

SEQ ID NO: 3137966 - RNA, 18 nt, Human
auaaauagcuagacuggu

SEQ ID NO: 3137967 - RNA, 12 nt, Human
ugugaacuugaa

SEQ ID NO: 3137968 - RNA, 16 nt, Human
ugugaacuugaaauuu

SEQ ID NO: 3137969 - RNA, 14 nt, Human
ugugaacuugaaau

SEQ ID NO: 3137970 - RNA, 15 nt, Human
ugugaacuugaaauu

SEQ ID NO: 3137971 - RNA, 18 nt, Human
ugugcugggguuaucuga

SEQ ID NO: 3137972 - RNA, 19 nt, Human
agugaguuggguguauugu

SEQ ID NO: 3137973 - RNA, 16 nt, Human
ucacuccccagccugg

SEQ ID NO: 3137974 - RNA, 17 nt, Human
ucacuccccagccuggg

SEQ ID NO: 3137975 - RNA, 18 nt, Human
ucacuccccagccugggc

SEQ ID NO: 3137976 - RNA, 19 nt, Human
ucacuccccagccugggcc

SEQ ID NO: 3137977 - RNA, 13 nt, Human
ucaauuuuaacaa

SEQ ID NO: 3137978 - RNA, 18 nt, Human
accaugggauaaaugcca

SEQ ID NO: 3137979 - RNA, 19 nt, Human
accaugggauaaaugccau

SEQ ID NO: 3137980 - RNA, 18 nt, Human
ucaaaauaucaaguguug

SEQ ID NO: 3137981 - RNA, 16 nt, Human
uauuuuuauauuuacu

SEQ ID NO: 3137982 - RNA, 18 nt, Human
ucaaaguugccuaaaucc

SEQ ID NO: 3137983 - RNA, 19 nt, Human
ucaaaguugccuaaaucca

SEQ ID NO: 3137984 - RNA, 21 nt, Human
ucaaaguugccuaaauccauu

SEQ ID NO: 3137985 - RNA, 22 nt, Human
ucaaaguugccuaaauccauuu

SEQ ID NO: 3137986 - RNA, 17 nt, Human
acauucuggucucgucu

SEQ ID NO: 3137987 - RNA, 18 nt, Human
acauucuggucucgucuu

SEQ ID NO: 3137988 - RNA, 20 nt, Human
acauucuggucucgucuucc

SEQ ID NO: 3137989 - RNA, 22 nt, Human
acauucuggucucgucuuccgu

SEQ ID NO: 3137990 - RNA, 17 nt, Human
acauacccgccuagcug

SEQ ID NO: 3137991 - RNA, 21 nt, Human
acauacccgccuagcugcugu

SEQ ID NO: 3137992 - RNA, 22 nt, Human
acauacccgccuagcugcuguc

SEQ ID NO: 3137993 - RNA, 16 nt, Human
uauuucuauauuuuca

SEQ ID NO: 3137994 - RNA, 17 nt, Human
uauuucuauauuuucau

SEQ ID NO: 3137995 - RNA, 20 nt, Human
acauagucuggcuguaccca

SEQ ID NO: 3137996 - RNA, 14 nt, Human
acauagucuggcug

SEQ ID NO: 3137997 - RNA, 15 nt, Human
acauagucuggcugu

SEQ ID NO: 3137998 - RNA, 14 nt, Human
accuggagggaaga

SEQ ID NO: 3137999 - RNA, 16 nt, Human
accuggagggaagagu

SEQ ID NO: 3138000 - RNA, 18 nt, Human
uccgggcaaaugccaggg

SEQ ID NO: 3138001 - RNA, 19 nt, Human
uccgggcaaaugccagggc

SEQ ID NO: 3138002 - RNA, 20 nt, Human
uccgggcaaaugccagggcc

SEQ ID NO: 3138003 - RNA, 21 nt, Human
uccgggcaaaugccagggccc

SEQ ID NO: 3138004 - RNA, 15 nt, Human
uccccucucccuucc

SEQ ID NO: 3138005 - RNA, 12 nt, Human
acguuccgggca

SEQ ID NO: 3138006 - RNA, 20 nt, Human
acguuccgggcaaaugccag

SEQ ID NO: 3138007 - RNA, 18 nt, Human
uccauuuaauaauuauau

SEQ ID NO: 3138008 - RNA, 17 nt, Human
uccauuuaauaauuaua

SEQ ID NO: 3138009 - RNA, 21 nt, Human
uccccaugcuuaacauacccg

SEQ ID NO: 3138010 - RNA, 19 nt, Human
ucugaagucagaucugccu

SEQ ID NO: 3138011 - RNA, 15 nt, Human
ucugaagucagaucu

SEQ ID NO: 3138012 - RNA, 20 nt, Human
agaaacgaucagacagaucu

SEQ ID NO: 3138013 - RNA, 14 nt, Human
acuuguuagaucua

SEQ ID NO: 3138014 - RNA, 15 nt, Human
acuuguuagaucuag

SEQ ID NO: 3138015 - RNA, 23 nt, Human
acuuguuagaucuaguucacucu

SEQ ID NO: 3138016 - RNA, 20 nt, Human
acuugaaauuugaauuuugu

SEQ ID NO: 3138017 - RNA, 19 nt, Human
acuugaaauuugaauuuug

SEQ ID NO: 3138018 - RNA, 16 nt, Human
acuugaaauuugaauu

SEQ ID NO: 3138019 - RNA, 13 nt, Human
acugcuccgugga

SEQ ID NO: 3138020 - RNA, 14 nt, Human
acugcuccguggag

SEQ ID NO: 3138021 - RNA, 17 nt, Human
acugcuccguggaggag

SEQ ID NO: 3138022 - RNA, 23 nt, Human
acugcuccguggaggagguuggg

SEQ ID NO: 3138023 - RNA, 12 nt, Human
acugccucuccc

SEQ ID NO: 3138024 - RNA, 13 nt, Human
acugccucucccu

SEQ ID NO: 3138025 - RNA, 14 nt, Human
acugccucucccuc

SEQ ID NO: 3138026 - RNA, 16 nt, Human
acugccucucccucug

SEQ ID NO: 3138027 - RNA, 17 nt, Human
acuuaagcauuuaggaa

SEQ ID NO: 3138028 - RNA, 12 nt, Human
acuguggugacu

SEQ ID NO: 3138029 - RNA, 14 nt, Human
acuguggugacuuu

SEQ ID NO: 3138030 - RNA, 15 nt, Human
acuguggugacuuug

SEQ ID NO: 3138031 - RNA, 18 nt, Human
acuguggugacuuuggau

SEQ ID NO: 3138032 - RNA, 20 nt, Human
acuguggugacuuuggauaa

SEQ ID NO: 3138033 - RNA, 21 nt, Human
acuguggugacuuuggauaau

SEQ ID NO: 3138034 - RNA, 13 nt, Human
ucgggcccuucuu

SEQ ID NO: 3138035 - RNA, 18 nt, Human
ucgggcccuucuugcugc

SEQ ID NO: 3138036 - RNA, 20 nt, Human
ucgggcccuucuugcugccc

SEQ ID NO: 3138037 - RNA, 21 nt, Human
ucgggcccuucuugcugcccu

SEQ ID NO: 3138038 - RNA, 23 nt, Human
ucgggcccuucuugcugcccugc

SEQ ID NO: 3138039 - RNA, 14 nt, Human
ucgggcucccgggu

SEQ ID NO: 3138040 - RNA, 22 nt, Human
agagauuuuuuuguuguuuguu

SEQ ID NO: 3138041 - RNA, 23 nt, Human
agagauuuuuuuguuguuuguuu

SEQ ID NO: 3138042 - RNA, 20 nt, Human
ugaaauuguaauuauaucug

SEQ ID NO: 3138043 - RNA, 21 nt, Human
ugaaauuguaauuauaucuga

SEQ ID NO: 3138044 - RNA, 14 nt, Human
ugaaauuugaauuu

SEQ ID NO: 3138045 - RNA, 15 nt, Human
ugaaauuugaauuuu

SEQ ID NO: 3138046 - RNA, 16 nt, Human
ugaaauuugaauuuug

SEQ ID NO: 3138047 - RNA, 17 nt, Human
ugaaauuugaauuuugu

SEQ ID NO: 3138048 - RNA, 17 nt, Human
ugaauuuauuggcuuuu

SEQ ID NO: 3138049 - RNA, 21 nt, Human
ugaauuuauuggcuuuucuga

SEQ ID NO: 3138050 - RNA, 22 nt, Human
ugaauuuauuggcuuuucugau

SEQ ID NO: 3138051 - RNA, 23 nt, Human
ugaauuuauuggcuuuucugauc

SEQ ID NO: 3138052 - RNA, 19 nt, Human
agaauuaguggcacuugcu

SEQ ID NO: 3138053 - RNA, 14 nt, Human
ucuguacuuuuugg

SEQ ID NO: 3138054 - RNA, 17 nt, Human
ucuguacuuuuuggcau

SEQ ID NO: 3138055 - RNA, 13 nt, Human
ucuguacuuuuug

SEQ ID NO: 3138056 - RNA, 14 nt, Human
ucugucccauuccc

SEQ ID NO: 3138057 - RNA, 17 nt, Human
ucugucccauucccugg

SEQ ID NO: 3138058 - RNA, 18 nt, Human
ucugucccauucccuggg

SEQ ID NO: 3138059 - RNA, 19 nt, Human
ucugucccauucccuggga

SEQ ID NO: 3138060 - RNA, 24 nt, Human
ucugucccauucccugggaucugg

SEQ ID NO: 3138061 - RNA, 19 nt, Human
ucugugaacuugaaauuug

SEQ ID NO: 3138062 - RNA, 22 nt, Human
ucugugaacuugaaauuugaau

SEQ ID NO: 3138063 - RNA, 16 nt, Human
agacuggugacugauu

SEQ ID NO: 3138064 - RNA, 17 nt, Human
agacuggugacugauuc

SEQ ID NO: 3138065 - RNA, 12 nt, Human
agacuggugacu

SEQ ID NO: 3138066 - RNA, 13 nt, Human
agacuggugacug

SEQ ID NO: 3138067 - RNA, 14 nt, Human
agacuggugacuga

SEQ ID NO: 3138068 - RNA, 21 nt, Human
aaccaugggauaaaugccauc

SEQ ID NO: 3138069 - RNA, 15 nt, Human
aaccaugggauaaau

SEQ ID NO: 3138070 - RNA, 17 nt, Human
aaccaugggauaaaugc

SEQ ID NO: 3138071 - RNA, 18 nt, Human
aaccaugggauaaaugcc

SEQ ID NO: 3138072 - RNA, 20 nt, Human
aaccaugggauaaaugccau

SEQ ID NO: 3138073 - RNA, 17 nt, Human
gucuccccuguuccccu

SEQ ID NO: 3138074 - RNA, 18 nt, Human
gucuccccuguuccccuc

SEQ ID NO: 3138075 - RNA, 19 nt, Human
gucuccccuguuccccucu

SEQ ID NO: 3138076 - RNA, 23 nt, Human
gucuccccuguuccccucucccu

SEQ ID NO: 3138077 - RNA, 19 nt, Human
gucucccgccccccacacu

SEQ ID NO: 3138078 - RNA, 19 nt, Human
gucucccccguguuccccu

SEQ ID NO: 3138079 - RNA, 21 nt, Human
gucucccccguguuccccucu

SEQ ID NO: 3138080 - RNA, 23 nt, Human
gucucccccguguuccccucuug

SEQ ID NO: 3138081 - RNA, 14 nt, Human
gucuuccgucuccc

SEQ ID NO: 3138082 - RNA, 15 nt, Human
gucuuccgucucccc

SEQ ID NO: 3138083 - RNA, 20 nt, Human
aaaugggcgccccccccucc

SEQ ID NO: 3138084 - RNA, 17 nt, Human
guaugugugaagugagu

SEQ ID NO: 3138085 - RNA, 15 nt, Human
guauguggcaaaaug

SEQ ID NO: 3138086 - RNA, 13 nt, Human
guaugugugaagu

SEQ ID NO: 3138087 - RNA, 14 nt, Human
aaaugcaaugugaa

SEQ ID NO: 3138088 - RNA, 14 nt, Human
aaauccauuuggaa

SEQ ID NO: 3138089 - RNA, 15 nt, Human
aaauccauuuggaaa

SEQ ID NO: 3138090 - RNA, 16 nt, Human
aaauccauuuggaaau

SEQ ID NO: 3138091 - RNA, 19 nt, Human
aaaucccauuauucaaagu

SEQ ID NO: 3138092 - RNA, 20 nt, Human
aaaucccauuauucaaaguu

SEQ ID NO: 3138093 - RNA, 21 nt, Human
aaaucccauuauucaaaguug

SEQ ID NO: 3138094 - RNA, 22 nt, Human
aaaucccauuauucaaaguugc

SEQ ID NO: 3138095 - RNA, 18 nt, Human
aaauccauuuggaaaucu

SEQ ID NO: 3138096 - RNA, 21 nt, Human
aaauccauuuggaaaucuuua

SEQ ID NO: 3138097 - RNA, 22 nt, Human
aaauccauuuggaaaucuuuaa

SEQ ID NO: 3138098 - RNA, 23 nt, Human
aaauccauuuggaaaucuuuaaa

SEQ ID NO: 3138099 - RNA, 13 nt, Human
aaaucccauuauu

SEQ ID NO: 3138100 - RNA, 15 nt, Human
aaaucccauuauuca

SEQ ID NO: 3138101 - RNA, 16 nt, Human
aaaucccauuauucaa

SEQ ID NO: 3138102 - RNA, 17 nt, Human
aaaucccauuauucaaa

SEQ ID NO: 3138103 - RNA, 19 nt, Human
guguuguacucaauuuuaa

SEQ ID NO: 3138104 - RNA, 15 nt, Human
guguguaugcugcuu

SEQ ID NO: 3138105 - RNA, 19 nt, Human
aagacugucuuaauuugca

SEQ ID NO: 3138106 - RNA, 21 nt, Human
aagaaacugacaugcccuccc

SEQ ID NO: 3138107 - RNA, 22 nt, Human
aagaaacugacaugcccucccu

SEQ ID NO: 3138108 - RNA, 18 nt, Human
guggauuccgagugguga

SEQ ID NO: 3138109 - RNA, 17 nt, Human
guggacauggcuguuca

SEQ ID NO: 3138110 - RNA, 19 nt, Human
aagaaugguccgugcuaag

SEQ ID NO: 3138111 - RNA, 22 nt, Human
aagaaugguccgugcuaaggac

SEQ ID NO: 3138112 - RNA, 12 nt, Human
guuagaucuagu

SEQ ID NO: 3138113 - RNA, 21 nt, Human
guuuaacaaaauguaugugag

SEQ ID NO: 3138114 - RNA, 14 nt, Human
guugccuaaaucca

SEQ ID NO: 3138115 - RNA, 15 nt, Human
guugccuaaauccau

SEQ ID NO: 3138116 - RNA, 16 nt, Human
guugccuaaauccauu

SEQ ID NO: 3138117 - RNA, 20 nt, Human
guuucuguacuuuuuggcau

SEQ ID NO: 3138118 - RNA, 15 nt, Human
guuucuguacuuuuu

SEQ ID NO: 3138119 - RNA, 17 nt, Human
uagucuugucucagauu

SEQ ID NO: 3138120 - RNA, 22 nt, Human
uagucuugucucagauuuuauu

SEQ ID NO: 3138121 - RNA, 11 nt, Human
acaccuccucu

SEQ ID NO: 3138122 - RNA, 15 nt, Human
acaccuccucucacu

SEQ ID NO: 3138123 - RNA, 18 nt, Human
acaccuccucucacuccc

SEQ ID NO: 3138124 - RNA, 20 nt, Human
acagauacuccuccaagguu

SEQ ID NO: 3138125 - RNA, 15 nt, Human
acaacagcuggugcc

SEQ ID NO: 3138126 - RNA, 17 nt, Human
acaaaugggcgcccccc

SEQ ID NO: 3138127 - RNA, 21 nt, Human
acaaaugggcgccccccccuc

SEQ ID NO: 3138128 - RNA, 22 nt, Human
acaaaugggcgccccccccucc

SEQ ID NO: 3138129 - RNA, 15 nt, Human
uagcuagacugguga

SEQ ID NO: 3138130 - RNA, 19 nt, Human
uacuuuuuggcauaacaua

SEQ ID NO: 3138131 - RNA, 20 nt, Human
uacuuuuuggcauaacauaa

SEQ ID NO: 3138132 - RNA, 14 nt, Human
uacuuuuuggcaua

SEQ ID NO: 3138133 - RNA, 16 nt, Human
uacuuugugcuggggu

SEQ ID NO: 3138134 - RNA, 22 nt, Human
uacuuugugcugggguuaucug

SEQ ID NO: 3138135 - RNA, 16 nt, Human
aauuuuguuucuguac

SEQ ID NO: 3138136 - RNA, 15 nt, Human
aauuuuguuucugua

SEQ ID NO: 3138137 - RNA, 20 nt, Human
acaaaguauuaagcauauau

SEQ ID NO: 3138138 - RNA, 14 nt, Human
uagaucuaguucac

SEQ ID NO: 3138139 - RNA, 20 nt, Human
aauaaccaaaugcaauguga

SEQ ID NO: 3138140 - RNA, 17 nt, Human
uaaauaaauaaauagcu

SEQ ID NO: 3138141 - RNA, 14 nt, Human
uaaauaaauagcua

SEQ ID NO: 3138142 - RNA, 15 nt, Human
uaaaucugugaacuu

SEQ ID NO: 3138143 - RNA, 16 nt, Human
uaaaucugugaacuug

SEQ ID NO: 3138144 - RNA, 22 nt, Human
uaaaucugugaacuugaaauuu

SEQ ID NO: 3138145 - RNA, 17 nt, Human
uaaaucugugaacuuga

SEQ ID NO: 3138146 - RNA, 18 nt, Human
uaaaucugugaacuugaa

SEQ ID NO: 3138147 - RNA, 19 nt, Human
uaaaucugugaacuugaaa

SEQ ID NO: 3138148 - RNA, 21 nt, Human
uaaaucugugaacuugaaauu

SEQ ID NO: 3138149 - RNA, 18 nt, Human
uaaauagcuagacuggug

SEQ ID NO: 3138150 - RNA, 17 nt, Human
aauauuuuaugauccag

SEQ ID NO: 3138151 - RNA, 18 nt, Human
aauauuuuaugauccagc

SEQ ID NO: 3138152 - RNA, 23 nt, Human
uaacauacccgccuagcugcugu

SEQ ID NO: 3138153 - RNA, 14 nt, Human
uaacauaaaucugu

SEQ ID NO: 3138154 - RNA, 15 nt, Human
uaacauaaaucugug

SEQ ID NO: 3138155 - RNA, 16 nt, Human
uaacauaaaucuguga

SEQ ID NO: 3138156 - RNA, 17 nt, Human
uaacauaaaucugugaa

SEQ ID NO: 3138157 - RNA, 18 nt, Human
uaacauaaaucugugaac

SEQ ID NO: 3138158 - RNA, 20 nt, Human
uaacauaaaucugugaacuu

SEQ ID NO: 3138159 - RNA, 13 nt, Human
aaucugugaacuu

SEQ ID NO: 3138160 - RNA, 15 nt, Human
aaucugugaacuuga

SEQ ID NO: 3138161 - RNA, 19 nt, Human
aaucugugaacuugaaauu

SEQ ID NO: 3138162 - RNA, 17 nt, Human
aaucugugaacuugaaa

SEQ ID NO: 3138163 - RNA, 18 nt, Human
aaucugugaacuugaaau

SEQ ID NO: 3138164 - RNA, 19 nt, Human
aaucuuuaaaaaaaaaauu

SEQ ID NO: 3138165 - RNA, 20 nt, Human
aaucuuuaaaaaaaaaauug

SEQ ID NO: 3138166 - RNA, 23 nt, Human
uacaguauaauuaacauguuaaa

SEQ ID NO: 3138167 - RNA, 18 nt, Human
uacaguauaauuaacaug

SEQ ID NO: 3138168 - RNA, 19 nt, Human
uacaguauaauuaacaugu

SEQ ID NO: 3138169 - RNA, 20 nt, Human
aauggacuguggugacuuug

SEQ ID NO: 3138170 - RNA, 16 nt, Human
aauggacuguggugac

SEQ ID NO: 3138171 - RNA, 16 nt, Human
uacaguauaauuaaca

SEQ ID NO: 3138172 - RNA, 17 nt, Human
uacaguauaauuaacau

SEQ ID NO: 3138173 - RNA, 14 nt, Human
uacaguauaauuaa

SEQ ID NO: 3138174 - RNA, 20 nt, Human
uacaggcugacguuccgggc

SEQ ID NO: 3138175 - RNA, 22 nt, Human
uacaggcugacguuccgggcaa

SEQ ID NO: 3138176 - RNA, 16 nt, Human
cacacaaggggcccuu

SEQ ID NO: 3138177 - RNA, 19 nt, Human
cacacaaggggcccuugga

SEQ ID NO: 3138178 - RNA, 13 nt, Human
caauuuuguuucu

SEQ ID NO: 3138179 - RNA, 17 nt, Human
caauuuuguuucuguac

SEQ ID NO: 3138180 - RNA, 14 nt, Human
caauuuuguuucug

SEQ ID NO: 3138181 - RNA, 16 nt, Human
caauuuuguuucugua

SEQ ID NO: 3138182 - RNA, 17 nt, Human
cacaaggggcccuugga

SEQ ID NO: 3138183 - RNA, 21 nt, Human
caagaaagggccaggagaugg

SEQ ID NO: 3138184 - RNA, 22 nt, Human
caagaaagggccaggagaugga

SEQ ID NO: 3138185 - RNA, 14 nt, Human
caaaguugccuaaa

SEQ ID NO: 3138186 - RNA, 15 nt, Human
caaaguugccuaaau

SEQ ID NO: 3138187 - RNA, 17 nt, Human
caaaguugccuaaaucc

SEQ ID NO: 3138188 - RNA, 16 nt, Human
ucauuauuuuauuaug

SEQ ID NO: 3138189 - RNA, 18 nt, Human
ucauuauuuuauuaugaa

SEQ ID NO: 3138190 - RNA, 19 nt, Human
ucauuauuuuauuaugaaa

SEQ ID NO: 3138191 - RNA, 14 nt, Human
ucauuauuuuauua

SEQ ID NO: 3138192 - RNA, 15 nt, Human
ucauuauuuuauuau

SEQ ID NO: 3138193 - RNA, 13 nt, Human
ucauuauuuuauu

SEQ ID NO: 3138194 - RNA, 22 nt, Human
uccagcagauuauucacugauu

SEQ ID NO: 3138195 - RNA, 17 nt, Human
uccagcagauuauucac

SEQ ID NO: 3138196 - RNA, 20 nt, Human
uccagcagauuauucacuga

SEQ ID NO: 3138197 - RNA, 13 nt, Human
ucccauucccugg

SEQ ID NO: 3138198 - RNA, 14 nt, Human
ucccauucccuggg

SEQ ID NO: 3138199 - RNA, 15 nt, Human
ucccauucccuggga

SEQ ID NO: 3138200 - RNA, 14 nt, Human
uccccagccugggc

SEQ ID NO: 3138201 - RNA, 15 nt, Human
uccccagccugggcc

SEQ ID NO: 3138202 - RNA, 16 nt, Human
uccccagccugggccc

SEQ ID NO: 3138203 - RNA, 17 nt, Human
uccccagccugggccca

SEQ ID NO: 3138204 - RNA, 21 nt, Human
uccccagccugggcccaucuc

SEQ ID NO: 3138205 - RNA, 18 nt, Human
ucccccguguuccccucu

SEQ ID NO: 3138206 - RNA, 19 nt, Human
ucccccguguuccccucuu

SEQ ID NO: 3138207 - RNA, 16 nt, Human
uccccuguuccccucu

SEQ ID NO: 3138208 - RNA, 17 nt, Human
uccccuguuccccucuc

SEQ ID NO: 3138209 - RNA, 18 nt, Human
uccccuguuccccucucc

SEQ ID NO: 3138210 - RNA, 19 nt, Human
uccccuguuccccucuccc

SEQ ID NO: 3138211 - RNA, 20 nt, Human
uccccuguuccccucucccu

SEQ ID NO: 3138212 - RNA, 18 nt, Human
ucacucuccauuuaauaa

SEQ ID NO: 3138213 - RNA, 17 nt, Human
uaucugaagucagaucu

SEQ ID NO: 3138214 - RNA, 18 nt, Human
uaucugaagucagaucug

SEQ ID NO: 3138215 - RNA, 15 nt, Human
uaucugaggaauucu

SEQ ID NO: 3138216 - RNA, 14 nt, Human
uauuuuuuucuaau

SEQ ID NO: 3138217 - RNA, 12 nt, Human
uauuuuaugauc

SEQ ID NO: 3138218 - RNA, 14 nt, Human
uccuuggcccccuu

SEQ ID NO: 3138219 - RNA, 20 nt, Human
uccuuggcccccuuucccgg

SEQ ID NO: 3138220 - RNA, 21 nt, Human
uccuuggcccccuuucccggg

SEQ ID NO: 3138221 - RNA, 17 nt, Human
ucucccgccccccacac

SEQ ID NO: 3138222 - RNA, 13 nt, Human
ucucccucugguc

SEQ ID NO: 3138223 - RNA, 16 nt, Human
ucucccucugguccca

SEQ ID NO: 3138224 - RNA, 20 nt, Human
ucugaggaauucuguauaga

SEQ ID NO: 3138225 - RNA, 19 nt, Human
ucugaggaauucuguauag

SEQ ID NO: 3138226 - RNA, 19 nt, Human
ucuuuaaaaaaaaaauugg

SEQ ID NO: 3138227 - RNA, 18 nt, Human
ucuuuaaaaaaaaaauug

SEQ ID NO: 3138228 - RNA, 19 nt, Human
ucuugucucagauuuuauu

SEQ ID NO: 3138229 - RNA, 11 nt, Human
ucuugucuccc

SEQ ID NO: 3138230 - RNA, 12 nt, Human
ucuugucucccc

SEQ ID NO: 3138231 - RNA, 13 nt, Human
ucuugucuccccu

SEQ ID NO: 3138232 - RNA, 15 nt, Human
ucuugucuccccugu

SEQ ID NO: 3138233 - RNA, 16 nt, Human
ucuugucuccccuguu

SEQ ID NO: 3138234 - RNA, 17 nt, Human
ucuugucucagauuuua

SEQ ID NO: 3138235 - RNA, 18 nt, Human
uacagaaucuaacuggug

SEQ ID NO: 3138236 - RNA, 12 nt, Human
uaauuuuggaau

SEQ ID NO: 3138237 - RNA, 13 nt, Human
uaauuuuggaauu

SEQ ID NO: 3138238 - RNA, 18 nt, Human
uacaauuuuguuucugua

SEQ ID NO: 3138239 - RNA, 19 nt, Human
uacaauuuuguuucuguac

SEQ ID NO: 3138240 - RNA, 21 nt, Human
uacaauuuuguuucuguacuu

SEQ ID NO: 3138241 - RNA, 14 nt, Human
uaguuuauaaaaga

SEQ ID NO: 3138242 - RNA, 18 nt, Human
uauaugcuauuucuauau

SEQ ID NO: 3138243 - RNA, 16 nt, Human
uauaugcuauuucuau

SEQ ID NO: 3138244 - RNA, 18 nt, Human
uauauuuuuauauuuacu

SEQ ID NO: 3138245 - RNA, 17 nt, Human
uauccuuaugccacccc

SEQ ID NO: 3138246 - RNA, 22 nt, Human
uauccuuaugccacccccgcug

SEQ ID NO: 3138247 - RNA, 19 nt, Human
uauauuuuuauauuuacua

SEQ ID NO: 3138248 - RNA, 12 nt, Human
uagcugcuguca

SEQ ID NO: 3138249 - RNA, 17 nt, Human
uagcugcugucacauuu

SEQ ID NO: 3138250 - RNA, 15 nt, Human
uagagaguguugaaa

SEQ ID NO: 3138251 - RNA, 14 nt, Human
uagagaguguugaa

SEQ ID NO: 3138252 - RNA, 13 nt, Human
uagacuggugacu

SEQ ID NO: 3138253 - RNA, 14 nt, Human
uagacuggugacug

SEQ ID NO: 3138254 - RNA, 17 nt, Human
uagacuggugacugauu

SEQ ID NO: 3138255 - RNA, 22 nt, Human
uaauaaccaaaugcaaugugaa

SEQ ID NO: 3138256 - RNA, 20 nt, Human
uaauaaggaaaaguuuaaua

SEQ ID NO: 3138257 - RNA, 18 nt, Human
uaauaaggaaaaguuuaa

SEQ ID NO: 3138258 - RNA, 22 nt, Human
uaauaauuauaugcuauuucua

SEQ ID NO: 3138259 - RNA, 23 nt, Human
uaauaauuauaugcuauuucuau

SEQ ID NO: 3138260 - RNA, 15 nt, Human
uaauaauuauaugcu

SEQ ID NO: 3138261 - RNA, 16 nt, Human
uaauaauuauaugcua

SEQ ID NO: 3138262 - RNA, 19 nt, Human
uaauaauuauaugcuauuu

SEQ ID NO: 3138263 - RNA, 20 nt, Human
uaauaauuauaugcuauuuc

SEQ ID NO: 3138264 - RNA, 12 nt, Human
uaauauuaaagc

SEQ ID NO: 3138265 - RNA, 13 nt, Human
uaauauuaaagcc

SEQ ID NO: 3138266 - RNA, 14 nt, Human
uaauauuaaagcca

SEQ ID NO: 3138267 - RNA, 18 nt, Human
uaauuaacauguuaaacc

SEQ ID NO: 3138268 - RNA, 19 nt, Human
uaauuaacauguuaaacca

SEQ ID NO: 3138269 - RNA, 12 nt, Human
uaauuaacaugu

SEQ ID NO: 3138270 - RNA, 14 nt, Human
uaauuaacauguua

SEQ ID NO: 3138271 - RNA, 15 nt, Human
uaauuaacauguuaa

SEQ ID NO: 3138272 - RNA, 17 nt, Human
uaauuaacauguuaaac

SEQ ID NO: 3138273 - RNA, 18 nt, Human
uaagccacugccucuccc

SEQ ID NO: 3138274 - RNA, 19 nt, Human
uaagccacugccucucccu

SEQ ID NO: 3138275 - RNA, 23 nt, Human
uaagccacugccucucccucugg

SEQ ID NO: 3138276 - RNA, 23 nt, Human
uaagcauauauuuuuauauuuac

SEQ ID NO: 3138277 - RNA, 21 nt, Human
uaagcauauauuuuuauauuu

SEQ ID NO: 3138278 - RNA, 22 nt, Human
uaagcauauauuuuuauauuua

SEQ ID NO: 3138279 - RNA, 19 nt, Human
uaagcauauauuuuuauau

SEQ ID NO: 3138280 - RNA, 16 nt, Human
uaagcauauauuuuua

SEQ ID NO: 3138281 - RNA, 16 nt, Human
uaaaucccauuauuca

SEQ ID NO: 3138282 - RNA, 17 nt, Human
uaaaucccauuauucaa

SEQ ID NO: 3138283 - RNA, 18 nt, Human
uaaauccauuuggaaauc

SEQ ID NO: 3138284 - RNA, 19 nt, Human
uaaauccauuuggaaaucu

SEQ ID NO: 3138285 - RNA, 22 nt, Human
uaaauccauuuggaaaucuuua

SEQ ID NO: 3138286 - RNA, 23 nt, Human
uaaauccauuuggaaaucuuuaa

SEQ ID NO: 3138287 - RNA, 16 nt, Human
uaacauguuaaaccau

SEQ ID NO: 3138288 - RNA, 17 nt, Human
uaacauguuaaaccaug

SEQ ID NO: 3138289 - RNA, 14 nt, Human
uaaccaagaggcug

SEQ ID NO: 3138290 - RNA, 15 nt, Human
uaaccaagaggcugg

SEQ ID NO: 3138291 - RNA, 16 nt, Human
uaaccaagaggcuggu

SEQ ID NO: 3138292 - RNA, 18 nt, Human
uaacauguuaaaccaugg

SEQ ID NO: 3138293 - RNA, 14 nt, Human
guuuagucuugucu

SEQ ID NO: 3138294 - RNA, 23 nt, Human
guuugugcugguguaugugugaa

SEQ ID NO: 3138295 - RNA, 12 nt, Human
guuuguuuaguc

SEQ ID NO: 3138296 - RNA, 14 nt, Human
uaaauccauuugga

SEQ ID NO: 3138297 - RNA, 15 nt, Human
uaaauccauuuggaa

SEQ ID NO: 3138298 - RNA, 16 nt, Human
uaaauccauuuggaaa

SEQ ID NO: 3138299 - RNA, 13 nt, Human
uaaaguugaauuu

SEQ ID NO: 3138300 - RNA, 14 nt, Human
uaaaguugaauuua

SEQ ID NO: 3138301 - RNA, 15 nt, Human
uaaaguugaauuuau

SEQ ID NO: 3138302 - RNA, 17 nt, Human
uaaaguugaauuuauug

SEQ ID NO: 3138303 - RNA, 19 nt, Human
uaaaguugaauuuauuggc

SEQ ID NO: 3138304 - RNA, 21 nt, Human
uaaaguugaauuuauuggcuu

SEQ ID NO: 3138305 - RNA, 23 nt, Human
uaaaguugaauuuauuggcuuuu

SEQ ID NO: 3138306 - RNA, 14 nt, Human
uaaacuuuucugau

SEQ ID NO: 3138307 - RNA, 15 nt, Human
uaaacuuuucugaua

SEQ ID NO: 3138308 - RNA, 13 nt, Human
uaaacuuuucuga

SEQ ID NO: 3138309 - RNA, 17 nt, Human
ugcgugcccggggcagc

SEQ ID NO: 3138310 - RNA, 15 nt, Human
ugcugaguuugugcu

SEQ ID NO: 3138311 - RNA, 17 nt, Human
ugcugaguuugugcugg

SEQ ID NO: 3138312 - RNA, 21 nt, Human
ugccuaaggacuucuuuaauu

SEQ ID NO: 3138313 - RNA, 23 nt, Human
ugccuaaggacuucuuuaauuuu

SEQ ID NO: 3138314 - RNA, 22 nt, Human
ugcacggugaauggcuuuguau

SEQ ID NO: 3138315 - RNA, 23 nt, Human
ugcacggugaauggcuuuguaua

SEQ ID NO: 3138316 - RNA, 19 nt, Human
ugcacggugaauggcuuug

SEQ ID NO: 3138317 - RNA, 18 nt, Human
ugccacccccgcuggagg

SEQ ID NO: 3138318 - RNA, 19 nt, Human
ugccacccccgcuggagga

SEQ ID NO: 3138319 - RNA, 23 nt, Human
ugccacccccgcuggaggaugug

SEQ ID NO: 3138320 - RNA, 17 nt, Human
ugggcgccgugcugggc

SEQ ID NO: 3138321 - RNA, 18 nt, Human
ugggcgccgugcugggca

SEQ ID NO: 3138322 - RNA, 19 nt, Human
ugggcgccgugcugggcag

SEQ ID NO: 3138323 - RNA, 20 nt, Human
ugggcgccgugcugggcagc

SEQ ID NO: 3138324 - RNA, 23 nt, Human
ugggcgccgugcugggcagcccg

SEQ ID NO: 3138325 - RNA, 20 nt, Human
ugggcgccccccccucccca

SEQ ID NO: 3138326 - RNA, 15 nt, Human
uggcuguacccagga

SEQ ID NO: 3138327 - RNA, 14 nt, Human
uggcuuuguauaga

SEQ ID NO: 3138328 - RNA, 22 nt, Human
uggcuuuguauagaaccucuuu

SEQ ID NO: 3138329 - RNA, 18 nt, Human
uggaggcggugcggcagg

SEQ ID NO: 3138330 - RNA, 22 nt, Human
uggaggcggugcggcagggaag

SEQ ID NO: 3138331 - RNA, 20 nt, Human
uggauaauaaggaaaaguuu

SEQ ID NO: 3138332 - RNA, 15 nt, Human
uggcauaacauaaau

SEQ ID NO: 3138333 - RNA, 12 nt, Human
ugcuuucagaua

SEQ ID NO: 3138334 - RNA, 16 nt, Human
ugcuuucagauacugg

SEQ ID NO: 3138335 - RNA, 17 nt, Human
ugcuuucagauacugga

SEQ ID NO: 3138336 - RNA, 20 nt, Human
ugcuuucagauacuggauug

SEQ ID NO: 3138337 - RNA, 21 nt, Human
ugcuuucagauacuggauugu

SEQ ID NO: 3138338 - RNA, 16 nt, Human
uguauagaaccucuuu

SEQ ID NO: 3138339 - RNA, 13 nt, Human
uguacucaauuuu

SEQ ID NO: 3138340 - RNA, 14 nt, Human
ugucccauucccug

SEQ ID NO: 3138341 - RNA, 15 nt, Human
ugucccauucccugg

SEQ ID NO: 3138342 - RNA, 16 nt, Human
ugucccauucccuggg

SEQ ID NO: 3138343 - RNA, 17 nt, Human
ugucccauucccuggga

SEQ ID NO: 3138344 - RNA, 18 nt, Human
ugucccauucccugggau

SEQ ID NO: 3138345 - RNA, 14 nt, Human
ugugcgcuaaacuu

SEQ ID NO: 3138346 - RNA, 23 nt, Human
ugugcgcuaaacuuuucugauag

SEQ ID NO: 3138347 - RNA, 19 nt, Human
ugugcgcuaaacuuuucug

SEQ ID NO: 3138348 - RNA, 22 nt, Human
ugugcgcuaaacuuuucugaua

SEQ ID NO: 3138349 - RNA, 21 nt, Human
uguuuguuuagucuugucuca

SEQ ID NO: 3138350 - RNA, 12 nt, Human
uguuuguuuagu

SEQ ID NO: 3138351 - RNA, 12 nt, Human
uuaacauguuaa

SEQ ID NO: 3138352 - RNA, 18 nt, Human
uuaacauguuaaaccaug

SEQ ID NO: 3138353 - RNA, 19 nt, Human
uuaacauguuaaaccaugg

SEQ ID NO: 3138354 - RNA, 18 nt, Human
uuaauaauuauaugcuau

SEQ ID NO: 3138355 - RNA, 20 nt, Human
uuaauaauuauaugcuauuu

SEQ ID NO: 3138356 - RNA, 23 nt, Human
uuaauaauuauaugcuauuucua

SEQ ID NO: 3138357 - RNA, 20 nt, Human
uguugaaacggaugauuucu

SEQ ID NO: 3138358 - RNA, 23 nt, Human
uguugaaacggaugauuucuaug

SEQ ID NO: 3138359 - RNA, 21 nt, Human
uguugaaacggaugauuucua

SEQ ID NO: 3138360 - RNA, 22 nt, Human
uguugaaacggaugauuucuau

SEQ ID NO: 3138361 - RNA, 14 nt, Human
uguuguuuguuuag

SEQ ID NO: 3138362 - RNA, 17 nt, Human
ugugugaagugagugag

SEQ ID NO: 3138363 - RNA, 14 nt, Human
uguguguaugcugc

SEQ ID NO: 3138364 - RNA, 16 nt, Human
uguguguaugcugcuu

SEQ ID NO: 3138365 - RNA, 17 nt, Human
uguguguaugcugcuuu

SEQ ID NO: 3138366 - RNA, 16 nt, Human
uguuagaucuaguuca

SEQ ID NO: 3138367 - RNA, 23 nt, Human
uguuaaaccaugggauaaaugcc

SEQ ID NO: 3138368 - RNA, 20 nt, Human
uguuaaaccaugggauaaau

SEQ ID NO: 3138369 - RNA, 21 nt, Human
uguuaaaccaugggauaaaug

SEQ ID NO: 3138370 - RNA, 18 nt, Human
uguuaaaccaugggauaa

SEQ ID NO: 3138371 - RNA, 16 nt, Human
uguuaaaccaugggau

SEQ ID NO: 3138372 - RNA, 20 nt, Human
uugaaacggaugauuucuau

SEQ ID NO: 3138373 - RNA, 22 nt, Human
uugaaacggaugauuucuaugc

SEQ ID NO: 3138374 - RNA, 21 nt, Human
uugaaacggaugauuucuaug

SEQ ID NO: 3138375 - RNA, 22 nt, Human
uuguacaaaguauuaagcauau

SEQ ID NO: 3138376 - RNA, 17 nt, Human
uuggcaucucuguccca

SEQ ID NO: 3138377 - RNA, 15 nt, Human
uuggcuuuucugauc

SEQ ID NO: 3138378 - RNA, 19 nt, Human
uuggcuuuucugauccagu

SEQ ID NO: 3138379 - RNA, 22 nt, Human
uuggcuuuucugauccaguuuu

SEQ ID NO: 3138380 - RNA, 21 nt, Human
uuggaccaaaaaccaguauug

SEQ ID NO: 3138381 - RNA, 15 nt, Human
uuggaaaucuuuaaa

SEQ ID NO: 3138382 - RNA, 12 nt, Human
uuggaaaucuuu

SEQ ID NO: 3138383 - RNA, 20 nt, Human
uugcuggggccgaaagaaca

SEQ ID NO: 3138384 - RNA, 16 nt, Human
uugcugcccugcccca

SEQ ID NO: 3138385 - RNA, 18 nt, Human
uugcgugcccggggcagc

SEQ ID NO: 3138386 - RNA, 15 nt, Human
uuacuaaaauggacu

SEQ ID NO: 3138387 - RNA, 18 nt, Human
uuacuaaaauggacugug

SEQ ID NO: 3138388 - RNA, 16 nt, Human
uuacuaaaauggacug

SEQ ID NO: 3138389 - RNA, 17 nt, Human
uuacuaaaauggacugu

SEQ ID NO: 3138390 - RNA, 11 nt, Human
uucacugauuu

SEQ ID NO: 3138391 - RNA, 18 nt, Human
uucagcugcauacaguuu

SEQ ID NO: 3138392 - RNA, 15 nt, Human
uucuauauuuucauu

SEQ ID NO: 3138393 - RNA, 16 nt, Human
uucuauauuuucauuc

SEQ ID NO: 3138394 - RNA, 18 nt, Human
uucuauauuuucauucuc

SEQ ID NO: 3138395 - RNA, 21 nt, Human
uucuauauuuucauucuccua

SEQ ID NO: 3138396 - RNA, 14 nt, Human
uucuauauguuuaa

SEQ ID NO: 3138397 - RNA, 11 nt, Human
uucuauauuuu

SEQ ID NO: 3138398 - RNA, 14 nt, Human
uucuauauuuucau

SEQ ID NO: 3138399 - RNA, 17 nt, Human
uucuaugcugaguuugu

SEQ ID NO: 3138400 - RNA, 17 nt, Human
uuuauuggcuuuucuga

SEQ ID NO: 3138401 - RNA, 21 nt, Human
uuuauuggcuuuucugaucca

SEQ ID NO: 3138402 - RNA, 13 nt, Human
uuuaugauccagc

SEQ ID NO: 3138403 - RNA, 20 nt, Human
uuucauuauuuuauuaugaa

SEQ ID NO: 3138404 - RNA, 14 nt, Human
uuucucuuucguua

SEQ ID NO: 3138405 - RNA, 15 nt, Human
uuucuaaccaagagg

SEQ ID NO: 3138406 - RNA, 19 nt, Human
uuucuaaccaagaggcugg

SEQ ID NO: 3138407 - RNA, 20 nt, Human
uuucuaaccaagaggcuggu

SEQ ID NO: 3138408 - RNA, 15 nt, Human
uuuuaugauccagca

SEQ ID NO: 3138409 - RNA, 13 nt, Human
uuuuaugauccag

SEQ ID NO: 3138410 - RNA, 19 nt, Human
uuuguuguuuguuuagucu

SEQ ID NO: 3138411 - RNA, 12 nt, Human
uuuguuguuugu

SEQ ID NO: 3138412 - RNA, 14 nt, Human
uuuguuguuuguuu

SEQ ID NO: 3138413 - RNA, 12 nt, Human
uuuguguuagag

SEQ ID NO: 3138414 - RNA, 11 nt, Human
uuuguauagaa

SEQ ID NO: 3138415 - RNA, 16 nt, Human
uuuggaaaucuuuaaa

SEQ ID NO: 3138416 - RNA, 15 nt, Human
uuuggaaaucuuuaa

SEQ ID NO: 3138417 - RNA, 20 nt, Human
ccaggaauggagccugcacg

SEQ ID NO: 3138418 - RNA, 23 nt, Human
cccaaaagaaacugacaugcccu

SEQ ID NO: 3138419 - RNA, 22 nt, Human
ccaugcuuaacauacccgccua

SEQ ID NO: 3138420 - RNA, 13 nt, Human
ccaucucccugcu

SEQ ID NO: 3138421 - RNA, 16 nt, Human
ccaucucccugcuuug

SEQ ID NO: 3138422 - RNA, 19 nt, Human
ccaucaauaaaaaauuaug

SEQ ID NO: 3138423 - RNA, 20 nt, Human
ccaucaauaaaaaauuauga

SEQ ID NO: 3138424 - RNA, 13 nt, Human
ccaugcagguggu

SEQ ID NO: 3138425 - RNA, 23 nt, Human
ccaugcagguggugucgggcccu

SEQ ID NO: 3138426 - RNA, 15 nt, Human
cccaaguuggggguc

SEQ ID NO: 3138427 - RNA, 13 nt, Human
cccacaccuccuc

SEQ ID NO: 3138428 - RNA, 14 nt, Human
cccacaccuccucu

SEQ ID NO: 3138429 - RNA, 17 nt, Human
cccacaccuccucucac

SEQ ID NO: 3138430 - RNA, 18 nt, Human
cccacaccuccucucacu

SEQ ID NO: 3138431 - RNA, 20 nt, Human
ccccaacucgggcucccggg

SEQ ID NO: 3138432 - RNA, 12 nt, Human
ccaagaggcugg

SEQ ID NO: 3138433 - RNA, 13 nt, Human
ccaagaggcuggu

SEQ ID NO: 3138434 - RNA, 14 nt, Human
ccaagaggcugguu

SEQ ID NO: 3138435 - RNA, 23 nt, Human
ccaagaggcugguuuuggcaucu

SEQ ID NO: 3138436 - RNA, 12 nt, Human
cauuuaauaauu

SEQ ID NO: 3138437 - RNA, 14 nt, Human
cauuuaauaauuau

SEQ ID NO: 3138438 - RNA, 15 nt, Human
cauuuaauaauuaua

SEQ ID NO: 3138439 - RNA, 16 nt, Human
cauuuaauaauuauau

SEQ ID NO: 3138440 - RNA, 17 nt, Human
cauuuaauaauuauaug

SEQ ID NO: 3138441 - RNA, 19 nt, Human
cauuuaauaauuauaugcu

SEQ ID NO: 3138442 - RNA, 23 nt, Human
cauuuaauaauuauaugcuauuu

SEQ ID NO: 3138443 - RNA, 17 nt, Human
ccccguguuccccucuu

SEQ ID NO: 3138444 - RNA, 13 nt, Human
ccccuccccaugc

SEQ ID NO: 3138445 - RNA, 21 nt, Human
ccccuccccaugcagguggug

SEQ ID NO: 3138446 - RNA, 17 nt, Human
ccccccacacuucccug

SEQ ID NO: 3138447 - RNA, 13 nt, Human
cccccgcuggagg

SEQ ID NO: 3138448 - RNA, 17 nt, Human
ccgggcaaaugccaggg

SEQ ID NO: 3138449 - RNA, 18 nt, Human
ccgggcaaaugccagggc

SEQ ID NO: 3138450 - RNA, 19 nt, Human
ccgggcaaaugccagggcc

SEQ ID NO: 3138451 - RNA, 21 nt, Human
ccgggcaaaugccagggcccg

SEQ ID NO: 3138452 - RNA, 13 nt, Human
ccgugcuaaggac

SEQ ID NO: 3138453 - RNA, 21 nt, Human
ccucacccacccuuuuuuaaa

SEQ ID NO: 3138454 - RNA, 13 nt, Human
ccugauuaaagaa

SEQ ID NO: 3138455 - RNA, 12 nt, Human
ccugauuaaaga

SEQ ID NO: 3138456 - RNA, 12 nt, Human
ccuccucccaug

SEQ ID NO: 3138457 - RNA, 13 nt, Human
ccuccucccaugu

SEQ ID NO: 3138458 - RNA, 14 nt, Human
ccuccucccauguc

SEQ ID NO: 3138459 - RNA, 18 nt, Human
ccuccucccaugucacug

SEQ ID NO: 3138460 - RNA, 22 nt, Human
ccuccucccaugucacugcaga

SEQ ID NO: 3138461 - RNA, 16 nt, Human
ccuuugcuugaaagaa

SEQ ID NO: 3138462 - RNA, 16 nt, Human
ccuuucucuuucguua

SEQ ID NO: 3138463 - RNA, 21 nt, Human
ccuuggcccccuuucccgggc

SEQ ID NO: 3138464 - RNA, 13 nt, Human
cgcguugaaauug

SEQ ID NO: 3138465 - RNA, 17 nt, Human
cgcguugaaauuguaau

SEQ ID NO: 3138466 - RNA, 21 nt, Human
cgcguugaaauuguaauuaua

SEQ ID NO: 3138467 - RNA, 15 nt, Human
cgcuaggcucgccuu

SEQ ID NO: 3138468 - RNA, 18 nt, Human
cgcuaggcucgccuuccc

SEQ ID NO: 3138469 - RNA, 21 nt, Human
cgcuaggcucgccuucccucc

SEQ ID NO: 3138470 - RNA, 22 nt, Human
cgcuaggcucgccuucccuccu

SEQ ID NO: 3138471 - RNA, 23 nt, Human
cgcuaggcucgccuucccuccug

SEQ ID NO: 3138472 - RNA, 18 nt, Human
cgccccccacacuucccu

SEQ ID NO: 3138473 - RNA, 20 nt, Human
cgccccccacacuucccugg

SEQ ID NO: 3138474 - RNA, 21 nt, Human
cgccccccacacuucccuggc

SEQ ID NO: 3138475 - RNA, 17 nt, Human
cgccccccccuccccau

SEQ ID NO: 3138476 - RNA, 13 nt, Human
cggaugauuucua

SEQ ID NO: 3138477 - RNA, 14 nt, Human
cggaugauuucuau

SEQ ID NO: 3138478 - RNA, 18 nt, Human
cggggcagcagcagcccu

SEQ ID NO: 3138479 - RNA, 20 nt, Human
cggggcagcagcagcccugc

SEQ ID NO: 3138480 - RNA, 21 nt, Human
cggggcagcagcagcccugcc

SEQ ID NO: 3138481 - RNA, 17 nt, Human
cggggccgacauugucu

SEQ ID NO: 3138482 - RNA, 19 nt, Human
cguauguggcaaaauguua

SEQ ID NO: 3138483 - RNA, 14 nt, Human
cgucucccccgugu

SEQ ID NO: 3138484 - RNA, 21 nt, Human
cgucucccccguguuccccuc

SEQ ID NO: 3138485 - RNA, 22 nt, Human
cgucucccccguguuccccucu

SEQ ID NO: 3138486 - RNA, 10 nt, Human
cgucuccccc

SEQ ID NO: 3138487 - RNA, 14 nt, Human
cgugcccggggcag

SEQ ID NO: 3138488 - RNA, 16 nt, Human
cgugcccggggcagca

SEQ ID NO: 3138489 - RNA, 22 nt, Human
cguucauggaacgcguugaaau

SEQ ID NO: 3138490 - RNA, 21 nt, Human
cguucauggaacgcguugaaa

SEQ ID NO: 3138491 - RNA, 23 nt, Human
cguucauggaacgcguugaaauu

SEQ ID NO: 3138492 - RNA, 22 nt, Human
cguuccgggcaaaugccagggc

SEQ ID NO: 3138493 - RNA, 13 nt, Human
cguugaaauugua

SEQ ID NO: 3138494 - RNA, 18 nt, Human
ccugcuuugcgugcccgg

SEQ ID NO: 3138495 - RNA, 19 nt, Human
ccugcuuugcgugcccggg

SEQ ID NO: 3138496 - RNA, 20 nt, Human
ccugcuuugcgugcccgggg

SEQ ID NO: 3138497 - RNA, 21 nt, Human
ccugcuuucagauacuggauu

SEQ ID NO: 3138498 - RNA, 15 nt, Human
ccugcuuucagauac

SEQ ID NO: 3138499 - RNA, 16 nt, Human
ccugcuuucagauacu

SEQ ID NO: 3138500 - RNA, 15 nt, Human
ccuggcggccccaac

SEQ ID NO: 3138501 - RNA, 18 nt, Human
ccuggcggccccaacucg

SEQ ID NO: 3138502 - RNA, 15 nt, Human
ccugggaucuggugg

SEQ ID NO: 3138503 - RNA, 20 nt, Human
ccugggaucugguggucagc

SEQ ID NO: 3138504 - RNA, 21 nt, Human
ccugggaucugguggucagcc

SEQ ID NO: 3138505 - RNA, 23 nt, Human
ccugggaucugguggucagcccu

SEQ ID NO: 3138506 - RNA, 15 nt, Human
cugauucuucagcaa

SEQ ID NO: 3138507 - RNA, 18 nt, Human
cugcagauugagaccuac

SEQ ID NO: 3138508 - RNA, 20 nt, Human
cugauccaguuuuguuugga

SEQ ID NO: 3138509 - RNA, 20 nt, Human
cugauagaggaagccugauu

SEQ ID NO: 3138510 - RNA, 20 nt, Human
cugccuaaggacuucuuuaa

SEQ ID NO: 3138511 - RNA, 21 nt, Human
cugccuaaggacuucuuuaau

SEQ ID NO: 3138512 - RNA, 22 nt, Human
cugccuaaggacuucuuuaauu

SEQ ID NO: 3138513 - RNA, 19 nt, Human
cugccuaaggacuucuuua

SEQ ID NO: 3138514 - RNA, 15 nt, Human
cugcuccguggagga

SEQ ID NO: 3138515 - RNA, 23 nt, Human
cugcuccguggaggagguuggga

SEQ ID NO: 3138516 - RNA, 12 nt, Human
cugguggucagc

SEQ ID NO: 3138517 - RNA, 15 nt, Human
cugguggucagcccu

SEQ ID NO: 3138518 - RNA, 16 nt, Human
cugguggucagcccua

SEQ ID NO: 3138519 - RNA, 19 nt, Human
cugguggucagcccuagga

SEQ ID NO: 3138520 - RNA, 16 nt, Human
cuggaggcggugcggc

SEQ ID NO: 3138521 - RNA, 17 nt, Human
cuggaggcggugcggca

SEQ ID NO: 3138522 - RNA, 18 nt, Human
cuggaggcggugcggcag

SEQ ID NO: 3138523 - RNA, 19 nt, Human
cuggaggcggugcggcagg

SEQ ID NO: 3138524 - RNA, 17 nt, Human
cuggagggaagagugga

SEQ ID NO: 3138525 - RNA, 21 nt, Human
cuggagggaagaguggaggug

SEQ ID NO: 3138526 - RNA, 22 nt, Human
cuggagggaagaguggaggugg

SEQ ID NO: 3138527 - RNA, 23 nt, Human
cuggagggaagaguggaggugga

SEQ ID NO: 3138528 - RNA, 17 nt, Human
cuggaggaugugggcag

SEQ ID NO: 3138529 - RNA, 18 nt, Human
cuggaggaugugggcagc

SEQ ID NO: 3138530 - RNA, 19 nt, Human
cuggaggaugugggcagcu

SEQ ID NO: 3138531 - RNA, 22 nt, Human
cuggcaaaauaguucugcaggu

SEQ ID NO: 3138532 - RNA, 23 nt, Human
cuggcaaaauaguucugcagguu

SEQ ID NO: 3138533 - RNA, 19 nt, Human
cuggauuguacuuugugcu

SEQ ID NO: 3138534 - RNA, 20 nt, Human
cuggauuguacuuugugcug

SEQ ID NO: 3138535 - RNA, 18 nt, Human
cugcuuucagauacugga

SEQ ID NO: 3138536 - RNA, 21 nt, Human
cugcuuucagauacuggauug

SEQ ID NO: 3138537 - RNA, 17 nt, Human
cugcuuuggucuugccc

SEQ ID NO: 3138538 - RNA, 16 nt, Human
cugcuuucagauacug

SEQ ID NO: 3138539 - RNA, 18 nt, Human
cuccuaucaccugucuug

SEQ ID NO: 3138540 - RNA, 14 nt, Human
cuccucucacuccc

SEQ ID NO: 3138541 - RNA, 15 nt, Human
cuccucucacucccc

SEQ ID NO: 3138542 - RNA, 18 nt, Human
cuccucucacuccccagc

SEQ ID NO: 3138543 - RNA, 22 nt, Human
cuccucucacuccccagccugg

SEQ ID NO: 3138544 - RNA, 13 nt, Human
cucccuucccucc

SEQ ID NO: 3138545 - RNA, 14 nt, Human
cucccuucccuccu

SEQ ID NO: 3138546 - RNA, 15 nt, Human
cucccuucccuccuc

SEQ ID NO: 3138547 - RNA, 16 nt, Human
cucccuucccuccucc

SEQ ID NO: 3138548 - RNA, 13 nt, Human
cucccuucucccu

SEQ ID NO: 3138549 - RNA, 14 nt, Human
cucccuucucccug

SEQ ID NO: 3138550 - RNA, 15 nt, Human
cucccuucucccugg

SEQ ID NO: 3138551 - RNA, 16 nt, Human
cucccuucucccugga

SEQ ID NO: 3138552 - RNA, 17 nt, Human
cucccuucucccuggau

SEQ ID NO: 3138553 - RNA, 12 nt, Human
cucuugucuccc

SEQ ID NO: 3138554 - RNA, 13 nt, Human
cucuugucucccc

SEQ ID NO: 3138555 - RNA, 14 nt, Human
cucuugucuccccu

SEQ ID NO: 3138556 - RNA, 16 nt, Human
cucuugucuccccugu

SEQ ID NO: 3138557 - RNA, 20 nt, Human
cucuugucuccccuguuccc

SEQ ID NO: 3138558 - RNA, 15 nt, Human
cugaagucagaucug

SEQ ID NO: 3138559 - RNA, 16 nt, Human
cugaagucagaucugc

SEQ ID NO: 3138560 - RNA, 14 nt, Human
cugaagucagaucu

SEQ ID NO: 3138561 - RNA, 13 nt, Human
cucuccauuuaau

SEQ ID NO: 3138562 - RNA, 23 nt, Human
cuuaugccacccccgcuggagga

SEQ ID NO: 3138563 - RNA, 14 nt, Human
cuuaagccacugcc

SEQ ID NO: 3138564 - RNA, 17 nt, Human
cuuaagccacugccucu

SEQ ID NO: 3138565 - RNA, 19 nt, Human
cuuaagccacugccucucc

SEQ ID NO: 3138566 - RNA, 20 nt, Human
cuuaagccacugccucuccc

SEQ ID NO: 3138567 - RNA, 21 nt, Human
cuuaagccacugccucucccu

SEQ ID NO: 3138568 - RNA, 22 nt, Human
cuuaagccacugccucucccuc

SEQ ID NO: 3138569 - RNA, 11 nt, Human
cuucccuccuc

SEQ ID NO: 3138570 - RNA, 12 nt, Human
cuucccuccucc

SEQ ID NO: 3138571 - RNA, 13 nt, Human
cuucccuccuccc

SEQ ID NO: 3138572 - RNA, 14 nt, Human
cuucccuccuccca

SEQ ID NO: 3138573 - RNA, 16 nt, Human
cuucccuccucccaug

SEQ ID NO: 3138574 - RNA, 17 nt, Human
cuucccuccucccaugu

SEQ ID NO: 3138575 - RNA, 18 nt, Human
cuucccuccucccauguc

SEQ ID NO: 3138576 - RNA, 19 nt, Human
cuucccuccucccauguca

SEQ ID NO: 3138577 - RNA, 13 nt, Human
cuucccuccugcu

SEQ ID NO: 3138578 - RNA, 15 nt, Human
cuucccuccugcuuu

SEQ ID NO: 3138579 - RNA, 16 nt, Human
cuucccuccugcuuug

SEQ ID NO: 3138580 - RNA, 20 nt, Human
cuugggcgccgugcugggca

SEQ ID NO: 3138581 - RNA, 21 nt, Human
cuugggcgccgugcugggcag

SEQ ID NO: 3138582 - RNA, 22 nt, Human
cuugggcgccgugcugggcagc

SEQ ID NO: 3138583 - RNA, 23 nt, Human
cuugggcgccgugcugggcagcc

SEQ ID NO: 3138584 - RNA, 13 nt, Human
cuuguuagaucua

SEQ ID NO: 3138585 - RNA, 17 nt, Human
cuuuaaaaaaaaaauug

SEQ ID NO: 3138586 - RNA, 13 nt, Human
cuugcugcccugc

SEQ ID NO: 3138587 - RNA, 16 nt, Human
cuugcugcccugcccc

SEQ ID NO: 3138588 - RNA, 20 nt, Human
cuugcugcccugccccaagu

SEQ ID NO: 3138589 - RNA, 16 nt, Human
cuuuggauaauaagga

SEQ ID NO: 3138590 - RNA, 14 nt, Human
cuuuggauaauaag

SEQ ID NO: 3138591 - RNA, 14 nt, Human
cuuugcuugaaaga

SEQ ID NO: 3138592 - RNA, 13 nt, Human
cuuucugaaauaa

SEQ ID NO: 3138593 - RNA, 14 nt, Human
cuuuucugauccag

SEQ ID NO: 3138594 - RNA, 15 nt, Human
cuuuucugauccagu

SEQ ID NO: 3138595 - RNA, 14 nt, Human
cuuuucugauagag

SEQ ID NO: 3138596 - RNA, 11 nt, Human
cuuuucugauc

SEQ ID NO: 3138597 - RNA, 16 nt, Human
cuuuucugauccaguu

SEQ ID NO: 3138598 - RNA, 18 nt, Human
cuuuucugauccaguuuu

SEQ ID NO: 3138599 - RNA, 14 nt, Human
cuuuuucauuauuu

SEQ ID NO: 3138600 - RNA, 12 nt, Human
cuuuuucauuau

SEQ ID NO: 3138601 - RNA, 13 nt, Human
cuuuuucauuauu

SEQ ID NO: 3138602 - RNA, 15 nt, Human
cuuuuuuaaauaaau

SEQ ID NO: 3138603 - RNA, 22 nt, Human
gaauuuauuggcuuuucugauc

SEQ ID NO: 3138604 - RNA, 14 nt, Human
gaauuuauuggcuu

SEQ ID NO: 3138605 - RNA, 16 nt, Human
gaauuuauuggcuuuu

SEQ ID NO: 3138606 - RNA, 20 nt, Human
gaauuuauuggcuuuucuga

SEQ ID NO: 3138607 - RNA, 21 nt, Human
gaauuuauuggcuuuucugau

SEQ ID NO: 3138608 - RNA, 23 nt, Human
gaaugguccgugcuaaggacuug

SEQ ID NO: 3138609 - RNA, 20 nt, Human
gaaugguccgugcuaaggac

SEQ ID NO: 3138610 - RNA, 22 nt, Human
gaaugguccgugcuaaggacuu

SEQ ID NO: 3138611 - RNA, 21 nt, Human
gaauggcuuuguauagaaccu

SEQ ID NO: 3138612 - RNA, 20 nt, Human
gaagaggggugcagaggcug

SEQ ID NO: 3138613 - RNA, 17 nt, Human
gaaauuguaauuauauc

SEQ ID NO: 3138614 - RNA, 16 nt, Human
gacugauucuucagca

SEQ ID NO: 3138615 - RNA, 13 nt, Human
gacugauucuuca

SEQ ID NO: 3138616 - RNA, 22 nt, Human
gauaauaaggaaaaguuuaaua

SEQ ID NO: 3138617 - RNA, 20 nt, Human
gauaauaaggaaaaguuuaa

SEQ ID NO: 3138618 - RNA, 21 nt, Human
gauaauaaggaaaaguuuaau

SEQ ID NO: 3138619 - RNA, 17 nt, Human
gauaauuauugguaauu

SEQ ID NO: 3138620 - RNA, 15 nt, Human
gaucuaggagaggag

SEQ ID NO: 3138621 - RNA, 21 nt, Human
gaucuaggagaggagaaccag

SEQ ID NO: 3138622 - RNA, 17 nt, Human
gaucuaguucacucucc

SEQ ID NO: 3138623 - RNA, 14 nt, Human
gaucugguggucag

SEQ ID NO: 3138624 - RNA, 19 nt, Human
gaucugguggucagcccua

SEQ ID NO: 3138625 - RNA, 20 nt, Human
gaucugguggucagcccuag

SEQ ID NO: 3138626 - RNA, 22 nt, Human
gaucugguggucagcccuagga

SEQ ID NO: 3138627 - RNA, 14 nt, Human
gaucuaccuggagg

SEQ ID NO: 3138628 - RNA, 15 nt, Human
gaucuaccuggaggg

SEQ ID NO: 3138629 - RNA, 17 nt, Human
gaucuaccuggagggaa

SEQ ID NO: 3138630 - RNA, 14 nt, Human
gcaaaugccagggc

SEQ ID NO: 3138631 - RNA, 15 nt, Human
gcaaaugccagggcc

SEQ ID NO: 3138632 - RNA, 17 nt, Human
gcaaaugccagggcccg

SEQ ID NO: 3138633 - RNA, 18 nt, Human
gcaaaugccagggcccgc

SEQ ID NO: 3138634 - RNA, 16 nt, Human
gcauauauuuuuauau

SEQ ID NO: 3138635 - RNA, 14 nt, Human
gcauauauuuuuau

SEQ ID NO: 3138636 - RNA, 15 nt, Human
gcauauauuuuuaua

SEQ ID NO: 3138637 - RNA, 11 nt, Human
gcauauauuuu

SEQ ID NO: 3138638 - RNA, 20 nt, Human
gcuagacuggugacugauuc

SEQ ID NO: 3138639 - RNA, 22 nt, Human
gcuagacuggugacugauucuu

SEQ ID NO: 3138640 - RNA, 13 nt, Human
gcuagacugguga

SEQ ID NO: 3138641 - RNA, 15 nt, Human
gcuagacuggugacu

SEQ ID NO: 3138642 - RNA, 16 nt, Human
gcuagacuggugacug

SEQ ID NO: 3138643 - RNA, 19 nt, Human
gcuagacuggugacugauu

SEQ ID NO: 3138644 - RNA, 13 nt, Human
gcgcuugggcgcc

SEQ ID NO: 3138645 - RNA, 21 nt, Human
gcgcuugggcgccgugcuggg

SEQ ID NO: 3138646 - RNA, 22 nt, Human
gcgcuugggcgccgugcugggc

SEQ ID NO: 3138647 - RNA, 23 nt, Human
gcgcuugggcgccgugcugggca

SEQ ID NO: 3138648 - RNA, 11 nt, Human
gcgccacugcu

SEQ ID NO: 3138649 - RNA, 18 nt, Human
gcgccacugcuccgugga

SEQ ID NO: 3138650 - RNA, 19 nt, Human
gcgccacugcuccguggag

SEQ ID NO: 3138651 - RNA, 20 nt, Human
gccuuuuucauuauuuuauu

SEQ ID NO: 3138652 - RNA, 22 nt, Human
gccuuuuucauuauuuuauuau

SEQ ID NO: 3138653 - RNA, 12 nt, Human
gccuuuuucauu

SEQ ID NO: 3138654 - RNA, 16 nt, Human
gccuuuuucauuauuu

SEQ ID NO: 3138655 - RNA, 12 nt, Human
gccuaaggacuu

SEQ ID NO: 3138656 - RNA, 13 nt, Human
gccuaaggacuuc

SEQ ID NO: 3138657 - RNA, 14 nt, Human
gccuaaggacuucu

SEQ ID NO: 3138658 - RNA, 15 nt, Human
gccuaaggacuucuu

SEQ ID NO: 3138659 - RNA, 18 nt, Human
gccuaaggacuucuuuaa

SEQ ID NO: 3138660 - RNA, 15 nt, Human
gcccuucuugcugcc

SEQ ID NO: 3138661 - RNA, 16 nt, Human
gcccuucuugcugccc

SEQ ID NO: 3138662 - RNA, 23 nt, Human
gcccuucuugcugcccugcccca

SEQ ID NO: 3138663 - RNA, 13 nt, Human
gccagggcccgca

SEQ ID NO: 3138664 - RNA, 14 nt, Human
gccagggcuggaga

SEQ ID NO: 3138665 - RNA, 15 nt, Human
gccagggcuggagaa

SEQ ID NO: 3138666 - RNA, 13 nt, Human
gcccaucucccug

SEQ ID NO: 3138667 - RNA, 14 nt, Human
gcccaucucccugc

SEQ ID NO: 3138668 - RNA, 17 nt, Human
gcccaucucccugcuuu

SEQ ID NO: 3138669 - RNA, 18 nt, Human
gcccaucucccugcuuug

SEQ ID NO: 3138670 - RNA, 22 nt, Human
ggaagaggggugcagaggcugu

SEQ ID NO: 3138671 - RNA, 21 nt, Human
ggaacgcguugaaauuguaau

SEQ ID NO: 3138672 - RNA, 17 nt, Human
ggaacgcguugaaauug

SEQ ID NO: 3138673 - RNA, 16 nt, Human
ggaacgcguugaaauu

SEQ ID NO: 3138674 - RNA, 18 nt, Human
ggaaaaguuuaauauuaa

SEQ ID NO: 3138675 - RNA, 19 nt, Human
ggaaaaguuuaauauuaaa

SEQ ID NO: 3138676 - RNA, 22 nt, Human
gcuggugcccugcuuucagaua

SEQ ID NO: 3138677 - RNA, 24 nt, Human
gcuggugcccugcuuucagauacu

SEQ ID NO: 3138678 - RNA, 14 nt, Human
ggcagcagcagccc

SEQ ID NO: 3138679 - RNA, 15 nt, Human
ggcagcagcagcccu

SEQ ID NO: 3138680 - RNA, 16 nt, Human
ggcagcagcagcccug

SEQ ID NO: 3138681 - RNA, 17 nt, Human
ggcagcagcagcccugc

SEQ ID NO: 3138682 - RNA, 17 nt, Human
ggcccccuuucccgggc

SEQ ID NO: 3138683 - RNA, 18 nt, Human
ggcccccuuucccgggcu

SEQ ID NO: 3138684 - RNA, 19 nt, Human
ggcccccuuucccgggcug

SEQ ID NO: 3138685 - RNA, 15 nt, Human
ggaggaugugggcag

SEQ ID NO: 3138686 - RNA, 16 nt, Human
ggaggaugugggcagc

SEQ ID NO: 3138687 - RNA, 20 nt, Human
gguuaucugaagucagaucu

SEQ ID NO: 3138688 - RNA, 16 nt, Human
gguguaugugugaagu

SEQ ID NO: 3138689 - RNA, 16 nt, Human
gguggugucgggcccu

SEQ ID NO: 3138690 - RNA, 19 nt, Human
gguggugucgggcccuucu

SEQ ID NO: 3138691 - RNA, 14 nt, Human
gguggucagcccua

SEQ ID NO: 3138692 - RNA, 14 nt, Human
ggugacuuuggaua

SEQ ID NO: 3138693 - RNA, 18 nt, Human
ggugacuuuggauaauaa

SEQ ID NO: 3138694 - RNA, 21 nt, Human
ggugacuuuggauaauaagga

SEQ ID NO: 3138695 - RNA, 19 nt, Human
ggugacuuuggauaauaag

SEQ ID NO: 3138696 - RNA, 20 nt, Human
ggugacuuuggauaauaagg

SEQ ID NO: 3138697 - RNA, 17 nt, Human
ggucucgucuuccgucu

SEQ ID NO: 3138698 - RNA, 20 nt, Human
ggucucgucuuccgucuccc

SEQ ID NO: 3138699 - RNA, 22 nt, Human
ggucucgucuuccgucuccccc

SEQ ID NO: 3138700 - RNA, 14 nt, Human
gggugcagaggcug

SEQ ID NO: 3138701 - RNA, 15 nt, Human
gggugcagaggcugu

SEQ ID NO: 3138702 - RNA, 16 nt, Human
gggugcagaggcugug

SEQ ID NO: 3138703 - RNA, 11 nt, Human
ggggauucuua

SEQ ID NO: 3138704 - RNA, 15 nt, Human
ggggauucuuaaagu

SEQ ID NO: 3138705 - RNA, 12 nt, Human
gggcccuggagg

SEQ ID NO: 3138706 - RNA, 13 nt, Human
gggcccuggaggc

SEQ ID NO: 3138707 - RNA, 16 nt, Human
gggaucuaggagagga

SEQ ID NO: 3138708 - RNA, 13 nt, Human
ggcuuuucugauc

SEQ ID NO: 3138709 - RNA, 16 nt, Human
ggcuuuucugauccag

SEQ ID NO: 3138710 - RNA, 12 nt, Human
ggcuuuucugau

SEQ ID NO: 3138711 - RNA, 17 nt, Human
ggcuuuucugauccagu

SEQ ID NO: 3138712 - RNA, 15 nt, Human
cugaggaauucugua

SEQ ID NO: 3138713 - RNA, 16 nt, Human
cugaggaauucuguau

SEQ ID NO: 3138714 - RNA, 18 nt, Human
cugaggaauucuguauag

SEQ ID NO: 3138715 - RNA, 19 nt, Human
cugaggaauucuguauaga

SEQ ID NO: 3138716 - RNA, 13 nt, Human
cuccuuucucuuu

SEQ ID NO: 3138717 - RNA, 13 nt, Human
cucucccuucccu

SEQ ID NO: 3138718 - RNA, 14 nt, Human
cucucccuucccuc

SEQ ID NO: 3138719 - RNA, 15 nt, Human
cucucccuucccucc

SEQ ID NO: 3138720 - RNA, 16 nt, Human
cucucccuucccuccu

SEQ ID NO: 3138721 - RNA, 14 nt, Human
cucccucugguccc

SEQ ID NO: 3138722 - RNA, 15 nt, Human
cucccucugguccca

SEQ ID NO: 3138723 - RNA, 17 nt, Human
cuaggcucgccuucccu

SEQ ID NO: 3138724 - RNA, 18 nt, Human
cuaggcucgccuucccuc

SEQ ID NO: 3138725 - RNA, 20 nt, Human
cuaggcucgccuucccuccu

SEQ ID NO: 3138726 - RNA, 21 nt, Human
cuaggcucgccuucccuccug

SEQ ID NO: 3138727 - RNA, 22 nt, Human
cuagaccagugagcgcuugggc

SEQ ID NO: 3138728 - RNA, 19 nt, Human
cgcuggaggaugugggcag

SEQ ID NO: 3138729 - RNA, 20 nt, Human
cgcuggaggaugugggcagc

SEQ ID NO: 3138730 - RNA, 21 nt, Human
cgcuggaggaugugggcagcu

SEQ ID NO: 3138731 - RNA, 13 nt, Human
cgccuucccuccu

SEQ ID NO: 3138732 - RNA, 14 nt, Human
cgccuucccuccug

SEQ ID NO: 3138733 - RNA, 15 nt, Human
cgccuucccuccugc

SEQ ID NO: 3138734 - RNA, 19 nt, Human
cgccuucccuccugcuuug

SEQ ID NO: 3138735 - RNA, 15 nt, Human
cgguggugaggcagu

SEQ ID NO: 3138736 - RNA, 15 nt, Human
cuaaacuuuucugau

SEQ ID NO: 3138737 - RNA, 16 nt, Human
cuaaacuuuucugaua

SEQ ID NO: 3138738 - RNA, 14 nt, Human
ccucccuucucccu

SEQ ID NO: 3138739 - RNA, 15 nt, Human
ccucccuucucccug

SEQ ID NO: 3138740 - RNA, 16 nt, Human
ccucccuucucccugg

SEQ ID NO: 3138741 - RNA, 17 nt, Human
ccucccuucucccugga

SEQ ID NO: 3138742 - RNA, 18 nt, Human
ccucccuucucccuggau

SEQ ID NO: 3138743 - RNA, 13 nt, Human
cccuucucccugg

SEQ ID NO: 3138744 - RNA, 14 nt, Human
cccuucucccugga

SEQ ID NO: 3138745 - RNA, 15 nt, Human
cccuucucccuggau

SEQ ID NO: 3138746 - RNA, 14 nt, Human
ccgacauugucucc

SEQ ID NO: 3138747 - RNA, 15 nt, Human
ccgacauugucuccc

SEQ ID NO: 3138748 - RNA, 17 nt, Human
ccgacauugucucccgc

SEQ ID NO: 3138749 - RNA, 18 nt, Human
ccccucuugucuccccug

SEQ ID NO: 3138750 - RNA, 12 nt, Human
cccuccucccau

SEQ ID NO: 3138751 - RNA, 19 nt, Human
cccuccucccaugucacug

SEQ ID NO: 3138752 - RNA, 20 nt, Human
cccuccucccaugucacugc

SEQ ID NO: 3138753 - RNA, 13 nt, Human
cccuccugcuuug

SEQ ID NO: 3138754 - RNA, 13 nt, Human
cccccuuucccgg

SEQ ID NO: 3138755 - RNA, 14 nt, Human
cccccuuucccggg

SEQ ID NO: 3138756 - RNA, 15 nt, Human
cccccuuucccgggc

SEQ ID NO: 3138757 - RNA, 23 nt, Human
ccccaugcuuaacauacccgccu

SEQ ID NO: 3138758 - RNA, 15 nt, Human
cccaucacugcgcca

SEQ ID NO: 3138759 - RNA, 21 nt, Human
cccaucacugcgccacugcuc

SEQ ID NO: 3138760 - RNA, 22 nt, Human
cccaucacugcgccacugcucc

SEQ ID NO: 3138761 - RNA, 16 nt, Human
cccaacucgggcuccc

SEQ ID NO: 3138762 - RNA, 20 nt, Human
cccaacucgggcucccgggu

SEQ ID NO: 3138763 - RNA, 21 nt, Human
auuguaauuauaucugaggaa

SEQ ID NO: 3138764 - RNA, 16 nt, Human
auuguacaaaguauua

SEQ ID NO: 3138765 - RNA, 17 nt, Human
auuguacaaaguauuaa

SEQ ID NO: 3138766 - RNA, 19 nt, Human
auuguacaaaguauuaagc

SEQ ID NO: 3138767 - RNA, 16 nt, Human
auuguaauuauaucug

SEQ ID NO: 3138768 - RNA, 17 nt, Human
auuguaauuauaucuga

SEQ ID NO: 3138769 - RNA, 15 nt, Human
auuguaauuauaucu

SEQ ID NO: 3138770 - RNA, 15 nt, Human
auuucuauauuuuca

SEQ ID NO: 3138771 - RNA, 16 nt, Human
auuucuauauuuucau

SEQ ID NO: 3138772 - RNA, 17 nt, Human
auuucuauauuuucauu

SEQ ID NO: 3138773 - RNA, 18 nt, Human
auuucuauauuuucauuc

SEQ ID NO: 3138774 - RNA, 19 nt, Human
auuucuauauuuucauucu

SEQ ID NO: 3138775 - RNA, 19 nt, Human
auuucuaugcugaguuugu

SEQ ID NO: 3138776 - RNA, 21 nt, Human
auuucuaugcugaguuugugc

SEQ ID NO: 3138777 - RNA, 22 nt, Human
auuucuaugcugaguuugugcu

SEQ ID NO: 3138778 - RNA, 15 nt, Human
caacucgggcucccg

SEQ ID NO: 3138779 - RNA, 23 nt, Human
caaaugcuguaacuuucugaaau

SEQ ID NO: 3138780 - RNA, 14 nt, Human
caaaugccagggcc

SEQ ID NO: 3138781 - RNA, 16 nt, Human
caaaugccagggcccg

SEQ ID NO: 3138782 - RNA, 13 nt, Human
auuuuuuuguugu

SEQ ID NO: 3138783 - RNA, 15 nt, Human
auuuuuauauuuacu

SEQ ID NO: 3138784 - RNA, 16 nt, Human
auuuuuauauuuacua

SEQ ID NO: 3138785 - RNA, 13 nt, Human
caugucacugcag

SEQ ID NO: 3138786 - RNA, 22 nt, Human
cauuuggaaaucuuuaaaaaaa

SEQ ID NO: 3138787 - RNA, 12 nt, Human
caguauuguaca

SEQ ID NO: 3138788 - RNA, 13 nt, Human
caguauuguacaa

SEQ ID NO: 3138789 - RNA, 16 nt, Human
caguauuguacaaagu

SEQ ID NO: 3138790 - RNA, 17 nt, Human
caguauuguacaaagua

SEQ ID NO: 3138791 - RNA, 18 nt, Human
caguauuguacaaaguau

SEQ ID NO: 3138792 - RNA, 19 nt, Human
caguauuguacaaaguauu

SEQ ID NO: 3138793 - RNA, 21 nt, Human
caguauuguacaaaguauuaa

SEQ ID NO: 3138794 - RNA, 22 nt, Human
gcuauuucuauauuuucauucu

SEQ ID NO: 3138795 - RNA, 17 nt, Human
gcuaaguugggaucuag

SEQ ID NO: 3138796 - RNA, 14 nt, Human
gcgugcccggggca

SEQ ID NO: 3138797 - RNA, 16 nt, Human
gcgugcccggggcagc

SEQ ID NO: 3138798 - RNA, 17 nt, Human
gcgugcccggggcagca

SEQ ID NO: 3138799 - RNA, 18 nt, Human
gcucccggguccuuggcc

SEQ ID NO: 3138800 - RNA, 22 nt, Human
gcucccggguccuuggcccccu

SEQ ID NO: 3138801 - RNA, 13 nt, Human
gcccggggcagca

SEQ ID NO: 3138802 - RNA, 20 nt, Human
gcccggggcagcagcagccc

SEQ ID NO: 3138803 - RNA, 21 nt, Human
gcccggggcagcagcagcccu

SEQ ID NO: 3138804 - RNA, 23 nt, Human
gcccggggcagcagcagcccugc

SEQ ID NO: 3138805 - RNA, 16 nt, Human
gccccccacacuuccc

SEQ ID NO: 3138806 - RNA, 17 nt, Human
gccccccacacuucccu

SEQ ID NO: 3138807 - RNA, 18 nt, Human
gccccccacacuucccug

SEQ ID NO: 3138808 - RNA, 19 nt, Human
gccccccacacuucccugg

SEQ ID NO: 3138809 - RNA, 20 nt, Human
gccccccacacuucccuggc

SEQ ID NO: 3138810 - RNA, 21 nt, Human
gccccccacacuucccuggcg

SEQ ID NO: 3138811 - RNA, 17 nt, Human
gccccccccuccccaug

SEQ ID NO: 3138812 - RNA, 12 nt, Human
gccuagcugcug

SEQ ID NO: 3138813 - RNA, 13 nt, Human
gccuagcugcugu

SEQ ID NO: 3138814 - RNA, 15 nt, Human
gccuagcugcuguca

SEQ ID NO: 3138815 - RNA, 13 nt, Human
gcccugccccaca

SEQ ID NO: 3138816 - RNA, 14 nt, Human
gcccugccccacac

SEQ ID NO: 3138817 - RNA, 15 nt, Human
gcccugccccacacc

SEQ ID NO: 3138818 - RNA, 14 nt, Human
gcugggguuaucug

SEQ ID NO: 3138819 - RNA, 22 nt, Human
gcugggguuaucugaagucaga

SEQ ID NO: 3138820 - RNA, 23 nt, Human
gcugggguuaucugaagucagau

SEQ ID NO: 3138821 - RNA, 12 nt, Human
ggacuuguuaga

SEQ ID NO: 3138822 - RNA, 15 nt, Human
ggacuuguuagaucu

SEQ ID NO: 3138823 - RNA, 21 nt, Human
ggacuucuuuaauuuuggaau

SEQ ID NO: 3138824 - RNA, 18 nt, Human
ggacuucuuuaauuuugg

SEQ ID NO: 3138825 - RNA, 22 nt, Human
ggacuucuuuaauuuuggaauu

SEQ ID NO: 3138826 - RNA, 16 nt, Human
ggccgacauugucucc

SEQ ID NO: 3138827 - RNA, 17 nt, Human
ggccgacauugucuccc

SEQ ID NO: 3138828 - RNA, 10 nt, Human
ggcccuugga

SEQ ID NO: 3138829 - RNA, 17 nt, Human
ggcccuucuugcugccc

SEQ ID NO: 3138830 - RNA, 18 nt, Human
ggcccuucuugcugcccu

SEQ ID NO: 3138831 - RNA, 19 nt, Human
ggcccuucuugcugcccug

SEQ ID NO: 3138832 - RNA, 23 nt, Human
ggcccuucuugcugcccugcccc

SEQ ID NO: 3138833 - RNA, 17 nt, Human
ggcauaacauaaaucug

SEQ ID NO: 3138834 - RNA, 16 nt, Human
ggcauaacauaaaucu

SEQ ID NO: 3138835 - RNA, 17 nt, Human
ggcagcccgcuaggcuc

SEQ ID NO: 3138836 - RNA, 17 nt, Human
aaaaccaguauuguaca

SEQ ID NO: 3138837 - RNA, 12 nt, Human
aaaagccagggc

SEQ ID NO: 3138838 - RNA, 18 nt, Human
aaaagccagggcuggaga

SEQ ID NO: 3138839 - RNA, 15 nt, Human
ggcuguacccaggaa

SEQ ID NO: 3138840 - RNA, 12 nt, Human
gggaacagggcg

SEQ ID NO: 3138841 - RNA, 13 nt, Human
ggugcagaggcug

SEQ ID NO: 3138842 - RNA, 14 nt, Human
ggugcagaggcugu

SEQ ID NO: 3138843 - RNA, 15 nt, Human
aaagcucacuuuacu

SEQ ID NO: 3138844 - RNA, 11 nt, Human
aaacuuuucug

SEQ ID NO: 3138845 - RNA, 13 nt, Human
gguccuuggcccc

SEQ ID NO: 3138846 - RNA, 16 nt, Human
gguccuuggcccccuu

SEQ ID NO: 3138847 - RNA, 22 nt, Human
gguccuuggcccccuuucccgg

SEQ ID NO: 3138848 - RNA, 14 nt, Human
ggggcccuuggagc

SEQ ID NO: 3138849 - RNA, 18 nt, Human
ggggcccuuggagcgugg

SEQ ID NO: 3138850 - RNA, 17 nt, Human
aaacauggccuuugcuu

SEQ ID NO: 3138851 - RNA, 16 nt, Human
aaacauggccuuugcu

SEQ ID NO: 3138852 - RNA, 23 nt, Human
aaaguugccuaaauccauuugga

SEQ ID NO: 3138853 - RNA, 16 nt, Human
aaaguugccuaaaucc

SEQ ID NO: 3138854 - RNA, 17 nt, Human
aaaguugccuaaaucca

SEQ ID NO: 3138855 - RNA, 12 nt, Human
aaaguuuaauau

SEQ ID NO: 3138856 - RNA, 13 nt, Human
aaaguugccuaaa

SEQ ID NO: 3138857 - RNA, 14 nt, Human
aaaguugccuaaau

SEQ ID NO: 3138858 - RNA, 13 nt, Human
aaaguauuaagca

SEQ ID NO: 3138859 - RNA, 18 nt, Human
aaaguauuaagcauauau

SEQ ID NO: 3138860 - RNA, 19 nt, Human
aaaguauuaagcauauauu

SEQ ID NO: 3138861 - RNA, 20 nt, Human
aaaguauuaagcauauauuu

SEQ ID NO: 3138862 - RNA, 20 nt, Human
guaauuuuaugagcugugag

SEQ ID NO: 3138863 - RNA, 21 nt, Human
aaauacaauuuuguuucugua

SEQ ID NO: 3138864 - RNA, 22 nt, Human
aaauacaauuuuguuucuguac

SEQ ID NO: 3138865 - RNA, 14 nt, Human
aaauacaauuuugu

SEQ ID NO: 3138866 - RNA, 17 nt, Human
aaauacaauuuuguuuc

SEQ ID NO: 3138867 - RNA, 18 nt, Human
aaauacaauuuuguuucu

SEQ ID NO: 3138868 - RNA, 20 nt, Human
aaauacaauuuuguuucugu

SEQ ID NO: 3138869 - RNA, 13 nt, Human
aaauacaauuuug

SEQ ID NO: 3138870 - RNA, 17 nt, Human
gacuguggugacuuugg

SEQ ID NO: 3138871 - RNA, 19 nt, Human
gacuuuggauaauaaggaa

SEQ ID NO: 3138872 - RNA, 17 nt, Human
gacgcugaccguggagc

SEQ ID NO: 3138873 - RNA, 19 nt, Human
gaccagugagcgcuugggc

SEQ ID NO: 3138874 - RNA, 21 nt, Human
gagguggauuccgagugguga

SEQ ID NO: 3138875 - RNA, 24 nt, Human
gagguggauuccgaguggugacag

SEQ ID NO: 3138876 - RNA, 12 nt, Human
gagcgcuugggc

SEQ ID NO: 3138877 - RNA, 15 nt, Human
gagcgcuugggcgcc

SEQ ID NO: 3138878 - RNA, 21 nt, Human
gagcugugagaaggguguugu

SEQ ID NO: 3138879 - RNA, 16 nt, Human
gcaaaaauauuuuaug

SEQ ID NO: 3138880 - RNA, 23 nt, Human
gcaaaaauauuuuaugauccagc

SEQ ID NO: 3138881 - RNA, 17 nt, Human
gcaaaaauauuuuauga

SEQ ID NO: 3138882 - RNA, 22 nt, Human
gcaaaaauauuuuaugauccag

SEQ ID NO: 3138883 - RNA, 16 nt, Human
gauucuuaaaguugaa

SEQ ID NO: 3138884 - RNA, 17 nt, Human
gauucuuaaaguugaau

SEQ ID NO: 3138885 - RNA, 21 nt, Human
gauucuuaaaguugaauuuau

SEQ ID NO: 3138886 - RNA, 15 nt, Human
gauucuuaaaguuga

SEQ ID NO: 3138887 - RNA, 21 nt, Human
gcagggaagaggggugcagag

SEQ ID NO: 3138888 - RNA, 15 nt, Human
gcagcuuagggcccu

SEQ ID NO: 3138889 - RNA, 17 nt, Human
gcagcuuagggcccugg

SEQ ID NO: 3138890 - RNA, 18 nt, Human
gcagcuuagggcccugga

SEQ ID NO: 3138891 - RNA, 19 nt, Human
gcagcuuagggcccuggag

SEQ ID NO: 3138892 - RNA, 20 nt, Human
gcagcuuagggcccuggagg

SEQ ID NO: 3138893 - RNA, 21 nt, Human
gcagcuuagggcccuggaggc

SEQ ID NO: 3138894 - RNA, 13 nt, Human
gcauaacauaaau

SEQ ID NO: 3138895 - RNA, 21 nt, Human
gcaguugagaaaauuugaaug

SEQ ID NO: 3138896 - RNA, 20 nt, Human
gcagguggugucgggcccuu

SEQ ID NO: 3138897 - RNA, 15 nt, Human
cuguacuuuuuggca

SEQ ID NO: 3138898 - RNA, 13 nt, Human
cugguugguuuug

SEQ ID NO: 3138899 - RNA, 15 nt, Human
cuuaaaguugaauuu

SEQ ID NO: 3138900 - RNA, 18 nt, Human
cuuaaaguugaauuuauu

SEQ ID NO: 3138901 - RNA, 14 nt, Human
cuuaaaguugaauu

SEQ ID NO: 3138902 - RNA, 22 nt, Human
cuuaaaguugaauuuauuggcu

SEQ ID NO: 3138903 - RNA, 14 nt, Human
cuuagggcccugga

SEQ ID NO: 3138904 - RNA, 15 nt, Human
cuuagggcccuggag

SEQ ID NO: 3138905 - RNA, 16 nt, Human
cuuagggcccuggagg

SEQ ID NO: 3138906 - RNA, 17 nt, Human
cuuagggcccuggaggc

SEQ ID NO: 3138907 - RNA, 18 nt, Human
cuuagggcccuggaggcg

SEQ ID NO: 3138908 - RNA, 12 nt, Human
cugccucucccu

SEQ ID NO: 3138909 - RNA, 13 nt, Human
cugccucucccuc

SEQ ID NO: 3138910 - RNA, 14 nt, Human
cugccucucccucu

SEQ ID NO: 3138911 - RNA, 15 nt, Human
cugccucucccucug

SEQ ID NO: 3138912 - RNA, 16 nt, Human
cugccucucccucugg

SEQ ID NO: 3138913 - RNA, 13 nt, Human
cuugauuaaaagu

SEQ ID NO: 3138914 - RNA, 15 nt, Human
cuuucagauacugga

SEQ ID NO: 3138915 - RNA, 17 nt, Human
cuuucagauacuggauu

SEQ ID NO: 3138916 - RNA, 13 nt, Human
cuuucagauacug

SEQ ID NO: 3138917 - RNA, 22 nt, Human
cuuucagauacuggauuguacu

SEQ ID NO: 3138918 - RNA, 14 nt, Human
cuuucagauacugg

SEQ ID NO: 3138919 - RNA, 14 nt, Human
cuugucucagauuu

SEQ ID NO: 3138920 - RNA, 17 nt, Human
cuugucucagauuuuau

SEQ ID NO: 3138921 - RNA, 13 nt, Human
cuugucucagauu

SEQ ID NO: 3138922 - RNA, 18 nt, Human
cuugucucagauuuuauu

SEQ ID NO: 3138923 - RNA, 21 nt, Human
gaaagaaaauaccaaggaaca

SEQ ID NO: 3138924 - RNA, 13 nt, Human
gaaagggccagga

SEQ ID NO: 3138925 - RNA, 15 nt, Human
gaaagggccaggaga

SEQ ID NO: 3138926 - RNA, 18 nt, Human
gaaagggccaggagaugg

SEQ ID NO: 3138927 - RNA, 12 nt, Human
gaaaucuuuaaa

SEQ ID NO: 3138928 - RNA, 15 nt, Human
gaaaucuuuaaaaaa

SEQ ID NO: 3138929 - RNA, 15 nt, Human
gaaaaaaggaagugg

SEQ ID NO: 3138930 - RNA, 19 nt, Human
uuugugcugguguaugugu

SEQ ID NO: 3138931 - RNA, 21 nt, Human
uuuggcauaacauaaaucugu

SEQ ID NO: 3138932 - RNA, 20 nt, Human
uuuggcauaacauaaaucug

SEQ ID NO: 3138933 - RNA, 16 nt, Human
augguuuaacaaaaug

SEQ ID NO: 3138934 - RNA, 22 nt, Human
auguaaaucccauuauucaaag

SEQ ID NO: 3138935 - RNA, 23 nt, Human
auguaaaucccauuauucaaagu

SEQ ID NO: 3138936 - RNA, 14 nt, Human
auguaaaucccauu

SEQ ID NO: 3138937 - RNA, 20 nt, Human
auguaaaucccauuauucaa

SEQ ID NO: 3138938 - RNA, 21 nt, Human
augggcgccccccccucccca

SEQ ID NO: 3138939 - RNA, 20 nt, Human
augggauaaaugccaucaau

SEQ ID NO: 3138940 - RNA, 15 nt, Human
augggauaaaugcca

SEQ ID NO: 3138941 - RNA, 16 nt, Human
augggauaaaugccau

SEQ ID NO: 3138942 - RNA, 20 nt, Human
uuucuguacuuuuuggcaua

SEQ ID NO: 3138943 - RNA, 19 nt, Human
uuucuguacuuuuuggcau

SEQ ID NO: 3138944 - RNA, 22 nt, Human
augauccagcagauuauucacu

SEQ ID NO: 3138945 - RNA, 19 nt, Human
augauccagcagauuauuc

SEQ ID NO: 3138946 - RNA, 20 nt, Human
augauccagcagauuauuca

SEQ ID NO: 3138947 - RNA, 10 nt, Human
augauccagc

SEQ ID NO: 3138948 - RNA, 21 nt, Human
uuuaaauaaauaaauagcuag

SEQ ID NO: 3138949 - RNA, 19 nt, Human
augccacccccgcuggagg

SEQ ID NO: 3138950 - RNA, 20 nt, Human
augccacccccgcuggagga

SEQ ID NO: 3138951 - RNA, 21 nt, Human
augccacccccgcuggaggau

SEQ ID NO: 3138952 - RNA, 16 nt, Human
uuuauauuuacuaaaa

SEQ ID NO: 3138953 - RNA, 13 nt, Human
uuuauauuuacua

SEQ ID NO: 3138954 - RNA, 11 nt, Human
augcuauuucu

SEQ ID NO: 3138955 - RNA, 13 nt, Human
augcuauuucuau

SEQ ID NO: 3138956 - RNA, 14 nt, Human
augcuauuucuaua

SEQ ID NO: 3138957 - RNA, 15 nt, Human
augcuauuucuauau

SEQ ID NO: 3138958 - RNA, 20 nt, Human
augcuauuucuauauuuuca

SEQ ID NO: 3138959 - RNA, 23 nt, Human
augcuauuucuauauuuucauuc

SEQ ID NO: 3138960 - RNA, 21 nt, Human
augcuauuucuauauuuucau

SEQ ID NO: 3138961 - RNA, 22 nt, Human
augcuauuucuauauuuucauu

SEQ ID NO: 3138962 - RNA, 14 nt, Human
uuuauuacaguaua

SEQ ID NO: 3138963 - RNA, 18 nt, Human
uuuauuacaguauaauua

SEQ ID NO: 3138964 - RNA, 18 nt, Human
auggaacgcguugaaauu

SEQ ID NO: 3138965 - RNA, 19 nt, Human
auggaacgcguugaaauug

SEQ ID NO: 3138966 - RNA, 16 nt, Human
auggaacgcguugaaa

SEQ ID NO: 3138967 - RNA, 17 nt, Human
auggaacgcguugaaau

SEQ ID NO: 3138968 - RNA, 15 nt, Human
auggaacgcguugaa

SEQ ID NO: 3138969 - RNA, 21 nt, Human
augcugcuuuucuuuucuaac

SEQ ID NO: 3138970 - RNA, 11 nt, Human
augcugcuuuu

SEQ ID NO: 3138971 - RNA, 14 nt, Human
augggauaaaugcc

SEQ ID NO: 3138972 - RNA, 13 nt, Human
uuucauuauuuua

SEQ ID NO: 3138973 - RNA, 15 nt, Human
uuucauuauuuuauu

SEQ ID NO: 3138974 - RNA, 19 nt, Human
uuucauuauuuuauuauga

SEQ ID NO: 3138975 - RNA, 17 nt, Human
auggacuguggugacuu

SEQ ID NO: 3138976 - RNA, 22 nt, Human
auggacuguggugacuuuggau

SEQ ID NO: 3138977 - RNA, 16 nt, Human
auggacuguggugacu

SEQ ID NO: 3138978 - RNA, 14 nt, Human
uuucccgggcuguc

SEQ ID NO: 3138979 - RNA, 23 nt, Human
aucaccugucuugccuuuuucau

SEQ ID NO: 3138980 - RNA, 22 nt, Human
aucaccugucuugccuuuuuca

SEQ ID NO: 3138981 - RNA, 19 nt, Human
uuccgggcaaaugccaggg

SEQ ID NO: 3138982 - RNA, 13 nt, Human
uuccgucuccccc

SEQ ID NO: 3138983 - RNA, 15 nt, Human
uugaaauuguaauua

SEQ ID NO: 3138984 - RNA, 17 nt, Human
uugaaauuguaauuaua

SEQ ID NO: 3138985 - RNA, 13 nt, Human
uugaaauuguaau

SEQ ID NO: 3138986 - RNA, 14 nt, Human
uugaaauuguaauu

SEQ ID NO: 3138987 - RNA, 20 nt, Human
auccauuuggaaaucuuuaa

SEQ ID NO: 3138988 - RNA, 21 nt, Human
auccauuuggaaaucuuuaaa

SEQ ID NO: 3138989 - RNA, 14 nt, Human
uugcuugaaagaaa

SEQ ID NO: 3138990 - RNA, 19 nt, Human
uuggcccccuuucccgggc

SEQ ID NO: 3138991 - RNA, 15 nt, Human
aucugguggucagcc

SEQ ID NO: 3138992 - RNA, 18 nt, Human
aucugguggucagcccua

SEQ ID NO: 3138993 - RNA, 20 nt, Human
aucugguggucagcccuagg

SEQ ID NO: 3138994 - RNA, 20 nt, Human
aucugccuaaggacuucuuu

SEQ ID NO: 3138995 - RNA, 21 nt, Human
aucugccuaaggacuucuuua

SEQ ID NO: 3138996 - RNA, 11 nt, Human
aucugccuaag

SEQ ID NO: 3138997 - RNA, 22 nt, Human
aucugccuaaggacuucuuuaa

SEQ ID NO: 3138998 - RNA, 23 nt, Human
aucugccuaaggacuucuuuaau

SEQ ID NO: 3138999 - RNA, 18 nt, Human
uugagaccuacaggcuga

SEQ ID NO: 3139000 - RNA, 14 nt, Human
uugaagccaugucu

SEQ ID NO: 3139001 - RNA, 17 nt, Human
uugaagccaugucuaca

SEQ ID NO: 3139002 - RNA, 10 nt, Human
auugucuccc

SEQ ID NO: 3139003 - RNA, 18 nt, Human
auugucucccgcccccca

SEQ ID NO: 3139004 - RNA, 19 nt, Human
auugucucccgccccccac

SEQ ID NO: 3139005 - RNA, 16 nt, Human
auuggcuuuucugauc

SEQ ID NO: 3139006 - RNA, 19 nt, Human
auuggcuuuucugauccag

SEQ ID NO: 3139007 - RNA, 20 nt, Human
auuggcuuuucugauccagu

SEQ ID NO: 3139008 - RNA, 13 nt, Human
auuggcuuuucug

SEQ ID NO: 3139009 - RNA, 15 nt, Human
auuggcuuuucugau

SEQ ID NO: 3139010 - RNA, 15 nt, Human
auuugaauuuugugu

SEQ ID NO: 3139011 - RNA, 21 nt, Human
auuugacauagucuggcugua

SEQ ID NO: 3139012 - RNA, 16 nt, Human
auuugacauagucugg

SEQ ID NO: 3139013 - RNA, 17 nt, Human
auuugacauagucuggc

SEQ ID NO: 3139014 - RNA, 17 nt, Human
auuuuaacaacagcugg

SEQ ID NO: 3139015 - RNA, 11 nt, Human
auuuuguuucu

SEQ ID NO: 3139016 - RNA, 23 nt, Human
auuuuguuguguguaugcugcuu

SEQ ID NO: 3139017 - RNA, 12 nt, Human
auuuuggaauuu

SEQ ID NO: 3139018 - RNA, 14 nt, Human
auuuuguuucugua

SEQ ID NO: 3139019 - RNA, 15 nt, Human
auuuuguuucuguac

SEQ ID NO: 3139020 - RNA, 13 nt, Human
auucuguauagau

SEQ ID NO: 3139021 - RNA, 18 nt, Human
auucuuaaaguugaauuu

SEQ ID NO: 3139022 - RNA, 11 nt, Human
auucuguauag

SEQ ID NO: 3139023 - RNA, 12 nt, Human
auucuguauaga

SEQ ID NO: 3139024 - RNA, 19 nt, Human
auucuuaaaguugaauuua

SEQ ID NO: 3139025 - RNA, 20 nt, Human
auucuuaaaguugaauuuau

SEQ ID NO: 3139026 - RNA, 21 nt, Human
auucuuaaaguugaauuuauu

SEQ ID NO: 3139027 - RNA, 13 nt, Human
auuauucaaaguu

SEQ ID NO: 3139028 - RNA, 14 nt, Human
auuauucaaaguug

SEQ ID NO: 3139029 - RNA, 15 nt, Human
auuauucaaaguugc

SEQ ID NO: 3139030 - RNA, 16 nt, Human
agccugcacggugaau

SEQ ID NO: 3139031 - RNA, 18 nt, Human
agccugcacggugaaugg

SEQ ID NO: 3139032 - RNA, 14 nt, Human
agccugauuaaaga

SEQ ID NO: 3139033 - RNA, 13 nt, Human
agcguggacuggu

SEQ ID NO: 3139034 - RNA, 15 nt, Human
aggaauucuguauag

SEQ ID NO: 3139035 - RNA, 23 nt, Human
aggaauucuguauagauuagaau

SEQ ID NO: 3139036 - RNA, 16 nt, Human
aggaauucuguauaga

SEQ ID NO: 3139037 - RNA, 17 nt, Human
aggaauucuguauagau

SEQ ID NO: 3139038 - RNA, 22 nt, Human
aggaauucuguauagauuagaa

SEQ ID NO: 3139039 - RNA, 23 nt, Human
aggaaaaguuuaauauuaaagcc

SEQ ID NO: 3139040 - RNA, 24 nt, Human
aggaaaaguuuaauauuaaagcca

SEQ ID NO: 3139041 - RNA, 21 nt, Human
aggaaaaguuuaauauuaaag

SEQ ID NO: 3139042 - RNA, 14 nt, Human
agcuuagggcccug

SEQ ID NO: 3139043 - RNA, 15 nt, Human
agcuuagggcccugg

SEQ ID NO: 3139044 - RNA, 16 nt, Human
agcuuagggcccugga

SEQ ID NO: 3139045 - RNA, 17 nt, Human
agcuuagggcccuggag

SEQ ID NO: 3139046 - RNA, 18 nt, Human
agcuuagggcccuggagg

SEQ ID NO: 3139047 - RNA, 19 nt, Human
agcuuagggcccuggaggc

SEQ ID NO: 3139048 - RNA, 18 nt, Human
agcugcauacaguuugca

SEQ ID NO: 3139049 - RNA, 21 nt, Human
ugccuuuuucauuauuuuauu

SEQ ID NO: 3139050 - RNA, 14 nt, Human
ugccuuuuucauua

SEQ ID NO: 3139051 - RNA, 15 nt, Human
ugccuuuuucauuau

SEQ ID NO: 3139052 - RNA, 16 nt, Human
ugccuuuuucauuauu

SEQ ID NO: 3139053 - RNA, 17 nt, Human
ugccuuuuucauuauuu

SEQ ID NO: 3139054 - RNA, 13 nt, Human
ugccuuuuucauu

SEQ ID NO: 3139055 - RNA, 17 nt, Human
uggaauuuuccuccuuu

SEQ ID NO: 3139056 - RNA, 21 nt, Human
uggaauuuuccuccuuucucu

SEQ ID NO: 3139057 - RNA, 15 nt, Human
uggacaccggaaaca

SEQ ID NO: 3139058 - RNA, 16 nt, Human
uggagcuuaagccacu

SEQ ID NO: 3139059 - RNA, 17 nt, Human
uggagcuuaagccacug

SEQ ID NO: 3139060 - RNA, 18 nt, Human
uggagcuuaagccacugc

SEQ ID NO: 3139061 - RNA, 19 nt, Human
uggagcuuaagccacugcc

SEQ ID NO: 3139062 - RNA, 20 nt, Human
uggagcuuaagccacugccu

SEQ ID NO: 3139063 - RNA, 22 nt, Human
uggagcuuaagccacugccucu

SEQ ID NO: 3139064 - RNA, 23 nt, Human
uggagccugcacggugaauggcu

SEQ ID NO: 3139065 - RNA, 22 nt, Human
aggcaguugagaaaauuugaau

SEQ ID NO: 3139066 - RNA, 20 nt, Human
ugggaggggguugggguggu

SEQ ID NO: 3139067 - RNA, 24 nt, Human
ugggaggggguuggggugguugag

SEQ ID NO: 3139068 - RNA, 14 nt, Human
agggcuggagaaca

SEQ ID NO: 3139069 - RNA, 16 nt, Human
uguguuagagauuuuu

SEQ ID NO: 3139070 - RNA, 20 nt, Human
agucuugucucagauuuuau

SEQ ID NO: 3139071 - RNA, 21 nt, Human
agucuugucucagauuuuauu

SEQ ID NO: 3139072 - RNA, 17 nt, Human
agucuugucucagauuu

SEQ ID NO: 3139073 - RNA, 19 nt, Human
agucuugucucagauuuua

SEQ ID NO: 3139074 - RNA, 16 nt, Human
agucuugucucagauu

SEQ ID NO: 3139075 - RNA, 23 nt, Human
ugucuccccuguuccccucuccc

SEQ ID NO: 3139076 - RNA, 13 nt, Human
ugucucccgcccc

SEQ ID NO: 3139077 - RNA, 24 nt, Human
ugucucccgccccccacacuuccc

SEQ ID NO: 3139078 - RNA, 19 nt, Human
ugugcugggguuaucugaa

SEQ ID NO: 3139079 - RNA, 20 nt, Human
ugugcugguguaugugugaa

SEQ ID NO: 3139080 - RNA, 21 nt, Human
agugaguuggguguauugugc

SEQ ID NO: 3139081 - RNA, 20 nt, Human
agugaguuggguguauugug

SEQ ID NO: 3139082 - RNA, 17 nt, Human
agguugaagccaugucu

SEQ ID NO: 3139083 - RNA, 14 nt, Human
aguauuaagcauau

SEQ ID NO: 3139084 - RNA, 12 nt, Human
aguauuaagcau

SEQ ID NO: 3139085 - RNA, 13 nt, Human
aguauaauuaaca

SEQ ID NO: 3139086 - RNA, 14 nt, Human
aguauaauuaacau

SEQ ID NO: 3139087 - RNA, 16 nt, Human
aguauaauuaacaugu

SEQ ID NO: 3139088 - RNA, 23 nt, Human
aguauaauuaacauguuaaacca

SEQ ID NO: 3139089 - RNA, 21 nt, Human
auagaggaagccugauuaaag

SEQ ID NO: 3139090 - RNA, 22 nt, Human
auagaggaagccugauuaaaga

SEQ ID NO: 3139091 - RNA, 13 nt, Human
auagauuagaauu

SEQ ID NO: 3139092 - RNA, 15 nt, Human
auagauuagaauucu

SEQ ID NO: 3139093 - RNA, 16 nt, Human
auagauuagaauucug

SEQ ID NO: 3139094 - RNA, 21 nt, Human
auagauuagagaguguugaaa

SEQ ID NO: 3139095 - RNA, 22 nt, Human
auagauuagagaguguugaaac

SEQ ID NO: 3139096 - RNA, 20 nt, Human
auagaaccucuuugucuaca

SEQ ID NO: 3139097 - RNA, 14 nt, Human
auagaaccucuuug

SEQ ID NO: 3139098 - RNA, 23 nt, Human
uuauuaugaaacuuguguaaaua

SEQ ID NO: 3139099 - RNA, 17 nt, Human
uuauuaugaaacuugug

SEQ ID NO: 3139100 - RNA, 20 nt, Human
uuauuaugaaacuuguguaa

SEQ ID NO: 3139101 - RNA, 21 nt, Human
uuauuaugaaacuuguguaaa

SEQ ID NO: 3139102 - RNA, 22 nt, Human
uuauuaugaaacuuguguaaau

SEQ ID NO: 3139103 - RNA, 11 nt, Human
uuauuaugaaa

SEQ ID NO: 3139104 - RNA, 13 nt, Human
uuauuauguaaau

SEQ ID NO: 3139105 - RNA, 14 nt, Human
uuauuauguaaauc

SEQ ID NO: 3139106 - RNA, 16 nt, Human
uuauuauguaaauccc

SEQ ID NO: 3139107 - RNA, 22 nt, Human
uuauuauguaaaucccauuauu

SEQ ID NO: 3139108 - RNA, 15 nt, Human
uuauucaaaguugcc

SEQ ID NO: 3139109 - RNA, 19 nt, Human
uuauucaaaguugccuaaa

SEQ ID NO: 3139110 - RNA, 13 nt, Human
uuauucaaaguug

SEQ ID NO: 3139111 - RNA, 14 nt, Human
uuauucacugauuu

SEQ ID NO: 3139112 - RNA, 17 nt, Human
auacuccuccaagguua

SEQ ID NO: 3139113 - RNA, 15 nt, Human
auacuggauuguacu

SEQ ID NO: 3139114 - RNA, 22 nt, Human
uuaugauccagcagauuauuca

SEQ ID NO: 3139115 - RNA, 23 nt, Human
uuaugauccagcagauuauucac

SEQ ID NO: 3139116 - RNA, 19 nt, Human
uuauguaaaucccauuauu

SEQ ID NO: 3139117 - RNA, 21 nt, Human
uuauguaaaucccauuauuca

SEQ ID NO: 3139118 - RNA, 22 nt, Human
uuauguaaaucccauuauucaa

SEQ ID NO: 3139119 - RNA, 23 nt, Human
uuauguaaaucccauuauucaaa

SEQ ID NO: 3139120 - RNA, 12 nt, Human
uuauguaaaucc

SEQ ID NO: 3139121 - RNA, 13 nt, Human
uuauguaaauccc

SEQ ID NO: 3139122 - RNA, 11 nt, Human
uuauguaaauc

SEQ ID NO: 3139123 - RNA, 16 nt, Human
uuaugugcgcugauaa

SEQ ID NO: 3139124 - RNA, 19 nt, Human
uuaugaaacuuguguaaau

SEQ ID NO: 3139125 - RNA, 13 nt, Human
uuaugaaacuugu

SEQ ID NO: 3139126 - RNA, 16 nt, Human
uuaugaaacuugugua

SEQ ID NO: 3139127 - RNA, 18 nt, Human
uuaugaaacuuguguaaa

SEQ ID NO: 3139128 - RNA, 13 nt, Human
uuaugauccagca

SEQ ID NO: 3139129 - RNA, 18 nt, Human
uuaugauccagcagauua

SEQ ID NO: 3139130 - RNA, 21 nt, Human
uuaugagcugugagaagggug

SEQ ID NO: 3139131 - RNA, 14 nt, Human
uuaugagcugugag

SEQ ID NO: 3139132 - RNA, 17 nt, Human
uuaaaccaugggauaaa

SEQ ID NO: 3139133 - RNA, 21 nt, Human
uuaaaccaugggauaaaugcc

SEQ ID NO: 3139134 - RNA, 22 nt, Human
uuaaaccaugggauaaaugcca

SEQ ID NO: 3139135 - RNA, 13 nt, Human
uuaaaguugaauu

SEQ ID NO: 3139136 - RNA, 16 nt, Human
uuaaaguugaauuuau

SEQ ID NO: 3139137 - RNA, 17 nt, Human
uuaaaguugaauuuauu

SEQ ID NO: 3139138 - RNA, 22 nt, Human
uuaaaguugaauuuauuggcuu

SEQ ID NO: 3139139 - RNA, 19 nt, Human
aguuugugcugguguaugu

SEQ ID NO: 3139140 - RNA, 13 nt, Human
uuaauuuuggaau

SEQ ID NO: 3139141 - RNA, 14 nt, Human
uuaauuuuggaauu

SEQ ID NO: 3139142 - RNA, 15 nt, Human
uuaauuuuggaauuu

SEQ ID NO: 3139143 - RNA, 14 nt, Human
aguuuuguuuggac

SEQ ID NO: 3139144 - RNA, 16 nt, Human
aguuuuguuuggacca

SEQ ID NO: 3139145 - RNA, 12 nt, Human
aguuuuguuugg

SEQ ID NO: 3139146 - RNA, 18 nt, Human
aguuuuguuuggaccaaa

SEQ ID NO: 3139147 - RNA, 14 nt, Human
uuagggcccuggag

SEQ ID NO: 3139148 - RNA, 15 nt, Human
uuagggcccuggagg

SEQ ID NO: 3139149 - RNA, 14 nt, Human
uuagaauucuguau

SEQ ID NO: 3139150 - RNA, 15 nt, Human
uuagaauucuguaua

SEQ ID NO: 3139151 - RNA, 19 nt, Human
auaaaucugugaacuugaa

SEQ ID NO: 3139152 - RNA, 15 nt, Human
auaaaucugugaacu

SEQ ID NO: 3139153 - RNA, 16 nt, Human
auaaaucugugaacuu

SEQ ID NO: 3139154 - RNA, 17 nt, Human
auaaaugccaucaauaa

SEQ ID NO: 3139155 - RNA, 18 nt, Human
auaaaugccaucaauaaa

SEQ ID NO: 3139156 - RNA, 15 nt, Human
agagggaacagggcg

SEQ ID NO: 3139157 - RNA, 19 nt, Human
agagggaacagggcggaga

SEQ ID NO: 3139158 - RNA, 13 nt, Human
ugaagccaugucu

SEQ ID NO: 3139159 - RNA, 22 nt, Human
agauuuuauuauguaaauccca

SEQ ID NO: 3139160 - RNA, 20 nt, Human
agauuuuauuauguaaaucc

SEQ ID NO: 3139161 - RNA, 21 nt, Human
agauuuuauuauguaaauccc

SEQ ID NO: 3139162 - RNA, 23 nt, Human
agcaaaaauauuuuaugauccag

SEQ ID NO: 3139163 - RNA, 15 nt, Human
agcaaaaauauuuua

SEQ ID NO: 3139164 - RNA, 17 nt, Human
agcaaaaauauuuuaug

SEQ ID NO: 3139165 - RNA, 18 nt, Human
agcaaaaauauuuuauga

SEQ ID NO: 3139166 - RNA, 19 nt, Human
agcaaaaauauuuuaugau

SEQ ID NO: 3139167 - RNA, 16 nt, Human
agauuauucacugauu

SEQ ID NO: 3139168 - RNA, 12 nt, Human
ugaauuuauugg

SEQ ID NO: 3139169 - RNA, 15 nt, Human
ugaauuuauuggcuu

SEQ ID NO: 3139170 - RNA, 16 nt, Human
ugaauuuauuggcuuu

SEQ ID NO: 3139171 - RNA, 14 nt, Human
agcagauuauucac

SEQ ID NO: 3139172 - RNA, 15 nt, Human
agcagauuauucacu

SEQ ID NO: 3139173 - RNA, 16 nt, Human
agcagauuauucacug

SEQ ID NO: 3139174 - RNA, 19 nt, Human
agcagauuauucacugauu

SEQ ID NO: 3139175 - RNA, 20 nt, Human
agcagauuauucacugauuu

SEQ ID NO: 3139176 - RNA, 13 nt, Human
ugagcgcuugggc

SEQ ID NO: 3139177 - RNA, 15 nt, Human
ugaggaauucuguau

SEQ ID NO: 3139178 - RNA, 16 nt, Human
ugaggaauucuguaua

SEQ ID NO: 3139179 - RNA, 14 nt, Human
ugaggaauucugua

SEQ ID NO: 3139180 - RNA, 18 nt, Human
ugaggaauucuguauaga

SEQ ID NO: 3139181 - RNA, 19 nt, Human
ugaggaauucuguauagau

SEQ ID NO: 3139182 - RNA, 16 nt, Human
ucuguauagauuagag

SEQ ID NO: 3139183 - RNA, 22 nt, Human
ucuggucccacaaaugggcgcc

SEQ ID NO: 3139184 - RNA, 17 nt, Human
ucuguauagauuagaau

SEQ ID NO: 3139185 - RNA, 16 nt, Human
ucuucaaaauaucaag

SEQ ID NO: 3139186 - RNA, 18 nt, Human
ucuuuaauuuuggaauuu

SEQ ID NO: 3139187 - RNA, 14 nt, Human
ucuuuaauuuugga

SEQ ID NO: 3139188 - RNA, 15 nt, Human
ucuuuaauuuuggaa

SEQ ID NO: 3139189 - RNA, 16 nt, Human
ucuuuaauuuuggaau

SEQ ID NO: 3139190 - RNA, 17 nt, Human
ucuuuaauuuuggaauu

SEQ ID NO: 3139191 - RNA, 13 nt, Human
ucuuuaauuuugg

SEQ ID NO: 3139192 - RNA, 14 nt, Human
ucuuccgucucccc

SEQ ID NO: 3139193 - RNA, 15 nt, Human
ucuuccgucuccccc

SEQ ID NO: 3139194 - RNA, 20 nt, Human
ucuuccgucucccccguguu

SEQ ID NO: 3139195 - RNA, 14 nt, Human
agaccuacaggcug

SEQ ID NO: 3139196 - RNA, 16 nt, Human
agaccuacaggcugac

SEQ ID NO: 3139197 - RNA, 17 nt, Human
ucucccuucccuccucc

SEQ ID NO: 3139198 - RNA, 12 nt, Human
ucuccauuuaau

SEQ ID NO: 3139199 - RNA, 16 nt, Human
ucuccauuuaauaauu

SEQ ID NO: 3139200 - RNA, 19 nt, Human
ucuccauuuaauaauuaua

SEQ ID NO: 3139201 - RNA, 21 nt, Human
acuuguguaaauacaauuuug

SEQ ID NO: 3139202 - RNA, 22 nt, Human
acuuguguaaauacaauuuugu

SEQ ID NO: 3139203 - RNA, 13 nt, Human
acuuguguaaaua

SEQ ID NO: 3139204 - RNA, 23 nt, Human
acuuguguaaauacaauuuuguu

SEQ ID NO: 3139205 - RNA, 20 nt, Human
agaaacugacaugcccuccc

SEQ ID NO: 3139206 - RNA, 21 nt, Human
agaaacugacaugcccucccu

SEQ ID NO: 3139207 - RNA, 22 nt, Human
agaaacugacaugcccucccuu

SEQ ID NO: 3139208 - RNA, 13 nt, Human
ucugccuaaggac

SEQ ID NO: 3139209 - RNA, 14 nt, Human
ucugccuaaggacu

SEQ ID NO: 3139210 - RNA, 15 nt, Human
ucugccuaaggacuu

SEQ ID NO: 3139211 - RNA, 15 nt, Human
acccaaaagaaacug

SEQ ID NO: 3139212 - RNA, 14 nt, Human
accagugagcgcuu

SEQ ID NO: 3139213 - RNA, 13 nt, Human
acccccgcuggag

SEQ ID NO: 3139214 - RNA, 15 nt, Human
acccccgcuggagga

SEQ ID NO: 3139215 - RNA, 21 nt, Human
ucagaucugccuaaggacuuc

SEQ ID NO: 3139216 - RNA, 13 nt, Human
ucagauuuuauua

SEQ ID NO: 3139217 - RNA, 14 nt, Human
ucagauuuuauuau

SEQ ID NO: 3139218 - RNA, 15 nt, Human
ucagauuuuauuaug

SEQ ID NO: 3139219 - RNA, 16 nt, Human
ucagauuuuauuaugu

SEQ ID NO: 3139220 - RNA, 19 nt, Human
ucagauuuuauuauguaaa

SEQ ID NO: 3139221 - RNA, 20 nt, Human
ucagauuuuauuauguaaau

SEQ ID NO: 3139222 - RNA, 16 nt, Human
ucccgccccccacacu

SEQ ID NO: 3139223 - RNA, 19 nt, Human
ucccgccccccacacuucc

SEQ ID NO: 3139224 - RNA, 22 nt, Human
ucccgccccccacacuucccug

SEQ ID NO: 3139225 - RNA, 23 nt, Human
ucccgccccccacacuucccugg

SEQ ID NO: 3139226 - RNA, 20 nt, Human
uccgucucccccguguuccc

SEQ ID NO: 3139227 - RNA, 14 nt, Human
uccgugcuaaggac

SEQ ID NO: 3139228 - RNA, 15 nt, Human
uccgugcuaaggacu

SEQ ID NO: 3139229 - RNA, 22 nt, Human
acucuccauuuaauaauuauau

SEQ ID NO: 3139230 - RNA, 22 nt, Human
uccucaguaaguguuagaggga

SEQ ID NO: 3139231 - RNA, 14 nt, Human
ucgccuucccuccu

SEQ ID NO: 3139232 - RNA, 15 nt, Human
ucgccuucccuccug

SEQ ID NO: 3139233 - RNA, 16 nt, Human
ucgccuucccuccugc

SEQ ID NO: 3139234 - RNA, 13 nt, Human
acuggauuguacu

SEQ ID NO: 3139235 - RNA, 16 nt, Human
acuggauuguacuuug

SEQ ID NO: 3139236 - RNA, 23 nt, Human
acuggcaaaauaguucugcaggu

SEQ ID NO: 3139237 - RNA, 14 nt, Human
acugcagauugaga

SEQ ID NO: 3139238 - RNA, 17 nt, Human
acugcagauugagaccu

SEQ ID NO: 3139239 - RNA, 20 nt, Human
acugcagauugagaccuaca

SEQ ID NO: 3139240 - RNA, 23 nt, Human
acugcagauugagaccuacaggc

SEQ ID NO: 3139241 - RNA, 18 nt, Human
uaaaccaugggauaaaug

SEQ ID NO: 3139242 - RNA, 20 nt, Human
uaaaccaugggauaaaugcc

SEQ ID NO: 3139243 - RNA, 21 nt, Human
uaaaccaugggauaaaugcca

SEQ ID NO: 3139244 - RNA, 22 nt, Human
uaaaccaugggauaaaugccau

SEQ ID NO: 3139245 - RNA, 18 nt, Human
aaguuuaauauuaaagcc

SEQ ID NO: 3139246 - RNA, 19 nt, Human
aaguuuaauauuaaagcca

SEQ ID NO: 3139247 - RNA, 20 nt, Human
aaguuuaauauuaaagccau

SEQ ID NO: 3139248 - RNA, 21 nt, Human
aaguuuaauauuaaagccaug

SEQ ID NO: 3139249 - RNA, 14 nt, Human
aauaaaaaauuaug

SEQ ID NO: 3139250 - RNA, 15 nt, Human
aauaaaaaauuauga

SEQ ID NO: 3139251 - RNA, 16 nt, Human
aauaaaaaauuaugac

SEQ ID NO: 3139252 - RNA, 21 nt, Human
aauaaauagcuagacugguga

SEQ ID NO: 3139253 - RNA, 13 nt, Human
aauaaggaaaagu

SEQ ID NO: 3139254 - RNA, 15 nt, Human
aauaaggaaaaguuu

SEQ ID NO: 3139255 - RNA, 14 nt, Human
aauaauuauaugcu

SEQ ID NO: 3139256 - RNA, 15 nt, Human
aauaauuauaugcua

SEQ ID NO: 3139257 - RNA, 20 nt, Human
aauaauuauaugcuauuucu

SEQ ID NO: 3139258 - RNA, 21 nt, Human
aauaauuauaugcuauuucua

SEQ ID NO: 3139259 - RNA, 22 nt, Human
aauaauuauaugcuauuucuau

SEQ ID NO: 3139260 - RNA, 23 nt, Human
aauaauuauaugcuauuucuaua

SEQ ID NO: 3139261 - RNA, 16 nt, Human
aauaaggaaaaguuua

SEQ ID NO: 3139262 - RNA, 19 nt, Human
aauaaggaaaaguuuaaua

SEQ ID NO: 3139263 - RNA, 22 nt, Human
aauaaggaaaaguuuaauauua

SEQ ID NO: 3139264 - RNA, 19 nt, Human
uaaaucccauuauucaaag

SEQ ID NO: 3139265 - RNA, 23 nt, Human
uaaaucccauuauucaaaguugc

SEQ ID NO: 3139266 - RNA, 23 nt, Human
uaaauagcuagacuggugacuga

SEQ ID NO: 3139267 - RNA, 13 nt, Human
uaaauacaauuuu

SEQ ID NO: 3139268 - RNA, 15 nt, Human
uaaauacaauuuugu

SEQ ID NO: 3139269 - RNA, 22 nt, Human
uaaauacaauuuuguuucugua

SEQ ID NO: 3139270 - RNA, 23 nt, Human
uaaauacaauuuuguuucuguac

SEQ ID NO: 3139271 - RNA, 19 nt, Human
uaaauagcuagacugguga

SEQ ID NO: 3139272 - RNA, 22 nt, Human
aauacaauuuuguuucuguacu

SEQ ID NO: 3139273 - RNA, 23 nt, Human
aauacaauuuuguuucuguacuu

SEQ ID NO: 3139274 - RNA, 15 nt, Human
aauacaauuuuguuu

SEQ ID NO: 3139275 - RNA, 17 nt, Human
aauacaauuuuguuucu

SEQ ID NO: 3139276 - RNA, 18 nt, Human
aauacaauuuuguuucug

SEQ ID NO: 3139277 - RNA, 20 nt, Human
aauacaauuuuguuucugua

SEQ ID NO: 3139278 - RNA, 12 nt, Human
aauacaauuuug

SEQ ID NO: 3139279 - RNA, 13 nt, Human
aauacaauuuugu

SEQ ID NO: 3139280 - RNA, 16 nt, Human
uaacaacagcuggugc

SEQ ID NO: 3139281 - RNA, 12 nt, Human
guuccccucucc

SEQ ID NO: 3139282 - RNA, 14 nt, Human
guuccccucucccu

SEQ ID NO: 3139283 - RNA, 16 nt, Human
guuccccucucccuuc

SEQ ID NO: 3139284 - RNA, 19 nt, Human
guuccccucucccuucccu

SEQ ID NO: 3139285 - RNA, 20 nt, Human
guuccccucucccuucccuc

SEQ ID NO: 3139286 - RNA, 22 nt, Human
guuccccucucccuucccuccu

SEQ ID NO: 3139287 - RNA, 23 nt, Human
guuccccucucccuucccuccuc

SEQ ID NO: 3139288 - RNA, 18 nt, Human
guuccccucuugucuccc

SEQ ID NO: 3139289 - RNA, 20 nt, Human
guuccccucuugucuccccu

SEQ ID NO: 3139290 - RNA, 21 nt, Human
guuccccucuugucuccccug

SEQ ID NO: 3139291 - RNA, 22 nt, Human
guuccccucuugucuccccugu

SEQ ID NO: 3139292 - RNA, 22 nt, Human
guugaauuuauuggcuuuucug

SEQ ID NO: 3139293 - RNA, 14 nt, Human
guugggggucagug

SEQ ID NO: 3139294 - RNA, 22 nt, Human
guugggggucagugcugccugu

SEQ ID NO: 3139295 - RNA, 13 nt, Human
aaguauuaagcau

SEQ ID NO: 3139296 - RNA, 10 nt, Human
guuucuguac

SEQ ID NO: 3139297 - RNA, 12 nt, Human
aacauaaaucug

SEQ ID NO: 3139298 - RNA, 14 nt, Human
aacauaaaucugug

SEQ ID NO: 3139299 - RNA, 15 nt, Human
aacauaaaucuguga

SEQ ID NO: 3139300 - RNA, 16 nt, Human
aacauguuaaaccaug

SEQ ID NO: 3139301 - RNA, 23 nt, Human
aacauguuaaaccaugggauaaa

SEQ ID NO: 3139302 - RNA, 13 nt, Human
guccuuggccccc

SEQ ID NO: 3139303 - RNA, 15 nt, Human
guccuuggcccccuu

SEQ ID NO: 3139304 - RNA, 23 nt, Human
guccuuggcccccuuucccgggc

SEQ ID NO: 3139305 - RNA, 10 nt, Human
aaccaagagg

SEQ ID NO: 3139306 - RNA, 13 nt, Human
aaccaagaggcug

SEQ ID NO: 3139307 - RNA, 14 nt, Human
aaccaagaggcugg

SEQ ID NO: 3139308 - RNA, 15 nt, Human
aaccaagaggcuggu

SEQ ID NO: 3139309 - RNA, 17 nt, Human
aaccaagaggcugguuu

SEQ ID NO: 3139310 - RNA, 18 nt, Human
aaccaaaugcaaugugaa

SEQ ID NO: 3139311 - RNA, 12 nt, Human
gugcugggcagc

SEQ ID NO: 3139312 - RNA, 13 nt, Human
gugcugggcagcc

SEQ ID NO: 3139313 - RNA, 14 nt, Human
gugcugggcagccc

SEQ ID NO: 3139314 - RNA, 15 nt, Human
gugcugggcagcccg

SEQ ID NO: 3139315 - RNA, 22 nt, Human
gugcugggguuaucugaaguca

SEQ ID NO: 3139316 - RNA, 19 nt, Human
gugcugguguaugugugaa

SEQ ID NO: 3139317 - RNA, 14 nt, Human
aacuuguguaaaua

SEQ ID NO: 3139318 - RNA, 15 nt, Human
aacuuguguaaauac

SEQ ID NO: 3139319 - RNA, 20 nt, Human
aacuuguguaaauacaauuu

SEQ ID NO: 3139320 - RNA, 21 nt, Human
guguugaaacggaugauuucu

SEQ ID NO: 3139321 - RNA, 23 nt, Human
guguugaaacggaugauuucuau

SEQ ID NO: 3139322 - RNA, 19 nt, Human
uauagauuagagaguguug

SEQ ID NO: 3139323 - RNA, 22 nt, Human
uauagauuagagaguguugaaa

SEQ ID NO: 3139324 - RNA, 20 nt, Human
uauagauuagaauucuguau

SEQ ID NO: 3139325 - RNA, 19 nt, Human
uauagauuagaauucugua

SEQ ID NO: 3139326 - RNA, 18 nt, Human
uauaaaagacugucuuaa

SEQ ID NO: 3139327 - RNA, 10 nt, Human
uaugauccag

SEQ ID NO: 3139328 - RNA, 11 nt, Human
uaugauccagc

SEQ ID NO: 3139329 - RNA, 19 nt, Human
uaugauccagcagauuauu

SEQ ID NO: 3139330 - RNA, 22 nt, Human
uaugauccagcagauuauucac

SEQ ID NO: 3139331 - RNA, 20 nt, Human
uaugauccagcagauuauuc

SEQ ID NO: 3139332 - RNA, 21 nt, Human
uaugauccagcagauuauuca

SEQ ID NO: 3139333 - RNA, 20 nt, Human
uaucaccugucuugccuuuu

SEQ ID NO: 3139334 - RNA, 13 nt, Human
uauucacugauuu

SEQ ID NO: 3139335 - RNA, 19 nt, Human
uauucacugauuugacaua

SEQ ID NO: 3139336 - RNA, 22 nt, Human
uauucacugauuugacauaguc

SEQ ID NO: 3139337 - RNA, 23 nt, Human
uauucaaaguugccuaaauccau

SEQ ID NO: 3139338 - RNA, 16 nt, Human
uauucaaaguugccua

SEQ ID NO: 3139339 - RNA, 18 nt, Human
uauucaaaguugccuaaa

SEQ ID NO: 3139340 - RNA, 21 nt, Human
uauucaaaguugccuaaaucc

SEQ ID NO: 3139341 - RNA, 22 nt, Human
uauucaaaguugccuaaaucca

SEQ ID NO: 3139342 - RNA, 17 nt, Human
acagcuggugcccugcu

SEQ ID NO: 3139343 - RNA, 20 nt, Human
acagcuggugcccugcuuuc

SEQ ID NO: 3139344 - RNA, 13 nt, Human
uauuaaagccaug

SEQ ID NO: 3139345 - RNA, 14 nt, Human
uauuaaagccaugu

SEQ ID NO: 3139346 - RNA, 12 nt, Human
uauuaaagccau

SEQ ID NO: 3139347 - RNA, 14 nt, Human
uauuacaguauaau

SEQ ID NO: 3139348 - RNA, 16 nt, Human
uauuacaguauaauua

SEQ ID NO: 3139349 - RNA, 18 nt, Human
uauuacaguauaauuaac

SEQ ID NO: 3139350 - RNA, 20 nt, Human
uauuacaguauaauuaacau

SEQ ID NO: 3139351 - RNA, 21 nt, Human
uauuacaguauaauuaacaug

SEQ ID NO: 3139352 - RNA, 20 nt, Human
uauuaaagccauguuuauua

SEQ ID NO: 3139353 - RNA, 17 nt, Human
uauuaaagccauguuua

SEQ ID NO: 3139354 - RNA, 18 nt, Human
uauuaaagccauguuuau

SEQ ID NO: 3139355 - RNA, 23 nt, Human
acaguauaauuaacauguuaaac

SEQ ID NO: 3139356 - RNA, 21 nt, Human
acaguauaauuaacauguuaa

SEQ ID NO: 3139357 - RNA, 18 nt, Human
uauuuacuaaaauggacu

SEQ ID NO: 3139358 - RNA, 15 nt, Human
uauuguacaaaguau

SEQ ID NO: 3139359 - RNA, 16 nt, Human
uauuguacaaaguauu

SEQ ID NO: 3139360 - RNA, 21 nt, Human
uauuguacaaaguauuaagca

SEQ ID NO: 3139361 - RNA, 22 nt, Human
uauuguacaaaguauuaagcau

SEQ ID NO: 3139362 - RNA, 23 nt, Human
uauuguacaaaguauuaagcaua

SEQ ID NO: 3139363 - RNA, 14 nt, Human
uauuggcuuuucug

SEQ ID NO: 3139364 - RNA, 15 nt, Human
uauuggcuuuucuga

SEQ ID NO: 3139365 - RNA, 16 nt, Human
uauuggcuuuucugau

SEQ ID NO: 3139366 - RNA, 17 nt, Human
uauuggcuuuucugauc

SEQ ID NO: 3139367 - RNA, 18 nt, Human
uauuggcuuuucugaucc

SEQ ID NO: 3139368 - RNA, 21 nt, Human
uauuggcuuuucugauccagu

SEQ ID NO: 3139369 - RNA, 22 nt, Human
uauuggcuuuucugauccaguu

SEQ ID NO: 3139370 - RNA, 12 nt, Human
uacucaauuuua

SEQ ID NO: 3139371 - RNA, 13 nt, Human
uacucaauuuuaa

SEQ ID NO: 3139372 - RNA, 14 nt, Human
uacucaauuuuaac

SEQ ID NO: 3139373 - RNA, 18 nt, Human
aauuugaauuuuguguua

SEQ ID NO: 3139374 - RNA, 13 nt, Human
aauuugaauuuug

SEQ ID NO: 3139375 - RNA, 16 nt, Human
aauuugaauuuugugu

SEQ ID NO: 3139376 - RNA, 13 nt, Human
acaaaaacauggc

SEQ ID NO: 3139377 - RNA, 14 nt, Human
uagaaccucuuugu

SEQ ID NO: 3139378 - RNA, 21 nt, Human
uagaggaagccugauuaaaga

SEQ ID NO: 3139379 - RNA, 16 nt, Human
uacaaaaacauggccu

SEQ ID NO: 3139380 - RNA, 21 nt, Human
uaauuauaugcuauuucuaua

SEQ ID NO: 3139381 - RNA, 20 nt, Human
uaauuauaugcuauuucuau

SEQ ID NO: 3139382 - RNA, 13 nt, Human
uaauuauaucuga

SEQ ID NO: 3139383 - RNA, 17 nt, Human
uaauuauaucugaggaa

SEQ ID NO: 3139384 - RNA, 18 nt, Human
aauuaacauguuaaacca

SEQ ID NO: 3139385 - RNA, 13 nt, Human
aauuaacauguua

SEQ ID NO: 3139386 - RNA, 14 nt, Human
aauuaacauguuaa

SEQ ID NO: 3139387 - RNA, 18 nt, Human
aaaaaauuggggauucuu

SEQ ID NO: 3139388 - RNA, 20 nt, Human
aaaaaccaguauuguacaaa

SEQ ID NO: 3139389 - RNA, 19 nt, Human
aaaaaccaucuguaaaaga

SEQ ID NO: 3139390 - RNA, 15 nt, Human
aaaccaugggauaaa

SEQ ID NO: 3139391 - RNA, 20 nt, Human
aaaccaugggauaaaugcca

SEQ ID NO: 3139392 - RNA, 15 nt, Human
aaaucugugaacuug

SEQ ID NO: 3139393 - RNA, 16 nt, Human
aaaucugugaacuuga

SEQ ID NO: 3139394 - RNA, 18 nt, Human
aaaucugugaacuugaaa

SEQ ID NO: 3139395 - RNA, 18 nt, Human
aaauagcuagacugguga

SEQ ID NO: 3139396 - RNA, 10 nt, Human
aaauaaauaa

SEQ ID NO: 3139397 - RNA, 16 nt, Human
aaagccagggcuggag

SEQ ID NO: 3139398 - RNA, 14 nt, Human
aacggaugauuucu

SEQ ID NO: 3139399 - RNA, 15 nt, Human
aacggaugauuucua

SEQ ID NO: 3139400 - RNA, 16 nt, Human
aacggaugauuucuau

SEQ ID NO: 3139401 - RNA, 17 nt, Human
aacggaugauuucuaug

SEQ ID NO: 3139402 - RNA, 17 nt, Human
aacgaucagacagaucu

SEQ ID NO: 3139403 - RNA, 20 nt, Human
aacagcuggugcccugcuuu

SEQ ID NO: 3139404 - RNA, 21 nt, Human
aacagcuggugcccugcuuuc

SEQ ID NO: 3139405 - RNA, 19 nt, Human
aacagcuggugcccugcuu

SEQ ID NO: 3139406 - RNA, 17 nt, Human
aacagcuggugcccugc

SEQ ID NO: 3139407 - RNA, 15 nt, Human
aaguugccuaaaucc

SEQ ID NO: 3139408 - RNA, 16 nt, Human
aaguugccuaaaucca

SEQ ID NO: 3139409 - RNA, 17 nt, Human
aaguugccuaaauccau

SEQ ID NO: 3139410 - RNA, 18 nt, Human
aaguugccuaaauccauu

SEQ ID NO: 3139411 - RNA, 19 nt, Human
aaguugccuaaauccauuu

SEQ ID NO: 3139412 - RNA, 15 nt, Human
aagaguggaggugga

SEQ ID NO: 3139413 - RNA, 14 nt, Human
aaggacuucuuuaa

SEQ ID NO: 3139414 - RNA, 15 nt, Human
aaggacuucuuuaau

SEQ ID NO: 3139415 - RNA, 20 nt, Human
aaggacuucuuuaauuuugg

SEQ ID NO: 3139416 - RNA, 21 nt, Human
aaggacuucuuuaauuuugga

SEQ ID NO: 3139417 - RNA, 13 nt, Human
aagggccaggaga

SEQ ID NO: 3139418 - RNA, 17 nt, Human
aagggccaggagaugga

SEQ ID NO: 3139419 - RNA, 12 nt, Human
aaguugccuaaa

SEQ ID NO: 3139420 - RNA, 14 nt, Human
acuggugacugauu

SEQ ID NO: 3139421 - RNA, 19 nt, Human
acugguugguuuugccauu

SEQ ID NO: 3139422 - RNA, 15 nt, Human
agaaaauaccaagga

SEQ ID NO: 3139423 - RNA, 16 nt, Human
agaaagggccaggaga

SEQ ID NO: 3139424 - RNA, 20 nt, Human
agaaagggccaggagaugga

SEQ ID NO: 3139425 - RNA, 20 nt, Human
accagauucuauccucaucu

SEQ ID NO: 3139426 - RNA, 21 nt, Human
accagauucuauccucaucuu

SEQ ID NO: 3139427 - RNA, 13 nt, Human
aauuuuguuucug

SEQ ID NO: 3139428 - RNA, 14 nt, Human
aauuuuguuucugu

SEQ ID NO: 3139429 - RNA, 19 nt, Human
acaagaaagggccaggaga

SEQ ID NO: 3139430 - RNA, 21 nt, Human
agacagauacuccuccaaggu

SEQ ID NO: 3139431 - RNA, 15 nt, Human
agacagauacuccuc

SEQ ID NO: 3139432 - RNA, 20 nt, Human
aggcugguuuuggcaucucu

SEQ ID NO: 3139433 - RNA, 21 nt, Human
aggcugguuuuggcaucucug

SEQ ID NO: 3139434 - RNA, 20 nt, Human
augguccgugcuaaggacuu

SEQ ID NO: 3139435 - RNA, 21 nt, Human
augguccgugcuaaggacuug

SEQ ID NO: 3139436 - RNA, 19 nt, Human
augguccgugcuaaggacu

SEQ ID NO: 3139437 - RNA, 11 nt, Human
augugggcagc

SEQ ID NO: 3139438 - RNA, 12 nt, Human
augugggcagcu

SEQ ID NO: 3139439 - RNA, 13 nt, Human
augugugaaguga

SEQ ID NO: 3139440 - RNA, 15 nt, Human
auccucaucuuuuuu

SEQ ID NO: 3139441 - RNA, 14 nt, Human
aucucccugcuuug

SEQ ID NO: 3139442 - RNA, 17 nt, Human
aucucugucccauuccc

SEQ ID NO: 3139443 - RNA, 19 nt, Human
aucucugucccauucccug

SEQ ID NO: 3139444 - RNA, 20 nt, Human
aucucugucccauucccugg

SEQ ID NO: 3139445 - RNA, 21 nt, Human
aucucugucccauucccuggg

SEQ ID NO: 3139446 - RNA, 22 nt, Human
aucucugucccauucccuggga

SEQ ID NO: 3139447 - RNA, 14 nt, Human
auaacauaaaucug

SEQ ID NO: 3139448 - RNA, 15 nt, Human
auaacauaaaucugu

SEQ ID NO: 3139449 - RNA, 17 nt, Human
auaacauaaaucuguga

SEQ ID NO: 3139450 - RNA, 18 nt, Human
auaacauaaaucugugaa

SEQ ID NO: 3139451 - RNA, 19 nt, Human
auaacauaaaucugugaac

SEQ ID NO: 3139452 - RNA, 15 nt, Human
auaauuaacauguua

SEQ ID NO: 3139453 - RNA, 16 nt, Human
auaaggaaaaguuuaa

SEQ ID NO: 3139454 - RNA, 15 nt, Human
auaaggaaaaguuua

SEQ ID NO: 3139455 - RNA, 18 nt, Human
auauuuacuaaaauggac

SEQ ID NO: 3139456 - RNA, 20 nt, Human
auauuuacuaaaauggacug

SEQ ID NO: 3139457 - RNA, 22 nt, Human
auaugcuauuucuauauuuuca

SEQ ID NO: 3139458 - RNA, 23 nt, Human
auaugcuauuucuauauuuucau

SEQ ID NO: 3139459 - RNA, 15 nt, Human
auaugcuauuucuau

SEQ ID NO: 3139460 - RNA, 16 nt, Human
auaugcuauuucuaua

SEQ ID NO: 3139461 - RNA, 18 nt, Human
auaugcuauuucuauauu

SEQ ID NO: 3139462 - RNA, 19 nt, Human
auaugcuauuucuauauuu

SEQ ID NO: 3139463 - RNA, 21 nt, Human
auaugcuauuucuauauuuuc

SEQ ID NO: 3139464 - RNA, 12 nt, Human
cacaccuccucu

SEQ ID NO: 3139465 - RNA, 12 nt, Human
cacacuucccug

SEQ ID NO: 3139466 - RNA, 13 nt, Human
cacacuucccugg

SEQ ID NO: 3139467 - RNA, 14 nt, Human
cacacuucccuggc

SEQ ID NO: 3139468 - RNA, 15 nt, Human
cacacuucccuggcg

SEQ ID NO: 3139469 - RNA, 20 nt, Human
cacauugguguuguacucaa

SEQ ID NO: 3139470 - RNA, 18 nt, Human
caaaguugccuaaaucca

SEQ ID NO: 3139471 - RNA, 19 nt, Human
caaaguugccuaaauccau

SEQ ID NO: 3139472 - RNA, 15 nt, Human
cacccacccuuuuuu

SEQ ID NO: 3139473 - RNA, 14 nt, Human
cacccccgcuggag

SEQ ID NO: 3139474 - RNA, 16 nt, Human
cacccccgcuggagga

SEQ ID NO: 3139475 - RNA, 16 nt, Human
uugaaacggaugauuu

SEQ ID NO: 3139476 - RNA, 19 nt, Human
uugaaacggaugauuucua

SEQ ID NO: 3139477 - RNA, 17 nt, Human
uucuuuaauuuuggaau

SEQ ID NO: 3139478 - RNA, 18 nt, Human
uucuuuaauuuuggaauu

SEQ ID NO: 3139479 - RNA, 12 nt, Human
uucuuuaauuuu

SEQ ID NO: 3139480 - RNA, 14 nt, Human
uucuguauagauua

SEQ ID NO: 3139481 - RNA, 13 nt, Human
uucuguauagauu

SEQ ID NO: 3139482 - RNA, 11 nt, Human
uucuguauaga

SEQ ID NO: 3139483 - RNA, 18 nt, Human
uuggcauaacauaaaucu

SEQ ID NO: 3139484 - RNA, 19 nt, Human
uuggcauaacauaaaucug

SEQ ID NO: 3139485 - RNA, 20 nt, Human
uuggcauaacauaaaucugu

SEQ ID NO: 3139486 - RNA, 22 nt, Human
uuggcauaacauaaaucuguga

SEQ ID NO: 3139487 - RNA, 23 nt, Human
uuggcauaacauaaaucugugaa

SEQ ID NO: 3139488 - RNA, 12 nt, Human
uugccuuuuuca

SEQ ID NO: 3139489 - RNA, 13 nt, Human
uugccuuuuucau

SEQ ID NO: 3139490 - RNA, 14 nt, Human
uugccuuuuucauu

SEQ ID NO: 3139491 - RNA, 15 nt, Human
uugccuuuuucauua

SEQ ID NO: 3139492 - RNA, 16 nt, Human
uugccuuuuucauuau

SEQ ID NO: 3139493 - RNA, 17 nt, Human
uugccuuuuucauuauu

SEQ ID NO: 3139494 - RNA, 13 nt, Human
uuucugauccagu

SEQ ID NO: 3139495 - RNA, 15 nt, Human
uuucugauccaguuu

SEQ ID NO: 3139496 - RNA, 16 nt, Human
uuucugauccaguuuu

SEQ ID NO: 3139497 - RNA, 20 nt, Human
uuucugauccaguuuuguuu

SEQ ID NO: 3139498 - RNA, 22 nt, Human
uuucugauccaguuuuguuugg

SEQ ID NO: 3139499 - RNA, 14 nt, Human
uuucugaaauaaca
